United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 24

SEQ ID NO: 891794 - RNA, 17 nt, Mycobacterium avium subsp. paratuberculosis
gugggcgaacgaggccg

SEQ ID NO: 891795 - RNA, 13 nt, Mycobacterium avium subsp. paratuberculosis
gugggccagucga

SEQ ID NO: 891796 - RNA, 14 nt, Mycobacterium avium subsp. paratuberculosis
gugggccaucgcca

SEQ ID NO: 891797 - RNA, 15 nt, Mycobacterium avium subsp. paratuberculosis
gugggccaucgccag

SEQ ID NO: 891798 - RNA, 13 nt, Mycobacterium avium subsp. paratuberculosis
gugggcccgccgu

SEQ ID NO: 891799 - RNA, 14 nt, Mycobacterium avium subsp. paratuberculosis
gugggaccgucggc

SEQ ID NO: 891800 - RNA, 15 nt, Mycobacterium avium subsp. paratuberculosis
gugggagguacucga

SEQ ID NO: 891801 - RNA, 14 nt, Mycobacterium avium subsp. paratuberculosis
gugggccagcgcgg

SEQ ID NO: 891802 - RNA, 15 nt, Mycobacterium avium subsp. paratuberculosis
gugggccagcgcggu

SEQ ID NO: 891803 - RNA, 13 nt, Mycobacterium avium subsp. paratuberculosis
guggccaccacau

SEQ ID NO: 891804 - RNA, 21 nt, Mycobacterium avium subsp. paratuberculosis
guggcugcacgucacgggcca

SEQ ID NO: 891805 - RNA, 14 nt, Mycobacterium avium subsp. paratuberculosis
guggcuuccagccc

SEQ ID NO: 891806 - RNA, 14 nt, Mycobacterium avium subsp. paratuberculosis
guggcuugaucgca

SEQ ID NO: 891807 - RNA, 16 nt, Mycobacterium avium subsp. paratuberculosis
guggcuugaucgcacc

SEQ ID NO: 891808 - RNA, 17 nt, Mycobacterium avium subsp. paratuberculosis
guggcuugaucgcaccc

SEQ ID NO: 891809 - RNA, 23 nt, Mycobacterium avium subsp. paratuberculosis
guggcugucggggaccguccccg

SEQ ID NO: 891810 - RNA, 13 nt, Mycobacterium avium subsp. paratuberculosis
guggcugucgggu

SEQ ID NO: 891811 - RNA, 22 nt, Mycobacterium avium subsp. paratuberculosis
guggucggcgaacgcccggucg

SEQ ID NO: 891812 - RNA, 14 nt, Mycobacterium avium subsp. paratuberculosis
guggucucgaugca

SEQ ID NO: 891813 - RNA, 19 nt, Mycobacterium avium subsp. paratuberculosis
guggucucgcaccugccgu

SEQ ID NO: 891814 - RNA, 21 nt, Mycobacterium avium subsp. paratuberculosis
guggucugccagaacggcggc

SEQ ID NO: 891815 - RNA, 21 nt, Mycobacterium avium subsp. paratuberculosis
guggucggcagcaccggcagc

SEQ ID NO: 891816 - RNA, 16 nt, Mycobacterium avium subsp. paratuberculosis
guggucggccacgacg

SEQ ID NO: 891817 - RNA, 19 nt, Mycobacterium avium subsp. paratuberculosis
guggucggccacgacgcgg

SEQ ID NO: 891818 - RNA, 19 nt, Mycobacterium avium subsp. paratuberculosis
guggucgguagggucgggu

SEQ ID NO: 891819 - RNA, 20 nt, Mycobacterium avium subsp. paratuberculosis
guggucgguagggucgggug

SEQ ID NO: 891820 - RNA, 14 nt, Mycobacterium avium subsp. paratuberculosis
guggucgucgacga

SEQ ID NO: 891821 - RNA, 23 nt, Mycobacterium avium subsp. paratuberculosis
guggucgucgacgagcccgccgg

SEQ ID NO: 891822 - RNA, 22 nt, Mycobacterium avium subsp. paratuberculosis
guggucucccagacgucgaccu

SEQ ID NO: 891823 - RNA, 19 nt, Mycobacterium avium subsp. paratuberculosis
guggucuccuggccgccgu

SEQ ID NO: 891824 - RNA, 11 nt, Mycobacterium avium subsp. paratuberculosis
guggugucgac

SEQ ID NO: 891825 - RNA, 14 nt, Mycobacterium avium subsp. paratuberculosis
gugguggucgucga

SEQ ID NO: 891826 - RNA, 13 nt, Mycobacterium avium subsp. paratuberculosis
gugguggucucga

SEQ ID NO: 891827 - RNA, 13 nt, Mycobacterium avium subsp. paratuberculosis
gugguggugccca

SEQ ID NO: 891828 - RNA, 15 nt, Mycobacterium avium subsp. paratuberculosis
gugguggugcgggug

SEQ ID NO: 891829 - RNA, 14 nt, Mycobacterium avium subsp. paratuberculosis
gugguggcggcgaa

SEQ ID NO: 891830 - RNA, 19 nt, Mycobacterium avium subsp. paratuberculosis
guggugggcgaacagcagc

SEQ ID NO: 891831 - RNA, 20 nt, Mycobacterium avium subsp. paratuberculosis
guggugggcgugcaggccgc

SEQ ID NO: 891832 - RNA, 19 nt, Mycobacterium avium subsp. paratuberculosis
gugguggggccggcgaagg

SEQ ID NO: 891833 - RNA, 17 nt, Mycobacterium avium subsp. paratuberculosis
guguccacgaugcggug

SEQ ID NO: 891834 - RNA, 18 nt, Mycobacterium avium subsp. paratuberculosis
guguccacgucgcccagc

SEQ ID NO: 891835 - RNA, 14 nt, Mycobacterium avium subsp. paratuberculosis
guguccagccgcac

SEQ ID NO: 891836 - RNA, 22 nt, Mycobacterium avium subsp. paratuberculosis
guguccagcggguugucgucgu

SEQ ID NO: 891837 - RNA, 23 nt, Mycobacterium avium subsp. paratuberculosis
guguccagcggguugucgucguc

SEQ ID NO: 891838 - RNA, 20 nt, Mycobacterium avium subsp. paratuberculosis
guguccaggucguuggaguc

SEQ ID NO: 891839 - RNA, 16 nt, Mycobacterium avium subsp. paratuberculosis
gugguucuccgcgaca

SEQ ID NO: 891840 - RNA, 16 nt, Mycobacterium avium subsp. paratuberculosis
guggugugcaccagcg

SEQ ID NO: 891841 - RNA, 16 nt, Mycobacterium avium subsp. paratuberculosis
gugucaggucggcgau

SEQ ID NO: 891842 - RNA, 15 nt, Mycobacterium avium subsp. paratuberculosis
guguccuugcgcacc

SEQ ID NO: 891843 - RNA, 18 nt, Mycobacterium avium subsp. paratuberculosis
guguccgucgccggaggc

SEQ ID NO: 891844 - RNA, 13 nt, Mycobacterium avium subsp. paratuberculosis
guguccggcccga

SEQ ID NO: 891845 - RNA, 21 nt, Mycobacterium avium subsp. paratuberculosis
guguccggcccgaugcggacc

SEQ ID NO: 891846 - RNA, 16 nt, Mycobacterium avium subsp. paratuberculosis
guguccgggcgcccag

SEQ ID NO: 891847 - RNA, 13 nt, Mycobacterium avium subsp. paratuberculosis
guguccgacgccg

SEQ ID NO: 891848 - RNA, 14 nt, Mycobacterium avium subsp. paratuberculosis
gugucccggcgccc

SEQ ID NO: 891849 - RNA, 22 nt, Mycobacterium avium subsp. paratuberculosis
guguccagaacucggcggcggu

SEQ ID NO: 891850 - RNA, 13 nt, Mycobacterium avium subsp. paratuberculosis
gugucccagcgcc

SEQ ID NO: 891851 - RNA, 14 nt, Mycobacterium avium subsp. paratuberculosis
gugucccagcgcca

SEQ ID NO: 891852 - RNA, 16 nt, Mycobacterium avium subsp. paratuberculosis
gugucccagcgccacu

SEQ ID NO: 891853 - RNA, 19 nt, Mycobacterium avium subsp. paratuberculosis
gugucccaguucccggcgg

SEQ ID NO: 891854 - RNA, 20 nt, Mycobacterium avium subsp. paratuberculosis
gugucccaguucccggcggg

SEQ ID NO: 891855 - RNA, 15 nt, Mycobacterium avium subsp. paratuberculosis
gugugcgcaucggcg

SEQ ID NO: 891856 - RNA, 16 nt, Mycobacterium avium subsp. paratuberculosis
gugugcggcagcucgg

SEQ ID NO: 891857 - RNA, 15 nt, Mycobacterium avium subsp. paratuberculosis
gugugcucagcuccc

SEQ ID NO: 891858 - RNA, 18 nt, Mycobacterium avium subsp. paratuberculosis
gugucggugcccaggucg

SEQ ID NO: 891859 - RNA, 19 nt, Mycobacterium avium subsp. paratuberculosis
gugucggugccgagcacgc

SEQ ID NO: 891860 - RNA, 21 nt, Mycobacterium avium subsp. paratuberculosis
gugucguagacgacgucgacc

SEQ ID NO: 891861 - RNA, 21 nt, Mycobacterium avium subsp. paratuberculosis
gugucguaguugcgcgccgau

SEQ ID NO: 891862 - RNA, 18 nt, Mycobacterium avium subsp. paratuberculosis
gugucgucgucgccgccg

SEQ ID NO: 891863 - RNA, 13 nt, Mycobacterium avium subsp. paratuberculosis
gugucgucgucgg

SEQ ID NO: 891864 - RNA, 21 nt, Mycobacterium avium subsp. paratuberculosis
gugucguggcgugccgggcgg

SEQ ID NO: 891865 - RNA, 17 nt, Mycobacterium avium subsp. paratuberculosis
gugucgugugcgugacg

SEQ ID NO: 891866 - RNA, 22 nt, Mycobacterium avium subsp. paratuberculosis
guguggccgcccucgcugccgc

SEQ ID NO: 891867 - RNA, 13 nt, Mycobacterium avium subsp. paratuberculosis
guguggccgcggc

SEQ ID NO: 891868 - RNA, 14 nt, Mycobacterium avium subsp. paratuberculosis
guguggcgcugaug

SEQ ID NO: 891869 - RNA, 14 nt, Mycobacterium avium subsp. paratuberculosis
gugugggcgcccgc

SEQ ID NO: 891870 - RNA, 16 nt, Mycobacterium avium subsp. paratuberculosis
gugugguacagcgcca

SEQ ID NO: 891871 - RNA, 21 nt, Mycobacterium avium subsp. paratuberculosis
gugugguacagcgccagcggc

SEQ ID NO: 891872 - RNA, 22 nt, Mycobacterium avium subsp. paratuberculosis
gugucgcccagcugggccagcg

SEQ ID NO: 891873 - RNA, 20 nt, Mycobacterium avium subsp. paratuberculosis
gugucgcccguggcccacgg

SEQ ID NO: 891874 - RNA, 15 nt, Mycobacterium avium subsp. paratuberculosis
gugucgcccucgcgc

SEQ ID NO: 891875 - RNA, 13 nt, Mycobacterium avium subsp. paratuberculosis
gugucgcccucgg

SEQ ID NO: 891876 - RNA, 21 nt, Mycobacterium avium subsp. paratuberculosis
gugucgcacugcuucgggucg

SEQ ID NO: 891877 - RNA, 16 nt, Mycobacterium avium subsp. paratuberculosis
gugucgccgguggugc

SEQ ID NO: 891878 - RNA, 13 nt, Mycobacterium avium subsp. paratuberculosis
gugucgccggggc

SEQ ID NO: 891879 - RNA, 15 nt, Mycobacterium avium subsp. paratuberculosis
guguccgcgccggcg

SEQ ID NO: 891880 - RNA, 16 nt, Mycobacterium avium subsp. paratuberculosis
guguccgcgccggcgc

SEQ ID NO: 891881 - RNA, 13 nt, Mycobacterium avium subsp. paratuberculosis
gugucgaacagca

SEQ ID NO: 891882 - RNA, 17 nt, Mycobacterium avium subsp. paratuberculosis
gugucgaacagcaggcc

SEQ ID NO: 891883 - RNA, 15 nt, Mycobacterium avium subsp. paratuberculosis
gugucgaagaccggu

SEQ ID NO: 891884 - RNA, 18 nt, Mycobacterium avium subsp. paratuberculosis
gugucgaagacgguccgc

SEQ ID NO: 891885 - RNA, 22 nt, Mycobacterium avium subsp. paratuberculosis
gugucgaagcugcgcagccgug

SEQ ID NO: 891886 - RNA, 17 nt, Mycobacterium avium subsp. paratuberculosis
gugucgaaggccggggu

SEQ ID NO: 891887 - RNA, 18 nt, Mycobacterium avium subsp. paratuberculosis
gugucgaaguacgccguc

SEQ ID NO: 891888 - RNA, 13 nt, Mycobacterium avium subsp. paratuberculosis
gugucgaagucga

SEQ ID NO: 891889 - RNA, 16 nt, Mycobacterium avium subsp. paratuberculosis
gugucgacccaggucg

SEQ ID NO: 891890 - RNA, 12 nt, Mycobacterium avium subsp. paratuberculosis
gugucgacgccg

SEQ ID NO: 891891 - RNA, 21 nt, Mycobacterium avium subsp. paratuberculosis
gugucgacgcugagcacccgc

SEQ ID NO: 891892 - RNA, 21 nt, Mycobacterium avium subsp. paratuberculosis
gugucgagcacgucgacgccg

SEQ ID NO: 891893 - RNA, 23 nt, Mycobacterium avium subsp. paratuberculosis
gugucgagcacgucgacgccggu

SEQ ID NO: 891894 - RNA, 11 nt, Mycobacterium avium subsp. paratuberculosis
gugucgcggcc

SEQ ID NO: 891895 - RNA, 14 nt, Mycobacterium avium subsp. paratuberculosis
gugucggcggggcc

SEQ ID NO: 891896 - RNA, 14 nt, Mycobacterium avium subsp. paratuberculosis
gugucggggucggc

SEQ ID NO: 891897 - RNA, 21 nt, Mycobacterium avium subsp. paratuberculosis
gugucggggucggcgccgcgc

SEQ ID NO: 891898 - RNA, 23 nt, Mycobacterium avium subsp. paratuberculosis
gugucgggugguuuugcgucugc

SEQ ID NO: 891899 - RNA, 19 nt, Mycobacterium avium subsp. paratuberculosis
gugucgcuguaggccagcc

SEQ ID NO: 891900 - RNA, 20 nt, Mycobacterium avium subsp. paratuberculosis
gugucgcuguaggccagccc

SEQ ID NO: 891901 - RNA, 21 nt, Mycobacterium avium subsp. paratuberculosis
gugucgcuguaggccagcccg

SEQ ID NO: 891902 - RNA, 22 nt, Mycobacterium avium subsp. paratuberculosis
gugucgcuguaggccagcccgg

SEQ ID NO: 891903 - RNA, 18 nt, Mycobacterium avium subsp. paratuberculosis
gugucggaaucggcgccg

SEQ ID NO: 891904 - RNA, 11 nt, Mycobacterium avium subsp. paratuberculosis
gugucggcgaa

SEQ ID NO: 891905 - RNA, 11 nt, Mycobacterium avium subsp. paratuberculosis
gugucggcgac

SEQ ID NO: 891906 - RNA, 21 nt, Mycobacterium avium subsp. paratuberculosis
ugcguggucuaccugcugcuc

SEQ ID NO: 891907 - RNA, 20 nt, Mycobacterium avium subsp. paratuberculosis
ugcguucccagcccggccag

SEQ ID NO: 891908 - RNA, 21 nt, Mycobacterium avium subsp. paratuberculosis
ugcguucccagcccggccagu

SEQ ID NO: 891909 - RNA, 15 nt, Mycobacterium avium subsp. paratuberculosis
ugcguuccucgacgg

SEQ ID NO: 891910 - RNA, 23 nt, Mycobacterium avium subsp. paratuberculosis
ugcuagcgagcgggcacgccgcc

SEQ ID NO: 891911 - RNA, 18 nt, Mycobacterium avium subsp. paratuberculosis
ugcgucacgcuggugacg

SEQ ID NO: 891912 - RNA, 22 nt, Mycobacterium avium subsp. paratuberculosis
ugcgucagaaccggggccagca

SEQ ID NO: 891913 - RNA, 16 nt, Mycobacterium avium subsp. paratuberculosis
ugcgucccgcgccgga

SEQ ID NO: 891914 - RNA, 19 nt, Mycobacterium avium subsp. paratuberculosis
ugcgucccguuggcgccgg

SEQ ID NO: 891915 - RNA, 17 nt, Mycobacterium avium subsp. paratuberculosis
ugcguccagaccggccg

SEQ ID NO: 891916 - RNA, 21 nt, Mycobacterium avium subsp. paratuberculosis
ugcgugcagacaaccggugug

SEQ ID NO: 891917 - RNA, 21 nt, Mycobacterium avium subsp. paratuberculosis
ugcgugcgcucgaccucggcg

SEQ ID NO: 891918 - RNA, 13 nt, Mycobacterium avium subsp. paratuberculosis
ugcggcgcucggu

SEQ ID NO: 891919 - RNA, 20 nt, Mycobacterium avium subsp. paratuberculosis
ugcggcgccgcccggcgaua

SEQ ID NO: 891920 - RNA, 13 nt, Mycobacterium avium subsp. paratuberculosis
ugcggcgcggcca

SEQ ID NO: 891921 - RNA, 18 nt, Mycobacterium avium subsp. paratuberculosis
ugcggcgcagcgucucga

SEQ ID NO: 891922 - RNA, 16 nt, Mycobacterium avium subsp. paratuberculosis
ugcggcgcggcggugg

SEQ ID NO: 891923 - RNA, 13 nt, Mycobacterium avium subsp. paratuberculosis
ugcggcgcggugc

SEQ ID NO: 891924 - RNA, 14 nt, Mycobacterium avium subsp. paratuberculosis
ugcggcgcggugcg

SEQ ID NO: 891925 - RNA, 18 nt, Mycobacterium avium subsp. paratuberculosis
ugcggcgcggugcgccga

SEQ ID NO: 891926 - RNA, 19 nt, Mycobacterium avium subsp. paratuberculosis
ugcggcgcggugcgccgac

SEQ ID NO: 891927 - RNA, 15 nt, Mycobacterium avium subsp. paratuberculosis
ugcggcgacgaucgg

SEQ ID NO: 891928 - RNA, 15 nt, Mycobacterium avium subsp. paratuberculosis
ugcggcgcagccagc

SEQ ID NO: 891929 - RNA, 22 nt, Mycobacterium avium subsp. paratuberculosis
ugcggcgagucccggcgcacca

SEQ ID NO: 891930 - RNA, 17 nt, Mycobacterium avium subsp. paratuberculosis
ugcggcgaacgcguccc

SEQ ID NO: 891931 - RNA, 14 nt, Mycobacterium avium subsp. paratuberculosis
ugcggccucgacga

SEQ ID NO: 891932 - RNA, 14 nt, Mycobacterium avium subsp. paratuberculosis
ugcggccucggcac

SEQ ID NO: 891933 - RNA, 19 nt, Mycobacterium avium subsp. paratuberculosis
ugcugaacgccugccggcg

SEQ ID NO: 891934 - RNA, 12 nt, Mycobacterium avium subsp. paratuberculosis
ugcucugcgcgc

SEQ ID NO: 891935 - RNA, 17 nt, Mycobacterium avium subsp. paratuberculosis
ugcucugcgcgcggugc

SEQ ID NO: 891936 - RNA, 16 nt, Mycobacterium avium subsp. paratuberculosis
ugcucgugcaaaccgg

SEQ ID NO: 891937 - RNA, 18 nt, Mycobacterium avium subsp. paratuberculosis
ugcucgucgagcauccgg

SEQ ID NO: 891938 - RNA, 14 nt, Mycobacterium avium subsp. paratuberculosis
ugcucgucgcgggc

SEQ ID NO: 891939 - RNA, 21 nt, Mycobacterium avium subsp. paratuberculosis
ugcucggugauccacgcggug

SEQ ID NO: 891940 - RNA, 16 nt, Mycobacterium avium subsp. paratuberculosis
ugcucggugaugccga

SEQ ID NO: 891941 - RNA, 15 nt, Mycobacterium avium subsp. paratuberculosis
ugcucgucggugacg

SEQ ID NO: 891942 - RNA, 13 nt, Mycobacterium avium subsp. paratuberculosis
ugcucgggugacg

SEQ ID NO: 891943 - RNA, 13 nt, Mycobacterium avium subsp. paratuberculosis
ugcucaccgagcu

SEQ ID NO: 891944 - RNA, 22 nt, Mycobacterium avium subsp. paratuberculosis
ugcucaccgagcugggccggcg

SEQ ID NO: 891945 - RNA, 15 nt, Mycobacterium avium subsp. paratuberculosis
ugcucggcggcccgc

SEQ ID NO: 891946 - RNA, 13 nt, Mycobacterium avium subsp. paratuberculosis
ugcucggcggccg

SEQ ID NO: 891947 - RNA, 14 nt, Mycobacterium avium subsp. paratuberculosis
ugcucggcggcgca

SEQ ID NO: 891948 - RNA, 23 nt, Mycobacterium avium subsp. paratuberculosis
ugcucggggcaguagugguccac

SEQ ID NO: 891949 - RNA, 18 nt, Mycobacterium avium subsp. paratuberculosis
ugcucggggcucgcggug

SEQ ID NO: 891950 - RNA, 18 nt, Mycobacterium avium subsp. paratuberculosis
ugcucggcgagcaccgug

SEQ ID NO: 891951 - RNA, 13 nt, Mycobacterium avium subsp. paratuberculosis
ugcucagccgcac

SEQ ID NO: 891952 - RNA, 15 nt, Mycobacterium avium subsp. paratuberculosis
ugcucggccagcggg

SEQ ID NO: 891953 - RNA, 20 nt, Mycobacterium avium subsp. paratuberculosis
ugcucggccaccgcgcggug

SEQ ID NO: 891954 - RNA, 14 nt, Mycobacterium avium subsp. paratuberculosis
ugcucggccacgac

SEQ ID NO: 891955 - RNA, 19 nt, Mycobacterium avium subsp. paratuberculosis
ugcugcagcgcccgggcca

SEQ ID NO: 891956 - RNA, 13 nt, Mycobacterium avium subsp. paratuberculosis
ugcugcagcgcga

SEQ ID NO: 891957 - RNA, 20 nt, Mycobacterium avium subsp. paratuberculosis
ugcugacccggucgcggccg

SEQ ID NO: 891958 - RNA, 16 nt, Mycobacterium avium subsp. paratuberculosis
ugcugcccgcgacggc

SEQ ID NO: 891959 - RNA, 20 nt, Mycobacterium avium subsp. paratuberculosis
ugcugccggaacgagccgga

SEQ ID NO: 891960 - RNA, 14 nt, Mycobacterium avium subsp. paratuberculosis
ugcugccggccggc

SEQ ID NO: 891961 - RNA, 13 nt, Mycobacterium avium subsp. paratuberculosis
ugcugccgccggc

SEQ ID NO: 891962 - RNA, 13 nt, Mycobacterium avium subsp. paratuberculosis
ugcugccgugccg

SEQ ID NO: 891963 - RNA, 22 nt, Mycobacterium avium subsp. paratuberculosis
ugcuggcccgguuccagcggca

SEQ ID NO: 891964 - RNA, 18 nt, Mycobacterium avium subsp. paratuberculosis
ugcuggccaucgccgagc

SEQ ID NO: 891965 - RNA, 23 nt, Mycobacterium avium subsp. paratuberculosis
ugcuggcggccuucuuggccgga

SEQ ID NO: 891966 - RNA, 18 nt, Mycobacterium avium subsp. paratuberculosis
ugcuggcguucgccgagg

SEQ ID NO: 891967 - RNA, 22 nt, Mycobacterium avium subsp. paratuberculosis
ugcuggucaugccgucgacgac

SEQ ID NO: 891968 - RNA, 19 nt, Mycobacterium avium subsp. paratuberculosis
ugcugggacgggucggcgg

SEQ ID NO: 891969 - RNA, 23 nt, Mycobacterium avium subsp. paratuberculosis
ugcugggccacgauccgcgcggc

SEQ ID NO: 891970 - RNA, 16 nt, Mycobacterium avium subsp. paratuberculosis
uggacguccagcggcc

SEQ ID NO: 891971 - RNA, 15 nt, Mycobacterium avium subsp. paratuberculosis
uggacuccaccgcca

SEQ ID NO: 891972 - RNA, 16 nt, Mycobacterium avium subsp. paratuberculosis
uggacuccaccgccac

SEQ ID NO: 891973 - RNA, 21 nt, Mycobacterium avium subsp. paratuberculosis
uggacgucguuuuccagccgg

SEQ ID NO: 891974 - RNA, 22 nt, Mycobacterium avium subsp. paratuberculosis
uggacgucguuuuccagccggc

SEQ ID NO: 891975 - RNA, 19 nt, Mycobacterium avium subsp. paratuberculosis
uggacgccgcacgcgaccg

SEQ ID NO: 891976 - RNA, 21 nt, Mycobacterium avium subsp. paratuberculosis
uggacggggcgaugccgacac

SEQ ID NO: 891977 - RNA, 18 nt, Mycobacterium avium subsp. paratuberculosis
uggacggucagcgcgccg

SEQ ID NO: 891978 - RNA, 21 nt, Mycobacterium avium subsp. paratuberculosis
uggacggcccgacgacgccgu

SEQ ID NO: 891979 - RNA, 23 nt, Mycobacterium avium subsp. paratuberculosis
uggagaucaccgcguagcgccgc

SEQ ID NO: 891980 - RNA, 22 nt, Mycobacterium avium subsp. paratuberculosis
uggagaagaucuucucgguguc

SEQ ID NO: 891981 - RNA, 21 nt, Mycobacterium avium subsp. paratuberculosis
uggagaccucuucgacccgca

SEQ ID NO: 891982 - RNA, 23 nt, Mycobacterium avium subsp. paratuberculosis
uggagcggcccagcucggugauc

SEQ ID NO: 891983 - RNA, 16 nt, Mycobacterium avium subsp. paratuberculosis
uggaggugaucgccag

SEQ ID NO: 891984 - RNA, 17 nt, Mycobacterium avium subsp. paratuberculosis
uggaggugccgcgcagc

SEQ ID NO: 891985 - RNA, 16 nt, Mycobacterium avium subsp. paratuberculosis
uggagucguccgaacc

SEQ ID NO: 891986 - RNA, 12 nt, Mycobacterium avium subsp. paratuberculosis
uggagccgagca

SEQ ID NO: 891987 - RNA, 21 nt, Mycobacterium avium subsp. paratuberculosis
uggagccgagcaccgggcugu

SEQ ID NO: 891988 - RNA, 16 nt, Mycobacterium avium subsp. paratuberculosis
uggaggccaacgagcg

SEQ ID NO: 891989 - RNA, 14 nt, Mycobacterium avium subsp. paratuberculosis
uggagccguccggg

SEQ ID NO: 891990 - RNA, 12 nt, Mycobacterium avium subsp. paratuberculosis
ugcugucgucgc

SEQ ID NO: 891991 - RNA, 22 nt, Mycobacterium avium subsp. paratuberculosis
uggaacgcaagaagucgguguu

SEQ ID NO: 891992 - RNA, 18 nt, Mycobacterium avium subsp. paratuberculosis
uggaagucgccguccggg

SEQ ID NO: 891993 - RNA, 18 nt, Mycobacterium avium subsp. paratuberculosis
uggaagcgcaucgccggc

SEQ ID NO: 891994 - RNA, 17 nt, Mycobacterium avium subsp. paratuberculosis
uggaagcgcccgcgcgc

SEQ ID NO: 891995 - RNA, 18 nt, Mycobacterium avium subsp. paratuberculosis
uggaagcggugauggcga

SEQ ID NO: 891996 - RNA, 18 nt, Mycobacterium avium subsp. paratuberculosis
uggaccagggcgguggcg

SEQ ID NO: 891997 - RNA, 21 nt, Mycobacterium avium subsp. paratuberculosis
uggaccagggcgguggcggcg

SEQ ID NO: 891998 - RNA, 18 nt, Mycobacterium avium subsp. paratuberculosis
uggacccgaagucgacgc

SEQ ID NO: 891999 - RNA, 21 nt, Mycobacterium avium subsp. paratuberculosis
uggacgccagcaugaucaccg

SEQ ID NO: 892000 - RNA, 21 nt, Mycobacterium avium subsp. paratuberculosis
uggacgaugcggggccggcgg

SEQ ID NO: 892001 - RNA, 22 nt, Mycobacterium avium subsp. paratuberculosis
uggacgaugcggggccggcggc

SEQ ID NO: 892002 - RNA, 17 nt, Mycobacterium avium subsp. paratuberculosis
uggacgcggucgccgcc

SEQ ID NO: 892003 - RNA, 16 nt, Mycobacterium avium subsp. paratuberculosis
uggacgcccgcgaccc

SEQ ID NO: 892004 - RNA, 14 nt, Mycobacterium avium subsp. paratuberculosis
uggacgaacgcggc

SEQ ID NO: 892005 - RNA, 20 nt, Mycobacterium avium subsp. paratuberculosis
uggacgaaacccggcggacg

SEQ ID NO: 892006 - RNA, 20 nt, Mycobacterium avium subsp. paratuberculosis
uggacgaaagccuccaaccc

SEQ ID NO: 892007 - RNA, 21 nt, Mycobacterium avium subsp. paratuberculosis
uggacgaguggucggccgccc

SEQ ID NO: 892008 - RNA, 23 nt, Mycobacterium avium subsp. paratuberculosis
uggauauccagccuugcagccgc

SEQ ID NO: 892009 - RNA, 12 nt, Mycobacterium avium subsp. paratuberculosis
uggaucaucccg

SEQ ID NO: 892010 - RNA, 14 nt, Mycobacterium avium subsp. paratuberculosis
uggaucaucccgac

SEQ ID NO: 892011 - RNA, 14 nt, Mycobacterium avium subsp. paratuberculosis
uggaucgccgcaac

SEQ ID NO: 892012 - RNA, 18 nt, Mycobacterium avium subsp. paratuberculosis
uggaucccgaacugccgc

SEQ ID NO: 892013 - RNA, 15 nt, Mycobacterium avium subsp. paratuberculosis
uggauccgaucagca

SEQ ID NO: 892014 - RNA, 15 nt, Mycobacterium avium subsp. paratuberculosis
uggaucggcccgacg

SEQ ID NO: 892015 - RNA, 17 nt, Mycobacterium avium subsp. paratuberculosis
uggauucgucgcuggcc

SEQ ID NO: 892016 - RNA, 23 nt, Mycobacterium avium subsp. paratuberculosis
uggauggucaccggggugccgcc

SEQ ID NO: 892017 - RNA, 21 nt, Mycobacterium avium subsp. paratuberculosis
uggaugccgcccuugcucgcg

SEQ ID NO: 892018 - RNA, 15 nt, Mycobacterium avium subsp. paratuberculosis
uggauggcgcccagc

SEQ ID NO: 892019 - RNA, 16 nt, Mycobacterium avium subsp. paratuberculosis
uggauggcgcccagcc

SEQ ID NO: 892020 - RNA, 20 nt, Mycobacterium avium subsp. paratuberculosis
uggauggcgcccagcccgag

SEQ ID NO: 892021 - RNA, 21 nt, Mycobacterium avium subsp. paratuberculosis
uggcaggcgauggugccggcc

SEQ ID NO: 892022 - RNA, 15 nt, Mycobacterium avium subsp. paratuberculosis
uggcaccccgcgccg

SEQ ID NO: 892023 - RNA, 20 nt, Mycobacterium avium subsp. paratuberculosis
uggcaccccgcgccgggcgu

SEQ ID NO: 892024 - RNA, 23 nt, Mycobacterium avium subsp. paratuberculosis
uggcacccgggcgcgacggucac

SEQ ID NO: 892025 - RNA, 19 nt, Mycobacterium avium subsp. paratuberculosis
uggcaccgggugggccgac

SEQ ID NO: 892026 - RNA, 21 nt, Mycobacterium avium subsp. paratuberculosis
uggcaccgggugggccgaccu

SEQ ID NO: 892027 - RNA, 21 nt, Mycobacterium avium subsp. paratuberculosis
ugcgaucauuccgccgaaacc

SEQ ID NO: 892028 - RNA, 13 nt, Mycobacterium avium subsp. paratuberculosis
ugcgaucgccgcg

SEQ ID NO: 892029 - RNA, 14 nt, Mycobacterium avium subsp. paratuberculosis
ugcgaucgccgcgc

SEQ ID NO: 892030 - RNA, 23 nt, Mycobacterium avium subsp. paratuberculosis
ugcgaucgaugaauccgcgcagc

SEQ ID NO: 892031 - RNA, 22 nt, Mycobacterium avium subsp. paratuberculosis
ugcgcagguugucggccaacag

SEQ ID NO: 892032 - RNA, 16 nt, Mycobacterium avium subsp. paratuberculosis
ugcgcagucgcugguc

SEQ ID NO: 892033 - RNA, 20 nt, Mycobacterium avium subsp. paratuberculosis
ugcgcagcgcccaggcgugc

SEQ ID NO: 892034 - RNA, 14 nt, Mycobacterium avium subsp. paratuberculosis
ugcgcagcgcgucg

SEQ ID NO: 892035 - RNA, 20 nt, Mycobacterium avium subsp. paratuberculosis
ugcgcagccgucgcaucagc

SEQ ID NO: 892036 - RNA, 14 nt, Mycobacterium avium subsp. paratuberculosis
ugcgcagccgggcg

SEQ ID NO: 892037 - RNA, 14 nt, Mycobacterium avium subsp. paratuberculosis
ugcgcagcagcggc

SEQ ID NO: 892038 - RNA, 13 nt, Mycobacterium avium subsp. paratuberculosis
ugcgcagcaccgu

SEQ ID NO: 892039 - RNA, 17 nt, Mycobacterium avium subsp. paratuberculosis
ugcgcagccgcugcagc

SEQ ID NO: 892040 - RNA, 21 nt, Mycobacterium avium subsp. paratuberculosis
ugcgcagccgcugcagcgccg

SEQ ID NO: 892041 - RNA, 15 nt, Mycobacterium avium subsp. paratuberculosis
ugcgcagccggcagc

SEQ ID NO: 892042 - RNA, 12 nt, Mycobacterium avium subsp. paratuberculosis
ugccugcgggcc

SEQ ID NO: 892043 - RNA, 16 nt, Mycobacterium avium subsp. paratuberculosis
ugccugguucgacgug

SEQ ID NO: 892044 - RNA, 20 nt, Mycobacterium avium subsp. paratuberculosis
ugcgacagaaaucgcgcaga

SEQ ID NO: 892045 - RNA, 21 nt, Mycobacterium avium subsp. paratuberculosis
ugcgacagcacgggcgggcag

SEQ ID NO: 892046 - RNA, 16 nt, Mycobacterium avium subsp. paratuberculosis
ugcgaaucgucggcga

SEQ ID NO: 892047 - RNA, 17 nt, Mycobacterium avium subsp. paratuberculosis
ugcgaccgccgccgcga

SEQ ID NO: 892048 - RNA, 20 nt, Mycobacterium avium subsp. paratuberculosis
ugcgaccgccgccgcgacca

SEQ ID NO: 892049 - RNA, 21 nt, Mycobacterium avium subsp. paratuberculosis
ugcgaccccgccgucgacgcg

SEQ ID NO: 892050 - RNA, 15 nt, Mycobacterium avium subsp. paratuberculosis
ugccguggucggcga

SEQ ID NO: 892051 - RNA, 17 nt, Mycobacterium avium subsp. paratuberculosis
ugccguucagcgcggcc

SEQ ID NO: 892052 - RNA, 18 nt, Mycobacterium avium subsp. paratuberculosis
ugccguucagcgcggcca

SEQ ID NO: 892053 - RNA, 21 nt, Mycobacterium avium subsp. paratuberculosis
ugccguucagcgcggccaccu

SEQ ID NO: 892054 - RNA, 14 nt, Mycobacterium avium subsp. paratuberculosis
ugccgugcgcgcug

SEQ ID NO: 892055 - RNA, 20 nt, Mycobacterium avium subsp. paratuberculosis
ugccgugcgcgcuggugcug

SEQ ID NO: 892056 - RNA, 15 nt, Mycobacterium avium subsp. paratuberculosis
ugccguugggcacgg

SEQ ID NO: 892057 - RNA, 21 nt, Mycobacterium avium subsp. paratuberculosis
ugccguuggucuguggucggu

SEQ ID NO: 892058 - RNA, 16 nt, Mycobacterium avium subsp. paratuberculosis
ugccguugagcgugga

SEQ ID NO: 892059 - RNA, 22 nt, Mycobacterium avium subsp. paratuberculosis
ugccguugagcguggacaccgc

SEQ ID NO: 892060 - RNA, 17 nt, Mycobacterium avium subsp. paratuberculosis
ugccguugaucaccgug

SEQ ID NO: 892061 - RNA, 23 nt, Mycobacterium avium subsp. paratuberculosis
ugccguugaugaagaccuggccg

SEQ ID NO: 892062 - RNA, 16 nt, Mycobacterium avium subsp. paratuberculosis
ugccguugccaggccg

SEQ ID NO: 892063 - RNA, 22 nt, Mycobacterium avium subsp. paratuberculosis
ugccguugccaggccgcgagca

SEQ ID NO: 892064 - RNA, 18 nt, Mycobacterium avium subsp. paratuberculosis
ugccguugcgccagcggg

SEQ ID NO: 892065 - RNA, 17 nt, Mycobacterium avium subsp. paratuberculosis
ugccuccacgucaccga

SEQ ID NO: 892066 - RNA, 19 nt, Mycobacterium avium subsp. paratuberculosis
ugccuccacgucaccgacg

SEQ ID NO: 892067 - RNA, 20 nt, Mycobacterium avium subsp. paratuberculosis
ugccuacaggugccggcggc

SEQ ID NO: 892068 - RNA, 21 nt, Mycobacterium avium subsp. paratuberculosis
ugccucgccacugggcgucgg

SEQ ID NO: 892069 - RNA, 18 nt, Mycobacterium avium subsp. paratuberculosis
ugccucuucggcgcgccg

SEQ ID NO: 892070 - RNA, 19 nt, Mycobacterium avium subsp. paratuberculosis
ugccucuucgucggccggc

SEQ ID NO: 892071 - RNA, 14 nt, Mycobacterium avium subsp. paratuberculosis
ugccucggccagca

SEQ ID NO: 892072 - RNA, 13 nt, Mycobacterium avium subsp. paratuberculosis
ugccgcgcggcga

SEQ ID NO: 892073 - RNA, 20 nt, Mycobacterium avium subsp. paratuberculosis
ugccgcgcggacgcggcgga

SEQ ID NO: 892074 - RNA, 17 nt, Mycobacterium avium subsp. paratuberculosis
ugccgcgccccgagcag

SEQ ID NO: 892075 - RNA, 19 nt, Mycobacterium avium subsp. paratuberculosis
ugccgcgccccgagcagcg

SEQ ID NO: 892076 - RNA, 12 nt, Mycobacterium avium subsp. paratuberculosis
ugccgcgccggg

SEQ ID NO: 892077 - RNA, 19 nt, Mycobacterium avium subsp. paratuberculosis
ugccgcggugcggcccgcg

SEQ ID NO: 892078 - RNA, 22 nt, Mycobacterium avium subsp. paratuberculosis
ugccgcggugcggcccgcggca

SEQ ID NO: 892079 - RNA, 20 nt, Mycobacterium avium subsp. paratuberculosis
ugccgcgggccagcagccgg

SEQ ID NO: 892080 - RNA, 23 nt, Mycobacterium avium subsp. paratuberculosis
ugccgcggcgcaccccgaaccag

SEQ ID NO: 892081 - RNA, 13 nt, Mycobacterium avium subsp. paratuberculosis
ugccgcggcggcg

SEQ ID NO: 892082 - RNA, 17 nt, Mycobacterium avium subsp. paratuberculosis
ugccgcggcggcgccga

SEQ ID NO: 892083 - RNA, 18 nt, Mycobacterium avium subsp. paratuberculosis
ugccgcggcggcgccgac

SEQ ID NO: 892084 - RNA, 13 nt, Mycobacterium avium subsp. paratuberculosis
ugccgcggcgucc

SEQ ID NO: 892085 - RNA, 23 nt, Mycobacterium avium subsp. paratuberculosis
ugccgcggccgcguugucgacca

SEQ ID NO: 892086 - RNA, 18 nt, Mycobacterium avium subsp. paratuberculosis
ugccgcgcugcgccgggu

SEQ ID NO: 892087 - RNA, 20 nt, Mycobacterium avium subsp. paratuberculosis
ugccguaaguggcgccgcgg

SEQ ID NO: 892088 - RNA, 21 nt, Mycobacterium avium subsp. paratuberculosis
ugccguaaguggcgccgcggu

SEQ ID NO: 892089 - RNA, 22 nt, Mycobacterium avium subsp. paratuberculosis
ugccguaaguggcgccgcgguc

SEQ ID NO: 892090 - RNA, 19 nt, Mycobacterium avium subsp. paratuberculosis
ugccguagaucucgcgccg

SEQ ID NO: 892091 - RNA, 21 nt, Mycobacterium avium subsp. paratuberculosis
ugccguccagcuccgccgaca

SEQ ID NO: 892092 - RNA, 23 nt, Mycobacterium avium subsp. paratuberculosis
ugccgucacccagaucgcccggg

SEQ ID NO: 892093 - RNA, 14 nt, Mycobacterium avium subsp. paratuberculosis
ugccgucacgcccg

SEQ ID NO: 892094 - RNA, 20 nt, Mycobacterium avium subsp. paratuberculosis
ugccgucacgcccguugacg

SEQ ID NO: 892095 - RNA, 19 nt, Mycobacterium avium subsp. paratuberculosis
ugccgucacugucggcgcg

SEQ ID NO: 892096 - RNA, 20 nt, Mycobacterium avium subsp. paratuberculosis
ugccgucacugucggcgcgg

SEQ ID NO: 892097 - RNA, 17 nt, Mycobacterium avium subsp. paratuberculosis
ugccgugcucggcggcg

SEQ ID NO: 892098 - RNA, 14 nt, Mycobacterium avium subsp. paratuberculosis
ugccgugcugggac

SEQ ID NO: 892099 - RNA, 14 nt, Mycobacterium avium subsp. paratuberculosis
ugccgugcugggcg

SEQ ID NO: 892100 - RNA, 15 nt, Mycobacterium avium subsp. paratuberculosis
ugccguccacccggc

SEQ ID NO: 892101 - RNA, 15 nt, Mycobacterium avium subsp. paratuberculosis
ugccguggcggcggu

SEQ ID NO: 892102 - RNA, 12 nt, Mycobacterium avium subsp. paratuberculosis
ugcggcccagcg

SEQ ID NO: 892103 - RNA, 14 nt, Mycobacterium avium subsp. paratuberculosis
ugcggcccagcccg

SEQ ID NO: 892104 - RNA, 21 nt, Mycobacterium avium subsp. paratuberculosis
ugcggcccagcccggccagca

SEQ ID NO: 892105 - RNA, 16 nt, Mycobacterium avium subsp. paratuberculosis
ugcggccauguccccg

SEQ ID NO: 892106 - RNA, 24 nt, Mycobacterium avium subsp. paratuberculosis
ugcggcccaaccggaucggcuagc

SEQ ID NO: 892107 - RNA, 16 nt, Mycobacterium avium subsp. paratuberculosis
ugcggagaucgugcug

SEQ ID NO: 892108 - RNA, 21 nt, Mycobacterium avium subsp. paratuberculosis
ugcggcagcucggcggcccgc

SEQ ID NO: 892109 - RNA, 18 nt, Mycobacterium avium subsp. paratuberculosis
ugcgcugcuuagccccuc

SEQ ID NO: 892110 - RNA, 14 nt, Mycobacterium avium subsp. paratuberculosis
ugcgcuguggugac

SEQ ID NO: 892111 - RNA, 20 nt, Mycobacterium avium subsp. paratuberculosis
ugcggaacccacgugcggcg

SEQ ID NO: 892112 - RNA, 13 nt, Mycobacterium avium subsp. paratuberculosis
ugcggaacaccgc

SEQ ID NO: 892113 - RNA, 16 nt, Mycobacterium avium subsp. paratuberculosis
ugcggacggucgccga

SEQ ID NO: 892114 - RNA, 23 nt, Mycobacterium avium subsp. paratuberculosis
ugcggacaccagucgcacaaccg

SEQ ID NO: 892115 - RNA, 16 nt, Mycobacterium avium subsp. paratuberculosis
ugcgcuccucgacgua

SEQ ID NO: 892116 - RNA, 12 nt, Mycobacterium avium subsp. paratuberculosis
ugcgcucgacgg

SEQ ID NO: 892117 - RNA, 13 nt, Mycobacterium avium subsp. paratuberculosis
ugcgcucgacggc

SEQ ID NO: 892118 - RNA, 22 nt, Mycobacterium avium subsp. paratuberculosis
ugcgcucacccaaaaaggcgcg

SEQ ID NO: 892119 - RNA, 13 nt, Mycobacterium avium subsp. paratuberculosis
ugcgcgucgucgc

SEQ ID NO: 892120 - RNA, 22 nt, Mycobacterium avium subsp. paratuberculosis
ugcgcguuuugaaauccgggcg

SEQ ID NO: 892121 - RNA, 13 nt, Mycobacterium avium subsp. paratuberculosis
ugcgcuaccaggc

SEQ ID NO: 892122 - RNA, 14 nt, Mycobacterium avium subsp. paratuberculosis
ugcgcugcaccgca

SEQ ID NO: 892123 - RNA, 16 nt, Mycobacterium avium subsp. paratuberculosis
ugcgcugcagcgagac

SEQ ID NO: 892124 - RNA, 19 nt, Mycobacterium avium subsp. paratuberculosis
ugcgcugcagcgagaccuc

SEQ ID NO: 892125 - RNA, 20 nt, Mycobacterium avium subsp. paratuberculosis
ugcgcugcagcgagaccucc

SEQ ID NO: 892126 - RNA, 13 nt, Mycobacterium avium subsp. paratuberculosis
ugcgcugcccgau

SEQ ID NO: 892127 - RNA, 14 nt, Mycobacterium avium subsp. paratuberculosis
ugcgcucggccggg

SEQ ID NO: 892128 - RNA, 23 nt, Mycobacterium avium subsp. paratuberculosis
ugcgcgucagccgucgucguccg

SEQ ID NO: 892129 - RNA, 17 nt, Mycobacterium avium subsp. paratuberculosis
ugcgcgucauggccguc

SEQ ID NO: 892130 - RNA, 14 nt, Mycobacterium avium subsp. paratuberculosis
ugcgcgucgcggcg

SEQ ID NO: 892131 - RNA, 17 nt, Mycobacterium avium subsp. paratuberculosis
ugcgcgucgcggcgcgg

SEQ ID NO: 892132 - RNA, 18 nt, Mycobacterium avium subsp. paratuberculosis
ugcgcgucggagaucacc

SEQ ID NO: 892133 - RNA, 20 nt, Mycobacterium avium subsp. paratuberculosis
ugcgcgucggagaucaccgg

SEQ ID NO: 892134 - RNA, 22 nt, Mycobacterium avium subsp. paratuberculosis
ugcgcgucggagaucaccggca

SEQ ID NO: 892135 - RNA, 19 nt, Mycobacterium avium subsp. paratuberculosis
ugcgcgggucgccgggcag

SEQ ID NO: 892136 - RNA, 15 nt, Mycobacterium avium subsp. paratuberculosis
ugcgcgggcgcggcc

SEQ ID NO: 892137 - RNA, 22 nt, Mycobacterium avium subsp. paratuberculosis
ugcgcgggcgcggccagcgcga

SEQ ID NO: 892138 - RNA, 20 nt, Mycobacterium avium subsp. paratuberculosis
ugcgcgggcgcggacagcug

SEQ ID NO: 892139 - RNA, 15 nt, Mycobacterium avium subsp. paratuberculosis
ugcgcgggcgcccgu

SEQ ID NO: 892140 - RNA, 13 nt, Mycobacterium avium subsp. paratuberculosis
ugcgcggcgccgu

SEQ ID NO: 892141 - RNA, 22 nt, Mycobacterium avium subsp. paratuberculosis
ugcgcggcgccguuucggacga

SEQ ID NO: 892142 - RNA, 11 nt, Mycobacterium avium subsp. paratuberculosis
ugcgcggcgcg

SEQ ID NO: 892143 - RNA, 19 nt, Mycobacterium avium subsp. paratuberculosis
ugcgcggcgcgaagcccuc

SEQ ID NO: 892144 - RNA, 17 nt, Mycobacterium avium subsp. paratuberculosis
ugcgcggcguccaccag

SEQ ID NO: 892145 - RNA, 22 nt, Mycobacterium avium subsp. paratuberculosis
ugcgcggcguccaccagcacgc

SEQ ID NO: 892146 - RNA, 17 nt, Mycobacterium avium subsp. paratuberculosis
ugcgcggcacgggccgu

SEQ ID NO: 892147 - RNA, 18 nt, Mycobacterium avium subsp. paratuberculosis
ugcgcggaaugcucgaca

SEQ ID NO: 892148 - RNA, 19 nt, Mycobacterium avium subsp. paratuberculosis
ugcgcggaaugcucgacac

SEQ ID NO: 892149 - RNA, 15 nt, Mycobacterium avium subsp. paratuberculosis
ugcgcggaccggcga

SEQ ID NO: 892150 - RNA, 21 nt, Mycobacterium avium subsp. paratuberculosis
ugcgcggccugcagcaccgaa

SEQ ID NO: 892151 - RNA, 21 nt, Mycobacterium avium subsp. paratuberculosis
ugcgcggccgcgucggcggcg

SEQ ID NO: 892152 - RNA, 15 nt, Mycobacterium avium subsp. paratuberculosis
ugcgcggccgcccag

SEQ ID NO: 892153 - RNA, 23 nt, Mycobacterium avium subsp. paratuberculosis
ugcgcggcccguugagcaccgcg

SEQ ID NO: 892154 - RNA, 14 nt, Mycobacterium avium subsp. paratuberculosis
ugcgcgcgcaccug

SEQ ID NO: 892155 - RNA, 15 nt, Mycobacterium avium subsp. paratuberculosis
ugcgcgcuggccgcg

SEQ ID NO: 892156 - RNA, 16 nt, Mycobacterium avium subsp. paratuberculosis
ugcgcgaugucgacgg

SEQ ID NO: 892157 - RNA, 18 nt, Mycobacterium avium subsp. paratuberculosis
ugcgcgaguaggcgaaga

SEQ ID NO: 892158 - RNA, 23 nt, Mycobacterium avium subsp. paratuberculosis
ugcgcgagucgagcaccgcgacc

SEQ ID NO: 892159 - RNA, 21 nt, Mycobacterium avium subsp. paratuberculosis
ugcgcgagcagaucgcggauc

SEQ ID NO: 892160 - RNA, 22 nt, Mycobacterium avium subsp. paratuberculosis
ugcgcgaggaggggucggugcg

SEQ ID NO: 892161 - RNA, 14 nt, Mycobacterium avium subsp. paratuberculosis
ugcgcgccgaccgc

SEQ ID NO: 892162 - RNA, 15 nt, Mycobacterium avium subsp. paratuberculosis
ugcgcgccgaccgcg

SEQ ID NO: 892163 - RNA, 19 nt, Mycobacterium avium subsp. paratuberculosis
ugcgcgccgaccgcgagca

SEQ ID NO: 892164 - RNA, 14 nt, Mycobacterium avium subsp. paratuberculosis
ugcgcgccccggcc

SEQ ID NO: 892165 - RNA, 16 nt, Mycobacterium avium subsp. paratuberculosis
ugcgcgccccggcccg

SEQ ID NO: 892166 - RNA, 13 nt, Mycobacterium avium subsp. paratuberculosis
ugcgcgccguugg

SEQ ID NO: 892167 - RNA, 20 nt, Mycobacterium avium subsp. paratuberculosis
ugcgcgccuccgacgacgau

SEQ ID NO: 892168 - RNA, 16 nt, Mycobacterium avium subsp. paratuberculosis
ugcgcgccgucggcga

SEQ ID NO: 892169 - RNA, 13 nt, Mycobacterium avium subsp. paratuberculosis
ugcgcgccgugac

SEQ ID NO: 892170 - RNA, 13 nt, Mycobacterium avium subsp. paratuberculosis
ugcgcgccgcgac

SEQ ID NO: 892171 - RNA, 14 nt, Mycobacterium avium subsp. paratuberculosis
ugcgcgccgacgac

SEQ ID NO: 892172 - RNA, 15 nt, Mycobacterium avium subsp. paratuberculosis
ugcgcgccgacgacc

SEQ ID NO: 892173 - RNA, 17 nt, Mycobacterium avium subsp. paratuberculosis
ugcgcgccgacgaccag

SEQ ID NO: 892174 - RNA, 18 nt, Mycobacterium avium subsp. paratuberculosis
ugcgcgccgacgaccagu

SEQ ID NO: 892175 - RNA, 15 nt, Mycobacterium avium subsp. paratuberculosis
ugcgcgccgcaaccg

SEQ ID NO: 892176 - RNA, 20 nt, Mycobacterium avium subsp. paratuberculosis
ugcgccuugucgauggucgc

SEQ ID NO: 892177 - RNA, 18 nt, Mycobacterium avium subsp. paratuberculosis
ugcgcgacggcgcuguac

SEQ ID NO: 892178 - RNA, 18 nt, Mycobacterium avium subsp. paratuberculosis
ugcgcgagauggcgauca

SEQ ID NO: 892179 - RNA, 22 nt, Mycobacterium avium subsp. paratuberculosis
ugcgcgagauggcgaucagaug

SEQ ID NO: 892180 - RNA, 14 nt, Mycobacterium avium subsp. paratuberculosis
ugcgcgacgccguc

SEQ ID NO: 892181 - RNA, 15 nt, Mycobacterium avium subsp. paratuberculosis
ugcgcgacgccguca

SEQ ID NO: 892182 - RNA, 22 nt, Mycobacterium avium subsp. paratuberculosis
ugcgcgacaccugcucaccgag

SEQ ID NO: 892183 - RNA, 21 nt, Mycobacterium avium subsp. paratuberculosis
ugcgcgaccaaacgcagcguc

SEQ ID NO: 892184 - RNA, 22 nt, Mycobacterium avium subsp. paratuberculosis
ugcgccgcgcuugcgaucgccg

SEQ ID NO: 892185 - RNA, 16 nt, Mycobacterium avium subsp. paratuberculosis
ugcgccggcgcggcca

SEQ ID NO: 892186 - RNA, 19 nt, Mycobacterium avium subsp. paratuberculosis
ugcgccggauucggcgcgg

SEQ ID NO: 892187 - RNA, 15 nt, Mycobacterium avium subsp. paratuberculosis
ugcgccggcaacugg

SEQ ID NO: 892188 - RNA, 21 nt, Mycobacterium avium subsp. paratuberculosis
ugcgccggcaacuggccgccc

SEQ ID NO: 892189 - RNA, 14 nt, Mycobacterium avium subsp. paratuberculosis
ugcgccgcggugcg

SEQ ID NO: 892190 - RNA, 17 nt, Mycobacterium avium subsp. paratuberculosis
ugcgccgcgucgacgcc

SEQ ID NO: 892191 - RNA, 18 nt, Mycobacterium avium subsp. paratuberculosis
ugcgccgcgucgacgccg

SEQ ID NO: 892192 - RNA, 20 nt, Mycobacterium avium subsp. paratuberculosis
ugcgccgcggcggcucggcg

SEQ ID NO: 892193 - RNA, 13 nt, Mycobacterium avium subsp. paratuberculosis
ugcgccgccuccg

SEQ ID NO: 892194 - RNA, 18 nt, Mycobacterium avium subsp. paratuberculosis
ugcgccgccuccgggcug

SEQ ID NO: 892195 - RNA, 21 nt, Mycobacterium avium subsp. paratuberculosis
ugcgccgcccacaccgacacc

SEQ ID NO: 892196 - RNA, 23 nt, Mycobacterium avium subsp. paratuberculosis
ugcgccgcccacaccgacaccgg

SEQ ID NO: 892197 - RNA, 23 nt, Mycobacterium avium subsp. paratuberculosis
ugcgccgcauuggugccggccuc

SEQ ID NO: 892198 - RNA, 14 nt, Mycobacterium avium subsp. paratuberculosis
ugcgccgccgcguc

SEQ ID NO: 892199 - RNA, 20 nt, Mycobacterium avium subsp. paratuberculosis
ugcgccgccgcgucgccgcc

SEQ ID NO: 892200 - RNA, 22 nt, Mycobacterium avium subsp. paratuberculosis
ugcgccgccgcgucgccgccgg

SEQ ID NO: 892201 - RNA, 17 nt, Mycobacterium avium subsp. paratuberculosis
ugcgcaugacggccugc

SEQ ID NO: 892202 - RNA, 20 nt, Mycobacterium avium subsp. paratuberculosis
ugcgcaucggcgacgccgcc

SEQ ID NO: 892203 - RNA, 16 nt, Mycobacterium avium subsp. paratuberculosis
ugcgcauucggcgacg

SEQ ID NO: 892204 - RNA, 12 nt, Mycobacterium avium subsp. paratuberculosis
ugcgcaucagcg

SEQ ID NO: 892205 - RNA, 15 nt, Mycobacterium avium subsp. paratuberculosis
ugcgcaucagcgcca

SEQ ID NO: 892206 - RNA, 14 nt, Mycobacterium avium subsp. paratuberculosis
ugguugagcaccgc

SEQ ID NO: 892207 - RNA, 15 nt, Mycobacterium avium subsp. paratuberculosis
ugguugagcaccgcg

SEQ ID NO: 892208 - RNA, 19 nt, Mycobacterium avium subsp. paratuberculosis
ugguugaacggcaccccgc

SEQ ID NO: 892209 - RNA, 21 nt, Mycobacterium avium subsp. paratuberculosis
ugguucgacgugaucuggucg

SEQ ID NO: 892210 - RNA, 18 nt, Mycobacterium avium subsp. paratuberculosis
ugucagggcagcgguguc

SEQ ID NO: 892211 - RNA, 17 nt, Mycobacterium avium subsp. paratuberculosis
ugucaggaucgccgguc

SEQ ID NO: 892212 - RNA, 15 nt, Mycobacterium avium subsp. paratuberculosis
ugucaggucggcgau

SEQ ID NO: 892213 - RNA, 17 nt, Mycobacterium avium subsp. paratuberculosis
uguccacccccgcggug

SEQ ID NO: 892214 - RNA, 19 nt, Mycobacterium avium subsp. paratuberculosis
uguccccgauuucgcggcc

SEQ ID NO: 892215 - RNA, 20 nt, Mycobacterium avium subsp. paratuberculosis
uguccagcgucucgaugacc

SEQ ID NO: 892216 - RNA, 20 nt, Mycobacterium avium subsp. paratuberculosis
uguccagcagcgccggcagc

SEQ ID NO: 892217 - RNA, 17 nt, Mycobacterium avium subsp. paratuberculosis
uguccaggauccccguc

SEQ ID NO: 892218 - RNA, 17 nt, Mycobacterium avium subsp. paratuberculosis
uguccaggccgucgagg

SEQ ID NO: 892219 - RNA, 15 nt, Mycobacterium avium subsp. paratuberculosis
uguccuacggcgggu

SEQ ID NO: 892220 - RNA, 21 nt, Mycobacterium avium subsp. paratuberculosis
uguccucccagcgcccgggcg

SEQ ID NO: 892221 - RNA, 20 nt, Mycobacterium avium subsp. paratuberculosis
uguccucgagcugcacgggc

SEQ ID NO: 892222 - RNA, 16 nt, Mycobacterium avium subsp. paratuberculosis
uguccugcucggcgac

SEQ ID NO: 892223 - RNA, 19 nt, Mycobacterium avium subsp. paratuberculosis
uguccggucuucucggcca

SEQ ID NO: 892224 - RNA, 16 nt, Mycobacterium avium subsp. paratuberculosis
uguccgggauggacga

SEQ ID NO: 892225 - RNA, 15 nt, Mycobacterium avium subsp. paratuberculosis
ugucccuugggcgga

SEQ ID NO: 892226 - RNA, 15 nt, Mycobacterium avium subsp. paratuberculosis
ugucccgggcgaacg

SEQ ID NO: 892227 - RNA, 14 nt, Mycobacterium avium subsp. paratuberculosis
uguccccgccggug

SEQ ID NO: 892228 - RNA, 14 nt, Mycobacterium avium subsp. paratuberculosis
uguccgacgccguc

SEQ ID NO: 892229 - RNA, 18 nt, Mycobacterium avium subsp. paratuberculosis
uguccgaugacgagcagc

SEQ ID NO: 892230 - RNA, 22 nt, Mycobacterium avium subsp. paratuberculosis
ugucgauggucgccugcuggac

SEQ ID NO: 892231 - RNA, 17 nt, Mycobacterium avium subsp. paratuberculosis
ugucgccggcgaccgcc

SEQ ID NO: 892232 - RNA, 18 nt, Mycobacterium avium subsp. paratuberculosis
ugucgccgagguccucga

SEQ ID NO: 892233 - RNA, 14 nt, Mycobacterium avium subsp. paratuberculosis
ugucgcccgcgucg

SEQ ID NO: 892234 - RNA, 20 nt, Mycobacterium avium subsp. paratuberculosis
ugucgcccucgaucgcgacc

SEQ ID NO: 892235 - RNA, 16 nt, Mycobacterium avium subsp. paratuberculosis
ugucgcccucgcgcag

SEQ ID NO: 892236 - RNA, 23 nt, Mycobacterium avium subsp. paratuberculosis
ugucgccgaacgccaccaccucc

SEQ ID NO: 892237 - RNA, 14 nt, Mycobacterium avium subsp. paratuberculosis
ugucgcgcaccgcg

SEQ ID NO: 892238 - RNA, 16 nt, Mycobacterium avium subsp. paratuberculosis
ugucgcgcaccgcggc

SEQ ID NO: 892239 - RNA, 20 nt, Mycobacterium avium subsp. paratuberculosis
ugucgccgauuucggugucg

SEQ ID NO: 892240 - RNA, 11 nt, Mycobacterium avium subsp. paratuberculosis
ugucgccggug

SEQ ID NO: 892241 - RNA, 14 nt, Mycobacterium avium subsp. paratuberculosis
ugucgccgcgccag

SEQ ID NO: 892242 - RNA, 15 nt, Mycobacterium avium subsp. paratuberculosis
ugucgccgcgccagc

SEQ ID NO: 892243 - RNA, 24 nt, Mycobacterium avium subsp. paratuberculosis
ugucgcgcgaacagccgaccgauc

SEQ ID NO: 892244 - RNA, 14 nt, Mycobacterium avium subsp. paratuberculosis
ugucgcgggcgaaa

SEQ ID NO: 892245 - RNA, 21 nt, Mycobacterium avium subsp. paratuberculosis
ugucgcggugcagacgugacg

SEQ ID NO: 892246 - RNA, 13 nt, Mycobacterium avium subsp. paratuberculosis
ugucgcgcggcug

SEQ ID NO: 892247 - RNA, 12 nt, Mycobacterium avium subsp. paratuberculosis
ugucgacccgcg

SEQ ID NO: 892248 - RNA, 18 nt, Mycobacterium avium subsp. paratuberculosis
ugucgaccucggccacca

SEQ ID NO: 892249 - RNA, 13 nt, Mycobacterium avium subsp. paratuberculosis
ugucgaccaccag

SEQ ID NO: 892250 - RNA, 13 nt, Mycobacterium avium subsp. paratuberculosis
ugucgagcaccgc

SEQ ID NO: 892251 - RNA, 15 nt, Mycobacterium avium subsp. paratuberculosis
ugucgacgucggugg

SEQ ID NO: 892252 - RNA, 14 nt, Mycobacterium avium subsp. paratuberculosis
ugucgacgcugcag

SEQ ID NO: 892253 - RNA, 19 nt, Mycobacterium avium subsp. paratuberculosis
ugucgacgcccuuggcgcc

SEQ ID NO: 892254 - RNA, 23 nt, Mycobacterium avium subsp. paratuberculosis
ugucgagccaccacugcgccguc

SEQ ID NO: 892255 - RNA, 13 nt, Mycobacterium avium subsp. paratuberculosis
ugucgagccggug

SEQ ID NO: 892256 - RNA, 16 nt, Mycobacterium avium subsp. paratuberculosis
ugucgaggucggugag

SEQ ID NO: 892257 - RNA, 18 nt, Mycobacterium avium subsp. paratuberculosis
uggugcgcccgucggugg

SEQ ID NO: 892258 - RNA, 18 nt, Mycobacterium avium subsp. paratuberculosis
uggugcgcagcccgccgg

SEQ ID NO: 892259 - RNA, 11 nt, Mycobacterium avium subsp. paratuberculosis
ugguggucgac

SEQ ID NO: 892260 - RNA, 12 nt, Mycobacterium avium subsp. paratuberculosis
ugguggucgacg

SEQ ID NO: 892261 - RNA, 17 nt, Mycobacterium avium subsp. paratuberculosis
ugguggucgacgcgccg

SEQ ID NO: 892262 - RNA, 18 nt, Mycobacterium avium subsp. paratuberculosis
ugguggucgacgcgccgc

SEQ ID NO: 892263 - RNA, 17 nt, Mycobacterium avium subsp. paratuberculosis
ugguggucgucgacgag

SEQ ID NO: 892264 - RNA, 22 nt, Mycobacterium avium subsp. paratuberculosis
ugguguuccaccagcggccguc

SEQ ID NO: 892265 - RNA, 22 nt, Mycobacterium avium subsp. paratuberculosis
uggugucgaagcugcgcagccg

SEQ ID NO: 892266 - RNA, 21 nt, Mycobacterium avium subsp. paratuberculosis
uggugucuuucucgaugaccc

SEQ ID NO: 892267 - RNA, 18 nt, Mycobacterium avium subsp. paratuberculosis
uggugugcaaggcgaugc

SEQ ID NO: 892268 - RNA, 17 nt, Mycobacterium avium subsp. paratuberculosis
uggugauggacggggcg

SEQ ID NO: 892269 - RNA, 21 nt, Mycobacterium avium subsp. paratuberculosis
uggugauuguaggugugcagc

SEQ ID NO: 892270 - RNA, 15 nt, Mycobacterium avium subsp. paratuberculosis
uggugaucggccagg

SEQ ID NO: 892271 - RNA, 18 nt, Mycobacterium avium subsp. paratuberculosis
uggugaugaaucgucccg

SEQ ID NO: 892272 - RNA, 23 nt, Mycobacterium avium subsp. paratuberculosis
uggugaucagcauccgcaacgug

SEQ ID NO: 892273 - RNA, 22 nt, Mycobacterium avium subsp. paratuberculosis
uggugaugcgcugcaaccgguc

SEQ ID NO: 892274 - RNA, 15 nt, Mycobacterium avium subsp. paratuberculosis
uggugaugcggucgg

SEQ ID NO: 892275 - RNA, 17 nt, Mycobacterium avium subsp. paratuberculosis
uggugaugcggucggcg

SEQ ID NO: 892276 - RNA, 14 nt, Mycobacterium avium subsp. paratuberculosis
uggugccgucggcg

SEQ ID NO: 892277 - RNA, 22 nt, Mycobacterium avium subsp. paratuberculosis
uggucgcugcucaugagcccuc

SEQ ID NO: 892278 - RNA, 21 nt, Mycobacterium avium subsp. paratuberculosis
uggucgcggcguugcccgcug

SEQ ID NO: 892279 - RNA, 21 nt, Mycobacterium avium subsp. paratuberculosis
uggucgcggccuugcgggccg

SEQ ID NO: 892280 - RNA, 13 nt, Mycobacterium avium subsp. paratuberculosis
uggucgcgccgcg

SEQ ID NO: 892281 - RNA, 22 nt, Mycobacterium avium subsp. paratuberculosis
uggucgccgucguauucgacgg

SEQ ID NO: 892282 - RNA, 23 nt, Mycobacterium avium subsp. paratuberculosis
uggucgcgaagcguaugccggug

SEQ ID NO: 892283 - RNA, 20 nt, Mycobacterium avium subsp. paratuberculosis
uggucgcccaccacgacgac

SEQ ID NO: 892284 - RNA, 15 nt, Mycobacterium avium subsp. paratuberculosis
uggucgccgacggug

SEQ ID NO: 892285 - RNA, 15 nt, Mycobacterium avium subsp. paratuberculosis
uggucggagccgucg

SEQ ID NO: 892286 - RNA, 20 nt, Mycobacterium avium subsp. paratuberculosis
uggucggagccgucgguguc

SEQ ID NO: 892287 - RNA, 18 nt, Mycobacterium avium subsp. paratuberculosis
uggucgcuuucggugacc

SEQ ID NO: 892288 - RNA, 21 nt, Mycobacterium avium subsp. paratuberculosis
uggucggcaccuccugcaccc

SEQ ID NO: 892289 - RNA, 17 nt, Mycobacterium avium subsp. paratuberculosis
uggucggcgacgccguc

SEQ ID NO: 892290 - RNA, 20 nt, Mycobacterium avium subsp. paratuberculosis
uggucggcgacgccgucggg

SEQ ID NO: 892291 - RNA, 14 nt, Mycobacterium avium subsp. paratuberculosis
uggucggcgcgguc

SEQ ID NO: 892292 - RNA, 16 nt, Mycobacterium avium subsp. paratuberculosis
uggugaggucgcgcag

SEQ ID NO: 892293 - RNA, 21 nt, Mycobacterium avium subsp. paratuberculosis
uggugaccguacucgugggcc

SEQ ID NO: 892294 - RNA, 17 nt, Mycobacterium avium subsp. paratuberculosis
uggugaccugcggaucg

SEQ ID NO: 892295 - RNA, 23 nt, Mycobacterium avium subsp. paratuberculosis
uggugaccugcggaucgcgggcg

SEQ ID NO: 892296 - RNA, 14 nt, Mycobacterium avium subsp. paratuberculosis
uggugacgccgacg

SEQ ID NO: 892297 - RNA, 12 nt, Mycobacterium avium subsp. paratuberculosis
uggugacgccgc

SEQ ID NO: 892298 - RNA, 12 nt, Mycobacterium avium subsp. paratuberculosis
uggugacgggcg

SEQ ID NO: 892299 - RNA, 12 nt, Mycobacterium avium subsp. paratuberculosis
uggugacccgga

SEQ ID NO: 892300 - RNA, 17 nt, Mycobacterium avium subsp. paratuberculosis
uggucguugcacacccg

SEQ ID NO: 892301 - RNA, 22 nt, Mycobacterium avium subsp. paratuberculosis
uggucguugcacacccggugcg

SEQ ID NO: 892302 - RNA, 18 nt, Mycobacterium avium subsp. paratuberculosis
uggucgugcucgucggcg

SEQ ID NO: 892303 - RNA, 12 nt, Mycobacterium avium subsp. paratuberculosis
uggucggucagc

SEQ ID NO: 892304 - RNA, 19 nt, Mycobacterium avium subsp. paratuberculosis
uggucgguagggucgggug

SEQ ID NO: 892305 - RNA, 23 nt, Mycobacterium avium subsp. paratuberculosis
uggucgggcgcaccacgaccucc

SEQ ID NO: 892306 - RNA, 23 nt, Mycobacterium avium subsp. paratuberculosis
uggucggggucgaacaucacccg

SEQ ID NO: 892307 - RNA, 23 nt, Mycobacterium avium subsp. paratuberculosis
uggucggcggguaugucggcgac

SEQ ID NO: 892308 - RNA, 22 nt, Mycobacterium avium subsp. paratuberculosis
ugggucagcucccccgucgggc

SEQ ID NO: 892309 - RNA, 17 nt, Mycobacterium avium subsp. paratuberculosis
ugggucccaucgcugcc

SEQ ID NO: 892310 - RNA, 21 nt, Mycobacterium avium subsp. paratuberculosis
uggguccgauugcccgacucc

SEQ ID NO: 892311 - RNA, 22 nt, Mycobacterium avium subsp. paratuberculosis
ugggucgccgggucuuccacgc

SEQ ID NO: 892312 - RNA, 12 nt, Mycobacterium avium subsp. paratuberculosis
ugggucacgcug

SEQ ID NO: 892313 - RNA, 22 nt, Mycobacterium avium subsp. paratuberculosis
ugggucagccacgggcggucgg

SEQ ID NO: 892314 - RNA, 15 nt, Mycobacterium avium subsp. paratuberculosis
ugggccuccggcggc

SEQ ID NO: 892315 - RNA, 23 nt, Mycobacterium avium subsp. paratuberculosis
ugggcgaacagcagcacccgggu

SEQ ID NO: 892316 - RNA, 16 nt, Mycobacterium avium subsp. paratuberculosis
ugggcgaacgaggccg

SEQ ID NO: 892317 - RNA, 22 nt, Mycobacterium avium subsp. paratuberculosis
ugggccggucggucggccgcac

SEQ ID NO: 892318 - RNA, 14 nt, Mycobacterium avium subsp. paratuberculosis
ugggccgucgcccg

SEQ ID NO: 892319 - RNA, 19 nt, Mycobacterium avium subsp. paratuberculosis
ugggccgggaugaagccgc

SEQ ID NO: 892320 - RNA, 23 nt, Mycobacterium avium subsp. paratuberculosis
ugggccgccggccgcucgcgggc

SEQ ID NO: 892321 - RNA, 12 nt, Mycobacterium avium subsp. paratuberculosis
ugggccgccguc

SEQ ID NO: 892322 - RNA, 19 nt, Mycobacterium avium subsp. paratuberculosis
ugggccgccgucgccacca

SEQ ID NO: 892323 - RNA, 17 nt, Mycobacterium avium subsp. paratuberculosis
ugggccagaucgacccc

SEQ ID NO: 892324 - RNA, 14 nt, Mycobacterium avium subsp. paratuberculosis
ugggccacggcgcg

SEQ ID NO: 892325 - RNA, 20 nt, Mycobacterium avium subsp. paratuberculosis
ugggcaugucgccgaacgcc

SEQ ID NO: 892326 - RNA, 15 nt, Mycobacterium avium subsp. paratuberculosis
ugguacagcaccgcc

SEQ ID NO: 892327 - RNA, 12 nt, Mycobacterium avium subsp. paratuberculosis
uggucagcgcgg

SEQ ID NO: 892328 - RNA, 21 nt, Mycobacterium avium subsp. paratuberculosis
uggucagcgcggcccgcggcg

SEQ ID NO: 892329 - RNA, 12 nt, Mycobacterium avium subsp. paratuberculosis
ugguagcugcug

SEQ ID NO: 892330 - RNA, 19 nt, Mycobacterium avium subsp. paratuberculosis
uggucacccacuggcggcc

SEQ ID NO: 892331 - RNA, 23 nt, Mycobacterium avium subsp. paratuberculosis
uggucacccgcagcccgaccuuc

SEQ ID NO: 892332 - RNA, 20 nt, Mycobacterium avium subsp. paratuberculosis
uggucaccguguuggugacg

SEQ ID NO: 892333 - RNA, 20 nt, Mycobacterium avium subsp. paratuberculosis
uggucagcggcgccaccggg

SEQ ID NO: 892334 - RNA, 21 nt, Mycobacterium avium subsp. paratuberculosis
uggucagcggcgccaccggga

SEQ ID NO: 892335 - RNA, 18 nt, Mycobacterium avium subsp. paratuberculosis
uggucagcgucucgccgg

SEQ ID NO: 892336 - RNA, 22 nt, Mycobacterium avium subsp. paratuberculosis
uggucagguaggcgucgaacgg

SEQ ID NO: 892337 - RNA, 19 nt, Mycobacterium avium subsp. paratuberculosis
uggucagcugccgcaccgc

SEQ ID NO: 892338 - RNA, 22 nt, Mycobacterium avium subsp. paratuberculosis
uggucgaaccgcgagcgcgcgg

SEQ ID NO: 892339 - RNA, 17 nt, Mycobacterium avium subsp. paratuberculosis
uggucgaugucggugcg

SEQ ID NO: 892340 - RNA, 15 nt, Mycobacterium avium subsp. paratuberculosis
uggucgagccgcagu

SEQ ID NO: 892341 - RNA, 19 nt, Mycobacterium avium subsp. paratuberculosis
uggucgaacagcacgccgg

SEQ ID NO: 892342 - RNA, 21 nt, Mycobacterium avium subsp. paratuberculosis
uggucgaacagcgcgcccgac

SEQ ID NO: 892343 - RNA, 17 nt, Mycobacterium avium subsp. paratuberculosis
uggcuuuggucgccagc

SEQ ID NO: 892344 - RNA, 15 nt, Mycobacterium avium subsp. paratuberculosis
uggcugaggccgccc

SEQ ID NO: 892345 - RNA, 21 nt, Mycobacterium avium subsp. paratuberculosis
uggcugaggccgccccggccg

SEQ ID NO: 892346 - RNA, 18 nt, Mycobacterium avium subsp. paratuberculosis
uggcugucggggaccguc

SEQ ID NO: 892347 - RNA, 22 nt, Mycobacterium avium subsp. paratuberculosis
uggcuggucacccacuggcggc

SEQ ID NO: 892348 - RNA, 17 nt, Mycobacterium avium subsp. paratuberculosis
ugggcaauaccggcagc

SEQ ID NO: 892349 - RNA, 13 nt, Mycobacterium avium subsp. paratuberculosis
ugggcaccggcac

SEQ ID NO: 892350 - RNA, 20 nt, Mycobacterium avium subsp. paratuberculosis
ugggcaccagcagcgcgacg

SEQ ID NO: 892351 - RNA, 20 nt, Mycobacterium avium subsp. paratuberculosis
ugggcaccuggccgucggug

SEQ ID NO: 892352 - RNA, 15 nt, Mycobacterium avium subsp. paratuberculosis
ugggcaucaucggca

SEQ ID NO: 892353 - RNA, 19 nt, Mycobacterium avium subsp. paratuberculosis
ugggcauccgcucgccgcg

SEQ ID NO: 892354 - RNA, 17 nt, Mycobacterium avium subsp. paratuberculosis
ugggcaucgucucggac

SEQ ID NO: 892355 - RNA, 20 nt, Mycobacterium avium subsp. paratuberculosis
ugggcagccaaccgccgggg

SEQ ID NO: 892356 - RNA, 17 nt, Mycobacterium avium subsp. paratuberculosis
ugggcagccgcgcgugc

SEQ ID NO: 892357 - RNA, 15 nt, Mycobacterium avium subsp. paratuberculosis
ugggcagccggcaac

SEQ ID NO: 892358 - RNA, 16 nt, Mycobacterium avium subsp. paratuberculosis
ugggcagcggaaucgc

SEQ ID NO: 892359 - RNA, 21 nt, Mycobacterium avium subsp. paratuberculosis
ugggcagcucgucggcgcgcc

SEQ ID NO: 892360 - RNA, 18 nt, Mycobacterium avium subsp. paratuberculosis
ugggaucagcagcaccgg

SEQ ID NO: 892361 - RNA, 18 nt, Mycobacterium avium subsp. paratuberculosis
ugggaugucuagccgccg

SEQ ID NO: 892362 - RNA, 17 nt, Mycobacterium avium subsp. paratuberculosis
ugggacagccggucgac

SEQ ID NO: 892363 - RNA, 16 nt, Mycobacterium avium subsp. paratuberculosis
ugggacggcggguggg

SEQ ID NO: 892364 - RNA, 16 nt, Mycobacterium avium subsp. paratuberculosis
ugggacgggucggcgg

SEQ ID NO: 892365 - RNA, 16 nt, Mycobacterium avium subsp. paratuberculosis
ugggagcacgugauga

SEQ ID NO: 892366 - RNA, 21 nt, Mycobacterium avium subsp. paratuberculosis
ugggacugggcgccgccggcg

SEQ ID NO: 892367 - RNA, 17 nt, Mycobacterium avium subsp. paratuberculosis
ugggagacuuccacuua

SEQ ID NO: 892368 - RNA, 17 nt, Mycobacterium avium subsp. paratuberculosis
uggcguaaccggugaca

SEQ ID NO: 892369 - RNA, 20 nt, Mycobacterium avium subsp. paratuberculosis
uggcguagaucugcacgcug

SEQ ID NO: 892370 - RNA, 21 nt, Mycobacterium avium subsp. paratuberculosis
uggcguaggacagcagccgcu

SEQ ID NO: 892371 - RNA, 21 nt, Mycobacterium avium subsp. paratuberculosis
uggcgguguucgagggcgcgg

SEQ ID NO: 892372 - RNA, 13 nt, Mycobacterium avium subsp. paratuberculosis
uggcgguggcggc

SEQ ID NO: 892373 - RNA, 13 nt, Mycobacterium avium subsp. paratuberculosis
uggcgguggggcc

SEQ ID NO: 892374 - RNA, 14 nt, Mycobacterium avium subsp. paratuberculosis
uggcggccggccgc

SEQ ID NO: 892375 - RNA, 17 nt, Mycobacterium avium subsp. paratuberculosis
uggcggccgggucgagc

SEQ ID NO: 892376 - RNA, 19 nt, Mycobacterium avium subsp. paratuberculosis
uggcggccaggccggcgac

SEQ ID NO: 892377 - RNA, 20 nt, Mycobacterium avium subsp. paratuberculosis
uggcggccaggccggcgacg

SEQ ID NO: 892378 - RNA, 21 nt, Mycobacterium avium subsp. paratuberculosis
uggcggccaggccggcgacga

SEQ ID NO: 892379 - RNA, 22 nt, Mycobacterium avium subsp. paratuberculosis
uggcggccaggccggcgacgau

SEQ ID NO: 892380 - RNA, 15 nt, Mycobacterium avium subsp. paratuberculosis
uggcggccagcgcgc

SEQ ID NO: 892381 - RNA, 18 nt, Mycobacterium avium subsp. paratuberculosis
uggcggccagcgcgccgc

SEQ ID NO: 892382 - RNA, 19 nt, Mycobacterium avium subsp. paratuberculosis
uggcggccagcgcgccgcc

SEQ ID NO: 892383 - RNA, 20 nt, Mycobacterium avium subsp. paratuberculosis
uggcggccagcgucuugacg

SEQ ID NO: 892384 - RNA, 17 nt, Mycobacterium avium subsp. paratuberculosis
uggcggcccagaucgcg

SEQ ID NO: 892385 - RNA, 20 nt, Mycobacterium avium subsp. paratuberculosis
uggcggcccagaucgcgguc

SEQ ID NO: 892386 - RNA, 14 nt, Mycobacterium avium subsp. paratuberculosis
uggcggcccgacca

SEQ ID NO: 892387 - RNA, 22 nt, Mycobacterium avium subsp. paratuberculosis
uggcggcccgaccagcgggccg

SEQ ID NO: 892388 - RNA, 12 nt, Mycobacterium avium subsp. paratuberculosis
uggcggcccgcg

SEQ ID NO: 892389 - RNA, 15 nt, Mycobacterium avium subsp. paratuberculosis
uggcggcccgcgccg

SEQ ID NO: 892390 - RNA, 16 nt, Mycobacterium avium subsp. paratuberculosis
uggcggcccgcgccgg

SEQ ID NO: 892391 - RNA, 16 nt, Mycobacterium avium subsp. paratuberculosis
uggcgucguuggcgcc

SEQ ID NO: 892392 - RNA, 18 nt, Mycobacterium avium subsp. paratuberculosis
uggcgucguuggcgccgu

SEQ ID NO: 892393 - RNA, 21 nt, Mycobacterium avium subsp. paratuberculosis
uggcgucguuggcgccguccg

SEQ ID NO: 892394 - RNA, 16 nt, Mycobacterium avium subsp. paratuberculosis
uggcgucgguggcggc

SEQ ID NO: 892395 - RNA, 12 nt, Mycobacterium avium subsp. paratuberculosis
uggcgucgucgg

SEQ ID NO: 892396 - RNA, 21 nt, Mycobacterium avium subsp. paratuberculosis
uggcgucggugaacucgucca

SEQ ID NO: 892397 - RNA, 12 nt, Mycobacterium avium subsp. paratuberculosis
uggcgucggugg

SEQ ID NO: 892398 - RNA, 20 nt, Mycobacterium avium subsp. paratuberculosis
uggcguaugccuccucggug

SEQ ID NO: 892399 - RNA, 17 nt, Mycobacterium avium subsp. paratuberculosis
uggcguauucggcgcgc

SEQ ID NO: 892400 - RNA, 18 nt, Mycobacterium avium subsp. paratuberculosis
uggcguauucggcgcgca

SEQ ID NO: 892401 - RNA, 17 nt, Mycobacterium avium subsp. paratuberculosis
uggcguagucgacuucc

SEQ ID NO: 892402 - RNA, 17 nt, Mycobacterium avium subsp. paratuberculosis
uggcguagucgucgauc

SEQ ID NO: 892403 - RNA, 20 nt, Mycobacterium avium subsp. paratuberculosis
uggcguagugggucggcggc

SEQ ID NO: 892404 - RNA, 18 nt, Mycobacterium avium subsp. paratuberculosis
uggcguaguggugcaggu

SEQ ID NO: 892405 - RNA, 19 nt, Mycobacterium avium subsp. paratuberculosis
uggcguauaacacgaugcg

SEQ ID NO: 892406 - RNA, 14 nt, Mycobacterium avium subsp. paratuberculosis
uggcgugacgcucg

SEQ ID NO: 892407 - RNA, 18 nt, Mycobacterium avium subsp. paratuberculosis
uggcgugacgcucgacgg

SEQ ID NO: 892408 - RNA, 15 nt, Mycobacterium avium subsp. paratuberculosis
uggcgugacgcucgg

SEQ ID NO: 892409 - RNA, 17 nt, Mycobacterium avium subsp. paratuberculosis
uggcgugacgcucggcg

SEQ ID NO: 892410 - RNA, 19 nt, Mycobacterium avium subsp. paratuberculosis
uggcgugacggucgaccuc

SEQ ID NO: 892411 - RNA, 19 nt, Mycobacterium avium subsp. paratuberculosis
uggcgugacguucgucagc

SEQ ID NO: 892412 - RNA, 16 nt, Mycobacterium avium subsp. paratuberculosis
uggcgucgucggcggc

SEQ ID NO: 892413 - RNA, 21 nt, Mycobacterium avium subsp. paratuberculosis
uggcgugaaucuuggccagca

SEQ ID NO: 892414 - RNA, 17 nt, Mycobacterium avium subsp. paratuberculosis
uggcgugccggcgcugc

SEQ ID NO: 892415 - RNA, 19 nt, Mycobacterium avium subsp. paratuberculosis
uggcgugccgggcgguacg

SEQ ID NO: 892416 - RNA, 16 nt, Mycobacterium avium subsp. paratuberculosis
uggcguggcacccggg

SEQ ID NO: 892417 - RNA, 16 nt, Mycobacterium avium subsp. paratuberculosis
uggcgugcggcgcggu

SEQ ID NO: 892418 - RNA, 20 nt, Mycobacterium avium subsp. paratuberculosis
uggcgugguggaaggugacg

SEQ ID NO: 892419 - RNA, 20 nt, Mycobacterium avium subsp. paratuberculosis
uggcguuuuccuucggugcg

SEQ ID NO: 892420 - RNA, 14 nt, Mycobacterium avium subsp. paratuberculosis
uggcguugcgggcg

SEQ ID NO: 892421 - RNA, 21 nt, Mycobacterium avium subsp. paratuberculosis
uggcguugcagaacgcgcgga

SEQ ID NO: 892422 - RNA, 14 nt, Mycobacterium avium subsp. paratuberculosis
uggcguuacacccg

SEQ ID NO: 892423 - RNA, 15 nt, Mycobacterium avium subsp. paratuberculosis
uggcguuacacccgc

SEQ ID NO: 892424 - RNA, 21 nt, Mycobacterium avium subsp. paratuberculosis
uggcgugcuugaacgccgccc

SEQ ID NO: 892425 - RNA, 14 nt, Mycobacterium avium subsp. paratuberculosis
uggcguucgccgag

SEQ ID NO: 892426 - RNA, 16 nt, Mycobacterium avium subsp. paratuberculosis
uggcugacggcgucgu

SEQ ID NO: 892427 - RNA, 21 nt, Mycobacterium avium subsp. paratuberculosis
uggcucggcccgccgggcgcc

SEQ ID NO: 892428 - RNA, 13 nt, Mycobacterium avium subsp. paratuberculosis
uggcuccccggcg

SEQ ID NO: 892429 - RNA, 21 nt, Mycobacterium avium subsp. paratuberculosis
uggcucagcggcaggugcgcc

SEQ ID NO: 892430 - RNA, 17 nt, Mycobacterium avium subsp. paratuberculosis
uggcaucccgcgccugc

SEQ ID NO: 892431 - RNA, 23 nt, Mycobacterium avium subsp. paratuberculosis
uggcaggccaucagcccggcguc

SEQ ID NO: 892432 - RNA, 19 nt, Mycobacterium avium subsp. paratuberculosis
uggccgugcaccgucgccg

SEQ ID NO: 892433 - RNA, 20 nt, Mycobacterium avium subsp. paratuberculosis
uggccgugcaccgucgccgg

SEQ ID NO: 892434 - RNA, 22 nt, Mycobacterium avium subsp. paratuberculosis
uggccgugugcgcaucggcgac

SEQ ID NO: 892435 - RNA, 20 nt, Mycobacterium avium subsp. paratuberculosis
uggccgucggccugcgcugc

SEQ ID NO: 892436 - RNA, 13 nt, Mycobacterium avium subsp. paratuberculosis
uggccgucggcga

SEQ ID NO: 892437 - RNA, 12 nt, Mycobacterium avium subsp. paratuberculosis
uggccgucgggu

SEQ ID NO: 892438 - RNA, 12 nt, Mycobacterium avium subsp. paratuberculosis
uggccggccggg

SEQ ID NO: 892439 - RNA, 11 nt, Mycobacterium avium subsp. paratuberculosis
uggccggcgaa

SEQ ID NO: 892440 - RNA, 18 nt, Mycobacterium avium subsp. paratuberculosis
uggccggcgaaccgccgc

SEQ ID NO: 892441 - RNA, 12 nt, Mycobacterium avium subsp. paratuberculosis
uggccggcccgc

SEQ ID NO: 892442 - RNA, 13 nt, Mycobacterium avium subsp. paratuberculosis
uggccggcccgcc

SEQ ID NO: 892443 - RNA, 17 nt, Mycobacterium avium subsp. paratuberculosis
uggccggcccgcccgua

SEQ ID NO: 892444 - RNA, 13 nt, Mycobacterium avium subsp. paratuberculosis
uggccggccagca

SEQ ID NO: 892445 - RNA, 18 nt, Mycobacterium avium subsp. paratuberculosis
uggccggccaccagcggc

SEQ ID NO: 892446 - RNA, 17 nt, Mycobacterium avium subsp. paratuberculosis
uggccggacgggucgac

SEQ ID NO: 892447 - RNA, 19 nt, Mycobacterium avium subsp. paratuberculosis
uggccggagccuuggucgc

SEQ ID NO: 892448 - RNA, 18 nt, Mycobacterium avium subsp. paratuberculosis
uggccgcuuuccaccccg

SEQ ID NO: 892449 - RNA, 17 nt, Mycobacterium avium subsp. paratuberculosis
uggccucgggcgacgac

SEQ ID NO: 892450 - RNA, 22 nt, Mycobacterium avium subsp. paratuberculosis
uggccucgucgaugucggcggc

SEQ ID NO: 892451 - RNA, 14 nt, Mycobacterium avium subsp. paratuberculosis
uggccucgucgcgg

SEQ ID NO: 892452 - RNA, 15 nt, Mycobacterium avium subsp. paratuberculosis
uggccucgucggcgc

SEQ ID NO: 892453 - RNA, 19 nt, Mycobacterium avium subsp. paratuberculosis
uggccucgucggcgccguc

SEQ ID NO: 892454 - RNA, 15 nt, Mycobacterium avium subsp. paratuberculosis
uggccucggcgcggg

SEQ ID NO: 892455 - RNA, 15 nt, Mycobacterium avium subsp. paratuberculosis
uggccucggcgcugc

SEQ ID NO: 892456 - RNA, 19 nt, Mycobacterium avium subsp. paratuberculosis
uggccucggcgcugcccgc

SEQ ID NO: 892457 - RNA, 20 nt, Mycobacterium avium subsp. paratuberculosis
uggccugcccggcggugccg

SEQ ID NO: 892458 - RNA, 21 nt, Mycobacterium avium subsp. paratuberculosis
uggccugcccggcggugccga

SEQ ID NO: 892459 - RNA, 14 nt, Mycobacterium avium subsp. paratuberculosis
uggccugaaccagc

SEQ ID NO: 892460 - RNA, 21 nt, Mycobacterium avium subsp. paratuberculosis
uggccugaaccagcucgugca

SEQ ID NO: 892461 - RNA, 20 nt, Mycobacterium avium subsp. paratuberculosis
uggccucgcgcaaugccgcc

SEQ ID NO: 892462 - RNA, 22 nt, Mycobacterium avium subsp. paratuberculosis
uggccucgcgcaaugccgccgc

SEQ ID NO: 892463 - RNA, 21 nt, Mycobacterium avium subsp. paratuberculosis
uggccucgagugccugcgccc

SEQ ID NO: 892464 - RNA, 19 nt, Mycobacterium avium subsp. paratuberculosis
uggccuccagguucgccgc

SEQ ID NO: 892465 - RNA, 21 nt, Mycobacterium avium subsp. paratuberculosis
uggccuccagguucgccgccc

SEQ ID NO: 892466 - RNA, 19 nt, Mycobacterium avium subsp. paratuberculosis
uggccuccccauccgcggc

SEQ ID NO: 892467 - RNA, 18 nt, Mycobacterium avium subsp. paratuberculosis
uggccuccgacccgucca

SEQ ID NO: 892468 - RNA, 14 nt, Mycobacterium avium subsp. paratuberculosis
uggccuccgugcug

SEQ ID NO: 892469 - RNA, 17 nt, Mycobacterium avium subsp. paratuberculosis
uggccuccucggugacc

SEQ ID NO: 892470 - RNA, 20 nt, Mycobacterium avium subsp. paratuberculosis
uggccguugaucgagcaccg

SEQ ID NO: 892471 - RNA, 22 nt, Mycobacterium avium subsp. paratuberculosis
uggccguucaggucgaucagcg

SEQ ID NO: 892472 - RNA, 15 nt, Mycobacterium avium subsp. paratuberculosis
uggccuuguggucga

SEQ ID NO: 892473 - RNA, 15 nt, Mycobacterium avium subsp. paratuberculosis
uggccuuggccacca

SEQ ID NO: 892474 - RNA, 14 nt, Mycobacterium avium subsp. paratuberculosis
uggccuugcagccc

SEQ ID NO: 892475 - RNA, 17 nt, Mycobacterium avium subsp. paratuberculosis
uggccuugcugaucccc

SEQ ID NO: 892476 - RNA, 15 nt, Mycobacterium avium subsp. paratuberculosis
uggccugcuugggca

SEQ ID NO: 892477 - RNA, 17 nt, Mycobacterium avium subsp. paratuberculosis
uggccuggucgaacagc

SEQ ID NO: 892478 - RNA, 20 nt, Mycobacterium avium subsp. paratuberculosis
uggccugcuguuccucgaac

SEQ ID NO: 892479 - RNA, 14 nt, Mycobacterium avium subsp. paratuberculosis
uggccugguggccc

SEQ ID NO: 892480 - RNA, 15 nt, Mycobacterium avium subsp. paratuberculosis
uggccuugacgacgg

SEQ ID NO: 892481 - RNA, 12 nt, Mycobacterium avium subsp. paratuberculosis
uggcgcgccgca

SEQ ID NO: 892482 - RNA, 21 nt, Mycobacterium avium subsp. paratuberculosis
uggcgcgccccggcccgucca

SEQ ID NO: 892483 - RNA, 14 nt, Mycobacterium avium subsp. paratuberculosis
uggcgccgcgcagc

SEQ ID NO: 892484 - RNA, 16 nt, Mycobacterium avium subsp. paratuberculosis
uggcgcgcagucgcag

SEQ ID NO: 892485 - RNA, 22 nt, Mycobacterium avium subsp. paratuberculosis
uggcgccggcgcgcgagcguca

SEQ ID NO: 892486 - RNA, 22 nt, Mycobacterium avium subsp. paratuberculosis
uggcgccggccagcaccacggu

SEQ ID NO: 892487 - RNA, 15 nt, Mycobacterium avium subsp. paratuberculosis
uggcgccggcaucga

SEQ ID NO: 892488 - RNA, 21 nt, Mycobacterium avium subsp. paratuberculosis
uggcgccggcaucgaccgccc

SEQ ID NO: 892489 - RNA, 12 nt, Mycobacterium avium subsp. paratuberculosis
uggcgccggcca

SEQ ID NO: 892490 - RNA, 16 nt, Mycobacterium avium subsp. paratuberculosis
uggcgccgcccaccag

SEQ ID NO: 892491 - RNA, 16 nt, Mycobacterium avium subsp. paratuberculosis
uggcggccaacgccuc

SEQ ID NO: 892492 - RNA, 22 nt, Mycobacterium avium subsp. paratuberculosis
uggcggccaacgccucgucgac

SEQ ID NO: 892493 - RNA, 19 nt, Mycobacterium avium subsp. paratuberculosis
uggcggccaccaugccggc

SEQ ID NO: 892494 - RNA, 20 nt, Mycobacterium avium subsp. paratuberculosis
uggcggccaccaugccggcg

SEQ ID NO: 892495 - RNA, 22 nt, Mycobacterium avium subsp. paratuberculosis
uggcggccacgacggcgcuggc

SEQ ID NO: 892496 - RNA, 21 nt, Mycobacterium avium subsp. paratuberculosis
uggcggccagcgagaagucgc

SEQ ID NO: 892497 - RNA, 19 nt, Mycobacterium avium subsp. paratuberculosis
uggcggaauuuucgccguc

SEQ ID NO: 892498 - RNA, 15 nt, Mycobacterium avium subsp. paratuberculosis
uggcggauggcgccc

SEQ ID NO: 892499 - RNA, 18 nt, Mycobacterium avium subsp. paratuberculosis
uggcggcaacggccauga

SEQ ID NO: 892500 - RNA, 13 nt, Mycobacterium avium subsp. paratuberculosis
uggcggcaagccc

SEQ ID NO: 892501 - RNA, 23 nt, Mycobacterium avium subsp. paratuberculosis
uggcgccacagccggggaucgcg

SEQ ID NO: 892502 - RNA, 20 nt, Mycobacterium avium subsp. paratuberculosis
uggcgcagggcguucgacgu

SEQ ID NO: 892503 - RNA, 21 nt, Mycobacterium avium subsp. paratuberculosis
uggcgcccagcgucucggcgg

SEQ ID NO: 892504 - RNA, 15 nt, Mycobacterium avium subsp. paratuberculosis
uggcgcccagcgugg

SEQ ID NO: 892505 - RNA, 13 nt, Mycobacterium avium subsp. paratuberculosis
uggcgccaccucc

SEQ ID NO: 892506 - RNA, 16 nt, Mycobacterium avium subsp. paratuberculosis
uggcgccacugccgcc

SEQ ID NO: 892507 - RNA, 22 nt, Mycobacterium avium subsp. paratuberculosis
uggcgccacugccgccgcccag

SEQ ID NO: 892508 - RNA, 13 nt, Mycobacterium avium subsp. paratuberculosis
uggcgccgcgguc

SEQ ID NO: 892509 - RNA, 17 nt, Mycobacterium avium subsp. paratuberculosis
uggcgccgacgucaggg

SEQ ID NO: 892510 - RNA, 23 nt, Mycobacterium avium subsp. paratuberculosis
uggcgccgaggaucuugaucgcg

SEQ ID NO: 892511 - RNA, 12 nt, Mycobacterium avium subsp. paratuberculosis
uggcgccgaucg

SEQ ID NO: 892512 - RNA, 17 nt, Mycobacterium avium subsp. paratuberculosis
uggcgccgaucgcgcgc

SEQ ID NO: 892513 - RNA, 21 nt, Mycobacterium avium subsp. paratuberculosis
uggcgcccuugccgaugccgg

SEQ ID NO: 892514 - RNA, 16 nt, Mycobacterium avium subsp. paratuberculosis
uggcgacggcgacgac

SEQ ID NO: 892515 - RNA, 20 nt, Mycobacterium avium subsp. paratuberculosis
uggcgacggcgacgaccguc

SEQ ID NO: 892516 - RNA, 13 nt, Mycobacterium avium subsp. paratuberculosis
uggcgacgacgcc

SEQ ID NO: 892517 - RNA, 15 nt, Mycobacterium avium subsp. paratuberculosis
uggcgacgacgccga

SEQ ID NO: 892518 - RNA, 17 nt, Mycobacterium avium subsp. paratuberculosis
uggcgacgacggcggag

SEQ ID NO: 892519 - RNA, 14 nt, Mycobacterium avium subsp. paratuberculosis
uggcgaccgcgcag

SEQ ID NO: 892520 - RNA, 15 nt, Mycobacterium avium subsp. paratuberculosis
uggcgaccgcgcagg

SEQ ID NO: 892521 - RNA, 18 nt, Mycobacterium avium subsp. paratuberculosis
uggcgaccgcgcaggcgg

SEQ ID NO: 892522 - RNA, 23 nt, Mycobacterium avium subsp. paratuberculosis
uggcgaccgcgcaggcggcgacg

SEQ ID NO: 892523 - RNA, 19 nt, Mycobacterium avium subsp. paratuberculosis
uggcgaaccagcgcccgcu

SEQ ID NO: 892524 - RNA, 20 nt, Mycobacterium avium subsp. paratuberculosis
uggcgaaccgcggcggcagc

SEQ ID NO: 892525 - RNA, 14 nt, Mycobacterium avium subsp. paratuberculosis
uggcgaccgguccg

SEQ ID NO: 892526 - RNA, 14 nt, Mycobacterium avium subsp. paratuberculosis
uggcgaccucgugg

SEQ ID NO: 892527 - RNA, 20 nt, Mycobacterium avium subsp. paratuberculosis
uggcgacgaagucgacggcg

SEQ ID NO: 892528 - RNA, 20 nt, Mycobacterium avium subsp. paratuberculosis
aauuguucggccaccgcgcg

SEQ ID NO: 892529 - RNA, 12 nt, Mycobacterium avium subsp. paratuberculosis
aauucggcgauc

SEQ ID NO: 892530 - RNA, 22 nt, Mycobacterium avium subsp. paratuberculosis
aauucggagaccaggucggccu

SEQ ID NO: 892531 - RNA, 14 nt, Mycobacterium avium subsp. paratuberculosis
aauucgucggcggu

SEQ ID NO: 892532 - RNA, 13 nt, Mycobacterium avium subsp. paratuberculosis
aauugacgccgac

SEQ ID NO: 892533 - RNA, 19 nt, Mycobacterium avium subsp. paratuberculosis
aauugcuuuuugaccaccg

SEQ ID NO: 892534 - RNA, 13 nt, Mycobacterium avium subsp. paratuberculosis
aauugcgcugcac

SEQ ID NO: 892535 - RNA, 16 nt, Mycobacterium avium subsp. paratuberculosis
aaugcguuccgcgaca

SEQ ID NO: 892536 - RNA, 23 nt, Mycobacterium avium subsp. paratuberculosis
aauucagugaggccagcacccgg

SEQ ID NO: 892537 - RNA, 16 nt, Mycobacterium avium subsp. paratuberculosis
aauucgccggggcacc

SEQ ID NO: 892538 - RNA, 15 nt, Mycobacterium avium subsp. paratuberculosis
aauuccucagcgccc

SEQ ID NO: 892539 - RNA, 16 nt, Mycobacterium avium subsp. paratuberculosis
aaucgccccaggcgga

SEQ ID NO: 892540 - RNA, 15 nt, Mycobacterium avium subsp. paratuberculosis
aaucucgucggggcg

SEQ ID NO: 892541 - RNA, 16 nt, Mycobacterium avium subsp. paratuberculosis
aaugcaucgcgaucga

SEQ ID NO: 892542 - RNA, 19 nt, Mycobacterium avium subsp. paratuberculosis
aaugcccucguagcggccg

SEQ ID NO: 892543 - RNA, 22 nt, Mycobacterium avium subsp. paratuberculosis
uuuugaaauagccgcgccgcgg

SEQ ID NO: 892544 - RNA, 17 nt, Mycobacterium avium subsp. paratuberculosis
uuucacgucggcgaugg

SEQ ID NO: 892545 - RNA, 19 nt, Mycobacterium avium subsp. paratuberculosis
uuguugaccguugcgcccc

SEQ ID NO: 892546 - RNA, 13 nt, Mycobacterium avium subsp. paratuberculosis
uuguugcucggcg

SEQ ID NO: 892547 - RNA, 20 nt, Mycobacterium avium subsp. paratuberculosis
aaucgacaccgcacggccca

SEQ ID NO: 892548 - RNA, 13 nt, Mycobacterium avium subsp. paratuberculosis
aauccucgccgag

SEQ ID NO: 892549 - RNA, 16 nt, Mycobacterium avium subsp. paratuberculosis
uugggcgccucgccga

SEQ ID NO: 892550 - RNA, 15 nt, Mycobacterium avium subsp. paratuberculosis
uugggccggcgcccg

SEQ ID NO: 892551 - RNA, 22 nt, Mycobacterium avium subsp. paratuberculosis
uugggccggcgcccgucacgcu

SEQ ID NO: 892552 - RNA, 15 nt, Mycobacterium avium subsp. paratuberculosis
uugggccgccggccg

SEQ ID NO: 892553 - RNA, 22 nt, Mycobacterium avium subsp. paratuberculosis
uugggccgccggccgcucgcgg

SEQ ID NO: 892554 - RNA, 16 nt, Mycobacterium avium subsp. paratuberculosis
uugggcagcagcucga

SEQ ID NO: 892555 - RNA, 16 nt, Mycobacterium avium subsp. paratuberculosis
uugggcagcucggcgg

SEQ ID NO: 892556 - RNA, 17 nt, Mycobacterium avium subsp. paratuberculosis
uugggccagcggcgccg

SEQ ID NO: 892557 - RNA, 16 nt, Mycobacterium avium subsp. paratuberculosis
uugggcgccugcggug

SEQ ID NO: 892558 - RNA, 20 nt, Mycobacterium avium subsp. paratuberculosis
uuguagcugauggcacccuc

SEQ ID NO: 892559 - RNA, 19 nt, Mycobacterium avium subsp. paratuberculosis
aauccgggaccggcgucac

SEQ ID NO: 892560 - RNA, 22 nt, Mycobacterium avium subsp. paratuberculosis
aauccgggugucgacgccgggc

SEQ ID NO: 892561 - RNA, 23 nt, Mycobacterium avium subsp. paratuberculosis
uuggcuugaaaguccgccgacag

SEQ ID NO: 892562 - RNA, 12 nt, Mycobacterium avium subsp. paratuberculosis
uuggcugucgcg

SEQ ID NO: 892563 - RNA, 17 nt, Mycobacterium avium subsp. paratuberculosis
uuggcgggcgacuucuu

SEQ ID NO: 892564 - RNA, 17 nt, Mycobacterium avium subsp. paratuberculosis
uuggcgggcgccuucuu

SEQ ID NO: 892565 - RNA, 19 nt, Mycobacterium avium subsp. paratuberculosis
uuggcggccgggucgagcg

SEQ ID NO: 892566 - RNA, 20 nt, Mycobacterium avium subsp. paratuberculosis
uuggcggucugcgcccgauc

SEQ ID NO: 892567 - RNA, 13 nt, Mycobacterium avium subsp. paratuberculosis
uuggcggcggcca

SEQ ID NO: 892568 - RNA, 13 nt, Mycobacterium avium subsp. paratuberculosis
uuggcggcggccu

SEQ ID NO: 892569 - RNA, 13 nt, Mycobacterium avium subsp. paratuberculosis
uuggcggcgguga

SEQ ID NO: 892570 - RNA, 20 nt, Mycobacterium avium subsp. paratuberculosis
uuggcggcggugaucgccgg

SEQ ID NO: 892571 - RNA, 22 nt, Mycobacterium avium subsp. paratuberculosis
uuggcggcggugaucucgucgg

SEQ ID NO: 892572 - RNA, 13 nt, Mycobacterium avium subsp. paratuberculosis
uuggcggcggugg

SEQ ID NO: 892573 - RNA, 18 nt, Mycobacterium avium subsp. paratuberculosis
uuggcguaguggugcagg

SEQ ID NO: 892574 - RNA, 14 nt, Mycobacterium avium subsp. paratuberculosis
uuggcgucgaugcg

SEQ ID NO: 892575 - RNA, 15 nt, Mycobacterium avium subsp. paratuberculosis
uuggcgucgggcacc

SEQ ID NO: 892576 - RNA, 13 nt, Mycobacterium avium subsp. paratuberculosis
uuggcgucgucgg

SEQ ID NO: 892577 - RNA, 15 nt, Mycobacterium avium subsp. paratuberculosis
uuggagaucucggcg

SEQ ID NO: 892578 - RNA, 17 nt, Mycobacterium avium subsp. paratuberculosis
uuggagccgagcaccgg

SEQ ID NO: 892579 - RNA, 22 nt, Mycobacterium avium subsp. paratuberculosis
uuggaccagggcgguggcggcg

SEQ ID NO: 892580 - RNA, 18 nt, Mycobacterium avium subsp. paratuberculosis
uuggauuuaucucggcga

SEQ ID NO: 892581 - RNA, 14 nt, Mycobacterium avium subsp. paratuberculosis
uuggcccgccgccg

SEQ ID NO: 892582 - RNA, 22 nt, Mycobacterium avium subsp. paratuberculosis
uuggcccgcgcccgcucgaggg

SEQ ID NO: 892583 - RNA, 17 nt, Mycobacterium avium subsp. paratuberculosis
uuggcccgcggcgcccg

SEQ ID NO: 892584 - RNA, 23 nt, Mycobacterium avium subsp. paratuberculosis
uuggcccugcucuucgcgcgcgg

SEQ ID NO: 892585 - RNA, 18 nt, Mycobacterium avium subsp. paratuberculosis
uuggccgcgacgccgccg

SEQ ID NO: 892586 - RNA, 19 nt, Mycobacterium avium subsp. paratuberculosis
uuggccgcgacgccgccgc

SEQ ID NO: 892587 - RNA, 15 nt, Mycobacterium avium subsp. paratuberculosis
uuggccgcgccgccg

SEQ ID NO: 892588 - RNA, 22 nt, Mycobacterium avium subsp. paratuberculosis
uuggcggccaacgccucgucga

SEQ ID NO: 892589 - RNA, 22 nt, Mycobacterium avium subsp. paratuberculosis
uuggcggccaccaucuccgcgg

SEQ ID NO: 892590 - RNA, 17 nt, Mycobacterium avium subsp. paratuberculosis
uuggccgccagcaccuc

SEQ ID NO: 892591 - RNA, 21 nt, Mycobacterium avium subsp. paratuberculosis
uuggccugguagcugagcagc

SEQ ID NO: 892592 - RNA, 15 nt, Mycobacterium avium subsp. paratuberculosis
uuggccucggcgcgg

SEQ ID NO: 892593 - RNA, 23 nt, Mycobacterium avium subsp. paratuberculosis
uuggccgggcggaagucggugcc

SEQ ID NO: 892594 - RNA, 20 nt, Mycobacterium avium subsp. paratuberculosis
uuggccggcacucgccucgg

SEQ ID NO: 892595 - RNA, 23 nt, Mycobacterium avium subsp. paratuberculosis
uuggccggcacucgccucggagg

SEQ ID NO: 892596 - RNA, 11 nt, Mycobacterium avium subsp. paratuberculosis
uuggccggccc

SEQ ID NO: 892597 - RNA, 18 nt, Mycobacterium avium subsp. paratuberculosis
uuggccggaaucgcggga

SEQ ID NO: 892598 - RNA, 17 nt, Mycobacterium avium subsp. paratuberculosis
uuggccggagccuucuu

SEQ ID NO: 892599 - RNA, 19 nt, Mycobacterium avium subsp. paratuberculosis
uuggccggcuucucggcgu

SEQ ID NO: 892600 - RNA, 18 nt, Mycobacterium avium subsp. paratuberculosis
uugccuuuccgcgcggcg

SEQ ID NO: 892601 - RNA, 21 nt, Mycobacterium avium subsp. paratuberculosis
uugccuuuccgcgcggcgggc

SEQ ID NO: 892602 - RNA, 21 nt, Mycobacterium avium subsp. paratuberculosis
uugcgaccccgccgucgacgc

SEQ ID NO: 892603 - RNA, 19 nt, Mycobacterium avium subsp. paratuberculosis
uugcgcaacagcgugcaca

SEQ ID NO: 892604 - RNA, 15 nt, Mycobacterium avium subsp. paratuberculosis
uugaucucaucgucg

SEQ ID NO: 892605 - RNA, 17 nt, Mycobacterium avium subsp. paratuberculosis
uugauccggaucgggcg

SEQ ID NO: 892606 - RNA, 13 nt, Mycobacterium avium subsp. paratuberculosis
uugaucucggcgg

SEQ ID NO: 892607 - RNA, 16 nt, Mycobacterium avium subsp. paratuberculosis
uugaucucggcggcga

SEQ ID NO: 892608 - RNA, 15 nt, Mycobacterium avium subsp. paratuberculosis
uugaucucgucgcgg

SEQ ID NO: 892609 - RNA, 22 nt, Mycobacterium avium subsp. paratuberculosis
uugaucacaccgucggcgaucg

SEQ ID NO: 892610 - RNA, 17 nt, Mycobacterium avium subsp. paratuberculosis
uugaucauccggcgggg

SEQ ID NO: 892611 - RNA, 18 nt, Mycobacterium avium subsp. paratuberculosis
uugcgcucggucgcggcg

SEQ ID NO: 892612 - RNA, 14 nt, Mycobacterium avium subsp. paratuberculosis
uugcgcggcgccgg

SEQ ID NO: 892613 - RNA, 13 nt, Mycobacterium avium subsp. paratuberculosis
uugcgcggcgggc

SEQ ID NO: 892614 - RNA, 17 nt, Mycobacterium avium subsp. paratuberculosis
uugcgcgggucgccggg

SEQ ID NO: 892615 - RNA, 13 nt, Mycobacterium avium subsp. paratuberculosis
uugcgcgccgcga

SEQ ID NO: 892616 - RNA, 22 nt, Mycobacterium avium subsp. paratuberculosis
uugcgcacccgcgggucgucgg

SEQ ID NO: 892617 - RNA, 15 nt, Mycobacterium avium subsp. paratuberculosis
uugcguugcgcggcg

SEQ ID NO: 892618 - RNA, 20 nt, Mycobacterium avium subsp. paratuberculosis
uugcgggccggagccuucuu

SEQ ID NO: 892619 - RNA, 18 nt, Mycobacterium avium subsp. paratuberculosis
uugcgucugcucgccguc

SEQ ID NO: 892620 - RNA, 13 nt, Mycobacterium avium subsp. paratuberculosis
uugcggccggcgg

SEQ ID NO: 892621 - RNA, 15 nt, Mycobacterium avium subsp. paratuberculosis
uugcggcgcaaccuc

SEQ ID NO: 892622 - RNA, 11 nt, Mycobacterium avium subsp. paratuberculosis
uugcggcgggc

SEQ ID NO: 892623 - RNA, 15 nt, Mycobacterium avium subsp. paratuberculosis
uugcgggacugggcg

SEQ ID NO: 892624 - RNA, 17 nt, Mycobacterium avium subsp. paratuberculosis
uugcgggcggcgcggcg

SEQ ID NO: 892625 - RNA, 17 nt, Mycobacterium avium subsp. paratuberculosis
uugcgggucugcucacg

SEQ ID NO: 892626 - RNA, 16 nt, Mycobacterium avium subsp. paratuberculosis
uugcgggugucgccgg

SEQ ID NO: 892627 - RNA, 18 nt, Mycobacterium avium subsp. paratuberculosis
uugcgggugucgccggug

SEQ ID NO: 892628 - RNA, 21 nt, Mycobacterium avium subsp. paratuberculosis
uugcgguccccggagagccgg

SEQ ID NO: 892629 - RNA, 16 nt, Mycobacterium avium subsp. paratuberculosis
uugcguuccucgacgg

SEQ ID NO: 892630 - RNA, 13 nt, Mycobacterium avium subsp. paratuberculosis
uugcucgccgcgu

SEQ ID NO: 892631 - RNA, 22 nt, Mycobacterium avium subsp. paratuberculosis
uugcugagccggcccugcggcc

SEQ ID NO: 892632 - RNA, 14 nt, Mycobacterium avium subsp. paratuberculosis
uugcugcccgcggc

SEQ ID NO: 892633 - RNA, 21 nt, Mycobacterium avium subsp. paratuberculosis
uugaacgcguacagcgcccgg

SEQ ID NO: 892634 - RNA, 14 nt, Mycobacterium avium subsp. paratuberculosis
uugaacucggccag

SEQ ID NO: 892635 - RNA, 12 nt, Mycobacterium avium subsp. paratuberculosis
uugaagcccucg

SEQ ID NO: 892636 - RNA, 13 nt, Mycobacterium avium subsp. paratuberculosis
uugacccggccgc

SEQ ID NO: 892637 - RNA, 13 nt, Mycobacterium avium subsp. paratuberculosis
uugaccaccagcg

SEQ ID NO: 892638 - RNA, 14 nt, Mycobacterium avium subsp. paratuberculosis
uugaccaccaggua

SEQ ID NO: 892639 - RNA, 14 nt, Mycobacterium avium subsp. paratuberculosis
uugaccacggugcg

SEQ ID NO: 892640 - RNA, 15 nt, Mycobacterium avium subsp. paratuberculosis
uugacccucagcagg

SEQ ID NO: 892641 - RNA, 15 nt, Mycobacterium avium subsp. paratuberculosis
uugaccccgacggcg

SEQ ID NO: 892642 - RNA, 20 nt, Mycobacterium avium subsp. paratuberculosis
uugaccccgacggcgccgcg

SEQ ID NO: 892643 - RNA, 20 nt, Mycobacterium avium subsp. paratuberculosis
uugaccccggccccggccgg

SEQ ID NO: 892644 - RNA, 23 nt, Mycobacterium avium subsp. paratuberculosis
uugacggccgggcccucggacgg

SEQ ID NO: 892645 - RNA, 16 nt, Mycobacterium avium subsp. paratuberculosis
uugaccggugcgcccg

SEQ ID NO: 892646 - RNA, 13 nt, Mycobacterium avium subsp. paratuberculosis
uugaccgucgcgg

SEQ ID NO: 892647 - RNA, 17 nt, Mycobacterium avium subsp. paratuberculosis
uugaccgugacggugcg

SEQ ID NO: 892648 - RNA, 21 nt, Mycobacterium avium subsp. paratuberculosis
uugacgaacuccugcucgcgg

SEQ ID NO: 892649 - RNA, 14 nt, Mycobacterium avium subsp. paratuberculosis
uugacgcugggcgg

SEQ ID NO: 892650 - RNA, 21 nt, Mycobacterium avium subsp. paratuberculosis
uugacggucugggaggcggcg

SEQ ID NO: 892651 - RNA, 17 nt, Mycobacterium avium subsp. paratuberculosis
uugacgugcgacaccgg

SEQ ID NO: 892652 - RNA, 22 nt, Mycobacterium avium subsp. paratuberculosis
uugagccacaacaugucccggg

SEQ ID NO: 892653 - RNA, 14 nt, Mycobacterium avium subsp. paratuberculosis
uugagccccgccgg

SEQ ID NO: 892654 - RNA, 15 nt, Mycobacterium avium subsp. paratuberculosis
uugagccccgccggg

SEQ ID NO: 892655 - RNA, 13 nt, Mycobacterium avium subsp. paratuberculosis
uugagccgccgcg

SEQ ID NO: 892656 - RNA, 23 nt, Mycobacterium avium subsp. paratuberculosis
uugagccggauguccuacggcgg

SEQ ID NO: 892657 - RNA, 19 nt, Mycobacterium avium subsp. paratuberculosis
uugagcgccagcgcggugc

SEQ ID NO: 892658 - RNA, 16 nt, Mycobacterium avium subsp. paratuberculosis
uugagcgcgucgucgc

SEQ ID NO: 892659 - RNA, 15 nt, Mycobacterium avium subsp. paratuberculosis
uugauaggucacgcc

SEQ ID NO: 892660 - RNA, 16 nt, Mycobacterium avium subsp. paratuberculosis
uugagucccucggcga

SEQ ID NO: 892661 - RNA, 19 nt, Mycobacterium avium subsp. paratuberculosis
uugagucccucggcgagcg

SEQ ID NO: 892662 - RNA, 18 nt, Mycobacterium avium subsp. paratuberculosis
uugaggaacgcgaccguc

SEQ ID NO: 892663 - RNA, 22 nt, Mycobacterium avium subsp. paratuberculosis
uugaggaucugcacgucggcgg

SEQ ID NO: 892664 - RNA, 16 nt, Mycobacterium avium subsp. paratuberculosis
uugaggaugacgacgg

SEQ ID NO: 892665 - RNA, 22 nt, Mycobacterium avium subsp. paratuberculosis
uugagcucgcggcgcagcucgc

SEQ ID NO: 892666 - RNA, 14 nt, Mycobacterium avium subsp. paratuberculosis
uucucggacgcccg

SEQ ID NO: 892667 - RNA, 21 nt, Mycobacterium avium subsp. paratuberculosis
uucucggaguaguuccggcgg

SEQ ID NO: 892668 - RNA, 20 nt, Mycobacterium avium subsp. paratuberculosis
uucucgcucugccgggccgc

SEQ ID NO: 892669 - RNA, 21 nt, Mycobacterium avium subsp. paratuberculosis
uucucacaggugacgacgcuc

SEQ ID NO: 892670 - RNA, 19 nt, Mycobacterium avium subsp. paratuberculosis
uucguagggacugcgccgg

SEQ ID NO: 892671 - RNA, 22 nt, Mycobacterium avium subsp. paratuberculosis
uucguaccuagggcccacgcuc

SEQ ID NO: 892672 - RNA, 18 nt, Mycobacterium avium subsp. paratuberculosis
uucgguggggccgccguc

SEQ ID NO: 892673 - RNA, 23 nt, Mycobacterium avium subsp. paratuberculosis
uucggugucccaguucccggcgg

SEQ ID NO: 892674 - RNA, 12 nt, Mycobacterium avium subsp. paratuberculosis
uucggucagcac

SEQ ID NO: 892675 - RNA, 22 nt, Mycobacterium avium subsp. paratuberculosis
uucggucccggcgggggcggcg

SEQ ID NO: 892676 - RNA, 15 nt, Mycobacterium avium subsp. paratuberculosis
uucgguggccccggg

SEQ ID NO: 892677 - RNA, 23 nt, Mycobacterium avium subsp. paratuberculosis
uucggugcccgggguccaccggc

SEQ ID NO: 892678 - RNA, 19 nt, Mycobacterium avium subsp. paratuberculosis
uucgggucagaccgcggcg

SEQ ID NO: 892679 - RNA, 13 nt, Mycobacterium avium subsp. paratuberculosis
uucgggucgccgg

SEQ ID NO: 892680 - RNA, 23 nt, Mycobacterium avium subsp. paratuberculosis
uucggggcguguggggaauccgg

SEQ ID NO: 892681 - RNA, 14 nt, Mycobacterium avium subsp. paratuberculosis
uucggggguggcca

SEQ ID NO: 892682 - RNA, 20 nt, Mycobacterium avium subsp. paratuberculosis
uucggggugacuucgagccg

SEQ ID NO: 892683 - RNA, 18 nt, Mycobacterium avium subsp. paratuberculosis
uugaaauagccgcgccgc

SEQ ID NO: 892684 - RNA, 16 nt, Mycobacterium avium subsp. paratuberculosis
uucugccacucgucga

SEQ ID NO: 892685 - RNA, 16 nt, Mycobacterium avium subsp. paratuberculosis
uucuugcugccgucgg

SEQ ID NO: 892686 - RNA, 13 nt, Mycobacterium avium subsp. paratuberculosis
uucuugacgccga

SEQ ID NO: 892687 - RNA, 16 nt, Mycobacterium avium subsp. paratuberculosis
uucuuggccgcgccgc

SEQ ID NO: 892688 - RNA, 16 nt, Mycobacterium avium subsp. paratuberculosis
uucuuggcgggcgacu

SEQ ID NO: 892689 - RNA, 14 nt, Mycobacterium avium subsp. paratuberculosis
uuccuccucggcgc

SEQ ID NO: 892690 - RNA, 16 nt, Mycobacterium avium subsp. paratuberculosis
uuccggugucgagccg

SEQ ID NO: 892691 - RNA, 17 nt, Mycobacterium avium subsp. paratuberculosis
uuccggugucgagccgg

SEQ ID NO: 892692 - RNA, 17 nt, Mycobacterium avium subsp. paratuberculosis
uuccggccggccgccgg

SEQ ID NO: 892693 - RNA, 19 nt, Mycobacterium avium subsp. paratuberculosis
uuccggggaaccgcccuuc

SEQ ID NO: 892694 - RNA, 20 nt, Mycobacterium avium subsp. paratuberculosis
uuccucgugcgugcgcucga

SEQ ID NO: 892695 - RNA, 19 nt, Mycobacterium avium subsp. paratuberculosis
uuccucgcugaccucgaca

SEQ ID NO: 892696 - RNA, 17 nt, Mycobacterium avium subsp. paratuberculosis
uuccucggcgcucgccg

SEQ ID NO: 892697 - RNA, 11 nt, Mycobacterium avium subsp. paratuberculosis
uuccucgacgu

SEQ ID NO: 892698 - RNA, 21 nt, Mycobacterium avium subsp. paratuberculosis
uuccugcgcuaccaggcgugc

SEQ ID NO: 892699 - RNA, 14 nt, Mycobacterium avium subsp. paratuberculosis
uuccuggccgauga

SEQ ID NO: 892700 - RNA, 22 nt, Mycobacterium avium subsp. paratuberculosis
uucccgaacagggcgacggcgg

SEQ ID NO: 892701 - RNA, 21 nt, Mycobacterium avium subsp. paratuberculosis
uuccccguagucacccggccc

SEQ ID NO: 892702 - RNA, 18 nt, Mycobacterium avium subsp. paratuberculosis
uucccgaguggcgccguc

SEQ ID NO: 892703 - RNA, 16 nt, Mycobacterium avium subsp. paratuberculosis
uucccgccgccgcggg

SEQ ID NO: 892704 - RNA, 14 nt, Mycobacterium avium subsp. paratuberculosis
uucccgccgccguc

SEQ ID NO: 892705 - RNA, 16 nt, Mycobacterium avium subsp. paratuberculosis
uucccgccgccgucgg

SEQ ID NO: 892706 - RNA, 22 nt, Mycobacterium avium subsp. paratuberculosis
uuccggaucaaccacaccagca

SEQ ID NO: 892707 - RNA, 13 nt, Mycobacterium avium subsp. paratuberculosis
uuccggaugccgg

SEQ ID NO: 892708 - RNA, 24 nt, Mycobacterium avium subsp. paratuberculosis
uucaggucuccguugucgaggucg

SEQ ID NO: 892709 - RNA, 19 nt, Mycobacterium avium subsp. paratuberculosis
uucagcgggcgcagcucgu

SEQ ID NO: 892710 - RNA, 20 nt, Mycobacterium avium subsp. paratuberculosis
uucgcguuccgccacggcgg

SEQ ID NO: 892711 - RNA, 19 nt, Mycobacterium avium subsp. paratuberculosis
uucgcggugggcucgucga

SEQ ID NO: 892712 - RNA, 17 nt, Mycobacterium avium subsp. paratuberculosis
uucgcggucggcaaccc

SEQ ID NO: 892713 - RNA, 23 nt, Mycobacterium avium subsp. paratuberculosis
uucgcggucggcaacccgaccuc

SEQ ID NO: 892714 - RNA, 17 nt, Mycobacterium avium subsp. paratuberculosis
uucgcguacccgcgcgg

SEQ ID NO: 892715 - RNA, 18 nt, Mycobacterium avium subsp. paratuberculosis
uucgcgucugcucgccgg

SEQ ID NO: 892716 - RNA, 21 nt, Mycobacterium avium subsp. paratuberculosis
uucgcgaucacguucucggcg

SEQ ID NO: 892717 - RNA, 17 nt, Mycobacterium avium subsp. paratuberculosis
uucgccggggccuucuu

SEQ ID NO: 892718 - RNA, 22 nt, Mycobacterium avium subsp. paratuberculosis
uucgccggggccuucuuggcgg

SEQ ID NO: 892719 - RNA, 21 nt, Mycobacterium avium subsp. paratuberculosis
uucgccgucgugguggccgcg

SEQ ID NO: 892720 - RNA, 23 nt, Mycobacterium avium subsp. paratuberculosis
uucgccuccgggaaggcggccgc

SEQ ID NO: 892721 - RNA, 18 nt, Mycobacterium avium subsp. paratuberculosis
uucgccugcagccgccgc

SEQ ID NO: 892722 - RNA, 19 nt, Mycobacterium avium subsp. paratuberculosis
uucgccugcagccgccgcg

SEQ ID NO: 892723 - RNA, 14 nt, Mycobacterium avium subsp. paratuberculosis
uucgccggccagca

SEQ ID NO: 892724 - RNA, 13 nt, Mycobacterium avium subsp. paratuberculosis
uucggccgccgug

SEQ ID NO: 892725 - RNA, 12 nt, Mycobacterium avium subsp. paratuberculosis
uucggccgcgga

SEQ ID NO: 892726 - RNA, 20 nt, Mycobacterium avium subsp. paratuberculosis
uucggccggcagcggugccg

SEQ ID NO: 892727 - RNA, 23 nt, Mycobacterium avium subsp. paratuberculosis
uucggcgaugcguugcgccagca

SEQ ID NO: 892728 - RNA, 22 nt, Mycobacterium avium subsp. paratuberculosis
uucggcgccaacaacucgacgc

SEQ ID NO: 892729 - RNA, 13 nt, Mycobacterium avium subsp. paratuberculosis
uucggcgccagcc

SEQ ID NO: 892730 - RNA, 13 nt, Mycobacterium avium subsp. paratuberculosis
uucggcgccgcga

SEQ ID NO: 892731 - RNA, 18 nt, Mycobacterium avium subsp. paratuberculosis
uucggcgcgcagcucgcg

SEQ ID NO: 892732 - RNA, 13 nt, Mycobacterium avium subsp. paratuberculosis
uucggcgcgccgg

SEQ ID NO: 892733 - RNA, 20 nt, Mycobacterium avium subsp. paratuberculosis
uucgggcugcgcuugcggcg

SEQ ID NO: 892734 - RNA, 20 nt, Mycobacterium avium subsp. paratuberculosis
uucggggauguagccgccgg

SEQ ID NO: 892735 - RNA, 16 nt, Mycobacterium avium subsp. paratuberculosis
uucgcuggcggggcgu

SEQ ID NO: 892736 - RNA, 16 nt, Mycobacterium avium subsp. paratuberculosis
uucggccaccgcgcgg

SEQ ID NO: 892737 - RNA, 21 nt, Mycobacterium avium subsp. paratuberculosis
uucggccaccgcgcggcgguc

SEQ ID NO: 892738 - RNA, 20 nt, Mycobacterium avium subsp. paratuberculosis
uucggccaccgcguccgcgg

SEQ ID NO: 892739 - RNA, 23 nt, Mycobacterium avium subsp. paratuberculosis
uucggccagcgcggugugcggcg

SEQ ID NO: 892740 - RNA, 16 nt, Mycobacterium avium subsp. paratuberculosis
uucgcugccgccgccg

SEQ ID NO: 892741 - RNA, 13 nt, Mycobacterium avium subsp. paratuberculosis
uucgcugcgccgg

SEQ ID NO: 892742 - RNA, 16 nt, Mycobacterium avium subsp. paratuberculosis
uucgcugcgccggcgg

SEQ ID NO: 892743 - RNA, 20 nt, Mycobacterium avium subsp. paratuberculosis
uucgccgcgcuugcgaccgc

SEQ ID NO: 892744 - RNA, 14 nt, Mycobacterium avium subsp. paratuberculosis
uucgaugucgccgg

SEQ ID NO: 892745 - RNA, 16 nt, Mycobacterium avium subsp. paratuberculosis
uucgaugucgccggcg

SEQ ID NO: 892746 - RNA, 20 nt, Mycobacterium avium subsp. paratuberculosis
uucgaugucgccggcgaccg

SEQ ID NO: 892747 - RNA, 18 nt, Mycobacterium avium subsp. paratuberculosis
uucgaugcggucccgcgg

SEQ ID NO: 892748 - RNA, 16 nt, Mycobacterium avium subsp. paratuberculosis
uuccugguagucgucg

SEQ ID NO: 892749 - RNA, 20 nt, Mycobacterium avium subsp. paratuberculosis
uucgacgaugccguagagcc

SEQ ID NO: 892750 - RNA, 19 nt, Mycobacterium avium subsp. paratuberculosis
uucgaggaucugggcggcg

SEQ ID NO: 892751 - RNA, 13 nt, Mycobacterium avium subsp. paratuberculosis
uucgagccgccgc

SEQ ID NO: 892752 - RNA, 15 nt, Mycobacterium avium subsp. paratuberculosis
uucgagccgccgccg

SEQ ID NO: 892753 - RNA, 17 nt, Mycobacterium avium subsp. paratuberculosis
uucgagacacgcgccgg

SEQ ID NO: 892754 - RNA, 23 nt, Mycobacterium avium subsp. paratuberculosis
uucgacggugaugucgccggcgg

SEQ ID NO: 892755 - RNA, 16 nt, Mycobacterium avium subsp. paratuberculosis
uucgauccgccggugc

SEQ ID NO: 892756 - RNA, 19 nt, Mycobacterium avium subsp. paratuberculosis
uucgaucaaaucccgcagc

SEQ ID NO: 892757 - RNA, 20 nt, Mycobacterium avium subsp. paratuberculosis
uucgaucaggcgcagcccga

SEQ ID NO: 892758 - RNA, 15 nt, Mycobacterium avium subsp. paratuberculosis
uuacucgccggcggc

SEQ ID NO: 892759 - RNA, 19 nt, Mycobacterium avium subsp. paratuberculosis
uuacucgccggcggcgccg

SEQ ID NO: 892760 - RNA, 17 nt, Mycobacterium avium subsp. paratuberculosis
uucaaccccgcgcgcgg

SEQ ID NO: 892761 - RNA, 13 nt, Mycobacterium avium subsp. paratuberculosis
uucaccccggcgc

SEQ ID NO: 892762 - RNA, 15 nt, Mycobacterium avium subsp. paratuberculosis
uucaccccggcgcgg

SEQ ID NO: 892763 - RNA, 21 nt, Mycobacterium avium subsp. paratuberculosis
uucaccccguaugcgccaacg

SEQ ID NO: 892764 - RNA, 16 nt, Mycobacterium avium subsp. paratuberculosis
uucaccagcgccucgg

SEQ ID NO: 892765 - RNA, 19 nt, Mycobacterium avium subsp. paratuberculosis
uucaccagggugccccgcg

SEQ ID NO: 892766 - RNA, 15 nt, Mycobacterium avium subsp. paratuberculosis
uucagccggagccgg

SEQ ID NO: 892767 - RNA, 12 nt, Mycobacterium avium subsp. paratuberculosis
uucagccggcgg

SEQ ID NO: 892768 - RNA, 16 nt, Mycobacterium avium subsp. paratuberculosis
uucagccugaugccgg

SEQ ID NO: 892769 - RNA, 14 nt, Mycobacterium avium subsp. paratuberculosis
uucaccgcgccggg

SEQ ID NO: 892770 - RNA, 14 nt, Mycobacterium avium subsp. paratuberculosis
uguuggcggcggug

SEQ ID NO: 892771 - RNA, 16 nt, Mycobacterium avium subsp. paratuberculosis
uguuggccgcgacgcc

SEQ ID NO: 892772 - RNA, 15 nt, Mycobacterium avium subsp. paratuberculosis
uguuggaaccggcca

SEQ ID NO: 892773 - RNA, 14 nt, Mycobacterium avium subsp. paratuberculosis
uguuggagccgucc

SEQ ID NO: 892774 - RNA, 21 nt, Mycobacterium avium subsp. paratuberculosis
uguugcucggggcucgcggug

SEQ ID NO: 892775 - RNA, 20 nt, Mycobacterium avium subsp. paratuberculosis
uguugcgcgggaagccgccg

SEQ ID NO: 892776 - RNA, 16 nt, Mycobacterium avium subsp. paratuberculosis
uguugcggcggccggc

SEQ ID NO: 892777 - RNA, 19 nt, Mycobacterium avium subsp. paratuberculosis
ugucgcgcacccgcacgug

SEQ ID NO: 892778 - RNA, 21 nt, Mycobacterium avium subsp. paratuberculosis
ugucgcguucccgggcccgcu

SEQ ID NO: 892779 - RNA, 15 nt, Mycobacterium avium subsp. paratuberculosis
ugucgcugccgccgc

SEQ ID NO: 892780 - RNA, 22 nt, Mycobacterium avium subsp. paratuberculosis
ugucggagcugcgcgccccggc

SEQ ID NO: 892781 - RNA, 18 nt, Mycobacterium avium subsp. paratuberculosis
ugucgcuguaggccagcc

SEQ ID NO: 892782 - RNA, 22 nt, Mycobacterium avium subsp. paratuberculosis
ugucgcuguuagccucgccagc

SEQ ID NO: 892783 - RNA, 14 nt, Mycobacterium avium subsp. paratuberculosis
ugucgcugccgccg

SEQ ID NO: 892784 - RNA, 14 nt, Mycobacterium avium subsp. paratuberculosis
ugucgcucaucccg

SEQ ID NO: 892785 - RNA, 15 nt, Mycobacterium avium subsp. paratuberculosis
ugucggcgggcgggc

SEQ ID NO: 892786 - RNA, 12 nt, Mycobacterium avium subsp. paratuberculosis
uguucaccccga

SEQ ID NO: 892787 - RNA, 22 nt, Mycobacterium avium subsp. paratuberculosis
uguucaccccguugagcagcgg

SEQ ID NO: 892788 - RNA, 14 nt, Mycobacterium avium subsp. paratuberculosis
uguucaccggcguc

SEQ ID NO: 892789 - RNA, 12 nt, Mycobacterium avium subsp. paratuberculosis
ugucggcgagcu

SEQ ID NO: 892790 - RNA, 14 nt, Mycobacterium avium subsp. paratuberculosis
uguuuggcugucgc

SEQ ID NO: 892791 - RNA, 14 nt, Mycobacterium avium subsp. paratuberculosis
acuucuacggcggg

SEQ ID NO: 892792 - RNA, 21 nt, Mycobacterium avium subsp. paratuberculosis
acuucuacggcgggccggcgc

SEQ ID NO: 892793 - RNA, 20 nt, Mycobacterium avium subsp. paratuberculosis
acuucguugguggucgacgc

SEQ ID NO: 892794 - RNA, 22 nt, Mycobacterium avium subsp. paratuberculosis
acuucguugguggucgacgcgc

SEQ ID NO: 892795 - RNA, 14 nt, Mycobacterium avium subsp. paratuberculosis
acuugaucgcggcg

SEQ ID NO: 892796 - RNA, 21 nt, Mycobacterium avium subsp. paratuberculosis
acuugaugacgcacgucggca

SEQ ID NO: 892797 - RNA, 20 nt, Mycobacterium avium subsp. paratuberculosis
acuugaugcugcccggcgcc

SEQ ID NO: 892798 - RNA, 22 nt, Mycobacterium avium subsp. paratuberculosis
acuugcgcgccgugacgccgau

SEQ ID NO: 892799 - RNA, 14 nt, Mycobacterium avium subsp. paratuberculosis
acuugcggccgcga

SEQ ID NO: 892800 - RNA, 15 nt, Mycobacterium avium subsp. paratuberculosis
acuugcggccgcgac

SEQ ID NO: 892801 - RNA, 18 nt, Mycobacterium avium subsp. paratuberculosis
acuugccgccggcgcagu

SEQ ID NO: 892802 - RNA, 14 nt, Mycobacterium avium subsp. paratuberculosis
acuugcuggcgcug

SEQ ID NO: 892803 - RNA, 18 nt, Mycobacterium avium subsp. paratuberculosis
acuuguggaaggcgccgg

SEQ ID NO: 892804 - RNA, 19 nt, Mycobacterium avium subsp. paratuberculosis
acuuguggaaggcgccggc

SEQ ID NO: 892805 - RNA, 13 nt, Mycobacterium avium subsp. paratuberculosis
acuguuugaugcc

SEQ ID NO: 892806 - RNA, 20 nt, Mycobacterium avium subsp. paratuberculosis
acuguccaggccgaggcuga

SEQ ID NO: 892807 - RNA, 20 nt, Mycobacterium avium subsp. paratuberculosis
acugucggcucgcccgcgac

SEQ ID NO: 892808 - RNA, 15 nt, Mycobacterium avium subsp. paratuberculosis
acugucggcgccccg

SEQ ID NO: 892809 - RNA, 21 nt, Mycobacterium avium subsp. paratuberculosis
acugucggcgccccgcccgcg

SEQ ID NO: 892810 - RNA, 16 nt, Mycobacterium avium subsp. paratuberculosis
acuucgacggcagcgg

SEQ ID NO: 892811 - RNA, 15 nt, Mycobacterium avium subsp. paratuberculosis
acuucgacggugaug

SEQ ID NO: 892812 - RNA, 15 nt, Mycobacterium avium subsp. paratuberculosis
acuuccgcccggcga

SEQ ID NO: 892813 - RNA, 15 nt, Mycobacterium avium subsp. paratuberculosis
acuucgucagcagcg

SEQ ID NO: 892814 - RNA, 16 nt, Mycobacterium avium subsp. paratuberculosis
acuucgucagcagcga

SEQ ID NO: 892815 - RNA, 15 nt, Mycobacterium avium subsp. paratuberculosis
acuucgccagcgggc

SEQ ID NO: 892816 - RNA, 16 nt, Mycobacterium avium subsp. paratuberculosis
acuucgccagcgggcc

SEQ ID NO: 892817 - RNA, 15 nt, Mycobacterium avium subsp. paratuberculosis
acuucgcguuccgcc

SEQ ID NO: 892818 - RNA, 17 nt, Mycobacterium avium subsp. paratuberculosis
acuucgcguuccgccac

SEQ ID NO: 892819 - RNA, 21 nt, Mycobacterium avium subsp. paratuberculosis
acuucgcuguaguagccgggg

SEQ ID NO: 892820 - RNA, 15 nt, Mycobacterium avium subsp. paratuberculosis
acuuccagcaccggc

SEQ ID NO: 892821 - RNA, 20 nt, Mycobacterium avium subsp. paratuberculosis
acuucaccgucugcuggccc

SEQ ID NO: 892822 - RNA, 13 nt, Mycobacterium avium subsp. paratuberculosis
acuucacgcucgc

SEQ ID NO: 892823 - RNA, 18 nt, Mycobacterium avium subsp. paratuberculosis
acuucacgcucgcgugcg

SEQ ID NO: 892824 - RNA, 23 nt, Mycobacterium avium subsp. paratuberculosis
acucuggcgugacgcucggcgcg

SEQ ID NO: 892825 - RNA, 20 nt, Mycobacterium avium subsp. paratuberculosis
acucuggcgugacguucggc

SEQ ID NO: 892826 - RNA, 23 nt, Mycobacterium avium subsp. paratuberculosis
acucugcacucagagcagcgccu

SEQ ID NO: 892827 - RNA, 21 nt, Mycobacterium avium subsp. paratuberculosis
acucguccaugcuggugccgc

SEQ ID NO: 892828 - RNA, 14 nt, Mycobacterium avium subsp. paratuberculosis
acucgguguggccc

SEQ ID NO: 892829 - RNA, 12 nt, Mycobacterium avium subsp. paratuberculosis
acucgucgacgc

SEQ ID NO: 892830 - RNA, 13 nt, Mycobacterium avium subsp. paratuberculosis
acucgucgaucga

SEQ ID NO: 892831 - RNA, 16 nt, Mycobacterium avium subsp. paratuberculosis
acucgucgaucgacgc

SEQ ID NO: 892832 - RNA, 17 nt, Mycobacterium avium subsp. paratuberculosis
acucgucgaugcacgcc

SEQ ID NO: 892833 - RNA, 18 nt, Mycobacterium avium subsp. paratuberculosis
acucgucgccaccgaugc

SEQ ID NO: 892834 - RNA, 14 nt, Mycobacterium avium subsp. paratuberculosis
acucgucggcgguu

SEQ ID NO: 892835 - RNA, 15 nt, Mycobacterium avium subsp. paratuberculosis
acucgugggccacca

SEQ ID NO: 892836 - RNA, 16 nt, Mycobacterium avium subsp. paratuberculosis
acucguugccagccgg

SEQ ID NO: 892837 - RNA, 19 nt, Mycobacterium avium subsp. paratuberculosis
acucgucuugcagccgggg

SEQ ID NO: 892838 - RNA, 16 nt, Mycobacterium avium subsp. paratuberculosis
acucgugcggcgccgc

SEQ ID NO: 892839 - RNA, 18 nt, Mycobacterium avium subsp. paratuberculosis
acucgugcggcgccgccc

SEQ ID NO: 892840 - RNA, 18 nt, Mycobacterium avium subsp. paratuberculosis
acucguccucccgguagc

SEQ ID NO: 892841 - RNA, 18 nt, Mycobacterium avium subsp. paratuberculosis
acugagcccggcgacgaa

SEQ ID NO: 892842 - RNA, 14 nt, Mycobacterium avium subsp. paratuberculosis
acugagcgcccggu

SEQ ID NO: 892843 - RNA, 20 nt, Mycobacterium avium subsp. paratuberculosis
acugaccuucucccgcggca

SEQ ID NO: 892844 - RNA, 22 nt, Mycobacterium avium subsp. paratuberculosis
acugaccuucucccgcggcagc

SEQ ID NO: 892845 - RNA, 22 nt, Mycobacterium avium subsp. paratuberculosis
acucggccagggcucgugcagc

SEQ ID NO: 892846 - RNA, 17 nt, Mycobacterium avium subsp. paratuberculosis
acucggcgaugcgccgu

SEQ ID NO: 892847 - RNA, 14 nt, Mycobacterium avium subsp. paratuberculosis
acucggcgccgccg

SEQ ID NO: 892848 - RNA, 16 nt, Mycobacterium avium subsp. paratuberculosis
acucggccuccgcgcg

SEQ ID NO: 892849 - RNA, 17 nt, Mycobacterium avium subsp. paratuberculosis
acucggccuccgcgcgc

SEQ ID NO: 892850 - RNA, 20 nt, Mycobacterium avium subsp. paratuberculosis
acucggccuccgcgcgcggc

SEQ ID NO: 892851 - RNA, 19 nt, Mycobacterium avium subsp. paratuberculosis
acucggugaugccggccag

SEQ ID NO: 892852 - RNA, 18 nt, Mycobacterium avium subsp. paratuberculosis
acucggcgucgccgagcu

SEQ ID NO: 892853 - RNA, 22 nt, Mycobacterium avium subsp. paratuberculosis
acucgggugggggcguggugcu

SEQ ID NO: 892854 - RNA, 12 nt, Mycobacterium avium subsp. paratuberculosis
acucggucaccu

SEQ ID NO: 892855 - RNA, 18 nt, Mycobacterium avium subsp. paratuberculosis
acucggucaccucgucga

SEQ ID NO: 892856 - RNA, 19 nt, Mycobacterium avium subsp. paratuberculosis
acucgggaaaugcgucggc

SEQ ID NO: 892857 - RNA, 19 nt, Mycobacterium avium subsp. paratuberculosis
acucgggcaacgcgccggc

SEQ ID NO: 892858 - RNA, 13 nt, Mycobacterium avium subsp. paratuberculosis
acucgggcccgag

SEQ ID NO: 892859 - RNA, 15 nt, Mycobacterium avium subsp. paratuberculosis
acucgggcggccgcg

SEQ ID NO: 892860 - RNA, 18 nt, Mycobacterium avium subsp. paratuberculosis
acucgggcucgucguugc

SEQ ID NO: 892861 - RNA, 23 nt, Mycobacterium avium subsp. paratuberculosis
acucgggcucgucguugcgcagc

SEQ ID NO: 892862 - RNA, 14 nt, Mycobacterium avium subsp. paratuberculosis
acucggcggcgggc

SEQ ID NO: 892863 - RNA, 16 nt, Mycobacterium avium subsp. paratuberculosis
acucggcggcgggcag

SEQ ID NO: 892864 - RNA, 15 nt, Mycobacterium avium subsp. paratuberculosis
acucggcggugccgu

SEQ ID NO: 892865 - RNA, 16 nt, Mycobacterium avium subsp. paratuberculosis
acucggcggugccguc

SEQ ID NO: 892866 - RNA, 22 nt, Mycobacterium avium subsp. paratuberculosis
acucggcggugccguccucggc

SEQ ID NO: 892867 - RNA, 16 nt, Mycobacterium avium subsp. paratuberculosis
acucaccgguggccgc

SEQ ID NO: 892868 - RNA, 18 nt, Mycobacterium avium subsp. paratuberculosis
acucaccgguggccgcgu

SEQ ID NO: 892869 - RNA, 17 nt, Mycobacterium avium subsp. paratuberculosis
acucaguccucgccgag

SEQ ID NO: 892870 - RNA, 15 nt, Mycobacterium avium subsp. paratuberculosis
acucagagcagcgcc

SEQ ID NO: 892871 - RNA, 17 nt, Mycobacterium avium subsp. paratuberculosis
acucaggagugguaggg

SEQ ID NO: 892872 - RNA, 18 nt, Mycobacterium avium subsp. paratuberculosis
acuggaccgugccggaau

SEQ ID NO: 892873 - RNA, 18 nt, Mycobacterium avium subsp. paratuberculosis
acuggacgccguggaucg

SEQ ID NO: 892874 - RNA, 22 nt, Mycobacterium avium subsp. paratuberculosis
acuggauggcgauggccugcuc

SEQ ID NO: 892875 - RNA, 16 nt, Mycobacterium avium subsp. paratuberculosis
acugcgcggccggcgu

SEQ ID NO: 892876 - RNA, 19 nt, Mycobacterium avium subsp. paratuberculosis
acugcguguggcgcacgcc

SEQ ID NO: 892877 - RNA, 14 nt, Mycobacterium avium subsp. paratuberculosis
acugcaucucgacc

SEQ ID NO: 892878 - RNA, 18 nt, Mycobacterium avium subsp. paratuberculosis
acugcaucgccagcacau

SEQ ID NO: 892879 - RNA, 19 nt, Mycobacterium avium subsp. paratuberculosis
acugcauuucggacggcga

SEQ ID NO: 892880 - RNA, 14 nt, Mycobacterium avium subsp. paratuberculosis
acugcgcgcccgag

SEQ ID NO: 892881 - RNA, 17 nt, Mycobacterium avium subsp. paratuberculosis
acugcgcgaccaaacgc

SEQ ID NO: 892882 - RNA, 23 nt, Mycobacterium avium subsp. paratuberculosis
acugccaagacguccgcgucggc

SEQ ID NO: 892883 - RNA, 11 nt, Mycobacterium avium subsp. paratuberculosis
acugcgccggg

SEQ ID NO: 892884 - RNA, 12 nt, Mycobacterium avium subsp. paratuberculosis
acugcgccgggg

SEQ ID NO: 892885 - RNA, 20 nt, Mycobacterium avium subsp. paratuberculosis
acugcgccggggccgcggcu

SEQ ID NO: 892886 - RNA, 21 nt, Mycobacterium avium subsp. paratuberculosis
acugcgccgucaucgacaccg

SEQ ID NO: 892887 - RNA, 20 nt, Mycobacterium avium subsp. paratuberculosis
acugcaggaacaaccgcagc

SEQ ID NO: 892888 - RNA, 23 nt, Mycobacterium avium subsp. paratuberculosis
acugcaggaacaaccgcagcggc

SEQ ID NO: 892889 - RNA, 15 nt, Mycobacterium avium subsp. paratuberculosis
acugcaccagcacga

SEQ ID NO: 892890 - RNA, 15 nt, Mycobacterium avium subsp. paratuberculosis
acugcaccagcggcg

SEQ ID NO: 892891 - RNA, 18 nt, Mycobacterium avium subsp. paratuberculosis
acugcacagugcgucgcc

SEQ ID NO: 892892 - RNA, 21 nt, Mycobacterium avium subsp. paratuberculosis
acugggugcgcgggcgcccgu

SEQ ID NO: 892893 - RNA, 13 nt, Mycobacterium avium subsp. paratuberculosis
acugggugccccg

SEQ ID NO: 892894 - RNA, 18 nt, Mycobacterium avium subsp. paratuberculosis
acuggggugucagcgcga

SEQ ID NO: 892895 - RNA, 17 nt, Mycobacterium avium subsp. paratuberculosis
acugggcggccugcacc

SEQ ID NO: 892896 - RNA, 12 nt, Mycobacterium avium subsp. paratuberculosis
acugggcgccgc

SEQ ID NO: 892897 - RNA, 18 nt, Mycobacterium avium subsp. paratuberculosis
acugggcgccgccggcgu

SEQ ID NO: 892898 - RNA, 17 nt, Mycobacterium avium subsp. paratuberculosis
acugguuccacaccacc

SEQ ID NO: 892899 - RNA, 16 nt, Mycobacterium avium subsp. paratuberculosis
acuggugggcgucgug

SEQ ID NO: 892900 - RNA, 17 nt, Mycobacterium avium subsp. paratuberculosis
acuggucgaacagcgcg

SEQ ID NO: 892901 - RNA, 13 nt, Mycobacterium avium subsp. paratuberculosis
acugguaaccgcc

SEQ ID NO: 892902 - RNA, 21 nt, Mycobacterium avium subsp. paratuberculosis
acuggucgugcucgucggcgg

SEQ ID NO: 892903 - RNA, 14 nt, Mycobacterium avium subsp. paratuberculosis
acuggucgugcugg

SEQ ID NO: 892904 - RNA, 18 nt, Mycobacterium avium subsp. paratuberculosis
acuggucgugcuggagcg

SEQ ID NO: 892905 - RNA, 13 nt, Mycobacterium avium subsp. paratuberculosis
acugggccgccgu

SEQ ID NO: 892906 - RNA, 14 nt, Mycobacterium avium subsp. paratuberculosis
acugggccgccguc

SEQ ID NO: 892907 - RNA, 15 nt, Mycobacterium avium subsp. paratuberculosis
acugggccgccgucg

SEQ ID NO: 892908 - RNA, 14 nt, Mycobacterium avium subsp. paratuberculosis
acugggccgucgcc

SEQ ID NO: 892909 - RNA, 18 nt, Mycobacterium avium subsp. paratuberculosis
acuggcugagcaccgggg

SEQ ID NO: 892910 - RNA, 20 nt, Mycobacterium avium subsp. paratuberculosis
acuggcugagcaccgggguc

SEQ ID NO: 892911 - RNA, 18 nt, Mycobacterium avium subsp. paratuberculosis
acuggcguugaugcgggc

SEQ ID NO: 892912 - RNA, 15 nt, Mycobacterium avium subsp. paratuberculosis
acuggccaccgcgau

SEQ ID NO: 892913 - RNA, 17 nt, Mycobacterium avium subsp. paratuberculosis
acuggcccacgcagccg

SEQ ID NO: 892914 - RNA, 12 nt, Mycobacterium avium subsp. paratuberculosis
acuggcgccggu

SEQ ID NO: 892915 - RNA, 14 nt, Mycobacterium avium subsp. paratuberculosis
acuggcgccggucg

SEQ ID NO: 892916 - RNA, 19 nt, Mycobacterium avium subsp. paratuberculosis
acgugcacggcgccgugcc

SEQ ID NO: 892917 - RNA, 17 nt, Mycobacterium avium subsp. paratuberculosis
acgugcaccugcagccg

SEQ ID NO: 892918 - RNA, 17 nt, Mycobacterium avium subsp. paratuberculosis
acgugcacgugcaggug

SEQ ID NO: 892919 - RNA, 17 nt, Mycobacterium avium subsp. paratuberculosis
acgugcacucagggcga

SEQ ID NO: 892920 - RNA, 16 nt, Mycobacterium avium subsp. paratuberculosis
acguggaccgagcgcg

SEQ ID NO: 892921 - RNA, 19 nt, Mycobacterium avium subsp. paratuberculosis
acguggaccgagcgcgcga

SEQ ID NO: 892922 - RNA, 15 nt, Mycobacterium avium subsp. paratuberculosis
acgugcacccacgcc

SEQ ID NO: 892923 - RNA, 23 nt, Mycobacterium avium subsp. paratuberculosis
acgugcacccacgccagccgggu

SEQ ID NO: 892924 - RNA, 21 nt, Mycobacterium avium subsp. paratuberculosis
acgugcaccgcggccaacccg

SEQ ID NO: 892925 - RNA, 15 nt, Mycobacterium avium subsp. paratuberculosis
acgugcaccggcgag

SEQ ID NO: 892926 - RNA, 15 nt, Mycobacterium avium subsp. paratuberculosis
acgugaugcacccgg

SEQ ID NO: 892927 - RNA, 20 nt, Mycobacterium avium subsp. paratuberculosis
acgugaugcacccggacgug

SEQ ID NO: 892928 - RNA, 22 nt, Mycobacterium avium subsp. paratuberculosis
acgugaugccguggucggcgaa

SEQ ID NO: 892929 - RNA, 14 nt, Mycobacterium avium subsp. paratuberculosis
acgugggcggccac

SEQ ID NO: 892930 - RNA, 17 nt, Mycobacterium avium subsp. paratuberculosis
acgugggucaaccggua

SEQ ID NO: 892931 - RNA, 14 nt, Mycobacterium avium subsp. paratuberculosis
acguggcggccguc

SEQ ID NO: 892932 - RNA, 16 nt, Mycobacterium avium subsp. paratuberculosis
acguggcggccgucgc

SEQ ID NO: 892933 - RNA, 19 nt, Mycobacterium avium subsp. paratuberculosis
acguggcggcgguggcgau

SEQ ID NO: 892934 - RNA, 17 nt, Mycobacterium avium subsp. paratuberculosis
acguguucucacggcga

SEQ ID NO: 892935 - RNA, 14 nt, Mycobacterium avium subsp. paratuberculosis
acguguggcacccg

SEQ ID NO: 892936 - RNA, 15 nt, Mycobacterium avium subsp. paratuberculosis
acgugugggugagca

SEQ ID NO: 892937 - RNA, 16 nt, Mycobacterium avium subsp. paratuberculosis
acgugugggugagcau

SEQ ID NO: 892938 - RNA, 22 nt, Mycobacterium avium subsp. paratuberculosis
acgugucgucgucgccgccggu

SEQ ID NO: 892939 - RNA, 14 nt, Mycobacterium avium subsp. paratuberculosis
acgugucggcgucg

SEQ ID NO: 892940 - RNA, 22 nt, Mycobacterium avium subsp. paratuberculosis
acgugguugcguucgccggcgu

SEQ ID NO: 892941 - RNA, 19 nt, Mycobacterium avium subsp. paratuberculosis
acguguacucggcgucgcc

SEQ ID NO: 892942 - RNA, 14 nt, Mycobacterium avium subsp. paratuberculosis
acguggugcaccgc

SEQ ID NO: 892943 - RNA, 17 nt, Mycobacterium avium subsp. paratuberculosis
acguggugcaccgccag

SEQ ID NO: 892944 - RNA, 13 nt, Mycobacterium avium subsp. paratuberculosis
acguggucgggca

SEQ ID NO: 892945 - RNA, 23 nt, Mycobacterium avium subsp. paratuberculosis
acgugguggaugaugccggcggu

SEQ ID NO: 892946 - RNA, 13 nt, Mycobacterium avium subsp. paratuberculosis
acguggguggccc

SEQ ID NO: 892947 - RNA, 19 nt, Mycobacterium avium subsp. paratuberculosis
acgugggugguggugccgu

SEQ ID NO: 892948 - RNA, 22 nt, Mycobacterium avium subsp. paratuberculosis
acgugggugguggugccgucgc

SEQ ID NO: 892949 - RNA, 21 nt, Mycobacterium avium subsp. paratuberculosis
acguggucgagcaugcgggug

SEQ ID NO: 892950 - RNA, 22 nt, Mycobacterium avium subsp. paratuberculosis
acuacccgccgacgccugcgcg

SEQ ID NO: 892951 - RNA, 19 nt, Mycobacterium avium subsp. paratuberculosis
acuaauccccccgcgccgc

SEQ ID NO: 892952 - RNA, 21 nt, Mycobacterium avium subsp. paratuberculosis
acguugccgaucccggccagc

SEQ ID NO: 892953 - RNA, 17 nt, Mycobacterium avium subsp. paratuberculosis
acguugccgcacaccgc

SEQ ID NO: 892954 - RNA, 18 nt, Mycobacterium avium subsp. paratuberculosis
acguugccgcacaccgcg

SEQ ID NO: 892955 - RNA, 22 nt, Mycobacterium avium subsp. paratuberculosis
acguugagcacgcccgcgaucg

SEQ ID NO: 892956 - RNA, 17 nt, Mycobacterium avium subsp. paratuberculosis
acguugaggcggcggcg

SEQ ID NO: 892957 - RNA, 20 nt, Mycobacterium avium subsp. paratuberculosis
acguugaggcggcggcgggc

SEQ ID NO: 892958 - RNA, 23 nt, Mycobacterium avium subsp. paratuberculosis
acguugaggcggcggcgggccag

SEQ ID NO: 892959 - RNA, 17 nt, Mycobacterium avium subsp. paratuberculosis
acguugaccgcgaaggu

SEQ ID NO: 892960 - RNA, 17 nt, Mycobacterium avium subsp. paratuberculosis
acguugaucgcgccgau

SEQ ID NO: 892961 - RNA, 19 nt, Mycobacterium avium subsp. paratuberculosis
acguauccgcggucgacca

SEQ ID NO: 892962 - RNA, 21 nt, Mycobacterium avium subsp. paratuberculosis
acguaucgcgccugcaccggc

SEQ ID NO: 892963 - RNA, 15 nt, Mycobacterium avium subsp. paratuberculosis
acgucacggcgagga

SEQ ID NO: 892964 - RNA, 22 nt, Mycobacterium avium subsp. paratuberculosis
acgucacgggccaggcgcgcgc

SEQ ID NO: 892965 - RNA, 13 nt, Mycobacterium avium subsp. paratuberculosis
acgucaccgcgcu

SEQ ID NO: 892966 - RNA, 14 nt, Mycobacterium avium subsp. paratuberculosis
acgucaccgcgcuu

SEQ ID NO: 892967 - RNA, 15 nt, Mycobacterium avium subsp. paratuberculosis
acgucacgacgguca

SEQ ID NO: 892968 - RNA, 16 nt, Mycobacterium avium subsp. paratuberculosis
acgucacgacggucac

SEQ ID NO: 892969 - RNA, 12 nt, Mycobacterium avium subsp. paratuberculosis
acgucaggccgu

SEQ ID NO: 892970 - RNA, 19 nt, Mycobacterium avium subsp. paratuberculosis
acgucaggccguagcggcu

SEQ ID NO: 892971 - RNA, 21 nt, Mycobacterium avium subsp. paratuberculosis
acgucaggccguagcggcucg

SEQ ID NO: 892972 - RNA, 21 nt, Mycobacterium avium subsp. paratuberculosis
acgucaggccgugcacgaaca

SEQ ID NO: 892973 - RNA, 16 nt, Mycobacterium avium subsp. paratuberculosis
acgucccgcccggcgc

SEQ ID NO: 892974 - RNA, 12 nt, Mycobacterium avium subsp. paratuberculosis
acguccgagguc

SEQ ID NO: 892975 - RNA, 20 nt, Mycobacterium avium subsp. paratuberculosis
acgucaggcccagcgaggcg

SEQ ID NO: 892976 - RNA, 13 nt, Mycobacterium avium subsp. paratuberculosis
acguccgggccgc

SEQ ID NO: 892977 - RNA, 18 nt, Mycobacterium avium subsp. paratuberculosis
acguccgggccgccucga

SEQ ID NO: 892978 - RNA, 18 nt, Mycobacterium avium subsp. paratuberculosis
acguccgccuccgaccag

SEQ ID NO: 892979 - RNA, 21 nt, Mycobacterium avium subsp. paratuberculosis
acguccgccuccgaccagccg

SEQ ID NO: 892980 - RNA, 22 nt, Mycobacterium avium subsp. paratuberculosis
acguccgcgggaauuggcaccg

SEQ ID NO: 892981 - RNA, 15 nt, Mycobacterium avium subsp. paratuberculosis
acguccgcggugagc

SEQ ID NO: 892982 - RNA, 17 nt, Mycobacterium avium subsp. paratuberculosis
acguccgcggugagcac

SEQ ID NO: 892983 - RNA, 21 nt, Mycobacterium avium subsp. paratuberculosis
acguccgcggugagcaccgga

SEQ ID NO: 892984 - RNA, 13 nt, Mycobacterium avium subsp. paratuberculosis
acguccgcgucgg

SEQ ID NO: 892985 - RNA, 15 nt, Mycobacterium avium subsp. paratuberculosis
acguccgcgucggcg

SEQ ID NO: 892986 - RNA, 18 nt, Mycobacterium avium subsp. paratuberculosis
acguccggaugcggcgcc

SEQ ID NO: 892987 - RNA, 21 nt, Mycobacterium avium subsp. paratuberculosis
acguacagcgagccgucgacc

SEQ ID NO: 892988 - RNA, 13 nt, Mycobacterium avium subsp. paratuberculosis
acguacgggcuga

SEQ ID NO: 892989 - RNA, 13 nt, Mycobacterium avium subsp. paratuberculosis
acguacgcgcuga

SEQ ID NO: 892990 - RNA, 15 nt, Mycobacterium avium subsp. paratuberculosis
acguacuggcgccgg

SEQ ID NO: 892991 - RNA, 16 nt, Mycobacterium avium subsp. paratuberculosis
acguagaaggcgccgu

SEQ ID NO: 892992 - RNA, 19 nt, Mycobacterium avium subsp. paratuberculosis
acguagaaggcgccgucgg

SEQ ID NO: 892993 - RNA, 20 nt, Mycobacterium avium subsp. paratuberculosis
acguagaaggcgccgucggu

SEQ ID NO: 892994 - RNA, 23 nt, Mycobacterium avium subsp. paratuberculosis
acguagaaggcgccgucgguggg

SEQ ID NO: 892995 - RNA, 17 nt, Mycobacterium avium subsp. paratuberculosis
acguaagccauggcggc

SEQ ID NO: 892996 - RNA, 19 nt, Mycobacterium avium subsp. paratuberculosis
acgguuuuucccagcggcc

SEQ ID NO: 892997 - RNA, 23 nt, Mycobacterium avium subsp. paratuberculosis
acgguuuuggucugcgccggcgg

SEQ ID NO: 892998 - RNA, 21 nt, Mycobacterium avium subsp. paratuberculosis
acgguuuccaccaccacccgg

SEQ ID NO: 892999 - RNA, 17 nt, Mycobacterium avium subsp. paratuberculosis
acgguuucugccggccg

SEQ ID NO: 893000 - RNA, 18 nt, Mycobacterium avium subsp. paratuberculosis
acgguuucugccggccgc

SEQ ID NO: 893001 - RNA, 17 nt, Mycobacterium avium subsp. paratuberculosis
acgguuucaccgccguc

SEQ ID NO: 893002 - RNA, 15 nt, Mycobacterium avium subsp. paratuberculosis
acgugaucuggucgg

SEQ ID NO: 893003 - RNA, 19 nt, Mycobacterium avium subsp. paratuberculosis
acgugaucuggucggccag

SEQ ID NO: 893004 - RNA, 20 nt, Mycobacterium avium subsp. paratuberculosis
acgugaucuggucggccagc

SEQ ID NO: 893005 - RNA, 23 nt, Mycobacterium avium subsp. paratuberculosis
acgugaucuggucggccagcgcg

SEQ ID NO: 893006 - RNA, 21 nt, Mycobacterium avium subsp. paratuberculosis
acgugaugagcgaggacgucg

SEQ ID NO: 893007 - RNA, 15 nt, Mycobacterium avium subsp. paratuberculosis
acgugaucgcggugg

SEQ ID NO: 893008 - RNA, 17 nt, Mycobacterium avium subsp. paratuberculosis
acgugaucggcggccug

SEQ ID NO: 893009 - RNA, 19 nt, Mycobacterium avium subsp. paratuberculosis
acgugaaacuagcuucacg

SEQ ID NO: 893010 - RNA, 19 nt, Mycobacterium avium subsp. paratuberculosis
acgugaagcuaguuucacg

SEQ ID NO: 893011 - RNA, 15 nt, Mycobacterium avium subsp. paratuberculosis
acgucuugucgggga

SEQ ID NO: 893012 - RNA, 15 nt, Mycobacterium avium subsp. paratuberculosis
acgucugggccgccg

SEQ ID NO: 893013 - RNA, 16 nt, Mycobacterium avium subsp. paratuberculosis
acgucugggccgccga

SEQ ID NO: 893014 - RNA, 15 nt, Mycobacterium avium subsp. paratuberculosis
acgucugguuggccg

SEQ ID NO: 893015 - RNA, 20 nt, Mycobacterium avium subsp. paratuberculosis
acgucugguuggccggcggg

SEQ ID NO: 893016 - RNA, 23 nt, Mycobacterium avium subsp. paratuberculosis
acgucucggguuugccgacggug

SEQ ID NO: 893017 - RNA, 19 nt, Mycobacterium avium subsp. paratuberculosis
acgucucugucgucgacca

SEQ ID NO: 893018 - RNA, 20 nt, Mycobacterium avium subsp. paratuberculosis
acgucucugucgucgaccaa

SEQ ID NO: 893019 - RNA, 24 nt, Mycobacterium avium subsp. paratuberculosis
acgucgcggcccuggaugucacgg

SEQ ID NO: 893020 - RNA, 18 nt, Mycobacterium avium subsp. paratuberculosis
acgucgcgggugaccggc

SEQ ID NO: 893021 - RNA, 21 nt, Mycobacterium avium subsp. paratuberculosis
acgucgcgggugaccggcgcc

SEQ ID NO: 893022 - RNA, 22 nt, Mycobacterium avium subsp. paratuberculosis
acgucgcgggugaccggcgccg

SEQ ID NO: 893023 - RNA, 22 nt, Mycobacterium avium subsp. paratuberculosis
acgucguuuuccagccggcgca

SEQ ID NO: 893024 - RNA, 14 nt, Mycobacterium avium subsp. paratuberculosis
acgucugcggcucg

SEQ ID NO: 893025 - RNA, 16 nt, Mycobacterium avium subsp. paratuberculosis
acgucugcggcucggc

SEQ ID NO: 893026 - RNA, 18 nt, Mycobacterium avium subsp. paratuberculosis
acgucugcggcucggcgc

SEQ ID NO: 893027 - RNA, 20 nt, Mycobacterium avium subsp. paratuberculosis
acgucugcggcucggcgcug

SEQ ID NO: 893028 - RNA, 20 nt, Mycobacterium avium subsp. paratuberculosis
acgucugcgggaagcccacc

SEQ ID NO: 893029 - RNA, 23 nt, Mycobacterium avium subsp. paratuberculosis
acgucugcgggaagcccaccgcg

SEQ ID NO: 893030 - RNA, 14 nt, Mycobacterium avium subsp. paratuberculosis
acgucugcucggcg

SEQ ID NO: 893031 - RNA, 16 nt, Mycobacterium avium subsp. paratuberculosis
acgucugcucggcggg

SEQ ID NO: 893032 - RNA, 21 nt, Mycobacterium avium subsp. paratuberculosis
acguccucgucgguccaggug

SEQ ID NO: 893033 - RNA, 22 nt, Mycobacterium avium subsp. paratuberculosis
acguccugccaguugucgaucu

SEQ ID NO: 893034 - RNA, 14 nt, Mycobacterium avium subsp. paratuberculosis
acguccucgacgau

SEQ ID NO: 893035 - RNA, 15 nt, Mycobacterium avium subsp. paratuberculosis
acguccuggcgccag

SEQ ID NO: 893036 - RNA, 21 nt, Mycobacterium avium subsp. paratuberculosis
acguccuugacccggccgcac

SEQ ID NO: 893037 - RNA, 22 nt, Mycobacterium avium subsp. paratuberculosis
acguccuugaucagcaugucgc

SEQ ID NO: 893038 - RNA, 19 nt, Mycobacterium avium subsp. paratuberculosis
acguccuuggugacggccu

SEQ ID NO: 893039 - RNA, 21 nt, Mycobacterium avium subsp. paratuberculosis
acguccuuggugacggccucc

SEQ ID NO: 893040 - RNA, 15 nt, Mycobacterium avium subsp. paratuberculosis
acgucgaagcccggg

SEQ ID NO: 893041 - RNA, 16 nt, Mycobacterium avium subsp. paratuberculosis
acgucgaagcccgggu

SEQ ID NO: 893042 - RNA, 21 nt, Mycobacterium avium subsp. paratuberculosis
acgucgaagggucggucgagc

SEQ ID NO: 893043 - RNA, 16 nt, Mycobacterium avium subsp. paratuberculosis
acgucgaccgcgacga

SEQ ID NO: 893044 - RNA, 17 nt, Mycobacterium avium subsp. paratuberculosis
acgucgaccgcgacgac

SEQ ID NO: 893045 - RNA, 16 nt, Mycobacterium avium subsp. paratuberculosis
acgucgaccgcgccgg

SEQ ID NO: 893046 - RNA, 17 nt, Mycobacterium avium subsp. paratuberculosis
acgucgaccgcgccggg

SEQ ID NO: 893047 - RNA, 17 nt, Mycobacterium avium subsp. paratuberculosis
acguccucgcccgggug

SEQ ID NO: 893048 - RNA, 16 nt, Mycobacterium avium subsp. paratuberculosis
acgucgacacgccggc

SEQ ID NO: 893049 - RNA, 18 nt, Mycobacterium avium subsp. paratuberculosis
acgucgacacgccggccg

SEQ ID NO: 893050 - RNA, 17 nt, Mycobacterium avium subsp. paratuberculosis
acgucgcgccgcucggc

SEQ ID NO: 893051 - RNA, 23 nt, Mycobacterium avium subsp. paratuberculosis
acgucgcgccgcucggccagcag

SEQ ID NO: 893052 - RNA, 13 nt, Mycobacterium avium subsp. paratuberculosis
acgucgcgcgggg

SEQ ID NO: 893053 - RNA, 20 nt, Mycobacterium avium subsp. paratuberculosis
acgucgcgcggggucgggcc

SEQ ID NO: 893054 - RNA, 18 nt, Mycobacterium avium subsp. paratuberculosis
acgucgcgcggggugacg

SEQ ID NO: 893055 - RNA, 16 nt, Mycobacterium avium subsp. paratuberculosis
acgucgcgcugccggc

SEQ ID NO: 893056 - RNA, 18 nt, Mycobacterium avium subsp. paratuberculosis
acgucgcgcugccggccc

SEQ ID NO: 893057 - RNA, 19 nt, Mycobacterium avium subsp. paratuberculosis
acgucgcgcugccggcccg

SEQ ID NO: 893058 - RNA, 13 nt, Mycobacterium avium subsp. paratuberculosis
acgucgccgccgc

SEQ ID NO: 893059 - RNA, 13 nt, Mycobacterium avium subsp. paratuberculosis
acgucgccggccu

SEQ ID NO: 893060 - RNA, 14 nt, Mycobacterium avium subsp. paratuberculosis
acgucgccggccug

SEQ ID NO: 893061 - RNA, 15 nt, Mycobacterium avium subsp. paratuberculosis
acgucgccggccugc

SEQ ID NO: 893062 - RNA, 16 nt, Mycobacterium avium subsp. paratuberculosis
acgucgccggccugcc

SEQ ID NO: 893063 - RNA, 20 nt, Mycobacterium avium subsp. paratuberculosis
acgucgccggccugcccgcc

SEQ ID NO: 893064 - RNA, 14 nt, Mycobacterium avium subsp. paratuberculosis
acgucgccggcgac

SEQ ID NO: 893065 - RNA, 17 nt, Mycobacterium avium subsp. paratuberculosis
acgucgccggcgaccgc

SEQ ID NO: 893066 - RNA, 19 nt, Mycobacterium avium subsp. paratuberculosis
acgucgcgauagggccggc

SEQ ID NO: 893067 - RNA, 17 nt, Mycobacterium avium subsp. paratuberculosis
acggcguccagcugcgc

SEQ ID NO: 893068 - RNA, 21 nt, Mycobacterium avium subsp. paratuberculosis
acggcguccagcugcgcgccg

SEQ ID NO: 893069 - RNA, 23 nt, Mycobacterium avium subsp. paratuberculosis
acggcguccagcugcgcgccggc

SEQ ID NO: 893070 - RNA, 13 nt, Mycobacterium avium subsp. paratuberculosis
acggcgucggcga

SEQ ID NO: 893071 - RNA, 14 nt, Mycobacterium avium subsp. paratuberculosis
acggcgucggcggc

SEQ ID NO: 893072 - RNA, 16 nt, Mycobacterium avium subsp. paratuberculosis
acggcgucggcggccu

SEQ ID NO: 893073 - RNA, 17 nt, Mycobacterium avium subsp. paratuberculosis
acggcgucggcggccug

SEQ ID NO: 893074 - RNA, 20 nt, Mycobacterium avium subsp. paratuberculosis
acggcgguucgaagcgcagc

SEQ ID NO: 893075 - RNA, 23 nt, Mycobacterium avium subsp. paratuberculosis
acggcgguucgaagcgcagcguc

SEQ ID NO: 893076 - RNA, 21 nt, Mycobacterium avium subsp. paratuberculosis
acggcggugacguuccagccg

SEQ ID NO: 893077 - RNA, 19 nt, Mycobacterium avium subsp. paratuberculosis
acggcuaccuaggcgucgu

SEQ ID NO: 893078 - RNA, 21 nt, Mycobacterium avium subsp. paratuberculosis
acggcuaccuaggcgucgucg

SEQ ID NO: 893079 - RNA, 20 nt, Mycobacterium avium subsp. paratuberculosis
acggcuaccugaccagcggc

SEQ ID NO: 893080 - RNA, 22 nt, Mycobacterium avium subsp. paratuberculosis
acggcuaccugaccagcggcgc

SEQ ID NO: 893081 - RNA, 20 nt, Mycobacterium avium subsp. paratuberculosis
acggcguugaccaacgccgc

SEQ ID NO: 893082 - RNA, 23 nt, Mycobacterium avium subsp. paratuberculosis
acggcguugaccaacgccgccuc

SEQ ID NO: 893083 - RNA, 15 nt, Mycobacterium avium subsp. paratuberculosis
acggcguugaccggg

SEQ ID NO: 893084 - RNA, 19 nt, Mycobacterium avium subsp. paratuberculosis
acggcguugaccgggccgc

SEQ ID NO: 893085 - RNA, 16 nt, Mycobacterium avium subsp. paratuberculosis
acggcguccgggcgcu

SEQ ID NO: 893086 - RNA, 16 nt, Mycobacterium avium subsp. paratuberculosis
acggcgucgacacccg

SEQ ID NO: 893087 - RNA, 14 nt, Mycobacterium avium subsp. paratuberculosis
acggcgucuggccg

SEQ ID NO: 893088 - RNA, 16 nt, Mycobacterium avium subsp. paratuberculosis
acggcgucuggccgga

SEQ ID NO: 893089 - RNA, 20 nt, Mycobacterium avium subsp. paratuberculosis
acggcgucuggccggagcgg

SEQ ID NO: 893090 - RNA, 19 nt, Mycobacterium avium subsp. paratuberculosis
acggcaaccugggcggcgg

SEQ ID NO: 893091 - RNA, 20 nt, Mycobacterium avium subsp. paratuberculosis
acggcaaccugggcggcggc

SEQ ID NO: 893092 - RNA, 21 nt, Mycobacterium avium subsp. paratuberculosis
acggcaaccugggcggcggcg

SEQ ID NO: 893093 - RNA, 15 nt, Mycobacterium avium subsp. paratuberculosis
acggcaacggcggcg

SEQ ID NO: 893094 - RNA, 17 nt, Mycobacterium avium subsp. paratuberculosis
acggagccgagcaccag

SEQ ID NO: 893095 - RNA, 14 nt, Mycobacterium avium subsp. paratuberculosis
acggagcgcccggc

SEQ ID NO: 893096 - RNA, 22 nt, Mycobacterium avium subsp. paratuberculosis
acggagcgcccggccagccggc

SEQ ID NO: 893097 - RNA, 18 nt, Mycobacterium avium subsp. paratuberculosis
acggagcggccuaacgag

SEQ ID NO: 893098 - RNA, 16 nt, Mycobacterium avium subsp. paratuberculosis
acggcaccaccacggu

SEQ ID NO: 893099 - RNA, 15 nt, Mycobacterium avium subsp. paratuberculosis
acggcaccagcggau

SEQ ID NO: 893100 - RNA, 23 nt, Mycobacterium avium subsp. paratuberculosis
acggcaccagcggaucggcgguc

SEQ ID NO: 893101 - RNA, 15 nt, Mycobacterium avium subsp. paratuberculosis
acggcaaugguugcg

SEQ ID NO: 893102 - RNA, 18 nt, Mycobacterium avium subsp. paratuberculosis
acggcaaugguugcggcg

SEQ ID NO: 893103 - RNA, 22 nt, Mycobacterium avium subsp. paratuberculosis
acggcaaugguugcggcgggcc

SEQ ID NO: 893104 - RNA, 20 nt, Mycobacterium avium subsp. paratuberculosis
acggcaauacggggcauccc

SEQ ID NO: 893105 - RNA, 14 nt, Mycobacterium avium subsp. paratuberculosis
acggcaauccggcc

SEQ ID NO: 893106 - RNA, 15 nt, Mycobacterium avium subsp. paratuberculosis
acggcaauccggccc

SEQ ID NO: 893107 - RNA, 17 nt, Mycobacterium avium subsp. paratuberculosis
acggcaauccggccccg

SEQ ID NO: 893108 - RNA, 14 nt, Mycobacterium avium subsp. paratuberculosis
acggcuuccgcgga

SEQ ID NO: 893109 - RNA, 17 nt, Mycobacterium avium subsp. paratuberculosis
acggcuuccgcggacgg

SEQ ID NO: 893110 - RNA, 13 nt, Mycobacterium avium subsp. paratuberculosis
acgggagacgcug

SEQ ID NO: 893111 - RNA, 13 nt, Mycobacterium avium subsp. paratuberculosis
acgggauaugcgc

SEQ ID NO: 893112 - RNA, 17 nt, Mycobacterium avium subsp. paratuberculosis
acgggauaugcgccugc

SEQ ID NO: 893113 - RNA, 13 nt, Mycobacterium avium subsp. paratuberculosis
acgggaugaucgg

SEQ ID NO: 893114 - RNA, 17 nt, Mycobacterium avium subsp. paratuberculosis
acgggaugaucggcgcc

SEQ ID NO: 893115 - RNA, 21 nt, Mycobacterium avium subsp. paratuberculosis
acggggacgcugaacagcccg

SEQ ID NO: 893116 - RNA, 13 nt, Mycobacterium avium subsp. paratuberculosis
acggggacgucgu

SEQ ID NO: 893117 - RNA, 12 nt, Mycobacterium avium subsp. paratuberculosis
acgggcugcugc

SEQ ID NO: 893118 - RNA, 19 nt, Mycobacterium avium subsp. paratuberculosis
acgggcugcugcacgucgc

SEQ ID NO: 893119 - RNA, 17 nt, Mycobacterium avium subsp. paratuberculosis
acgggcugucccggccg

SEQ ID NO: 893120 - RNA, 18 nt, Mycobacterium avium subsp. paratuberculosis
acgggcacccgcgcgucg

SEQ ID NO: 893121 - RNA, 22 nt, Mycobacterium avium subsp. paratuberculosis
acgggcacccgcgcgucgcgca

SEQ ID NO: 893122 - RNA, 18 nt, Mycobacterium avium subsp. paratuberculosis
acgggcaccgacgaggag

SEQ ID NO: 893123 - RNA, 14 nt, Mycobacterium avium subsp. paratuberculosis
acgggcagccacgc

SEQ ID NO: 893124 - RNA, 15 nt, Mycobacterium avium subsp. paratuberculosis
acgggcagccacgcg

SEQ ID NO: 893125 - RNA, 16 nt, Mycobacterium avium subsp. paratuberculosis
acgggcagccacgcgc

SEQ ID NO: 893126 - RNA, 19 nt, Mycobacterium avium subsp. paratuberculosis
acgggaucggcgcgucggc

SEQ ID NO: 893127 - RNA, 20 nt, Mycobacterium avium subsp. paratuberculosis
acgggaucggcgcgucggcg

SEQ ID NO: 893128 - RNA, 18 nt, Mycobacterium avium subsp. paratuberculosis
acgggaugcggucgauca

SEQ ID NO: 893129 - RNA, 23 nt, Mycobacterium avium subsp. paratuberculosis
acgggauggcucagcgcaccgcc

SEQ ID NO: 893130 - RNA, 16 nt, Mycobacterium avium subsp. paratuberculosis
acgggcacaccgucgu

SEQ ID NO: 893131 - RNA, 18 nt, Mycobacterium avium subsp. paratuberculosis
acgggcacaccgucgucc

SEQ ID NO: 893132 - RNA, 17 nt, Mycobacterium avium subsp. paratuberculosis
acggcucaacggccggc

SEQ ID NO: 893133 - RNA, 18 nt, Mycobacterium avium subsp. paratuberculosis
acggcucaacggccggcg

SEQ ID NO: 893134 - RNA, 19 nt, Mycobacterium avium subsp. paratuberculosis
acggcucaacggccggcgc

SEQ ID NO: 893135 - RNA, 20 nt, Mycobacterium avium subsp. paratuberculosis
acggcucaacggccggcgcc

SEQ ID NO: 893136 - RNA, 18 nt, Mycobacterium avium subsp. paratuberculosis
acggcucccaggcccauc

SEQ ID NO: 893137 - RNA, 19 nt, Mycobacterium avium subsp. paratuberculosis
acggcucccaggcccaucg

SEQ ID NO: 893138 - RNA, 17 nt, Mycobacterium avium subsp. paratuberculosis
acggcucgccgcgcauc

SEQ ID NO: 893139 - RNA, 18 nt, Mycobacterium avium subsp. paratuberculosis
acggcucgccgcgcauca

SEQ ID NO: 893140 - RNA, 23 nt, Mycobacterium avium subsp. paratuberculosis
acggcucgccgcgcaucaucgcc

SEQ ID NO: 893141 - RNA, 22 nt, Mycobacterium avium subsp. paratuberculosis
acggcucguggguggucugcug

SEQ ID NO: 893142 - RNA, 16 nt, Mycobacterium avium subsp. paratuberculosis
acggcugcugcgcggc

SEQ ID NO: 893143 - RNA, 17 nt, Mycobacterium avium subsp. paratuberculosis
acggcugcugcgcggca

SEQ ID NO: 893144 - RNA, 20 nt, Mycobacterium avium subsp. paratuberculosis
acggcuggaaucccgccucg

SEQ ID NO: 893145 - RNA, 19 nt, Mycobacterium avium subsp. paratuberculosis
acggcugcgguuggccggc

SEQ ID NO: 893146 - RNA, 23 nt, Mycobacterium avium subsp. paratuberculosis
acggcugccgaccucgauggcga

SEQ ID NO: 893147 - RNA, 23 nt, Mycobacterium avium subsp. paratuberculosis
acggcucggucaagccggccagc

SEQ ID NO: 893148 - RNA, 19 nt, Mycobacterium avium subsp. paratuberculosis
acggcucuucgcggcgggg

SEQ ID NO: 893149 - RNA, 15 nt, Mycobacterium avium subsp. paratuberculosis
acggcucuucggcgc

SEQ ID NO: 893150 - RNA, 19 nt, Mycobacterium avium subsp. paratuberculosis
acggcucuucggcgccgag

SEQ ID NO: 893151 - RNA, 20 nt, Mycobacterium avium subsp. paratuberculosis
acggcucuucggcgccgagc

SEQ ID NO: 893152 - RNA, 15 nt, Mycobacterium avium subsp. paratuberculosis
acggcugcccggccc

SEQ ID NO: 893153 - RNA, 18 nt, Mycobacterium avium subsp. paratuberculosis
acggcugcccggcccgcc

SEQ ID NO: 893154 - RNA, 19 nt, Mycobacterium avium subsp. paratuberculosis
acggcugcccggcccgccg

SEQ ID NO: 893155 - RNA, 19 nt, Mycobacterium avium subsp. paratuberculosis
acggugcgugccagcagcu

SEQ ID NO: 893156 - RNA, 16 nt, Mycobacterium avium subsp. paratuberculosis
acggugcuggcgaugu

SEQ ID NO: 893157 - RNA, 14 nt, Mycobacterium avium subsp. paratuberculosis
acgguggacccgac

SEQ ID NO: 893158 - RNA, 13 nt, Mycobacterium avium subsp. paratuberculosis
acgguggccgcga

SEQ ID NO: 893159 - RNA, 20 nt, Mycobacterium avium subsp. paratuberculosis
acgguggcgggccgccgggu

SEQ ID NO: 893160 - RNA, 17 nt, Mycobacterium avium subsp. paratuberculosis
acgguggcgccggcauc

SEQ ID NO: 893161 - RNA, 14 nt, Mycobacterium avium subsp. paratuberculosis
acgguggcgcccag

SEQ ID NO: 893162 - RNA, 12 nt, Mycobacterium avium subsp. paratuberculosis
acgguggccgcc

SEQ ID NO: 893163 - RNA, 20 nt, Mycobacterium avium subsp. paratuberculosis
acgguggccgccaccaacau

SEQ ID NO: 893164 - RNA, 15 nt, Mycobacterium avium subsp. paratuberculosis
acgguggccgucucg

SEQ ID NO: 893165 - RNA, 16 nt, Mycobacterium avium subsp. paratuberculosis
acgguggccucggcgc

SEQ ID NO: 893166 - RNA, 20 nt, Mycobacterium avium subsp. paratuberculosis
acgguggcguccagcggguu

SEQ ID NO: 893167 - RNA, 15 nt, Mycobacterium avium subsp. paratuberculosis
acggugggcgccggg

SEQ ID NO: 893168 - RNA, 16 nt, Mycobacterium avium subsp. paratuberculosis
acggugggcgccgggu

SEQ ID NO: 893169 - RNA, 17 nt, Mycobacterium avium subsp. paratuberculosis
acggugggcgccggguc

SEQ ID NO: 893170 - RNA, 15 nt, Mycobacterium avium subsp. paratuberculosis
acggugggcccgccg

SEQ ID NO: 893171 - RNA, 17 nt, Mycobacterium avium subsp. paratuberculosis
acggugggcccgccguc

SEQ ID NO: 893172 - RNA, 22 nt, Mycobacterium avium subsp. paratuberculosis
acggugggcccgccgucgacca

SEQ ID NO: 893173 - RNA, 21 nt, Mycobacterium avium subsp. paratuberculosis
acgguguagacgcgggccggc

SEQ ID NO: 893174 - RNA, 22 nt, Mycobacterium avium subsp. paratuberculosis
acgguguugcgcacccgcgggu

SEQ ID NO: 893175 - RNA, 17 nt, Mycobacterium avium subsp. paratuberculosis
acgguguuguucaccgg

SEQ ID NO: 893176 - RNA, 15 nt, Mycobacterium avium subsp. paratuberculosis
acgguguagcggcgg

SEQ ID NO: 893177 - RNA, 17 nt, Mycobacterium avium subsp. paratuberculosis
acgguguaggacgccgu

SEQ ID NO: 893178 - RNA, 14 nt, Mycobacterium avium subsp. paratuberculosis
acggugggacggcg

SEQ ID NO: 893179 - RNA, 14 nt, Mycobacterium avium subsp. paratuberculosis
acgguguccgcggc

SEQ ID NO: 893180 - RNA, 12 nt, Mycobacterium avium subsp. paratuberculosis
acggugucgaua

SEQ ID NO: 893181 - RNA, 21 nt, Mycobacterium avium subsp. paratuberculosis
acggugucgcuguaggccagc

SEQ ID NO: 893182 - RNA, 17 nt, Mycobacterium avium subsp. paratuberculosis
acgguugccucggccag

SEQ ID NO: 893183 - RNA, 14 nt, Mycobacterium avium subsp. paratuberculosis
acgguuggccggcc

SEQ ID NO: 893184 - RNA, 16 nt, Mycobacterium avium subsp. paratuberculosis
acgguuggccggcccg

SEQ ID NO: 893185 - RNA, 21 nt, Mycobacterium avium subsp. paratuberculosis
acgguuggccggcccgcccgu

SEQ ID NO: 893186 - RNA, 23 nt, Mycobacterium avium subsp. paratuberculosis
acgguuggccggcccgcccguag

SEQ ID NO: 893187 - RNA, 15 nt, Mycobacterium avium subsp. paratuberculosis
acgguucggccgcuc

SEQ ID NO: 893188 - RNA, 18 nt, Mycobacterium avium subsp. paratuberculosis
acgguucggccgcucggg

SEQ ID NO: 893189 - RNA, 20 nt, Mycobacterium avium subsp. paratuberculosis
acgguucgggaaccuggccg

SEQ ID NO: 893190 - RNA, 22 nt, Mycobacterium avium subsp. paratuberculosis
acgggguucaguagcagcgucu

SEQ ID NO: 893191 - RNA, 19 nt, Mycobacterium avium subsp. paratuberculosis
acgggggaguagcgcgcga

SEQ ID NO: 893192 - RNA, 14 nt, Mycobacterium avium subsp. paratuberculosis
acgggggugccgac

SEQ ID NO: 893193 - RNA, 16 nt, Mycobacterium avium subsp. paratuberculosis
acgggggugccgaccg

SEQ ID NO: 893194 - RNA, 22 nt, Mycobacterium avium subsp. paratuberculosis
acgggggugccgaccgcguguc

SEQ ID NO: 893195 - RNA, 18 nt, Mycobacterium avium subsp. paratuberculosis
acggggcgaugccgacac

SEQ ID NO: 893196 - RNA, 22 nt, Mycobacterium avium subsp. paratuberculosis
acggggcgaugccgacacccca

SEQ ID NO: 893197 - RNA, 17 nt, Mycobacterium avium subsp. paratuberculosis
acggggcgccgcugcgg

SEQ ID NO: 893198 - RNA, 14 nt, Mycobacterium avium subsp. paratuberculosis
acggggcuauccgg

SEQ ID NO: 893199 - RNA, 18 nt, Mycobacterium avium subsp. paratuberculosis
acggguccuugccggcgg

SEQ ID NO: 893200 - RNA, 16 nt, Mycobacterium avium subsp. paratuberculosis
acgggucgaccgccgc

SEQ ID NO: 893201 - RNA, 18 nt, Mycobacterium avium subsp. paratuberculosis
acgggucgaccgccgcgu

SEQ ID NO: 893202 - RNA, 18 nt, Mycobacterium avium subsp. paratuberculosis
acggucacggccgccagc

SEQ ID NO: 893203 - RNA, 19 nt, Mycobacterium avium subsp. paratuberculosis
acggguaggugcccggguc

SEQ ID NO: 893204 - RNA, 19 nt, Mycobacterium avium subsp. paratuberculosis
acggguagugcacggacag

SEQ ID NO: 893205 - RNA, 13 nt, Mycobacterium avium subsp. paratuberculosis
acggucagcgcgc

SEQ ID NO: 893206 - RNA, 13 nt, Mycobacterium avium subsp. paratuberculosis
acggucagcgcgu

SEQ ID NO: 893207 - RNA, 18 nt, Mycobacterium avium subsp. paratuberculosis
acggucagcgcgucggcg

SEQ ID NO: 893208 - RNA, 16 nt, Mycobacterium avium subsp. paratuberculosis
acggucaugccgagcc

SEQ ID NO: 893209 - RNA, 18 nt, Mycobacterium avium subsp. paratuberculosis
acggucaugccgagccgc

SEQ ID NO: 893210 - RNA, 16 nt, Mycobacterium avium subsp. paratuberculosis
acggucagcggccagc

SEQ ID NO: 893211 - RNA, 23 nt, Mycobacterium avium subsp. paratuberculosis
acggucagcucgcgcccggccag

SEQ ID NO: 893212 - RNA, 15 nt, Mycobacterium avium subsp. paratuberculosis
acggucagccgcggc

SEQ ID NO: 893213 - RNA, 16 nt, Mycobacterium avium subsp. paratuberculosis
acggucagccgcggcu

SEQ ID NO: 893214 - RNA, 13 nt, Mycobacterium avium subsp. paratuberculosis
acggucaggcgca

SEQ ID NO: 893215 - RNA, 17 nt, Mycobacterium avium subsp. paratuberculosis
acggucaggcgcagcca

SEQ ID NO: 893216 - RNA, 22 nt, Mycobacterium avium subsp. paratuberculosis
acggucccguccaucgccgcgc

SEQ ID NO: 893217 - RNA, 15 nt, Mycobacterium avium subsp. paratuberculosis
acgguccccgcgccc

SEQ ID NO: 893218 - RNA, 14 nt, Mycobacterium avium subsp. paratuberculosis
acggugaucgccgg

SEQ ID NO: 893219 - RNA, 18 nt, Mycobacterium avium subsp. paratuberculosis
acggugaucucgccgagc

SEQ ID NO: 893220 - RNA, 16 nt, Mycobacterium avium subsp. paratuberculosis
acggucgcaccgcggc

SEQ ID NO: 893221 - RNA, 17 nt, Mycobacterium avium subsp. paratuberculosis
acggucgcaccgcggcg

SEQ ID NO: 893222 - RNA, 12 nt, Mycobacterium avium subsp. paratuberculosis
acggucgccgac

SEQ ID NO: 893223 - RNA, 15 nt, Mycobacterium avium subsp. paratuberculosis
acggugaugucgccg

SEQ ID NO: 893224 - RNA, 17 nt, Mycobacterium avium subsp. paratuberculosis
acggugaugucgccggc

SEQ ID NO: 893225 - RNA, 19 nt, Mycobacterium avium subsp. paratuberculosis
acggugauuccggcacccg

SEQ ID NO: 893226 - RNA, 20 nt, Mycobacterium avium subsp. paratuberculosis
acggugauuccggcacccgc

SEQ ID NO: 893227 - RNA, 22 nt, Mycobacterium avium subsp. paratuberculosis
acggugauuccggcacccgcca

SEQ ID NO: 893228 - RNA, 12 nt, Mycobacterium avium subsp. paratuberculosis
acggugccgagu

SEQ ID NO: 893229 - RNA, 13 nt, Mycobacterium avium subsp. paratuberculosis
acggugcggccuc

SEQ ID NO: 893230 - RNA, 15 nt, Mycobacterium avium subsp. paratuberculosis
acggugcgcaccgac

SEQ ID NO: 893231 - RNA, 22 nt, Mycobacterium avium subsp. paratuberculosis
acggugcgcccgucgucgccga

SEQ ID NO: 893232 - RNA, 13 nt, Mycobacterium avium subsp. paratuberculosis
acggugcgccggc

SEQ ID NO: 893233 - RNA, 14 nt, Mycobacterium avium subsp. paratuberculosis
acggugccgccguc

SEQ ID NO: 893234 - RNA, 20 nt, Mycobacterium avium subsp. paratuberculosis
acggugccgccgugcgcggc

SEQ ID NO: 893235 - RNA, 21 nt, Mycobacterium avium subsp. paratuberculosis
acggugccgccgugcgcggcg

SEQ ID NO: 893236 - RNA, 23 nt, Mycobacterium avium subsp. paratuberculosis
acggugccgccgugcgcggcgac

SEQ ID NO: 893237 - RNA, 15 nt, Mycobacterium avium subsp. paratuberculosis
acggugcccgcagca

SEQ ID NO: 893238 - RNA, 15 nt, Mycobacterium avium subsp. paratuberculosis
acggugcccgccgau

SEQ ID NO: 893239 - RNA, 21 nt, Mycobacterium avium subsp. paratuberculosis
acggugcccgccgaucgauca

SEQ ID NO: 893240 - RNA, 16 nt, Mycobacterium avium subsp. paratuberculosis
acggugcccgccgcga

SEQ ID NO: 893241 - RNA, 21 nt, Mycobacterium avium subsp. paratuberculosis
acggugcccgucggcaacgcc

SEQ ID NO: 893242 - RNA, 18 nt, Mycobacterium avium subsp. paratuberculosis
acggucgaccucgagcgu

SEQ ID NO: 893243 - RNA, 16 nt, Mycobacterium avium subsp. paratuberculosis
acggugcacacgccga

SEQ ID NO: 893244 - RNA, 15 nt, Mycobacterium avium subsp. paratuberculosis
acggugcagccgggg

SEQ ID NO: 893245 - RNA, 22 nt, Mycobacterium avium subsp. paratuberculosis
acgaguggucggccgcccacgu

SEQ ID NO: 893246 - RNA, 17 nt, Mycobacterium avium subsp. paratuberculosis
acgaggugaacgccgca

SEQ ID NO: 893247 - RNA, 14 nt, Mycobacterium avium subsp. paratuberculosis
acgaggugaccggc

SEQ ID NO: 893248 - RNA, 19 nt, Mycobacterium avium subsp. paratuberculosis
acgaggugaugccguccag

SEQ ID NO: 893249 - RNA, 18 nt, Mycobacterium avium subsp. paratuberculosis
acgaggggcagcagcgcc

SEQ ID NO: 893250 - RNA, 20 nt, Mycobacterium avium subsp. paratuberculosis
acgaggggcagcagcgccca

SEQ ID NO: 893251 - RNA, 22 nt, Mycobacterium avium subsp. paratuberculosis
acgaguuucccgucgucgaugc

SEQ ID NO: 893252 - RNA, 13 nt, Mycobacterium avium subsp. paratuberculosis
acgagaaggcggc

SEQ ID NO: 893253 - RNA, 14 nt, Mycobacterium avium subsp. paratuberculosis
acgagaaggcggcg

SEQ ID NO: 893254 - RNA, 23 nt, Mycobacterium avium subsp. paratuberculosis
acgagaucgguuggcucgcagau

SEQ ID NO: 893255 - RNA, 23 nt, Mycobacterium avium subsp. paratuberculosis
acgagagcggaucggcggcgacg

SEQ ID NO: 893256 - RNA, 13 nt, Mycobacterium avium subsp. paratuberculosis
acgaggccgacgu

SEQ ID NO: 893257 - RNA, 19 nt, Mycobacterium avium subsp. paratuberculosis
acgaggccagggcccgcag

SEQ ID NO: 893258 - RNA, 20 nt, Mycobacterium avium subsp. paratuberculosis
acgaggccagggcccgcagc

SEQ ID NO: 893259 - RNA, 22 nt, Mycobacterium avium subsp. paratuberculosis
acgaggccagggcccgcagccg

SEQ ID NO: 893260 - RNA, 16 nt, Mycobacterium avium subsp. paratuberculosis
acgaggcccggacggc

SEQ ID NO: 893261 - RNA, 14 nt, Mycobacterium avium subsp. paratuberculosis
acgagcacccagaa

SEQ ID NO: 893262 - RNA, 17 nt, Mycobacterium avium subsp. paratuberculosis
acgagcagacccgccgc

SEQ ID NO: 893263 - RNA, 13 nt, Mycobacterium avium subsp. paratuberculosis
acgagcagccgau

SEQ ID NO: 893264 - RNA, 16 nt, Mycobacterium avium subsp. paratuberculosis
acgaggccgcgccgug

SEQ ID NO: 893265 - RNA, 22 nt, Mycobacterium avium subsp. paratuberculosis
acgaggccgcgccgugcgccag

SEQ ID NO: 893266 - RNA, 18 nt, Mycobacterium avium subsp. paratuberculosis
acgaggccgggcuggcgc

SEQ ID NO: 893267 - RNA, 19 nt, Mycobacterium avium subsp. paratuberculosis
acgaggcgaguaaggccga

SEQ ID NO: 893268 - RNA, 22 nt, Mycobacterium avium subsp. paratuberculosis
acgaggcgggugaggacgcccg

SEQ ID NO: 893269 - RNA, 18 nt, Mycobacterium avium subsp. paratuberculosis
acgaggcgugcagcccgc

SEQ ID NO: 893270 - RNA, 20 nt, Mycobacterium avium subsp. paratuberculosis
acgaggcgugcagcccgcau

SEQ ID NO: 893271 - RNA, 18 nt, Mycobacterium avium subsp. paratuberculosis
acgaggcugugggccagc

SEQ ID NO: 893272 - RNA, 22 nt, Mycobacterium avium subsp. paratuberculosis
acgaggcugugggccagcagcg

SEQ ID NO: 893273 - RNA, 16 nt, Mycobacterium avium subsp. paratuberculosis
acgacaucaccaccgc

SEQ ID NO: 893274 - RNA, 20 nt, Mycobacterium avium subsp. paratuberculosis
acgacauccagaugcccagc

SEQ ID NO: 893275 - RNA, 13 nt, Mycobacterium avium subsp. paratuberculosis
acgacauccccgc

SEQ ID NO: 893276 - RNA, 21 nt, Mycobacterium avium subsp. paratuberculosis
acgacacguggaccgagcgcg

SEQ ID NO: 893277 - RNA, 14 nt, Mycobacterium avium subsp. paratuberculosis
acgaagcggccggg

SEQ ID NO: 893278 - RNA, 15 nt, Mycobacterium avium subsp. paratuberculosis
acgaagcgggcggcg

SEQ ID NO: 893279 - RNA, 17 nt, Mycobacterium avium subsp. paratuberculosis
acgaagcgggcggcgaa

SEQ ID NO: 893280 - RNA, 22 nt, Mycobacterium avium subsp. paratuberculosis
acgacaccacggucgccgcgcc

SEQ ID NO: 893281 - RNA, 14 nt, Mycobacterium avium subsp. paratuberculosis
acgacaccgacgac

SEQ ID NO: 893282 - RNA, 16 nt, Mycobacterium avium subsp. paratuberculosis
acgaaggugcgcacga

SEQ ID NO: 893283 - RNA, 15 nt, Mycobacterium avium subsp. paratuberculosis
acgaagggcgccagc

SEQ ID NO: 893284 - RNA, 16 nt, Mycobacterium avium subsp. paratuberculosis
acgaaggccgccgggu

SEQ ID NO: 893285 - RNA, 15 nt, Mycobacterium avium subsp. paratuberculosis
acgacuucggccucg

SEQ ID NO: 893286 - RNA, 17 nt, Mycobacterium avium subsp. paratuberculosis
acgacuucacaggccgc

SEQ ID NO: 893287 - RNA, 20 nt, Mycobacterium avium subsp. paratuberculosis
acgacuucacaggccgccuc

SEQ ID NO: 893288 - RNA, 17 nt, Mycobacterium avium subsp. paratuberculosis
acgacguccgggccgcc

SEQ ID NO: 893289 - RNA, 11 nt, Mycobacterium avium subsp. paratuberculosis
acgacgucgac

SEQ ID NO: 893290 - RNA, 12 nt, Mycobacterium avium subsp. paratuberculosis
acgacgucgacc

SEQ ID NO: 893291 - RNA, 17 nt, Mycobacterium avium subsp. paratuberculosis
acgacgucgaccgcgcc

SEQ ID NO: 893292 - RNA, 15 nt, Mycobacterium avium subsp. paratuberculosis
acgacgucgacgacc

SEQ ID NO: 893293 - RNA, 17 nt, Mycobacterium avium subsp. paratuberculosis
acgacguacccccgcac

SEQ ID NO: 893294 - RNA, 23 nt, Mycobacterium avium subsp. paratuberculosis
acgacggggaacucggugaugcc

SEQ ID NO: 893295 - RNA, 16 nt, Mycobacterium avium subsp. paratuberculosis
acgacggucaccggca

SEQ ID NO: 893296 - RNA, 19 nt, Mycobacterium avium subsp. paratuberculosis
acgacggucaccggcaggc

SEQ ID NO: 893297 - RNA, 17 nt, Mycobacterium avium subsp. paratuberculosis
acgacggucacggccgc

SEQ ID NO: 893298 - RNA, 20 nt, Mycobacterium avium subsp. paratuberculosis
acgacggucacggccgccag

SEQ ID NO: 893299 - RNA, 22 nt, Mycobacterium avium subsp. paratuberculosis
acgacggucacggccgccagca

SEQ ID NO: 893300 - RNA, 19 nt, Mycobacterium avium subsp. paratuberculosis
acgacggucuucccgccgc

SEQ ID NO: 893301 - RNA, 15 nt, Mycobacterium avium subsp. paratuberculosis
acgacggugcgcccg

SEQ ID NO: 893302 - RNA, 15 nt, Mycobacterium avium subsp. paratuberculosis
acgacggccaccgcg

SEQ ID NO: 893303 - RNA, 16 nt, Mycobacterium avium subsp. paratuberculosis
acgacggccaccgcga

SEQ ID NO: 893304 - RNA, 17 nt, Mycobacterium avium subsp. paratuberculosis
acgacggccaccgcgac

SEQ ID NO: 893305 - RNA, 20 nt, Mycobacterium avium subsp. paratuberculosis
acgacggccaccgcgacgcu

SEQ ID NO: 893306 - RNA, 12 nt, Mycobacterium avium subsp. paratuberculosis
acgacggcgccg

SEQ ID NO: 893307 - RNA, 15 nt, Mycobacterium avium subsp. paratuberculosis
acgacggcgccgccc

SEQ ID NO: 893308 - RNA, 18 nt, Mycobacterium avium subsp. paratuberculosis
acgacggcgccgcccggg

SEQ ID NO: 893309 - RNA, 19 nt, Mycobacterium avium subsp. paratuberculosis
acgacggcgccgcccgggc

SEQ ID NO: 893310 - RNA, 20 nt, Mycobacterium avium subsp. paratuberculosis
acgacggcgccgcccgggcc

SEQ ID NO: 893311 - RNA, 15 nt, Mycobacterium avium subsp. paratuberculosis
acgacggcgccgcgu

SEQ ID NO: 893312 - RNA, 11 nt, Mycobacterium avium subsp. paratuberculosis
acgacggcggg

SEQ ID NO: 893313 - RNA, 15 nt, Mycobacterium avium subsp. paratuberculosis
acgacaucucgacgg

SEQ ID NO: 893314 - RNA, 18 nt, Mycobacterium avium subsp. paratuberculosis
acgacaucucgacgguga

SEQ ID NO: 893315 - RNA, 23 nt, Mycobacterium avium subsp. paratuberculosis
acgacaucucgacggugaccggc

SEQ ID NO: 893316 - RNA, 15 nt, Mycobacterium avium subsp. paratuberculosis
accguuuucggcgcg

SEQ ID NO: 893317 - RNA, 16 nt, Mycobacterium avium subsp. paratuberculosis
accguuuucggcgcgc

SEQ ID NO: 893318 - RNA, 18 nt, Mycobacterium avium subsp. paratuberculosis
accguuuucggcgcgcag

SEQ ID NO: 893319 - RNA, 20 nt, Mycobacterium avium subsp. paratuberculosis
accguuuucggcgcgcagcu

SEQ ID NO: 893320 - RNA, 18 nt, Mycobacterium avium subsp. paratuberculosis
accuggugcucgcgcucg

SEQ ID NO: 893321 - RNA, 20 nt, Mycobacterium avium subsp. paratuberculosis
accuggucgggguggaucgc

SEQ ID NO: 893322 - RNA, 23 nt, Mycobacterium avium subsp. paratuberculosis
accuggucgggguggaucgccca

SEQ ID NO: 893323 - RNA, 15 nt, Mycobacterium avium subsp. paratuberculosis
accuggucggucagc

SEQ ID NO: 893324 - RNA, 16 nt, Mycobacterium avium subsp. paratuberculosis
accuggucgccgccgu

SEQ ID NO: 893325 - RNA, 21 nt, Mycobacterium avium subsp. paratuberculosis
accguugucucggcgccgucg

SEQ ID NO: 893326 - RNA, 14 nt, Mycobacterium avium subsp. paratuberculosis
accguuggccugcg

SEQ ID NO: 893327 - RNA, 21 nt, Mycobacterium avium subsp. paratuberculosis
accguugacgaccuugucgcg

SEQ ID NO: 893328 - RNA, 12 nt, Mycobacterium avium subsp. paratuberculosis
accguugcgccc

SEQ ID NO: 893329 - RNA, 18 nt, Mycobacterium avium subsp. paratuberculosis
accuucggagacguggcg

SEQ ID NO: 893330 - RNA, 16 nt, Mycobacterium avium subsp. paratuberculosis
accuucgagccgccgc

SEQ ID NO: 893331 - RNA, 19 nt, Mycobacterium avium subsp. paratuberculosis
accugguucucccgucgcg

SEQ ID NO: 893332 - RNA, 21 nt, Mycobacterium avium subsp. paratuberculosis
accugguucucccgucgcgac

SEQ ID NO: 893333 - RNA, 22 nt, Mycobacterium avium subsp. paratuberculosis
accugguugaacggcaccccgc

SEQ ID NO: 893334 - RNA, 15 nt, Mycobacterium avium subsp. paratuberculosis
accugguugccgccc

SEQ ID NO: 893335 - RNA, 20 nt, Mycobacterium avium subsp. paratuberculosis
accugguugccgcccucggc

SEQ ID NO: 893336 - RNA, 18 nt, Mycobacterium avium subsp. paratuberculosis
accugguuggcccgcacc

SEQ ID NO: 893337 - RNA, 22 nt, Mycobacterium avium subsp. paratuberculosis
accugguuggcccgcaccaccc

SEQ ID NO: 893338 - RNA, 17 nt, Mycobacterium avium subsp. paratuberculosis
accugguuggcgacagg

SEQ ID NO: 893339 - RNA, 20 nt, Mycobacterium avium subsp. paratuberculosis
accuugaccaccgagccggg

SEQ ID NO: 893340 - RNA, 22 nt, Mycobacterium avium subsp. paratuberculosis
accuugaccaccgagccgggca

SEQ ID NO: 893341 - RNA, 18 nt, Mycobacterium avium subsp. paratuberculosis
accuugaucggccccuug

SEQ ID NO: 893342 - RNA, 16 nt, Mycobacterium avium subsp. paratuberculosis
accuugaucucgucgc

SEQ ID NO: 893343 - RNA, 21 nt, Mycobacterium avium subsp. paratuberculosis
accuugaucucgucgcggcug

SEQ ID NO: 893344 - RNA, 16 nt, Mycobacterium avium subsp. paratuberculosis
acgaaaccgcguggcg

SEQ ID NO: 893345 - RNA, 21 nt, Mycobacterium avium subsp. paratuberculosis
acgaacgccaccacggcgucg

SEQ ID NO: 893346 - RNA, 23 nt, Mycobacterium avium subsp. paratuberculosis
acgaacgccaccacggcgucgcu

SEQ ID NO: 893347 - RNA, 13 nt, Mycobacterium avium subsp. paratuberculosis
acgaacgcggccg

SEQ ID NO: 893348 - RNA, 15 nt, Mycobacterium avium subsp. paratuberculosis
acgaacgcggcgaac

SEQ ID NO: 893349 - RNA, 14 nt, Mycobacterium avium subsp. paratuberculosis
acgaacgcggcgcc

SEQ ID NO: 893350 - RNA, 21 nt, Mycobacterium avium subsp. paratuberculosis
acgaacgcguucgucggcgcg

SEQ ID NO: 893351 - RNA, 16 nt, Mycobacterium avium subsp. paratuberculosis
acgaaccauucguggc

SEQ ID NO: 893352 - RNA, 22 nt, Mycobacterium avium subsp. paratuberculosis
acgaaauugggcugggucacca

SEQ ID NO: 893353 - RNA, 13 nt, Mycobacterium avium subsp. paratuberculosis
acgaacaccacgu

SEQ ID NO: 893354 - RNA, 13 nt, Mycobacterium avium subsp. paratuberculosis
acgaacaccggcg

SEQ ID NO: 893355 - RNA, 15 nt, Mycobacterium avium subsp. paratuberculosis
acgaacaccggcgcg

SEQ ID NO: 893356 - RNA, 14 nt, Mycobacterium avium subsp. paratuberculosis
acgaacaccggcgg

SEQ ID NO: 893357 - RNA, 17 nt, Mycobacterium avium subsp. paratuberculosis
acgaagaugcgcccggu

SEQ ID NO: 893358 - RNA, 17 nt, Mycobacterium avium subsp. paratuberculosis
acgaagaucccgcuggc

SEQ ID NO: 893359 - RNA, 18 nt, Mycobacterium avium subsp. paratuberculosis
acgaacgcuuccagcacc

SEQ ID NO: 893360 - RNA, 13 nt, Mycobacterium avium subsp. paratuberculosis
acgaacggcgcga

SEQ ID NO: 893361 - RNA, 15 nt, Mycobacterium avium subsp. paratuberculosis
acgaacuccgcgcgc

SEQ ID NO: 893362 - RNA, 14 nt, Mycobacterium avium subsp. paratuberculosis
acgaacgacgcggc

SEQ ID NO: 893363 - RNA, 14 nt, Mycobacterium avium subsp. paratuberculosis
acgaagaccggguc

SEQ ID NO: 893364 - RNA, 18 nt, Mycobacterium avium subsp. paratuberculosis
acgauggcgaccgcgcag

SEQ ID NO: 893365 - RNA, 20 nt, Mycobacterium avium subsp. paratuberculosis
acgauggcgaccgcgcaggc

SEQ ID NO: 893366 - RNA, 15 nt, Mycobacterium avium subsp. paratuberculosis
acgauugucggggcc

SEQ ID NO: 893367 - RNA, 23 nt, Mycobacterium avium subsp. paratuberculosis
acgauggccaggcccagcccggc

SEQ ID NO: 893368 - RNA, 22 nt, Mycobacterium avium subsp. paratuberculosis
acgauggcccggaccgccgcgg

SEQ ID NO: 893369 - RNA, 16 nt, Mycobacterium avium subsp. paratuberculosis
acgaugcugucgcggg

SEQ ID NO: 893370 - RNA, 12 nt, Mycobacterium avium subsp. paratuberculosis
acgaugcggccg

SEQ ID NO: 893371 - RNA, 19 nt, Mycobacterium avium subsp. paratuberculosis
acgaugcggccggcgggca

SEQ ID NO: 893372 - RNA, 18 nt, Mycobacterium avium subsp. paratuberculosis
acgaugcggccguuggcc

SEQ ID NO: 893373 - RNA, 13 nt, Mycobacterium avium subsp. paratuberculosis
acgaugcggggcc

SEQ ID NO: 893374 - RNA, 20 nt, Mycobacterium avium subsp. paratuberculosis
acgaugcggggccggcggcg

SEQ ID NO: 893375 - RNA, 17 nt, Mycobacterium avium subsp. paratuberculosis
acgcaacagggccaccg

SEQ ID NO: 893376 - RNA, 22 nt, Mycobacterium avium subsp. paratuberculosis
acgauuuccgguuccucggcgu

SEQ ID NO: 893377 - RNA, 15 nt, Mycobacterium avium subsp. paratuberculosis
acgcaaaagccccgc

SEQ ID NO: 893378 - RNA, 17 nt, Mycobacterium avium subsp. paratuberculosis
acgcacucgguguggcc

SEQ ID NO: 893379 - RNA, 14 nt, Mycobacterium avium subsp. paratuberculosis
acgcacgggcggcg

SEQ ID NO: 893380 - RNA, 15 nt, Mycobacterium avium subsp. paratuberculosis
acgcacgggcggcgg

SEQ ID NO: 893381 - RNA, 22 nt, Mycobacterium avium subsp. paratuberculosis
acgcacggcgaacggccgcgau

SEQ ID NO: 893382 - RNA, 12 nt, Mycobacterium avium subsp. paratuberculosis
acgcacgucggc

SEQ ID NO: 893383 - RNA, 15 nt, Mycobacterium avium subsp. paratuberculosis
acgcagcggcgucac

SEQ ID NO: 893384 - RNA, 16 nt, Mycobacterium avium subsp. paratuberculosis
acgcaccucggccggg

SEQ ID NO: 893385 - RNA, 17 nt, Mycobacterium avium subsp. paratuberculosis
acgcaccucggccgggu

SEQ ID NO: 893386 - RNA, 16 nt, Mycobacterium avium subsp. paratuberculosis
acgcacgaaaccgcgu

SEQ ID NO: 893387 - RNA, 17 nt, Mycobacterium avium subsp. paratuberculosis
acgcacgaaaccgcgug

SEQ ID NO: 893388 - RNA, 13 nt, Mycobacterium avium subsp. paratuberculosis
acgcacgccggcg

SEQ ID NO: 893389 - RNA, 15 nt, Mycobacterium avium subsp. paratuberculosis
acgcacgccggcggg

SEQ ID NO: 893390 - RNA, 17 nt, Mycobacterium avium subsp. paratuberculosis
acgcaagaagucggugu

SEQ ID NO: 893391 - RNA, 14 nt, Mycobacterium avium subsp. paratuberculosis
acgaucaccccgac

SEQ ID NO: 893392 - RNA, 20 nt, Mycobacterium avium subsp. paratuberculosis
acgauaucggccgcggggcc

SEQ ID NO: 893393 - RNA, 17 nt, Mycobacterium avium subsp. paratuberculosis
acgauccacagcgcgaa

SEQ ID NO: 893394 - RNA, 17 nt, Mycobacterium avium subsp. paratuberculosis
acgaucccagacccagc

SEQ ID NO: 893395 - RNA, 23 nt, Mycobacterium avium subsp. paratuberculosis
acgaucccagacccagcaucgcc

SEQ ID NO: 893396 - RNA, 15 nt, Mycobacterium avium subsp. paratuberculosis
acgaucagcgcgucg

SEQ ID NO: 893397 - RNA, 21 nt, Mycobacterium avium subsp. paratuberculosis
acgaucaccuuguugcgggcg

SEQ ID NO: 893398 - RNA, 13 nt, Mycobacterium avium subsp. paratuberculosis
acgaucaccacca

SEQ ID NO: 893399 - RNA, 21 nt, Mycobacterium avium subsp. paratuberculosis
acgaucagcacgucgcggccc

SEQ ID NO: 893400 - RNA, 22 nt, Mycobacterium avium subsp. paratuberculosis
acgaucagcacgucgcggcccu

SEQ ID NO: 893401 - RNA, 15 nt, Mycobacterium avium subsp. paratuberculosis
acgaugaugcccccg

SEQ ID NO: 893402 - RNA, 17 nt, Mycobacterium avium subsp. paratuberculosis
acgaugcccagccccuc

SEQ ID NO: 893403 - RNA, 12 nt, Mycobacterium avium subsp. paratuberculosis
acgaucgcggug

SEQ ID NO: 893404 - RNA, 18 nt, Mycobacterium avium subsp. paratuberculosis
acgaucggcuccagcgcc

SEQ ID NO: 893405 - RNA, 15 nt, Mycobacterium avium subsp. paratuberculosis
acgaucgcggccagc

SEQ ID NO: 893406 - RNA, 22 nt, Mycobacterium avium subsp. paratuberculosis
acgaucggguagacgucgggcu

SEQ ID NO: 893407 - RNA, 20 nt, Mycobacterium avium subsp. paratuberculosis
acgaucgucaccgugccguc

SEQ ID NO: 893408 - RNA, 16 nt, Mycobacterium avium subsp. paratuberculosis
acgaugccggcgucgu

SEQ ID NO: 893409 - RNA, 23 nt, Mycobacterium avium subsp. paratuberculosis
acgaugcccggggugcuggcgua

SEQ ID NO: 893410 - RNA, 14 nt, Mycobacterium avium subsp. paratuberculosis
acgaugccgcgcuc

SEQ ID NO: 893411 - RNA, 13 nt, Mycobacterium avium subsp. paratuberculosis
acgauccgcgccg

SEQ ID NO: 893412 - RNA, 14 nt, Mycobacterium avium subsp. paratuberculosis
acgauccgcgccgc

SEQ ID NO: 893413 - RNA, 13 nt, Mycobacterium avium subsp. paratuberculosis
acgauccgcgcgg

SEQ ID NO: 893414 - RNA, 21 nt, Mycobacterium avium subsp. paratuberculosis
acgauccgggccggucgguca

SEQ ID NO: 893415 - RNA, 15 nt, Mycobacterium avium subsp. paratuberculosis
acgauccgggcgccc

SEQ ID NO: 893416 - RNA, 16 nt, Mycobacterium avium subsp. paratuberculosis
acgaucccgccgcccg

SEQ ID NO: 893417 - RNA, 18 nt, Mycobacterium avium subsp. paratuberculosis
acgaucccgccgcccgcc

SEQ ID NO: 893418 - RNA, 14 nt, Mycobacterium avium subsp. paratuberculosis
acgaucgagccggu

SEQ ID NO: 893419 - RNA, 16 nt, Mycobacterium avium subsp. paratuberculosis
acgaucgcgacggccg

SEQ ID NO: 893420 - RNA, 14 nt, Mycobacterium avium subsp. paratuberculosis
acgaucgcgccggc

SEQ ID NO: 893421 - RNA, 16 nt, Mycobacterium avium subsp. paratuberculosis
acgaucgcgccggccg

SEQ ID NO: 893422 - RNA, 21 nt, Mycobacterium avium subsp. paratuberculosis
acgaucgcggugacgcgccgg

SEQ ID NO: 893423 - RNA, 18 nt, Mycobacterium avium subsp. paratuberculosis
acgcaggcguccagggcc

SEQ ID NO: 893424 - RNA, 15 nt, Mycobacterium avium subsp. paratuberculosis
acgcaggcguggccc

SEQ ID NO: 893425 - RNA, 19 nt, Mycobacterium avium subsp. paratuberculosis
acgcaggcguggcccagcc

SEQ ID NO: 893426 - RNA, 22 nt, Mycobacterium avium subsp. paratuberculosis
acgcaggcguggcccagccggu

SEQ ID NO: 893427 - RNA, 12 nt, Mycobacterium avium subsp. paratuberculosis
acgcaucggcgc

SEQ ID NO: 893428 - RNA, 14 nt, Mycobacterium avium subsp. paratuberculosis
acgcaucggcgccg

SEQ ID NO: 893429 - RNA, 14 nt, Mycobacterium avium subsp. paratuberculosis
acgccacggcgaac

SEQ ID NO: 893430 - RNA, 13 nt, Mycobacterium avium subsp. paratuberculosis
acgccacggcggc

SEQ ID NO: 893431 - RNA, 22 nt, Mycobacterium avium subsp. paratuberculosis
acgccacggggcugcgggccag

SEQ ID NO: 893432 - RNA, 16 nt, Mycobacterium avium subsp. paratuberculosis
acgccacguagcagca

SEQ ID NO: 893433 - RNA, 22 nt, Mycobacterium avium subsp. paratuberculosis
acgccacgucguucaugaucgg

SEQ ID NO: 893434 - RNA, 13 nt, Mycobacterium avium subsp. paratuberculosis
acgccagcacgug

SEQ ID NO: 893435 - RNA, 20 nt, Mycobacterium avium subsp. paratuberculosis
acgccagcacguggccgggc

SEQ ID NO: 893436 - RNA, 16 nt, Mycobacterium avium subsp. paratuberculosis
acgccaacugguccug

SEQ ID NO: 893437 - RNA, 20 nt, Mycobacterium avium subsp. paratuberculosis
acgccaacugguccugcggc

SEQ ID NO: 893438 - RNA, 22 nt, Mycobacterium avium subsp. paratuberculosis
acgccaacugguccugcggcug

SEQ ID NO: 893439 - RNA, 20 nt, Mycobacterium avium subsp. paratuberculosis
acgccacgcgucaggcgucg

SEQ ID NO: 893440 - RNA, 15 nt, Mycobacterium avium subsp. paratuberculosis
acgcauguccgccgu

SEQ ID NO: 893441 - RNA, 16 nt, Mycobacterium avium subsp. paratuberculosis
acgccaguucgucggc

SEQ ID NO: 893442 - RNA, 18 nt, Mycobacterium avium subsp. paratuberculosis
acgccaguucgucggccg

SEQ ID NO: 893443 - RNA, 20 nt, Mycobacterium avium subsp. paratuberculosis
acgccaguucgucggccguc

SEQ ID NO: 893444 - RNA, 19 nt, Mycobacterium avium subsp. paratuberculosis
acgccaguguggccgcggc

SEQ ID NO: 893445 - RNA, 20 nt, Mycobacterium avium subsp. paratuberculosis
acgccaguguggccgcggcg

SEQ ID NO: 893446 - RNA, 22 nt, Mycobacterium avium subsp. paratuberculosis
acgccaguguggccgcggcggc

SEQ ID NO: 893447 - RNA, 14 nt, Mycobacterium avium subsp. paratuberculosis
acgccagccaggcg

SEQ ID NO: 893448 - RNA, 15 nt, Mycobacterium avium subsp. paratuberculosis
acgccagcagccgca

SEQ ID NO: 893449 - RNA, 23 nt, Mycobacterium avium subsp. paratuberculosis
acgccagcagcugcgggaccagc

SEQ ID NO: 893450 - RNA, 15 nt, Mycobacterium avium subsp. paratuberculosis
acgccagccaggcga

SEQ ID NO: 893451 - RNA, 16 nt, Mycobacterium avium subsp. paratuberculosis
acgccagcaucgagau

SEQ ID NO: 893452 - RNA, 17 nt, Mycobacterium avium subsp. paratuberculosis
acgccaucaccagcgcg

SEQ ID NO: 893453 - RNA, 18 nt, Mycobacterium avium subsp. paratuberculosis
acgccaucaccagcgcgu

SEQ ID NO: 893454 - RNA, 19 nt, Mycobacterium avium subsp. paratuberculosis
acgccaugaacucguccac

SEQ ID NO: 893455 - RNA, 18 nt, Mycobacterium avium subsp. paratuberculosis
acgcccagcgcggcgaac

SEQ ID NO: 893456 - RNA, 16 nt, Mycobacterium avium subsp. paratuberculosis
acgccaucgccucggc

SEQ ID NO: 893457 - RNA, 15 nt, Mycobacterium avium subsp. paratuberculosis
acgccccggcggguc

SEQ ID NO: 893458 - RNA, 19 nt, Mycobacterium avium subsp. paratuberculosis
acgcccccgcuggcccggc

SEQ ID NO: 893459 - RNA, 21 nt, Mycobacterium avium subsp. paratuberculosis
acgcccccgcuggcccggcgu

SEQ ID NO: 893460 - RNA, 14 nt, Mycobacterium avium subsp. paratuberculosis
acgcccggcgagug

SEQ ID NO: 893461 - RNA, 12 nt, Mycobacterium avium subsp. paratuberculosis
acgcccggcgcc

SEQ ID NO: 893462 - RNA, 15 nt, Mycobacterium avium subsp. paratuberculosis
acgcccggcgccggc

SEQ ID NO: 893463 - RNA, 22 nt, Mycobacterium avium subsp. paratuberculosis
acgcccggcgccggcggccacg

SEQ ID NO: 893464 - RNA, 17 nt, Mycobacterium avium subsp. paratuberculosis
acgcccuccuggcgggu

SEQ ID NO: 893465 - RNA, 16 nt, Mycobacterium avium subsp. paratuberculosis
acgcccgucccgccga

SEQ ID NO: 893466 - RNA, 18 nt, Mycobacterium avium subsp. paratuberculosis
acgcccgucccugcgcgg

SEQ ID NO: 893467 - RNA, 15 nt, Mycobacterium avium subsp. paratuberculosis
acgcccggucgauga

SEQ ID NO: 893468 - RNA, 13 nt, Mycobacterium avium subsp. paratuberculosis
acgcccaggugca

SEQ ID NO: 893469 - RNA, 23 nt, Mycobacterium avium subsp. paratuberculosis
acgcccaggcucaggaucagcag

SEQ ID NO: 893470 - RNA, 13 nt, Mycobacterium avium subsp. paratuberculosis
acgccccaggcgc

SEQ ID NO: 893471 - RNA, 14 nt, Mycobacterium avium subsp. paratuberculosis
acgccccaggcgcc

SEQ ID NO: 893472 - RNA, 19 nt, Mycobacterium avium subsp. paratuberculosis
acgccccaguuggcgucgu

SEQ ID NO: 893473 - RNA, 21 nt, Mycobacterium avium subsp. paratuberculosis
acgccccauugccgcgccggg

SEQ ID NO: 893474 - RNA, 22 nt, Mycobacterium avium subsp. paratuberculosis
acgccccauugccgcgccgggg

SEQ ID NO: 893475 - RNA, 13 nt, Mycobacterium avium subsp. paratuberculosis
acgcucucgccgg

SEQ ID NO: 893476 - RNA, 14 nt, Mycobacterium avium subsp. paratuberculosis
acgcucucgccggu

SEQ ID NO: 893477 - RNA, 14 nt, Mycobacterium avium subsp. paratuberculosis
acgcucggcggccg

SEQ ID NO: 893478 - RNA, 13 nt, Mycobacterium avium subsp. paratuberculosis
acgcucggcggcg

SEQ ID NO: 893479 - RNA, 15 nt, Mycobacterium avium subsp. paratuberculosis
acgcucggcggcgcg

SEQ ID NO: 893480 - RNA, 22 nt, Mycobacterium avium subsp. paratuberculosis
acgcucggcggcgcgcaggcgc

SEQ ID NO: 893481 - RNA, 17 nt, Mycobacterium avium subsp. paratuberculosis
acgcucgggccggcgcc

SEQ ID NO: 893482 - RNA, 19 nt, Mycobacterium avium subsp. paratuberculosis
acgcucgggccggcgccga

SEQ ID NO: 893483 - RNA, 20 nt, Mycobacterium avium subsp. paratuberculosis
acgcucgggcuucggcguca

SEQ ID NO: 893484 - RNA, 21 nt, Mycobacterium avium subsp. paratuberculosis
acgcucgggcuucggcgucac

SEQ ID NO: 893485 - RNA, 22 nt, Mycobacterium avium subsp. paratuberculosis
acgcucggggccgguuggugcg

SEQ ID NO: 893486 - RNA, 24 nt, Mycobacterium avium subsp. paratuberculosis
acgcucggggccgguuggugcgcc

SEQ ID NO: 893487 - RNA, 19 nt, Mycobacterium avium subsp. paratuberculosis
acgcugaacagcccgagca

SEQ ID NO: 893488 - RNA, 18 nt, Mycobacterium avium subsp. paratuberculosis
acgcugaacggugccguc

SEQ ID NO: 893489 - RNA, 24 nt, Mycobacterium avium subsp. paratuberculosis
acgcugaagcccaccgccguuccg

SEQ ID NO: 893490 - RNA, 17 nt, Mycobacterium avium subsp. paratuberculosis
acgcucuucagcgcgac

SEQ ID NO: 893491 - RNA, 19 nt, Mycobacterium avium subsp. paratuberculosis
acgcugagcaaccgccgaa

SEQ ID NO: 893492 - RNA, 23 nt, Mycobacterium avium subsp. paratuberculosis
acgcugagcacccgcccggacgc

SEQ ID NO: 893493 - RNA, 17 nt, Mycobacterium avium subsp. paratuberculosis
acgcugagccgcucguc

SEQ ID NO: 893494 - RNA, 15 nt, Mycobacterium avium subsp. paratuberculosis
acgcugaccugugcg

SEQ ID NO: 893495 - RNA, 20 nt, Mycobacterium avium subsp. paratuberculosis
acgcugaccugugcgcccca

SEQ ID NO: 893496 - RNA, 16 nt, Mycobacterium avium subsp. paratuberculosis
acgcugacgaugcggc

SEQ ID NO: 893497 - RNA, 22 nt, Mycobacterium avium subsp. paratuberculosis
acgcugacgaugcggccggcgg

SEQ ID NO: 893498 - RNA, 16 nt, Mycobacterium avium subsp. paratuberculosis
acgcugaucaccacgg

SEQ ID NO: 893499 - RNA, 18 nt, Mycobacterium avium subsp. paratuberculosis
acgcugaucaccacgguc

SEQ ID NO: 893500 - RNA, 13 nt, Mycobacterium avium subsp. paratuberculosis
acgcugagcgcca

SEQ ID NO: 893501 - RNA, 18 nt, Mycobacterium avium subsp. paratuberculosis
acgcugaucuacgucggc

SEQ ID NO: 893502 - RNA, 16 nt, Mycobacterium avium subsp. paratuberculosis
acgcugcagguggccc

SEQ ID NO: 893503 - RNA, 18 nt, Mycobacterium avium subsp. paratuberculosis
acgcugcagguggcccac

SEQ ID NO: 893504 - RNA, 21 nt, Mycobacterium avium subsp. paratuberculosis
acgcugccaggcgguggccga

SEQ ID NO: 893505 - RNA, 15 nt, Mycobacterium avium subsp. paratuberculosis
acgcugcccaaccgu

SEQ ID NO: 893506 - RNA, 23 nt, Mycobacterium avium subsp. paratuberculosis
acgcugccgagguacgcgcugac

SEQ ID NO: 893507 - RNA, 17 nt, Mycobacterium avium subsp. paratuberculosis
acgcugccgcgccgcca

SEQ ID NO: 893508 - RNA, 19 nt, Mycobacterium avium subsp. paratuberculosis
acgcugccgcuggcgucga

SEQ ID NO: 893509 - RNA, 13 nt, Mycobacterium avium subsp. paratuberculosis
acgcugcgccagc

SEQ ID NO: 893510 - RNA, 15 nt, Mycobacterium avium subsp. paratuberculosis
acgcugcgccagccg

SEQ ID NO: 893511 - RNA, 19 nt, Mycobacterium avium subsp. paratuberculosis
acgcugcgccagccgucgc

SEQ ID NO: 893512 - RNA, 22 nt, Mycobacterium avium subsp. paratuberculosis
acgcugcgccagccgucgccgc

SEQ ID NO: 893513 - RNA, 17 nt, Mycobacterium avium subsp. paratuberculosis
acgcugcgcacccgguc

SEQ ID NO: 893514 - RNA, 21 nt, Mycobacterium avium subsp. paratuberculosis
acgcugcgcacccgguccggc

SEQ ID NO: 893515 - RNA, 14 nt, Mycobacterium avium subsp. paratuberculosis
acggacagcucacc

SEQ ID NO: 893516 - RNA, 19 nt, Mycobacterium avium subsp. paratuberculosis
acggaauucgggugcggcg

SEQ ID NO: 893517 - RNA, 15 nt, Mycobacterium avium subsp. paratuberculosis
acggacacccgcgcg

SEQ ID NO: 893518 - RNA, 16 nt, Mycobacterium avium subsp. paratuberculosis
acggacacccgcgcgg

SEQ ID NO: 893519 - RNA, 20 nt, Mycobacterium avium subsp. paratuberculosis
acggacacccgcgcggugcc

SEQ ID NO: 893520 - RNA, 13 nt, Mycobacterium avium subsp. paratuberculosis
acggaccgggcgg

SEQ ID NO: 893521 - RNA, 20 nt, Mycobacterium avium subsp. paratuberculosis
acggacgcauccacggccgg

SEQ ID NO: 893522 - RNA, 21 nt, Mycobacterium avium subsp. paratuberculosis
acggagacgacgacgaacgcg

SEQ ID NO: 893523 - RNA, 18 nt, Mycobacterium avium subsp. paratuberculosis
acgcugggcuccgaccgu

SEQ ID NO: 893524 - RNA, 13 nt, Mycobacterium avium subsp. paratuberculosis
acgcuggugacgu

SEQ ID NO: 893525 - RNA, 16 nt, Mycobacterium avium subsp. paratuberculosis
acgcuggugugacgcu

SEQ ID NO: 893526 - RNA, 14 nt, Mycobacterium avium subsp. paratuberculosis
acgcugggcgccgg

SEQ ID NO: 893527 - RNA, 15 nt, Mycobacterium avium subsp. paratuberculosis
acgcugggcggcgac

SEQ ID NO: 893528 - RNA, 18 nt, Mycobacterium avium subsp. paratuberculosis
acgcugcgcgccgauccg

SEQ ID NO: 893529 - RNA, 20 nt, Mycobacterium avium subsp. paratuberculosis
acgcuguccgcgugaaugcc

SEQ ID NO: 893530 - RNA, 21 nt, Mycobacterium avium subsp. paratuberculosis
acgcuguagggccaccacgcc

SEQ ID NO: 893531 - RNA, 17 nt, Mycobacterium avium subsp. paratuberculosis
acgcuguuggaaccggc

SEQ ID NO: 893532 - RNA, 16 nt, Mycobacterium avium subsp. paratuberculosis
acgcugugcucgacga

SEQ ID NO: 893533 - RNA, 14 nt, Mycobacterium avium subsp. paratuberculosis
acgcucaugcccgc

SEQ ID NO: 893534 - RNA, 23 nt, Mycobacterium avium subsp. paratuberculosis
acgcucaugcccgccacggccag

SEQ ID NO: 893535 - RNA, 15 nt, Mycobacterium avium subsp. paratuberculosis
acgcucacgcucggc

SEQ ID NO: 893536 - RNA, 16 nt, Mycobacterium avium subsp. paratuberculosis
acgcucacgcucggcc

SEQ ID NO: 893537 - RNA, 14 nt, Mycobacterium avium subsp. paratuberculosis
acgcucacccggcc

SEQ ID NO: 893538 - RNA, 16 nt, Mycobacterium avium subsp. paratuberculosis
acgcucacccggccca

SEQ ID NO: 893539 - RNA, 22 nt, Mycobacterium avium subsp. paratuberculosis
acgcucacccggcccaccggcc

SEQ ID NO: 893540 - RNA, 17 nt, Mycobacterium avium subsp. paratuberculosis
acgcucggcaggcgggg

SEQ ID NO: 893541 - RNA, 14 nt, Mycobacterium avium subsp. paratuberculosis
acgcucgccggcgg

SEQ ID NO: 893542 - RNA, 15 nt, Mycobacterium avium subsp. paratuberculosis
acgcucgccggcggc

SEQ ID NO: 893543 - RNA, 16 nt, Mycobacterium avium subsp. paratuberculosis
acgcucgccggcggcc

SEQ ID NO: 893544 - RNA, 19 nt, Mycobacterium avium subsp. paratuberculosis
acgcucgccggcggccgcc

SEQ ID NO: 893545 - RNA, 12 nt, Mycobacterium avium subsp. paratuberculosis
acgcucgcggug

SEQ ID NO: 893546 - RNA, 23 nt, Mycobacterium avium subsp. paratuberculosis
acgcucgcgguugggccgccggc

SEQ ID NO: 893547 - RNA, 23 nt, Mycobacterium avium subsp. paratuberculosis
acgcucgcgugcgaacgugaaac

SEQ ID NO: 893548 - RNA, 23 nt, Mycobacterium avium subsp. paratuberculosis
acgcucgcguggccugggcgacc

SEQ ID NO: 893549 - RNA, 19 nt, Mycobacterium avium subsp. paratuberculosis
acgcucggccguggccguc

SEQ ID NO: 893550 - RNA, 20 nt, Mycobacterium avium subsp. paratuberculosis
acgcucggccguggccguca

SEQ ID NO: 893551 - RNA, 12 nt, Mycobacterium avium subsp. paratuberculosis
acgcucggcgag

SEQ ID NO: 893552 - RNA, 14 nt, Mycobacterium avium subsp. paratuberculosis
acgcucggcgagug

SEQ ID NO: 893553 - RNA, 13 nt, Mycobacterium avium subsp. paratuberculosis
acgcucggcgaug

SEQ ID NO: 893554 - RNA, 16 nt, Mycobacterium avium subsp. paratuberculosis
acgcucggcgccgagc

SEQ ID NO: 893555 - RNA, 17 nt, Mycobacterium avium subsp. paratuberculosis
acgcucggcgccgagcg

SEQ ID NO: 893556 - RNA, 18 nt, Mycobacterium avium subsp. paratuberculosis
acgcucggcgccgagcgu

SEQ ID NO: 893557 - RNA, 20 nt, Mycobacterium avium subsp. paratuberculosis
acgcucggcgccgagcguga

SEQ ID NO: 893558 - RNA, 22 nt, Mycobacterium avium subsp. paratuberculosis
acgcucggcgccgagcgugaac

SEQ ID NO: 893559 - RNA, 14 nt, Mycobacterium avium subsp. paratuberculosis
acgcucggcgccgc

SEQ ID NO: 893560 - RNA, 16 nt, Mycobacterium avium subsp. paratuberculosis
acgcucggcgccgcgg

SEQ ID NO: 893561 - RNA, 15 nt, Mycobacterium avium subsp. paratuberculosis
acgcucggcgccggc

SEQ ID NO: 893562 - RNA, 21 nt, Mycobacterium avium subsp. paratuberculosis
acgcucggcgccggccgucac

SEQ ID NO: 893563 - RNA, 14 nt, Mycobacterium avium subsp. paratuberculosis
acgcucggcgcgac

SEQ ID NO: 893564 - RNA, 16 nt, Mycobacterium avium subsp. paratuberculosis
acgcucggcgcgacgu

SEQ ID NO: 893565 - RNA, 15 nt, Mycobacterium avium subsp. paratuberculosis
acgcucggcgcgcgg

SEQ ID NO: 893566 - RNA, 13 nt, Mycobacterium avium subsp. paratuberculosis
acgcucggcgcgu

SEQ ID NO: 893567 - RNA, 15 nt, Mycobacterium avium subsp. paratuberculosis
acgcucggcgcgucg

SEQ ID NO: 893568 - RNA, 16 nt, Mycobacterium avium subsp. paratuberculosis
acgcucggcgcgucgu

SEQ ID NO: 893569 - RNA, 17 nt, Mycobacterium avium subsp. paratuberculosis
acgcucggcgcgucguc

SEQ ID NO: 893570 - RNA, 15 nt, Mycobacterium avium subsp. paratuberculosis
acgcucgacggccgg

SEQ ID NO: 893571 - RNA, 16 nt, Mycobacterium avium subsp. paratuberculosis
acgcucgacggccggc

SEQ ID NO: 893572 - RNA, 17 nt, Mycobacterium avium subsp. paratuberculosis
acgcucgacggccggcg

SEQ ID NO: 893573 - RNA, 21 nt, Mycobacterium avium subsp. paratuberculosis
acgcucgaggccccgcgugac

SEQ ID NO: 893574 - RNA, 14 nt, Mycobacterium avium subsp. paratuberculosis
acgcucgcaggcga

SEQ ID NO: 893575 - RNA, 15 nt, Mycobacterium avium subsp. paratuberculosis
acgcucgcaggcgag

SEQ ID NO: 893576 - RNA, 22 nt, Mycobacterium avium subsp. paratuberculosis
acgcucgcaggcgagccgacag

SEQ ID NO: 893577 - RNA, 23 nt, Mycobacterium avium subsp. paratuberculosis
acgcucgcaggcgagccgacagu

SEQ ID NO: 893578 - RNA, 16 nt, Mycobacterium avium subsp. paratuberculosis
acgcucgccaccccgc

SEQ ID NO: 893579 - RNA, 21 nt, Mycobacterium avium subsp. paratuberculosis
acgcucgccaccccgcgccac

SEQ ID NO: 893580 - RNA, 22 nt, Mycobacterium avium subsp. paratuberculosis
acgcucgccaccccgcgccacg

SEQ ID NO: 893581 - RNA, 17 nt, Mycobacterium avium subsp. paratuberculosis
acgcuccagaugcggug

SEQ ID NO: 893582 - RNA, 20 nt, Mycobacterium avium subsp. paratuberculosis
acgcuccagaugcgguggug

SEQ ID NO: 893583 - RNA, 15 nt, Mycobacterium avium subsp. paratuberculosis
acgcgugcgucaucg

SEQ ID NO: 893584 - RNA, 21 nt, Mycobacterium avium subsp. paratuberculosis
acgcgugcgucaucgcgcugg

SEQ ID NO: 893585 - RNA, 17 nt, Mycobacterium avium subsp. paratuberculosis
acgcguuguugcucggc

SEQ ID NO: 893586 - RNA, 18 nt, Mycobacterium avium subsp. paratuberculosis
acgcguuguugcucggcg

SEQ ID NO: 893587 - RNA, 19 nt, Mycobacterium avium subsp. paratuberculosis
acgcguuguugcucggcgg

SEQ ID NO: 893588 - RNA, 20 nt, Mycobacterium avium subsp. paratuberculosis
acgcguuguugcucggcggc

SEQ ID NO: 893589 - RNA, 21 nt, Mycobacterium avium subsp. paratuberculosis
acgcguuguugcucggcggcc

SEQ ID NO: 893590 - RNA, 23 nt, Mycobacterium avium subsp. paratuberculosis
acgcguuguugcucggcggcccg

SEQ ID NO: 893591 - RNA, 20 nt, Mycobacterium avium subsp. paratuberculosis
acgcguucggacaccucggc

SEQ ID NO: 893592 - RNA, 23 nt, Mycobacterium avium subsp. paratuberculosis
acgcguucggacaccucggccag

SEQ ID NO: 893593 - RNA, 20 nt, Mycobacterium avium subsp. paratuberculosis
acgcguugcagcgccgcggc

SEQ ID NO: 893594 - RNA, 14 nt, Mycobacterium avium subsp. paratuberculosis
acgcguucgucggc

SEQ ID NO: 893595 - RNA, 15 nt, Mycobacterium avium subsp. paratuberculosis
acgcguucgucggcg

SEQ ID NO: 893596 - RNA, 21 nt, Mycobacterium avium subsp. paratuberculosis
acgcguucgucggcgcgucgu

SEQ ID NO: 893597 - RNA, 23 nt, Mycobacterium avium subsp. paratuberculosis
acgcguucuccucgaacaccgca

SEQ ID NO: 893598 - RNA, 21 nt, Mycobacterium avium subsp. paratuberculosis
acgcguugaccagaccgaaga

SEQ ID NO: 893599 - RNA, 14 nt, Mycobacterium avium subsp. paratuberculosis
acgcgguggugcuc

SEQ ID NO: 893600 - RNA, 20 nt, Mycobacterium avium subsp. paratuberculosis
acgcgguguuggcggcgucg

SEQ ID NO: 893601 - RNA, 14 nt, Mycobacterium avium subsp. paratuberculosis
acgcguacacggcc

SEQ ID NO: 893602 - RNA, 17 nt, Mycobacterium avium subsp. paratuberculosis
acgcguacacggcccgc

SEQ ID NO: 893603 - RNA, 23 nt, Mycobacterium avium subsp. paratuberculosis
acgcggugacaugcccgggcucg

SEQ ID NO: 893604 - RNA, 13 nt, Mycobacterium avium subsp. paratuberculosis
acgcggugacggu

SEQ ID NO: 893605 - RNA, 15 nt, Mycobacterium avium subsp. paratuberculosis
acgcggugacgguga

SEQ ID NO: 893606 - RNA, 22 nt, Mycobacterium avium subsp. paratuberculosis
acgcggugagcgcgccggcccg

SEQ ID NO: 893607 - RNA, 16 nt, Mycobacterium avium subsp. paratuberculosis
acgcggugagcgugcc

SEQ ID NO: 893608 - RNA, 13 nt, Mycobacterium avium subsp. paratuberculosis
acgcggugggcac

SEQ ID NO: 893609 - RNA, 21 nt, Mycobacterium avium subsp. paratuberculosis
acgcggugggcaccagcagcg

SEQ ID NO: 893610 - RNA, 22 nt, Mycobacterium avium subsp. paratuberculosis
acgcggugggcaccagcagcgc

SEQ ID NO: 893611 - RNA, 21 nt, Mycobacterium avium subsp. paratuberculosis
acgcguccguagugcucggcg

SEQ ID NO: 893612 - RNA, 13 nt, Mycobacterium avium subsp. paratuberculosis
acgcgucaccgga

SEQ ID NO: 893613 - RNA, 23 nt, Mycobacterium avium subsp. paratuberculosis
acgcgucaccggaauugaagccc

SEQ ID NO: 893614 - RNA, 21 nt, Mycobacterium avium subsp. paratuberculosis
acgcgucguugucgucgccgg

SEQ ID NO: 893615 - RNA, 22 nt, Mycobacterium avium subsp. paratuberculosis
acgcgucguugucgucgccggc

SEQ ID NO: 893616 - RNA, 16 nt, Mycobacterium avium subsp. paratuberculosis
acgcgucggcgccgga

SEQ ID NO: 893617 - RNA, 18 nt, Mycobacterium avium subsp. paratuberculosis
acgcgucggcgccggauc

SEQ ID NO: 893618 - RNA, 18 nt, Mycobacterium avium subsp. paratuberculosis
acgcgucggucagcggcg

SEQ ID NO: 893619 - RNA, 19 nt, Mycobacterium avium subsp. paratuberculosis
acgcgucggucagcggcgu

SEQ ID NO: 893620 - RNA, 16 nt, Mycobacterium avium subsp. paratuberculosis
acgcgucgaacagccg

SEQ ID NO: 893621 - RNA, 15 nt, Mycobacterium avium subsp. paratuberculosis
acgcgucgaccgccg

SEQ ID NO: 893622 - RNA, 16 nt, Mycobacterium avium subsp. paratuberculosis
acgcgucgaccgccgc

SEQ ID NO: 893623 - RNA, 19 nt, Mycobacterium avium subsp. paratuberculosis
acgcgucgcccacgccggu

SEQ ID NO: 893624 - RNA, 22 nt, Mycobacterium avium subsp. paratuberculosis
acgcgucgccgugccggaccgc

SEQ ID NO: 893625 - RNA, 15 nt, Mycobacterium avium subsp. paratuberculosis
acgcgucgcgccagc

SEQ ID NO: 893626 - RNA, 17 nt, Mycobacterium avium subsp. paratuberculosis
acgcgucgcgccagcgg

SEQ ID NO: 893627 - RNA, 18 nt, Mycobacterium avium subsp. paratuberculosis
acgcgucgcgccagcggu

SEQ ID NO: 893628 - RNA, 13 nt, Mycobacterium avium subsp. paratuberculosis
acgcgucgcggcg

SEQ ID NO: 893629 - RNA, 17 nt, Mycobacterium avium subsp. paratuberculosis
acgcgaaguccgacgag

SEQ ID NO: 893630 - RNA, 13 nt, Mycobacterium avium subsp. paratuberculosis
acgcgaacccaca

SEQ ID NO: 893631 - RNA, 16 nt, Mycobacterium avium subsp. paratuberculosis
acgcgaacggguagcc

SEQ ID NO: 893632 - RNA, 16 nt, Mycobacterium avium subsp. paratuberculosis
acgcgaaugucgacca

SEQ ID NO: 893633 - RNA, 22 nt, Mycobacterium avium subsp. paratuberculosis
acgcgaaugucgaccaccgggu

SEQ ID NO: 893634 - RNA, 14 nt, Mycobacterium avium subsp. paratuberculosis
acgcgacgcgcucg

SEQ ID NO: 893635 - RNA, 18 nt, Mycobacterium avium subsp. paratuberculosis
acgcgacgcgcucggcga

SEQ ID NO: 893636 - RNA, 13 nt, Mycobacterium avium subsp. paratuberculosis
acgcgacggcccg

SEQ ID NO: 893637 - RNA, 14 nt, Mycobacterium avium subsp. paratuberculosis
acgcgacggcccgg

SEQ ID NO: 893638 - RNA, 16 nt, Mycobacterium avium subsp. paratuberculosis
acgcgacggcccgguc

SEQ ID NO: 893639 - RNA, 21 nt, Mycobacterium avium subsp. paratuberculosis
acgcgacgggcaugccgucgg

SEQ ID NO: 893640 - RNA, 23 nt, Mycobacterium avium subsp. paratuberculosis
acgcgacgggcaugccgucggcg

SEQ ID NO: 893641 - RNA, 12 nt, Mycobacterium avium subsp. paratuberculosis
acgcgacggugg

SEQ ID NO: 893642 - RNA, 14 nt, Mycobacterium avium subsp. paratuberculosis
acgcgacgguggcg

SEQ ID NO: 893643 - RNA, 17 nt, Mycobacterium avium subsp. paratuberculosis
acgcgacgguggcggcg

SEQ ID NO: 893644 - RNA, 18 nt, Mycobacterium avium subsp. paratuberculosis
acgcgacgguggcggcga

SEQ ID NO: 893645 - RNA, 21 nt, Mycobacterium avium subsp. paratuberculosis
acgcgacgguggcggcgaugu

SEQ ID NO: 893646 - RNA, 15 nt, Mycobacterium avium subsp. paratuberculosis
acgcgaccgcgcggc

SEQ ID NO: 893647 - RNA, 16 nt, Mycobacterium avium subsp. paratuberculosis
acgcgaccgcgcggcg

SEQ ID NO: 893648 - RNA, 16 nt, Mycobacterium avium subsp. paratuberculosis
acgcgaccgcgucgac

SEQ ID NO: 893649 - RNA, 13 nt, Mycobacterium avium subsp. paratuberculosis
acgcgaccggccc

SEQ ID NO: 893650 - RNA, 16 nt, Mycobacterium avium subsp. paratuberculosis
acgcgaccgucgggac

SEQ ID NO: 893651 - RNA, 14 nt, Mycobacterium avium subsp. paratuberculosis
acgcgacgaaccgc

SEQ ID NO: 893652 - RNA, 20 nt, Mycobacterium avium subsp. paratuberculosis
acgcgacgaaccgccacacg

SEQ ID NO: 893653 - RNA, 13 nt, Mycobacterium avium subsp. paratuberculosis
acgcgcgccccgg

SEQ ID NO: 893654 - RNA, 15 nt, Mycobacterium avium subsp. paratuberculosis
acgcgcgccccgguc

SEQ ID NO: 893655 - RNA, 22 nt, Mycobacterium avium subsp. paratuberculosis
acgcgcgccccggucccgccgg

SEQ ID NO: 893656 - RNA, 13 nt, Mycobacterium avium subsp. paratuberculosis
acgcgcgcccggc

SEQ ID NO: 893657 - RNA, 13 nt, Mycobacterium avium subsp. paratuberculosis
acgcgcgcgccgu

SEQ ID NO: 893658 - RNA, 15 nt, Mycobacterium avium subsp. paratuberculosis
acgcgcgcgccgucu

SEQ ID NO: 893659 - RNA, 18 nt, Mycobacterium avium subsp. paratuberculosis
acgcgccgucgucgucgc

SEQ ID NO: 893660 - RNA, 13 nt, Mycobacterium avium subsp. paratuberculosis
acgcgcgcggcgu

SEQ ID NO: 893661 - RNA, 15 nt, Mycobacterium avium subsp. paratuberculosis
acgcgcgcgacggcg

SEQ ID NO: 893662 - RNA, 20 nt, Mycobacterium avium subsp. paratuberculosis
acgcgcgcgacggcgcguga

SEQ ID NO: 893663 - RNA, 13 nt, Mycobacterium avium subsp. paratuberculosis
acgcgcgaucggu

SEQ ID NO: 893664 - RNA, 13 nt, Mycobacterium avium subsp. paratuberculosis
acgcgccggcgca

SEQ ID NO: 893665 - RNA, 14 nt, Mycobacterium avium subsp. paratuberculosis
acgcgccggcgguc

SEQ ID NO: 893666 - RNA, 16 nt, Mycobacterium avium subsp. paratuberculosis
acgcgccggcggucga

SEQ ID NO: 893667 - RNA, 23 nt, Mycobacterium avium subsp. paratuberculosis
acgcgccgggcaacagcgcgccg

SEQ ID NO: 893668 - RNA, 12 nt, Mycobacterium avium subsp. paratuberculosis
acgcgccgguga

SEQ ID NO: 893669 - RNA, 16 nt, Mycobacterium avium subsp. paratuberculosis
acgcgccggugacccc

SEQ ID NO: 893670 - RNA, 22 nt, Mycobacterium avium subsp. paratuberculosis
acgcgccggugaccccgucgaa

SEQ ID NO: 893671 - RNA, 21 nt, Mycobacterium avium subsp. paratuberculosis
acgcgacgaagcggucgcgga

SEQ ID NO: 893672 - RNA, 18 nt, Mycobacterium avium subsp. paratuberculosis
acgcgagacgagccgccg

SEQ ID NO: 893673 - RNA, 24 nt, Mycobacterium avium subsp. paratuberculosis
acgcgagacgagccgccgcggguc

SEQ ID NO: 893674 - RNA, 14 nt, Mycobacterium avium subsp. paratuberculosis
acgcgagcggacgg

SEQ ID NO: 893675 - RNA, 16 nt, Mycobacterium avium subsp. paratuberculosis
acgcgagcggacgggc

SEQ ID NO: 893676 - RNA, 22 nt, Mycobacterium avium subsp. paratuberculosis
acgcgagcugcuucgucgccgg

SEQ ID NO: 893677 - RNA, 23 nt, Mycobacterium avium subsp. paratuberculosis
acgcgagcugcuucgucgccggg

SEQ ID NO: 893678 - RNA, 21 nt, Mycobacterium avium subsp. paratuberculosis
acgcgcuuguacaggucgacc

SEQ ID NO: 893679 - RNA, 22 nt, Mycobacterium avium subsp. paratuberculosis
acgcgcugucgcccucgaucgc

SEQ ID NO: 893680 - RNA, 14 nt, Mycobacterium avium subsp. paratuberculosis
acgcgcugccgacg

SEQ ID NO: 893681 - RNA, 15 nt, Mycobacterium avium subsp. paratuberculosis
acgcgcugccgacga

SEQ ID NO: 893682 - RNA, 16 nt, Mycobacterium avium subsp. paratuberculosis
acgcgcugccgacgau

SEQ ID NO: 893683 - RNA, 20 nt, Mycobacterium avium subsp. paratuberculosis
acgcggcggaggccugcgcg

SEQ ID NO: 893684 - RNA, 17 nt, Mycobacterium avium subsp. paratuberculosis
acgcggcggccugcgcg

SEQ ID NO: 893685 - RNA, 13 nt, Mycobacterium avium subsp. paratuberculosis
acgcggcgggaaa

SEQ ID NO: 893686 - RNA, 14 nt, Mycobacterium avium subsp. paratuberculosis
acgcggcgggaaac

SEQ ID NO: 893687 - RNA, 15 nt, Mycobacterium avium subsp. paratuberculosis
acgcggacacggccg

SEQ ID NO: 893688 - RNA, 18 nt, Mycobacterium avium subsp. paratuberculosis
acgcggacacggccggga

SEQ ID NO: 893689 - RNA, 21 nt, Mycobacterium avium subsp. paratuberculosis
acgcggacagcucgccggccg

SEQ ID NO: 893690 - RNA, 23 nt, Mycobacterium avium subsp. paratuberculosis
acgcggacagcucgccggccgcg

SEQ ID NO: 893691 - RNA, 21 nt, Mycobacterium avium subsp. paratuberculosis
acgcggacagggcggcgaccu

SEQ ID NO: 893692 - RNA, 19 nt, Mycobacterium avium subsp. paratuberculosis
acgcggcgaaggccagcga

SEQ ID NO: 893693 - RNA, 19 nt, Mycobacterium avium subsp. paratuberculosis
acgcggcgaccaccaccgc

SEQ ID NO: 893694 - RNA, 22 nt, Mycobacterium avium subsp. paratuberculosis
acgcggcgaccaccaccgccca

SEQ ID NO: 893695 - RNA, 23 nt, Mycobacterium avium subsp. paratuberculosis
acgcggcgaccaccaccgcccac

SEQ ID NO: 893696 - RNA, 12 nt, Mycobacterium avium subsp. paratuberculosis
acgcggcgccga

SEQ ID NO: 893697 - RNA, 13 nt, Mycobacterium avium subsp. paratuberculosis
acgcggcgccgac

SEQ ID NO: 893698 - RNA, 13 nt, Mycobacterium avium subsp. paratuberculosis
acgcggcgccggu

SEQ ID NO: 893699 - RNA, 16 nt, Mycobacterium avium subsp. paratuberculosis
acgcggcgcgacaccg

SEQ ID NO: 893700 - RNA, 20 nt, Mycobacterium avium subsp. paratuberculosis
acgcggcgcgacaccgcggc

SEQ ID NO: 893701 - RNA, 15 nt, Mycobacterium avium subsp. paratuberculosis
acgcggcgcgcgaug

SEQ ID NO: 893702 - RNA, 16 nt, Mycobacterium avium subsp. paratuberculosis
acgcggcgcgcgaugg

SEQ ID NO: 893703 - RNA, 22 nt, Mycobacterium avium subsp. paratuberculosis
acgcgggaccgggcccggcgcc

SEQ ID NO: 893704 - RNA, 18 nt, Mycobacterium avium subsp. paratuberculosis
acgcgggccggcacccgg

SEQ ID NO: 893705 - RNA, 13 nt, Mycobacterium avium subsp. paratuberculosis
acgcgggcgacgu

SEQ ID NO: 893706 - RNA, 17 nt, Mycobacterium avium subsp. paratuberculosis
acgcgggcgacgucaac

SEQ ID NO: 893707 - RNA, 13 nt, Mycobacterium avium subsp. paratuberculosis
acgcggcggcggu

SEQ ID NO: 893708 - RNA, 14 nt, Mycobacterium avium subsp. paratuberculosis
acgcggcggcggug

SEQ ID NO: 893709 - RNA, 16 nt, Mycobacterium avium subsp. paratuberculosis
acgcggcguugccgcc

SEQ ID NO: 893710 - RNA, 17 nt, Mycobacterium avium subsp. paratuberculosis
acgcggcguugccgccg

SEQ ID NO: 893711 - RNA, 20 nt, Mycobacterium avium subsp. paratuberculosis
acgcggcguugccgccggcg

SEQ ID NO: 893712 - RNA, 16 nt, Mycobacterium avium subsp. paratuberculosis
acgcggcucgcgcggu

SEQ ID NO: 893713 - RNA, 20 nt, Mycobacterium avium subsp. paratuberculosis
acgcggcugaucagccggcg

SEQ ID NO: 893714 - RNA, 24 nt, Mycobacterium avium subsp. paratuberculosis
acgcggcugaucagccggcgagcg

SEQ ID NO: 893715 - RNA, 18 nt, Mycobacterium avium subsp. paratuberculosis
acgcggcuggcccggcgc

SEQ ID NO: 893716 - RNA, 13 nt, Mycobacterium avium subsp. paratuberculosis
acgcgggcgccca

SEQ ID NO: 893717 - RNA, 23 nt, Mycobacterium avium subsp. paratuberculosis
acgcggggaaguaguaccccggg

SEQ ID NO: 893718 - RNA, 13 nt, Mycobacterium avium subsp. paratuberculosis
acgcggggcggcg

SEQ ID NO: 893719 - RNA, 15 nt, Mycobacterium avium subsp. paratuberculosis
acgcggggcggcggc

SEQ ID NO: 893720 - RNA, 16 nt, Mycobacterium avium subsp. paratuberculosis
acgcggggcggcggcg

SEQ ID NO: 893721 - RNA, 20 nt, Mycobacterium avium subsp. paratuberculosis
acgcggggcggcggcgccgg

SEQ ID NO: 893722 - RNA, 22 nt, Mycobacterium avium subsp. paratuberculosis
acgcggggcggcggcgccgggg

SEQ ID NO: 893723 - RNA, 20 nt, Mycobacterium avium subsp. paratuberculosis
acgcggucgccgcccacgcc

SEQ ID NO: 893724 - RNA, 23 nt, Mycobacterium avium subsp. paratuberculosis
acgcggucgucgucgucggugau

SEQ ID NO: 893725 - RNA, 20 nt, Mycobacterium avium subsp. paratuberculosis
acgcggucugcggugcgccc

SEQ ID NO: 893726 - RNA, 21 nt, Mycobacterium avium subsp. paratuberculosis
acgcggucugcggugcgccca

SEQ ID NO: 893727 - RNA, 22 nt, Mycobacterium avium subsp. paratuberculosis
acgcgguaccgaugaccaccgc

SEQ ID NO: 893728 - RNA, 22 nt, Mycobacterium avium subsp. paratuberculosis
acgcgguccacuuccgcgcagg

SEQ ID NO: 893729 - RNA, 18 nt, Mycobacterium avium subsp. paratuberculosis
acgccucgcgcagcgcgu

SEQ ID NO: 893730 - RNA, 13 nt, Mycobacterium avium subsp. paratuberculosis
acgccucggcgag

SEQ ID NO: 893731 - RNA, 15 nt, Mycobacterium avium subsp. paratuberculosis
acgccucgggccggc

SEQ ID NO: 893732 - RNA, 16 nt, Mycobacterium avium subsp. paratuberculosis
acgccucgggccggca

SEQ ID NO: 893733 - RNA, 17 nt, Mycobacterium avium subsp. paratuberculosis
acgccucgggccggcag

SEQ ID NO: 893734 - RNA, 14 nt, Mycobacterium avium subsp. paratuberculosis
acgccucguuggcc

SEQ ID NO: 893735 - RNA, 18 nt, Mycobacterium avium subsp. paratuberculosis
acgccucguuggccagcu

SEQ ID NO: 893736 - RNA, 13 nt, Mycobacterium avium subsp. paratuberculosis
acgccucggugcg

SEQ ID NO: 893737 - RNA, 19 nt, Mycobacterium avium subsp. paratuberculosis
acgccucgguggucgacga

SEQ ID NO: 893738 - RNA, 12 nt, Mycobacterium avium subsp. paratuberculosis
acgccucgucga

SEQ ID NO: 893739 - RNA, 13 nt, Mycobacterium avium subsp. paratuberculosis
acgccucgucgac

SEQ ID NO: 893740 - RNA, 14 nt, Mycobacterium avium subsp. paratuberculosis
acgccucgucgacc

SEQ ID NO: 893741 - RNA, 19 nt, Mycobacterium avium subsp. paratuberculosis
acgccucgucgaccgcggc

SEQ ID NO: 893742 - RNA, 15 nt, Mycobacterium avium subsp. paratuberculosis
acgccucgucgagca

SEQ ID NO: 893743 - RNA, 14 nt, Mycobacterium avium subsp. paratuberculosis
acgccguggcggcg

SEQ ID NO: 893744 - RNA, 17 nt, Mycobacterium avium subsp. paratuberculosis
acgccguggcggcgggc

SEQ ID NO: 893745 - RNA, 20 nt, Mycobacterium avium subsp. paratuberculosis
acgccguggcggcgggccag

SEQ ID NO: 893746 - RNA, 14 nt, Mycobacterium avium subsp. paratuberculosis
acgccgugcccggc

SEQ ID NO: 893747 - RNA, 19 nt, Mycobacterium avium subsp. paratuberculosis
acgccguggcccgcccagc

SEQ ID NO: 893748 - RNA, 21 nt, Mycobacterium avium subsp. paratuberculosis
acgccguggcccgcccagcgc

SEQ ID NO: 893749 - RNA, 15 nt, Mycobacterium avium subsp. paratuberculosis
acgcgaaagcacccg

SEQ ID NO: 893750 - RNA, 16 nt, Mycobacterium avium subsp. paratuberculosis
acgccugcggcccagc

SEQ ID NO: 893751 - RNA, 15 nt, Mycobacterium avium subsp. paratuberculosis
acgccugcgccgccg

SEQ ID NO: 893752 - RNA, 16 nt, Mycobacterium avium subsp. paratuberculosis
acgccugcgccgccgu

SEQ ID NO: 893753 - RNA, 15 nt, Mycobacterium avium subsp. paratuberculosis
acgccugccggcgcc

SEQ ID NO: 893754 - RNA, 19 nt, Mycobacterium avium subsp. paratuberculosis
acgccgucgaugacgcgcu

SEQ ID NO: 893755 - RNA, 13 nt, Mycobacterium avium subsp. paratuberculosis
acgccgucgucgu

SEQ ID NO: 893756 - RNA, 16 nt, Mycobacterium avium subsp. paratuberculosis
acgccguauucgccga

SEQ ID NO: 893757 - RNA, 17 nt, Mycobacterium avium subsp. paratuberculosis
acgccguauucgccgac

SEQ ID NO: 893758 - RNA, 19 nt, Mycobacterium avium subsp. paratuberculosis
acgccguauucgccgacgg

SEQ ID NO: 893759 - RNA, 14 nt, Mycobacterium avium subsp. paratuberculosis
acgccguccgacgu

SEQ ID NO: 893760 - RNA, 19 nt, Mycobacterium avium subsp. paratuberculosis
acgccggugaaaccggcgc

SEQ ID NO: 893761 - RNA, 20 nt, Mycobacterium avium subsp. paratuberculosis
acgccggugaaaccggcgcc

SEQ ID NO: 893762 - RNA, 16 nt, Mycobacterium avium subsp. paratuberculosis
acgccggugagcacga

SEQ ID NO: 893763 - RNA, 23 nt, Mycobacterium avium subsp. paratuberculosis
acgccggugagcacgaccgccag

SEQ ID NO: 893764 - RNA, 16 nt, Mycobacterium avium subsp. paratuberculosis
acgccguacccgaagc

SEQ ID NO: 893765 - RNA, 21 nt, Mycobacterium avium subsp. paratuberculosis
acgccguagaucacgccggug

SEQ ID NO: 893766 - RNA, 15 nt, Mycobacterium avium subsp. paratuberculosis
acgccgggcgcccgc

SEQ ID NO: 893767 - RNA, 16 nt, Mycobacterium avium subsp. paratuberculosis
acgccgguagccgcuc

SEQ ID NO: 893768 - RNA, 18 nt, Mycobacterium avium subsp. paratuberculosis
acgccgguagccgcucgc

SEQ ID NO: 893769 - RNA, 21 nt, Mycobacterium avium subsp. paratuberculosis
acgccgguagccgcucgccca

SEQ ID NO: 893770 - RNA, 23 nt, Mycobacterium avium subsp. paratuberculosis
acgccgguagccgcucgcccagc

SEQ ID NO: 893771 - RNA, 16 nt, Mycobacterium avium subsp. paratuberculosis
acgccggucagcacca

SEQ ID NO: 893772 - RNA, 23 nt, Mycobacterium avium subsp. paratuberculosis
acgccggucagcaccauggcguc

SEQ ID NO: 893773 - RNA, 21 nt, Mycobacterium avium subsp. paratuberculosis
acgccggucucgaacacgccg

SEQ ID NO: 893774 - RNA, 19 nt, Mycobacterium avium subsp. paratuberculosis
acgccggguugggcggcgg

SEQ ID NO: 893775 - RNA, 20 nt, Mycobacterium avium subsp. paratuberculosis
acgccggguugggcggcggc

SEQ ID NO: 893776 - RNA, 21 nt, Mycobacterium avium subsp. paratuberculosis
acgccggguuuguccggccag

SEQ ID NO: 893777 - RNA, 21 nt, Mycobacterium avium subsp. paratuberculosis
acgccgggguagaggccgcgg

SEQ ID NO: 893778 - RNA, 22 nt, Mycobacterium avium subsp. paratuberculosis
acgccgggguagaggccgcgga

SEQ ID NO: 893779 - RNA, 15 nt, Mycobacterium avium subsp. paratuberculosis
acgccgggucgacgc

SEQ ID NO: 893780 - RNA, 20 nt, Mycobacterium avium subsp. paratuberculosis
acgccgggucgacgccgagu

SEQ ID NO: 893781 - RNA, 20 nt, Mycobacterium avium subsp. paratuberculosis
acgccggcuugccccggucc

SEQ ID NO: 893782 - RNA, 12 nt, Mycobacterium avium subsp. paratuberculosis
acgccgggccgc

SEQ ID NO: 893783 - RNA, 20 nt, Mycobacterium avium subsp. paratuberculosis
acgccggcgugcacaggccg

SEQ ID NO: 893784 - RNA, 15 nt, Mycobacterium avium subsp. paratuberculosis
acgccgggcagcgcg

SEQ ID NO: 893785 - RNA, 16 nt, Mycobacterium avium subsp. paratuberculosis
acgccgggcagcgcgc

SEQ ID NO: 893786 - RNA, 17 nt, Mycobacterium avium subsp. paratuberculosis
acgccgggcagcgcgcg

SEQ ID NO: 893787 - RNA, 12 nt, Mycobacterium avium subsp. paratuberculosis
acgccgcgcugg

SEQ ID NO: 893788 - RNA, 17 nt, Mycobacterium avium subsp. paratuberculosis
acgcccuagcgggccag

SEQ ID NO: 893789 - RNA, 20 nt, Mycobacterium avium subsp. paratuberculosis
acgcccguucgagcgccgga

SEQ ID NO: 893790 - RNA, 13 nt, Mycobacterium avium subsp. paratuberculosis
acgcccuggccgc

SEQ ID NO: 893791 - RNA, 21 nt, Mycobacterium avium subsp. paratuberculosis
acgcccuggccgccggccgcg

SEQ ID NO: 893792 - RNA, 13 nt, Mycobacterium avium subsp. paratuberculosis
acgcccuuggcgc

SEQ ID NO: 893793 - RNA, 17 nt, Mycobacterium avium subsp. paratuberculosis
acgcccuuggcgcccag

SEQ ID NO: 893794 - RNA, 18 nt, Mycobacterium avium subsp. paratuberculosis
acgcccuuguccucgagc

SEQ ID NO: 893795 - RNA, 13 nt, Mycobacterium avium subsp. paratuberculosis
acgccgcgcagcg

SEQ ID NO: 893796 - RNA, 14 nt, Mycobacterium avium subsp. paratuberculosis
acgccgcgcagcgg

SEQ ID NO: 893797 - RNA, 12 nt, Mycobacterium avium subsp. paratuberculosis
acgccgcgcauc

SEQ ID NO: 893798 - RNA, 12 nt, Mycobacterium avium subsp. paratuberculosis
acgccgcgcacg

SEQ ID NO: 893799 - RNA, 12 nt, Mycobacterium avium subsp. paratuberculosis
acgccgcgcagc

SEQ ID NO: 893800 - RNA, 13 nt, Mycobacterium avium subsp. paratuberculosis
acgccgcgcccgu

SEQ ID NO: 893801 - RNA, 15 nt, Mycobacterium avium subsp. paratuberculosis
acgccgcgcccgucg

SEQ ID NO: 893802 - RNA, 16 nt, Mycobacterium avium subsp. paratuberculosis
acgccgcgcccgucga

SEQ ID NO: 893803 - RNA, 19 nt, Mycobacterium avium subsp. paratuberculosis
acgccgcgcccgucgagcg

SEQ ID NO: 893804 - RNA, 20 nt, Mycobacterium avium subsp. paratuberculosis
acgccgcgcccgucgagcgu

SEQ ID NO: 893805 - RNA, 12 nt, Mycobacterium avium subsp. paratuberculosis
acgccgcgccgc

SEQ ID NO: 893806 - RNA, 17 nt, Mycobacterium avium subsp. paratuberculosis
acgccgcgccgcccggc

SEQ ID NO: 893807 - RNA, 14 nt, Mycobacterium avium subsp. paratuberculosis
acgccgcgacgaug

SEQ ID NO: 893808 - RNA, 13 nt, Mycobacterium avium subsp. paratuberculosis
acgccgccgucgu

SEQ ID NO: 893809 - RNA, 22 nt, Mycobacterium avium subsp. paratuberculosis
acgccgccguguaggccgcgcu

SEQ ID NO: 893810 - RNA, 14 nt, Mycobacterium avium subsp. paratuberculosis
acaccaacgacagc

SEQ ID NO: 893811 - RNA, 13 nt, Mycobacterium avium subsp. paratuberculosis
acaccaccgacgc

SEQ ID NO: 893812 - RNA, 21 nt, Mycobacterium avium subsp. paratuberculosis
acaccaccgacgcgucgcggc

SEQ ID NO: 893813 - RNA, 14 nt, Mycobacterium avium subsp. paratuberculosis
acaccaccaggccg

SEQ ID NO: 893814 - RNA, 16 nt, Mycobacterium avium subsp. paratuberculosis
acaccaccaggccgua

SEQ ID NO: 893815 - RNA, 13 nt, Mycobacterium avium subsp. paratuberculosis
acaccaccgcgcg

SEQ ID NO: 893816 - RNA, 14 nt, Mycobacterium avium subsp. paratuberculosis
acaccaccgcggcg

SEQ ID NO: 893817 - RNA, 14 nt, Mycobacterium avium subsp. paratuberculosis
acaccaccggcaac

SEQ ID NO: 893818 - RNA, 20 nt, Mycobacterium avium subsp. paratuberculosis
acaccaccggcaaccgccac

SEQ ID NO: 893819 - RNA, 12 nt, Mycobacterium avium subsp. paratuberculosis
acaccaccggcc

SEQ ID NO: 893820 - RNA, 14 nt, Mycobacterium avium subsp. paratuberculosis
acaccaccggccgc

SEQ ID NO: 893821 - RNA, 21 nt, Mycobacterium avium subsp. paratuberculosis
acaccaccggccgcccggcga

SEQ ID NO: 893822 - RNA, 21 nt, Mycobacterium avium subsp. paratuberculosis
acaccaccgugcuggccacca

SEQ ID NO: 893823 - RNA, 14 nt, Mycobacterium avium subsp. paratuberculosis
acaccacggccggc

SEQ ID NO: 893824 - RNA, 17 nt, Mycobacterium avium subsp. paratuberculosis
acaccacggccggcaac

SEQ ID NO: 893825 - RNA, 18 nt, Mycobacterium avium subsp. paratuberculosis
acaccacgguccccgcgc

SEQ ID NO: 893826 - RNA, 19 nt, Mycobacterium avium subsp. paratuberculosis
acaccacgguccccgcgcc

SEQ ID NO: 893827 - RNA, 22 nt, Mycobacterium avium subsp. paratuberculosis
acaccacgguccccgcgcccgc

SEQ ID NO: 893828 - RNA, 14 nt, Mycobacterium avium subsp. paratuberculosis
acaccacgguggcg

SEQ ID NO: 893829 - RNA, 21 nt, Mycobacterium avium subsp. paratuberculosis
acaccacgguguagcggcggc

SEQ ID NO: 893830 - RNA, 12 nt, Mycobacterium avium subsp. paratuberculosis
acacaucguggc

SEQ ID NO: 893831 - RNA, 16 nt, Mycobacterium avium subsp. paratuberculosis
acacaggucgcccggc

SEQ ID NO: 893832 - RNA, 22 nt, Mycobacterium avium subsp. paratuberculosis
acacccacgaacgucugcggga

SEQ ID NO: 893833 - RNA, 19 nt, Mycobacterium avium subsp. paratuberculosis
acaccagggugcgcacgau

SEQ ID NO: 893834 - RNA, 17 nt, Mycobacterium avium subsp. paratuberculosis
acaccagggugcgcagc

SEQ ID NO: 893835 - RNA, 18 nt, Mycobacterium avium subsp. paratuberculosis
acaccagcgucgcgauca

SEQ ID NO: 893836 - RNA, 24 nt, Mycobacterium avium subsp. paratuberculosis
acaccagcguguugagcucgcggc

SEQ ID NO: 893837 - RNA, 21 nt, Mycobacterium avium subsp. paratuberculosis
acaccagcguucgucgccggu

SEQ ID NO: 893838 - RNA, 21 nt, Mycobacterium avium subsp. paratuberculosis
acaccagaugccgcucggcgc

SEQ ID NO: 893839 - RNA, 14 nt, Mycobacterium avium subsp. paratuberculosis
acaccagcccggcc

SEQ ID NO: 893840 - RNA, 15 nt, Mycobacterium avium subsp. paratuberculosis
acaccagcccggccg

SEQ ID NO: 893841 - RNA, 15 nt, Mycobacterium avium subsp. paratuberculosis
acaccagcgcgcacg

SEQ ID NO: 893842 - RNA, 16 nt, Mycobacterium avium subsp. paratuberculosis
acaccagcggucggcg

SEQ ID NO: 893843 - RNA, 17 nt, Mycobacterium avium subsp. paratuberculosis
acaccagcacccagcac

SEQ ID NO: 893844 - RNA, 14 nt, Mycobacterium avium subsp. paratuberculosis
acaccagcacggcg

SEQ ID NO: 893845 - RNA, 16 nt, Mycobacterium avium subsp. paratuberculosis
acaccagcacggcggc

SEQ ID NO: 893846 - RNA, 14 nt, Mycobacterium avium subsp. paratuberculosis
acaccgcuggccga

SEQ ID NO: 893847 - RNA, 17 nt, Mycobacterium avium subsp. paratuberculosis
acaccgcuggccgaggc

SEQ ID NO: 893848 - RNA, 18 nt, Mycobacterium avium subsp. paratuberculosis
acaccgcuggccgaggcc

SEQ ID NO: 893849 - RNA, 17 nt, Mycobacterium avium subsp. paratuberculosis
acaccggaucggcugcg

SEQ ID NO: 893850 - RNA, 14 nt, Mycobacterium avium subsp. paratuberculosis
acaccggccgggac

SEQ ID NO: 893851 - RNA, 23 nt, Mycobacterium avium subsp. paratuberculosis
acaccccgcgagucaccggcucg

SEQ ID NO: 893852 - RNA, 13 nt, Mycobacterium avium subsp. paratuberculosis
acaccccggccac

SEQ ID NO: 893853 - RNA, 16 nt, Mycobacterium avium subsp. paratuberculosis
acacccagccgcugaa

SEQ ID NO: 893854 - RNA, 17 nt, Mycobacterium avium subsp. paratuberculosis
acacccagcgagccgau

SEQ ID NO: 893855 - RNA, 12 nt, Mycobacterium avium subsp. paratuberculosis
acacccagcgcc

SEQ ID NO: 893856 - RNA, 14 nt, Mycobacterium avium subsp. paratuberculosis
acacccagcgccag

SEQ ID NO: 893857 - RNA, 20 nt, Mycobacterium avium subsp. paratuberculosis
acacccagaugcccagcggc

SEQ ID NO: 893858 - RNA, 16 nt, Mycobacterium avium subsp. paratuberculosis
acaccggcagcgccac

SEQ ID NO: 893859 - RNA, 15 nt, Mycobacterium avium subsp. paratuberculosis
acaccggcggcgacg

SEQ ID NO: 893860 - RNA, 18 nt, Mycobacterium avium subsp. paratuberculosis
acaccggcggcgacggca

SEQ ID NO: 893861 - RNA, 19 nt, Mycobacterium avium subsp. paratuberculosis
acaccggcggcgacggcac

SEQ ID NO: 893862 - RNA, 22 nt, Mycobacterium avium subsp. paratuberculosis
acaccggcgugaugacggcggc

SEQ ID NO: 893863 - RNA, 23 nt, Mycobacterium avium subsp. paratuberculosis
acaccggcgugaugacggcggcg

SEQ ID NO: 893864 - RNA, 16 nt, Mycobacterium avium subsp. paratuberculosis
acaccgggaucggcgg

SEQ ID NO: 893865 - RNA, 18 nt, Mycobacterium avium subsp. paratuberculosis
acaccgggaucggcggcg

SEQ ID NO: 893866 - RNA, 20 nt, Mycobacterium avium subsp. paratuberculosis
acaccgggaucggggugccg

SEQ ID NO: 893867 - RNA, 16 nt, Mycobacterium avium subsp. paratuberculosis
acaccggcucgcugau

SEQ ID NO: 893868 - RNA, 19 nt, Mycobacterium avium subsp. paratuberculosis
acaccggcucgcugaucug

SEQ ID NO: 893869 - RNA, 14 nt, Mycobacterium avium subsp. paratuberculosis
acaccggcugaccg

SEQ ID NO: 893870 - RNA, 15 nt, Mycobacterium avium subsp. paratuberculosis
acaccggcugaccgg

SEQ ID NO: 893871 - RNA, 23 nt, Mycobacterium avium subsp. paratuberculosis
acaccggcgaggugaaccgcgac

SEQ ID NO: 893872 - RNA, 14 nt, Mycobacterium avium subsp. paratuberculosis
acaccggcgcgacc

SEQ ID NO: 893873 - RNA, 16 nt, Mycobacterium avium subsp. paratuberculosis
acacguagucgccgau

SEQ ID NO: 893874 - RNA, 22 nt, Mycobacterium avium subsp. paratuberculosis
acacguugagcccggaccggcc

SEQ ID NO: 893875 - RNA, 21 nt, Mycobacterium avium subsp. paratuberculosis
acacguugagucccucggcga

SEQ ID NO: 893876 - RNA, 21 nt, Mycobacterium avium subsp. paratuberculosis
acacguugcgcaucagcgcca

SEQ ID NO: 893877 - RNA, 22 nt, Mycobacterium avium subsp. paratuberculosis
acacguugcgcaucagcgccac

SEQ ID NO: 893878 - RNA, 14 nt, Mycobacterium avium subsp. paratuberculosis
acacgucggccagc

SEQ ID NO: 893879 - RNA, 16 nt, Mycobacterium avium subsp. paratuberculosis
acacgucggccagcgc

SEQ ID NO: 893880 - RNA, 17 nt, Mycobacterium avium subsp. paratuberculosis
acacgucggccagcgcg

SEQ ID NO: 893881 - RNA, 16 nt, Mycobacterium avium subsp. paratuberculosis
acacgugcaucugcga

SEQ ID NO: 893882 - RNA, 19 nt, Mycobacterium avium subsp. paratuberculosis
acagacacagcacgcccug

SEQ ID NO: 893883 - RNA, 15 nt, Mycobacterium avium subsp. paratuberculosis
acaccuugucggcga

SEQ ID NO: 893884 - RNA, 15 nt, Mycobacterium avium subsp. paratuberculosis
acaccuuucggccgc

SEQ ID NO: 893885 - RNA, 17 nt, Mycobacterium avium subsp. paratuberculosis
acaccuuccaccaccgc

SEQ ID NO: 893886 - RNA, 22 nt, Mycobacterium avium subsp. paratuberculosis
acaccuccuuggguucggcggc

SEQ ID NO: 893887 - RNA, 23 nt, Mycobacterium avium subsp. paratuberculosis
acaccuccuuggguucggcggcg

SEQ ID NO: 893888 - RNA, 22 nt, Mycobacterium avium subsp. paratuberculosis
acaccucgccguccuugacgaa

SEQ ID NO: 893889 - RNA, 21 nt, Mycobacterium avium subsp. paratuberculosis
acaccucggccagcgccgcgc

SEQ ID NO: 893890 - RNA, 12 nt, Mycobacterium avium subsp. paratuberculosis
acaccucggcga

SEQ ID NO: 893891 - RNA, 13 nt, Mycobacterium avium subsp. paratuberculosis
acaccucggcgac

SEQ ID NO: 893892 - RNA, 15 nt, Mycobacterium avium subsp. paratuberculosis
acaccucggcgacgu

SEQ ID NO: 893893 - RNA, 14 nt, Mycobacterium avium subsp. paratuberculosis
acaccucggcgaug

SEQ ID NO: 893894 - RNA, 12 nt, Mycobacterium avium subsp. paratuberculosis
acaccucgggau

SEQ ID NO: 893895 - RNA, 23 nt, Mycobacterium avium subsp. paratuberculosis
acaccucggugaucucaccggcg

SEQ ID NO: 893896 - RNA, 21 nt, Mycobacterium avium subsp. paratuberculosis
acaccucgucgaucuucgcgg

SEQ ID NO: 893897 - RNA, 14 nt, Mycobacterium avium subsp. paratuberculosis
acaccugcggcggc

SEQ ID NO: 893898 - RNA, 15 nt, Mycobacterium avium subsp. paratuberculosis
acaccugcggcggca

SEQ ID NO: 893899 - RNA, 15 nt, Mycobacterium avium subsp. paratuberculosis
acacgaacccggcgg

SEQ ID NO: 893900 - RNA, 13 nt, Mycobacterium avium subsp. paratuberculosis
acacgaagccggu

SEQ ID NO: 893901 - RNA, 22 nt, Mycobacterium avium subsp. paratuberculosis
acacgaauacccuccgggcggc

SEQ ID NO: 893902 - RNA, 20 nt, Mycobacterium avium subsp. paratuberculosis
acacgaauacccuucggccg

SEQ ID NO: 893903 - RNA, 16 nt, Mycobacterium avium subsp. paratuberculosis
acacgggccgcgccga

SEQ ID NO: 893904 - RNA, 14 nt, Mycobacterium avium subsp. paratuberculosis
acacgggccgucca

SEQ ID NO: 893905 - RNA, 20 nt, Mycobacterium avium subsp. paratuberculosis
acacgggcggcagggccagc

SEQ ID NO: 893906 - RNA, 15 nt, Mycobacterium avium subsp. paratuberculosis
acacguacagcggcg

SEQ ID NO: 893907 - RNA, 20 nt, Mycobacterium avium subsp. paratuberculosis
acacguccagcucucgagca

SEQ ID NO: 893908 - RNA, 23 nt, Mycobacterium avium subsp. paratuberculosis
acacguagaaggcgccgucggug

SEQ ID NO: 893909 - RNA, 15 nt, Mycobacterium avium subsp. paratuberculosis
acacguccuggcgcc

SEQ ID NO: 893910 - RNA, 23 nt, Mycobacterium avium subsp. paratuberculosis
acagcagcagaaccagcaccgcc

SEQ ID NO: 893911 - RNA, 22 nt, Mycobacterium avium subsp. paratuberculosis
acagcagcagcagcggcagcga

SEQ ID NO: 893912 - RNA, 16 nt, Mycobacterium avium subsp. paratuberculosis
acagcagccccugcac

SEQ ID NO: 893913 - RNA, 12 nt, Mycobacterium avium subsp. paratuberculosis
acagcagccgca

SEQ ID NO: 893914 - RNA, 22 nt, Mycobacterium avium subsp. paratuberculosis
acagaugccagacgaacgcggc

SEQ ID NO: 893915 - RNA, 13 nt, Mycobacterium avium subsp. paratuberculosis
acagaugccugcc

SEQ ID NO: 893916 - RNA, 23 nt, Mycobacterium avium subsp. paratuberculosis
acagaugccugcccagcggcacg

SEQ ID NO: 893917 - RNA, 18 nt, Mycobacterium avium subsp. paratuberculosis
acagaucgucucggccag

SEQ ID NO: 893918 - RNA, 19 nt, Mycobacterium avium subsp. paratuberculosis
acagagcgggaucccgcag

SEQ ID NO: 893919 - RNA, 20 nt, Mycobacterium avium subsp. paratuberculosis
acagagcgggaucccgcagc

SEQ ID NO: 893920 - RNA, 18 nt, Mycobacterium avium subsp. paratuberculosis
acagacucagcccggccc

SEQ ID NO: 893921 - RNA, 19 nt, Mycobacterium avium subsp. paratuberculosis
acagacucagcccggccca

SEQ ID NO: 893922 - RNA, 13 nt, Mycobacterium avium subsp. paratuberculosis
acagccgccccga

SEQ ID NO: 893923 - RNA, 14 nt, Mycobacterium avium subsp. paratuberculosis
acagccgcccggcg

SEQ ID NO: 893924 - RNA, 15 nt, Mycobacterium avium subsp. paratuberculosis
acagccgcccggcgc

SEQ ID NO: 893925 - RNA, 16 nt, Mycobacterium avium subsp. paratuberculosis
acagccgcccggcgcc

SEQ ID NO: 893926 - RNA, 17 nt, Mycobacterium avium subsp. paratuberculosis
acagccgagauggcaac

SEQ ID NO: 893927 - RNA, 16 nt, Mycobacterium avium subsp. paratuberculosis
acagcccguugcugcg

SEQ ID NO: 893928 - RNA, 16 nt, Mycobacterium avium subsp. paratuberculosis
acagccgcaccggcgc

SEQ ID NO: 893929 - RNA, 17 nt, Mycobacterium avium subsp. paratuberculosis
acagccgcaccggcgcc

SEQ ID NO: 893930 - RNA, 19 nt, Mycobacterium avium subsp. paratuberculosis
acagccgcaccggcgccgc

SEQ ID NO: 893931 - RNA, 19 nt, Mycobacterium avium subsp. paratuberculosis
acagccgcagcagccgcgc

SEQ ID NO: 893932 - RNA, 19 nt, Mycobacterium avium subsp. paratuberculosis
acagcaugaagaucagcac

SEQ ID NO: 893933 - RNA, 17 nt, Mycobacterium avium subsp. paratuberculosis
acagcauuucgcgcggc

SEQ ID NO: 893934 - RNA, 13 nt, Mycobacterium avium subsp. paratuberculosis
acagcagcgcgcc

SEQ ID NO: 893935 - RNA, 15 nt, Mycobacterium avium subsp. paratuberculosis
acagcagcgccgcgg

SEQ ID NO: 893936 - RNA, 12 nt, Mycobacterium avium subsp. paratuberculosis
acagcagcggca

SEQ ID NO: 893937 - RNA, 16 nt, Mycobacterium avium subsp. paratuberculosis
acagcaggaucuccgg

SEQ ID NO: 893938 - RNA, 17 nt, Mycobacterium avium subsp. paratuberculosis
acagcaggaucuccggc

SEQ ID NO: 893939 - RNA, 19 nt, Mycobacterium avium subsp. paratuberculosis
acagcagggcaccgacggc

SEQ ID NO: 893940 - RNA, 22 nt, Mycobacterium avium subsp. paratuberculosis
acagcagggcaccgacggccgc

SEQ ID NO: 893941 - RNA, 23 nt, Mycobacterium avium subsp. paratuberculosis
acagcagggcaccgacggccgca

SEQ ID NO: 893942 - RNA, 16 nt, Mycobacterium avium subsp. paratuberculosis
acagcgugcacacccg

SEQ ID NO: 893943 - RNA, 14 nt, Mycobacterium avium subsp. paratuberculosis
acagccgcgauagc

SEQ ID NO: 893944 - RNA, 20 nt, Mycobacterium avium subsp. paratuberculosis
acagcgugacccugccguca

SEQ ID NO: 893945 - RNA, 18 nt, Mycobacterium avium subsp. paratuberculosis
acagcgucucgaccgcgg

SEQ ID NO: 893946 - RNA, 20 nt, Mycobacterium avium subsp. paratuberculosis
acagcgucucgaccgcggug

SEQ ID NO: 893947 - RNA, 21 nt, Mycobacterium avium subsp. paratuberculosis
acagcgucucgacggcgccga

SEQ ID NO: 893948 - RNA, 22 nt, Mycobacterium avium subsp. paratuberculosis
acagcgucucgacggcgccgac

SEQ ID NO: 893949 - RNA, 23 nt, Mycobacterium avium subsp. paratuberculosis
acagccggacgggaucggcgcgu

SEQ ID NO: 893950 - RNA, 13 nt, Mycobacterium avium subsp. paratuberculosis
acagccggcccga

SEQ ID NO: 893951 - RNA, 14 nt, Mycobacterium avium subsp. paratuberculosis
acagccggcggcgg

SEQ ID NO: 893952 - RNA, 22 nt, Mycobacterium avium subsp. paratuberculosis
acagccggcggcggcggucggc

SEQ ID NO: 893953 - RNA, 20 nt, Mycobacterium avium subsp. paratuberculosis
acagccgggaaucgagggcg

SEQ ID NO: 893954 - RNA, 15 nt, Mycobacterium avium subsp. paratuberculosis
acagccgcuuggcgc

SEQ ID NO: 893955 - RNA, 20 nt, Mycobacterium avium subsp. paratuberculosis
acagccgcuuggcgcgccgc

SEQ ID NO: 893956 - RNA, 22 nt, Mycobacterium avium subsp. paratuberculosis
acagccgcauguugugcccgac

SEQ ID NO: 893957 - RNA, 17 nt, Mycobacterium avium subsp. paratuberculosis
acagccgggccgcccgc

SEQ ID NO: 893958 - RNA, 18 nt, Mycobacterium avium subsp. paratuberculosis
acagccgggccgcccgcg

SEQ ID NO: 893959 - RNA, 19 nt, Mycobacterium avium subsp. paratuberculosis
acagccgggccgcccgcgc

SEQ ID NO: 893960 - RNA, 20 nt, Mycobacterium avium subsp. paratuberculosis
acagccgggccgcccgcgcg

SEQ ID NO: 893961 - RNA, 20 nt, Mycobacterium avium subsp. paratuberculosis
acagccggggaucgcgcagc

SEQ ID NO: 893962 - RNA, 22 nt, Mycobacterium avium subsp. paratuberculosis
acagccggggaucgcgcagccg

SEQ ID NO: 893963 - RNA, 20 nt, Mycobacterium avium subsp. paratuberculosis
acagccgguccgaccgccac

SEQ ID NO: 893964 - RNA, 21 nt, Mycobacterium avium subsp. paratuberculosis
acagccgguccgaccgccacc

SEQ ID NO: 893965 - RNA, 17 nt, Mycobacterium avium subsp. paratuberculosis
acagccggucgcgcauc

SEQ ID NO: 893966 - RNA, 16 nt, Mycobacterium avium subsp. paratuberculosis
acagcuaggccagcag

SEQ ID NO: 893967 - RNA, 19 nt, Mycobacterium avium subsp. paratuberculosis
acagcuaggccagcagcgc

SEQ ID NO: 893968 - RNA, 17 nt, Mycobacterium avium subsp. paratuberculosis
acagcuaggucguggcg

SEQ ID NO: 893969 - RNA, 21 nt, Mycobacterium avium subsp. paratuberculosis
acagcuaggucguggcgccga

SEQ ID NO: 893970 - RNA, 23 nt, Mycobacterium avium subsp. paratuberculosis
acagcuaggucguggcgccgagg

SEQ ID NO: 893971 - RNA, 13 nt, Mycobacterium avium subsp. paratuberculosis
acagcguggucgc

SEQ ID NO: 893972 - RNA, 19 nt, Mycobacterium avium subsp. paratuberculosis
acagcguggucgcgcagca

SEQ ID NO: 893973 - RNA, 15 nt, Mycobacterium avium subsp. paratuberculosis
acagcucgaccagcc

SEQ ID NO: 893974 - RNA, 20 nt, Mycobacterium avium subsp. paratuberculosis
acagcucgaccagccggguc

SEQ ID NO: 893975 - RNA, 13 nt, Mycobacterium avium subsp. paratuberculosis
acagcucgccggc

SEQ ID NO: 893976 - RNA, 16 nt, Mycobacterium avium subsp. paratuberculosis
acagcucgccggccgc

SEQ ID NO: 893977 - RNA, 19 nt, Mycobacterium avium subsp. paratuberculosis
acaggaugcguucggccag

SEQ ID NO: 893978 - RNA, 18 nt, Mycobacterium avium subsp. paratuberculosis
acaggacguugaggcggc

SEQ ID NO: 893979 - RNA, 18 nt, Mycobacterium avium subsp. paratuberculosis
acaggaucuggacgaucg

SEQ ID NO: 893980 - RNA, 22 nt, Mycobacterium avium subsp. paratuberculosis
acaggaugcccaacagcucgcg

SEQ ID NO: 893981 - RNA, 20 nt, Mycobacterium avium subsp. paratuberculosis
acaggaggguuuucggggcg

SEQ ID NO: 893982 - RNA, 21 nt, Mycobacterium avium subsp. paratuberculosis
acaggaggguuuucggggcgu

SEQ ID NO: 893983 - RNA, 16 nt, Mycobacterium avium subsp. paratuberculosis
acagcuuucgggcggc

SEQ ID NO: 893984 - RNA, 22 nt, Mycobacterium avium subsp. paratuberculosis
acagcuuugggaagaggcgcgc

SEQ ID NO: 893985 - RNA, 12 nt, Mycobacterium avium subsp. paratuberculosis
acaggaacgcga

SEQ ID NO: 893986 - RNA, 14 nt, Mycobacterium avium subsp. paratuberculosis
acaggaacgcgacg

SEQ ID NO: 893987 - RNA, 23 nt, Mycobacterium avium subsp. paratuberculosis
acaggaacgcgucgaccgccgcg

SEQ ID NO: 893988 - RNA, 17 nt, Mycobacterium avium subsp. paratuberculosis
acaggaacgggccggcg

SEQ ID NO: 893989 - RNA, 18 nt, Mycobacterium avium subsp. paratuberculosis
acaggaacgggccggcgu

SEQ ID NO: 893990 - RNA, 17 nt, Mycobacterium avium subsp. paratuberculosis
acagcugcgcgggcgcg

SEQ ID NO: 893991 - RNA, 23 nt, Mycobacterium avium subsp. paratuberculosis
acagcugcgcgggcgcggccagc

SEQ ID NO: 893992 - RNA, 17 nt, Mycobacterium avium subsp. paratuberculosis
acagcugguccggccgg

SEQ ID NO: 893993 - RNA, 19 nt, Mycobacterium avium subsp. paratuberculosis
acagcucgcgggccugcuc

SEQ ID NO: 893994 - RNA, 23 nt, Mycobacterium avium subsp. paratuberculosis
acagcucgggcagcgugucccgg

SEQ ID NO: 893995 - RNA, 15 nt, Mycobacterium avium subsp. paratuberculosis
acagcugagcagccc

SEQ ID NO: 893996 - RNA, 18 nt, Mycobacterium avium subsp. paratuberculosis
acagcugagcagcccgac

SEQ ID NO: 893997 - RNA, 23 nt, Mycobacterium avium subsp. paratuberculosis
acagcugagcagcccgaccaccu

SEQ ID NO: 893998 - RNA, 13 nt, Mycobacterium avium subsp. paratuberculosis
acagcuucggcgc

SEQ ID NO: 893999 - RNA, 16 nt, Mycobacterium avium subsp. paratuberculosis
acagcuucggcgccga

SEQ ID NO: 894000 - RNA, 13 nt, Mycobacterium avium subsp. paratuberculosis
acagcuugauguu

SEQ ID NO: 894001 - RNA, 21 nt, Mycobacterium avium subsp. paratuberculosis
acagcuugauguugccgugcu

SEQ ID NO: 894002 - RNA, 15 nt, Mycobacterium avium subsp. paratuberculosis
acagggagccgacga

SEQ ID NO: 894003 - RNA, 23 nt, Mycobacterium avium subsp. paratuberculosis
acagggaggacagcaccgccauc

SEQ ID NO: 894004 - RNA, 14 nt, Mycobacterium avium subsp. paratuberculosis
acagggccaccgcg

SEQ ID NO: 894005 - RNA, 19 nt, Mycobacterium avium subsp. paratuberculosis
acagggucaucgcgccgga

SEQ ID NO: 894006 - RNA, 16 nt, Mycobacterium avium subsp. paratuberculosis
acagggccgcgcgggc

SEQ ID NO: 894007 - RNA, 13 nt, Mycobacterium avium subsp. paratuberculosis
acagggcgacauc

SEQ ID NO: 894008 - RNA, 16 nt, Mycobacterium avium subsp. paratuberculosis
acagggcgacggcggc

SEQ ID NO: 894009 - RNA, 17 nt, Mycobacterium avium subsp. paratuberculosis
acaggcuggccagcucg

SEQ ID NO: 894010 - RNA, 20 nt, Mycobacterium avium subsp. paratuberculosis
acaggcuggccagcucggcg

SEQ ID NO: 894011 - RNA, 15 nt, Mycobacterium avium subsp. paratuberculosis
acaggcccagcagcg

SEQ ID NO: 894012 - RNA, 14 nt, Mycobacterium avium subsp. paratuberculosis
acaggccccacgcg

SEQ ID NO: 894013 - RNA, 22 nt, Mycobacterium avium subsp. paratuberculosis
acaggccccacgcgcucagcgc

SEQ ID NO: 894014 - RNA, 14 nt, Mycobacterium avium subsp. paratuberculosis
acaggcagcccggc

SEQ ID NO: 894015 - RNA, 16 nt, Mycobacterium avium subsp. paratuberculosis
acaggcagcccggcug

SEQ ID NO: 894016 - RNA, 23 nt, Mycobacterium avium subsp. paratuberculosis
acaggcacacgaacaccggcgga

SEQ ID NO: 894017 - RNA, 22 nt, Mycobacterium avium subsp. paratuberculosis
acaggccgccgcauuccucggc

SEQ ID NO: 894018 - RNA, 15 nt, Mycobacterium avium subsp. paratuberculosis
acaggccgccugcgg

SEQ ID NO: 894019 - RNA, 18 nt, Mycobacterium avium subsp. paratuberculosis
acaggccgaacagcagcg

SEQ ID NO: 894020 - RNA, 14 nt, Mycobacterium avium subsp. paratuberculosis
acaggccgagcgcg

SEQ ID NO: 894021 - RNA, 17 nt, Mycobacterium avium subsp. paratuberculosis
acaggccgagcgcgcug

SEQ ID NO: 894022 - RNA, 14 nt, Mycobacterium avium subsp. paratuberculosis
acaggccggcgacg

SEQ ID NO: 894023 - RNA, 14 nt, Mycobacterium avium subsp. paratuberculosis
acaggccgucgggg

SEQ ID NO: 894024 - RNA, 21 nt, Mycobacterium avium subsp. paratuberculosis
acaggcgaaucggcgcacagc

SEQ ID NO: 894025 - RNA, 20 nt, Mycobacterium avium subsp. paratuberculosis
acaucggcagcagggugccg

SEQ ID NO: 894026 - RNA, 13 nt, Mycobacterium avium subsp. paratuberculosis
acaucggcgccga

SEQ ID NO: 894027 - RNA, 14 nt, Mycobacterium avium subsp. paratuberculosis
acaucggcgccgac

SEQ ID NO: 894028 - RNA, 15 nt, Mycobacterium avium subsp. paratuberculosis
acaucggcgccgacg

SEQ ID NO: 894029 - RNA, 15 nt, Mycobacterium avium subsp. paratuberculosis
acaucgccucggccg

SEQ ID NO: 894030 - RNA, 17 nt, Mycobacterium avium subsp. paratuberculosis
acaucgccucggcgucc

SEQ ID NO: 894031 - RNA, 16 nt, Mycobacterium avium subsp. paratuberculosis
acauccagaugcccag

SEQ ID NO: 894032 - RNA, 16 nt, Mycobacterium avium subsp. paratuberculosis
acauccaggaccgcgc

SEQ ID NO: 894033 - RNA, 16 nt, Mycobacterium avium subsp. paratuberculosis
acaucgacgcgaccgg

SEQ ID NO: 894034 - RNA, 13 nt, Mycobacterium avium subsp. paratuberculosis
acaucgagcccac

SEQ ID NO: 894035 - RNA, 21 nt, Mycobacterium avium subsp. paratuberculosis
acaucgagcccaccgcgccca

SEQ ID NO: 894036 - RNA, 12 nt, Mycobacterium avium subsp. paratuberculosis
acaucgccaccu

SEQ ID NO: 894037 - RNA, 14 nt, Mycobacterium avium subsp. paratuberculosis
acauggcgcccgcg

SEQ ID NO: 894038 - RNA, 16 nt, Mycobacterium avium subsp. paratuberculosis
acauggcggccagccg

SEQ ID NO: 894039 - RNA, 22 nt, Mycobacterium avium subsp. paratuberculosis
acaugccgagcagcaccgcgac

SEQ ID NO: 894040 - RNA, 18 nt, Mycobacterium avium subsp. paratuberculosis
acaugccguugccaggcc

SEQ ID NO: 894041 - RNA, 15 nt, Mycobacterium avium subsp. paratuberculosis
acaugccggcgccga

SEQ ID NO: 894042 - RNA, 16 nt, Mycobacterium avium subsp. paratuberculosis
acaugccggcgccgau

SEQ ID NO: 894043 - RNA, 13 nt, Mycobacterium avium subsp. paratuberculosis
acaugcugcacgg

SEQ ID NO: 894044 - RNA, 15 nt, Mycobacterium avium subsp. paratuberculosis
acaugcugccgccgg

SEQ ID NO: 894045 - RNA, 15 nt, Mycobacterium avium subsp. paratuberculosis
acaugcgcagcgccc

SEQ ID NO: 894046 - RNA, 18 nt, Mycobacterium avium subsp. paratuberculosis
acaucagaucgccgacga

SEQ ID NO: 894047 - RNA, 15 nt, Mycobacterium avium subsp. paratuberculosis
acaucagcucggcgg

SEQ ID NO: 894048 - RNA, 13 nt, Mycobacterium avium subsp. paratuberculosis
acaucacgguggc

SEQ ID NO: 894049 - RNA, 14 nt, Mycobacterium avium subsp. paratuberculosis
acaucacgguggcc

SEQ ID NO: 894050 - RNA, 16 nt, Mycobacterium avium subsp. paratuberculosis
acaucacgguggccgc

SEQ ID NO: 894051 - RNA, 15 nt, Mycobacterium avium subsp. paratuberculosis
acaucacgucccgcu

SEQ ID NO: 894052 - RNA, 17 nt, Mycobacterium avium subsp. paratuberculosis
acaucaccgcgggcgcg

SEQ ID NO: 894053 - RNA, 23 nt, Mycobacterium avium subsp. paratuberculosis
acaucaccgcgggcgcgccgucc

SEQ ID NO: 894054 - RNA, 19 nt, Mycobacterium avium subsp. paratuberculosis
acaucacccggcggcaccg

SEQ ID NO: 894055 - RNA, 19 nt, Mycobacterium avium subsp. paratuberculosis
acagguucuuggcggccug

SEQ ID NO: 894056 - RNA, 21 nt, Mycobacterium avium subsp. paratuberculosis
acaucaccaaccgcucggcga

SEQ ID NO: 894057 - RNA, 20 nt, Mycobacterium avium subsp. paratuberculosis
acagguaggcggcgccgucg

SEQ ID NO: 894058 - RNA, 23 nt, Mycobacterium avium subsp. paratuberculosis
acagguagcggugcucgauguac

SEQ ID NO: 894059 - RNA, 20 nt, Mycobacterium avium subsp. paratuberculosis
acagguaguagcgcgccggg

SEQ ID NO: 894060 - RNA, 23 nt, Mycobacterium avium subsp. paratuberculosis
acagguaguagcgcgccgggguc

SEQ ID NO: 894061 - RNA, 22 nt, Mycobacterium avium subsp. paratuberculosis
acaggucgaccaucugccggcg

SEQ ID NO: 894062 - RNA, 23 nt, Mycobacterium avium subsp. paratuberculosis
acaggucgaugauguugccccgc

SEQ ID NO: 894063 - RNA, 21 nt, Mycobacterium avium subsp. paratuberculosis
acaggucgcccggcucgccgg

SEQ ID NO: 894064 - RNA, 13 nt, Mycobacterium avium subsp. paratuberculosis
acaggucggcggu

SEQ ID NO: 894065 - RNA, 17 nt, Mycobacterium avium subsp. paratuberculosis
acaggucggcgugcagc

SEQ ID NO: 894066 - RNA, 17 nt, Mycobacterium avium subsp. paratuberculosis
acaggucgcugcccggc

SEQ ID NO: 894067 - RNA, 18 nt, Mycobacterium avium subsp. paratuberculosis
acaggucgcugcccggcg

SEQ ID NO: 894068 - RNA, 15 nt, Mycobacterium avium subsp. paratuberculosis
acagguuggcgccga

SEQ ID NO: 894069 - RNA, 16 nt, Mycobacterium avium subsp. paratuberculosis
acagguuggcgccgaa

SEQ ID NO: 894070 - RNA, 16 nt, Mycobacterium avium subsp. paratuberculosis
acagguuucgcucguc

SEQ ID NO: 894071 - RNA, 16 nt, Mycobacterium avium subsp. paratuberculosis
acaggugccggcggcg

SEQ ID NO: 894072 - RNA, 20 nt, Mycobacterium avium subsp. paratuberculosis
acaggugccggcggcgcggc

SEQ ID NO: 894073 - RNA, 15 nt, Mycobacterium avium subsp. paratuberculosis
acagguggggcacca

SEQ ID NO: 894074 - RNA, 18 nt, Mycobacterium avium subsp. paratuberculosis
accaguagaaguggccga

SEQ ID NO: 894075 - RNA, 14 nt, Mycobacterium avium subsp. paratuberculosis
accagucgcgcagc

SEQ ID NO: 894076 - RNA, 13 nt, Mycobacterium avium subsp. paratuberculosis
accagucggcgcg

SEQ ID NO: 894077 - RNA, 16 nt, Mycobacterium avium subsp. paratuberculosis
accaguaggucacccg

SEQ ID NO: 894078 - RNA, 21 nt, Mycobacterium avium subsp. paratuberculosis
accagguugucgccgcgccag

SEQ ID NO: 894079 - RNA, 22 nt, Mycobacterium avium subsp. paratuberculosis
accagguugucgccgcgccagc

SEQ ID NO: 894080 - RNA, 23 nt, Mycobacterium avium subsp. paratuberculosis
accagguugucgccgcgccagcc

SEQ ID NO: 894081 - RNA, 22 nt, Mycobacterium avium subsp. paratuberculosis
accaggugggcggccaccacuu

SEQ ID NO: 894082 - RNA, 14 nt, Mycobacterium avium subsp. paratuberculosis
accaggugaccggc

SEQ ID NO: 894083 - RNA, 18 nt, Mycobacterium avium subsp. paratuberculosis
accagguucgcgcagcuc

SEQ ID NO: 894084 - RNA, 14 nt, Mycobacterium avium subsp. paratuberculosis
accaggucgccggc

SEQ ID NO: 894085 - RNA, 17 nt, Mycobacterium avium subsp. paratuberculosis
accaggucgccggcggc

SEQ ID NO: 894086 - RNA, 14 nt, Mycobacterium avium subsp. paratuberculosis
accaggucgcggcg

SEQ ID NO: 894087 - RNA, 16 nt, Mycobacterium avium subsp. paratuberculosis
accaggucgcggcgcu

SEQ ID NO: 894088 - RNA, 12 nt, Mycobacterium avium subsp. paratuberculosis
accagguccggu

SEQ ID NO: 894089 - RNA, 21 nt, Mycobacterium avium subsp. paratuberculosis
accagguccgguucgaccggc

SEQ ID NO: 894090 - RNA, 18 nt, Mycobacterium avium subsp. paratuberculosis
accaggucuccgucggcg

SEQ ID NO: 894091 - RNA, 17 nt, Mycobacterium avium subsp. paratuberculosis
accaggguggccgccac

SEQ ID NO: 894092 - RNA, 13 nt, Mycobacterium avium subsp. paratuberculosis
accagggugcgca

SEQ ID NO: 894093 - RNA, 20 nt, Mycobacterium avium subsp. paratuberculosis
accagggugcgcagcgcguc

SEQ ID NO: 894094 - RNA, 21 nt, Mycobacterium avium subsp. paratuberculosis
accagggugcgcagcgcgucg

SEQ ID NO: 894095 - RNA, 20 nt, Mycobacterium avium subsp. paratuberculosis
accagggcgucgagcgcguc

SEQ ID NO: 894096 - RNA, 18 nt, Mycobacterium avium subsp. paratuberculosis
accagggucucgcgcagc

SEQ ID NO: 894097 - RNA, 19 nt, Mycobacterium avium subsp. paratuberculosis
accagggucucgcgcagca

SEQ ID NO: 894098 - RNA, 18 nt, Mycobacterium avium subsp. paratuberculosis
accagggucuucagcccg

SEQ ID NO: 894099 - RNA, 21 nt, Mycobacterium avium subsp. paratuberculosis
accagggucuucagcccgcgc

SEQ ID NO: 894100 - RNA, 13 nt, Mycobacterium avium subsp. paratuberculosis
accagggugccgc

SEQ ID NO: 894101 - RNA, 20 nt, Mycobacterium avium subsp. paratuberculosis
accaggucgagguccucggc

SEQ ID NO: 894102 - RNA, 18 nt, Mycobacterium avium subsp. paratuberculosis
accaggucgcacaccagc

SEQ ID NO: 894103 - RNA, 21 nt, Mycobacterium avium subsp. paratuberculosis
accaggucgcacaccagcacg

SEQ ID NO: 894104 - RNA, 23 nt, Mycobacterium avium subsp. paratuberculosis
accaggucgcacaccagcacggc

SEQ ID NO: 894105 - RNA, 20 nt, Mycobacterium avium subsp. paratuberculosis
accagggugucgucgcgcac

SEQ ID NO: 894106 - RNA, 16 nt, Mycobacterium avium subsp. paratuberculosis
accagguaccggcggg

SEQ ID NO: 894107 - RNA, 17 nt, Mycobacterium avium subsp. paratuberculosis
accagguaggcgaccau

SEQ ID NO: 894108 - RNA, 19 nt, Mycobacterium avium subsp. paratuberculosis
accagguaggcgguggcgc

SEQ ID NO: 894109 - RNA, 21 nt, Mycobacterium avium subsp. paratuberculosis
accagguaggcgguggcgcac

SEQ ID NO: 894110 - RNA, 19 nt, Mycobacterium avium subsp. paratuberculosis
accagguauucaucgcggc

SEQ ID NO: 894111 - RNA, 15 nt, Mycobacterium avium subsp. paratuberculosis
accagggcgguggcg

SEQ ID NO: 894112 - RNA, 13 nt, Mycobacterium avium subsp. paratuberculosis
accagggccgcga

SEQ ID NO: 894113 - RNA, 14 nt, Mycobacterium avium subsp. paratuberculosis
accagggccugcag

SEQ ID NO: 894114 - RNA, 15 nt, Mycobacterium avium subsp. paratuberculosis
accagggccugcagc

SEQ ID NO: 894115 - RNA, 17 nt, Mycobacterium avium subsp. paratuberculosis
accagggcgaccgccgc

SEQ ID NO: 894116 - RNA, 18 nt, Mycobacterium avium subsp. paratuberculosis
accagggcgaggaacccg

SEQ ID NO: 894117 - RNA, 22 nt, Mycobacterium avium subsp. paratuberculosis
accagggcgaucaccgcggcca

SEQ ID NO: 894118 - RNA, 18 nt, Mycobacterium avium subsp. paratuberculosis
accagggcagccagcccg

SEQ ID NO: 894119 - RNA, 15 nt, Mycobacterium avium subsp. paratuberculosis
accagggcagcgccu

SEQ ID NO: 894120 - RNA, 16 nt, Mycobacterium avium subsp. paratuberculosis
accagggcagcgccuc

SEQ ID NO: 894121 - RNA, 17 nt, Mycobacterium avium subsp. paratuberculosis
accagggcagcgccucg

SEQ ID NO: 894122 - RNA, 19 nt, Mycobacterium avium subsp. paratuberculosis
accagggcagcgccucggc

SEQ ID NO: 894123 - RNA, 17 nt, Mycobacterium avium subsp. paratuberculosis
accagcgcggacaccag

SEQ ID NO: 894124 - RNA, 13 nt, Mycobacterium avium subsp. paratuberculosis
accagcgcgccgc

SEQ ID NO: 894125 - RNA, 15 nt, Mycobacterium avium subsp. paratuberculosis
accagcgcgccgccc

SEQ ID NO: 894126 - RNA, 13 nt, Mycobacterium avium subsp. paratuberculosis
accagcgcggugc

SEQ ID NO: 894127 - RNA, 18 nt, Mycobacterium avium subsp. paratuberculosis
accagcgcguagagcauc

SEQ ID NO: 894128 - RNA, 23 nt, Mycobacterium avium subsp. paratuberculosis
accagcgcguagagcaucagguc

SEQ ID NO: 894129 - RNA, 18 nt, Mycobacterium avium subsp. paratuberculosis
accagcgcggccaccacc

SEQ ID NO: 894130 - RNA, 22 nt, Mycobacterium avium subsp. paratuberculosis
accaggcccagcggaucgaggu

SEQ ID NO: 894131 - RNA, 12 nt, Mycobacterium avium subsp. paratuberculosis
accaggcccagg

SEQ ID NO: 894132 - RNA, 23 nt, Mycobacterium avium subsp. paratuberculosis
accaggcccaggccgacgccggc

SEQ ID NO: 894133 - RNA, 16 nt, Mycobacterium avium subsp. paratuberculosis
accagcggcagcacgu

SEQ ID NO: 894134 - RNA, 18 nt, Mycobacterium avium subsp. paratuberculosis
accagcggcagcagcacc

SEQ ID NO: 894135 - RNA, 13 nt, Mycobacterium avium subsp. paratuberculosis
accagcggcaucg

SEQ ID NO: 894136 - RNA, 17 nt, Mycobacterium avium subsp. paratuberculosis
accagcggcaucgccgc

SEQ ID NO: 894137 - RNA, 19 nt, Mycobacterium avium subsp. paratuberculosis
accagcggcccaccgcgac

SEQ ID NO: 894138 - RNA, 12 nt, Mycobacterium avium subsp. paratuberculosis
accagcggcccg

SEQ ID NO: 894139 - RNA, 15 nt, Mycobacterium avium subsp. paratuberculosis
accagcggcccgcug

SEQ ID NO: 894140 - RNA, 20 nt, Mycobacterium avium subsp. paratuberculosis
accaggcccaccaccacgag

SEQ ID NO: 894141 - RNA, 16 nt, Mycobacterium avium subsp. paratuberculosis
accaggccgcgcuggc

SEQ ID NO: 894142 - RNA, 18 nt, Mycobacterium avium subsp. paratuberculosis
accaggccgcgcuggcgc

SEQ ID NO: 894143 - RNA, 19 nt, Mycobacterium avium subsp. paratuberculosis
accaggccgcgcuggcgca

SEQ ID NO: 894144 - RNA, 17 nt, Mycobacterium avium subsp. paratuberculosis
accaggccgaagacgau

SEQ ID NO: 894145 - RNA, 15 nt, Mycobacterium avium subsp. paratuberculosis
accaggccgacgcug

SEQ ID NO: 894146 - RNA, 18 nt, Mycobacterium avium subsp. paratuberculosis
accaggccgacgcuggcc

SEQ ID NO: 894147 - RNA, 21 nt, Mycobacterium avium subsp. paratuberculosis
accaggcugaacgucgucagc

SEQ ID NO: 894148 - RNA, 18 nt, Mycobacterium avium subsp. paratuberculosis
accaggcugcucggcggg

SEQ ID NO: 894149 - RNA, 19 nt, Mycobacterium avium subsp. paratuberculosis
accaggcugcucggcgggc

SEQ ID NO: 894150 - RNA, 19 nt, Mycobacterium avium subsp. paratuberculosis
accagggacaugccgagca

SEQ ID NO: 894151 - RNA, 21 nt, Mycobacterium avium subsp. paratuberculosis
accagggacaugccgagcagc

SEQ ID NO: 894152 - RNA, 18 nt, Mycobacterium avium subsp. paratuberculosis
accaggcccuccugggug

SEQ ID NO: 894153 - RNA, 12 nt, Mycobacterium avium subsp. paratuberculosis
accaggcgacgu

SEQ ID NO: 894154 - RNA, 13 nt, Mycobacterium avium subsp. paratuberculosis
accaggcgacguu

SEQ ID NO: 894155 - RNA, 13 nt, Mycobacterium avium subsp. paratuberculosis
accaggcgcacca

SEQ ID NO: 894156 - RNA, 16 nt, Mycobacterium avium subsp. paratuberculosis
accaggcgcaccagcu

SEQ ID NO: 894157 - RNA, 13 nt, Mycobacterium avium subsp. paratuberculosis
accaggcgccggc

SEQ ID NO: 894158 - RNA, 16 nt, Mycobacterium avium subsp. paratuberculosis
accaggcgccggccag

SEQ ID NO: 894159 - RNA, 18 nt, Mycobacterium avium subsp. paratuberculosis
accaguuucacgucggcg

SEQ ID NO: 894160 - RNA, 20 nt, Mycobacterium avium subsp. paratuberculosis
accaguuucacgucggcgau

SEQ ID NO: 894161 - RNA, 17 nt, Mycobacterium avium subsp. paratuberculosis
accagugcacgcucggc

SEQ ID NO: 894162 - RNA, 20 nt, Mycobacterium avium subsp. paratuberculosis
accagugcacgcucggcggg

SEQ ID NO: 894163 - RNA, 16 nt, Mycobacterium avium subsp. paratuberculosis
accagugcagagcgau

SEQ ID NO: 894164 - RNA, 16 nt, Mycobacterium avium subsp. paratuberculosis
accagugcccggccaa

SEQ ID NO: 894165 - RNA, 16 nt, Mycobacterium avium subsp. paratuberculosis
accaguguccgggcgc

SEQ ID NO: 894166 - RNA, 15 nt, Mycobacterium avium subsp. paratuberculosis
accagugguggccga

SEQ ID NO: 894167 - RNA, 21 nt, Mycobacterium avium subsp. paratuberculosis
accaguucuucgaugacggcc

SEQ ID NO: 894168 - RNA, 19 nt, Mycobacterium avium subsp. paratuberculosis
accaguucgcccuggccgc

SEQ ID NO: 894169 - RNA, 20 nt, Mycobacterium avium subsp. paratuberculosis
accaguuccugcaugccggg

SEQ ID NO: 894170 - RNA, 23 nt, Mycobacterium avium subsp. paratuberculosis
accaguuccugcaugccgggcag

SEQ ID NO: 894171 - RNA, 17 nt, Mycobacterium avium subsp. paratuberculosis
accauccgcgacgccag

SEQ ID NO: 894172 - RNA, 17 nt, Mycobacterium avium subsp. paratuberculosis
accaucccgccgccgaa

SEQ ID NO: 894173 - RNA, 18 nt, Mycobacterium avium subsp. paratuberculosis
accaucgcgauggaagcg

SEQ ID NO: 894174 - RNA, 21 nt, Mycobacterium avium subsp. paratuberculosis
accaucgcgauggaagcgccc

SEQ ID NO: 894175 - RNA, 14 nt, Mycobacterium avium subsp. paratuberculosis
accaucgaggcgau

SEQ ID NO: 894176 - RNA, 13 nt, Mycobacterium avium subsp. paratuberculosis
accaucagcgccc

SEQ ID NO: 894177 - RNA, 14 nt, Mycobacterium avium subsp. paratuberculosis
accaucagcgcccg

SEQ ID NO: 894178 - RNA, 15 nt, Mycobacterium avium subsp. paratuberculosis
accaucagcggcucg

SEQ ID NO: 894179 - RNA, 16 nt, Mycobacterium avium subsp. paratuberculosis
accaucagcggcucgc

SEQ ID NO: 894180 - RNA, 14 nt, Mycobacterium avium subsp. paratuberculosis
accaucaggccggc

SEQ ID NO: 894181 - RNA, 18 nt, Mycobacterium avium subsp. paratuberculosis
accaucaggccggccugc

SEQ ID NO: 894182 - RNA, 21 nt, Mycobacterium avium subsp. paratuberculosis
accaucaggccggccugccac

SEQ ID NO: 894183 - RNA, 19 nt, Mycobacterium avium subsp. paratuberculosis
accaucaccuguacguguc

SEQ ID NO: 894184 - RNA, 13 nt, Mycobacterium avium subsp. paratuberculosis
accaugucgacgc

SEQ ID NO: 894185 - RNA, 21 nt, Mycobacterium avium subsp. paratuberculosis
accaugucgacgcugagccgc

SEQ ID NO: 894186 - RNA, 23 nt, Mycobacterium avium subsp. paratuberculosis
accaugucgacgcugagccgcuc

SEQ ID NO: 894187 - RNA, 16 nt, Mycobacterium avium subsp. paratuberculosis
accaugucguugacgc

SEQ ID NO: 894188 - RNA, 21 nt, Mycobacterium avium subsp. paratuberculosis
accauggcgcggcggccggcc

SEQ ID NO: 894189 - RNA, 23 nt, Mycobacterium avium subsp. paratuberculosis
accauggcgcggcggccggccag

SEQ ID NO: 894190 - RNA, 18 nt, Mycobacterium avium subsp. paratuberculosis
accauggcuuccgccgag

SEQ ID NO: 894191 - RNA, 14 nt, Mycobacterium avium subsp. paratuberculosis
accaugccgccgaa

SEQ ID NO: 894192 - RNA, 13 nt, Mycobacterium avium subsp. paratuberculosis
accauugcgccgg

SEQ ID NO: 894193 - RNA, 19 nt, Mycobacterium avium subsp. paratuberculosis
accaucgggucgucggcgu

SEQ ID NO: 894194 - RNA, 16 nt, Mycobacterium avium subsp. paratuberculosis
accaugaucagcgccg

SEQ ID NO: 894195 - RNA, 17 nt, Mycobacterium avium subsp. paratuberculosis
accaugaucagcgccgu

SEQ ID NO: 894196 - RNA, 21 nt, Mycobacterium avium subsp. paratuberculosis
accaugaucagcgccguggcc

SEQ ID NO: 894197 - RNA, 13 nt, Mycobacterium avium subsp. paratuberculosis
accaugcccggcg

SEQ ID NO: 894198 - RNA, 15 nt, Mycobacterium avium subsp. paratuberculosis
accaugauguagcgg

SEQ ID NO: 894199 - RNA, 17 nt, Mycobacterium avium subsp. paratuberculosis
accaugauguagcggcg

SEQ ID NO: 894200 - RNA, 17 nt, Mycobacterium avium subsp. paratuberculosis
accaugccggcguccag

SEQ ID NO: 894201 - RNA, 20 nt, Mycobacterium avium subsp. paratuberculosis
accaugccguagcggucgcc

SEQ ID NO: 894202 - RNA, 18 nt, Mycobacterium avium subsp. paratuberculosis
acauguucuccucgucgc

SEQ ID NO: 894203 - RNA, 21 nt, Mycobacterium avium subsp. paratuberculosis
acauguucuccucgucgcggg

SEQ ID NO: 894204 - RNA, 23 nt, Mycobacterium avium subsp. paratuberculosis
acauucacgaggccgggcuggcg

SEQ ID NO: 894205 - RNA, 19 nt, Mycobacterium avium subsp. paratuberculosis
accaaugcgccggcggccg

SEQ ID NO: 894206 - RNA, 16 nt, Mycobacterium avium subsp. paratuberculosis
accaauggcggccacg

SEQ ID NO: 894207 - RNA, 17 nt, Mycobacterium avium subsp. paratuberculosis
accacacccagcgccag

SEQ ID NO: 894208 - RNA, 16 nt, Mycobacterium avium subsp. paratuberculosis
accacacccgcggccg

SEQ ID NO: 894209 - RNA, 14 nt, Mycobacterium avium subsp. paratuberculosis
accaccaccgccgu

SEQ ID NO: 894210 - RNA, 22 nt, Mycobacterium avium subsp. paratuberculosis
accaccacgaccagugcccggc

SEQ ID NO: 894211 - RNA, 14 nt, Mycobacterium avium subsp. paratuberculosis
accaccagcgaggu

SEQ ID NO: 894212 - RNA, 14 nt, Mycobacterium avium subsp. paratuberculosis
accaccagcgggcu

SEQ ID NO: 894213 - RNA, 22 nt, Mycobacterium avium subsp. paratuberculosis
accaccagcgggcugugccggc

SEQ ID NO: 894214 - RNA, 16 nt, Mycobacterium avium subsp. paratuberculosis
accaccagcucgucgc

SEQ ID NO: 894215 - RNA, 22 nt, Mycobacterium avium subsp. paratuberculosis
accaccagccgcaggugcucgc

SEQ ID NO: 894216 - RNA, 23 nt, Mycobacterium avium subsp. paratuberculosis
accaccagccgcaggugcucgcc

SEQ ID NO: 894217 - RNA, 16 nt, Mycobacterium avium subsp. paratuberculosis
accaccaggagcaccu

SEQ ID NO: 894218 - RNA, 19 nt, Mycobacterium avium subsp. paratuberculosis
accaccaggagcaccugcg

SEQ ID NO: 894219 - RNA, 22 nt, Mycobacterium avium subsp. paratuberculosis
accaccaggagcaccugcgcga

SEQ ID NO: 894220 - RNA, 13 nt, Mycobacterium avium subsp. paratuberculosis
accaccacgcugg

SEQ ID NO: 894221 - RNA, 16 nt, Mycobacterium avium subsp. paratuberculosis
accaccacggagcgcc

SEQ ID NO: 894222 - RNA, 22 nt, Mycobacterium avium subsp. paratuberculosis
accaccacggagcgcccggcca

SEQ ID NO: 894223 - RNA, 14 nt, Mycobacterium avium subsp. paratuberculosis
accaccacggccau

SEQ ID NO: 894224 - RNA, 14 nt, Mycobacterium avium subsp. paratuberculosis
accaccacggccgc

SEQ ID NO: 894225 - RNA, 15 nt, Mycobacterium avium subsp. paratuberculosis
accaccacggccgcc

SEQ ID NO: 894226 - RNA, 18 nt, Mycobacterium avium subsp. paratuberculosis
accaccacggggcggguc

SEQ ID NO: 894227 - RNA, 15 nt, Mycobacterium avium subsp. paratuberculosis
accaccacgguggcg

SEQ ID NO: 894228 - RNA, 15 nt, Mycobacterium avium subsp. paratuberculosis
accacgacgccgggc

SEQ ID NO: 894229 - RNA, 15 nt, Mycobacterium avium subsp. paratuberculosis
accacgaucagcgcg

SEQ ID NO: 894230 - RNA, 19 nt, Mycobacterium avium subsp. paratuberculosis
accacgaucagcgcgucga

SEQ ID NO: 894231 - RNA, 22 nt, Mycobacterium avium subsp. paratuberculosis
accacgacgucgagccagcggg

SEQ ID NO: 894232 - RNA, 15 nt, Mycobacterium avium subsp. paratuberculosis
accacgaagggcgcc

SEQ ID NO: 894233 - RNA, 17 nt, Mycobacterium avium subsp. paratuberculosis
accacgaagggcgccag

SEQ ID NO: 894234 - RNA, 22 nt, Mycobacterium avium subsp. paratuberculosis
accacgaacugggugccccgcc

SEQ ID NO: 894235 - RNA, 20 nt, Mycobacterium avium subsp. paratuberculosis
accacgaccagugcccggcc

SEQ ID NO: 894236 - RNA, 16 nt, Mycobacterium avium subsp. paratuberculosis
accacgauguugaucg

SEQ ID NO: 894237 - RNA, 17 nt, Mycobacterium avium subsp. paratuberculosis
accacgcgaucaggucc

SEQ ID NO: 894238 - RNA, 19 nt, Mycobacterium avium subsp. paratuberculosis
accacgccgugcccggcgc

SEQ ID NO: 894239 - RNA, 20 nt, Mycobacterium avium subsp. paratuberculosis
accacgccgugcccggcgcc

SEQ ID NO: 894240 - RNA, 23 nt, Mycobacterium avium subsp. paratuberculosis
accacgccgugcccggcgcccug

SEQ ID NO: 894241 - RNA, 14 nt, Mycobacterium avium subsp. paratuberculosis
accacgccgcgcuu

SEQ ID NO: 894242 - RNA, 13 nt, Mycobacterium avium subsp. paratuberculosis
accacgccgcggu

SEQ ID NO: 894243 - RNA, 20 nt, Mycobacterium avium subsp. paratuberculosis
accacgccgcggucgcugac

SEQ ID NO: 894244 - RNA, 13 nt, Mycobacterium avium subsp. paratuberculosis
accacgccgucga

SEQ ID NO: 894245 - RNA, 16 nt, Mycobacterium avium subsp. paratuberculosis
accacgccgucgacga

SEQ ID NO: 894246 - RNA, 16 nt, Mycobacterium avium subsp. paratuberculosis
accaccgccaccagcg

SEQ ID NO: 894247 - RNA, 18 nt, Mycobacterium avium subsp. paratuberculosis
accaccgccaccagcgca

SEQ ID NO: 894248 - RNA, 17 nt, Mycobacterium avium subsp. paratuberculosis
accaccagguaggcgac

SEQ ID NO: 894249 - RNA, 21 nt, Mycobacterium avium subsp. paratuberculosis
accaccgcccggaccggcucg

SEQ ID NO: 894250 - RNA, 14 nt, Mycobacterium avium subsp. paratuberculosis
accaccaggugcgg

SEQ ID NO: 894251 - RNA, 20 nt, Mycobacterium avium subsp. paratuberculosis
accaccgacagcacccggcc

SEQ ID NO: 894252 - RNA, 14 nt, Mycobacterium avium subsp. paratuberculosis
accaccgaccggcu

SEQ ID NO: 894253 - RNA, 14 nt, Mycobacterium avium subsp. paratuberculosis
accaccgagccggc

SEQ ID NO: 894254 - RNA, 16 nt, Mycobacterium avium subsp. paratuberculosis
accaccgagccggcgu

SEQ ID NO: 894255 - RNA, 19 nt, Mycobacterium avium subsp. paratuberculosis
accaccgagccggugccgc

SEQ ID NO: 894256 - RNA, 14 nt, Mycobacterium avium subsp. paratuberculosis
accacgaagcuggc

SEQ ID NO: 894257 - RNA, 15 nt, Mycobacterium avium subsp. paratuberculosis
accaccuugcgcagc

SEQ ID NO: 894258 - RNA, 16 nt, Mycobacterium avium subsp. paratuberculosis
accaccuugcgcagca

SEQ ID NO: 894259 - RNA, 21 nt, Mycobacterium avium subsp. paratuberculosis
accaccuugguggccgcggcc

SEQ ID NO: 894260 - RNA, 22 nt, Mycobacterium avium subsp. paratuberculosis
accaccuugguggccgcggccg

SEQ ID NO: 894261 - RNA, 23 nt, Mycobacterium avium subsp. paratuberculosis
accaccuugguggccgcggccgc

SEQ ID NO: 894262 - RNA, 17 nt, Mycobacterium avium subsp. paratuberculosis
accacgaacaccggcgc

SEQ ID NO: 894263 - RNA, 18 nt, Mycobacterium avium subsp. paratuberculosis
accacgaacaccggcgcg

SEQ ID NO: 894264 - RNA, 19 nt, Mycobacterium avium subsp. paratuberculosis
accacgaacaccggcgcga

SEQ ID NO: 894265 - RNA, 20 nt, Mycobacterium avium subsp. paratuberculosis
accacgaacaccggcgcgac

SEQ ID NO: 894266 - RNA, 15 nt, Mycobacterium avium subsp. paratuberculosis
accacgaaccaggcg

SEQ ID NO: 894267 - RNA, 19 nt, Mycobacterium avium subsp. paratuberculosis
accacgaaccaggcgccgg

SEQ ID NO: 894268 - RNA, 20 nt, Mycobacterium avium subsp. paratuberculosis
accacgaaccaggcgccggc

SEQ ID NO: 894269 - RNA, 12 nt, Mycobacterium avium subsp. paratuberculosis
accaccgcgagc

SEQ ID NO: 894270 - RNA, 13 nt, Mycobacterium avium subsp. paratuberculosis
accaccgcgccca

SEQ ID NO: 894271 - RNA, 12 nt, Mycobacterium avium subsp. paratuberculosis
accaccgcgccg

SEQ ID NO: 894272 - RNA, 14 nt, Mycobacterium avium subsp. paratuberculosis
accaccgcgccguc

SEQ ID NO: 894273 - RNA, 16 nt, Mycobacterium avium subsp. paratuberculosis
accaccgcgccgucgu

SEQ ID NO: 894274 - RNA, 13 nt, Mycobacterium avium subsp. paratuberculosis
accaccgccucga

SEQ ID NO: 894275 - RNA, 16 nt, Mycobacterium avium subsp. paratuberculosis
accaccgccucgacgg

SEQ ID NO: 894276 - RNA, 17 nt, Mycobacterium avium subsp. paratuberculosis
accaccgccucgacggu

SEQ ID NO: 894277 - RNA, 14 nt, Mycobacterium avium subsp. paratuberculosis
accaccgccggccc

SEQ ID NO: 894278 - RNA, 15 nt, Mycobacterium avium subsp. paratuberculosis
accaccgccggcccg

SEQ ID NO: 894279 - RNA, 12 nt, Mycobacterium avium subsp. paratuberculosis
accaccgcgcug

SEQ ID NO: 894280 - RNA, 17 nt, Mycobacterium avium subsp. paratuberculosis
accaccgcgcugcgcgc

SEQ ID NO: 894281 - RNA, 18 nt, Mycobacterium avium subsp. paratuberculosis
accacgcugagcaaccgc

SEQ ID NO: 894282 - RNA, 15 nt, Mycobacterium avium subsp. paratuberculosis
accacggucgccgcg

SEQ ID NO: 894283 - RNA, 19 nt, Mycobacterium avium subsp. paratuberculosis
accacggugaucucgccga

SEQ ID NO: 894284 - RNA, 20 nt, Mycobacterium avium subsp. paratuberculosis
accacggugaucucgccgag

SEQ ID NO: 894285 - RNA, 16 nt, Mycobacterium avium subsp. paratuberculosis
accacgguggccgcga

SEQ ID NO: 894286 - RNA, 15 nt, Mycobacterium avium subsp. paratuberculosis
accacgguggcgccg

SEQ ID NO: 894287 - RNA, 17 nt, Mycobacterium avium subsp. paratuberculosis
accacgguggcgccgcg

SEQ ID NO: 894288 - RNA, 21 nt, Mycobacterium avium subsp. paratuberculosis
accacgguggcgccgcgcagc

SEQ ID NO: 894289 - RNA, 23 nt, Mycobacterium avium subsp. paratuberculosis
accacgguggcgccgcgcagcca

SEQ ID NO: 894290 - RNA, 18 nt, Mycobacterium avium subsp. paratuberculosis
accacgguggcgccggca

SEQ ID NO: 894291 - RNA, 23 nt, Mycobacterium avium subsp. paratuberculosis
accacgguggcgccggcaucgac

SEQ ID NO: 894292 - RNA, 15 nt, Mycobacterium avium subsp. paratuberculosis
accacguccgcggug

SEQ ID NO: 894293 - RNA, 14 nt, Mycobacterium avium subsp. paratuberculosis
accacguaggcgau

SEQ ID NO: 894294 - RNA, 22 nt, Mycobacterium avium subsp. paratuberculosis
accacguaggcgaucagcgcgc

SEQ ID NO: 894295 - RNA, 14 nt, Mycobacterium avium subsp. paratuberculosis
accacggagcgccc

SEQ ID NO: 894296 - RNA, 17 nt, Mycobacterium avium subsp. paratuberculosis
accacggagcgcccggc

SEQ ID NO: 894297 - RNA, 12 nt, Mycobacterium avium subsp. paratuberculosis
accacgcggcgg

SEQ ID NO: 894298 - RNA, 15 nt, Mycobacterium avium subsp. paratuberculosis
accacgcggcggcgg

SEQ ID NO: 894299 - RNA, 17 nt, Mycobacterium avium subsp. paratuberculosis
accacggugaacgggcc

SEQ ID NO: 894300 - RNA, 20 nt, Mycobacterium avium subsp. paratuberculosis
accacggugaacgggccgca

SEQ ID NO: 894301 - RNA, 21 nt, Mycobacterium avium subsp. paratuberculosis
accacggugaacgggccgcac

SEQ ID NO: 894302 - RNA, 16 nt, Mycobacterium avium subsp. paratuberculosis
accacggucacagccg

SEQ ID NO: 894303 - RNA, 17 nt, Mycobacterium avium subsp. paratuberculosis
accacggucacagccgc

SEQ ID NO: 894304 - RNA, 18 nt, Mycobacterium avium subsp. paratuberculosis
accacggucacagccgcg

SEQ ID NO: 894305 - RNA, 19 nt, Mycobacterium avium subsp. paratuberculosis
accacggucacagccgcga

SEQ ID NO: 894306 - RNA, 17 nt, Mycobacterium avium subsp. paratuberculosis
accacggucagggccag

SEQ ID NO: 894307 - RNA, 18 nt, Mycobacterium avium subsp. paratuberculosis
accacggucagggccagc

SEQ ID NO: 894308 - RNA, 19 nt, Mycobacterium avium subsp. paratuberculosis
accacggucagggccagca

SEQ ID NO: 894309 - RNA, 16 nt, Mycobacterium avium subsp. paratuberculosis
accacgguccccgcgc

SEQ ID NO: 894310 - RNA, 17 nt, Mycobacterium avium subsp. paratuberculosis
accacgguccccgcgcc

SEQ ID NO: 894311 - RNA, 20 nt, Mycobacterium avium subsp. paratuberculosis
accacgguccccgcgcccgc

SEQ ID NO: 894312 - RNA, 21 nt, Mycobacterium avium subsp. paratuberculosis
accacgguccccgcgcccgcc

SEQ ID NO: 894313 - RNA, 23 nt, Mycobacterium avium subsp. paratuberculosis
accacgguccccgcgcccgccgc

SEQ ID NO: 894314 - RNA, 13 nt, Mycobacterium avium subsp. paratuberculosis
accagcaccccgc

SEQ ID NO: 894315 - RNA, 18 nt, Mycobacterium avium subsp. paratuberculosis
accagcacccagcacagc

SEQ ID NO: 894316 - RNA, 21 nt, Mycobacterium avium subsp. paratuberculosis
accagcacccagcacagcgag

SEQ ID NO: 894317 - RNA, 19 nt, Mycobacterium avium subsp. paratuberculosis
accagaucgucgggcaccu

SEQ ID NO: 894318 - RNA, 23 nt, Mycobacterium avium subsp. paratuberculosis
accagaucguguccgcgccggcg

SEQ ID NO: 894319 - RNA, 22 nt, Mycobacterium avium subsp. paratuberculosis
accagcaacaccuuucggccgc

SEQ ID NO: 894320 - RNA, 23 nt, Mycobacterium avium subsp. paratuberculosis
accagaccgaagaucaccgcgac

SEQ ID NO: 894321 - RNA, 17 nt, Mycobacterium avium subsp. paratuberculosis
accagauaggccagcgc

SEQ ID NO: 894322 - RNA, 17 nt, Mycobacterium avium subsp. paratuberculosis
accagauucaccagcgc

SEQ ID NO: 894323 - RNA, 18 nt, Mycobacterium avium subsp. paratuberculosis
accagauucaccagcgcc

SEQ ID NO: 894324 - RNA, 20 nt, Mycobacterium avium subsp. paratuberculosis
accagauucaccagcgccuc

SEQ ID NO: 894325 - RNA, 16 nt, Mycobacterium avium subsp. paratuberculosis
accagaugccgcucgg

SEQ ID NO: 894326 - RNA, 14 nt, Mycobacterium avium subsp. paratuberculosis
accagaugccgggc

SEQ ID NO: 894327 - RNA, 15 nt, Mycobacterium avium subsp. paratuberculosis
accagaugccgggcu

SEQ ID NO: 894328 - RNA, 12 nt, Mycobacterium avium subsp. paratuberculosis
accagaucggcg

SEQ ID NO: 894329 - RNA, 23 nt, Mycobacterium avium subsp. paratuberculosis
accagauccucgaauccgcgggc

SEQ ID NO: 894330 - RNA, 23 nt, Mycobacterium avium subsp. paratuberculosis
accagaucgagcugggcccgcgc

SEQ ID NO: 894331 - RNA, 14 nt, Mycobacterium avium subsp. paratuberculosis
accagcaccgcggc

SEQ ID NO: 894332 - RNA, 16 nt, Mycobacterium avium subsp. paratuberculosis
accagcaccgccgcgg

SEQ ID NO: 894333 - RNA, 17 nt, Mycobacterium avium subsp. paratuberculosis
accagcaccgccgcggc

SEQ ID NO: 894334 - RNA, 21 nt, Mycobacterium avium subsp. paratuberculosis
accagcaccggcaccgccagc

SEQ ID NO: 894335 - RNA, 12 nt, Mycobacterium avium subsp. paratuberculosis
accagcaccgcc

SEQ ID NO: 894336 - RNA, 15 nt, Mycobacterium avium subsp. paratuberculosis
accagcacgccguug

SEQ ID NO: 894337 - RNA, 18 nt, Mycobacterium avium subsp. paratuberculosis
accagcacggcgaccagc

SEQ ID NO: 894338 - RNA, 19 nt, Mycobacterium avium subsp. paratuberculosis
accagcacggcgaccagcg

SEQ ID NO: 894339 - RNA, 14 nt, Mycobacterium avium subsp. paratuberculosis
accagcacggcggc

SEQ ID NO: 894340 - RNA, 16 nt, Mycobacterium avium subsp. paratuberculosis
accagcacggcggcgc

SEQ ID NO: 894341 - RNA, 20 nt, Mycobacterium avium subsp. paratuberculosis
accagcacggcggcgcugau

SEQ ID NO: 894342 - RNA, 15 nt, Mycobacterium avium subsp. paratuberculosis
accagcaugcgccag

SEQ ID NO: 894343 - RNA, 15 nt, Mycobacterium avium subsp. paratuberculosis
accagccacaccgcc

SEQ ID NO: 894344 - RNA, 17 nt, Mycobacterium avium subsp. paratuberculosis
accagccacaccgccgc

SEQ ID NO: 894345 - RNA, 18 nt, Mycobacterium avium subsp. paratuberculosis
accagccacaccgccgcg

SEQ ID NO: 894346 - RNA, 20 nt, Mycobacterium avium subsp. paratuberculosis
accagccacaccgccgcggc

SEQ ID NO: 894347 - RNA, 14 nt, Mycobacterium avium subsp. paratuberculosis
accagcccaggucg

SEQ ID NO: 894348 - RNA, 16 nt, Mycobacterium avium subsp. paratuberculosis
accagcccccgcgggu

SEQ ID NO: 894349 - RNA, 21 nt, Mycobacterium avium subsp. paratuberculosis
accagcgcacacagcagcagc

SEQ ID NO: 894350 - RNA, 16 nt, Mycobacterium avium subsp. paratuberculosis
accagcgauccggcgc

SEQ ID NO: 894351 - RNA, 17 nt, Mycobacterium avium subsp. paratuberculosis
accagcgauccggcgcg

SEQ ID NO: 894352 - RNA, 21 nt, Mycobacterium avium subsp. paratuberculosis
accagcccgaugccgccgagg

SEQ ID NO: 894353 - RNA, 13 nt, Mycobacterium avium subsp. paratuberculosis
accagcccgccgu

SEQ ID NO: 894354 - RNA, 14 nt, Mycobacterium avium subsp. paratuberculosis
accagcccgccguc

SEQ ID NO: 894355 - RNA, 16 nt, Mycobacterium avium subsp. paratuberculosis
accagcccgccgucgg

SEQ ID NO: 894356 - RNA, 12 nt, Mycobacterium avium subsp. paratuberculosis
accagcccggcc

SEQ ID NO: 894357 - RNA, 14 nt, Mycobacterium avium subsp. paratuberculosis
accagcccggccag

SEQ ID NO: 894358 - RNA, 15 nt, Mycobacterium avium subsp. paratuberculosis
accagcccggccagc

SEQ ID NO: 894359 - RNA, 19 nt, Mycobacterium avium subsp. paratuberculosis
accagcccggccagcggca

SEQ ID NO: 894360 - RNA, 13 nt, Mycobacterium avium subsp. paratuberculosis
accagcccggccc

SEQ ID NO: 894361 - RNA, 19 nt, Mycobacterium avium subsp. paratuberculosis
accagcgagcccagcugcg

SEQ ID NO: 894362 - RNA, 20 nt, Mycobacterium avium subsp. paratuberculosis
accagcgagcccagcugcgc

SEQ ID NO: 894363 - RNA, 15 nt, Mycobacterium avium subsp. paratuberculosis
accagcgcccccgac

SEQ ID NO: 894364 - RNA, 18 nt, Mycobacterium avium subsp. paratuberculosis
accagcgcccgcccggac

SEQ ID NO: 894365 - RNA, 16 nt, Mycobacterium avium subsp. paratuberculosis
accagcgccgcgauga

SEQ ID NO: 894366 - RNA, 18 nt, Mycobacterium avium subsp. paratuberculosis
accagcgcgaacagcgcg

SEQ ID NO: 894367 - RNA, 19 nt, Mycobacterium avium subsp. paratuberculosis
accagcgccucgcgggugc

SEQ ID NO: 894368 - RNA, 14 nt, Mycobacterium avium subsp. paratuberculosis
accagcgccucggc

SEQ ID NO: 894369 - RNA, 20 nt, Mycobacterium avium subsp. paratuberculosis
accagcgccucggccugcgc

SEQ ID NO: 894370 - RNA, 17 nt, Mycobacterium avium subsp. paratuberculosis
accagcgccugggcgua

SEQ ID NO: 894371 - RNA, 15 nt, Mycobacterium avium subsp. paratuberculosis
acccguuggcaggcc

SEQ ID NO: 894372 - RNA, 14 nt, Mycobacterium avium subsp. paratuberculosis
acccucagaccaug

SEQ ID NO: 894373 - RNA, 20 nt, Mycobacterium avium subsp. paratuberculosis
acccucagcagggcggcacc

SEQ ID NO: 894374 - RNA, 21 nt, Mycobacterium avium subsp. paratuberculosis
acccucagcagggcggcaccg

SEQ ID NO: 894375 - RNA, 20 nt, Mycobacterium avium subsp. paratuberculosis
acccucagggagcugcccgc

SEQ ID NO: 894376 - RNA, 16 nt, Mycobacterium avium subsp. paratuberculosis
acccguuugaggcgag

SEQ ID NO: 894377 - RNA, 21 nt, Mycobacterium avium subsp. paratuberculosis
acccguuugaggcgagcaauu

SEQ ID NO: 894378 - RNA, 15 nt, Mycobacterium avium subsp. paratuberculosis
acccguucggcgucg

SEQ ID NO: 894379 - RNA, 16 nt, Mycobacterium avium subsp. paratuberculosis
acccguucggcgucga

SEQ ID NO: 894380 - RNA, 23 nt, Mycobacterium avium subsp. paratuberculosis
acccguaggagcugacggccaug

SEQ ID NO: 894381 - RNA, 19 nt, Mycobacterium avium subsp. paratuberculosis
acccgguuccaccgggccg

SEQ ID NO: 894382 - RNA, 21 nt, Mycobacterium avium subsp. paratuberculosis
acccgguuccaccgggccgcc

SEQ ID NO: 894383 - RNA, 22 nt, Mycobacterium avium subsp. paratuberculosis
acccgguuccaccgggccgcca

SEQ ID NO: 894384 - RNA, 20 nt, Mycobacterium avium subsp. paratuberculosis
acccgguucugggcgggcuc

SEQ ID NO: 894385 - RNA, 19 nt, Mycobacterium avium subsp. paratuberculosis
acccgguugagcaccgcau

SEQ ID NO: 894386 - RNA, 16 nt, Mycobacterium avium subsp. paratuberculosis
acccgguugauccgga

SEQ ID NO: 894387 - RNA, 13 nt, Mycobacterium avium subsp. paratuberculosis
acccggugccggc

SEQ ID NO: 894388 - RNA, 18 nt, Mycobacterium avium subsp. paratuberculosis
acccggugccggccgggu

SEQ ID NO: 894389 - RNA, 22 nt, Mycobacterium avium subsp. paratuberculosis
acccggugggacugggcgccgc

SEQ ID NO: 894390 - RNA, 21 nt, Mycobacterium avium subsp. paratuberculosis
acccguaacacgaucaccccg

SEQ ID NO: 894391 - RNA, 23 nt, Mycobacterium avium subsp. paratuberculosis
acccguaacacgaucaccccgac

SEQ ID NO: 894392 - RNA, 16 nt, Mycobacterium avium subsp. paratuberculosis
acccguaauugaucgu

SEQ ID NO: 894393 - RNA, 17 nt, Mycobacterium avium subsp. paratuberculosis
acccguuccccggccga

SEQ ID NO: 894394 - RNA, 18 nt, Mycobacterium avium subsp. paratuberculosis
acccguuccccggccgac

SEQ ID NO: 894395 - RNA, 16 nt, Mycobacterium avium subsp. paratuberculosis
acccguuccucgacgu

SEQ ID NO: 894396 - RNA, 18 nt, Mycobacterium avium subsp. paratuberculosis
acccuggcgaaccgcggc

SEQ ID NO: 894397 - RNA, 19 nt, Mycobacterium avium subsp. paratuberculosis
acccuggcgaaccgcggcg

SEQ ID NO: 894398 - RNA, 13 nt, Mycobacterium avium subsp. paratuberculosis
acccuccggcgcc

SEQ ID NO: 894399 - RNA, 15 nt, Mycobacterium avium subsp. paratuberculosis
acccuccggcgccug

SEQ ID NO: 894400 - RNA, 13 nt, Mycobacterium avium subsp. paratuberculosis
acccuccgggcgg

SEQ ID NO: 894401 - RNA, 13 nt, Mycobacterium avium subsp. paratuberculosis
acccucgacgccg

SEQ ID NO: 894402 - RNA, 16 nt, Mycobacterium avium subsp. paratuberculosis
acccucgacgccgggc

SEQ ID NO: 894403 - RNA, 15 nt, Mycobacterium avium subsp. paratuberculosis
acccucgaggccgac

SEQ ID NO: 894404 - RNA, 17 nt, Mycobacterium avium subsp. paratuberculosis
acccucgaggccgacgu

SEQ ID NO: 894405 - RNA, 16 nt, Mycobacterium avium subsp. paratuberculosis
acccugggcggcgaca

SEQ ID NO: 894406 - RNA, 23 nt, Mycobacterium avium subsp. paratuberculosis
acccugggcggcgacacgccgac

SEQ ID NO: 894407 - RNA, 19 nt, Mycobacterium avium subsp. paratuberculosis
accgaaccgccccgcgcga

SEQ ID NO: 894408 - RNA, 19 nt, Mycobacterium avium subsp. paratuberculosis
accgaacccggaucggcca

SEQ ID NO: 894409 - RNA, 13 nt, Mycobacterium avium subsp. paratuberculosis
accgaacccgggc

SEQ ID NO: 894410 - RNA, 15 nt, Mycobacterium avium subsp. paratuberculosis
accgaacccgggcgc

SEQ ID NO: 894411 - RNA, 14 nt, Mycobacterium avium subsp. paratuberculosis
acccuucggccggc

SEQ ID NO: 894412 - RNA, 17 nt, Mycobacterium avium subsp. paratuberculosis
acccuucggccggcagc

SEQ ID NO: 894413 - RNA, 17 nt, Mycobacterium avium subsp. paratuberculosis
acccuugacuaccgcgc

SEQ ID NO: 894414 - RNA, 18 nt, Mycobacterium avium subsp. paratuberculosis
acccuugacuaccgcgcc

SEQ ID NO: 894415 - RNA, 19 nt, Mycobacterium avium subsp. paratuberculosis
acccuugacuaccgcgccc

SEQ ID NO: 894416 - RNA, 15 nt, Mycobacterium avium subsp. paratuberculosis
acccgguagcgcagc

SEQ ID NO: 894417 - RNA, 18 nt, Mycobacterium avium subsp. paratuberculosis
acccgguagcgcagcacc

SEQ ID NO: 894418 - RNA, 18 nt, Mycobacterium avium subsp. paratuberculosis
acccggucagcucgccgu

SEQ ID NO: 894419 - RNA, 19 nt, Mycobacterium avium subsp. paratuberculosis
acccggucagcucgccguc

SEQ ID NO: 894420 - RNA, 19 nt, Mycobacterium avium subsp. paratuberculosis
acccgggcuagacgcgcac

SEQ ID NO: 894421 - RNA, 22 nt, Mycobacterium avium subsp. paratuberculosis
acccgggcugcccggcgccggu

SEQ ID NO: 894422 - RNA, 23 nt, Mycobacterium avium subsp. paratuberculosis
acccgggcugcccggcgccgguc

SEQ ID NO: 894423 - RNA, 15 nt, Mycobacterium avium subsp. paratuberculosis
acccggggccguccg

SEQ ID NO: 894424 - RNA, 18 nt, Mycobacterium avium subsp. paratuberculosis
acccgggucgagcggccc

SEQ ID NO: 894425 - RNA, 21 nt, Mycobacterium avium subsp. paratuberculosis
acccgggugcccggcugggcg

SEQ ID NO: 894426 - RNA, 18 nt, Mycobacterium avium subsp. paratuberculosis
acccggguggacaccgcg

SEQ ID NO: 894427 - RNA, 22 nt, Mycobacterium avium subsp. paratuberculosis
acccggguggacaccgcgauca

SEQ ID NO: 894428 - RNA, 13 nt, Mycobacterium avium subsp. paratuberculosis
acccggguggccc

SEQ ID NO: 894429 - RNA, 21 nt, Mycobacterium avium subsp. paratuberculosis
acccggguguuggagccgucc

SEQ ID NO: 894430 - RNA, 21 nt, Mycobacterium avium subsp. paratuberculosis
acccggguguuggcgcacagc

SEQ ID NO: 894431 - RNA, 22 nt, Mycobacterium avium subsp. paratuberculosis
acccggguugcgugcagccgca

SEQ ID NO: 894432 - RNA, 16 nt, Mycobacterium avium subsp. paratuberculosis
acccggucggccgcgu

SEQ ID NO: 894433 - RNA, 18 nt, Mycobacterium avium subsp. paratuberculosis
acccggucggccgcgugc

SEQ ID NO: 894434 - RNA, 23 nt, Mycobacterium avium subsp. paratuberculosis
acccggucugaucgcccagcacc

SEQ ID NO: 894435 - RNA, 21 nt, Mycobacterium avium subsp. paratuberculosis
acccggucuuguugugcugca

SEQ ID NO: 894436 - RNA, 18 nt, Mycobacterium avium subsp. paratuberculosis
acccgguccggcccgggg

SEQ ID NO: 894437 - RNA, 18 nt, Mycobacterium avium subsp. paratuberculosis
acccgguccggcuggucg

SEQ ID NO: 894438 - RNA, 19 nt, Mycobacterium avium subsp. paratuberculosis
acccgguccggcuggucgg

SEQ ID NO: 894439 - RNA, 21 nt, Mycobacterium avium subsp. paratuberculosis
acccgguccggcuggucggcc

SEQ ID NO: 894440 - RNA, 21 nt, Mycobacterium avium subsp. paratuberculosis
acccgguccuucucgcacagc

SEQ ID NO: 894441 - RNA, 13 nt, Mycobacterium avium subsp. paratuberculosis
acccggucgacga

SEQ ID NO: 894442 - RNA, 18 nt, Mycobacterium avium subsp. paratuberculosis
acccggucgacgauggcc

SEQ ID NO: 894443 - RNA, 20 nt, Mycobacterium avium subsp. paratuberculosis
acccggucgaugugcgcgcu

SEQ ID NO: 894444 - RNA, 21 nt, Mycobacterium avium subsp. paratuberculosis
acccggucgaugugcgcgcug

SEQ ID NO: 894445 - RNA, 14 nt, Mycobacterium avium subsp. paratuberculosis
acccggucgccggu

SEQ ID NO: 894446 - RNA, 15 nt, Mycobacterium avium subsp. paratuberculosis
acccggucgccggug

SEQ ID NO: 894447 - RNA, 18 nt, Mycobacterium avium subsp. paratuberculosis
acccgcugcaccagcccg

SEQ ID NO: 894448 - RNA, 20 nt, Mycobacterium avium subsp. paratuberculosis
acccgcugcaccagcccguc

SEQ ID NO: 894449 - RNA, 20 nt, Mycobacterium avium subsp. paratuberculosis
acccgcugcagccgguccgg

SEQ ID NO: 894450 - RNA, 21 nt, Mycobacterium avium subsp. paratuberculosis
acccgcugcagccgguccggc

SEQ ID NO: 894451 - RNA, 18 nt, Mycobacterium avium subsp. paratuberculosis
acccgcugcucgaccucg

SEQ ID NO: 894452 - RNA, 20 nt, Mycobacterium avium subsp. paratuberculosis
acccgcugcucgaccucggc

SEQ ID NO: 894453 - RNA, 23 nt, Mycobacterium avium subsp. paratuberculosis
acccgcugcucgaccucggcgac

SEQ ID NO: 894454 - RNA, 19 nt, Mycobacterium avium subsp. paratuberculosis
acccgcuggaacagcgggc

SEQ ID NO: 894455 - RNA, 20 nt, Mycobacterium avium subsp. paratuberculosis
acccgcuggaacagcgggcc

SEQ ID NO: 894456 - RNA, 23 nt, Mycobacterium avium subsp. paratuberculosis
acccgcuggaacagcgggccggc

SEQ ID NO: 894457 - RNA, 15 nt, Mycobacterium avium subsp. paratuberculosis
acccgcucggcgauc

SEQ ID NO: 894458 - RNA, 22 nt, Mycobacterium avium subsp. paratuberculosis
acccgcucgggcgccucgaaca

SEQ ID NO: 894459 - RNA, 16 nt, Mycobacterium avium subsp. paratuberculosis
acccggcuggccgcac

SEQ ID NO: 894460 - RNA, 21 nt, Mycobacterium avium subsp. paratuberculosis
acccggcuucgcugcgccggc

SEQ ID NO: 894461 - RNA, 17 nt, Mycobacterium avium subsp. paratuberculosis
acccgggaugccgaggu

SEQ ID NO: 894462 - RNA, 21 nt, Mycobacterium avium subsp. paratuberculosis
acccgggcagcuuccgccucg

SEQ ID NO: 894463 - RNA, 23 nt, Mycobacterium avium subsp. paratuberculosis
acccgggcagcuuccgccucggc

SEQ ID NO: 894464 - RNA, 19 nt, Mycobacterium avium subsp. paratuberculosis
acccgggccgccacggcgc

SEQ ID NO: 894465 - RNA, 21 nt, Mycobacterium avium subsp. paratuberculosis
acccgggccgccacggcgcca

SEQ ID NO: 894466 - RNA, 21 nt, Mycobacterium avium subsp. paratuberculosis
acccgggccugcggcggccgc

SEQ ID NO: 894467 - RNA, 22 nt, Mycobacterium avium subsp. paratuberculosis
acccgggccuuguugcggcgca

SEQ ID NO: 894468 - RNA, 19 nt, Mycobacterium avium subsp. paratuberculosis
acccgggcgauggugccgc

SEQ ID NO: 894469 - RNA, 23 nt, Mycobacterium avium subsp. paratuberculosis
acccgggcgauggugccgccggu

SEQ ID NO: 894470 - RNA, 13 nt, Mycobacterium avium subsp. paratuberculosis
acccgggcgccau

SEQ ID NO: 894471 - RNA, 20 nt, Mycobacterium avium subsp. paratuberculosis
acccgggcgccauccgcagc

SEQ ID NO: 894472 - RNA, 12 nt, Mycobacterium avium subsp. paratuberculosis
acccgggcgccg

SEQ ID NO: 894473 - RNA, 14 nt, Mycobacterium avium subsp. paratuberculosis
acccgggcgccggc

SEQ ID NO: 894474 - RNA, 15 nt, Mycobacterium avium subsp. paratuberculosis
acccgggcgccggcg

SEQ ID NO: 894475 - RNA, 16 nt, Mycobacterium avium subsp. paratuberculosis
acccgggcgccggcga

SEQ ID NO: 894476 - RNA, 13 nt, Mycobacterium avium subsp. paratuberculosis
acccgggcgcgac

SEQ ID NO: 894477 - RNA, 16 nt, Mycobacterium avium subsp. paratuberculosis
acccgggcgcgcccac

SEQ ID NO: 894478 - RNA, 21 nt, Mycobacterium avium subsp. paratuberculosis
acccgggcgcgcccacccgcg

SEQ ID NO: 894479 - RNA, 18 nt, Mycobacterium avium subsp. paratuberculosis
acccgggcggccugcugc

SEQ ID NO: 894480 - RNA, 13 nt, Mycobacterium avium subsp. paratuberculosis
acccgcaccaccg

SEQ ID NO: 894481 - RNA, 15 nt, Mycobacterium avium subsp. paratuberculosis
acccgcaacgcugac

SEQ ID NO: 894482 - RNA, 17 nt, Mycobacterium avium subsp. paratuberculosis
acccgcaacgcugaccg

SEQ ID NO: 894483 - RNA, 17 nt, Mycobacterium avium subsp. paratuberculosis
acccgcaaggccgccag

SEQ ID NO: 894484 - RNA, 18 nt, Mycobacterium avium subsp. paratuberculosis
acccgcaaggccgccagc

SEQ ID NO: 894485 - RNA, 23 nt, Mycobacterium avium subsp. paratuberculosis
acccgcaaggccgccagccgcgu

SEQ ID NO: 894486 - RNA, 15 nt, Mycobacterium avium subsp. paratuberculosis
acccgcaccaccgcc

SEQ ID NO: 894487 - RNA, 24 nt, Mycobacterium avium subsp. paratuberculosis
acccgcaccaccgcccggaccggc

SEQ ID NO: 894488 - RNA, 18 nt, Mycobacterium avium subsp. paratuberculosis
acccgcaccucgcccggc

SEQ ID NO: 894489 - RNA, 19 nt, Mycobacterium avium subsp. paratuberculosis
acccgcaccucgcccggcu

SEQ ID NO: 894490 - RNA, 20 nt, Mycobacterium avium subsp. paratuberculosis
acccgcaccucgcccggcuc

SEQ ID NO: 894491 - RNA, 21 nt, Mycobacterium avium subsp. paratuberculosis
acccgcaccucgcccggcucg

SEQ ID NO: 894492 - RNA, 17 nt, Mycobacterium avium subsp. paratuberculosis
acccgcaccucgcuggc

SEQ ID NO: 894493 - RNA, 22 nt, Mycobacterium avium subsp. paratuberculosis
acccgcaccucgcuggcggcgc

SEQ ID NO: 894494 - RNA, 12 nt, Mycobacterium avium subsp. paratuberculosis
acccgcagcccg

SEQ ID NO: 894495 - RNA, 14 nt, Mycobacterium avium subsp. paratuberculosis
acccgcagcccgac

SEQ ID NO: 894496 - RNA, 15 nt, Mycobacterium avium subsp. paratuberculosis
acccgcagccgcgag

SEQ ID NO: 894497 - RNA, 16 nt, Mycobacterium avium subsp. paratuberculosis
acccgcagcgaggcga

SEQ ID NO: 894498 - RNA, 15 nt, Mycobacterium avium subsp. paratuberculosis
acccgcagcgcggcg

SEQ ID NO: 894499 - RNA, 18 nt, Mycobacterium avium subsp. paratuberculosis
acccgcagcuccagcgag

SEQ ID NO: 894500 - RNA, 18 nt, Mycobacterium avium subsp. paratuberculosis
acccgcagcucgccggug

SEQ ID NO: 894501 - RNA, 14 nt, Mycobacterium avium subsp. paratuberculosis
acccgcaggccaug

SEQ ID NO: 894502 - RNA, 14 nt, Mycobacterium avium subsp. paratuberculosis
acccgcagggcgcc

SEQ ID NO: 894503 - RNA, 20 nt, Mycobacterium avium subsp. paratuberculosis
acccgcacgaaaugcgggcg

SEQ ID NO: 894504 - RNA, 17 nt, Mycobacterium avium subsp. paratuberculosis
acccgcacgaugccgcg

SEQ ID NO: 894505 - RNA, 19 nt, Mycobacterium avium subsp. paratuberculosis
acccgcacgaugccgcgcu

SEQ ID NO: 894506 - RNA, 23 nt, Mycobacterium avium subsp. paratuberculosis
acccgcacgauguguaacaacuc

SEQ ID NO: 894507 - RNA, 16 nt, Mycobacterium avium subsp. paratuberculosis
acccgcacgcccgggc

SEQ ID NO: 894508 - RNA, 18 nt, Mycobacterium avium subsp. paratuberculosis
acccgcgcgucgcgcagc

SEQ ID NO: 894509 - RNA, 19 nt, Mycobacterium avium subsp. paratuberculosis
acccgcgcgacaucaccgc

SEQ ID NO: 894510 - RNA, 23 nt, Mycobacterium avium subsp. paratuberculosis
acccgcgcgacaucaccgcgggc

SEQ ID NO: 894511 - RNA, 13 nt, Mycobacterium avium subsp. paratuberculosis
acccgcgcggcgc

SEQ ID NO: 894512 - RNA, 14 nt, Mycobacterium avium subsp. paratuberculosis
acccgcgcggcgca

SEQ ID NO: 894513 - RNA, 14 nt, Mycobacterium avium subsp. paratuberculosis
acccgcgcggcguc

SEQ ID NO: 894514 - RNA, 15 nt, Mycobacterium avium subsp. paratuberculosis
acccgcgcggcgucg

SEQ ID NO: 894515 - RNA, 17 nt, Mycobacterium avium subsp. paratuberculosis
acccgcgcggcgucggc

SEQ ID NO: 894516 - RNA, 21 nt, Mycobacterium avium subsp. paratuberculosis
acccgcgcggcgucggccugc

SEQ ID NO: 894517 - RNA, 17 nt, Mycobacterium avium subsp. paratuberculosis
acccgcggaacgcucac

SEQ ID NO: 894518 - RNA, 13 nt, Mycobacterium avium subsp. paratuberculosis
acccgcucgacgc

SEQ ID NO: 894519 - RNA, 20 nt, Mycobacterium avium subsp. paratuberculosis
acccgcucgacgcgcacccg

SEQ ID NO: 894520 - RNA, 16 nt, Mycobacterium avium subsp. paratuberculosis
acccgcucgcgggccc

SEQ ID NO: 894521 - RNA, 21 nt, Mycobacterium avium subsp. paratuberculosis
acccgcucgcgggcccgcgcc

SEQ ID NO: 894522 - RNA, 23 nt, Mycobacterium avium subsp. paratuberculosis
acccgcucgcgggcccgcgccgc

SEQ ID NO: 894523 - RNA, 12 nt, Mycobacterium avium subsp. paratuberculosis
acccgcgccggc

SEQ ID NO: 894524 - RNA, 14 nt, Mycobacterium avium subsp. paratuberculosis
acccgcgccggcag

SEQ ID NO: 894525 - RNA, 16 nt, Mycobacterium avium subsp. paratuberculosis
acccgcgcacgcucgc

SEQ ID NO: 894526 - RNA, 24 nt, Mycobacterium avium subsp. paratuberculosis
acccgcaucaacugcaccagcggc

SEQ ID NO: 894527 - RNA, 15 nt, Mycobacterium avium subsp. paratuberculosis
acccgcgaccccucc

SEQ ID NO: 894528 - RNA, 21 nt, Mycobacterium avium subsp. paratuberculosis
acccgcgaccccuccaacggc

SEQ ID NO: 894529 - RNA, 15 nt, Mycobacterium avium subsp. paratuberculosis
acccaaaacaucggc

SEQ ID NO: 894530 - RNA, 18 nt, Mycobacterium avium subsp. paratuberculosis
acccaacucaugggcccg

SEQ ID NO: 894531 - RNA, 15 nt, Mycobacterium avium subsp. paratuberculosis
acccacaccucgcag

SEQ ID NO: 894532 - RNA, 22 nt, Mycobacterium avium subsp. paratuberculosis
acccaccggcccagccggcggu

SEQ ID NO: 894533 - RNA, 14 nt, Mycobacterium avium subsp. paratuberculosis
acccaccggcgcag

SEQ ID NO: 894534 - RNA, 15 nt, Mycobacterium avium subsp. paratuberculosis
acccgacacgccgau

SEQ ID NO: 894535 - RNA, 13 nt, Mycobacterium avium subsp. paratuberculosis
acccaccagcgcc

SEQ ID NO: 894536 - RNA, 21 nt, Mycobacterium avium subsp. paratuberculosis
acccaccccgaucggggccag

SEQ ID NO: 894537 - RNA, 15 nt, Mycobacterium avium subsp. paratuberculosis
acccgacggucgggc

SEQ ID NO: 894538 - RNA, 16 nt, Mycobacterium avium subsp. paratuberculosis
acccgacggucgggcc

SEQ ID NO: 894539 - RNA, 17 nt, Mycobacterium avium subsp. paratuberculosis
acccgacguugccgcug

SEQ ID NO: 894540 - RNA, 12 nt, Mycobacterium avium subsp. paratuberculosis
acccgaccagca

SEQ ID NO: 894541 - RNA, 21 nt, Mycobacterium avium subsp. paratuberculosis
acccgaccagcaccgcggcgu

SEQ ID NO: 894542 - RNA, 13 nt, Mycobacterium avium subsp. paratuberculosis
acccgaccgcgau

SEQ ID NO: 894543 - RNA, 15 nt, Mycobacterium avium subsp. paratuberculosis
acccgaccgcgaugc

SEQ ID NO: 894544 - RNA, 17 nt, Mycobacterium avium subsp. paratuberculosis
acccgaccgcgaugcag

SEQ ID NO: 894545 - RNA, 18 nt, Mycobacterium avium subsp. paratuberculosis
acccgaccucgucgacgg

SEQ ID NO: 894546 - RNA, 22 nt, Mycobacterium avium subsp. paratuberculosis
acccgaccucgucgacggcggc

SEQ ID NO: 894547 - RNA, 23 nt, Mycobacterium avium subsp. paratuberculosis
acccgaccucgucgacggcggcg

SEQ ID NO: 894548 - RNA, 18 nt, Mycobacterium avium subsp. paratuberculosis
acccgaccgacgcccggc

SEQ ID NO: 894549 - RNA, 12 nt, Mycobacterium avium subsp. paratuberculosis
acccgacuucgg

SEQ ID NO: 894550 - RNA, 16 nt, Mycobacterium avium subsp. paratuberculosis
acccgacuucggcucg

SEQ ID NO: 894551 - RNA, 18 nt, Mycobacterium avium subsp. paratuberculosis
acccgacuucggcucggc

SEQ ID NO: 894552 - RNA, 21 nt, Mycobacterium avium subsp. paratuberculosis
acccgacuucggcucggcgac

SEQ ID NO: 894553 - RNA, 12 nt, Mycobacterium avium subsp. paratuberculosis
acccgagcaccc

SEQ ID NO: 894554 - RNA, 18 nt, Mycobacterium avium subsp. paratuberculosis
acccgagcaccccggcgg

SEQ ID NO: 894555 - RNA, 24 nt, Mycobacterium avium subsp. paratuberculosis
acccgagcaccccggcggccgcgu

SEQ ID NO: 894556 - RNA, 15 nt, Mycobacterium avium subsp. paratuberculosis
acccgagcaccgggc

SEQ ID NO: 894557 - RNA, 15 nt, Mycobacterium avium subsp. paratuberculosis
acccgauccacggcg

SEQ ID NO: 894558 - RNA, 20 nt, Mycobacterium avium subsp. paratuberculosis
acccgauccagggcccgcuc

SEQ ID NO: 894559 - RNA, 14 nt, Mycobacterium avium subsp. paratuberculosis
acccgaucgaucau

SEQ ID NO: 894560 - RNA, 21 nt, Mycobacterium avium subsp. paratuberculosis
acccgaucgaucaucgccucg

SEQ ID NO: 894561 - RNA, 14 nt, Mycobacterium avium subsp. paratuberculosis
acccgaucgccgag

SEQ ID NO: 894562 - RNA, 16 nt, Mycobacterium avium subsp. paratuberculosis
acccgaucgccgaguc

SEQ ID NO: 894563 - RNA, 14 nt, Mycobacterium avium subsp. paratuberculosis
acccgcaacaccac

SEQ ID NO: 894564 - RNA, 19 nt, Mycobacterium avium subsp. paratuberculosis
acccgcaacaccacgucgg

SEQ ID NO: 894565 - RNA, 17 nt, Mycobacterium avium subsp. paratuberculosis
acccgaugaccggcccg

SEQ ID NO: 894566 - RNA, 23 nt, Mycobacterium avium subsp. paratuberculosis
acccgaugaccggcccggcggcc

SEQ ID NO: 894567 - RNA, 22 nt, Mycobacterium avium subsp. paratuberculosis
acccgauuucauauugguucgc

SEQ ID NO: 894568 - RNA, 20 nt, Mycobacterium avium subsp. paratuberculosis
acccgaugcucgaugcgcac

SEQ ID NO: 894569 - RNA, 17 nt, Mycobacterium avium subsp. paratuberculosis
accgacggagccgagca

SEQ ID NO: 894570 - RNA, 14 nt, Mycobacterium avium subsp. paratuberculosis
accgacugcgacgg

SEQ ID NO: 894571 - RNA, 20 nt, Mycobacterium avium subsp. paratuberculosis
accgacggccgcaccccacc

SEQ ID NO: 894572 - RNA, 23 nt, Mycobacterium avium subsp. paratuberculosis
accgacggccgcaccccacccgc

SEQ ID NO: 894573 - RNA, 22 nt, Mycobacterium avium subsp. paratuberculosis
accgacuguuugaugccgucgg

SEQ ID NO: 894574 - RNA, 17 nt, Mycobacterium avium subsp. paratuberculosis
accgacuccuccggccc

SEQ ID NO: 894575 - RNA, 19 nt, Mycobacterium avium subsp. paratuberculosis
accgagaccaugccgccga

SEQ ID NO: 894576 - RNA, 14 nt, Mycobacterium avium subsp. paratuberculosis
accgagauggccac

SEQ ID NO: 894577 - RNA, 19 nt, Mycobacterium avium subsp. paratuberculosis
accgagaucaugccggcga

SEQ ID NO: 894578 - RNA, 18 nt, Mycobacterium avium subsp. paratuberculosis
accgagaucucgucgaug

SEQ ID NO: 894579 - RNA, 13 nt, Mycobacterium avium subsp. paratuberculosis
accgagcagcggg

SEQ ID NO: 894580 - RNA, 14 nt, Mycobacterium avium subsp. paratuberculosis
accgagccgcgcgc

SEQ ID NO: 894581 - RNA, 11 nt, Mycobacterium avium subsp. paratuberculosis
accgagccggc

SEQ ID NO: 894582 - RNA, 14 nt, Mycobacterium avium subsp. paratuberculosis
accgagccggcggc

SEQ ID NO: 894583 - RNA, 15 nt, Mycobacterium avium subsp. paratuberculosis
accgagccggcggcg

SEQ ID NO: 894584 - RNA, 14 nt, Mycobacterium avium subsp. paratuberculosis
accgagccggcguc

SEQ ID NO: 894585 - RNA, 18 nt, Mycobacterium avium subsp. paratuberculosis
accgagccgggcagcgcg

SEQ ID NO: 894586 - RNA, 20 nt, Mycobacterium avium subsp. paratuberculosis
accgagccgggcagcgcgac

SEQ ID NO: 894587 - RNA, 12 nt, Mycobacterium avium subsp. paratuberculosis
accgagccgggg

SEQ ID NO: 894588 - RNA, 20 nt, Mycobacterium avium subsp. paratuberculosis
accgagccugggauugccgg

SEQ ID NO: 894589 - RNA, 19 nt, Mycobacterium avium subsp. paratuberculosis
accgacaagggccgggcgc

SEQ ID NO: 894590 - RNA, 23 nt, Mycobacterium avium subsp. paratuberculosis
accgacaagggccgggcgcuggc

SEQ ID NO: 894591 - RNA, 18 nt, Mycobacterium avium subsp. paratuberculosis
accgacgccagcgggccg

SEQ ID NO: 894592 - RNA, 13 nt, Mycobacterium avium subsp. paratuberculosis
accgacgcccggc

SEQ ID NO: 894593 - RNA, 21 nt, Mycobacterium avium subsp. paratuberculosis
accgacgcccggcuucgccgc

SEQ ID NO: 894594 - RNA, 12 nt, Mycobacterium avium subsp. paratuberculosis
accgacgcggcg

SEQ ID NO: 894595 - RNA, 14 nt, Mycobacterium avium subsp. paratuberculosis
accgacgcggcggc

SEQ ID NO: 894596 - RNA, 16 nt, Mycobacterium avium subsp. paratuberculosis
accgacgcggcggccg

SEQ ID NO: 894597 - RNA, 13 nt, Mycobacterium avium subsp. paratuberculosis
accgacgcgucgc

SEQ ID NO: 894598 - RNA, 17 nt, Mycobacterium avium subsp. paratuberculosis
accgacgcgucgcggcg

SEQ ID NO: 894599 - RNA, 17 nt, Mycobacterium avium subsp. paratuberculosis
accgacgcucgccaccc

SEQ ID NO: 894600 - RNA, 22 nt, Mycobacterium avium subsp. paratuberculosis
accgacgcucgccaccccgcgc

SEQ ID NO: 894601 - RNA, 14 nt, Mycobacterium avium subsp. paratuberculosis
accgacgcggucac

SEQ ID NO: 894602 - RNA, 18 nt, Mycobacterium avium subsp. paratuberculosis
accgaacgacgagccguc

SEQ ID NO: 894603 - RNA, 13 nt, Mycobacterium avium subsp. paratuberculosis
accgaacgccagc

SEQ ID NO: 894604 - RNA, 22 nt, Mycobacterium avium subsp. paratuberculosis
accgaagggaaaggcagcagcc

SEQ ID NO: 894605 - RNA, 20 nt, Mycobacterium avium subsp. paratuberculosis
accgaaucacccacggccac

SEQ ID NO: 894606 - RNA, 14 nt, Mycobacterium avium subsp. paratuberculosis
accgaaucgccgag

SEQ ID NO: 894607 - RNA, 16 nt, Mycobacterium avium subsp. paratuberculosis
accgaagccgacgucg

SEQ ID NO: 894608 - RNA, 16 nt, Mycobacterium avium subsp. paratuberculosis
accgaggugccgcggg

SEQ ID NO: 894609 - RNA, 15 nt, Mycobacterium avium subsp. paratuberculosis
accgaguugaacgcg

SEQ ID NO: 894610 - RNA, 19 nt, Mycobacterium avium subsp. paratuberculosis
accgaguugaacgcgucga

SEQ ID NO: 894611 - RNA, 12 nt, Mycobacterium avium subsp. paratuberculosis
accgauccgccg

SEQ ID NO: 894612 - RNA, 13 nt, Mycobacterium avium subsp. paratuberculosis
accgauccgccgg

SEQ ID NO: 894613 - RNA, 17 nt, Mycobacterium avium subsp. paratuberculosis
accgauccgccggcgaa

SEQ ID NO: 894614 - RNA, 12 nt, Mycobacterium avium subsp. paratuberculosis
accgaucaccgg

SEQ ID NO: 894615 - RNA, 16 nt, Mycobacterium avium subsp. paratuberculosis
accgaucaccggcagc

SEQ ID NO: 894616 - RNA, 17 nt, Mycobacterium avium subsp. paratuberculosis
accgaucaccggcagca

SEQ ID NO: 894617 - RNA, 20 nt, Mycobacterium avium subsp. paratuberculosis
accgaucaccggcagcagcg

SEQ ID NO: 894618 - RNA, 15 nt, Mycobacterium avium subsp. paratuberculosis
accgaugcgggccag

SEQ ID NO: 894619 - RNA, 19 nt, Mycobacterium avium subsp. paratuberculosis
accgaucucgauggacgcg

SEQ ID NO: 894620 - RNA, 23 nt, Mycobacterium avium subsp. paratuberculosis
accgaucucgauggacgcggugg

SEQ ID NO: 894621 - RNA, 15 nt, Mycobacterium avium subsp. paratuberculosis
accgaugaccaccgc

SEQ ID NO: 894622 - RNA, 20 nt, Mycobacterium avium subsp. paratuberculosis
accgaucggauucggguggc

SEQ ID NO: 894623 - RNA, 12 nt, Mycobacterium avium subsp. paratuberculosis
accgaucggcac

SEQ ID NO: 894624 - RNA, 13 nt, Mycobacterium avium subsp. paratuberculosis
accgauccggcgc

SEQ ID NO: 894625 - RNA, 14 nt, Mycobacterium avium subsp. paratuberculosis
accgauccggcgcc

SEQ ID NO: 894626 - RNA, 18 nt, Mycobacterium avium subsp. paratuberculosis
accgagcggcgcugcagc

SEQ ID NO: 894627 - RNA, 21 nt, Mycobacterium avium subsp. paratuberculosis
accgagcgucacgcuggcgug

SEQ ID NO: 894628 - RNA, 13 nt, Mycobacterium avium subsp. paratuberculosis
accgagcgcgcga

SEQ ID NO: 894629 - RNA, 12 nt, Mycobacterium avium subsp. paratuberculosis
accgagcggccg

SEQ ID NO: 894630 - RNA, 16 nt, Mycobacterium avium subsp. paratuberculosis
accgagcugggccggc

SEQ ID NO: 894631 - RNA, 18 nt, Mycobacterium avium subsp. paratuberculosis
accgagcugggccggcgc

SEQ ID NO: 894632 - RNA, 14 nt, Mycobacterium avium subsp. paratuberculosis
accgaggccgcccg

SEQ ID NO: 894633 - RNA, 17 nt, Mycobacterium avium subsp. paratuberculosis
accgagguggcccagcc

SEQ ID NO: 894634 - RNA, 19 nt, Mycobacterium avium subsp. paratuberculosis
accgaggugacgucgcgcc

SEQ ID NO: 894635 - RNA, 12 nt, Mycobacterium avium subsp. paratuberculosis
accgagucgcgc

SEQ ID NO: 894636 - RNA, 14 nt, Mycobacterium avium subsp. paratuberculosis
accgagucgcgcga

SEQ ID NO: 894637 - RNA, 19 nt, Mycobacterium avium subsp. paratuberculosis
accgagucgcgcgaccagu

SEQ ID NO: 894638 - RNA, 14 nt, Mycobacterium avium subsp. paratuberculosis
accgagucgcugca

SEQ ID NO: 894639 - RNA, 20 nt, Mycobacterium avium subsp. paratuberculosis
accgagucggugaccaccug

SEQ ID NO: 894640 - RNA, 23 nt, Mycobacterium avium subsp. paratuberculosis
accgagucggugaccaccugcac

SEQ ID NO: 894641 - RNA, 13 nt, Mycobacterium avium subsp. paratuberculosis
accgagucgucgc

SEQ ID NO: 894642 - RNA, 22 nt, Mycobacterium avium subsp. paratuberculosis
accgagucgucgcgcaccagcu

SEQ ID NO: 894643 - RNA, 22 nt, Mycobacterium avium subsp. paratuberculosis
accgagugcggcgcggugcgcc

SEQ ID NO: 894644 - RNA, 13 nt, Mycobacterium avium subsp. paratuberculosis
accgaggcgaucg

SEQ ID NO: 894645 - RNA, 15 nt, Mycobacterium avium subsp. paratuberculosis
accgaggucaccgcg

SEQ ID NO: 894646 - RNA, 14 nt, Mycobacterium avium subsp. paratuberculosis
accgaggucgacgc

SEQ ID NO: 894647 - RNA, 15 nt, Mycobacterium avium subsp. paratuberculosis
accgcaaagcaccgc

SEQ ID NO: 894648 - RNA, 20 nt, Mycobacterium avium subsp. paratuberculosis
accgcaacguuguuccacgu

SEQ ID NO: 894649 - RNA, 18 nt, Mycobacterium avium subsp. paratuberculosis
accgauuucggccagccg

SEQ ID NO: 894650 - RNA, 21 nt, Mycobacterium avium subsp. paratuberculosis
accgauuucggccagccgggg

SEQ ID NO: 894651 - RNA, 20 nt, Mycobacterium avium subsp. paratuberculosis
accgcaacaccagcacggug

SEQ ID NO: 894652 - RNA, 13 nt, Mycobacterium avium subsp. paratuberculosis
accgcaacaccga

SEQ ID NO: 894653 - RNA, 12 nt, Mycobacterium avium subsp. paratuberculosis
accgauggccgc

SEQ ID NO: 894654 - RNA, 15 nt, Mycobacterium avium subsp. paratuberculosis
accgauggcggcggc

SEQ ID NO: 894655 - RNA, 19 nt, Mycobacterium avium subsp. paratuberculosis
accgauggcggcggcccgc

SEQ ID NO: 894656 - RNA, 20 nt, Mycobacterium avium subsp. paratuberculosis
accgauggcggcggcccgcc

SEQ ID NO: 894657 - RNA, 23 nt, Mycobacterium avium subsp. paratuberculosis
accgauggcggcggcccgccgcg

SEQ ID NO: 894658 - RNA, 23 nt, Mycobacterium avium subsp. paratuberculosis
accgcaauccuguuccccggcgg

SEQ ID NO: 894659 - RNA, 18 nt, Mycobacterium avium subsp. paratuberculosis
accgcaagugcggucagc

SEQ ID NO: 894660 - RNA, 16 nt, Mycobacterium avium subsp. paratuberculosis
accgcacccccagcuc

SEQ ID NO: 894661 - RNA, 16 nt, Mycobacterium avium subsp. paratuberculosis
accgcaccccgucgcg

SEQ ID NO: 894662 - RNA, 21 nt, Mycobacterium avium subsp. paratuberculosis
accgcacgaucagggugucga

SEQ ID NO: 894663 - RNA, 14 nt, Mycobacterium avium subsp. paratuberculosis
accgcaccgacgaa

SEQ ID NO: 894664 - RNA, 22 nt, Mycobacterium avium subsp. paratuberculosis
accgccaggaaggccaguucga

SEQ ID NO: 894665 - RNA, 16 nt, Mycobacterium avium subsp. paratuberculosis
accgccaggaccaccc

SEQ ID NO: 894666 - RNA, 13 nt, Mycobacterium avium subsp. paratuberculosis
accgccacggcga

SEQ ID NO: 894667 - RNA, 17 nt, Mycobacterium avium subsp. paratuberculosis
accgccacggcgacgac

SEQ ID NO: 894668 - RNA, 20 nt, Mycobacterium avium subsp. paratuberculosis
accgccacggcgacgaccac

SEQ ID NO: 894669 - RNA, 16 nt, Mycobacterium avium subsp. paratuberculosis
accgccacgacgcggc

SEQ ID NO: 894670 - RNA, 18 nt, Mycobacterium avium subsp. paratuberculosis
accgccacgacgcggcga

SEQ ID NO: 894671 - RNA, 19 nt, Mycobacterium avium subsp. paratuberculosis
accgccacgacgcggcgau

SEQ ID NO: 894672 - RNA, 17 nt, Mycobacterium avium subsp. paratuberculosis
accgccaccagcaggcc

SEQ ID NO: 894673 - RNA, 18 nt, Mycobacterium avium subsp. paratuberculosis
accgccaccagcaggccc

SEQ ID NO: 894674 - RNA, 16 nt, Mycobacterium avium subsp. paratuberculosis
accgccaccagcgcac

SEQ ID NO: 894675 - RNA, 14 nt, Mycobacterium avium subsp. paratuberculosis
accgccaccaggcc

SEQ ID NO: 894676 - RNA, 15 nt, Mycobacterium avium subsp. paratuberculosis
accgcacggcccauc

SEQ ID NO: 894677 - RNA, 13 nt, Mycobacterium avium subsp. paratuberculosis
accgccaccgccc

SEQ ID NO: 894678 - RNA, 15 nt, Mycobacterium avium subsp. paratuberculosis
accgccaccgcccgc

SEQ ID NO: 894679 - RNA, 17 nt, Mycobacterium avium subsp. paratuberculosis
accgccaccgcccgcug

SEQ ID NO: 894680 - RNA, 13 nt, Mycobacterium avium subsp. paratuberculosis
accgccaccgcga

SEQ ID NO: 894681 - RNA, 14 nt, Mycobacterium avium subsp. paratuberculosis
accgccaccggccc

SEQ ID NO: 894682 - RNA, 15 nt, Mycobacterium avium subsp. paratuberculosis
accgccaccggcccg

SEQ ID NO: 894683 - RNA, 16 nt, Mycobacterium avium subsp. paratuberculosis
accgccaccggcccgg

SEQ ID NO: 894684 - RNA, 17 nt, Mycobacterium avium subsp. paratuberculosis
accgccaccggcccggc

SEQ ID NO: 894685 - RNA, 12 nt, Mycobacterium avium subsp. paratuberculosis
accgcccagcgg

SEQ ID NO: 894686 - RNA, 14 nt, Mycobacterium avium subsp. paratuberculosis
accgcccagcggcu

SEQ ID NO: 894687 - RNA, 19 nt, Mycobacterium avium subsp. paratuberculosis
accgccccagccgaccagu

SEQ ID NO: 894688 - RNA, 15 nt, Mycobacterium avium subsp. paratuberculosis
accgcccccgcggcg

SEQ ID NO: 894689 - RNA, 18 nt, Mycobacterium avium subsp. paratuberculosis
accgcccccgcggcggcc

SEQ ID NO: 894690 - RNA, 15 nt, Mycobacterium avium subsp. paratuberculosis
accgccaucgcggcg

SEQ ID NO: 894691 - RNA, 16 nt, Mycobacterium avium subsp. paratuberculosis
accgccaucgcggcgu

SEQ ID NO: 894692 - RNA, 22 nt, Mycobacterium avium subsp. paratuberculosis
accgccccgacgaucgcgccgg

SEQ ID NO: 894693 - RNA, 18 nt, Mycobacterium avium subsp. paratuberculosis
accgccccgccgcgccgg

SEQ ID NO: 894694 - RNA, 19 nt, Mycobacterium avium subsp. paratuberculosis
accgccccgccgcgccggg

SEQ ID NO: 894695 - RNA, 22 nt, Mycobacterium avium subsp. paratuberculosis
accgccccgccggugucggcga

SEQ ID NO: 894696 - RNA, 13 nt, Mycobacterium avium subsp. paratuberculosis
accgccccgcgcg

SEQ ID NO: 894697 - RNA, 14 nt, Mycobacterium avium subsp. paratuberculosis
accgccccgcgcga

SEQ ID NO: 894698 - RNA, 20 nt, Mycobacterium avium subsp. paratuberculosis
accgccccgcuaaagccgac

SEQ ID NO: 894699 - RNA, 22 nt, Mycobacterium avium subsp. paratuberculosis
accgccccggucaccccggcca

SEQ ID NO: 894700 - RNA, 17 nt, Mycobacterium avium subsp. paratuberculosis
accgcccgaaccgcguc

SEQ ID NO: 894701 - RNA, 14 nt, Mycobacterium avium subsp. paratuberculosis
accgcccgcccggc

SEQ ID NO: 894702 - RNA, 18 nt, Mycobacterium avium subsp. paratuberculosis
accgcccgcccggcacga

SEQ ID NO: 894703 - RNA, 12 nt, Mycobacterium avium subsp. paratuberculosis
accgcccgcgcg

SEQ ID NO: 894704 - RNA, 13 nt, Mycobacterium avium subsp. paratuberculosis
accgcccgcgcga

SEQ ID NO: 894705 - RNA, 15 nt, Mycobacterium avium subsp. paratuberculosis
accgcccgcgcgaug

SEQ ID NO: 894706 - RNA, 12 nt, Mycobacterium avium subsp. paratuberculosis
accgcccgcgcu

SEQ ID NO: 894707 - RNA, 14 nt, Mycobacterium avium subsp. paratuberculosis
accgcccgcgcugg

SEQ ID NO: 894708 - RNA, 13 nt, Mycobacterium avium subsp. paratuberculosis
accgcccgcggug

SEQ ID NO: 894709 - RNA, 13 nt, Mycobacterium avium subsp. paratuberculosis
accgcccggaccg

SEQ ID NO: 894710 - RNA, 12 nt, Mycobacterium avium subsp. paratuberculosis
accgcccggcgc

SEQ ID NO: 894711 - RNA, 14 nt, Mycobacterium avium subsp. paratuberculosis
accgcccggcgccg

SEQ ID NO: 894712 - RNA, 15 nt, Mycobacterium avium subsp. paratuberculosis
accgcccggcgccga

SEQ ID NO: 894713 - RNA, 19 nt, Mycobacterium avium subsp. paratuberculosis
accgcccgggccaggcgcg

SEQ ID NO: 894714 - RNA, 21 nt, Mycobacterium avium subsp. paratuberculosis
accgcccggggcgcggaccgc

SEQ ID NO: 894715 - RNA, 14 nt, Mycobacterium avium subsp. paratuberculosis
accgcccgggugau

SEQ ID NO: 894716 - RNA, 20 nt, Mycobacterium avium subsp. paratuberculosis
accgcccggguugucgacgu

SEQ ID NO: 894717 - RNA, 21 nt, Mycobacterium avium subsp. paratuberculosis
accgcccggguugucgacgug

SEQ ID NO: 894718 - RNA, 17 nt, Mycobacterium avium subsp. paratuberculosis
accgcccggaugccggc

SEQ ID NO: 894719 - RNA, 23 nt, Mycobacterium avium subsp. paratuberculosis
accgcccggaugccggcgcccag

SEQ ID NO: 894720 - RNA, 17 nt, Mycobacterium avium subsp. paratuberculosis
accgccgaaacaccggc

SEQ ID NO: 894721 - RNA, 18 nt, Mycobacterium avium subsp. paratuberculosis
accgccgccauccgcgcc

SEQ ID NO: 894722 - RNA, 20 nt, Mycobacterium avium subsp. paratuberculosis
accgccgccauccgcgccga

SEQ ID NO: 894723 - RNA, 21 nt, Mycobacterium avium subsp. paratuberculosis
accgccgccauccgcgccgaa

SEQ ID NO: 894724 - RNA, 16 nt, Mycobacterium avium subsp. paratuberculosis
accgcccuuccagcac

SEQ ID NO: 894725 - RNA, 13 nt, Mycobacterium avium subsp. paratuberculosis
accgccgccgacu

SEQ ID NO: 894726 - RNA, 20 nt, Mycobacterium avium subsp. paratuberculosis
accgccgccgacuccccgcc

SEQ ID NO: 894727 - RNA, 18 nt, Mycobacterium avium subsp. paratuberculosis
accgccgcgcggccgggc

SEQ ID NO: 894728 - RNA, 19 nt, Mycobacterium avium subsp. paratuberculosis
accgccgcgcggccgggcu

SEQ ID NO: 894729 - RNA, 18 nt, Mycobacterium avium subsp. paratuberculosis
accgccgcgcucgcacca

SEQ ID NO: 894730 - RNA, 16 nt, Mycobacterium avium subsp. paratuberculosis
accgccggcccggcgu

SEQ ID NO: 894731 - RNA, 15 nt, Mycobacterium avium subsp. paratuberculosis
accgccggcgccguc

SEQ ID NO: 894732 - RNA, 15 nt, Mycobacterium avium subsp. paratuberculosis
accgccggcgcggac

SEQ ID NO: 894733 - RNA, 16 nt, Mycobacterium avium subsp. paratuberculosis
accgccggcgcggacg

SEQ ID NO: 894734 - RNA, 12 nt, Mycobacterium avium subsp. paratuberculosis
accgccgcgccg

SEQ ID NO: 894735 - RNA, 14 nt, Mycobacterium avium subsp. paratuberculosis
accgccgcgccgag

SEQ ID NO: 894736 - RNA, 17 nt, Mycobacterium avium subsp. paratuberculosis
accgucacccccggcgc

SEQ ID NO: 894737 - RNA, 18 nt, Mycobacterium avium subsp. paratuberculosis
accgucacccccggcgcg

SEQ ID NO: 894738 - RNA, 20 nt, Mycobacterium avium subsp. paratuberculosis
accgucacccccggcgcgac

SEQ ID NO: 894739 - RNA, 23 nt, Mycobacterium avium subsp. paratuberculosis
accgucaccgccgcaccgucgug

SEQ ID NO: 894740 - RNA, 14 nt, Mycobacterium avium subsp. paratuberculosis
accgucaccgccuc

SEQ ID NO: 894741 - RNA, 16 nt, Mycobacterium avium subsp. paratuberculosis
accgucaccguggcgg

SEQ ID NO: 894742 - RNA, 12 nt, Mycobacterium avium subsp. paratuberculosis
accgucaccuuc

SEQ ID NO: 894743 - RNA, 13 nt, Mycobacterium avium subsp. paratuberculosis
accgucacgcugg

SEQ ID NO: 894744 - RNA, 15 nt, Mycobacterium avium subsp. paratuberculosis
accgucacgcuggcg

SEQ ID NO: 894745 - RNA, 20 nt, Mycobacterium avium subsp. paratuberculosis
accgucacgcuggcgugaca

SEQ ID NO: 894746 - RNA, 14 nt, Mycobacterium avium subsp. paratuberculosis
accguagaccaccu

SEQ ID NO: 894747 - RNA, 17 nt, Mycobacterium avium subsp. paratuberculosis
accguagccggucggcc

SEQ ID NO: 894748 - RNA, 15 nt, Mycobacterium avium subsp. paratuberculosis
accgucaucgcggcg

SEQ ID NO: 894749 - RNA, 19 nt, Mycobacterium avium subsp. paratuberculosis
accguccacagccggcggc

SEQ ID NO: 894750 - RNA, 21 nt, Mycobacterium avium subsp. paratuberculosis
accguccacagccggcggcug

SEQ ID NO: 894751 - RNA, 16 nt, Mycobacterium avium subsp. paratuberculosis
accguccagcucagcg

SEQ ID NO: 894752 - RNA, 20 nt, Mycobacterium avium subsp. paratuberculosis
accgucaucgugugggcgcc

SEQ ID NO: 894753 - RNA, 22 nt, Mycobacterium avium subsp. paratuberculosis
accgucaucgugugggcgcccg

SEQ ID NO: 894754 - RNA, 16 nt, Mycobacterium avium subsp. paratuberculosis
accgucaugccguuga

SEQ ID NO: 894755 - RNA, 14 nt, Mycobacterium avium subsp. paratuberculosis
accguacggcccga

SEQ ID NO: 894756 - RNA, 18 nt, Mycobacterium avium subsp. paratuberculosis
accguaccgaggaugacc

SEQ ID NO: 894757 - RNA, 20 nt, Mycobacterium avium subsp. paratuberculosis
accguaccgaggaugaccgc

SEQ ID NO: 894758 - RNA, 23 nt, Mycobacterium avium subsp. paratuberculosis
accguaccgaggaugaccgcggc

SEQ ID NO: 894759 - RNA, 16 nt, Mycobacterium avium subsp. paratuberculosis
accgguuugucggcgc

SEQ ID NO: 894760 - RNA, 23 nt, Mycobacterium avium subsp. paratuberculosis
accgguugcccgguuccgcgaca

SEQ ID NO: 894761 - RNA, 23 nt, Mycobacterium avium subsp. paratuberculosis
accgguucgucaacgccccgguc

SEQ ID NO: 894762 - RNA, 16 nt, Mycobacterium avium subsp. paratuberculosis
accgguugcgccgagg

SEQ ID NO: 894763 - RNA, 17 nt, Mycobacterium avium subsp. paratuberculosis
accgguugcgccgaggu

SEQ ID NO: 894764 - RNA, 17 nt, Mycobacterium avium subsp. paratuberculosis
accgguugcggcgaacg

SEQ ID NO: 894765 - RNA, 15 nt, Mycobacterium avium subsp. paratuberculosis
accgguugcgggccg

SEQ ID NO: 894766 - RNA, 15 nt, Mycobacterium avium subsp. paratuberculosis
accggugugccuggc

SEQ ID NO: 894767 - RNA, 17 nt, Mycobacterium avium subsp. paratuberculosis
accggugugccuggcuc

SEQ ID NO: 894768 - RNA, 21 nt, Mycobacterium avium subsp. paratuberculosis
accgguucggacacggcgccg

SEQ ID NO: 894769 - RNA, 23 nt, Mycobacterium avium subsp. paratuberculosis
accgguucggacacggcgccgug

SEQ ID NO: 894770 - RNA, 24 nt, Mycobacterium avium subsp. paratuberculosis
accgguucggacacggcgccgugc

SEQ ID NO: 894771 - RNA, 22 nt, Mycobacterium avium subsp. paratuberculosis
accgguuccgggcgaccccggc

SEQ ID NO: 894772 - RNA, 20 nt, Mycobacterium avium subsp. paratuberculosis
accggugucacgcuggcgug

SEQ ID NO: 894773 - RNA, 14 nt, Mycobacterium avium subsp. paratuberculosis
accgguggccgcgu

SEQ ID NO: 894774 - RNA, 17 nt, Mycobacterium avium subsp. paratuberculosis
accgguggccgcgucga

SEQ ID NO: 894775 - RNA, 18 nt, Mycobacterium avium subsp. paratuberculosis
accgguggccgcgucgac

SEQ ID NO: 894776 - RNA, 19 nt, Mycobacterium avium subsp. paratuberculosis
accgguggccgcgucgacc

SEQ ID NO: 894777 - RNA, 18 nt, Mycobacterium avium subsp. paratuberculosis
accgguggugagacccug

SEQ ID NO: 894778 - RNA, 15 nt, Mycobacterium avium subsp. paratuberculosis
accggugcacgagcg

SEQ ID NO: 894779 - RNA, 20 nt, Mycobacterium avium subsp. paratuberculosis
accggugcacgagcgucgug

SEQ ID NO: 894780 - RNA, 13 nt, Mycobacterium avium subsp. paratuberculosis
accggugcgcccg

SEQ ID NO: 894781 - RNA, 14 nt, Mycobacterium avium subsp. paratuberculosis
accggugcgcccgc

SEQ ID NO: 894782 - RNA, 15 nt, Mycobacterium avium subsp. paratuberculosis
accggugcgcccgcg

SEQ ID NO: 894783 - RNA, 18 nt, Mycobacterium avium subsp. paratuberculosis
accggugcgcccgcgauc

SEQ ID NO: 894784 - RNA, 22 nt, Mycobacterium avium subsp. paratuberculosis
accggugcucuccugcuugacc

SEQ ID NO: 894785 - RNA, 19 nt, Mycobacterium avium subsp. paratuberculosis
accgguccuccccgcuggc

SEQ ID NO: 894786 - RNA, 21 nt, Mycobacterium avium subsp. paratuberculosis
accgguccgugccacggccgc

SEQ ID NO: 894787 - RNA, 24 nt, Mycobacterium avium subsp. paratuberculosis
accgguccgugccacggccgcggc

SEQ ID NO: 894788 - RNA, 12 nt, Mycobacterium avium subsp. paratuberculosis
accgggccgcug

SEQ ID NO: 894789 - RNA, 18 nt, Mycobacterium avium subsp. paratuberculosis
accgguccgccgucgggg

SEQ ID NO: 894790 - RNA, 14 nt, Mycobacterium avium subsp. paratuberculosis
accgguccgcgguu

SEQ ID NO: 894791 - RNA, 16 nt, Mycobacterium avium subsp. paratuberculosis
accgguccggccgugc

SEQ ID NO: 894792 - RNA, 16 nt, Mycobacterium avium subsp. paratuberculosis
accgguccggucacgc

SEQ ID NO: 894793 - RNA, 14 nt, Mycobacterium avium subsp. paratuberculosis
accggucguuggcc

SEQ ID NO: 894794 - RNA, 22 nt, Mycobacterium avium subsp. paratuberculosis
accggucucgaccgcggcgccg

SEQ ID NO: 894795 - RNA, 19 nt, Mycobacterium avium subsp. paratuberculosis
accgggaacagccaggcga

SEQ ID NO: 894796 - RNA, 15 nt, Mycobacterium avium subsp. paratuberculosis
accgggaagccgagc

SEQ ID NO: 894797 - RNA, 21 nt, Mycobacterium avium subsp. paratuberculosis
accgggaaggugucggccggg

SEQ ID NO: 894798 - RNA, 20 nt, Mycobacterium avium subsp. paratuberculosis
accgggacagccgcgccgac

SEQ ID NO: 894799 - RNA, 12 nt, Mycobacterium avium subsp. paratuberculosis
accgggacaucg

SEQ ID NO: 894800 - RNA, 18 nt, Mycobacterium avium subsp. paratuberculosis
accgggacaucgucgcgc

SEQ ID NO: 894801 - RNA, 15 nt, Mycobacterium avium subsp. paratuberculosis
accgggaccagcgcg

SEQ ID NO: 894802 - RNA, 16 nt, Mycobacterium avium subsp. paratuberculosis
accgggaccagcgcgg

SEQ ID NO: 894803 - RNA, 17 nt, Mycobacterium avium subsp. paratuberculosis
accgggaccagcgcggu

SEQ ID NO: 894804 - RNA, 18 nt, Mycobacterium avium subsp. paratuberculosis
accgggaccagcgcggug

SEQ ID NO: 894805 - RNA, 13 nt, Mycobacterium avium subsp. paratuberculosis
accgggaccugcu

SEQ ID NO: 894806 - RNA, 21 nt, Mycobacterium avium subsp. paratuberculosis
accgggaccugggucugcggc

SEQ ID NO: 894807 - RNA, 16 nt, Mycobacterium avium subsp. paratuberculosis
accgggacgacggcgc

SEQ ID NO: 894808 - RNA, 17 nt, Mycobacterium avium subsp. paratuberculosis
accgggacgacggcgcc

SEQ ID NO: 894809 - RNA, 22 nt, Mycobacterium avium subsp. paratuberculosis
accgggacgggggugccgaccg

SEQ ID NO: 894810 - RNA, 23 nt, Mycobacterium avium subsp. paratuberculosis
accgggacgggggugccgaccgc

SEQ ID NO: 894811 - RNA, 19 nt, Mycobacterium avium subsp. paratuberculosis
accgggagaacucgacgau

SEQ ID NO: 894812 - RNA, 17 nt, Mycobacterium avium subsp. paratuberculosis
accgggacaccgcuggc

SEQ ID NO: 894813 - RNA, 16 nt, Mycobacterium avium subsp. paratuberculosis
accgggauccggcgcg

SEQ ID NO: 894814 - RNA, 17 nt, Mycobacterium avium subsp. paratuberculosis
accgggauccggcgcgc

SEQ ID NO: 894815 - RNA, 18 nt, Mycobacterium avium subsp. paratuberculosis
accgggauccggcgcgcc

SEQ ID NO: 894816 - RNA, 21 nt, Mycobacterium avium subsp. paratuberculosis
accgggauccggcgcgccgcg

SEQ ID NO: 894817 - RNA, 17 nt, Mycobacterium avium subsp. paratuberculosis
accgggaucggcggcgg

SEQ ID NO: 894818 - RNA, 19 nt, Mycobacterium avium subsp. paratuberculosis
accgggaucggcggcgggg

SEQ ID NO: 894819 - RNA, 22 nt, Mycobacterium avium subsp. paratuberculosis
accgggaucggggugccgccgg

SEQ ID NO: 894820 - RNA, 19 nt, Mycobacterium avium subsp. paratuberculosis
accgggaucguguggccgc

SEQ ID NO: 894821 - RNA, 23 nt, Mycobacterium avium subsp. paratuberculosis
accgggauggcguucugcaccga

SEQ ID NO: 894822 - RNA, 15 nt, Mycobacterium avium subsp. paratuberculosis
accgggauggugacc

SEQ ID NO: 894823 - RNA, 21 nt, Mycobacterium avium subsp. paratuberculosis
accgggauggugaccagcgcc

SEQ ID NO: 894824 - RNA, 16 nt, Mycobacterium avium subsp. paratuberculosis
accgggcacccggcgc

SEQ ID NO: 894825 - RNA, 21 nt, Mycobacterium avium subsp. paratuberculosis
accgggcacccggcgcggccg

SEQ ID NO: 894826 - RNA, 23 nt, Mycobacterium avium subsp. paratuberculosis
accgggcacccggcgcggccgcc

SEQ ID NO: 894827 - RNA, 13 nt, Mycobacterium avium subsp. paratuberculosis
accgggcaccgac

SEQ ID NO: 894828 - RNA, 20 nt, Mycobacterium avium subsp. paratuberculosis
accgggcagccgcacaccgc

SEQ ID NO: 894829 - RNA, 21 nt, Mycobacterium avium subsp. paratuberculosis
accgggcaguagaacggcccg

SEQ ID NO: 894830 - RNA, 20 nt, Mycobacterium avium subsp. paratuberculosis
accgggcaguuccuugcgca

SEQ ID NO: 894831 - RNA, 22 nt, Mycobacterium avium subsp. paratuberculosis
accgggcaguuccuugcgcagc

SEQ ID NO: 894832 - RNA, 16 nt, Mycobacterium avium subsp. paratuberculosis
accgggcaggcacggu

SEQ ID NO: 894833 - RNA, 17 nt, Mycobacterium avium subsp. paratuberculosis
accgggccaggaugacc

SEQ ID NO: 894834 - RNA, 23 nt, Mycobacterium avium subsp. paratuberculosis
accgggccaggaugaccgcccag

SEQ ID NO: 894835 - RNA, 14 nt, Mycobacterium avium subsp. paratuberculosis
accgggcccagcuc

SEQ ID NO: 894836 - RNA, 22 nt, Mycobacterium avium subsp. paratuberculosis
accgggcccgcccgcagcggcg

SEQ ID NO: 894837 - RNA, 12 nt, Mycobacterium avium subsp. paratuberculosis
accgggcccggc

SEQ ID NO: 894838 - RNA, 21 nt, Mycobacterium avium subsp. paratuberculosis
accgggccgaaggcggcgccg

SEQ ID NO: 894839 - RNA, 22 nt, Mycobacterium avium subsp. paratuberculosis
accgggccgaggaagacgucga

SEQ ID NO: 894840 - RNA, 23 nt, Mycobacterium avium subsp. paratuberculosis
accguguuugcugcaugcgcugc

SEQ ID NO: 894841 - RNA, 17 nt, Mycobacterium avium subsp. paratuberculosis
accguguugaucucguc

SEQ ID NO: 894842 - RNA, 21 nt, Mycobacterium avium subsp. paratuberculosis
accguucuccgaggcguccuc

SEQ ID NO: 894843 - RNA, 17 nt, Mycobacterium avium subsp. paratuberculosis
accgugucgucgcugac

SEQ ID NO: 894844 - RNA, 17 nt, Mycobacterium avium subsp. paratuberculosis
accguggugacccggac

SEQ ID NO: 894845 - RNA, 15 nt, Mycobacterium avium subsp. paratuberculosis
accguguagccgacc

SEQ ID NO: 894846 - RNA, 23 nt, Mycobacterium avium subsp. paratuberculosis
accguguagccgaccgacccggc

SEQ ID NO: 894847 - RNA, 19 nt, Mycobacterium avium subsp. paratuberculosis
accguggcgggggagccgu

SEQ ID NO: 894848 - RNA, 21 nt, Mycobacterium avium subsp. paratuberculosis
accguggcgggggagccgugc

SEQ ID NO: 894849 - RNA, 14 nt, Mycobacterium avium subsp. paratuberculosis
accgugggcggcgc

SEQ ID NO: 894850 - RNA, 13 nt, Mycobacterium avium subsp. paratuberculosis
accguggugucgg

SEQ ID NO: 894851 - RNA, 17 nt, Mycobacterium avium subsp. paratuberculosis
accguggugugcccgcg

SEQ ID NO: 894852 - RNA, 20 nt, Mycobacterium avium subsp. paratuberculosis
accguggugugcccgcgggc

SEQ ID NO: 894853 - RNA, 15 nt, Mycobacterium avium subsp. paratuberculosis
accgugccgcgcggc

SEQ ID NO: 894854 - RNA, 19 nt, Mycobacterium avium subsp. paratuberculosis
accgugccgcgcggcggug

SEQ ID NO: 894855 - RNA, 20 nt, Mycobacterium avium subsp. paratuberculosis
accgugcccaccagccggcc

SEQ ID NO: 894856 - RNA, 21 nt, Mycobacterium avium subsp. paratuberculosis
accgugcccaccagccggccg

SEQ ID NO: 894857 - RNA, 22 nt, Mycobacterium avium subsp. paratuberculosis
accgugcccaccagccggccgg

SEQ ID NO: 894858 - RNA, 17 nt, Mycobacterium avium subsp. paratuberculosis
accgugcccgagccgau

SEQ ID NO: 894859 - RNA, 19 nt, Mycobacterium avium subsp. paratuberculosis
accgugcacgaucgcggug

SEQ ID NO: 894860 - RNA, 20 nt, Mycobacterium avium subsp. paratuberculosis
accgugccgucggcgucgac

SEQ ID NO: 894861 - RNA, 21 nt, Mycobacterium avium subsp. paratuberculosis
accgugccuuacgccgggguc

SEQ ID NO: 894862 - RNA, 19 nt, Mycobacterium avium subsp. paratuberculosis
accgugcgacuugguggcc

SEQ ID NO: 894863 - RNA, 15 nt, Mycobacterium avium subsp. paratuberculosis
accgugccgucacgc

SEQ ID NO: 894864 - RNA, 13 nt, Mycobacterium avium subsp. paratuberculosis
accgugccgucgc

SEQ ID NO: 894865 - RNA, 16 nt, Mycobacterium avium subsp. paratuberculosis
accgugccgucggcgu

SEQ ID NO: 894866 - RNA, 15 nt, Mycobacterium avium subsp. paratuberculosis
accgugccgcccguc

SEQ ID NO: 894867 - RNA, 19 nt, Mycobacterium avium subsp. paratuberculosis
accguggaagucgccgucc

SEQ ID NO: 894868 - RNA, 16 nt, Mycobacterium avium subsp. paratuberculosis
accguggagacguccg

SEQ ID NO: 894869 - RNA, 17 nt, Mycobacterium avium subsp. paratuberculosis
accgugcugauccacgc

SEQ ID NO: 894870 - RNA, 17 nt, Mycobacterium avium subsp. paratuberculosis
accgugcuggccaccac

SEQ ID NO: 894871 - RNA, 15 nt, Mycobacterium avium subsp. paratuberculosis
accgugcgcgcgcac

SEQ ID NO: 894872 - RNA, 16 nt, Mycobacterium avium subsp. paratuberculosis
accgugcgggucgcgc

SEQ ID NO: 894873 - RNA, 18 nt, Mycobacterium avium subsp. paratuberculosis
accguggccccacgggcc

SEQ ID NO: 894874 - RNA, 20 nt, Mycobacterium avium subsp. paratuberculosis
accguggccccagccaccgu

SEQ ID NO: 894875 - RNA, 14 nt, Mycobacterium avium subsp. paratuberculosis
accgucgcgcagcc

SEQ ID NO: 894876 - RNA, 15 nt, Mycobacterium avium subsp. paratuberculosis
accgucgcgcagccc

SEQ ID NO: 894877 - RNA, 16 nt, Mycobacterium avium subsp. paratuberculosis
accgucgcgcagcccg

SEQ ID NO: 894878 - RNA, 18 nt, Mycobacterium avium subsp. paratuberculosis
accgucgcgcagcccgau

SEQ ID NO: 894879 - RNA, 19 nt, Mycobacterium avium subsp. paratuberculosis
accgucgcggucagcucga

SEQ ID NO: 894880 - RNA, 12 nt, Mycobacterium avium subsp. paratuberculosis
accgucggcccg

SEQ ID NO: 894881 - RNA, 13 nt, Mycobacterium avium subsp. paratuberculosis
accgucggcccgc

SEQ ID NO: 894882 - RNA, 20 nt, Mycobacterium avium subsp. paratuberculosis
accgucgggacggccagcag

SEQ ID NO: 894883 - RNA, 13 nt, Mycobacterium avium subsp. paratuberculosis
accgucgcccgcc

SEQ ID NO: 894884 - RNA, 15 nt, Mycobacterium avium subsp. paratuberculosis
accgucgcccgccca

SEQ ID NO: 894885 - RNA, 16 nt, Mycobacterium avium subsp. paratuberculosis
accgucgcccgcccag

SEQ ID NO: 894886 - RNA, 21 nt, Mycobacterium avium subsp. paratuberculosis
accgucgcccgcccaggccgc

SEQ ID NO: 894887 - RNA, 23 nt, Mycobacterium avium subsp. paratuberculosis
accgucgcccgcccaggccgcca

SEQ ID NO: 894888 - RNA, 19 nt, Mycobacterium avium subsp. paratuberculosis
accgucgccgaccagccga

SEQ ID NO: 894889 - RNA, 13 nt, Mycobacterium avium subsp. paratuberculosis
accgucgccggcg

SEQ ID NO: 894890 - RNA, 13 nt, Mycobacterium avium subsp. paratuberculosis
accgucgccggcu

SEQ ID NO: 894891 - RNA, 14 nt, Mycobacterium avium subsp. paratuberculosis
accgucgccggcug

SEQ ID NO: 894892 - RNA, 14 nt, Mycobacterium avium subsp. paratuberculosis
accgucgacgacga

SEQ ID NO: 894893 - RNA, 22 nt, Mycobacterium avium subsp. paratuberculosis
accgucgacgacgaaucccgcc

SEQ ID NO: 894894 - RNA, 21 nt, Mycobacterium avium subsp. paratuberculosis
accgucccacacgggugugac

SEQ ID NO: 894895 - RNA, 22 nt, Mycobacterium avium subsp. paratuberculosis
accgucccggugucgccgucgc

SEQ ID NO: 894896 - RNA, 23 nt, Mycobacterium avium subsp. paratuberculosis
accguccgcagauagaucgacgc

SEQ ID NO: 894897 - RNA, 14 nt, Mycobacterium avium subsp. paratuberculosis
accgucuccggcgc

SEQ ID NO: 894898 - RNA, 16 nt, Mycobacterium avium subsp. paratuberculosis
accgucuccggcgcgg

SEQ ID NO: 894899 - RNA, 14 nt, Mycobacterium avium subsp. paratuberculosis
accgucugcgccgu

SEQ ID NO: 894900 - RNA, 15 nt, Mycobacterium avium subsp. paratuberculosis
accgucugcgccguc

SEQ ID NO: 894901 - RNA, 22 nt, Mycobacterium avium subsp. paratuberculosis
accgucugcgccgucaccggcu

SEQ ID NO: 894902 - RNA, 23 nt, Mycobacterium avium subsp. paratuberculosis
accgucugcgccgucaccggcug

SEQ ID NO: 894903 - RNA, 14 nt, Mycobacterium avium subsp. paratuberculosis
accgucggugucga

SEQ ID NO: 894904 - RNA, 21 nt, Mycobacterium avium subsp. paratuberculosis
accgucguacucgaccgcgac

SEQ ID NO: 894905 - RNA, 22 nt, Mycobacterium avium subsp. paratuberculosis
accgucguacucgaccgcgacu

SEQ ID NO: 894906 - RNA, 15 nt, Mycobacterium avium subsp. paratuberculosis
accgucguccacgcc

SEQ ID NO: 894907 - RNA, 19 nt, Mycobacterium avium subsp. paratuberculosis
accgucguccacgcccagc

SEQ ID NO: 894908 - RNA, 22 nt, Mycobacterium avium subsp. paratuberculosis
accgucguccacgcccagcgcc

SEQ ID NO: 894909 - RNA, 23 nt, Mycobacterium avium subsp. paratuberculosis
accgucgucccggugaugacggg

SEQ ID NO: 894910 - RNA, 16 nt, Mycobacterium avium subsp. paratuberculosis
accgucgggcguugcg

SEQ ID NO: 894911 - RNA, 17 nt, Mycobacterium avium subsp. paratuberculosis
accgugaucgccaccac

SEQ ID NO: 894912 - RNA, 13 nt, Mycobacterium avium subsp. paratuberculosis
accgugaggcccg

SEQ ID NO: 894913 - RNA, 15 nt, Mycobacterium avium subsp. paratuberculosis
accgugaggcccggc

SEQ ID NO: 894914 - RNA, 17 nt, Mycobacterium avium subsp. paratuberculosis
accgugaggcccggcgu

SEQ ID NO: 894915 - RNA, 18 nt, Mycobacterium avium subsp. paratuberculosis
accgugaggcccggcgug

SEQ ID NO: 894916 - RNA, 23 nt, Mycobacterium avium subsp. paratuberculosis
accgugaggcccggcgugggccg

SEQ ID NO: 894917 - RNA, 17 nt, Mycobacterium avium subsp. paratuberculosis
accgugaguucgcugac

SEQ ID NO: 894918 - RNA, 14 nt, Mycobacterium avium subsp. paratuberculosis
accgugacugggug

SEQ ID NO: 894919 - RNA, 21 nt, Mycobacterium avium subsp. paratuberculosis
accgugacugggugggacgga

SEQ ID NO: 894920 - RNA, 21 nt, Mycobacterium avium subsp. paratuberculosis
accgugaagcuaguuucacgc

SEQ ID NO: 894921 - RNA, 20 nt, Mycobacterium avium subsp. paratuberculosis
accgucuuggucucgccgau

SEQ ID NO: 894922 - RNA, 15 nt, Mycobacterium avium subsp. paratuberculosis
accgucuucggggcc

SEQ ID NO: 894923 - RNA, 18 nt, Mycobacterium avium subsp. paratuberculosis
accgucuucggggccgcc

SEQ ID NO: 894924 - RNA, 20 nt, Mycobacterium avium subsp. paratuberculosis
accgucuucggggccgccgu

SEQ ID NO: 894925 - RNA, 21 nt, Mycobacterium avium subsp. paratuberculosis
accgucuucggggccgccguc

SEQ ID NO: 894926 - RNA, 23 nt, Mycobacterium avium subsp. paratuberculosis
accgucuucggggccgccgucgg

SEQ ID NO: 894927 - RNA, 12 nt, Mycobacterium avium subsp. paratuberculosis
accggcuggucg

SEQ ID NO: 894928 - RNA, 20 nt, Mycobacterium avium subsp. paratuberculosis
accggcuggugcagcagcug

SEQ ID NO: 894929 - RNA, 22 nt, Mycobacterium avium subsp. paratuberculosis
accggcuucgggaucagcggga

SEQ ID NO: 894930 - RNA, 20 nt, Mycobacterium avium subsp. paratuberculosis
accggcuugccgaucgccgc

SEQ ID NO: 894931 - RNA, 22 nt, Mycobacterium avium subsp. paratuberculosis
accggcuugccgaucgccgcgg

SEQ ID NO: 894932 - RNA, 18 nt, Mycobacterium avium subsp. paratuberculosis
accggcguugcauuucgg

SEQ ID NO: 894933 - RNA, 22 nt, Mycobacterium avium subsp. paratuberculosis
accggcguggugggcagaugcc

SEQ ID NO: 894934 - RNA, 19 nt, Mycobacterium avium subsp. paratuberculosis
accggcgugaugacggcgg

SEQ ID NO: 894935 - RNA, 18 nt, Mycobacterium avium subsp. paratuberculosis
accggcggugccggccag

SEQ ID NO: 894936 - RNA, 15 nt, Mycobacterium avium subsp. paratuberculosis
accggcguacgacau

SEQ ID NO: 894937 - RNA, 22 nt, Mycobacterium avium subsp. paratuberculosis
accggcgucauggugcgcgggu

SEQ ID NO: 894938 - RNA, 13 nt, Mycobacterium avium subsp. paratuberculosis
accggcgucgaca

SEQ ID NO: 894939 - RNA, 15 nt, Mycobacterium avium subsp. paratuberculosis
accggcgucgacagc

SEQ ID NO: 894940 - RNA, 17 nt, Mycobacterium avium subsp. paratuberculosis
accggcgucgacagccg

SEQ ID NO: 894941 - RNA, 18 nt, Mycobacterium avium subsp. paratuberculosis
accggcgucgacagccgg

SEQ ID NO: 894942 - RNA, 22 nt, Mycobacterium avium subsp. paratuberculosis
accggcgucgacagccggucgc

SEQ ID NO: 894943 - RNA, 16 nt, Mycobacterium avium subsp. paratuberculosis
accggcggcggugagc

SEQ ID NO: 894944 - RNA, 22 nt, Mycobacterium avium subsp. paratuberculosis
accggcggcggugagcgcgucg

SEQ ID NO: 894945 - RNA, 23 nt, Mycobacterium avium subsp. paratuberculosis
accggcggcggugagcgcgucga

SEQ ID NO: 894946 - RNA, 22 nt, Mycobacterium avium subsp. paratuberculosis
accggcggcugggcagccgcgc

SEQ ID NO: 894947 - RNA, 23 nt, Mycobacterium avium subsp. paratuberculosis
accggcggcugggcagccgcgcg

SEQ ID NO: 894948 - RNA, 22 nt, Mycobacterium avium subsp. paratuberculosis
accggcgggaacucgaugcggc

SEQ ID NO: 894949 - RNA, 15 nt, Mycobacterium avium subsp. paratuberculosis
accggcgggcggcgg

SEQ ID NO: 894950 - RNA, 12 nt, Mycobacterium avium subsp. paratuberculosis
accggcggucac

SEQ ID NO: 894951 - RNA, 22 nt, Mycobacterium avium subsp. paratuberculosis
accggcgccgggcagcccgggu

SEQ ID NO: 894952 - RNA, 12 nt, Mycobacterium avium subsp. paratuberculosis
accggcgccggg

SEQ ID NO: 894953 - RNA, 11 nt, Mycobacterium avium subsp. paratuberculosis
accggcgccag

SEQ ID NO: 894954 - RNA, 19 nt, Mycobacterium avium subsp. paratuberculosis
accggcgccaggccggcga

SEQ ID NO: 894955 - RNA, 13 nt, Mycobacterium avium subsp. paratuberculosis
accggcgccaggu

SEQ ID NO: 894956 - RNA, 18 nt, Mycobacterium avium subsp. paratuberculosis
accggcgccccgggcagc

SEQ ID NO: 894957 - RNA, 20 nt, Mycobacterium avium subsp. paratuberculosis
accggcgccccgggcagcga

SEQ ID NO: 894958 - RNA, 21 nt, Mycobacterium avium subsp. paratuberculosis
accggccgagccgaugcccag

SEQ ID NO: 894959 - RNA, 22 nt, Mycobacterium avium subsp. paratuberculosis
accggccgagccgaugcccagc

SEQ ID NO: 894960 - RNA, 23 nt, Mycobacterium avium subsp. paratuberculosis
accggccgagccgaugcccagca

SEQ ID NO: 894961 - RNA, 17 nt, Mycobacterium avium subsp. paratuberculosis
accggccgauggcccag

SEQ ID NO: 894962 - RNA, 18 nt, Mycobacterium avium subsp. paratuberculosis
accggccgauggcccagg

SEQ ID NO: 894963 - RNA, 13 nt, Mycobacterium avium subsp. paratuberculosis
accggccggcccc

SEQ ID NO: 894964 - RNA, 17 nt, Mycobacterium avium subsp. paratuberculosis
accggccggccccgggg

SEQ ID NO: 894965 - RNA, 19 nt, Mycobacterium avium subsp. paratuberculosis
accggccggccccggggga

SEQ ID NO: 894966 - RNA, 14 nt, Mycobacterium avium subsp. paratuberculosis
accggccgcccggc

SEQ ID NO: 894967 - RNA, 17 nt, Mycobacterium avium subsp. paratuberculosis
accggccgcccggcgag

SEQ ID NO: 894968 - RNA, 12 nt, Mycobacterium avium subsp. paratuberculosis
accggccggcgc

SEQ ID NO: 894969 - RNA, 13 nt, Mycobacterium avium subsp. paratuberculosis
accggccggcgcg

SEQ ID NO: 894970 - RNA, 19 nt, Mycobacterium avium subsp. paratuberculosis
accggccggcgcgcacggc

SEQ ID NO: 894971 - RNA, 22 nt, Mycobacterium avium subsp. paratuberculosis
accggccggcgcgcacggcagc

SEQ ID NO: 894972 - RNA, 14 nt, Mycobacterium avium subsp. paratuberculosis
accggccggcgcgg

SEQ ID NO: 894973 - RNA, 15 nt, Mycobacterium avium subsp. paratuberculosis
accggccggcgcggc

SEQ ID NO: 894974 - RNA, 21 nt, Mycobacterium avium subsp. paratuberculosis
accggcgaugcagaucaccac

SEQ ID NO: 894975 - RNA, 17 nt, Mycobacterium avium subsp. paratuberculosis
accggcgaugccagcgc

SEQ ID NO: 894976 - RNA, 22 nt, Mycobacterium avium subsp. paratuberculosis
accggcgaugccagcgcaccgg

SEQ ID NO: 894977 - RNA, 14 nt, Mycobacterium avium subsp. paratuberculosis
accggcgauguggc

SEQ ID NO: 894978 - RNA, 17 nt, Mycobacterium avium subsp. paratuberculosis
accggcgauuucggccg

SEQ ID NO: 894979 - RNA, 20 nt, Mycobacterium avium subsp. paratuberculosis
accggcgauuucggccguga

SEQ ID NO: 894980 - RNA, 14 nt, Mycobacterium avium subsp. paratuberculosis
accggcgcagcgcg

SEQ ID NO: 894981 - RNA, 18 nt, Mycobacterium avium subsp. paratuberculosis
accggcgcagcgcgucgc

SEQ ID NO: 894982 - RNA, 20 nt, Mycobacterium avium subsp. paratuberculosis
accggcgcagcgcgucgcgc

SEQ ID NO: 894983 - RNA, 23 nt, Mycobacterium avium subsp. paratuberculosis
accggacgcagcgaucggcggcu

SEQ ID NO: 894984 - RNA, 19 nt, Mycobacterium avium subsp. paratuberculosis
accggacugcuugggcgcc

SEQ ID NO: 894985 - RNA, 15 nt, Mycobacterium avium subsp. paratuberculosis
accggagccuugguc

SEQ ID NO: 894986 - RNA, 18 nt, Mycobacterium avium subsp. paratuberculosis
accggagccuuggucgcg

SEQ ID NO: 894987 - RNA, 13 nt, Mycobacterium avium subsp. paratuberculosis
accggaggccgcg

SEQ ID NO: 894988 - RNA, 14 nt, Mycobacterium avium subsp. paratuberculosis
accggaggccgcgg

SEQ ID NO: 894989 - RNA, 15 nt, Mycobacterium avium subsp. paratuberculosis
accggcagcaccggc

SEQ ID NO: 894990 - RNA, 19 nt, Mycobacterium avium subsp. paratuberculosis
accggcagcaccggccgga

SEQ ID NO: 894991 - RNA, 12 nt, Mycobacterium avium subsp. paratuberculosis
accggcagcagc

SEQ ID NO: 894992 - RNA, 14 nt, Mycobacterium avium subsp. paratuberculosis
accggcagcagcgc

SEQ ID NO: 894993 - RNA, 15 nt, Mycobacterium avium subsp. paratuberculosis
accggcagcagcgcg

SEQ ID NO: 894994 - RNA, 17 nt, Mycobacterium avium subsp. paratuberculosis
accggcagcagcgcguc

SEQ ID NO: 894995 - RNA, 20 nt, Mycobacterium avium subsp. paratuberculosis
accggcagcagcgcgucgug

SEQ ID NO: 894996 - RNA, 15 nt, Mycobacterium avium subsp. paratuberculosis
accggcagccgcagc

SEQ ID NO: 894997 - RNA, 18 nt, Mycobacterium avium subsp. paratuberculosis
accggcagccgcagcgac

SEQ ID NO: 894998 - RNA, 18 nt, Mycobacterium avium subsp. paratuberculosis
accggcagccgcgcccac

SEQ ID NO: 894999 - RNA, 22 nt, Mycobacterium avium subsp. paratuberculosis
accggcagccgcgcccacccgc

SEQ ID NO: 895000 - RNA, 15 nt, Mycobacterium avium subsp. paratuberculosis
accggcagccggcgu

SEQ ID NO: 895001 - RNA, 16 nt, Mycobacterium avium subsp. paratuberculosis
accggcagccggcgua

SEQ ID NO: 895002 - RNA, 15 nt, Mycobacterium avium subsp. paratuberculosis
accggcacgucggcc

SEQ ID NO: 895003 - RNA, 16 nt, Mycobacterium avium subsp. paratuberculosis
accggcacgucggcca

SEQ ID NO: 895004 - RNA, 20 nt, Mycobacterium avium subsp. paratuberculosis
accggcacgucggccacgcc

SEQ ID NO: 895005 - RNA, 18 nt, Mycobacterium avium subsp. paratuberculosis
accggcagcaaccgcgaa

SEQ ID NO: 895006 - RNA, 15 nt, Mycobacterium avium subsp. paratuberculosis
accggcagcaccgcc

SEQ ID NO: 895007 - RNA, 16 nt, Mycobacterium avium subsp. paratuberculosis
accggcaggcgguagc

SEQ ID NO: 895008 - RNA, 18 nt, Mycobacterium avium subsp. paratuberculosis
accggcauucguguggcg

SEQ ID NO: 895009 - RNA, 20 nt, Mycobacterium avium subsp. paratuberculosis
accggcauucguguggcgca

SEQ ID NO: 895010 - RNA, 21 nt, Mycobacterium avium subsp. paratuberculosis
accggcauucguguggcgcac

SEQ ID NO: 895011 - RNA, 18 nt, Mycobacterium avium subsp. paratuberculosis
accggccaccucgucggc

SEQ ID NO: 895012 - RNA, 17 nt, Mycobacterium avium subsp. paratuberculosis
accggccagcagcagcc

SEQ ID NO: 895013 - RNA, 21 nt, Mycobacterium avium subsp. paratuberculosis
accggccagcagcagcccgcc

SEQ ID NO: 895014 - RNA, 17 nt, Mycobacterium avium subsp. paratuberculosis
accggccagggccgccg

SEQ ID NO: 895015 - RNA, 15 nt, Mycobacterium avium subsp. paratuberculosis
accggcccagcagcg

SEQ ID NO: 895016 - RNA, 21 nt, Mycobacterium avium subsp. paratuberculosis
accggcccagcagcgucacgu

SEQ ID NO: 895017 - RNA, 13 nt, Mycobacterium avium subsp. paratuberculosis
accggcccagccg

SEQ ID NO: 895018 - RNA, 18 nt, Mycobacterium avium subsp. paratuberculosis
accggcccagccggcggu

SEQ ID NO: 895019 - RNA, 19 nt, Mycobacterium avium subsp. paratuberculosis
accggcccagccggcggug

SEQ ID NO: 895020 - RNA, 17 nt, Mycobacterium avium subsp. paratuberculosis
accggcccagcgcggug

SEQ ID NO: 895021 - RNA, 13 nt, Mycobacterium avium subsp. paratuberculosis
accggcccggccg

SEQ ID NO: 895022 - RNA, 15 nt, Mycobacterium avium subsp. paratuberculosis
accggcccggccggc

SEQ ID NO: 895023 - RNA, 20 nt, Mycobacterium avium subsp. paratuberculosis
accggcccggccggcgcgac

SEQ ID NO: 895024 - RNA, 17 nt, Mycobacterium avium subsp. paratuberculosis
accggcccggcggccgg

SEQ ID NO: 895025 - RNA, 14 nt, Mycobacterium avium subsp. paratuberculosis
accggcccggcggg

SEQ ID NO: 895026 - RNA, 18 nt, Mycobacterium avium subsp. paratuberculosis
accgcugcuccggguccg

SEQ ID NO: 895027 - RNA, 14 nt, Mycobacterium avium subsp. paratuberculosis
accgcugcugcucg

SEQ ID NO: 895028 - RNA, 20 nt, Mycobacterium avium subsp. paratuberculosis
accgcugcugcucggccgca

SEQ ID NO: 895029 - RNA, 22 nt, Mycobacterium avium subsp. paratuberculosis
accgcugcugcucggccgcauc

SEQ ID NO: 895030 - RNA, 15 nt, Mycobacterium avium subsp. paratuberculosis
accgcugcugcugcc

SEQ ID NO: 895031 - RNA, 17 nt, Mycobacterium avium subsp. paratuberculosis
accgcugcugcugcccg

SEQ ID NO: 895032 - RNA, 14 nt, Mycobacterium avium subsp. paratuberculosis
accgcugggcggcg

SEQ ID NO: 895033 - RNA, 18 nt, Mycobacterium avium subsp. paratuberculosis
accgcugggcggcgcggc

SEQ ID NO: 895034 - RNA, 19 nt, Mycobacterium avium subsp. paratuberculosis
accgcugggcggcgcggcg

SEQ ID NO: 895035 - RNA, 22 nt, Mycobacterium avium subsp. paratuberculosis
accgcugucggugugagcggug

SEQ ID NO: 895036 - RNA, 18 nt, Mycobacterium avium subsp. paratuberculosis
accggaccgccgcggcgc

SEQ ID NO: 895037 - RNA, 19 nt, Mycobacterium avium subsp. paratuberculosis
accggaccgccgcggcgcc

SEQ ID NO: 895038 - RNA, 22 nt, Mycobacterium avium subsp. paratuberculosis
accggaccgccgcggcgcccgg

SEQ ID NO: 895039 - RNA, 14 nt, Mycobacterium avium subsp. paratuberculosis
accggaccggccag

SEQ ID NO: 895040 - RNA, 13 nt, Mycobacterium avium subsp. paratuberculosis
accggacgaacau

SEQ ID NO: 895041 - RNA, 21 nt, Mycobacterium avium subsp. paratuberculosis
accggaaggccagguugccac

SEQ ID NO: 895042 - RNA, 21 nt, Mycobacterium avium subsp. paratuberculosis
accggaauugaagcccugcuc

SEQ ID NO: 895043 - RNA, 17 nt, Mycobacterium avium subsp. paratuberculosis
accggaauggcagcagc

SEQ ID NO: 895044 - RNA, 20 nt, Mycobacterium avium subsp. paratuberculosis
accggaauggcagcagccgg

SEQ ID NO: 895045 - RNA, 13 nt, Mycobacterium avium subsp. paratuberculosis
accgcguccacga

SEQ ID NO: 895046 - RNA, 21 nt, Mycobacterium avium subsp. paratuberculosis
accgcguacagggcgucggac

SEQ ID NO: 895047 - RNA, 16 nt, Mycobacterium avium subsp. paratuberculosis
accgcgucagcagcgc

SEQ ID NO: 895048 - RNA, 19 nt, Mycobacterium avium subsp. paratuberculosis
accgcgucagcagcgcgac

SEQ ID NO: 895049 - RNA, 21 nt, Mycobacterium avium subsp. paratuberculosis
accgcgucagcagcgcgacgc

SEQ ID NO: 895050 - RNA, 15 nt, Mycobacterium avium subsp. paratuberculosis
accgcguagcgccgc

SEQ ID NO: 895051 - RNA, 20 nt, Mycobacterium avium subsp. paratuberculosis
accgcguagcgccgcccguc

SEQ ID NO: 895052 - RNA, 23 nt, Mycobacterium avium subsp. paratuberculosis
accgcguagcgccgcccguccag

SEQ ID NO: 895053 - RNA, 20 nt, Mycobacterium avium subsp. paratuberculosis
accgcggugaccgcccgcuc

SEQ ID NO: 895054 - RNA, 17 nt, Mycobacterium avium subsp. paratuberculosis
accgcggugagcggccg

SEQ ID NO: 895055 - RNA, 18 nt, Mycobacterium avium subsp. paratuberculosis
accgcggugagcggccgc

SEQ ID NO: 895056 - RNA, 19 nt, Mycobacterium avium subsp. paratuberculosis
accgcggugagcggccgca

SEQ ID NO: 895057 - RNA, 21 nt, Mycobacterium avium subsp. paratuberculosis
accgcggugagcggccgcagc

SEQ ID NO: 895058 - RNA, 24 nt, Mycobacterium avium subsp. paratuberculosis
accgcggugagcggccgcagcgca

SEQ ID NO: 895059 - RNA, 18 nt, Mycobacterium avium subsp. paratuberculosis
accgcggucgggucccgg

SEQ ID NO: 895060 - RNA, 17 nt, Mycobacterium avium subsp. paratuberculosis
accgcggucugcgccag

SEQ ID NO: 895061 - RNA, 19 nt, Mycobacterium avium subsp. paratuberculosis
accgcggucugcgccagcu

SEQ ID NO: 895062 - RNA, 20 nt, Mycobacterium avium subsp. paratuberculosis
accgcggucugcgccagcuc

SEQ ID NO: 895063 - RNA, 21 nt, Mycobacterium avium subsp. paratuberculosis
accgcgggcgcauaccagcgc

SEQ ID NO: 895064 - RNA, 18 nt, Mycobacterium avium subsp. paratuberculosis
accgcguccgaggcgguu

SEQ ID NO: 895065 - RNA, 15 nt, Mycobacterium avium subsp. paratuberculosis
accgcguccgcgguu

SEQ ID NO: 895066 - RNA, 22 nt, Mycobacterium avium subsp. paratuberculosis
accgcguccgcgucgucgaggc

SEQ ID NO: 895067 - RNA, 21 nt, Mycobacterium avium subsp. paratuberculosis
accgcguccugcaggcaggcc

SEQ ID NO: 895068 - RNA, 23 nt, Mycobacterium avium subsp. paratuberculosis
accgcguccugcaggcaggccgg

SEQ ID NO: 895069 - RNA, 23 nt, Mycobacterium avium subsp. paratuberculosis
accgcguccuucuccgccgggcu

SEQ ID NO: 895070 - RNA, 12 nt, Mycobacterium avium subsp. paratuberculosis
accgcgucgacc

SEQ ID NO: 895071 - RNA, 21 nt, Mycobacterium avium subsp. paratuberculosis
accgcgucgaccaccgccggc

SEQ ID NO: 895072 - RNA, 20 nt, Mycobacterium avium subsp. paratuberculosis
accgcgucgaugcgggcccg

SEQ ID NO: 895073 - RNA, 19 nt, Mycobacterium avium subsp. paratuberculosis
accgcgucgcagugccggu

SEQ ID NO: 895074 - RNA, 16 nt, Mycobacterium avium subsp. paratuberculosis
accgcgucggcgccgu

SEQ ID NO: 895075 - RNA, 17 nt, Mycobacterium avium subsp. paratuberculosis
accgcgucggcgccgua

SEQ ID NO: 895076 - RNA, 17 nt, Mycobacterium avium subsp. paratuberculosis
accgcgucggcgcuggc

SEQ ID NO: 895077 - RNA, 20 nt, Mycobacterium avium subsp. paratuberculosis
accgcgucggcgcuggccag

SEQ ID NO: 895078 - RNA, 19 nt, Mycobacterium avium subsp. paratuberculosis
accgcgucuuggacgcccg

SEQ ID NO: 895079 - RNA, 14 nt, Mycobacterium avium subsp. paratuberculosis
accgcugcggcaca

SEQ ID NO: 895080 - RNA, 15 nt, Mycobacterium avium subsp. paratuberculosis
accgcgggcagcagc

SEQ ID NO: 895081 - RNA, 14 nt, Mycobacterium avium subsp. paratuberculosis
accgcgggccaggc

SEQ ID NO: 895082 - RNA, 15 nt, Mycobacterium avium subsp. paratuberculosis
accgcgggccaggcc

SEQ ID NO: 895083 - RNA, 16 nt, Mycobacterium avium subsp. paratuberculosis
accgcgggccaggccc

SEQ ID NO: 895084 - RNA, 17 nt, Mycobacterium avium subsp. paratuberculosis
accgcgggccaggccca

SEQ ID NO: 895085 - RNA, 14 nt, Mycobacterium avium subsp. paratuberculosis
accgcgggcccgcc

SEQ ID NO: 895086 - RNA, 15 nt, Mycobacterium avium subsp. paratuberculosis
accgcgggcccgccg

SEQ ID NO: 895087 - RNA, 22 nt, Mycobacterium avium subsp. paratuberculosis
accgcgggcccgccguagcgcc

SEQ ID NO: 895088 - RNA, 14 nt, Mycobacterium avium subsp. paratuberculosis
accgcgggcgcgcc

SEQ ID NO: 895089 - RNA, 15 nt, Mycobacterium avium subsp. paratuberculosis
accgcgggcgcgccg

SEQ ID NO: 895090 - RNA, 19 nt, Mycobacterium avium subsp. paratuberculosis
accgcgggaauggccgcgc

SEQ ID NO: 895091 - RNA, 11 nt, Mycobacterium avium subsp. paratuberculosis
accgcggucac

SEQ ID NO: 895092 - RNA, 20 nt, Mycobacterium avium subsp. paratuberculosis
accgcggucgcggcgccggu

SEQ ID NO: 895093 - RNA, 21 nt, Mycobacterium avium subsp. paratuberculosis
accgcggucgcggcgccgguu

SEQ ID NO: 895094 - RNA, 18 nt, Mycobacterium avium subsp. paratuberculosis
accgcgggggcggccggg

SEQ ID NO: 895095 - RNA, 22 nt, Mycobacterium avium subsp. paratuberculosis
accgcgggggcggccgggccgc

SEQ ID NO: 895096 - RNA, 17 nt, Mycobacterium avium subsp. paratuberculosis
accgcggggugcccggc

SEQ ID NO: 895097 - RNA, 22 nt, Mycobacterium avium subsp. paratuberculosis
accgcgggugaggggcgcgcgc

SEQ ID NO: 895098 - RNA, 23 nt, Mycobacterium avium subsp. paratuberculosis
accgcgggugaggggcgcgcgcc

SEQ ID NO: 895099 - RNA, 19 nt, Mycobacterium avium subsp. paratuberculosis
accgcggcgggguccacgc

SEQ ID NO: 895100 - RNA, 23 nt, Mycobacterium avium subsp. paratuberculosis
accgcggcggugucggcgccccg

SEQ ID NO: 895101 - RNA, 16 nt, Mycobacterium avium subsp. paratuberculosis
accgcggcguagcgcc

SEQ ID NO: 895102 - RNA, 18 nt, Mycobacterium avium subsp. paratuberculosis
accgcggcguagcgccag

SEQ ID NO: 895103 - RNA, 17 nt, Mycobacterium avium subsp. paratuberculosis
accgcggcgugcgccag

SEQ ID NO: 895104 - RNA, 14 nt, Mycobacterium avium subsp. paratuberculosis
accgcggcuccggc

SEQ ID NO: 895105 - RNA, 23 nt, Mycobacterium avium subsp. paratuberculosis
accgcggcuccggccgcgccggc

SEQ ID NO: 895106 - RNA, 12 nt, Mycobacterium avium subsp. paratuberculosis
accgcggcgggc

SEQ ID NO: 895107 - RNA, 16 nt, Mycobacterium avium subsp. paratuberculosis
accgcggcggcgucga

SEQ ID NO: 895108 - RNA, 17 nt, Mycobacterium avium subsp. paratuberculosis
accgcggcggcgucgac

SEQ ID NO: 895109 - RNA, 18 nt, Mycobacterium avium subsp. paratuberculosis
accgcggcggcgucgacc

SEQ ID NO: 895110 - RNA, 12 nt, Mycobacterium avium subsp. paratuberculosis
accgcggcggcc

SEQ ID NO: 895111 - RNA, 14 nt, Mycobacterium avium subsp. paratuberculosis
accgcggcggccag

SEQ ID NO: 895112 - RNA, 16 nt, Mycobacterium avium subsp. paratuberculosis
accgcggccucggcgu

SEQ ID NO: 895113 - RNA, 19 nt, Mycobacterium avium subsp. paratuberculosis
accgcggccucgucgaggu

SEQ ID NO: 895114 - RNA, 20 nt, Mycobacterium avium subsp. paratuberculosis
accgcggcgacgucgugcac

SEQ ID NO: 895115 - RNA, 14 nt, Mycobacterium avium subsp. paratuberculosis
accgcggcgaucgc

SEQ ID NO: 895116 - RNA, 24 nt, Mycobacterium avium subsp. paratuberculosis
accgcggcgaugauccgcggcgcc

SEQ ID NO: 895117 - RNA, 20 nt, Mycobacterium avium subsp. paratuberculosis
accgcggcgauggcccgcug

SEQ ID NO: 895118 - RNA, 23 nt, Mycobacterium avium subsp. paratuberculosis
accgcggcgauggcccgcugcgc

SEQ ID NO: 895119 - RNA, 12 nt, Mycobacterium avium subsp. paratuberculosis
accgcggcgccg

SEQ ID NO: 895120 - RNA, 13 nt, Mycobacterium avium subsp. paratuberculosis
accgcggcgccga

SEQ ID NO: 895121 - RNA, 14 nt, Mycobacterium avium subsp. paratuberculosis
accgcggcgccgau

SEQ ID NO: 895122 - RNA, 15 nt, Mycobacterium avium subsp. paratuberculosis
accgcggcgccgucg

SEQ ID NO: 895123 - RNA, 13 nt, Mycobacterium avium subsp. paratuberculosis
accgcggcgcgca

SEQ ID NO: 895124 - RNA, 19 nt, Mycobacterium avium subsp. paratuberculosis
accgcggcgcgcaucgccg

SEQ ID NO: 895125 - RNA, 21 nt, Mycobacterium avium subsp. paratuberculosis
accgcggcgcgcaucgccguc

SEQ ID NO: 895126 - RNA, 23 nt, Mycobacterium avium subsp. paratuberculosis
accgcggcgcgcaucgccgucca

SEQ ID NO: 895127 - RNA, 13 nt, Mycobacterium avium subsp. paratuberculosis
accgcggcgcgcg

SEQ ID NO: 895128 - RNA, 15 nt, Mycobacterium avium subsp. paratuberculosis
accgcggcgcgcggc

SEQ ID NO: 895129 - RNA, 17 nt, Mycobacterium avium subsp. paratuberculosis
accgcggcgcgcggccg

SEQ ID NO: 895130 - RNA, 18 nt, Mycobacterium avium subsp. paratuberculosis
accgcggcgcgcggccgc

SEQ ID NO: 895131 - RNA, 20 nt, Mycobacterium avium subsp. paratuberculosis
accgcggcgcgcggccgcga

SEQ ID NO: 895132 - RNA, 23 nt, Mycobacterium avium subsp. paratuberculosis
accgcggcgcgcggccgcgacug

SEQ ID NO: 895133 - RNA, 20 nt, Mycobacterium avium subsp. paratuberculosis
accgccgggcauccgggccg

SEQ ID NO: 895134 - RNA, 16 nt, Mycobacterium avium subsp. paratuberculosis
accgccggugcgcagc

SEQ ID NO: 895135 - RNA, 17 nt, Mycobacterium avium subsp. paratuberculosis
accgccggugcgcagcu

SEQ ID NO: 895136 - RNA, 15 nt, Mycobacterium avium subsp. paratuberculosis
accgccgggcgggcc

SEQ ID NO: 895137 - RNA, 17 nt, Mycobacterium avium subsp. paratuberculosis
accgccgucccguccga

SEQ ID NO: 895138 - RNA, 21 nt, Mycobacterium avium subsp. paratuberculosis
accgccguccgggcacccgac

SEQ ID NO: 895139 - RNA, 23 nt, Mycobacterium avium subsp. paratuberculosis
accgccguccgggcacccgacgu

SEQ ID NO: 895140 - RNA, 15 nt, Mycobacterium avium subsp. paratuberculosis
accgcggaccaccgc

SEQ ID NO: 895141 - RNA, 18 nt, Mycobacterium avium subsp. paratuberculosis
accgcggaccaccgcgug

SEQ ID NO: 895142 - RNA, 18 nt, Mycobacterium avium subsp. paratuberculosis
accgcggccaacccgggc

SEQ ID NO: 895143 - RNA, 21 nt, Mycobacterium avium subsp. paratuberculosis
accgcggccaacccgggcgcc

SEQ ID NO: 895144 - RNA, 23 nt, Mycobacterium avium subsp. paratuberculosis
accgcggccaccugggcggggcu

SEQ ID NO: 895145 - RNA, 12 nt, Mycobacterium avium subsp. paratuberculosis
accgcggccagc

SEQ ID NO: 895146 - RNA, 17 nt, Mycobacterium avium subsp. paratuberculosis
accgcggccagcgcgcg

SEQ ID NO: 895147 - RNA, 23 nt, Mycobacterium avium subsp. paratuberculosis
accgcggccagcgcgcgggcguc

SEQ ID NO: 895148 - RNA, 17 nt, Mycobacterium avium subsp. paratuberculosis
accgcggccagcugcga

SEQ ID NO: 895149 - RNA, 21 nt, Mycobacterium avium subsp. paratuberculosis
accgcggacuggccaccgcga

SEQ ID NO: 895150 - RNA, 18 nt, Mycobacterium avium subsp. paratuberculosis
accgcggagcgcaacgug

SEQ ID NO: 895151 - RNA, 23 nt, Mycobacterium avium subsp. paratuberculosis
accgcggaggaauucgccgacgc

SEQ ID NO: 895152 - RNA, 17 nt, Mycobacterium avium subsp. paratuberculosis
accgccgucaccgccag

SEQ ID NO: 895153 - RNA, 14 nt, Mycobacterium avium subsp. paratuberculosis
accgcggaugacgg

SEQ ID NO: 895154 - RNA, 17 nt, Mycobacterium avium subsp. paratuberculosis
accgcggauuccagcgc

SEQ ID NO: 895155 - RNA, 19 nt, Mycobacterium avium subsp. paratuberculosis
accgcggauuccagcgcgu

SEQ ID NO: 895156 - RNA, 20 nt, Mycobacterium avium subsp. paratuberculosis
accgcggauuccagcgcgua

SEQ ID NO: 895157 - RNA, 14 nt, Mycobacterium avium subsp. paratuberculosis
aucuccaucccgcu

SEQ ID NO: 895158 - RNA, 15 nt, Mycobacterium avium subsp. paratuberculosis
aucuccaucccgcug

SEQ ID NO: 895159 - RNA, 17 nt, Mycobacterium avium subsp. paratuberculosis
aucuccaggcucgacaa

SEQ ID NO: 895160 - RNA, 19 nt, Mycobacterium avium subsp. paratuberculosis
aucuccgccuucgacgaug

SEQ ID NO: 895161 - RNA, 19 nt, Mycobacterium avium subsp. paratuberculosis
aucuccgggaacgcggcga

SEQ ID NO: 895162 - RNA, 19 nt, Mycobacterium avium subsp. paratuberculosis
aucuccggcacguugacgu

SEQ ID NO: 895163 - RNA, 12 nt, Mycobacterium avium subsp. paratuberculosis
aucuccggccgg

SEQ ID NO: 895164 - RNA, 20 nt, Mycobacterium avium subsp. paratuberculosis
aucucccaacgcagcgcauc

SEQ ID NO: 895165 - RNA, 23 nt, Mycobacterium avium subsp. paratuberculosis
aucucgaaugcggcugccggcca

SEQ ID NO: 895166 - RNA, 16 nt, Mycobacterium avium subsp. paratuberculosis
aucucgaccagcgccg

SEQ ID NO: 895167 - RNA, 13 nt, Mycobacterium avium subsp. paratuberculosis
aucuccucggcgu

SEQ ID NO: 895168 - RNA, 21 nt, Mycobacterium avium subsp. paratuberculosis
aucucgaccucgucggcggcg

SEQ ID NO: 895169 - RNA, 22 nt, Mycobacterium avium subsp. paratuberculosis
aucucgaccucgucggcggcga

SEQ ID NO: 895170 - RNA, 19 nt, Mycobacterium avium subsp. paratuberculosis
aucucgaccagcgccgaga

SEQ ID NO: 895171 - RNA, 16 nt, Mycobacterium avium subsp. paratuberculosis
aucucgagcauccggu

SEQ ID NO: 895172 - RNA, 13 nt, Mycobacterium avium subsp. paratuberculosis
aucucgccgcggu

SEQ ID NO: 895173 - RNA, 14 nt, Mycobacterium avium subsp. paratuberculosis
aucgugaugcgggu

SEQ ID NO: 895174 - RNA, 15 nt, Mycobacterium avium subsp. paratuberculosis
aucguugccggcggc

SEQ ID NO: 895175 - RNA, 21 nt, Mycobacterium avium subsp. paratuberculosis
aucgugcgcccauccggcgcc

SEQ ID NO: 895176 - RNA, 22 nt, Mycobacterium avium subsp. paratuberculosis
aucgugcgcccauccggcgccg

SEQ ID NO: 895177 - RNA, 19 nt, Mycobacterium avium subsp. paratuberculosis
aucgucucggccagccggu

SEQ ID NO: 895178 - RNA, 17 nt, Mycobacterium avium subsp. paratuberculosis
aucgucucggccgcggu

SEQ ID NO: 895179 - RNA, 21 nt, Mycobacterium avium subsp. paratuberculosis
aucggcucgccucaacgguug

SEQ ID NO: 895180 - RNA, 14 nt, Mycobacterium avium subsp. paratuberculosis
aucggcgcgccgaa

SEQ ID NO: 895181 - RNA, 17 nt, Mycobacterium avium subsp. paratuberculosis
aucggcggcucgccggc

SEQ ID NO: 895182 - RNA, 17 nt, Mycobacterium avium subsp. paratuberculosis
aucggcgggacccgcga

SEQ ID NO: 895183 - RNA, 16 nt, Mycobacterium avium subsp. paratuberculosis
aucggcgggcgccgaa

SEQ ID NO: 895184 - RNA, 21 nt, Mycobacterium avium subsp. paratuberculosis
aucggcggucccgugcgccgc

SEQ ID NO: 895185 - RNA, 16 nt, Mycobacterium avium subsp. paratuberculosis
aucggcgguccgccgc

SEQ ID NO: 895186 - RNA, 13 nt, Mycobacterium avium subsp. paratuberculosis
aucggcggccugc

SEQ ID NO: 895187 - RNA, 19 nt, Mycobacterium avium subsp. paratuberculosis
aucggcggccugcggcggc

SEQ ID NO: 895188 - RNA, 13 nt, Mycobacterium avium subsp. paratuberculosis
aucggcggcgggg

SEQ ID NO: 895189 - RNA, 15 nt, Mycobacterium avium subsp. paratuberculosis
aucggcggcggggug

SEQ ID NO: 895190 - RNA, 17 nt, Mycobacterium avium subsp. paratuberculosis
aucggcguuggcggcgu

SEQ ID NO: 895191 - RNA, 20 nt, Mycobacterium avium subsp. paratuberculosis
aucggcguuggcggcgucga

SEQ ID NO: 895192 - RNA, 22 nt, Mycobacterium avium subsp. paratuberculosis
aucggcguuggcggcgucgagu

SEQ ID NO: 895193 - RNA, 16 nt, Mycobacterium avium subsp. paratuberculosis
aucuguucggcggcga

SEQ ID NO: 895194 - RNA, 23 nt, Mycobacterium avium subsp. paratuberculosis
aucuucacgaagugcccggcgcc

SEQ ID NO: 895195 - RNA, 18 nt, Mycobacterium avium subsp. paratuberculosis
aucuucacgugcgcggcg

SEQ ID NO: 895196 - RNA, 20 nt, Mycobacterium avium subsp. paratuberculosis
aucuucacgugcgcggcguc

SEQ ID NO: 895197 - RNA, 21 nt, Mycobacterium avium subsp. paratuberculosis
aucuucgagacacgcgccggc

SEQ ID NO: 895198 - RNA, 20 nt, Mycobacterium avium subsp. paratuberculosis
aucuuccauauuggcuagcg

SEQ ID NO: 895199 - RNA, 14 nt, Mycobacterium avium subsp. paratuberculosis
aucuucuccccgcc

SEQ ID NO: 895200 - RNA, 15 nt, Mycobacterium avium subsp. paratuberculosis
aucuucuccgcggcc

SEQ ID NO: 895201 - RNA, 17 nt, Mycobacterium avium subsp. paratuberculosis
aucuucuccgcggccgc

SEQ ID NO: 895202 - RNA, 22 nt, Mycobacterium avium subsp. paratuberculosis
aucuugaucugggugccgcggu

SEQ ID NO: 895203 - RNA, 13 nt, Mycobacterium avium subsp. paratuberculosis
aucuugacggcga

SEQ ID NO: 895204 - RNA, 15 nt, Mycobacterium avium subsp. paratuberculosis
aucuugacggcgacg

SEQ ID NO: 895205 - RNA, 16 nt, Mycobacterium avium subsp. paratuberculosis
aucuugacggcgacgg

SEQ ID NO: 895206 - RNA, 11 nt, Mycobacterium avium subsp. paratuberculosis
aucuugaccgu

SEQ ID NO: 895207 - RNA, 18 nt, Mycobacterium avium subsp. paratuberculosis
aucuugugccagccgaag

SEQ ID NO: 895208 - RNA, 17 nt, Mycobacterium avium subsp. paratuberculosis
aucuugccgucggccgc

SEQ ID NO: 895209 - RNA, 22 nt, Mycobacterium avium subsp. paratuberculosis
aucugguuccacagcugcaggc

SEQ ID NO: 895210 - RNA, 13 nt, Mycobacterium avium subsp. paratuberculosis
aucuggucggcca

SEQ ID NO: 895211 - RNA, 13 nt, Mycobacterium avium subsp. paratuberculosis
aucugggcggcgg

SEQ ID NO: 895212 - RNA, 21 nt, Mycobacterium avium subsp. paratuberculosis
aucugggugagcgacaccagg

SEQ ID NO: 895213 - RNA, 23 nt, Mycobacterium avium subsp. paratuberculosis
aucuggguuugggucaucgacuc

SEQ ID NO: 895214 - RNA, 20 nt, Mycobacterium avium subsp. paratuberculosis
aucugcuuggucaccugacg

SEQ ID NO: 895215 - RNA, 23 nt, Mycobacterium avium subsp. paratuberculosis
aucugcggaccaucuacgaccuc

SEQ ID NO: 895216 - RNA, 18 nt, Mycobacterium avium subsp. paratuberculosis
aucugcucgaugcggccc

SEQ ID NO: 895217 - RNA, 19 nt, Mycobacterium avium subsp. paratuberculosis
aucugcucgaugcggcccu

SEQ ID NO: 895218 - RNA, 19 nt, Mycobacterium avium subsp. paratuberculosis
aucugcucggugucgaucg

SEQ ID NO: 895219 - RNA, 22 nt, Mycobacterium avium subsp. paratuberculosis
aucucggcggucugucgcgcga

SEQ ID NO: 895220 - RNA, 13 nt, Mycobacterium avium subsp. paratuberculosis
aucucgccgagca

SEQ ID NO: 895221 - RNA, 13 nt, Mycobacterium avium subsp. paratuberculosis
aucucgccgagcg

SEQ ID NO: 895222 - RNA, 14 nt, Mycobacterium avium subsp. paratuberculosis
aucucggccaccgu

SEQ ID NO: 895223 - RNA, 15 nt, Mycobacterium avium subsp. paratuberculosis
aucucggucgccagc

SEQ ID NO: 895224 - RNA, 16 nt, Mycobacterium avium subsp. paratuberculosis
aucucggucgccagca

SEQ ID NO: 895225 - RNA, 13 nt, Mycobacterium avium subsp. paratuberculosis
aucucggugccgg

SEQ ID NO: 895226 - RNA, 14 nt, Mycobacterium avium subsp. paratuberculosis
aucucggugccggu

SEQ ID NO: 895227 - RNA, 14 nt, Mycobacterium avium subsp. paratuberculosis
aucucggugccguc

SEQ ID NO: 895228 - RNA, 15 nt, Mycobacterium avium subsp. paratuberculosis
augcagcgccucggu

SEQ ID NO: 895229 - RNA, 22 nt, Mycobacterium avium subsp. paratuberculosis
augcagccgccgcggagcggcg

SEQ ID NO: 895230 - RNA, 23 nt, Mycobacterium avium subsp. paratuberculosis
augcagccgccgcggagcggcgg

SEQ ID NO: 895231 - RNA, 15 nt, Mycobacterium avium subsp. paratuberculosis
augaugucggccggc

SEQ ID NO: 895232 - RNA, 15 nt, Mycobacterium avium subsp. paratuberculosis
augaugucggcggcc

SEQ ID NO: 895233 - RNA, 12 nt, Mycobacterium avium subsp. paratuberculosis
augaucggcagg

SEQ ID NO: 895234 - RNA, 15 nt, Mycobacterium avium subsp. paratuberculosis
augaugggcgaucga

SEQ ID NO: 895235 - RNA, 18 nt, Mycobacterium avium subsp. paratuberculosis
augauguucuccggcccg

SEQ ID NO: 895236 - RNA, 17 nt, Mycobacterium avium subsp. paratuberculosis
augcagaucaccacggu

SEQ ID NO: 895237 - RNA, 15 nt, Mycobacterium avium subsp. paratuberculosis
augcagaccagcccg

SEQ ID NO: 895238 - RNA, 18 nt, Mycobacterium avium subsp. paratuberculosis
augcagcagguugcggug

SEQ ID NO: 895239 - RNA, 14 nt, Mycobacterium avium subsp. paratuberculosis
augaucacaccgcu

SEQ ID NO: 895240 - RNA, 20 nt, Mycobacterium avium subsp. paratuberculosis
augaucaccgccagcgcgcc

SEQ ID NO: 895241 - RNA, 14 nt, Mycobacterium avium subsp. paratuberculosis
augaucagcgcgcc

SEQ ID NO: 895242 - RNA, 16 nt, Mycobacterium avium subsp. paratuberculosis
augaucaggccccacc

SEQ ID NO: 895243 - RNA, 15 nt, Mycobacterium avium subsp. paratuberculosis
augauccgcggcgcc

SEQ ID NO: 895244 - RNA, 19 nt, Mycobacterium avium subsp. paratuberculosis
augaggucgcgaccgccgg

SEQ ID NO: 895245 - RNA, 14 nt, Mycobacterium avium subsp. paratuberculosis
augacgccgcgguu

SEQ ID NO: 895246 - RNA, 17 nt, Mycobacterium avium subsp. paratuberculosis
augacgccgcgguuggu

SEQ ID NO: 895247 - RNA, 19 nt, Mycobacterium avium subsp. paratuberculosis
augacgccggacagcuggc

SEQ ID NO: 895248 - RNA, 18 nt, Mycobacterium avium subsp. paratuberculosis
augacgcccagcugcaug

SEQ ID NO: 895249 - RNA, 13 nt, Mycobacterium avium subsp. paratuberculosis
augaagugcgcca

SEQ ID NO: 895250 - RNA, 22 nt, Mycobacterium avium subsp. paratuberculosis
augaagaauuccaugucgucga

SEQ ID NO: 895251 - RNA, 13 nt, Mycobacterium avium subsp. paratuberculosis
augaccacccucg

SEQ ID NO: 895252 - RNA, 13 nt, Mycobacterium avium subsp. paratuberculosis
augaccagcgcga

SEQ ID NO: 895253 - RNA, 16 nt, Mycobacterium avium subsp. paratuberculosis
augaccaugucgacgc

SEQ ID NO: 895254 - RNA, 19 nt, Mycobacterium avium subsp. paratuberculosis
augaccgacauggccagca

SEQ ID NO: 895255 - RNA, 17 nt, Mycobacterium avium subsp. paratuberculosis
augacgagcagcgugcu

SEQ ID NO: 895256 - RNA, 19 nt, Mycobacterium avium subsp. paratuberculosis
aucuuguuguuggugccgc

SEQ ID NO: 895257 - RNA, 22 nt, Mycobacterium avium subsp. paratuberculosis
aucuuggcgagcugaccggcca

SEQ ID NO: 895258 - RNA, 22 nt, Mycobacterium avium subsp. paratuberculosis
augaaauccgggaccggcguca

SEQ ID NO: 895259 - RNA, 22 nt, Mycobacterium avium subsp. paratuberculosis
augaaccgcugcugcucggccg

SEQ ID NO: 895260 - RNA, 15 nt, Mycobacterium avium subsp. paratuberculosis
augaacaugcccugc

SEQ ID NO: 895261 - RNA, 21 nt, Mycobacterium avium subsp. paratuberculosis
augaacucgcgggcgagcagc

SEQ ID NO: 895262 - RNA, 11 nt, Mycobacterium avium subsp. paratuberculosis
augaacuccuc

SEQ ID NO: 895263 - RNA, 19 nt, Mycobacterium avium subsp. paratuberculosis
augaacucguccaccgaca

SEQ ID NO: 895264 - RNA, 14 nt, Mycobacterium avium subsp. paratuberculosis
auccugcccggucu

SEQ ID NO: 895265 - RNA, 15 nt, Mycobacterium avium subsp. paratuberculosis
auccugcagcuggcg

SEQ ID NO: 895266 - RNA, 16 nt, Mycobacterium avium subsp. paratuberculosis
auccugcgcaucgagc

SEQ ID NO: 895267 - RNA, 17 nt, Mycobacterium avium subsp. paratuberculosis
auccugcuggccgggcu

SEQ ID NO: 895268 - RNA, 18 nt, Mycobacterium avium subsp. paratuberculosis
auccucgaauccgcgggc

SEQ ID NO: 895269 - RNA, 14 nt, Mycobacterium avium subsp. paratuberculosis
auccucgccgcggg

SEQ ID NO: 895270 - RNA, 17 nt, Mycobacterium avium subsp. paratuberculosis
auccucagcagcuagcc

SEQ ID NO: 895271 - RNA, 17 nt, Mycobacterium avium subsp. paratuberculosis
auccuguuccccggcgg

SEQ ID NO: 895272 - RNA, 20 nt, Mycobacterium avium subsp. paratuberculosis
auccugguccggcgcccgau

SEQ ID NO: 895273 - RNA, 22 nt, Mycobacterium avium subsp. paratuberculosis
aucgaacagggcggcgggcccg

SEQ ID NO: 895274 - RNA, 16 nt, Mycobacterium avium subsp. paratuberculosis
aucgaaccgccgcgcu

SEQ ID NO: 895275 - RNA, 17 nt, Mycobacterium avium subsp. paratuberculosis
aucgaaaugaccgcgcc

SEQ ID NO: 895276 - RNA, 16 nt, Mycobacterium avium subsp. paratuberculosis
aucgaaugcagcggcu

SEQ ID NO: 895277 - RNA, 19 nt, Mycobacterium avium subsp. paratuberculosis
aucgaacuugaucaccgcg

SEQ ID NO: 895278 - RNA, 23 nt, Mycobacterium avium subsp. paratuberculosis
aucgaacggcggaaccgggccgc

SEQ ID NO: 895279 - RNA, 12 nt, Mycobacterium avium subsp. paratuberculosis
aucgacaccucg

SEQ ID NO: 895280 - RNA, 12 nt, Mycobacterium avium subsp. paratuberculosis
aucgacagggcg

SEQ ID NO: 895281 - RNA, 18 nt, Mycobacterium avium subsp. paratuberculosis
aucgacagguucuuggcg

SEQ ID NO: 895282 - RNA, 23 nt, Mycobacterium avium subsp. paratuberculosis
aucgacagguucuuggcggccug

SEQ ID NO: 895283 - RNA, 15 nt, Mycobacterium avium subsp. paratuberculosis
aucgacaccagcgug

SEQ ID NO: 895284 - RNA, 18 nt, Mycobacterium avium subsp. paratuberculosis
aucgacaccgcacggccc

SEQ ID NO: 895285 - RNA, 19 nt, Mycobacterium avium subsp. paratuberculosis
aucgaccggaugaugccgg

SEQ ID NO: 895286 - RNA, 20 nt, Mycobacterium avium subsp. paratuberculosis
aucgaccggaugaugccggu

SEQ ID NO: 895287 - RNA, 22 nt, Mycobacterium avium subsp. paratuberculosis
aucgaccggguuggcgcgcacc

SEQ ID NO: 895288 - RNA, 14 nt, Mycobacterium avium subsp. paratuberculosis
aucgaccgguucgu

SEQ ID NO: 895289 - RNA, 15 nt, Mycobacterium avium subsp. paratuberculosis
aucgacgagccgggc

SEQ ID NO: 895290 - RNA, 16 nt, Mycobacterium avium subsp. paratuberculosis
aucgacgagccgggcc

SEQ ID NO: 895291 - RNA, 15 nt, Mycobacterium avium subsp. paratuberculosis
aucgacgccgacauc

SEQ ID NO: 895292 - RNA, 19 nt, Mycobacterium avium subsp. paratuberculosis
aucgacgacgccagcugcc

SEQ ID NO: 895293 - RNA, 20 nt, Mycobacterium avium subsp. paratuberculosis
aucgaccaacuccaccgccc

SEQ ID NO: 895294 - RNA, 16 nt, Mycobacterium avium subsp. paratuberculosis
aucgacccccaccgcg

SEQ ID NO: 895295 - RNA, 19 nt, Mycobacterium avium subsp. paratuberculosis
aucgacccccaccgcgaca

SEQ ID NO: 895296 - RNA, 14 nt, Mycobacterium avium subsp. paratuberculosis
auccgacaccgccu

SEQ ID NO: 895297 - RNA, 15 nt, Mycobacterium avium subsp. paratuberculosis
aucccuugccgccga

SEQ ID NO: 895298 - RNA, 21 nt, Mycobacterium avium subsp. paratuberculosis
auccgaccggcucagcccggc

SEQ ID NO: 895299 - RNA, 17 nt, Mycobacterium avium subsp. paratuberculosis
aucagcgcguccaaccg

SEQ ID NO: 895300 - RNA, 20 nt, Mycobacterium avium subsp. paratuberculosis
aucagcgcguccaaccgcgg

SEQ ID NO: 895301 - RNA, 13 nt, Mycobacterium avium subsp. paratuberculosis
aucagcgcgucga

SEQ ID NO: 895302 - RNA, 14 nt, Mycobacterium avium subsp. paratuberculosis
aucagcggcgggcc

SEQ ID NO: 895303 - RNA, 22 nt, Mycobacterium avium subsp. paratuberculosis
aucagcggcgggcccagcagau

SEQ ID NO: 895304 - RNA, 18 nt, Mycobacterium avium subsp. paratuberculosis
aucagcgucagcaccgcg

SEQ ID NO: 895305 - RNA, 19 nt, Mycobacterium avium subsp. paratuberculosis
aucagcguguuggacgccc

SEQ ID NO: 895306 - RNA, 17 nt, Mycobacterium avium subsp. paratuberculosis
aucagcguuccggcggc

SEQ ID NO: 895307 - RNA, 21 nt, Mycobacterium avium subsp. paratuberculosis
aucagcguuccggcggccggc

SEQ ID NO: 895308 - RNA, 16 nt, Mycobacterium avium subsp. paratuberculosis
auccgauugcggcgca

SEQ ID NO: 895309 - RNA, 15 nt, Mycobacterium avium subsp. paratuberculosis
auccgaucgcggccc

SEQ ID NO: 895310 - RNA, 19 nt, Mycobacterium avium subsp. paratuberculosis
auccgaucugcucgaugcg

SEQ ID NO: 895311 - RNA, 17 nt, Mycobacterium avium subsp. paratuberculosis
auccgaucaucagggca

SEQ ID NO: 895312 - RNA, 21 nt, Mycobacterium avium subsp. paratuberculosis
auccgaugacgcugccgcgcc

SEQ ID NO: 895313 - RNA, 19 nt, Mycobacterium avium subsp. paratuberculosis
auccgaggguucgguggcc

SEQ ID NO: 895314 - RNA, 17 nt, Mycobacterium avium subsp. paratuberculosis
auccgaguuggccggca

SEQ ID NO: 895315 - RNA, 16 nt, Mycobacterium avium subsp. paratuberculosis
auccgcagcaccaggg

SEQ ID NO: 895316 - RNA, 15 nt, Mycobacterium avium subsp. paratuberculosis
auccgcagccgcugc

SEQ ID NO: 895317 - RNA, 16 nt, Mycobacterium avium subsp. paratuberculosis
auccgcagccgcugcc

SEQ ID NO: 895318 - RNA, 13 nt, Mycobacterium avium subsp. paratuberculosis
auccgcccggccc

SEQ ID NO: 895319 - RNA, 21 nt, Mycobacterium avium subsp. paratuberculosis
auccgcccguagaugcggccc

SEQ ID NO: 895320 - RNA, 20 nt, Mycobacterium avium subsp. paratuberculosis
auccgccacccgcugcucga

SEQ ID NO: 895321 - RNA, 12 nt, Mycobacterium avium subsp. paratuberculosis
auccgcaccgga

SEQ ID NO: 895322 - RNA, 20 nt, Mycobacterium avium subsp. paratuberculosis
auccgcaccggacgcagcga

SEQ ID NO: 895323 - RNA, 17 nt, Mycobacterium avium subsp. paratuberculosis
auccgcaggaugccgau

SEQ ID NO: 895324 - RNA, 20 nt, Mycobacterium avium subsp. paratuberculosis
auccgguaccagaucgagcu

SEQ ID NO: 895325 - RNA, 19 nt, Mycobacterium avium subsp. paratuberculosis
auccgguagaagaccaccu

SEQ ID NO: 895326 - RNA, 18 nt, Mycobacterium avium subsp. paratuberculosis
auccggucagcgccagca

SEQ ID NO: 895327 - RNA, 17 nt, Mycobacterium avium subsp. paratuberculosis
auccggucaacgccgcg

SEQ ID NO: 895328 - RNA, 18 nt, Mycobacterium avium subsp. paratuberculosis
auccggucaacgccgcgc

SEQ ID NO: 895329 - RNA, 18 nt, Mycobacterium avium subsp. paratuberculosis
auccgggccgccgcggac

SEQ ID NO: 895330 - RNA, 13 nt, Mycobacterium avium subsp. paratuberculosis
auccgggccggcg

SEQ ID NO: 895331 - RNA, 17 nt, Mycobacterium avium subsp. paratuberculosis
auccgggcgccauccgc

SEQ ID NO: 895332 - RNA, 19 nt, Mycobacterium avium subsp. paratuberculosis
auccgggcgccggccggcg

SEQ ID NO: 895333 - RNA, 14 nt, Mycobacterium avium subsp. paratuberculosis
auccgggcgccggu

SEQ ID NO: 895334 - RNA, 16 nt, Mycobacterium avium subsp. paratuberculosis
auccggggucagggcg

SEQ ID NO: 895335 - RNA, 18 nt, Mycobacterium avium subsp. paratuberculosis
auccggggucagggcgcu

SEQ ID NO: 895336 - RNA, 14 nt, Mycobacterium avium subsp. paratuberculosis
auccgggcggcauc

SEQ ID NO: 895337 - RNA, 18 nt, Mycobacterium avium subsp. paratuberculosis
auccgggcggcaucgcgc

SEQ ID NO: 895338 - RNA, 13 nt, Mycobacterium avium subsp. paratuberculosis
auccggcugagca

SEQ ID NO: 895339 - RNA, 20 nt, Mycobacterium avium subsp. paratuberculosis
auccggcugagcagcucgcg

SEQ ID NO: 895340 - RNA, 19 nt, Mycobacterium avium subsp. paratuberculosis
auccggcgucucagucggc

SEQ ID NO: 895341 - RNA, 16 nt, Mycobacterium avium subsp. paratuberculosis
auccggcucagaaggc

SEQ ID NO: 895342 - RNA, 17 nt, Mycobacterium avium subsp. paratuberculosis
auccggauugccgggca

SEQ ID NO: 895343 - RNA, 17 nt, Mycobacterium avium subsp. paratuberculosis
auccggaaugcggugcu

SEQ ID NO: 895344 - RNA, 15 nt, Mycobacterium avium subsp. paratuberculosis
auccgcuggugcgcg

SEQ ID NO: 895345 - RNA, 16 nt, Mycobacterium avium subsp. paratuberculosis
auccgcuggugcgcgc

SEQ ID NO: 895346 - RNA, 17 nt, Mycobacterium avium subsp. paratuberculosis
auccgcuggugcgcgcc

SEQ ID NO: 895347 - RNA, 20 nt, Mycobacterium avium subsp. paratuberculosis
auccgcuggugcgcgccggc

SEQ ID NO: 895348 - RNA, 12 nt, Mycobacterium avium subsp. paratuberculosis
auccgcggcgcc

SEQ ID NO: 895349 - RNA, 15 nt, Mycobacterium avium subsp. paratuberculosis
auccgcggucgacca

SEQ ID NO: 895350 - RNA, 13 nt, Mycobacterium avium subsp. paratuberculosis
auccgcucgccgc

SEQ ID NO: 895351 - RNA, 15 nt, Mycobacterium avium subsp. paratuberculosis
auccgcucgccgcgg

SEQ ID NO: 895352 - RNA, 15 nt, Mycobacterium avium subsp. paratuberculosis
aucgaggacaccgcg

SEQ ID NO: 895353 - RNA, 18 nt, Mycobacterium avium subsp. paratuberculosis
aucgaggaccggcgccgg

SEQ ID NO: 895354 - RNA, 19 nt, Mycobacterium avium subsp. paratuberculosis
aucgaggaccggcgccggc

SEQ ID NO: 895355 - RNA, 17 nt, Mycobacterium avium subsp. paratuberculosis
aucgcccaacaacucga

SEQ ID NO: 895356 - RNA, 14 nt, Mycobacterium avium subsp. paratuberculosis
aucgcccacccgca

SEQ ID NO: 895357 - RNA, 12 nt, Mycobacterium avium subsp. paratuberculosis
aucgagcgcgcu

SEQ ID NO: 895358 - RNA, 16 nt, Mycobacterium avium subsp. paratuberculosis
aucgagcucgcagucg

SEQ ID NO: 895359 - RNA, 20 nt, Mycobacterium avium subsp. paratuberculosis
aucgagcucgcagucgauca

SEQ ID NO: 895360 - RNA, 16 nt, Mycobacterium avium subsp. paratuberculosis
aucgagcgggcgggcu

SEQ ID NO: 895361 - RNA, 19 nt, Mycobacterium avium subsp. paratuberculosis
aucgagcugggcccgcgca

SEQ ID NO: 895362 - RNA, 21 nt, Mycobacterium avium subsp. paratuberculosis
aucgagcugggcccgcgcauc

SEQ ID NO: 895363 - RNA, 17 nt, Mycobacterium avium subsp. paratuberculosis
aucgcccagcaccgcga

SEQ ID NO: 895364 - RNA, 13 nt, Mycobacterium avium subsp. paratuberculosis
aucgcccagcgca

SEQ ID NO: 895365 - RNA, 15 nt, Mycobacterium avium subsp. paratuberculosis
aucgcccagcgcagc

SEQ ID NO: 895366 - RNA, 18 nt, Mycobacterium avium subsp. paratuberculosis
aucgcccagcgcagcgcc

SEQ ID NO: 895367 - RNA, 18 nt, Mycobacterium avium subsp. paratuberculosis
aucgcccaucaccgcacc

SEQ ID NO: 895368 - RNA, 22 nt, Mycobacterium avium subsp. paratuberculosis
aucgcccaucaccgcaccgacg

SEQ ID NO: 895369 - RNA, 17 nt, Mycobacterium avium subsp. paratuberculosis
aucgcccauuugccggu

SEQ ID NO: 895370 - RNA, 23 nt, Mycobacterium avium subsp. paratuberculosis
aucgcccagucccguugcgggac

SEQ ID NO: 895371 - RNA, 22 nt, Mycobacterium avium subsp. paratuberculosis
aucgcccagugcgcgccguguu

SEQ ID NO: 895372 - RNA, 13 nt, Mycobacterium avium subsp. paratuberculosis
aucgccccggaga

SEQ ID NO: 895373 - RNA, 12 nt, Mycobacterium avium subsp. paratuberculosis
aucgcccgccgc

SEQ ID NO: 895374 - RNA, 14 nt, Mycobacterium avium subsp. paratuberculosis
aucgcccgccgcga

SEQ ID NO: 895375 - RNA, 22 nt, Mycobacterium avium subsp. paratuberculosis
aucgcccgcgaaaucuucgccg

SEQ ID NO: 895376 - RNA, 18 nt, Mycobacterium avium subsp. paratuberculosis
aucgcccgcuccgcgggc

SEQ ID NO: 895377 - RNA, 20 nt, Mycobacterium avium subsp. paratuberculosis
aucgcccgcuccgcggugcu

SEQ ID NO: 895378 - RNA, 17 nt, Mycobacterium avium subsp. paratuberculosis
aucgacuugccgccgca

SEQ ID NO: 895379 - RNA, 17 nt, Mycobacterium avium subsp. paratuberculosis
aucgacugcgacacccg

SEQ ID NO: 895380 - RNA, 17 nt, Mycobacterium avium subsp. paratuberculosis
aucgacgucaccaccgg

SEQ ID NO: 895381 - RNA, 21 nt, Mycobacterium avium subsp. paratuberculosis
aucgacgucagcucccccgac

SEQ ID NO: 895382 - RNA, 13 nt, Mycobacterium avium subsp. paratuberculosis
aucgacuccagca

SEQ ID NO: 895383 - RNA, 20 nt, Mycobacterium avium subsp. paratuberculosis
aucgacuccagcaccggcgc

SEQ ID NO: 895384 - RNA, 21 nt, Mycobacterium avium subsp. paratuberculosis
aucgacuccagcaccggcgcc

SEQ ID NO: 895385 - RNA, 22 nt, Mycobacterium avium subsp. paratuberculosis
aucgacuccagcaccggcgcca

SEQ ID NO: 895386 - RNA, 13 nt, Mycobacterium avium subsp. paratuberculosis
aucgacgcgaccu

SEQ ID NO: 895387 - RNA, 17 nt, Mycobacterium avium subsp. paratuberculosis
aucgagcccaccgcgcc

SEQ ID NO: 895388 - RNA, 21 nt, Mycobacterium avium subsp. paratuberculosis
aucgagcccaccgcgcccagc

SEQ ID NO: 895389 - RNA, 13 nt, Mycobacterium avium subsp. paratuberculosis
aucgagccgagca

SEQ ID NO: 895390 - RNA, 19 nt, Mycobacterium avium subsp. paratuberculosis
aucgagccgagcaccggca

SEQ ID NO: 895391 - RNA, 21 nt, Mycobacterium avium subsp. paratuberculosis
aucgagccgagcaccggcagc

SEQ ID NO: 895392 - RNA, 19 nt, Mycobacterium avium subsp. paratuberculosis
aucgagccgccugcgcgcc

SEQ ID NO: 895393 - RNA, 21 nt, Mycobacterium avium subsp. paratuberculosis
aucgagccgccugcgcgccgu

SEQ ID NO: 895394 - RNA, 23 nt, Mycobacterium avium subsp. paratuberculosis
aucgagccgccugcgcgccgucg

SEQ ID NO: 895395 - RNA, 15 nt, Mycobacterium avium subsp. paratuberculosis
aucgagccgcggccc

SEQ ID NO: 895396 - RNA, 16 nt, Mycobacterium avium subsp. paratuberculosis
aucgagccgcggcccg

SEQ ID NO: 895397 - RNA, 18 nt, Mycobacterium avium subsp. paratuberculosis
aucgagcacccggcgggg

SEQ ID NO: 895398 - RNA, 19 nt, Mycobacterium avium subsp. paratuberculosis
aucgagaccaugucggcca

SEQ ID NO: 895399 - RNA, 14 nt, Mycobacterium avium subsp. paratuberculosis
aucgagaugccggg

SEQ ID NO: 895400 - RNA, 13 nt, Mycobacterium avium subsp. paratuberculosis
aucgccgucacgu

SEQ ID NO: 895401 - RNA, 19 nt, Mycobacterium avium subsp. paratuberculosis
aucgccggugcggccgcga

SEQ ID NO: 895402 - RNA, 21 nt, Mycobacterium avium subsp. paratuberculosis
aucgccggugcggccgcgauc

SEQ ID NO: 895403 - RNA, 13 nt, Mycobacterium avium subsp. paratuberculosis
aucgccggggauc

SEQ ID NO: 895404 - RNA, 19 nt, Mycobacterium avium subsp. paratuberculosis
aucgccggggcgcugagca

SEQ ID NO: 895405 - RNA, 17 nt, Mycobacterium avium subsp. paratuberculosis
aucgccgggucgcacgc

SEQ ID NO: 895406 - RNA, 18 nt, Mycobacterium avium subsp. paratuberculosis
aucgccuacugcgccaau

SEQ ID NO: 895407 - RNA, 14 nt, Mycobacterium avium subsp. paratuberculosis
aucgccguccacgg

SEQ ID NO: 895408 - RNA, 22 nt, Mycobacterium avium subsp. paratuberculosis
aucgccguccacgggucgccgu

SEQ ID NO: 895409 - RNA, 20 nt, Mycobacterium avium subsp. paratuberculosis
aucgccgucgccaccgaguc

SEQ ID NO: 895410 - RNA, 15 nt, Mycobacterium avium subsp. paratuberculosis
aucgccgucgucagc

SEQ ID NO: 895411 - RNA, 14 nt, Mycobacterium avium subsp. paratuberculosis
aucgcgcaggugau

SEQ ID NO: 895412 - RNA, 14 nt, Mycobacterium avium subsp. paratuberculosis
aucgcgcagccgcg

SEQ ID NO: 895413 - RNA, 16 nt, Mycobacterium avium subsp. paratuberculosis
aucgcgcagccgcggu

SEQ ID NO: 895414 - RNA, 16 nt, Mycobacterium avium subsp. paratuberculosis
aucgcgaugucgacgg

SEQ ID NO: 895415 - RNA, 17 nt, Mycobacterium avium subsp. paratuberculosis
aucgcgaucaccgcggc

SEQ ID NO: 895416 - RNA, 20 nt, Mycobacterium avium subsp. paratuberculosis
aucgcgaucaccgcggccac

SEQ ID NO: 895417 - RNA, 17 nt, Mycobacterium avium subsp. paratuberculosis
aucgcgauccgggcgcc

SEQ ID NO: 895418 - RNA, 20 nt, Mycobacterium avium subsp. paratuberculosis
aucgcgauccgggcgccggc

SEQ ID NO: 895419 - RNA, 14 nt, Mycobacterium avium subsp. paratuberculosis
aucgcgaucgccga

SEQ ID NO: 895420 - RNA, 15 nt, Mycobacterium avium subsp. paratuberculosis
aucgcgaucgccgau

SEQ ID NO: 895421 - RNA, 17 nt, Mycobacterium avium subsp. paratuberculosis
aucgcgauggaagcgcc

SEQ ID NO: 895422 - RNA, 20 nt, Mycobacterium avium subsp. paratuberculosis
aucgcgauggaagcgcccgc

SEQ ID NO: 895423 - RNA, 20 nt, Mycobacterium avium subsp. paratuberculosis
aucgccgcaacuugcccgac

SEQ ID NO: 895424 - RNA, 18 nt, Mycobacterium avium subsp. paratuberculosis
aucgcccgguccaucccg

SEQ ID NO: 895425 - RNA, 12 nt, Mycobacterium avium subsp. paratuberculosis
aucgcccggugc

SEQ ID NO: 895426 - RNA, 21 nt, Mycobacterium avium subsp. paratuberculosis
aucgcccggcgcccggccggc

SEQ ID NO: 895427 - RNA, 12 nt, Mycobacterium avium subsp. paratuberculosis
aucgccgcgcac

SEQ ID NO: 895428 - RNA, 15 nt, Mycobacterium avium subsp. paratuberculosis
aucgccgcgcccagc

SEQ ID NO: 895429 - RNA, 16 nt, Mycobacterium avium subsp. paratuberculosis
aucgccgcgcccagca

SEQ ID NO: 895430 - RNA, 20 nt, Mycobacterium avium subsp. paratuberculosis
aucgccgccaucgccgccgc

SEQ ID NO: 895431 - RNA, 24 nt, Mycobacterium avium subsp. paratuberculosis
aucgccgccaucgccgccgccauc

SEQ ID NO: 895432 - RNA, 13 nt, Mycobacterium avium subsp. paratuberculosis
aucgccgcccauc

SEQ ID NO: 895433 - RNA, 19 nt, Mycobacterium avium subsp. paratuberculosis
aucgccgcccaucggcagc

SEQ ID NO: 895434 - RNA, 16 nt, Mycobacterium avium subsp. paratuberculosis
aucgccggcgaccgug

SEQ ID NO: 895435 - RNA, 18 nt, Mycobacterium avium subsp. paratuberculosis
aucgccggcgaccgugcc

SEQ ID NO: 895436 - RNA, 21 nt, Mycobacterium avium subsp. paratuberculosis
aucgccggcgaccgugcccac

SEQ ID NO: 895437 - RNA, 14 nt, Mycobacterium avium subsp. paratuberculosis
aucgccggcgccgg

SEQ ID NO: 895438 - RNA, 15 nt, Mycobacterium avium subsp. paratuberculosis
aucgccggcgcgcug

SEQ ID NO: 895439 - RNA, 19 nt, Mycobacterium avium subsp. paratuberculosis
aucgccgggauggugagcc

SEQ ID NO: 895440 - RNA, 18 nt, Mycobacterium avium subsp. paratuberculosis
aucgccggacagcgggcc

SEQ ID NO: 895441 - RNA, 19 nt, Mycobacterium avium subsp. paratuberculosis
aucgccggaucgagcaccc

SEQ ID NO: 895442 - RNA, 16 nt, Mycobacterium avium subsp. paratuberculosis
aucgccggaucgccga

SEQ ID NO: 895443 - RNA, 19 nt, Mycobacterium avium subsp. paratuberculosis
aucgccggaucgccgaggu

SEQ ID NO: 895444 - RNA, 14 nt, Mycobacterium avium subsp. paratuberculosis
aucgccgcggcgau

SEQ ID NO: 895445 - RNA, 16 nt, Mycobacterium avium subsp. paratuberculosis
aucgccgcggugcgcg

SEQ ID NO: 895446 - RNA, 14 nt, Mycobacterium avium subsp. paratuberculosis
aucgccgcgguggc

SEQ ID NO: 895447 - RNA, 21 nt, Mycobacterium avium subsp. paratuberculosis
aucgcugcgagcccggccagu

SEQ ID NO: 895448 - RNA, 22 nt, Mycobacterium avium subsp. paratuberculosis
aucgcugcgcccgccgccacca

SEQ ID NO: 895449 - RNA, 22 nt, Mycobacterium avium subsp. paratuberculosis
aucgcuggggugcccaccagca

SEQ ID NO: 895450 - RNA, 16 nt, Mycobacterium avium subsp. paratuberculosis
aucgcugguggccgac

SEQ ID NO: 895451 - RNA, 18 nt, Mycobacterium avium subsp. paratuberculosis
aucgcugguggccgacgu

SEQ ID NO: 895452 - RNA, 17 nt, Mycobacterium avium subsp. paratuberculosis
aucggauucgucgguca

SEQ ID NO: 895453 - RNA, 20 nt, Mycobacterium avium subsp. paratuberculosis
aucggauuucccgcuuggcg

SEQ ID NO: 895454 - RNA, 21 nt, Mycobacterium avium subsp. paratuberculosis
aucggagguugauggccagaa

SEQ ID NO: 895455 - RNA, 14 nt, Mycobacterium avium subsp. paratuberculosis
aucgcggccagcgu

SEQ ID NO: 895456 - RNA, 18 nt, Mycobacterium avium subsp. paratuberculosis
aucgcggcccacccgcag

SEQ ID NO: 895457 - RNA, 19 nt, Mycobacterium avium subsp. paratuberculosis
aucgcggcccccacgcagc

SEQ ID NO: 895458 - RNA, 17 nt, Mycobacterium avium subsp. paratuberculosis
aucgcggcccgccgcuc

SEQ ID NO: 895459 - RNA, 19 nt, Mycobacterium avium subsp. paratuberculosis
aucgcggcccgccgcucac

SEQ ID NO: 895460 - RNA, 22 nt, Mycobacterium avium subsp. paratuberculosis
aucgcggcccgccgcucaccgc

SEQ ID NO: 895461 - RNA, 19 nt, Mycobacterium avium subsp. paratuberculosis
aucgcggaucgaacagggc

SEQ ID NO: 895462 - RNA, 21 nt, Mycobacterium avium subsp. paratuberculosis
aucgcgccgaucugaccgagc

SEQ ID NO: 895463 - RNA, 11 nt, Mycobacterium avium subsp. paratuberculosis
aucgcgccgca

SEQ ID NO: 895464 - RNA, 19 nt, Mycobacterium avium subsp. paratuberculosis
aucgcgccgcaugaugcgg

SEQ ID NO: 895465 - RNA, 17 nt, Mycobacterium avium subsp. paratuberculosis
aucgcgcgcggcgacgg

SEQ ID NO: 895466 - RNA, 21 nt, Mycobacterium avium subsp. paratuberculosis
aucgcgcgcggcggccaccgc

SEQ ID NO: 895467 - RNA, 13 nt, Mycobacterium avium subsp. paratuberculosis
aucgcgccggccg

SEQ ID NO: 895468 - RNA, 14 nt, Mycobacterium avium subsp. paratuberculosis
aucgcgccggccgc

SEQ ID NO: 895469 - RNA, 15 nt, Mycobacterium avium subsp. paratuberculosis
aucgcgccggccgcc

SEQ ID NO: 895470 - RNA, 14 nt, Mycobacterium avium subsp. paratuberculosis
aucggcgccacgac

SEQ ID NO: 895471 - RNA, 19 nt, Mycobacterium avium subsp. paratuberculosis
aucggcgccacgaccagcg

SEQ ID NO: 895472 - RNA, 16 nt, Mycobacterium avium subsp. paratuberculosis
aucggcgcccaccgcg

SEQ ID NO: 895473 - RNA, 18 nt, Mycobacterium avium subsp. paratuberculosis
aucggcgcccaccgcggc

SEQ ID NO: 895474 - RNA, 20 nt, Mycobacterium avium subsp. paratuberculosis
aucggcgcccaccgcggcgc

SEQ ID NO: 895475 - RNA, 18 nt, Mycobacterium avium subsp. paratuberculosis
aucggcgcccucgccgac

SEQ ID NO: 895476 - RNA, 21 nt, Mycobacterium avium subsp. paratuberculosis
aucggcgccgaauucgguugu

SEQ ID NO: 895477 - RNA, 15 nt, Mycobacterium avium subsp. paratuberculosis
aucggcgagccggga

SEQ ID NO: 895478 - RNA, 14 nt, Mycobacterium avium subsp. paratuberculosis
aucggcgacgccgc

SEQ ID NO: 895479 - RNA, 15 nt, Mycobacterium avium subsp. paratuberculosis
aucggcgacgccgcc

SEQ ID NO: 895480 - RNA, 18 nt, Mycobacterium avium subsp. paratuberculosis
aucggcgacgccgccguc

SEQ ID NO: 895481 - RNA, 22 nt, Mycobacterium avium subsp. paratuberculosis
aucggccgggagauacggucgc

SEQ ID NO: 895482 - RNA, 16 nt, Mycobacterium avium subsp. paratuberculosis
aucggcggccaccagc

SEQ ID NO: 895483 - RNA, 14 nt, Mycobacterium avium subsp. paratuberculosis
aucggcgcgucggc

SEQ ID NO: 895484 - RNA, 13 nt, Mycobacterium avium subsp. paratuberculosis
aucggcgcgcggg

SEQ ID NO: 895485 - RNA, 13 nt, Mycobacterium avium subsp. paratuberculosis
aucggcgcggcga

SEQ ID NO: 895486 - RNA, 12 nt, Mycobacterium avium subsp. paratuberculosis
aucggcgcgucg

SEQ ID NO: 895487 - RNA, 19 nt, Mycobacterium avium subsp. paratuberculosis
aucggcgcgaagucgagca

SEQ ID NO: 895488 - RNA, 18 nt, Mycobacterium avium subsp. paratuberculosis
aucggccaggcgcccagc

SEQ ID NO: 895489 - RNA, 14 nt, Mycobacterium avium subsp. paratuberculosis
aucggcccggccaa

SEQ ID NO: 895490 - RNA, 18 nt, Mycobacterium avium subsp. paratuberculosis
aucggccaggaaccaccg

SEQ ID NO: 895491 - RNA, 18 nt, Mycobacterium avium subsp. paratuberculosis
aucggcccccgggcccga

SEQ ID NO: 895492 - RNA, 18 nt, Mycobacterium avium subsp. paratuberculosis
aucggccccggccgagcc

SEQ ID NO: 895493 - RNA, 21 nt, Mycobacterium avium subsp. paratuberculosis
aucggcccgaucucgcgcggg

SEQ ID NO: 895494 - RNA, 15 nt, Mycobacterium avium subsp. paratuberculosis
aucggccgcggggcc

SEQ ID NO: 895495 - RNA, 18 nt, Mycobacterium avium subsp. paratuberculosis
aucggccgcggggccggc

SEQ ID NO: 895496 - RNA, 21 nt, Mycobacterium avium subsp. paratuberculosis
aucggccgcggggccggcgcu

SEQ ID NO: 895497 - RNA, 16 nt, Mycobacterium avium subsp. paratuberculosis
aucggccgcgucgggc

SEQ ID NO: 895498 - RNA, 16 nt, Mycobacterium avium subsp. paratuberculosis
aucggccgcugcgggc

SEQ ID NO: 895499 - RNA, 21 nt, Mycobacterium avium subsp. paratuberculosis
aucggccgcugcgggcgggcc

SEQ ID NO: 895500 - RNA, 23 nt, Mycobacterium avium subsp. paratuberculosis
aucggccgcugcgggcgggccgc

SEQ ID NO: 895501 - RNA, 16 nt, Mycobacterium avium subsp. paratuberculosis
aucggcacgucgagca

SEQ ID NO: 895502 - RNA, 15 nt, Mycobacterium avium subsp. paratuberculosis
aucggcagacccagc

SEQ ID NO: 895503 - RNA, 19 nt, Mycobacterium avium subsp. paratuberculosis
aucggcagacccagcagcg

SEQ ID NO: 895504 - RNA, 20 nt, Mycobacterium avium subsp. paratuberculosis
aucggcagacccagcagcgg

SEQ ID NO: 895505 - RNA, 15 nt, Mycobacterium avium subsp. paratuberculosis
auugcccgacuccuc

SEQ ID NO: 895506 - RNA, 14 nt, Mycobacterium avium subsp. paratuberculosis
auugccgagcaccc

SEQ ID NO: 895507 - RNA, 16 nt, Mycobacterium avium subsp. paratuberculosis
auugccgagcaccccg

SEQ ID NO: 895508 - RNA, 22 nt, Mycobacterium avium subsp. paratuberculosis
auugccagcuucgggcgcgcgc

SEQ ID NO: 895509 - RNA, 15 nt, Mycobacterium avium subsp. paratuberculosis
auucugcugcccgac

SEQ ID NO: 895510 - RNA, 23 nt, Mycobacterium avium subsp. paratuberculosis
auugaagcccugcucggugaugc

SEQ ID NO: 895511 - RNA, 15 nt, Mycobacterium avium subsp. paratuberculosis
auugaauucgaccac

SEQ ID NO: 895512 - RNA, 18 nt, Mycobacterium avium subsp. paratuberculosis
auugaagaagcgggccaa

SEQ ID NO: 895513 - RNA, 20 nt, Mycobacterium avium subsp. paratuberculosis
auugacggcccacgucgcgc

SEQ ID NO: 895514 - RNA, 13 nt, Mycobacterium avium subsp. paratuberculosis
auugaccauccgg

SEQ ID NO: 895515 - RNA, 15 nt, Mycobacterium avium subsp. paratuberculosis
auugaggcuggcgau

SEQ ID NO: 895516 - RNA, 17 nt, Mycobacterium avium subsp. paratuberculosis
auugagguagucggccc

SEQ ID NO: 895517 - RNA, 19 nt, Mycobacterium avium subsp. paratuberculosis
auugguggcccggucguac

SEQ ID NO: 895518 - RNA, 11 nt, Mycobacterium avium subsp. paratuberculosis
auugucggccg

SEQ ID NO: 895519 - RNA, 20 nt, Mycobacterium avium subsp. paratuberculosis
auugucgcugcgaggcgggc

SEQ ID NO: 895520 - RNA, 19 nt, Mycobacterium avium subsp. paratuberculosis
auugcuuuuugaccaccgg

SEQ ID NO: 895521 - RNA, 20 nt, Mycobacterium avium subsp. paratuberculosis
auugcuuuuugaccaccggc

SEQ ID NO: 895522 - RNA, 15 nt, Mycobacterium avium subsp. paratuberculosis
auuggacagcggcgc

SEQ ID NO: 895523 - RNA, 16 nt, Mycobacterium avium subsp. paratuberculosis
auuggacagcggcgcg

SEQ ID NO: 895524 - RNA, 16 nt, Mycobacterium avium subsp. paratuberculosis
auuggccgcgcgcagg

SEQ ID NO: 895525 - RNA, 21 nt, Mycobacterium avium subsp. paratuberculosis
auuggcgucgguggcggcggc

SEQ ID NO: 895526 - RNA, 18 nt, Mycobacterium avium subsp. paratuberculosis
auugccgggcaccagcga

SEQ ID NO: 895527 - RNA, 12 nt, Mycobacterium avium subsp. paratuberculosis
auugccgcgccg

SEQ ID NO: 895528 - RNA, 18 nt, Mycobacterium avium subsp. paratuberculosis
auugcgacuugcgcgccg

SEQ ID NO: 895529 - RNA, 14 nt, Mycobacterium avium subsp. paratuberculosis
auugcgagcaggcc

SEQ ID NO: 895530 - RNA, 15 nt, Mycobacterium avium subsp. paratuberculosis
auugcgagcaggccg

SEQ ID NO: 895531 - RNA, 22 nt, Mycobacterium avium subsp. paratuberculosis
auugcgccagcagcaacgcggu

SEQ ID NO: 895532 - RNA, 15 nt, Mycobacterium avium subsp. paratuberculosis
auugcgcggcgccgg

SEQ ID NO: 895533 - RNA, 22 nt, Mycobacterium avium subsp. paratuberculosis
auugccuugcuccacacuggcu

SEQ ID NO: 895534 - RNA, 22 nt, Mycobacterium avium subsp. paratuberculosis
auugcggcccuugcggccgauc

SEQ ID NO: 895535 - RNA, 17 nt, Mycobacterium avium subsp. paratuberculosis
auugcgcugcaccgcag

SEQ ID NO: 895536 - RNA, 20 nt, Mycobacterium avium subsp. paratuberculosis
auugcgcuugucagcggccu

SEQ ID NO: 895537 - RNA, 13 nt, Mycobacterium avium subsp. paratuberculosis
auuccucggccag

SEQ ID NO: 895538 - RNA, 14 nt, Mycobacterium avium subsp. paratuberculosis
auucgcccaccccg

SEQ ID NO: 895539 - RNA, 16 nt, Mycobacterium avium subsp. paratuberculosis
auucgcccaccccggc

SEQ ID NO: 895540 - RNA, 13 nt, Mycobacterium avium subsp. paratuberculosis
auucgggccagcg

SEQ ID NO: 895541 - RNA, 14 nt, Mycobacterium avium subsp. paratuberculosis
auucgggccagcgc

SEQ ID NO: 895542 - RNA, 21 nt, Mycobacterium avium subsp. paratuberculosis
auucgggccgccgcgcgggua

SEQ ID NO: 895543 - RNA, 14 nt, Mycobacterium avium subsp. paratuberculosis
auucggccgggucc

SEQ ID NO: 895544 - RNA, 15 nt, Mycobacterium avium subsp. paratuberculosis
auucggcgccgcgac

SEQ ID NO: 895545 - RNA, 19 nt, Mycobacterium avium subsp. paratuberculosis
auucggcgccgcgaccccg

SEQ ID NO: 895546 - RNA, 21 nt, Mycobacterium avium subsp. paratuberculosis
auucggcgccgcgaccccgga

SEQ ID NO: 895547 - RNA, 15 nt, Mycobacterium avium subsp. paratuberculosis
auucgcugccccggc

SEQ ID NO: 895548 - RNA, 13 nt, Mycobacterium avium subsp. paratuberculosis
auucgcgcaccuu

SEQ ID NO: 895549 - RNA, 17 nt, Mycobacterium avium subsp. paratuberculosis
auucucagcagcgggcc

SEQ ID NO: 895550 - RNA, 17 nt, Mycobacterium avium subsp. paratuberculosis
auucucgcugcggcgca

SEQ ID NO: 895551 - RNA, 22 nt, Mycobacterium avium subsp. paratuberculosis
auucgguggcgauggugcugcc

SEQ ID NO: 895552 - RNA, 19 nt, Mycobacterium avium subsp. paratuberculosis
auucggguggcgucgccgc

SEQ ID NO: 895553 - RNA, 12 nt, Mycobacterium avium subsp. paratuberculosis
auguugcggccg

SEQ ID NO: 895554 - RNA, 15 nt, Mycobacterium avium subsp. paratuberculosis
auuccgccgaaaccc

SEQ ID NO: 895555 - RNA, 17 nt, Mycobacterium avium subsp. paratuberculosis
auuccggccggccgccg

SEQ ID NO: 895556 - RNA, 13 nt, Mycobacterium avium subsp. paratuberculosis
auuccggcgcgau

SEQ ID NO: 895557 - RNA, 14 nt, Mycobacterium avium subsp. paratuberculosis
auucaggucaccgc

SEQ ID NO: 895558 - RNA, 19 nt, Mycobacterium avium subsp. paratuberculosis
auucagcgucgccaugccg

SEQ ID NO: 895559 - RNA, 22 nt, Mycobacterium avium subsp. paratuberculosis
auggagcgcgacgggcugcugc

SEQ ID NO: 895560 - RNA, 16 nt, Mycobacterium avium subsp. paratuberculosis
auggaggugccgcgca

SEQ ID NO: 895561 - RNA, 18 nt, Mycobacterium avium subsp. paratuberculosis
auggaggugccgcgcagc

SEQ ID NO: 895562 - RNA, 17 nt, Mycobacterium avium subsp. paratuberculosis
auggaaugugccugcgg

SEQ ID NO: 895563 - RNA, 20 nt, Mycobacterium avium subsp. paratuberculosis
auggaaugugccugcgggcc

SEQ ID NO: 895564 - RNA, 13 nt, Mycobacterium avium subsp. paratuberculosis
auggaaggugcug

SEQ ID NO: 895565 - RNA, 19 nt, Mycobacterium avium subsp. paratuberculosis
auggacaggcacucgccca

SEQ ID NO: 895566 - RNA, 17 nt, Mycobacterium avium subsp. paratuberculosis
auggacguccagcggcc

SEQ ID NO: 895567 - RNA, 19 nt, Mycobacterium avium subsp. paratuberculosis
auggacguccagcggcccu

SEQ ID NO: 895568 - RNA, 17 nt, Mycobacterium avium subsp. paratuberculosis
augcuuggucgcggcgu

SEQ ID NO: 895569 - RNA, 21 nt, Mycobacterium avium subsp. paratuberculosis
augcuguggaagggccccggc

SEQ ID NO: 895570 - RNA, 23 nt, Mycobacterium avium subsp. paratuberculosis
augcuuccgaucaacggcagcga

SEQ ID NO: 895571 - RNA, 20 nt, Mycobacterium avium subsp. paratuberculosis
augcuggccaucgccgagcc

SEQ ID NO: 895572 - RNA, 19 nt, Mycobacterium avium subsp. paratuberculosis
auggccaccaucaggccgg

SEQ ID NO: 895573 - RNA, 11 nt, Mycobacterium avium subsp. paratuberculosis
auggcaucgcc

SEQ ID NO: 895574 - RNA, 20 nt, Mycobacterium avium subsp. paratuberculosis
auggcaucgccaaggcgcug

SEQ ID NO: 895575 - RNA, 16 nt, Mycobacterium avium subsp. paratuberculosis
auggccagcagguaga

SEQ ID NO: 895576 - RNA, 13 nt, Mycobacterium avium subsp. paratuberculosis
auggccagcacca

SEQ ID NO: 895577 - RNA, 16 nt, Mycobacterium avium subsp. paratuberculosis
auggccagcaccaccg

SEQ ID NO: 895578 - RNA, 17 nt, Mycobacterium avium subsp. paratuberculosis
auggccagcaccaccgc

SEQ ID NO: 895579 - RNA, 15 nt, Mycobacterium avium subsp. paratuberculosis
auggccaccgggcgu

SEQ ID NO: 895580 - RNA, 15 nt, Mycobacterium avium subsp. paratuberculosis
auggcccgcgcgaug

SEQ ID NO: 895581 - RNA, 14 nt, Mycobacterium avium subsp. paratuberculosis
auggcccgcucggu

SEQ ID NO: 895582 - RNA, 17 nt, Mycobacterium avium subsp. paratuberculosis
auggcccgcugcgccga

SEQ ID NO: 895583 - RNA, 21 nt, Mycobacterium avium subsp. paratuberculosis
auggcccaggccgcggucgcc

SEQ ID NO: 895584 - RNA, 17 nt, Mycobacterium avium subsp. paratuberculosis
auggccaucuggccgcg

SEQ ID NO: 895585 - RNA, 18 nt, Mycobacterium avium subsp. paratuberculosis
auggccaucuggccgcgg

SEQ ID NO: 895586 - RNA, 19 nt, Mycobacterium avium subsp. paratuberculosis
auggccaucuggccgcggg

SEQ ID NO: 895587 - RNA, 14 nt, Mycobacterium avium subsp. paratuberculosis
auggccagcgcggc

SEQ ID NO: 895588 - RNA, 15 nt, Mycobacterium avium subsp. paratuberculosis
auggccagcgcggcg

SEQ ID NO: 895589 - RNA, 13 nt, Mycobacterium avium subsp. paratuberculosis
auggccagcucgu

SEQ ID NO: 895590 - RNA, 18 nt, Mycobacterium avium subsp. paratuberculosis
auggccaggaacggcgcc

SEQ ID NO: 895591 - RNA, 16 nt, Mycobacterium avium subsp. paratuberculosis
augcggcaccagcccg

SEQ ID NO: 895592 - RNA, 13 nt, Mycobacterium avium subsp. paratuberculosis
augcgccggcggu

SEQ ID NO: 895593 - RNA, 16 nt, Mycobacterium avium subsp. paratuberculosis
augcgccggguccagc

SEQ ID NO: 895594 - RNA, 20 nt, Mycobacterium avium subsp. paratuberculosis
augcgccggguccagccgcg

SEQ ID NO: 895595 - RNA, 15 nt, Mycobacterium avium subsp. paratuberculosis
augcggcccggccac

SEQ ID NO: 895596 - RNA, 23 nt, Mycobacterium avium subsp. paratuberculosis
augcggccgacuuggucagcccg

SEQ ID NO: 895597 - RNA, 22 nt, Mycobacterium avium subsp. paratuberculosis
augcggccauguccccgccggu

SEQ ID NO: 895598 - RNA, 23 nt, Mycobacterium avium subsp. paratuberculosis
augcggccauguccccgccggug

SEQ ID NO: 895599 - RNA, 14 nt, Mycobacterium avium subsp. paratuberculosis
augcggcccagccc

SEQ ID NO: 895600 - RNA, 15 nt, Mycobacterium avium subsp. paratuberculosis
augcgcccgcgccac

SEQ ID NO: 895601 - RNA, 18 nt, Mycobacterium avium subsp. paratuberculosis
augcgcccgcugcggcgc

SEQ ID NO: 895602 - RNA, 19 nt, Mycobacterium avium subsp. paratuberculosis
augcgcccgcugcggcgca

SEQ ID NO: 895603 - RNA, 13 nt, Mycobacterium avium subsp. paratuberculosis
augcgcccgguca

SEQ ID NO: 895604 - RNA, 14 nt, Mycobacterium avium subsp. paratuberculosis
augcgcaccaucac

SEQ ID NO: 895605 - RNA, 18 nt, Mycobacterium avium subsp. paratuberculosis
augcgccaccgacaccac

SEQ ID NO: 895606 - RNA, 19 nt, Mycobacterium avium subsp. paratuberculosis
augcgccaccgacaccacc

SEQ ID NO: 895607 - RNA, 20 nt, Mycobacterium avium subsp. paratuberculosis
augcgccaccgacaccaccg

SEQ ID NO: 895608 - RNA, 22 nt, Mycobacterium avium subsp. paratuberculosis
augcgccaccgacaccaccggc

SEQ ID NO: 895609 - RNA, 13 nt, Mycobacterium avium subsp. paratuberculosis
augcgcacccccg

SEQ ID NO: 895610 - RNA, 21 nt, Mycobacterium avium subsp. paratuberculosis
augcgcaccgcggcgugcgcc

SEQ ID NO: 895611 - RNA, 17 nt, Mycobacterium avium subsp. paratuberculosis
augcgcaagcaccggcu

SEQ ID NO: 895612 - RNA, 21 nt, Mycobacterium avium subsp. paratuberculosis
augcgcaagcaccggcuggcc

SEQ ID NO: 895613 - RNA, 16 nt, Mycobacterium avium subsp. paratuberculosis
augcgcaccacgcccg

SEQ ID NO: 895614 - RNA, 15 nt, Mycobacterium avium subsp. paratuberculosis
augcugcccggcgcc

SEQ ID NO: 895615 - RNA, 19 nt, Mycobacterium avium subsp. paratuberculosis
augcugcgggucagcagcu

SEQ ID NO: 895616 - RNA, 13 nt, Mycobacterium avium subsp. paratuberculosis
augcugauacccg

SEQ ID NO: 895617 - RNA, 20 nt, Mycobacterium avium subsp. paratuberculosis
augcugauacccgcgcggcg

SEQ ID NO: 895618 - RNA, 21 nt, Mycobacterium avium subsp. paratuberculosis
augcugauacccgcgcggcgc

SEQ ID NO: 895619 - RNA, 20 nt, Mycobacterium avium subsp. paratuberculosis
augcggugcugccgugccga

SEQ ID NO: 895620 - RNA, 14 nt, Mycobacterium avium subsp. paratuberculosis
augcgucaugccgg

SEQ ID NO: 895621 - RNA, 15 nt, Mycobacterium avium subsp. paratuberculosis
augcgucaugccgga

SEQ ID NO: 895622 - RNA, 17 nt, Mycobacterium avium subsp. paratuberculosis
augcgucaugccggaga

SEQ ID NO: 895623 - RNA, 15 nt, Mycobacterium avium subsp. paratuberculosis
augcggccggcgggc

SEQ ID NO: 895624 - RNA, 13 nt, Mycobacterium avium subsp. paratuberculosis
augcggccgucgg

SEQ ID NO: 895625 - RNA, 13 nt, Mycobacterium avium subsp. paratuberculosis
augcgggccaccg

SEQ ID NO: 895626 - RNA, 16 nt, Mycobacterium avium subsp. paratuberculosis
augcggcugccggcca

SEQ ID NO: 895627 - RNA, 17 nt, Mycobacterium avium subsp. paratuberculosis
augcggcugccggccaa

SEQ ID NO: 895628 - RNA, 18 nt, Mycobacterium avium subsp. paratuberculosis
augcgggcgauggcgggc

SEQ ID NO: 895629 - RNA, 13 nt, Mycobacterium avium subsp. paratuberculosis
augcgggcgccga

SEQ ID NO: 895630 - RNA, 22 nt, Mycobacterium avium subsp. paratuberculosis
augcggucgaugagcuggugca

SEQ ID NO: 895631 - RNA, 23 nt, Mycobacterium avium subsp. paratuberculosis
augcgguggucgaacacggcgcu

SEQ ID NO: 895632 - RNA, 16 nt, Mycobacterium avium subsp. paratuberculosis
augcggucgucgccca

SEQ ID NO: 895633 - RNA, 16 nt, Mycobacterium avium subsp. paratuberculosis
augcggugccgggcca

SEQ ID NO: 895634 - RNA, 14 nt, Mycobacterium avium subsp. paratuberculosis
augcggugccgggu

SEQ ID NO: 895635 - RNA, 23 nt, Mycobacterium avium subsp. paratuberculosis
augguguggaucgcuucggccag

SEQ ID NO: 895636 - RNA, 22 nt, Mycobacterium avium subsp. paratuberculosis
augguguuccaccagcggccgu

SEQ ID NO: 895637 - RNA, 16 nt, Mycobacterium avium subsp. paratuberculosis
augguggucgccgucg

SEQ ID NO: 895638 - RNA, 19 nt, Mycobacterium avium subsp. paratuberculosis
augggugaucgcggcccgc

SEQ ID NO: 895639 - RNA, 18 nt, Mycobacterium avium subsp. paratuberculosis
auggguggucaccguguu

SEQ ID NO: 895640 - RNA, 20 nt, Mycobacterium avium subsp. paratuberculosis
augggggugccgcagcggcg

SEQ ID NO: 895641 - RNA, 14 nt, Mycobacterium avium subsp. paratuberculosis
augggaucagcagc

SEQ ID NO: 895642 - RNA, 18 nt, Mycobacterium avium subsp. paratuberculosis
augggaucagcagcaccg

SEQ ID NO: 895643 - RNA, 14 nt, Mycobacterium avium subsp. paratuberculosis
auggcgaugccgga

SEQ ID NO: 895644 - RNA, 18 nt, Mycobacterium avium subsp. paratuberculosis
auggcgaugacgucgucg

SEQ ID NO: 895645 - RNA, 17 nt, Mycobacterium avium subsp. paratuberculosis
auggcgaucaccccggc

SEQ ID NO: 895646 - RNA, 21 nt, Mycobacterium avium subsp. paratuberculosis
auggcgaacacgucggccagc

SEQ ID NO: 895647 - RNA, 22 nt, Mycobacterium avium subsp. paratuberculosis
auggcgaaguagucggcguccg

SEQ ID NO: 895648 - RNA, 22 nt, Mycobacterium avium subsp. paratuberculosis
auggcgacggucugccgggaca

SEQ ID NO: 895649 - RNA, 20 nt, Mycobacterium avium subsp. paratuberculosis
auggcgaacauggucgccca

SEQ ID NO: 895650 - RNA, 19 nt, Mycobacterium avium subsp. paratuberculosis
auggcgaaccagcgcccgc

SEQ ID NO: 895651 - RNA, 18 nt, Mycobacterium avium subsp. paratuberculosis
augggcgcguuggccggc

SEQ ID NO: 895652 - RNA, 21 nt, Mycobacterium avium subsp. paratuberculosis
augggcugcgcgucgagcagc

SEQ ID NO: 895653 - RNA, 18 nt, Mycobacterium avium subsp. paratuberculosis
augggcugcgcgucgagc

SEQ ID NO: 895654 - RNA, 19 nt, Mycobacterium avium subsp. paratuberculosis
augggcugcgcgucgagca

SEQ ID NO: 895655 - RNA, 16 nt, Mycobacterium avium subsp. paratuberculosis
augggcucgaccacgc

SEQ ID NO: 895656 - RNA, 12 nt, Mycobacterium avium subsp. paratuberculosis
augggcucgagc

SEQ ID NO: 895657 - RNA, 15 nt, Mycobacterium avium subsp. paratuberculosis
auggggacgucgacg

SEQ ID NO: 895658 - RNA, 15 nt, Mycobacterium avium subsp. paratuberculosis
auggggcaguagcga

SEQ ID NO: 895659 - RNA, 11 nt, Mycobacterium avium subsp. paratuberculosis
augggcaucgu

SEQ ID NO: 895660 - RNA, 12 nt, Mycobacterium avium subsp. paratuberculosis
augggcagcgcc

SEQ ID NO: 895661 - RNA, 15 nt, Mycobacterium avium subsp. paratuberculosis
augggcccggcccgu

SEQ ID NO: 895662 - RNA, 19 nt, Mycobacterium avium subsp. paratuberculosis
auguggucggccacgacgc

SEQ ID NO: 895663 - RNA, 20 nt, Mycobacterium avium subsp. paratuberculosis
auguggucggccacgacgcg

SEQ ID NO: 895664 - RNA, 20 nt, Mycobacterium avium subsp. paratuberculosis
augugcuugaucagcgggcu

SEQ ID NO: 895665 - RNA, 16 nt, Mycobacterium avium subsp. paratuberculosis
auguggccgucgccga

SEQ ID NO: 895666 - RNA, 17 nt, Mycobacterium avium subsp. paratuberculosis
auguggggggucggagc

SEQ ID NO: 895667 - RNA, 17 nt, Mycobacterium avium subsp. paratuberculosis
augugguugcuggcguc

SEQ ID NO: 895668 - RNA, 22 nt, Mycobacterium avium subsp. paratuberculosis
augugcgcgcuggccgcgugca

SEQ ID NO: 895669 - RNA, 20 nt, Mycobacterium avium subsp. paratuberculosis
augugcucggucaacccgau

SEQ ID NO: 895670 - RNA, 17 nt, Mycobacterium avium subsp. paratuberculosis
augugaucggcggccac

SEQ ID NO: 895671 - RNA, 14 nt, Mycobacterium avium subsp. paratuberculosis
augugccugcgggc

SEQ ID NO: 895672 - RNA, 15 nt, Mycobacterium avium subsp. paratuberculosis
augugccugcgggcc

SEQ ID NO: 895673 - RNA, 16 nt, Mycobacterium avium subsp. paratuberculosis
augugccuggcccaga

SEQ ID NO: 895674 - RNA, 21 nt, Mycobacterium avium subsp. paratuberculosis
auguucaaucccguugcggug

SEQ ID NO: 895675 - RNA, 18 nt, Mycobacterium avium subsp. paratuberculosis
auguucaccccggcgcgg

SEQ ID NO: 895676 - RNA, 16 nt, Mycobacterium avium subsp. paratuberculosis
auguucaguucgucca

SEQ ID NO: 895677 - RNA, 16 nt, Mycobacterium avium subsp. paratuberculosis
auguucuccggcccgg

SEQ ID NO: 895678 - RNA, 19 nt, Mycobacterium avium subsp. paratuberculosis
augugacgcgggaccgggc

SEQ ID NO: 895679 - RNA, 23 nt, Mycobacterium avium subsp. paratuberculosis
augugacgcgggaccgggcccgg

SEQ ID NO: 895680 - RNA, 14 nt, Mycobacterium avium subsp. paratuberculosis
augucuagccgccg

SEQ ID NO: 895681 - RNA, 19 nt, Mycobacterium avium subsp. paratuberculosis
augucgugaccaaugcggu

SEQ ID NO: 895682 - RNA, 19 nt, Mycobacterium avium subsp. paratuberculosis
augucgugcggucgcacca

SEQ ID NO: 895683 - RNA, 13 nt, Mycobacterium avium subsp. paratuberculosis
augucgucgccgg

SEQ ID NO: 895684 - RNA, 15 nt, Mycobacterium avium subsp. paratuberculosis
augucgucgucgacg

SEQ ID NO: 895685 - RNA, 16 nt, Mycobacterium avium subsp. paratuberculosis
augucguacgggcgca

SEQ ID NO: 895686 - RNA, 15 nt, Mycobacterium avium subsp. paratuberculosis
augucguccucgguc

SEQ ID NO: 895687 - RNA, 15 nt, Mycobacterium avium subsp. paratuberculosis
augucggugagcgcc

SEQ ID NO: 895688 - RNA, 19 nt, Mycobacterium avium subsp. paratuberculosis
augucggugagcgccaccc

SEQ ID NO: 895689 - RNA, 20 nt, Mycobacterium avium subsp. paratuberculosis
augucggugagcgccacccc

SEQ ID NO: 895690 - RNA, 13 nt, Mycobacterium avium subsp. paratuberculosis
augucggugccga

SEQ ID NO: 895691 - RNA, 18 nt, Mycobacterium avium subsp. paratuberculosis
augucggugcggcgggcu

SEQ ID NO: 895692 - RNA, 19 nt, Mycobacterium avium subsp. paratuberculosis
augucgguggacagcgcga

SEQ ID NO: 895693 - RNA, 24 nt, Mycobacterium avium subsp. paratuberculosis
augucgguggccuuggccaccacg

SEQ ID NO: 895694 - RNA, 17 nt, Mycobacterium avium subsp. paratuberculosis
augucggugggccgcac

SEQ ID NO: 895695 - RNA, 22 nt, Mycobacterium avium subsp. paratuberculosis
augucacccguuugaggcgagc

SEQ ID NO: 895696 - RNA, 13 nt, Mycobacterium avium subsp. paratuberculosis
augucggccggca

SEQ ID NO: 895697 - RNA, 14 nt, Mycobacterium avium subsp. paratuberculosis
augucggccggcag

SEQ ID NO: 895698 - RNA, 16 nt, Mycobacterium avium subsp. paratuberculosis
augucggccgguccgu

SEQ ID NO: 895699 - RNA, 20 nt, Mycobacterium avium subsp. paratuberculosis
augucggccagcgcggcggc

SEQ ID NO: 895700 - RNA, 14 nt, Mycobacterium avium subsp. paratuberculosis
augucggcgacccg

SEQ ID NO: 895701 - RNA, 15 nt, Mycobacterium avium subsp. paratuberculosis
augucggcggcccgg

SEQ ID NO: 895702 - RNA, 13 nt, Mycobacterium avium subsp. paratuberculosis
augucggcggccg

SEQ ID NO: 895703 - RNA, 12 nt, Mycobacterium avium subsp. paratuberculosis
augucggcgggc

SEQ ID NO: 895704 - RNA, 17 nt, Mycobacterium avium subsp. paratuberculosis
augucggcgucgccgag

SEQ ID NO: 895705 - RNA, 16 nt, Mycobacterium avium subsp. paratuberculosis
augucggcguuggucc

SEQ ID NO: 895706 - RNA, 22 nt, Mycobacterium avium subsp. paratuberculosis
augucggcuucguacggcccgg

SEQ ID NO: 895707 - RNA, 15 nt, Mycobacterium avium subsp. paratuberculosis
caaacuccgggggau

SEQ ID NO: 895708 - RNA, 15 nt, Mycobacterium avium subsp. paratuberculosis
caaaccgcgucuugg

SEQ ID NO: 895709 - RNA, 13 nt, Mycobacterium avium subsp. paratuberculosis
caaacccgggaug

SEQ ID NO: 895710 - RNA, 13 nt, Mycobacterium avium subsp. paratuberculosis
caaaccggaccgc

SEQ ID NO: 895711 - RNA, 17 nt, Mycobacterium avium subsp. paratuberculosis
caaaccggaccgccgcg

SEQ ID NO: 895712 - RNA, 17 nt, Mycobacterium avium subsp. paratuberculosis
caaaccguugaccacca

SEQ ID NO: 895713 - RNA, 19 nt, Mycobacterium avium subsp. paratuberculosis
caaaccguugaccaccagg

SEQ ID NO: 895714 - RNA, 17 nt, Mycobacterium avium subsp. paratuberculosis
caaaccguuuucggcgc

SEQ ID NO: 895715 - RNA, 23 nt, Mycobacterium avium subsp. paratuberculosis
caaaccguuuucggcgcgcagcu

SEQ ID NO: 895716 - RNA, 19 nt, Mycobacterium avium subsp. paratuberculosis
caaagcggcuaagccggcg

SEQ ID NO: 895717 - RNA, 21 nt, Mycobacterium avium subsp. paratuberculosis
caaacccauugucgccgugcg

SEQ ID NO: 895718 - RNA, 18 nt, Mycobacterium avium subsp. paratuberculosis
caaacccagcaccaacag

SEQ ID NO: 895719 - RNA, 18 nt, Mycobacterium avium subsp. paratuberculosis
caaaccccuuggcgucca

SEQ ID NO: 895720 - RNA, 13 nt, Mycobacterium avium subsp. paratuberculosis
auuguucggccac

SEQ ID NO: 895721 - RNA, 16 nt, Mycobacterium avium subsp. paratuberculosis
caaauccagcagcgcg

SEQ ID NO: 895722 - RNA, 14 nt, Mycobacterium avium subsp. paratuberculosis
caaaucccgcagcu

SEQ ID NO: 895723 - RNA, 14 nt, Mycobacterium avium subsp. paratuberculosis
caaauccggcagcg

SEQ ID NO: 895724 - RNA, 23 nt, Mycobacterium avium subsp. paratuberculosis
caaauccggcagcgcucgucguc

SEQ ID NO: 895725 - RNA, 21 nt, Mycobacterium avium subsp. paratuberculosis
caaaucgcuugcgccgcagcg

SEQ ID NO: 895726 - RNA, 21 nt, Mycobacterium avium subsp. paratuberculosis
caacaacucgacguucggcgg

SEQ ID NO: 895727 - RNA, 16 nt, Mycobacterium avium subsp. paratuberculosis
caacaccaacgacagc

SEQ ID NO: 895728 - RNA, 18 nt, Mycobacterium avium subsp. paratuberculosis
caacaccaacgacagcga

SEQ ID NO: 895729 - RNA, 20 nt, Mycobacterium avium subsp. paratuberculosis
caacaccaacgacagcgacg

SEQ ID NO: 895730 - RNA, 13 nt, Mycobacterium avium subsp. paratuberculosis
caacaccacgucg

SEQ ID NO: 895731 - RNA, 21 nt, Mycobacterium avium subsp. paratuberculosis
caacaccagcuggauggcgcc

SEQ ID NO: 895732 - RNA, 17 nt, Mycobacterium avium subsp. paratuberculosis
caacacccuugcgccgc

SEQ ID NO: 895733 - RNA, 18 nt, Mycobacterium avium subsp. paratuberculosis
caacaccgaaagccgaca

SEQ ID NO: 895734 - RNA, 17 nt, Mycobacterium avium subsp. paratuberculosis
caacaccgccagcaccg

SEQ ID NO: 895735 - RNA, 14 nt, Mycobacterium avium subsp. paratuberculosis
caacaccggcacga

SEQ ID NO: 895736 - RNA, 11 nt, Mycobacterium avium subsp. paratuberculosis
caaccgcagca

SEQ ID NO: 895737 - RNA, 14 nt, Mycobacterium avium subsp. paratuberculosis
caaccgcauucggc

SEQ ID NO: 895738 - RNA, 16 nt, Mycobacterium avium subsp. paratuberculosis
caaccgccacgacgcg

SEQ ID NO: 895739 - RNA, 16 nt, Mycobacterium avium subsp. paratuberculosis
caaccgcccagcggcu

SEQ ID NO: 895740 - RNA, 13 nt, Mycobacterium avium subsp. paratuberculosis
caacccggacagc

SEQ ID NO: 895741 - RNA, 12 nt, Mycobacterium avium subsp. paratuberculosis
caacccggccgc

SEQ ID NO: 895742 - RNA, 15 nt, Mycobacterium avium subsp. paratuberculosis
caaccgagucgcugc

SEQ ID NO: 895743 - RNA, 18 nt, Mycobacterium avium subsp. paratuberculosis
caaccgagucgcugcagc

SEQ ID NO: 895744 - RNA, 21 nt, Mycobacterium avium subsp. paratuberculosis
caaccgauuucggccagccgg

SEQ ID NO: 895745 - RNA, 20 nt, Mycobacterium avium subsp. paratuberculosis
caaccgcugcugcugcccgc

SEQ ID NO: 895746 - RNA, 23 nt, Mycobacterium avium subsp. paratuberculosis
caaccgcuuugaauugagcgccg

SEQ ID NO: 895747 - RNA, 23 nt, Mycobacterium avium subsp. paratuberculosis
caaccggaauggcagcagccgga

SEQ ID NO: 895748 - RNA, 17 nt, Mycobacterium avium subsp. paratuberculosis
caaccgcccggcgccga

SEQ ID NO: 895749 - RNA, 20 nt, Mycobacterium avium subsp. paratuberculosis
caaccgcggcggcggcccgu

SEQ ID NO: 895750 - RNA, 15 nt, Mycobacterium avium subsp. paratuberculosis
caaccguucaacggc

SEQ ID NO: 895751 - RNA, 20 nt, Mycobacterium avium subsp. paratuberculosis
caaccgguccaguccggccg

SEQ ID NO: 895752 - RNA, 17 nt, Mycobacterium avium subsp. paratuberculosis
caaccgguccgccgucg

SEQ ID NO: 895753 - RNA, 15 nt, Mycobacterium avium subsp. paratuberculosis
caaccgucaguucgu

SEQ ID NO: 895754 - RNA, 14 nt, Mycobacterium avium subsp. paratuberculosis
caaccggccccgag

SEQ ID NO: 895755 - RNA, 16 nt, Mycobacterium avium subsp. paratuberculosis
caaccggccccgagcg

SEQ ID NO: 895756 - RNA, 23 nt, Mycobacterium avium subsp. paratuberculosis
caaccgggcaggcacggugucga

SEQ ID NO: 895757 - RNA, 23 nt, Mycobacterium avium subsp. paratuberculosis
caaccgggauaccgcgaccgccu

SEQ ID NO: 895758 - RNA, 19 nt, Mycobacterium avium subsp. paratuberculosis
caaccgggccgcacccccu

SEQ ID NO: 895759 - RNA, 21 nt, Mycobacterium avium subsp. paratuberculosis
caaccgguagaagaugcgccg

SEQ ID NO: 895760 - RNA, 16 nt, Mycobacterium avium subsp. paratuberculosis
caacacggccucgauc

SEQ ID NO: 895761 - RNA, 15 nt, Mycobacterium avium subsp. paratuberculosis
caacacgccggcggc

SEQ ID NO: 895762 - RNA, 12 nt, Mycobacterium avium subsp. paratuberculosis
caacaccggcgg

SEQ ID NO: 895763 - RNA, 18 nt, Mycobacterium avium subsp. paratuberculosis
caacaccggcggcgacgg

SEQ ID NO: 895764 - RNA, 23 nt, Mycobacterium avium subsp. paratuberculosis
caacaccgggauccggcgcgccg

SEQ ID NO: 895765 - RNA, 17 nt, Mycobacterium avium subsp. paratuberculosis
caacaccgguccggccg

SEQ ID NO: 895766 - RNA, 15 nt, Mycobacterium avium subsp. paratuberculosis
caacaccucggcgac

SEQ ID NO: 895767 - RNA, 17 nt, Mycobacterium avium subsp. paratuberculosis
caacaccucggcgacgu

SEQ ID NO: 895768 - RNA, 13 nt, Mycobacterium avium subsp. paratuberculosis
caacaccucgggc

SEQ ID NO: 895769 - RNA, 15 nt, Mycobacterium avium subsp. paratuberculosis
caacaugucccgggc

SEQ ID NO: 895770 - RNA, 16 nt, Mycobacterium avium subsp. paratuberculosis
caacacggcggcgcgc

SEQ ID NO: 895771 - RNA, 22 nt, Mycobacterium avium subsp. paratuberculosis
caacacggcggcgcgcacguca

SEQ ID NO: 895772 - RNA, 16 nt, Mycobacterium avium subsp. paratuberculosis
caacacguagucgccg

SEQ ID NO: 895773 - RNA, 19 nt, Mycobacterium avium subsp. paratuberculosis
caacacguagucgccgaug

SEQ ID NO: 895774 - RNA, 16 nt, Mycobacterium avium subsp. paratuberculosis
caaccccgcgcgcggg

SEQ ID NO: 895775 - RNA, 15 nt, Mycobacterium avium subsp. paratuberculosis
caaccccgggcggcu

SEQ ID NO: 895776 - RNA, 17 nt, Mycobacterium avium subsp. paratuberculosis
caacccgaaagccccca

SEQ ID NO: 895777 - RNA, 17 nt, Mycobacterium avium subsp. paratuberculosis
caacccgaccucgucga

SEQ ID NO: 895778 - RNA, 14 nt, Mycobacterium avium subsp. paratuberculosis
caacccgagcaccg

SEQ ID NO: 895779 - RNA, 15 nt, Mycobacterium avium subsp. paratuberculosis
caaccacaccagcau

SEQ ID NO: 895780 - RNA, 19 nt, Mycobacterium avium subsp. paratuberculosis
caaccacagcggcgcauga

SEQ ID NO: 895781 - RNA, 13 nt, Mycobacterium avium subsp. paratuberculosis
caaccaacucgcg

SEQ ID NO: 895782 - RNA, 20 nt, Mycobacterium avium subsp. paratuberculosis
caaccaccguggccccagcc

SEQ ID NO: 895783 - RNA, 14 nt, Mycobacterium avium subsp. paratuberculosis
caacuacccgccga

SEQ ID NO: 895784 - RNA, 21 nt, Mycobacterium avium subsp. paratuberculosis
caacuacccgccgacgccugc

SEQ ID NO: 895785 - RNA, 15 nt, Mycobacterium avium subsp. paratuberculosis
caacuccaccgcccg

SEQ ID NO: 895786 - RNA, 22 nt, Mycobacterium avium subsp. paratuberculosis
caacucacuaucgacaacacga

SEQ ID NO: 895787 - RNA, 18 nt, Mycobacterium avium subsp. paratuberculosis
caacucaguccucgccga

SEQ ID NO: 895788 - RNA, 17 nt, Mycobacterium avium subsp. paratuberculosis
caacguguacucggcgu

SEQ ID NO: 895789 - RNA, 19 nt, Mycobacterium avium subsp. paratuberculosis
caacguguacucggcgucg

SEQ ID NO: 895790 - RNA, 22 nt, Mycobacterium avium subsp. paratuberculosis
caacgugucgagcacgucgacg

SEQ ID NO: 895791 - RNA, 15 nt, Mycobacterium avium subsp. paratuberculosis
caacgugcgccggcc

SEQ ID NO: 895792 - RNA, 15 nt, Mycobacterium avium subsp. paratuberculosis
caacgugauacgccg

SEQ ID NO: 895793 - RNA, 17 nt, Mycobacterium avium subsp. paratuberculosis
caacgugaugagcgcgu

SEQ ID NO: 895794 - RNA, 23 nt, Mycobacterium avium subsp. paratuberculosis
caacgugaugccguggucggcga

SEQ ID NO: 895795 - RNA, 16 nt, Mycobacterium avium subsp. paratuberculosis
caacgugccacaggcc

SEQ ID NO: 895796 - RNA, 20 nt, Mycobacterium avium subsp. paratuberculosis
caacgugccacaggccgaac

SEQ ID NO: 895797 - RNA, 23 nt, Mycobacterium avium subsp. paratuberculosis
caacgugccacaggccgaacagc

SEQ ID NO: 895798 - RNA, 22 nt, Mycobacterium avium subsp. paratuberculosis
caacggcgucgacacccgggcg

SEQ ID NO: 895799 - RNA, 13 nt, Mycobacterium avium subsp. paratuberculosis
caacggcggcggc

SEQ ID NO: 895800 - RNA, 15 nt, Mycobacterium avium subsp. paratuberculosis
caacggcggcggcac

SEQ ID NO: 895801 - RNA, 22 nt, Mycobacterium avium subsp. paratuberculosis
caacggcggcggcggcagguug

SEQ ID NO: 895802 - RNA, 16 nt, Mycobacterium avium subsp. paratuberculosis
caacggcucgccgcgc

SEQ ID NO: 895803 - RNA, 17 nt, Mycobacterium avium subsp. paratuberculosis
caacggcucgccgcgca

SEQ ID NO: 895804 - RNA, 22 nt, Mycobacterium avium subsp. paratuberculosis
caacggcucggucaagccggcc

SEQ ID NO: 895805 - RNA, 19 nt, Mycobacterium avium subsp. paratuberculosis
caacggcggucgugcggcu

SEQ ID NO: 895806 - RNA, 15 nt, Mycobacterium avium subsp. paratuberculosis
caacgacgucggcgu

SEQ ID NO: 895807 - RNA, 16 nt, Mycobacterium avium subsp. paratuberculosis
caacgacgucggcguc

SEQ ID NO: 895808 - RNA, 20 nt, Mycobacterium avium subsp. paratuberculosis
caacgacgucggcgucaucg

SEQ ID NO: 895809 - RNA, 17 nt, Mycobacterium avium subsp. paratuberculosis
caaccugggcggcggcg

SEQ ID NO: 895810 - RNA, 20 nt, Mycobacterium avium subsp. paratuberculosis
caaccugggcggcggcggga

SEQ ID NO: 895811 - RNA, 19 nt, Mycobacterium avium subsp. paratuberculosis
caacgacucauucgacucc

SEQ ID NO: 895812 - RNA, 22 nt, Mycobacterium avium subsp. paratuberculosis
caacgagacacccucgcgcagg

SEQ ID NO: 895813 - RNA, 19 nt, Mycobacterium avium subsp. paratuberculosis
caacgaggccagggcccgc

SEQ ID NO: 895814 - RNA, 16 nt, Mycobacterium avium subsp. paratuberculosis
caacgaggcccggacg

SEQ ID NO: 895815 - RNA, 22 nt, Mycobacterium avium subsp. paratuberculosis
caacgaggcccggacggccacc

SEQ ID NO: 895816 - RNA, 14 nt, Mycobacterium avium subsp. paratuberculosis
caacgagcgcgccg

SEQ ID NO: 895817 - RNA, 14 nt, Mycobacterium avium subsp. paratuberculosis
caacgcgucgaaca

SEQ ID NO: 895818 - RNA, 23 nt, Mycobacterium avium subsp. paratuberculosis
caacgcgucgaacagccgggccg

SEQ ID NO: 895819 - RNA, 14 nt, Mycobacterium avium subsp. paratuberculosis
caacgcgucggcgc

SEQ ID NO: 895820 - RNA, 16 nt, Mycobacterium avium subsp. paratuberculosis
caacgcgucggcgccg

SEQ ID NO: 895821 - RNA, 23 nt, Mycobacterium avium subsp. paratuberculosis
caacgauuuccgguuccucggcg

SEQ ID NO: 895822 - RNA, 18 nt, Mycobacterium avium subsp. paratuberculosis
caacgcggugaccgcggc

SEQ ID NO: 895823 - RNA, 19 nt, Mycobacterium avium subsp. paratuberculosis
caacgcggugaccgcggcc

SEQ ID NO: 895824 - RNA, 20 nt, Mycobacterium avium subsp. paratuberculosis
caacgcggugaccgcggccu

SEQ ID NO: 895825 - RNA, 13 nt, Mycobacterium avium subsp. paratuberculosis
caacggcggaccg

SEQ ID NO: 895826 - RNA, 14 nt, Mycobacterium avium subsp. paratuberculosis
caacggcggaccgg

SEQ ID NO: 895827 - RNA, 17 nt, Mycobacterium avium subsp. paratuberculosis
caacggcggaccggcgg

SEQ ID NO: 895828 - RNA, 18 nt, Mycobacterium avium subsp. paratuberculosis
caacggcggaccggcggc

SEQ ID NO: 895829 - RNA, 20 nt, Mycobacterium avium subsp. paratuberculosis
caacggcggaccggcggccg

SEQ ID NO: 895830 - RNA, 23 nt, Mycobacterium avium subsp. paratuberculosis
caacggcggaccggcggccgcca

SEQ ID NO: 895831 - RNA, 23 nt, Mycobacterium avium subsp. paratuberculosis
caagcgauuacacaucaggaucg

SEQ ID NO: 895832 - RNA, 15 nt, Mycobacterium avium subsp. paratuberculosis
caagcgcgacaagca

SEQ ID NO: 895833 - RNA, 13 nt, Mycobacterium avium subsp. paratuberculosis
caacuccggcggc

SEQ ID NO: 895834 - RNA, 14 nt, Mycobacterium avium subsp. paratuberculosis
caacucccgcgccg

SEQ ID NO: 895835 - RNA, 19 nt, Mycobacterium avium subsp. paratuberculosis
caacucgaccugcccgggc

SEQ ID NO: 895836 - RNA, 18 nt, Mycobacterium avium subsp. paratuberculosis
caacucgacgcucggcga

SEQ ID NO: 895837 - RNA, 20 nt, Mycobacterium avium subsp. paratuberculosis
caacucgacguucggcgggc

SEQ ID NO: 895838 - RNA, 18 nt, Mycobacterium avium subsp. paratuberculosis
caacucaugggcccggcc

SEQ ID NO: 895839 - RNA, 16 nt, Mycobacterium avium subsp. paratuberculosis
caacucgccggagcgc

SEQ ID NO: 895840 - RNA, 17 nt, Mycobacterium avium subsp. paratuberculosis
caacucgccggagcgcc

SEQ ID NO: 895841 - RNA, 12 nt, Mycobacterium avium subsp. paratuberculosis
caacucgcgaug

SEQ ID NO: 895842 - RNA, 20 nt, Mycobacterium avium subsp. paratuberculosis
caacucgcgcucccggcgcc

SEQ ID NO: 895843 - RNA, 22 nt, Mycobacterium avium subsp. paratuberculosis
caacucgcgcucccggcgccgc

SEQ ID NO: 895844 - RNA, 17 nt, Mycobacterium avium subsp. paratuberculosis
caagccggcgucgauga

SEQ ID NO: 895845 - RNA, 18 nt, Mycobacterium avium subsp. paratuberculosis
caagggccaccgggccga

SEQ ID NO: 895846 - RNA, 19 nt, Mycobacterium avium subsp. paratuberculosis
caaggcggacaacgggaua

SEQ ID NO: 895847 - RNA, 22 nt, Mycobacterium avium subsp. paratuberculosis
caaggccuuggugugagggcgu

SEQ ID NO: 895848 - RNA, 13 nt, Mycobacterium avium subsp. paratuberculosis
caaggcgaugccc

SEQ ID NO: 895849 - RNA, 17 nt, Mycobacterium avium subsp. paratuberculosis
caaggagaaggccgcgc

SEQ ID NO: 895850 - RNA, 19 nt, Mycobacterium avium subsp. paratuberculosis
caaguagacucagcgucga

SEQ ID NO: 895851 - RNA, 17 nt, Mycobacterium avium subsp. paratuberculosis
caagugcaagggcgaca

SEQ ID NO: 895852 - RNA, 15 nt, Mycobacterium avium subsp. paratuberculosis
caagugcgguguggc

SEQ ID NO: 895853 - RNA, 23 nt, Mycobacterium avium subsp. paratuberculosis
caagugcgguguggccgcggugg

SEQ ID NO: 895854 - RNA, 20 nt, Mycobacterium avium subsp. paratuberculosis
caaguccucgguggccaccu

SEQ ID NO: 895855 - RNA, 21 nt, Mycobacterium avium subsp. paratuberculosis
caagucgucggugggccgccg

SEQ ID NO: 895856 - RNA, 15 nt, Mycobacterium avium subsp. paratuberculosis
caauacggcccggcg

SEQ ID NO: 895857 - RNA, 16 nt, Mycobacterium avium subsp. paratuberculosis
caauacggcccggcga

SEQ ID NO: 895858 - RNA, 19 nt, Mycobacterium avium subsp. paratuberculosis
caauacggugcccgccgcg

SEQ ID NO: 895859 - RNA, 22 nt, Mycobacterium avium subsp. paratuberculosis
caaucuucuccgcggccgcgcg

SEQ ID NO: 895860 - RNA, 20 nt, Mycobacterium avium subsp. paratuberculosis
caaugcccucguagcggccg

SEQ ID NO: 895861 - RNA, 17 nt, Mycobacterium avium subsp. paratuberculosis
caaugccgcagccgauc

SEQ ID NO: 895862 - RNA, 20 nt, Mycobacterium avium subsp. paratuberculosis
caaugccgcagccgaucucg

SEQ ID NO: 895863 - RNA, 16 nt, Mycobacterium avium subsp. paratuberculosis
caaugccggaucggga

SEQ ID NO: 895864 - RNA, 21 nt, Mycobacterium avium subsp. paratuberculosis
caaucucgggcaccccugccg

SEQ ID NO: 895865 - RNA, 22 nt, Mycobacterium avium subsp. paratuberculosis
caaucucgggcaccccugccgc

SEQ ID NO: 895866 - RNA, 17 nt, Mycobacterium avium subsp. paratuberculosis
caaucucgucggggcgc

SEQ ID NO: 895867 - RNA, 18 nt, Mycobacterium avium subsp. paratuberculosis
caaucgcugcgagcccgg

SEQ ID NO: 895868 - RNA, 20 nt, Mycobacterium avium subsp. paratuberculosis
caaucgcugcgagcccggcc

SEQ ID NO: 895869 - RNA, 20 nt, Mycobacterium avium subsp. paratuberculosis
caaucgggacgccacggcga

SEQ ID NO: 895870 - RNA, 13 nt, Mycobacterium avium subsp. paratuberculosis
caaucggcgccgg

SEQ ID NO: 895871 - RNA, 14 nt, Mycobacterium avium subsp. paratuberculosis
caaucggcgccggc

SEQ ID NO: 895872 - RNA, 14 nt, Mycobacterium avium subsp. paratuberculosis
caaucaccgcggug

SEQ ID NO: 895873 - RNA, 18 nt, Mycobacterium avium subsp. paratuberculosis
caauccugcccggucugc

SEQ ID NO: 895874 - RNA, 13 nt, Mycobacterium avium subsp. paratuberculosis
caauccggccccg

SEQ ID NO: 895875 - RNA, 23 nt, Mycobacterium avium subsp. paratuberculosis
caauccggccccgcugccguccg

SEQ ID NO: 895876 - RNA, 19 nt, Mycobacterium avium subsp. paratuberculosis
caaucccguugcggugacg

SEQ ID NO: 895877 - RNA, 20 nt, Mycobacterium avium subsp. paratuberculosis
cacaagggccaccgggccga

SEQ ID NO: 895878 - RNA, 21 nt, Mycobacterium avium subsp. paratuberculosis
cacaauccggucagcguggcg

SEQ ID NO: 895879 - RNA, 14 nt, Mycobacterium avium subsp. paratuberculosis
cacaacgccuccga

SEQ ID NO: 895880 - RNA, 21 nt, Mycobacterium avium subsp. paratuberculosis
caauugacguaaccguccagu

SEQ ID NO: 895881 - RNA, 23 nt, Mycobacterium avium subsp. paratuberculosis
cacaauggauccgaucagcagca

SEQ ID NO: 895882 - RNA, 12 nt, Mycobacterium avium subsp. paratuberculosis
cacaccccggcc

SEQ ID NO: 895883 - RNA, 15 nt, Mycobacterium avium subsp. paratuberculosis
cacacccgcacgcug

SEQ ID NO: 895884 - RNA, 17 nt, Mycobacterium avium subsp. paratuberculosis
cacaccgccgcggcggu

SEQ ID NO: 895885 - RNA, 14 nt, Mycobacterium avium subsp. paratuberculosis
cacaccgccggcca

SEQ ID NO: 895886 - RNA, 14 nt, Mycobacterium avium subsp. paratuberculosis
cacaccgccggcgc

SEQ ID NO: 895887 - RNA, 15 nt, Mycobacterium avium subsp. paratuberculosis
cacaccgccggcgcg

SEQ ID NO: 895888 - RNA, 20 nt, Mycobacterium avium subsp. paratuberculosis
cacaccgccggcgcggacgg

SEQ ID NO: 895889 - RNA, 13 nt, Mycobacterium avium subsp. paratuberculosis
cacaccgcgcaga

SEQ ID NO: 895890 - RNA, 13 nt, Mycobacterium avium subsp. paratuberculosis
cacaccgcgcgca

SEQ ID NO: 895891 - RNA, 18 nt, Mycobacterium avium subsp. paratuberculosis
cacaccgcggccagcgcg

SEQ ID NO: 895892 - RNA, 21 nt, Mycobacterium avium subsp. paratuberculosis
cacaccgcggccagcgcgcgg

SEQ ID NO: 895893 - RNA, 23 nt, Mycobacterium avium subsp. paratuberculosis
cacaccgcggccagcgcgcgggc

SEQ ID NO: 895894 - RNA, 20 nt, Mycobacterium avium subsp. paratuberculosis
cacacccgucgacucggcgg

SEQ ID NO: 895895 - RNA, 13 nt, Mycobacterium avium subsp. paratuberculosis
cacacccucggcc

SEQ ID NO: 895896 - RNA, 14 nt, Mycobacterium avium subsp. paratuberculosis
cacacccucggccc

SEQ ID NO: 895897 - RNA, 17 nt, Mycobacterium avium subsp. paratuberculosis
cacacccuugucgguga

SEQ ID NO: 895898 - RNA, 13 nt, Mycobacterium avium subsp. paratuberculosis
cacacccgcggcc

SEQ ID NO: 895899 - RNA, 14 nt, Mycobacterium avium subsp. paratuberculosis
cacacccgcggccg

SEQ ID NO: 895900 - RNA, 22 nt, Mycobacterium avium subsp. paratuberculosis
cacacccgcggccgcugcgccc

SEQ ID NO: 895901 - RNA, 16 nt, Mycobacterium avium subsp. paratuberculosis
cacaccgcggcggcgu

SEQ ID NO: 895902 - RNA, 13 nt, Mycobacterium avium subsp. paratuberculosis
cacaccgcugagg

SEQ ID NO: 895903 - RNA, 13 nt, Mycobacterium avium subsp. paratuberculosis
cacaccggccuuc

SEQ ID NO: 895904 - RNA, 13 nt, Mycobacterium avium subsp. paratuberculosis
cacaccggcgcug

SEQ ID NO: 895905 - RNA, 18 nt, Mycobacterium avium subsp. paratuberculosis
cacaccggcgcugcccgc

SEQ ID NO: 895906 - RNA, 22 nt, Mycobacterium avium subsp. paratuberculosis
cacaccggcgcugcccgcgauc

SEQ ID NO: 895907 - RNA, 18 nt, Mycobacterium avium subsp. paratuberculosis
cacaacccggacagcgcg

SEQ ID NO: 895908 - RNA, 14 nt, Mycobacterium avium subsp. paratuberculosis
caaugucacggcgg

SEQ ID NO: 895909 - RNA, 16 nt, Mycobacterium avium subsp. paratuberculosis
caaugguguagcucag

SEQ ID NO: 895910 - RNA, 20 nt, Mycobacterium avium subsp. paratuberculosis
caaugguugcggcgggccgc

SEQ ID NO: 895911 - RNA, 22 nt, Mycobacterium avium subsp. paratuberculosis
caaugguuuucgucgaucagca

SEQ ID NO: 895912 - RNA, 22 nt, Mycobacterium avium subsp. paratuberculosis
caccucaccugcguugcggcac

SEQ ID NO: 895913 - RNA, 15 nt, Mycobacterium avium subsp. paratuberculosis
caccguucccaccgg

SEQ ID NO: 895914 - RNA, 18 nt, Mycobacterium avium subsp. paratuberculosis
caccguguucaccagcgg

SEQ ID NO: 895915 - RNA, 17 nt, Mycobacterium avium subsp. paratuberculosis
caccguguuggugacga

SEQ ID NO: 895916 - RNA, 18 nt, Mycobacterium avium subsp. paratuberculosis
caccguucggggggcacg

SEQ ID NO: 895917 - RNA, 21 nt, Mycobacterium avium subsp. paratuberculosis
caccguucggggggcacgucc

SEQ ID NO: 895918 - RNA, 22 nt, Mycobacterium avium subsp. paratuberculosis
caccguugggggucgacugggc

SEQ ID NO: 895919 - RNA, 17 nt, Mycobacterium avium subsp. paratuberculosis
caccguugucucggcgc

SEQ ID NO: 895920 - RNA, 19 nt, Mycobacterium avium subsp. paratuberculosis
caccguugucucggcgccg

SEQ ID NO: 895921 - RNA, 22 nt, Mycobacterium avium subsp. paratuberculosis
caccguugucucggcgccgucg

SEQ ID NO: 895922 - RNA, 16 nt, Mycobacterium avium subsp. paratuberculosis
caccgugucggcgggc

SEQ ID NO: 895923 - RNA, 17 nt, Mycobacterium avium subsp. paratuberculosis
caccgugucgucgcuga

SEQ ID NO: 895924 - RNA, 14 nt, Mycobacterium avium subsp. paratuberculosis
caccguggucggca

SEQ ID NO: 895925 - RNA, 17 nt, Mycobacterium avium subsp. paratuberculosis
caccguggucggcagca

SEQ ID NO: 895926 - RNA, 22 nt, Mycobacterium avium subsp. paratuberculosis
caccguggucggcagcaccggc

SEQ ID NO: 895927 - RNA, 17 nt, Mycobacterium avium subsp. paratuberculosis
caccgugguggacaacu

SEQ ID NO: 895928 - RNA, 14 nt, Mycobacterium avium subsp. paratuberculosis
caccguggcggggg

SEQ ID NO: 895929 - RNA, 21 nt, Mycobacterium avium subsp. paratuberculosis
caccguggugugcccgcgggc

SEQ ID NO: 895930 - RNA, 19 nt, Mycobacterium avium subsp. paratuberculosis
caccguguagccgaccgac

SEQ ID NO: 895931 - RNA, 20 nt, Mycobacterium avium subsp. paratuberculosis
caccguguagccgaccgacc

SEQ ID NO: 895932 - RNA, 15 nt, Mycobacterium avium subsp. paratuberculosis
caccgugcgggucgc

SEQ ID NO: 895933 - RNA, 20 nt, Mycobacterium avium subsp. paratuberculosis
caccgugcgggucgcgcugc

SEQ ID NO: 895934 - RNA, 21 nt, Mycobacterium avium subsp. paratuberculosis
caccgugcgggucgcgcugcg

SEQ ID NO: 895935 - RNA, 23 nt, Mycobacterium avium subsp. paratuberculosis
caccgugcgggucgcgcugcggg

SEQ ID NO: 895936 - RNA, 21 nt, Mycobacterium avium subsp. paratuberculosis
caccgugcuggccaccacggg

SEQ ID NO: 895937 - RNA, 19 nt, Mycobacterium avium subsp. paratuberculosis
caccguggagacguccgag

SEQ ID NO: 895938 - RNA, 17 nt, Mycobacterium avium subsp. paratuberculosis
caccgugggcggcgcga

SEQ ID NO: 895939 - RNA, 23 nt, Mycobacterium avium subsp. paratuberculosis
caccgugggcggcgcgaucgucg

SEQ ID NO: 895940 - RNA, 20 nt, Mycobacterium avium subsp. paratuberculosis
caccguggccccacgggcca

SEQ ID NO: 895941 - RNA, 15 nt, Mycobacterium avium subsp. paratuberculosis
caccguggccccagc

SEQ ID NO: 895942 - RNA, 23 nt, Mycobacterium avium subsp. paratuberculosis
caccguggccccagccaccgugg

SEQ ID NO: 895943 - RNA, 15 nt, Mycobacterium avium subsp. paratuberculosis
caccguccuuguagg

SEQ ID NO: 895944 - RNA, 19 nt, Mycobacterium avium subsp. paratuberculosis
caccguccuuguaggugau

SEQ ID NO: 895945 - RNA, 18 nt, Mycobacterium avium subsp. paratuberculosis
caccgucgaagagugcga

SEQ ID NO: 895946 - RNA, 13 nt, Mycobacterium avium subsp. paratuberculosis
caccgucgacgac

SEQ ID NO: 895947 - RNA, 14 nt, Mycobacterium avium subsp. paratuberculosis
caccguccagcuca

SEQ ID NO: 895948 - RNA, 21 nt, Mycobacterium avium subsp. paratuberculosis
caccgucccggugucgccguc

SEQ ID NO: 895949 - RNA, 22 nt, Mycobacterium avium subsp. paratuberculosis
caccgucccggugucgccgucg

SEQ ID NO: 895950 - RNA, 13 nt, Mycobacterium avium subsp. paratuberculosis
caccgucaucgcg

SEQ ID NO: 895951 - RNA, 17 nt, Mycobacterium avium subsp. paratuberculosis
caccgucaucgcggcga

SEQ ID NO: 895952 - RNA, 21 nt, Mycobacterium avium subsp. paratuberculosis
caccgucaucucggugguggc

SEQ ID NO: 895953 - RNA, 21 nt, Mycobacterium avium subsp. paratuberculosis
caccgucagggugacguggcg

SEQ ID NO: 895954 - RNA, 14 nt, Mycobacterium avium subsp. paratuberculosis
caccgucagggugg

SEQ ID NO: 895955 - RNA, 23 nt, Mycobacterium avium subsp. paratuberculosis
caccgucaggguggugcccccgc

SEQ ID NO: 895956 - RNA, 13 nt, Mycobacterium avium subsp. paratuberculosis
caccgucaccgac

SEQ ID NO: 895957 - RNA, 13 nt, Mycobacterium avium subsp. paratuberculosis
caccgucggcgug

SEQ ID NO: 895958 - RNA, 21 nt, Mycobacterium avium subsp. paratuberculosis
caccgucguccacgcccagcg

SEQ ID NO: 895959 - RNA, 17 nt, Mycobacterium avium subsp. paratuberculosis
caccgucgugccagcgc

SEQ ID NO: 895960 - RNA, 18 nt, Mycobacterium avium subsp. paratuberculosis
caccgucgugccagcgca

SEQ ID NO: 895961 - RNA, 14 nt, Mycobacterium avium subsp. paratuberculosis
caccgucgacgacg

SEQ ID NO: 895962 - RNA, 15 nt, Mycobacterium avium subsp. paratuberculosis
caccgucgacgacga

SEQ ID NO: 895963 - RNA, 22 nt, Mycobacterium avium subsp. paratuberculosis
caccgucgacgacgaaucccgc

SEQ ID NO: 895964 - RNA, 16 nt, Mycobacterium avium subsp. paratuberculosis
caccgucgcccgccca

SEQ ID NO: 895965 - RNA, 22 nt, Mycobacterium avium subsp. paratuberculosis
caccgucgcccgcccaggccgc

SEQ ID NO: 895966 - RNA, 15 nt, Mycobacterium avium subsp. paratuberculosis
caccgucgccggcgg

SEQ ID NO: 895967 - RNA, 16 nt, Mycobacterium avium subsp. paratuberculosis
caccgucgccggcggg

SEQ ID NO: 895968 - RNA, 13 nt, Mycobacterium avium subsp. paratuberculosis
caccgucgccgug

SEQ ID NO: 895969 - RNA, 14 nt, Mycobacterium avium subsp. paratuberculosis
caccgucgccguga

SEQ ID NO: 895970 - RNA, 20 nt, Mycobacterium avium subsp. paratuberculosis
caccgucgccgugaucuggu

SEQ ID NO: 895971 - RNA, 20 nt, Mycobacterium avium subsp. paratuberculosis
caccgucgcgcacccagacg

SEQ ID NO: 895972 - RNA, 23 nt, Mycobacterium avium subsp. paratuberculosis
caccgucuuggucucgccgaucu

SEQ ID NO: 895973 - RNA, 13 nt, Mycobacterium avium subsp. paratuberculosis
caccgucggcgau

SEQ ID NO: 895974 - RNA, 17 nt, Mycobacterium avium subsp. paratuberculosis
caccgucucccacgaac

SEQ ID NO: 895975 - RNA, 23 nt, Mycobacterium avium subsp. paratuberculosis
caccgucugcgccgucaccggcu

SEQ ID NO: 895976 - RNA, 23 nt, Mycobacterium avium subsp. paratuberculosis
caccgugaguucgcugaccgcca

SEQ ID NO: 895977 - RNA, 16 nt, Mycobacterium avium subsp. paratuberculosis
caccgugaucgccacc

SEQ ID NO: 895978 - RNA, 17 nt, Mycobacterium avium subsp. paratuberculosis
caccgugaucgccacca

SEQ ID NO: 895979 - RNA, 15 nt, Mycobacterium avium subsp. paratuberculosis
caccgugcgcgcgca

SEQ ID NO: 895980 - RNA, 16 nt, Mycobacterium avium subsp. paratuberculosis
caccgugcgcgcgcac

SEQ ID NO: 895981 - RNA, 12 nt, Mycobacterium avium subsp. paratuberculosis
caccgugccgcc

SEQ ID NO: 895982 - RNA, 16 nt, Mycobacterium avium subsp. paratuberculosis
caccgugccgcccguc

SEQ ID NO: 895983 - RNA, 17 nt, Mycobacterium avium subsp. paratuberculosis
caccgugccgcccgucg

SEQ ID NO: 895984 - RNA, 18 nt, Mycobacterium avium subsp. paratuberculosis
caccgugccgcccgucgc

SEQ ID NO: 895985 - RNA, 21 nt, Mycobacterium avium subsp. paratuberculosis
caccgugccgcccgucgccuc

SEQ ID NO: 895986 - RNA, 13 nt, Mycobacterium avium subsp. paratuberculosis
caccgugccgcgc

SEQ ID NO: 895987 - RNA, 14 nt, Mycobacterium avium subsp. paratuberculosis
caccgugccgcgcg

SEQ ID NO: 895988 - RNA, 15 nt, Mycobacterium avium subsp. paratuberculosis
caccgugccgcgcgg

SEQ ID NO: 895989 - RNA, 16 nt, Mycobacterium avium subsp. paratuberculosis
caccgugccgcgcggc

SEQ ID NO: 895990 - RNA, 17 nt, Mycobacterium avium subsp. paratuberculosis
caccgugccgcgcggcg

SEQ ID NO: 895991 - RNA, 20 nt, Mycobacterium avium subsp. paratuberculosis
caccgugccgcgcggcggug

SEQ ID NO: 895992 - RNA, 13 nt, Mycobacterium avium subsp. paratuberculosis
caccgugccguca

SEQ ID NO: 895993 - RNA, 15 nt, Mycobacterium avium subsp. paratuberculosis
caccgugccgucgcu

SEQ ID NO: 895994 - RNA, 16 nt, Mycobacterium avium subsp. paratuberculosis
caccgugccgucggcg

SEQ ID NO: 895995 - RNA, 17 nt, Mycobacterium avium subsp. paratuberculosis
caccgugccgucggcgu

SEQ ID NO: 895996 - RNA, 19 nt, Mycobacterium avium subsp. paratuberculosis
caccgugccgucggcgucg

SEQ ID NO: 895997 - RNA, 16 nt, Mycobacterium avium subsp. paratuberculosis
caccgggcucggucac

SEQ ID NO: 895998 - RNA, 15 nt, Mycobacterium avium subsp. paratuberculosis
caccgggugcgucca

SEQ ID NO: 895999 - RNA, 17 nt, Mycobacterium avium subsp. paratuberculosis
caccgggugggccgacc

SEQ ID NO: 896000 - RNA, 14 nt, Mycobacterium avium subsp. paratuberculosis
caccgguccggccg

SEQ ID NO: 896001 - RNA, 15 nt, Mycobacterium avium subsp. paratuberculosis
caccgguccggccgu

SEQ ID NO: 896002 - RNA, 17 nt, Mycobacterium avium subsp. paratuberculosis
caccgguccggccgugc

SEQ ID NO: 896003 - RNA, 20 nt, Mycobacterium avium subsp. paratuberculosis
caccgguccggucacgcccg

SEQ ID NO: 896004 - RNA, 15 nt, Mycobacterium avium subsp. paratuberculosis
caccggucgacgacg

SEQ ID NO: 896005 - RNA, 18 nt, Mycobacterium avium subsp. paratuberculosis
caccggucgacgacgaac

SEQ ID NO: 896006 - RNA, 23 nt, Mycobacterium avium subsp. paratuberculosis
caccggggccaacuccggcggca

SEQ ID NO: 896007 - RNA, 14 nt, Mycobacterium avium subsp. paratuberculosis
caccggggccggcg

SEQ ID NO: 896008 - RNA, 15 nt, Mycobacterium avium subsp. paratuberculosis
caccggggccggcgg

SEQ ID NO: 896009 - RNA, 13 nt, Mycobacterium avium subsp. paratuberculosis
caccggggugccg

SEQ ID NO: 896010 - RNA, 15 nt, Mycobacterium avium subsp. paratuberculosis
caccggggugccgcc

SEQ ID NO: 896011 - RNA, 16 nt, Mycobacterium avium subsp. paratuberculosis
caccggggugccgccc

SEQ ID NO: 896012 - RNA, 17 nt, Mycobacterium avium subsp. paratuberculosis
caccggguacaccggcu

SEQ ID NO: 896013 - RNA, 23 nt, Mycobacterium avium subsp. paratuberculosis
caccggguacaccggcucgcuga

SEQ ID NO: 896014 - RNA, 14 nt, Mycobacterium avium subsp. paratuberculosis
caccgggucguccg

SEQ ID NO: 896015 - RNA, 19 nt, Mycobacterium avium subsp. paratuberculosis
caccgggucguccgcgacg

SEQ ID NO: 896016 - RNA, 19 nt, Mycobacterium avium subsp. paratuberculosis
caccgggucgucgcggaac

SEQ ID NO: 896017 - RNA, 18 nt, Mycobacterium avium subsp. paratuberculosis
caccgggugauaccggcc

SEQ ID NO: 896018 - RNA, 22 nt, Mycobacterium avium subsp. paratuberculosis
caccgggugauaccggcccagc

SEQ ID NO: 896019 - RNA, 21 nt, Mycobacterium avium subsp. paratuberculosis
caccgggugaugucgccgacc

SEQ ID NO: 896020 - RNA, 13 nt, Mycobacterium avium subsp. paratuberculosis
caccggugcggcg

SEQ ID NO: 896021 - RNA, 14 nt, Mycobacterium avium subsp. paratuberculosis
caccggugcggcgg

SEQ ID NO: 896022 - RNA, 23 nt, Mycobacterium avium subsp. paratuberculosis
caccgguggccgcgucgaccagc

SEQ ID NO: 896023 - RNA, 14 nt, Mycobacterium avium subsp. paratuberculosis
caccgguggccggg

SEQ ID NO: 896024 - RNA, 18 nt, Mycobacterium avium subsp. paratuberculosis
caccggugacgaccggca

SEQ ID NO: 896025 - RNA, 20 nt, Mycobacterium avium subsp. paratuberculosis
caccggugacgaccggcagc

SEQ ID NO: 896026 - RNA, 16 nt, Mycobacterium avium subsp. paratuberculosis
caccgguuugucggcg

SEQ ID NO: 896027 - RNA, 17 nt, Mycobacterium avium subsp. paratuberculosis
caccgguuugucggcgc

SEQ ID NO: 896028 - RNA, 18 nt, Mycobacterium avium subsp. paratuberculosis
caccgguuugucggcgcc

SEQ ID NO: 896029 - RNA, 16 nt, Mycobacterium avium subsp. paratuberculosis
caccgguugcgccgag

SEQ ID NO: 896030 - RNA, 17 nt, Mycobacterium avium subsp. paratuberculosis
caccggcuggccgagcg

SEQ ID NO: 896031 - RNA, 14 nt, Mycobacterium avium subsp. paratuberculosis
caccggcuggucgg

SEQ ID NO: 896032 - RNA, 16 nt, Mycobacterium avium subsp. paratuberculosis
caccggcuggugcagc

SEQ ID NO: 896033 - RNA, 17 nt, Mycobacterium avium subsp. paratuberculosis
caccggcuucgggauca

SEQ ID NO: 896034 - RNA, 20 nt, Mycobacterium avium subsp. paratuberculosis
caccggcuucgggaucagcg

SEQ ID NO: 896035 - RNA, 23 nt, Mycobacterium avium subsp. paratuberculosis
caccggcuucgggaucagcggga

SEQ ID NO: 896036 - RNA, 21 nt, Mycobacterium avium subsp. paratuberculosis
caccggcuccuugcgccgcaa

SEQ ID NO: 896037 - RNA, 17 nt, Mycobacterium avium subsp. paratuberculosis
caccggcucgcggggug

SEQ ID NO: 896038 - RNA, 21 nt, Mycobacterium avium subsp. paratuberculosis
caccggcucgggaacggucag

SEQ ID NO: 896039 - RNA, 13 nt, Mycobacterium avium subsp. paratuberculosis
caccggcggaucc

SEQ ID NO: 896040 - RNA, 16 nt, Mycobacterium avium subsp. paratuberculosis
caccggcgcgacggcg

SEQ ID NO: 896041 - RNA, 18 nt, Mycobacterium avium subsp. paratuberculosis
caccggcgcgacggcggc

SEQ ID NO: 896042 - RNA, 16 nt, Mycobacterium avium subsp. paratuberculosis
caccggcgcgccgcgu

SEQ ID NO: 896043 - RNA, 12 nt, Mycobacterium avium subsp. paratuberculosis
caccggcggcgg

SEQ ID NO: 896044 - RNA, 14 nt, Mycobacterium avium subsp. paratuberculosis
caccggcggcggcc

SEQ ID NO: 896045 - RNA, 15 nt, Mycobacterium avium subsp. paratuberculosis
caccggcggcggccu

SEQ ID NO: 896046 - RNA, 13 nt, Mycobacterium avium subsp. paratuberculosis
caccggcguggug

SEQ ID NO: 896047 - RNA, 20 nt, Mycobacterium avium subsp. paratuberculosis
caccggcgugaugacggcgg

SEQ ID NO: 896048 - RNA, 21 nt, Mycobacterium avium subsp. paratuberculosis
caccggcgugaugacggcggc

SEQ ID NO: 896049 - RNA, 23 nt, Mycobacterium avium subsp. paratuberculosis
caccggcgugaugacggcggcgg

SEQ ID NO: 896050 - RNA, 14 nt, Mycobacterium avium subsp. paratuberculosis
caccggcggcgacg

SEQ ID NO: 896051 - RNA, 17 nt, Mycobacterium avium subsp. paratuberculosis
caccggcgucgacagcc

SEQ ID NO: 896052 - RNA, 17 nt, Mycobacterium avium subsp. paratuberculosis
caccgggcggccguggu

SEQ ID NO: 896053 - RNA, 12 nt, Mycobacterium avium subsp. paratuberculosis
caccgggcgucg

SEQ ID NO: 896054 - RNA, 13 nt, Mycobacterium avium subsp. paratuberculosis
caccgggcgucgg

SEQ ID NO: 896055 - RNA, 14 nt, Mycobacterium avium subsp. paratuberculosis
caccgggcgucggc

SEQ ID NO: 896056 - RNA, 15 nt, Mycobacterium avium subsp. paratuberculosis
caccgggcgucggcg

SEQ ID NO: 896057 - RNA, 17 nt, Mycobacterium avium subsp. paratuberculosis
caccgggcgucggggcc

SEQ ID NO: 896058 - RNA, 19 nt, Mycobacterium avium subsp. paratuberculosis
caccgggccgaaggcggcg

SEQ ID NO: 896059 - RNA, 21 nt, Mycobacterium avium subsp. paratuberculosis
caccgggccgaaggcggcgcc

SEQ ID NO: 896060 - RNA, 21 nt, Mycobacterium avium subsp. paratuberculosis
caccgggcgacaccccgcgag

SEQ ID NO: 896061 - RNA, 23 nt, Mycobacterium avium subsp. paratuberculosis
caccgggauggcguucugcaccg

SEQ ID NO: 896062 - RNA, 13 nt, Mycobacterium avium subsp. paratuberculosis
caccgggcagccg

SEQ ID NO: 896063 - RNA, 16 nt, Mycobacterium avium subsp. paratuberculosis
caccgggcagccgcac

SEQ ID NO: 896064 - RNA, 20 nt, Mycobacterium avium subsp. paratuberculosis
caccgggcaguagaacggcc

SEQ ID NO: 896065 - RNA, 16 nt, Mycobacterium avium subsp. paratuberculosis
caccgggcccagcucg

SEQ ID NO: 896066 - RNA, 19 nt, Mycobacterium avium subsp. paratuberculosis
caccgggcccagcucggug

SEQ ID NO: 896067 - RNA, 20 nt, Mycobacterium avium subsp. paratuberculosis
caccgggcccagcucgguga

SEQ ID NO: 896068 - RNA, 16 nt, Mycobacterium avium subsp. paratuberculosis
caccgggcccgcccgc

SEQ ID NO: 896069 - RNA, 13 nt, Mycobacterium avium subsp. paratuberculosis
caccgggccgcca

SEQ ID NO: 896070 - RNA, 15 nt, Mycobacterium avium subsp. paratuberculosis
caccggcuuggcggu

SEQ ID NO: 896071 - RNA, 21 nt, Mycobacterium avium subsp. paratuberculosis
caccgggaaggugucggccgg

SEQ ID NO: 896072 - RNA, 20 nt, Mycobacterium avium subsp. paratuberculosis
caccgggacaccgcuggccg

SEQ ID NO: 896073 - RNA, 14 nt, Mycobacterium avium subsp. paratuberculosis
caccgggaccagcg

SEQ ID NO: 896074 - RNA, 20 nt, Mycobacterium avium subsp. paratuberculosis
caccgggaccagcgcggugc

SEQ ID NO: 896075 - RNA, 15 nt, Mycobacterium avium subsp. paratuberculosis
caccgggaccugcug

SEQ ID NO: 896076 - RNA, 23 nt, Mycobacterium avium subsp. paratuberculosis
caccgggaccugggucugcggcc

SEQ ID NO: 896077 - RNA, 24 nt, Mycobacterium avium subsp. paratuberculosis
caccgggaccugggucugcggccg

SEQ ID NO: 896078 - RNA, 20 nt, Mycobacterium avium subsp. paratuberculosis
caccgggacgggggugccga

SEQ ID NO: 896079 - RNA, 15 nt, Mycobacterium avium subsp. paratuberculosis
caccgggauccggcg

SEQ ID NO: 896080 - RNA, 16 nt, Mycobacterium avium subsp. paratuberculosis
caccgggauccggcgc

SEQ ID NO: 896081 - RNA, 23 nt, Mycobacterium avium subsp. paratuberculosis
caccgggauccggcgcgccgcga

SEQ ID NO: 896082 - RNA, 15 nt, Mycobacterium avium subsp. paratuberculosis
caccgggaucggcgg

SEQ ID NO: 896083 - RNA, 13 nt, Mycobacterium avium subsp. paratuberculosis
caccgggaucggg

SEQ ID NO: 896084 - RNA, 22 nt, Mycobacterium avium subsp. paratuberculosis
caccgggaucggggugccgccg

SEQ ID NO: 896085 - RNA, 17 nt, Mycobacterium avium subsp. paratuberculosis
caccggcuugccgaucg

SEQ ID NO: 896086 - RNA, 13 nt, Mycobacterium avium subsp. paratuberculosis
caccgggaguucu

SEQ ID NO: 896087 - RNA, 13 nt, Mycobacterium avium subsp. paratuberculosis
caccgggauggcg

SEQ ID NO: 896088 - RNA, 15 nt, Mycobacterium avium subsp. paratuberculosis
caccgcugaugccgc

SEQ ID NO: 896089 - RNA, 17 nt, Mycobacterium avium subsp. paratuberculosis
caccgcugaugccgccg

SEQ ID NO: 896090 - RNA, 13 nt, Mycobacterium avium subsp. paratuberculosis
caccgcugccacg

SEQ ID NO: 896091 - RNA, 22 nt, Mycobacterium avium subsp. paratuberculosis
caccgcucgucgggcucgucgu

SEQ ID NO: 896092 - RNA, 21 nt, Mycobacterium avium subsp. paratuberculosis
caccgcugagguagucccgcg

SEQ ID NO: 896093 - RNA, 19 nt, Mycobacterium avium subsp. paratuberculosis
caccgcuguggacaggucg

SEQ ID NO: 896094 - RNA, 21 nt, Mycobacterium avium subsp. paratuberculosis
caccgcuguggacaggucgau

SEQ ID NO: 896095 - RNA, 13 nt, Mycobacterium avium subsp. paratuberculosis
caccgcuggccga

SEQ ID NO: 896096 - RNA, 15 nt, Mycobacterium avium subsp. paratuberculosis
caccgcuggccgagg

SEQ ID NO: 896097 - RNA, 17 nt, Mycobacterium avium subsp. paratuberculosis
caccgcuggccgaggcc

SEQ ID NO: 896098 - RNA, 21 nt, Mycobacterium avium subsp. paratuberculosis
caccgcugggcggcgcggcgg

SEQ ID NO: 896099 - RNA, 19 nt, Mycobacterium avium subsp. paratuberculosis
caccggacgcagcgaucgg

SEQ ID NO: 896100 - RNA, 21 nt, Mycobacterium avium subsp. paratuberculosis
caccggacgcagcgaucggcg

SEQ ID NO: 896101 - RNA, 23 nt, Mycobacterium avium subsp. paratuberculosis
caccggacgcagcgaucggcggc

SEQ ID NO: 896102 - RNA, 15 nt, Mycobacterium avium subsp. paratuberculosis
caccggaccggccag

SEQ ID NO: 896103 - RNA, 19 nt, Mycobacterium avium subsp. paratuberculosis
caccgcuuugugaggcgcg

SEQ ID NO: 896104 - RNA, 14 nt, Mycobacterium avium subsp. paratuberculosis
caccggagcggcgg

SEQ ID NO: 896105 - RNA, 16 nt, Mycobacterium avium subsp. paratuberculosis
caccggaucgaccaac

SEQ ID NO: 896106 - RNA, 18 nt, Mycobacterium avium subsp. paratuberculosis
caccggcaaggugccguc

SEQ ID NO: 896107 - RNA, 21 nt, Mycobacterium avium subsp. paratuberculosis
caccggaugcucaccggucag

SEQ ID NO: 896108 - RNA, 16 nt, Mycobacterium avium subsp. paratuberculosis
caccggauggcgcccg

SEQ ID NO: 896109 - RNA, 13 nt, Mycobacterium avium subsp. paratuberculosis
caccggaucggcu

SEQ ID NO: 896110 - RNA, 20 nt, Mycobacterium avium subsp. paratuberculosis
caccggaugcaccggcagcc

SEQ ID NO: 896111 - RNA, 17 nt, Mycobacterium avium subsp. paratuberculosis
caccggcaaucgggacg

SEQ ID NO: 896112 - RNA, 20 nt, Mycobacterium avium subsp. paratuberculosis
caccggcaaucgggacgcca

SEQ ID NO: 896113 - RNA, 18 nt, Mycobacterium avium subsp. paratuberculosis
caccggcaccgccagcca

SEQ ID NO: 896114 - RNA, 14 nt, Mycobacterium avium subsp. paratuberculosis
caccggcaccgccc

SEQ ID NO: 896115 - RNA, 13 nt, Mycobacterium avium subsp. paratuberculosis
caccggcaccgcg

SEQ ID NO: 896116 - RNA, 17 nt, Mycobacterium avium subsp. paratuberculosis
caccggcacgaucgucg

SEQ ID NO: 896117 - RNA, 23 nt, Mycobacterium avium subsp. paratuberculosis
caccggcacgaucgucgccgcca

SEQ ID NO: 896118 - RNA, 17 nt, Mycobacterium avium subsp. paratuberculosis
caccggcacggcaccgc

SEQ ID NO: 896119 - RNA, 22 nt, Mycobacterium avium subsp. paratuberculosis
caccggcacggcaccgcgagca

SEQ ID NO: 896120 - RNA, 17 nt, Mycobacterium avium subsp. paratuberculosis
caccggcacgucgagcu

SEQ ID NO: 896121 - RNA, 19 nt, Mycobacterium avium subsp. paratuberculosis
caccggcacgucggccacg

SEQ ID NO: 896122 - RNA, 17 nt, Mycobacterium avium subsp. paratuberculosis
caccggcacgugcgggu

SEQ ID NO: 896123 - RNA, 19 nt, Mycobacterium avium subsp. paratuberculosis
caccggcacgugcggguug

SEQ ID NO: 896124 - RNA, 13 nt, Mycobacterium avium subsp. paratuberculosis
caccggcagugau

SEQ ID NO: 896125 - RNA, 18 nt, Mycobacterium avium subsp. paratuberculosis
caccggcagugaucggcg

SEQ ID NO: 896126 - RNA, 12 nt, Mycobacterium avium subsp. paratuberculosis
caccggcaggcg

SEQ ID NO: 896127 - RNA, 23 nt, Mycobacterium avium subsp. paratuberculosis
caccggcaugugccacagguaca

SEQ ID NO: 896128 - RNA, 15 nt, Mycobacterium avium subsp. paratuberculosis
caccggcagccagau

SEQ ID NO: 896129 - RNA, 16 nt, Mycobacterium avium subsp. paratuberculosis
caccggcagccagaug

SEQ ID NO: 896130 - RNA, 19 nt, Mycobacterium avium subsp. paratuberculosis
caccggcagccgcagcgac

SEQ ID NO: 896131 - RNA, 16 nt, Mycobacterium avium subsp. paratuberculosis
caccggcagcgccacc

SEQ ID NO: 896132 - RNA, 16 nt, Mycobacterium avium subsp. paratuberculosis
caccggcagcaccgcc

SEQ ID NO: 896133 - RNA, 20 nt, Mycobacterium avium subsp. paratuberculosis
caccggcagcaccgccgagc

SEQ ID NO: 896134 - RNA, 22 nt, Mycobacterium avium subsp. paratuberculosis
caccggccagggccgccgcaua

SEQ ID NO: 896135 - RNA, 23 nt, Mycobacterium avium subsp. paratuberculosis
caccggccagggccgccgcauac

SEQ ID NO: 896136 - RNA, 14 nt, Mycobacterium avium subsp. paratuberculosis
caccggccgcgcgu

SEQ ID NO: 896137 - RNA, 14 nt, Mycobacterium avium subsp. paratuberculosis
caccggccggaugu

SEQ ID NO: 896138 - RNA, 17 nt, Mycobacterium avium subsp. paratuberculosis
caccggccggccccggg

SEQ ID NO: 896139 - RNA, 15 nt, Mycobacterium avium subsp. paratuberculosis
caccggccgggacgg

SEQ ID NO: 896140 - RNA, 16 nt, Mycobacterium avium subsp. paratuberculosis
caccggcccggccggc

SEQ ID NO: 896141 - RNA, 18 nt, Mycobacterium avium subsp. paratuberculosis
caccggcccggccggcgc

SEQ ID NO: 896142 - RNA, 19 nt, Mycobacterium avium subsp. paratuberculosis
caccggcccggccggcgcg

SEQ ID NO: 896143 - RNA, 20 nt, Mycobacterium avium subsp. paratuberculosis
caccggcccggccggcgcga

SEQ ID NO: 896144 - RNA, 16 nt, Mycobacterium avium subsp. paratuberculosis
caccggcccggcgggc

SEQ ID NO: 896145 - RNA, 13 nt, Mycobacterium avium subsp. paratuberculosis
caccggccgaccg

SEQ ID NO: 896146 - RNA, 15 nt, Mycobacterium avium subsp. paratuberculosis
caccggccgaccggu

SEQ ID NO: 896147 - RNA, 20 nt, Mycobacterium avium subsp. paratuberculosis
caccggccgaccggucucga

SEQ ID NO: 896148 - RNA, 13 nt, Mycobacterium avium subsp. paratuberculosis
caccggccgagcc

SEQ ID NO: 896149 - RNA, 13 nt, Mycobacterium avium subsp. paratuberculosis
caccggccgcccg

SEQ ID NO: 896150 - RNA, 15 nt, Mycobacterium avium subsp. paratuberculosis
caccggccgcccggc

SEQ ID NO: 896151 - RNA, 19 nt, Mycobacterium avium subsp. paratuberculosis
caccggccgcccggcgagc

SEQ ID NO: 896152 - RNA, 20 nt, Mycobacterium avium subsp. paratuberculosis
caccggccgcccggcgagca

SEQ ID NO: 896153 - RNA, 18 nt, Mycobacterium avium subsp. paratuberculosis
caccggccauccgcugcg

SEQ ID NO: 896154 - RNA, 21 nt, Mycobacterium avium subsp. paratuberculosis
caccggcccagccggcggugc

SEQ ID NO: 896155 - RNA, 22 nt, Mycobacterium avium subsp. paratuberculosis
caccggcccagccggcggugca

SEQ ID NO: 896156 - RNA, 18 nt, Mycobacterium avium subsp. paratuberculosis
caccggccuucaccaggg

SEQ ID NO: 896157 - RNA, 19 nt, Mycobacterium avium subsp. paratuberculosis
caccggccuucaccagggu

SEQ ID NO: 896158 - RNA, 18 nt, Mycobacterium avium subsp. paratuberculosis
caccggccgguccgccca

SEQ ID NO: 896159 - RNA, 14 nt, Mycobacterium avium subsp. paratuberculosis
caccggcgacggcg

SEQ ID NO: 896160 - RNA, 20 nt, Mycobacterium avium subsp. paratuberculosis
caccggcgacggcgguucga

SEQ ID NO: 896161 - RNA, 20 nt, Mycobacterium avium subsp. paratuberculosis
caccggcgaggugaaccgcg

SEQ ID NO: 896162 - RNA, 22 nt, Mycobacterium avium subsp. paratuberculosis
caccggcgcagcgcgucgcgcc

SEQ ID NO: 896163 - RNA, 16 nt, Mycobacterium avium subsp. paratuberculosis
caccggcgccccgggc

SEQ ID NO: 896164 - RNA, 18 nt, Mycobacterium avium subsp. paratuberculosis
caccggcgccucgaugcg

SEQ ID NO: 896165 - RNA, 17 nt, Mycobacterium avium subsp. paratuberculosis
caccgcguagcgccgcc

SEQ ID NO: 896166 - RNA, 18 nt, Mycobacterium avium subsp. paratuberculosis
caccgcguagcgccgccc

SEQ ID NO: 896167 - RNA, 13 nt, Mycobacterium avium subsp. paratuberculosis
caccgcggucugc

SEQ ID NO: 896168 - RNA, 16 nt, Mycobacterium avium subsp. paratuberculosis
caccgcggugaccgcc

SEQ ID NO: 896169 - RNA, 17 nt, Mycobacterium avium subsp. paratuberculosis
caccgcggugaccgccc

SEQ ID NO: 896170 - RNA, 18 nt, Mycobacterium avium subsp. paratuberculosis
caccgcggugaccgcccg

SEQ ID NO: 896171 - RNA, 19 nt, Mycobacterium avium subsp. paratuberculosis
caccgcggugagcggccgc

SEQ ID NO: 896172 - RNA, 12 nt, Mycobacterium avium subsp. paratuberculosis
caccgcgggcuc

SEQ ID NO: 896173 - RNA, 21 nt, Mycobacterium avium subsp. paratuberculosis
caccgcggggcugggcgccau

SEQ ID NO: 896174 - RNA, 23 nt, Mycobacterium avium subsp. paratuberculosis
caccgcgggggcggccgggccgc

SEQ ID NO: 896175 - RNA, 17 nt, Mycobacterium avium subsp. paratuberculosis
caccgcggggugcccgg

SEQ ID NO: 896176 - RNA, 21 nt, Mycobacterium avium subsp. paratuberculosis
caccgcggggugcccggcgag

SEQ ID NO: 896177 - RNA, 20 nt, Mycobacterium avium subsp. paratuberculosis
caccgcgugcgagccgagca

SEQ ID NO: 896178 - RNA, 16 nt, Mycobacterium avium subsp. paratuberculosis
caccgcgucagcagcg

SEQ ID NO: 896179 - RNA, 19 nt, Mycobacterium avium subsp. paratuberculosis
caccgcgucguagagcuga

SEQ ID NO: 896180 - RNA, 14 nt, Mycobacterium avium subsp. paratuberculosis
caccgcguccgcgg

SEQ ID NO: 896181 - RNA, 15 nt, Mycobacterium avium subsp. paratuberculosis
caccgcguccgcggu

SEQ ID NO: 896182 - RNA, 16 nt, Mycobacterium avium subsp. paratuberculosis
caccgcguccgcgucg

SEQ ID NO: 896183 - RNA, 20 nt, Mycobacterium avium subsp. paratuberculosis
caccgcguccugcaggcagg

SEQ ID NO: 896184 - RNA, 23 nt, Mycobacterium avium subsp. paratuberculosis
caccgcguccugcaggcaggccg

SEQ ID NO: 896185 - RNA, 21 nt, Mycobacterium avium subsp. paratuberculosis
caccgcguccuucuccgccgg

SEQ ID NO: 896186 - RNA, 15 nt, Mycobacterium avium subsp. paratuberculosis
caccgcgucgcagug

SEQ ID NO: 896187 - RNA, 18 nt, Mycobacterium avium subsp. paratuberculosis
caccgcgucgcugcccag

SEQ ID NO: 896188 - RNA, 19 nt, Mycobacterium avium subsp. paratuberculosis
caccgcgucggcccagacg

SEQ ID NO: 896189 - RNA, 13 nt, Mycobacterium avium subsp. paratuberculosis
caccgcgucggcg

SEQ ID NO: 896190 - RNA, 20 nt, Mycobacterium avium subsp. paratuberculosis
caccgcgucggcgcuggcca

SEQ ID NO: 896191 - RNA, 19 nt, Mycobacterium avium subsp. paratuberculosis
caccgcguucucggcggac

SEQ ID NO: 896192 - RNA, 17 nt, Mycobacterium avium subsp. paratuberculosis
caccgcguugaucagcg

SEQ ID NO: 896193 - RNA, 19 nt, Mycobacterium avium subsp. paratuberculosis
caccgcguugaucagcgcc

SEQ ID NO: 896194 - RNA, 21 nt, Mycobacterium avium subsp. paratuberculosis
caccgcguugaucagcgccag

SEQ ID NO: 896195 - RNA, 16 nt, Mycobacterium avium subsp. paratuberculosis
caccgcguuggccgcc

SEQ ID NO: 896196 - RNA, 17 nt, Mycobacterium avium subsp. paratuberculosis
caccgcguuggccgcca

SEQ ID NO: 896197 - RNA, 21 nt, Mycobacterium avium subsp. paratuberculosis
caccgcguugucggcgacggc

SEQ ID NO: 896198 - RNA, 23 nt, Mycobacterium avium subsp. paratuberculosis
caccgcguugucggcgacggcgg

SEQ ID NO: 896199 - RNA, 13 nt, Mycobacterium avium subsp. paratuberculosis
caccgcggcgggg

SEQ ID NO: 896200 - RNA, 14 nt, Mycobacterium avium subsp. paratuberculosis
caccgcggcggcgu

SEQ ID NO: 896201 - RNA, 17 nt, Mycobacterium avium subsp. paratuberculosis
caccgcggcggcgucgg

SEQ ID NO: 896202 - RNA, 19 nt, Mycobacterium avium subsp. paratuberculosis
caccgcggcggcgucggcg

SEQ ID NO: 896203 - RNA, 14 nt, Mycobacterium avium subsp. paratuberculosis
caccgcggcggcca

SEQ ID NO: 896204 - RNA, 13 nt, Mycobacterium avium subsp. paratuberculosis
caccgcggcggcg

SEQ ID NO: 896205 - RNA, 16 nt, Mycobacterium avium subsp. paratuberculosis
caccgcggcgaucgcc

SEQ ID NO: 896206 - RNA, 13 nt, Mycobacterium avium subsp. paratuberculosis
caccgcggcgaug

SEQ ID NO: 896207 - RNA, 15 nt, Mycobacterium avium subsp. paratuberculosis
caccgcggcgaugau

SEQ ID NO: 896208 - RNA, 16 nt, Mycobacterium avium subsp. paratuberculosis
caccgcggcgccgucg

SEQ ID NO: 896209 - RNA, 20 nt, Mycobacterium avium subsp. paratuberculosis
caccgcggcgccgucgaaca

SEQ ID NO: 896210 - RNA, 12 nt, Mycobacterium avium subsp. paratuberculosis
caccgcggcgcg

SEQ ID NO: 896211 - RNA, 13 nt, Mycobacterium avium subsp. paratuberculosis
caccgcggcgcgc

SEQ ID NO: 896212 - RNA, 14 nt, Mycobacterium avium subsp. paratuberculosis
caccgcggcgcgca

SEQ ID NO: 896213 - RNA, 20 nt, Mycobacterium avium subsp. paratuberculosis
caccgcggcgcgcaucgccg

SEQ ID NO: 896214 - RNA, 22 nt, Mycobacterium avium subsp. paratuberculosis
caccgcggcgcgcggccgcgac

SEQ ID NO: 896215 - RNA, 17 nt, Mycobacterium avium subsp. paratuberculosis
caccgcggcggugucgg

SEQ ID NO: 896216 - RNA, 21 nt, Mycobacterium avium subsp. paratuberculosis
caccgcggcggugucggcgcc

SEQ ID NO: 896217 - RNA, 17 nt, Mycobacterium avium subsp. paratuberculosis
caccgcggcguagcgcc

SEQ ID NO: 896218 - RNA, 22 nt, Mycobacterium avium subsp. paratuberculosis
caccgcggcguagcgccagucg

SEQ ID NO: 896219 - RNA, 16 nt, Mycobacterium avium subsp. paratuberculosis
caccgcggcucggucg

SEQ ID NO: 896220 - RNA, 20 nt, Mycobacterium avium subsp. paratuberculosis
caccgcgggaauggccgcgc

SEQ ID NO: 896221 - RNA, 14 nt, Mycobacterium avium subsp. paratuberculosis
caccgcgggcagca

SEQ ID NO: 896222 - RNA, 12 nt, Mycobacterium avium subsp. paratuberculosis
caccgcgggcca

SEQ ID NO: 896223 - RNA, 16 nt, Mycobacterium avium subsp. paratuberculosis
caccgcgggccaggcc

SEQ ID NO: 896224 - RNA, 16 nt, Mycobacterium avium subsp. paratuberculosis
caccgcgccggcggcg

SEQ ID NO: 896225 - RNA, 22 nt, Mycobacterium avium subsp. paratuberculosis
caccgcgccgucuuccgggcca

SEQ ID NO: 896226 - RNA, 13 nt, Mycobacterium avium subsp. paratuberculosis
caccgcgccguga

SEQ ID NO: 896227 - RNA, 14 nt, Mycobacterium avium subsp. paratuberculosis
caccgcgccgggca

SEQ ID NO: 896228 - RNA, 16 nt, Mycobacterium avium subsp. paratuberculosis
caccgcgccgggcacc

SEQ ID NO: 896229 - RNA, 17 nt, Mycobacterium avium subsp. paratuberculosis
caccgcgccgggcacca

SEQ ID NO: 896230 - RNA, 22 nt, Mycobacterium avium subsp. paratuberculosis
caccgcgccgguccggcccugg

SEQ ID NO: 896231 - RNA, 13 nt, Mycobacterium avium subsp. paratuberculosis
caccgcgccgucg

SEQ ID NO: 896232 - RNA, 21 nt, Mycobacterium avium subsp. paratuberculosis
caccgcgccgugggcgucacg

SEQ ID NO: 896233 - RNA, 22 nt, Mycobacterium avium subsp. paratuberculosis
caccgcgccuuugacguucgcg

SEQ ID NO: 896234 - RNA, 15 nt, Mycobacterium avium subsp. paratuberculosis
caccgcgcgaagucc

SEQ ID NO: 896235 - RNA, 13 nt, Mycobacterium avium subsp. paratuberculosis
caccgcgcgcagg

SEQ ID NO: 896236 - RNA, 22 nt, Mycobacterium avium subsp. paratuberculosis
caccgcgcgcaggccccggcgc

SEQ ID NO: 896237 - RNA, 23 nt, Mycobacterium avium subsp. paratuberculosis
caccgcgcgcaggccccggcgcg

SEQ ID NO: 896238 - RNA, 21 nt, Mycobacterium avium subsp. paratuberculosis
caccgcggccagcgcgcgggc

SEQ ID NO: 896239 - RNA, 14 nt, Mycobacterium avium subsp. paratuberculosis
caccgcggccagcu

SEQ ID NO: 896240 - RNA, 19 nt, Mycobacterium avium subsp. paratuberculosis
caccgcggccagcugcgac

SEQ ID NO: 896241 - RNA, 23 nt, Mycobacterium avium subsp. paratuberculosis
caccgcggccagcugcgacagca

SEQ ID NO: 896242 - RNA, 15 nt, Mycobacterium avium subsp. paratuberculosis
caccgcggccgucgc

SEQ ID NO: 896243 - RNA, 22 nt, Mycobacterium avium subsp. paratuberculosis
caccgcggccgucgcggcgauc

SEQ ID NO: 896244 - RNA, 23 nt, Mycobacterium avium subsp. paratuberculosis
caccgcggccgucgcggcgaucg

SEQ ID NO: 896245 - RNA, 16 nt, Mycobacterium avium subsp. paratuberculosis
caccgcggcgacgucg

SEQ ID NO: 896246 - RNA, 12 nt, Mycobacterium avium subsp. paratuberculosis
caccgcggcgag

SEQ ID NO: 896247 - RNA, 13 nt, Mycobacterium avium subsp. paratuberculosis
caccgccggcccg

SEQ ID NO: 896248 - RNA, 14 nt, Mycobacterium avium subsp. paratuberculosis
caccgccggcccgg

SEQ ID NO: 896249 - RNA, 15 nt, Mycobacterium avium subsp. paratuberculosis
caccgccggcccggc

SEQ ID NO: 896250 - RNA, 12 nt, Mycobacterium avium subsp. paratuberculosis
caccgccggcgc

SEQ ID NO: 896251 - RNA, 13 nt, Mycobacterium avium subsp. paratuberculosis
caccgccggcgcc

SEQ ID NO: 896252 - RNA, 16 nt, Mycobacterium avium subsp. paratuberculosis
caccgaucgcgagggc

SEQ ID NO: 896253 - RNA, 19 nt, Mycobacterium avium subsp. paratuberculosis
caccgagaccaugccgccg

SEQ ID NO: 896254 - RNA, 21 nt, Mycobacterium avium subsp. paratuberculosis
caccgagaccaugccgccgaa

SEQ ID NO: 896255 - RNA, 16 nt, Mycobacterium avium subsp. paratuberculosis
caccgacuucauggcg

SEQ ID NO: 896256 - RNA, 22 nt, Mycobacterium avium subsp. paratuberculosis
caccgagaacagaugccggugc

SEQ ID NO: 896257 - RNA, 18 nt, Mycobacterium avium subsp. paratuberculosis
caccgaggugacgucgcg

SEQ ID NO: 896258 - RNA, 22 nt, Mycobacterium avium subsp. paratuberculosis
caccgaggugacgucgcgccgc

SEQ ID NO: 896259 - RNA, 17 nt, Mycobacterium avium subsp. paratuberculosis
caccgagguggcccagc

SEQ ID NO: 896260 - RNA, 19 nt, Mycobacterium avium subsp. paratuberculosis
caccgagguggcccagccg

SEQ ID NO: 896261 - RNA, 20 nt, Mycobacterium avium subsp. paratuberculosis
caccgagguggcccagccgc

SEQ ID NO: 896262 - RNA, 23 nt, Mycobacterium avium subsp. paratuberculosis
caccgagguggcccagccgcuga

SEQ ID NO: 896263 - RNA, 14 nt, Mycobacterium avium subsp. paratuberculosis
caccgagugcggcg

SEQ ID NO: 896264 - RNA, 15 nt, Mycobacterium avium subsp. paratuberculosis
caccgagugcggcgc

SEQ ID NO: 896265 - RNA, 19 nt, Mycobacterium avium subsp. paratuberculosis
caccgagugcggcgcggug

SEQ ID NO: 896266 - RNA, 20 nt, Mycobacterium avium subsp. paratuberculosis
caccgccgucggggcgucgg

SEQ ID NO: 896267 - RNA, 23 nt, Mycobacterium avium subsp. paratuberculosis
caccgccgucggggcgucggcgg

SEQ ID NO: 896268 - RNA, 14 nt, Mycobacterium avium subsp. paratuberculosis
caccgccucgacgg

SEQ ID NO: 896269 - RNA, 17 nt, Mycobacterium avium subsp. paratuberculosis
caccgccucgacgguga

SEQ ID NO: 896270 - RNA, 15 nt, Mycobacterium avium subsp. paratuberculosis
caccgccggcgccgu

SEQ ID NO: 896271 - RNA, 14 nt, Mycobacterium avium subsp. paratuberculosis
caccgccggcgcgg

SEQ ID NO: 896272 - RNA, 21 nt, Mycobacterium avium subsp. paratuberculosis
caccgccggcggccuccgcca

SEQ ID NO: 896273 - RNA, 16 nt, Mycobacterium avium subsp. paratuberculosis
caccgccgggcauccg

SEQ ID NO: 896274 - RNA, 22 nt, Mycobacterium avium subsp. paratuberculosis
caccgccgggcauccgggccgc

SEQ ID NO: 896275 - RNA, 13 nt, Mycobacterium avium subsp. paratuberculosis
caccgcgccggcg

SEQ ID NO: 896276 - RNA, 15 nt, Mycobacterium avium subsp. paratuberculosis
caccgcgccccggcg

SEQ ID NO: 896277 - RNA, 16 nt, Mycobacterium avium subsp. paratuberculosis
caccgcgccccggcgc

SEQ ID NO: 896278 - RNA, 18 nt, Mycobacterium avium subsp. paratuberculosis
caccgcgccccggcgcag

SEQ ID NO: 896279 - RNA, 22 nt, Mycobacterium avium subsp. paratuberculosis
caccgcgccccggcgcagcgcc

SEQ ID NO: 896280 - RNA, 16 nt, Mycobacterium avium subsp. paratuberculosis
caccgcgcccagcccc

SEQ ID NO: 896281 - RNA, 14 nt, Mycobacterium avium subsp. paratuberculosis
caccgccugcgcga

SEQ ID NO: 896282 - RNA, 19 nt, Mycobacterium avium subsp. paratuberculosis
cacacuggcgugacgcucg

SEQ ID NO: 896283 - RNA, 17 nt, Mycobacterium avium subsp. paratuberculosis
cacacugaaagccgagg

SEQ ID NO: 896284 - RNA, 20 nt, Mycobacterium avium subsp. paratuberculosis
cacacugaaagccgaggcgc

SEQ ID NO: 896285 - RNA, 19 nt, Mycobacterium avium subsp. paratuberculosis
caccacauucccgccgccg

SEQ ID NO: 896286 - RNA, 21 nt, Mycobacterium avium subsp. paratuberculosis
caccacauucccgccgccgcg

SEQ ID NO: 896287 - RNA, 16 nt, Mycobacterium avium subsp. paratuberculosis
caccacaguggccgcc

SEQ ID NO: 896288 - RNA, 13 nt, Mycobacterium avium subsp. paratuberculosis
cacacgugcggau

SEQ ID NO: 896289 - RNA, 20 nt, Mycobacterium avium subsp. paratuberculosis
cacacguugagcccggaccg

SEQ ID NO: 896290 - RNA, 21 nt, Mycobacterium avium subsp. paratuberculosis
cacacguugagcccggaccgg

SEQ ID NO: 896291 - RNA, 15 nt, Mycobacterium avium subsp. paratuberculosis
cacacggccucgccc

SEQ ID NO: 896292 - RNA, 16 nt, Mycobacterium avium subsp. paratuberculosis
cacacggccuugccga

SEQ ID NO: 896293 - RNA, 17 nt, Mycobacterium avium subsp. paratuberculosis
cacacgcgauagaccuc

SEQ ID NO: 896294 - RNA, 21 nt, Mycobacterium avium subsp. paratuberculosis
cacacgcggacagggcggcga

SEQ ID NO: 896295 - RNA, 13 nt, Mycobacterium avium subsp. paratuberculosis
cacacgcucggcg

SEQ ID NO: 896296 - RNA, 14 nt, Mycobacterium avium subsp. paratuberculosis
cacacgcucggcga

SEQ ID NO: 896297 - RNA, 14 nt, Mycobacterium avium subsp. paratuberculosis
cacacgcucggcgc

SEQ ID NO: 896298 - RNA, 15 nt, Mycobacterium avium subsp. paratuberculosis
cacacgcucggcgcg

SEQ ID NO: 896299 - RNA, 22 nt, Mycobacterium avium subsp. paratuberculosis
cacacgcucggcgcgcggggcc

SEQ ID NO: 896300 - RNA, 22 nt, Mycobacterium avium subsp. paratuberculosis
caccacauuggcgaccgcggcc

SEQ ID NO: 896301 - RNA, 19 nt, Mycobacterium avium subsp. paratuberculosis
caccaccaacggcucgccg

SEQ ID NO: 896302 - RNA, 20 nt, Mycobacterium avium subsp. paratuberculosis
caccaccacacccagcgcca

SEQ ID NO: 896303 - RNA, 15 nt, Mycobacterium avium subsp. paratuberculosis
caccaccacacccgc

SEQ ID NO: 896304 - RNA, 13 nt, Mycobacterium avium subsp. paratuberculosis
caccaccacgcga

SEQ ID NO: 896305 - RNA, 22 nt, Mycobacterium avium subsp. paratuberculosis
caccaccacgcgaucagguccg

SEQ ID NO: 896306 - RNA, 14 nt, Mycobacterium avium subsp. paratuberculosis
caccaccacgcugg

SEQ ID NO: 896307 - RNA, 14 nt, Mycobacterium avium subsp. paratuberculosis
caccaccacggugg

SEQ ID NO: 896308 - RNA, 22 nt, Mycobacterium avium subsp. paratuberculosis
caccaccacgguggcgccggca

SEQ ID NO: 896309 - RNA, 17 nt, Mycobacterium avium subsp. paratuberculosis
caccaccacgugccccu

SEQ ID NO: 896310 - RNA, 23 nt, Mycobacterium avium subsp. paratuberculosis
caccaccacgugccccuccucgg

SEQ ID NO: 896311 - RNA, 13 nt, Mycobacterium avium subsp. paratuberculosis
caccaccaggccg

SEQ ID NO: 896312 - RNA, 17 nt, Mycobacterium avium subsp. paratuberculosis
caccaccaccgccguca

SEQ ID NO: 896313 - RNA, 14 nt, Mycobacterium avium subsp. paratuberculosis
caccaccagcgggc

SEQ ID NO: 896314 - RNA, 21 nt, Mycobacterium avium subsp. paratuberculosis
caccaccagcgggcugugccg

SEQ ID NO: 896315 - RNA, 19 nt, Mycobacterium avium subsp. paratuberculosis
caccaccagcucgucgccg

SEQ ID NO: 896316 - RNA, 22 nt, Mycobacterium avium subsp. paratuberculosis
caccaccagcucgucgccgacc

SEQ ID NO: 896317 - RNA, 14 nt, Mycobacterium avium subsp. paratuberculosis
caccacccggaaga

SEQ ID NO: 896318 - RNA, 17 nt, Mycobacterium avium subsp. paratuberculosis
caccacccccgacccga

SEQ ID NO: 896319 - RNA, 15 nt, Mycobacterium avium subsp. paratuberculosis
caccacccggcgauu

SEQ ID NO: 896320 - RNA, 13 nt, Mycobacterium avium subsp. paratuberculosis
caccacccggcga

SEQ ID NO: 896321 - RNA, 13 nt, Mycobacterium avium subsp. paratuberculosis
caccacccgggug

SEQ ID NO: 896322 - RNA, 14 nt, Mycobacterium avium subsp. paratuberculosis
caccacccagcccu

SEQ ID NO: 896323 - RNA, 14 nt, Mycobacterium avium subsp. paratuberculosis
caccaccaccgaca

SEQ ID NO: 896324 - RNA, 16 nt, Mycobacterium avium subsp. paratuberculosis
caccaccagucggcgc

SEQ ID NO: 896325 - RNA, 18 nt, Mycobacterium avium subsp. paratuberculosis
caccaccagucggcgcgu

SEQ ID NO: 896326 - RNA, 14 nt, Mycobacterium avium subsp. paratuberculosis
caccaccugcacgg

SEQ ID NO: 896327 - RNA, 20 nt, Mycobacterium avium subsp. paratuberculosis
caccaccuccucgcgggcga

SEQ ID NO: 896328 - RNA, 14 nt, Mycobacterium avium subsp. paratuberculosis
caccaccucgcgcg

SEQ ID NO: 896329 - RNA, 18 nt, Mycobacterium avium subsp. paratuberculosis
caccaccucgcgggcgac

SEQ ID NO: 896330 - RNA, 14 nt, Mycobacterium avium subsp. paratuberculosis
caccaccgugccgu

SEQ ID NO: 896331 - RNA, 18 nt, Mycobacterium avium subsp. paratuberculosis
caccaccgugccgucgcg

SEQ ID NO: 896332 - RNA, 13 nt, Mycobacterium avium subsp. paratuberculosis
caccaccguggcg

SEQ ID NO: 896333 - RNA, 16 nt, Mycobacterium avium subsp. paratuberculosis
caccaccguggcgaug

SEQ ID NO: 896334 - RNA, 20 nt, Mycobacterium avium subsp. paratuberculosis
caccacggccaucacggugc

SEQ ID NO: 896335 - RNA, 14 nt, Mycobacterium avium subsp. paratuberculosis
caccacggccaugc

SEQ ID NO: 896336 - RNA, 12 nt, Mycobacterium avium subsp. paratuberculosis
caccacggccgc

SEQ ID NO: 896337 - RNA, 16 nt, Mycobacterium avium subsp. paratuberculosis
caccacggccgcagcg

SEQ ID NO: 896338 - RNA, 19 nt, Mycobacterium avium subsp. paratuberculosis
caccacggccgcagcggca

SEQ ID NO: 896339 - RNA, 15 nt, Mycobacterium avium subsp. paratuberculosis
caccacggccgccga

SEQ ID NO: 896340 - RNA, 22 nt, Mycobacterium avium subsp. paratuberculosis
caccacggccgccgaggcgaug

SEQ ID NO: 896341 - RNA, 13 nt, Mycobacterium avium subsp. paratuberculosis
caccacggccggc

SEQ ID NO: 896342 - RNA, 20 nt, Mycobacterium avium subsp. paratuberculosis
caccaccuucaucgccgucg

SEQ ID NO: 896343 - RNA, 23 nt, Mycobacterium avium subsp. paratuberculosis
caccaccuucaucgccgucgcca

SEQ ID NO: 896344 - RNA, 20 nt, Mycobacterium avium subsp. paratuberculosis
caccaccuugguggccgcgg

SEQ ID NO: 896345 - RNA, 17 nt, Mycobacterium avium subsp. paratuberculosis
caccaccuugucaccga

SEQ ID NO: 896346 - RNA, 12 nt, Mycobacterium avium subsp. paratuberculosis
caccaccggcuu

SEQ ID NO: 896347 - RNA, 14 nt, Mycobacterium avium subsp. paratuberculosis
caccaccgggucgu

SEQ ID NO: 896348 - RNA, 12 nt, Mycobacterium avium subsp. paratuberculosis
caccaccggcaa

SEQ ID NO: 896349 - RNA, 12 nt, Mycobacterium avium subsp. paratuberculosis
caccaccggccg

SEQ ID NO: 896350 - RNA, 20 nt, Mycobacterium avium subsp. paratuberculosis
caccaccggccgcccggcga

SEQ ID NO: 896351 - RNA, 22 nt, Mycobacterium avium subsp. paratuberculosis
caccaccggccgcccggcgagc

SEQ ID NO: 896352 - RNA, 17 nt, Mycobacterium avium subsp. paratuberculosis
caccaccgacagcaccc

SEQ ID NO: 896353 - RNA, 21 nt, Mycobacterium avium subsp. paratuberculosis
caccaccgacagcacccggcc

SEQ ID NO: 896354 - RNA, 18 nt, Mycobacterium avium subsp. paratuberculosis
caccaccgacgcgucgcg

SEQ ID NO: 896355 - RNA, 15 nt, Mycobacterium avium subsp. paratuberculosis
caccaccgagccggc

SEQ ID NO: 896356 - RNA, 17 nt, Mycobacterium avium subsp. paratuberculosis
caccaccggagcggcgg

SEQ ID NO: 896357 - RNA, 16 nt, Mycobacterium avium subsp. paratuberculosis
caccagaucgccccgc

SEQ ID NO: 896358 - RNA, 20 nt, Mycobacterium avium subsp. paratuberculosis
caccagaucgccccgcugga

SEQ ID NO: 896359 - RNA, 19 nt, Mycobacterium avium subsp. paratuberculosis
caccagaucgucgggcacc

SEQ ID NO: 896360 - RNA, 14 nt, Mycobacterium avium subsp. paratuberculosis
caccagaucguguc

SEQ ID NO: 896361 - RNA, 21 nt, Mycobacterium avium subsp. paratuberculosis
caccagaucguguccgcgccg

SEQ ID NO: 896362 - RNA, 14 nt, Mycobacterium avium subsp. paratuberculosis
caccagagcgccgg

SEQ ID NO: 896363 - RNA, 15 nt, Mycobacterium avium subsp. paratuberculosis
caccagagcgccgga

SEQ ID NO: 896364 - RNA, 22 nt, Mycobacterium avium subsp. paratuberculosis
caccagagcgccggacucgaag

SEQ ID NO: 896365 - RNA, 16 nt, Mycobacterium avium subsp. paratuberculosis
caccagaccggcgaag

SEQ ID NO: 896366 - RNA, 23 nt, Mycobacterium avium subsp. paratuberculosis
caccagaccggguuugaggccca

SEQ ID NO: 896367 - RNA, 19 nt, Mycobacterium avium subsp. paratuberculosis
caccaccgucaccgccgca

SEQ ID NO: 896368 - RNA, 23 nt, Mycobacterium avium subsp. paratuberculosis
caccagaaccauuugcccagcag

SEQ ID NO: 896369 - RNA, 20 nt, Mycobacterium avium subsp. paratuberculosis
caccacgguggcgccggcau

SEQ ID NO: 896370 - RNA, 14 nt, Mycobacterium avium subsp. paratuberculosis
caccacgguggcgu

SEQ ID NO: 896371 - RNA, 17 nt, Mycobacterium avium subsp. paratuberculosis
caccacgguggugucgu

SEQ ID NO: 896372 - RNA, 12 nt, Mycobacterium avium subsp. paratuberculosis
caccacggugua

SEQ ID NO: 896373 - RNA, 20 nt, Mycobacterium avium subsp. paratuberculosis
caccacggucagggccagca

SEQ ID NO: 896374 - RNA, 23 nt, Mycobacterium avium subsp. paratuberculosis
caccacggucagggccagcaaca

SEQ ID NO: 896375 - RNA, 20 nt, Mycobacterium avium subsp. paratuberculosis
caccacgguccccgcgcccg

SEQ ID NO: 896376 - RNA, 22 nt, Mycobacterium avium subsp. paratuberculosis
caccacgguccccgcgcccgcc

SEQ ID NO: 896377 - RNA, 17 nt, Mycobacterium avium subsp. paratuberculosis
caccacggucgccgcgc

SEQ ID NO: 896378 - RNA, 18 nt, Mycobacterium avium subsp. paratuberculosis
caccacggucgccgcgcc

SEQ ID NO: 896379 - RNA, 17 nt, Mycobacterium avium subsp. paratuberculosis
caccacggugaacgggc

SEQ ID NO: 896380 - RNA, 21 nt, Mycobacterium avium subsp. paratuberculosis
caccacggugaacgggccgca

SEQ ID NO: 896381 - RNA, 21 nt, Mycobacterium avium subsp. paratuberculosis
caccacggugaucucgccgag

SEQ ID NO: 896382 - RNA, 22 nt, Mycobacterium avium subsp. paratuberculosis
caccacggugaucucgccgagc

SEQ ID NO: 896383 - RNA, 23 nt, Mycobacterium avium subsp. paratuberculosis
caccacggugaucucgccgagca

SEQ ID NO: 896384 - RNA, 14 nt, Mycobacterium avium subsp. paratuberculosis
caccacgguggccg

SEQ ID NO: 896385 - RNA, 17 nt, Mycobacterium avium subsp. paratuberculosis
caccacgggucggucgg

SEQ ID NO: 896386 - RNA, 21 nt, Mycobacterium avium subsp. paratuberculosis
caccacgggucggucggcccg

SEQ ID NO: 896387 - RNA, 13 nt, Mycobacterium avium subsp. paratuberculosis
caccacggcggca

SEQ ID NO: 896388 - RNA, 14 nt, Mycobacterium avium subsp. paratuberculosis
caccacggcggcau

SEQ ID NO: 896389 - RNA, 19 nt, Mycobacterium avium subsp. paratuberculosis
caccacggcggcauguucg

SEQ ID NO: 896390 - RNA, 12 nt, Mycobacterium avium subsp. paratuberculosis
caccacggcacc

SEQ ID NO: 896391 - RNA, 20 nt, Mycobacterium avium subsp. paratuberculosis
caccacgcuguagggccacc

SEQ ID NO: 896392 - RNA, 22 nt, Mycobacterium avium subsp. paratuberculosis
caccacgcuguagggccaccac

SEQ ID NO: 896393 - RNA, 18 nt, Mycobacterium avium subsp. paratuberculosis
caccagaugcaccucgcc

SEQ ID NO: 896394 - RNA, 20 nt, Mycobacterium avium subsp. paratuberculosis
caccagaugccgcucggcgc

SEQ ID NO: 896395 - RNA, 16 nt, Mycobacterium avium subsp. paratuberculosis
caccagaugccgggcu

SEQ ID NO: 896396 - RNA, 17 nt, Mycobacterium avium subsp. paratuberculosis
caccagaugccgggcuc

SEQ ID NO: 896397 - RNA, 19 nt, Mycobacterium avium subsp. paratuberculosis
caccagaugccgggcuccg

SEQ ID NO: 896398 - RNA, 17 nt, Mycobacterium avium subsp. paratuberculosis
caccagcaccccgccgc

SEQ ID NO: 896399 - RNA, 19 nt, Mycobacterium avium subsp. paratuberculosis
caccagcaccccgccgcag

SEQ ID NO: 896400 - RNA, 14 nt, Mycobacterium avium subsp. paratuberculosis
caccagcaccgaga

SEQ ID NO: 896401 - RNA, 15 nt, Mycobacterium avium subsp. paratuberculosis
caccagcacgacacc

SEQ ID NO: 896402 - RNA, 17 nt, Mycobacterium avium subsp. paratuberculosis
caccagcaccaccgugg

SEQ ID NO: 896403 - RNA, 15 nt, Mycobacterium avium subsp. paratuberculosis
caccagcacaccgga

SEQ ID NO: 896404 - RNA, 17 nt, Mycobacterium avium subsp. paratuberculosis
caccagcacaccggauc

SEQ ID NO: 896405 - RNA, 18 nt, Mycobacterium avium subsp. paratuberculosis
caccagcaccaggcgggu

SEQ ID NO: 896406 - RNA, 20 nt, Mycobacterium avium subsp. paratuberculosis
caccagcacccagcacagcg

SEQ ID NO: 896407 - RNA, 14 nt, Mycobacterium avium subsp. paratuberculosis
caccagcagcgcga

SEQ ID NO: 896408 - RNA, 16 nt, Mycobacterium avium subsp. paratuberculosis
caccagcagcagguug

SEQ ID NO: 896409 - RNA, 15 nt, Mycobacterium avium subsp. paratuberculosis
caccagcagccgcag

SEQ ID NO: 896410 - RNA, 20 nt, Mycobacterium avium subsp. paratuberculosis
caccagcagccgcagcgcgc

SEQ ID NO: 896411 - RNA, 15 nt, Mycobacterium avium subsp. paratuberculosis
caccagcagccgguc

SEQ ID NO: 896412 - RNA, 16 nt, Mycobacterium avium subsp. paratuberculosis
caccagcagccggucg

SEQ ID NO: 896413 - RNA, 17 nt, Mycobacterium avium subsp. paratuberculosis
caccagcagccggucga

SEQ ID NO: 896414 - RNA, 22 nt, Mycobacterium avium subsp. paratuberculosis
caccagcagcgagaccggcacg

SEQ ID NO: 896415 - RNA, 20 nt, Mycobacterium avium subsp. paratuberculosis
caccagcagacccgacggga

SEQ ID NO: 896416 - RNA, 15 nt, Mycobacterium avium subsp. paratuberculosis
caccagcacggcgac

SEQ ID NO: 896417 - RNA, 16 nt, Mycobacterium avium subsp. paratuberculosis
caccagcacggcgacc

SEQ ID NO: 896418 - RNA, 15 nt, Mycobacterium avium subsp. paratuberculosis
caccagcacggcggc

SEQ ID NO: 896419 - RNA, 16 nt, Mycobacterium avium subsp. paratuberculosis
caccagcacggcggcg

SEQ ID NO: 896420 - RNA, 17 nt, Mycobacterium avium subsp. paratuberculosis
caccagcacggucccgu

SEQ ID NO: 896421 - RNA, 19 nt, Mycobacterium avium subsp. paratuberculosis
caccagcauggcgaucacc

SEQ ID NO: 896422 - RNA, 19 nt, Mycobacterium avium subsp. paratuberculosis
caccagcccgaugccgccg

SEQ ID NO: 896423 - RNA, 19 nt, Mycobacterium avium subsp. paratuberculosis
caccagcaggccccguucg

SEQ ID NO: 896424 - RNA, 14 nt, Mycobacterium avium subsp. paratuberculosis
caccagccggccgg

SEQ ID NO: 896425 - RNA, 15 nt, Mycobacterium avium subsp. paratuberculosis
caccagccggccggc

SEQ ID NO: 896426 - RNA, 13 nt, Mycobacterium avium subsp. paratuberculosis
caccagcccgucg

SEQ ID NO: 896427 - RNA, 16 nt, Mycobacterium avium subsp. paratuberculosis
caccagcccggccagc

SEQ ID NO: 896428 - RNA, 20 nt, Mycobacterium avium subsp. paratuberculosis
caccagcccggccagcggca

SEQ ID NO: 896429 - RNA, 18 nt, Mycobacterium avium subsp. paratuberculosis
caccagcgauccggcgcg

SEQ ID NO: 896430 - RNA, 19 nt, Mycobacterium avium subsp. paratuberculosis
caccagcgauccggcgcgu

SEQ ID NO: 896431 - RNA, 13 nt, Mycobacterium avium subsp. paratuberculosis
caccagcgcacac

SEQ ID NO: 896432 - RNA, 16 nt, Mycobacterium avium subsp. paratuberculosis
caccagcgccugggcg

SEQ ID NO: 896433 - RNA, 15 nt, Mycobacterium avium subsp. paratuberculosis
caccagcgccucggc

SEQ ID NO: 896434 - RNA, 13 nt, Mycobacterium avium subsp. paratuberculosis
caccagcggcacc

SEQ ID NO: 896435 - RNA, 16 nt, Mycobacterium avium subsp. paratuberculosis
caccagcggcaccagg

SEQ ID NO: 896436 - RNA, 18 nt, Mycobacterium avium subsp. paratuberculosis
caccagcggcaccaggua

SEQ ID NO: 896437 - RNA, 15 nt, Mycobacterium avium subsp. paratuberculosis
caccagcggccgucg

SEQ ID NO: 896438 - RNA, 18 nt, Mycobacterium avium subsp. paratuberculosis
caccagcggccgucgccg

SEQ ID NO: 896439 - RNA, 13 nt, Mycobacterium avium subsp. paratuberculosis
caccagcggcgcg

SEQ ID NO: 896440 - RNA, 16 nt, Mycobacterium avium subsp. paratuberculosis
caccagcggcgcgucg

SEQ ID NO: 896441 - RNA, 23 nt, Mycobacterium avium subsp. paratuberculosis
caccagcggcgcgucgcugggca

SEQ ID NO: 896442 - RNA, 17 nt, Mycobacterium avium subsp. paratuberculosis
caccagcgcgcggguga

SEQ ID NO: 896443 - RNA, 17 nt, Mycobacterium avium subsp. paratuberculosis
caccagcgcggacacca

SEQ ID NO: 896444 - RNA, 19 nt, Mycobacterium avium subsp. paratuberculosis
caccagcgcggacaccagg

SEQ ID NO: 896445 - RNA, 14 nt, Mycobacterium avium subsp. paratuberculosis
caccagcgcgguca

SEQ ID NO: 896446 - RNA, 15 nt, Mycobacterium avium subsp. paratuberculosis
caccagcgcggugau

SEQ ID NO: 896447 - RNA, 16 nt, Mycobacterium avium subsp. paratuberculosis
caccagcgcggugaug

SEQ ID NO: 896448 - RNA, 22 nt, Mycobacterium avium subsp. paratuberculosis
caccagcgcguagagcaucagg

SEQ ID NO: 896449 - RNA, 13 nt, Mycobacterium avium subsp. paratuberculosis
caccagcgcgacg

SEQ ID NO: 896450 - RNA, 15 nt, Mycobacterium avium subsp. paratuberculosis
caccagcgcgcacgc

SEQ ID NO: 896451 - RNA, 20 nt, Mycobacterium avium subsp. paratuberculosis
caccagcgcuuucgcgcacg

SEQ ID NO: 896452 - RNA, 14 nt, Mycobacterium avium subsp. paratuberculosis
caccagcgugcugc

SEQ ID NO: 896453 - RNA, 14 nt, Mycobacterium avium subsp. paratuberculosis
caccagcguggugc

SEQ ID NO: 896454 - RNA, 19 nt, Mycobacterium avium subsp. paratuberculosis
caccagcguggugcgcccg

SEQ ID NO: 896455 - RNA, 22 nt, Mycobacterium avium subsp. paratuberculosis
caccagcguggugcgcccgucg

SEQ ID NO: 896456 - RNA, 19 nt, Mycobacterium avium subsp. paratuberculosis
caccagcguguggcccugc

SEQ ID NO: 896457 - RNA, 14 nt, Mycobacterium avium subsp. paratuberculosis
caccagcguucguc

SEQ ID NO: 896458 - RNA, 18 nt, Mycobacterium avium subsp. paratuberculosis
caccagcguucgucgccg

SEQ ID NO: 896459 - RNA, 22 nt, Mycobacterium avium subsp. paratuberculosis
caccagcguucgucgccgguga

SEQ ID NO: 896460 - RNA, 13 nt, Mycobacterium avium subsp. paratuberculosis
caccagcgucgcg

SEQ ID NO: 896461 - RNA, 14 nt, Mycobacterium avium subsp. paratuberculosis
caccagcgucgcga

SEQ ID NO: 896462 - RNA, 13 nt, Mycobacterium avium subsp. paratuberculosis
caccagcggucgg

SEQ ID NO: 896463 - RNA, 20 nt, Mycobacterium avium subsp. paratuberculosis
caccagcggucggcgguucg

SEQ ID NO: 896464 - RNA, 21 nt, Mycobacterium avium subsp. paratuberculosis
caccagcggucggcgguucga

SEQ ID NO: 896465 - RNA, 13 nt, Mycobacterium avium subsp. paratuberculosis
caccagcgggcug

SEQ ID NO: 896466 - RNA, 22 nt, Mycobacterium avium subsp. paratuberculosis
caccagcgguaaccacccgugg

SEQ ID NO: 896467 - RNA, 20 nt, Mycobacterium avium subsp. paratuberculosis
caccagcucgaggccgcggg

SEQ ID NO: 896468 - RNA, 14 nt, Mycobacterium avium subsp. paratuberculosis
caccagcguggccg

SEQ ID NO: 896469 - RNA, 16 nt, Mycobacterium avium subsp. paratuberculosis
caccagcucggcgcug

SEQ ID NO: 896470 - RNA, 22 nt, Mycobacterium avium subsp. paratuberculosis
caccagcucggcgcugucggcg

SEQ ID NO: 896471 - RNA, 22 nt, Mycobacterium avium subsp. paratuberculosis
caccagcucggugaucaccaug

SEQ ID NO: 896472 - RNA, 17 nt, Mycobacterium avium subsp. paratuberculosis
caccagcucgucgccga

SEQ ID NO: 896473 - RNA, 18 nt, Mycobacterium avium subsp. paratuberculosis
caccagcucgucgccgac

SEQ ID NO: 896474 - RNA, 19 nt, Mycobacterium avium subsp. paratuberculosis
caccagcucgucgccgacc

SEQ ID NO: 896475 - RNA, 20 nt, Mycobacterium avium subsp. paratuberculosis
caccagcugauucgcggugg

SEQ ID NO: 896476 - RNA, 23 nt, Mycobacterium avium subsp. paratuberculosis
caccagcugauucgcgguggcga

SEQ ID NO: 896477 - RNA, 17 nt, Mycobacterium avium subsp. paratuberculosis
caccagcuggauggcgc

SEQ ID NO: 896478 - RNA, 17 nt, Mycobacterium avium subsp. paratuberculosis
caccagcugggaggcgc

SEQ ID NO: 896479 - RNA, 15 nt, Mycobacterium avium subsp. paratuberculosis
caccagcugucccag

SEQ ID NO: 896480 - RNA, 21 nt, Mycobacterium avium subsp. paratuberculosis
caccagcucgaugccguucgc

SEQ ID NO: 896481 - RNA, 22 nt, Mycobacterium avium subsp. paratuberculosis
caccagcugcggaaaugcccgc

SEQ ID NO: 896482 - RNA, 20 nt, Mycobacterium avium subsp. paratuberculosis
cacccgccggguggccgcca

SEQ ID NO: 896483 - RNA, 15 nt, Mycobacterium avium subsp. paratuberculosis
cacccgcgcgucgcg

SEQ ID NO: 896484 - RNA, 14 nt, Mycobacterium avium subsp. paratuberculosis
cacccgcgccggca

SEQ ID NO: 896485 - RNA, 14 nt, Mycobacterium avium subsp. paratuberculosis
cacccgcgccucca

SEQ ID NO: 896486 - RNA, 16 nt, Mycobacterium avium subsp. paratuberculosis
caccccgaccgacgcg

SEQ ID NO: 896487 - RNA, 16 nt, Mycobacterium avium subsp. paratuberculosis
caccccgacggagacg

SEQ ID NO: 896488 - RNA, 18 nt, Mycobacterium avium subsp. paratuberculosis
caccccgagcucgggcgc

SEQ ID NO: 896489 - RNA, 18 nt, Mycobacterium avium subsp. paratuberculosis
caccccgaguucggccag

SEQ ID NO: 896490 - RNA, 17 nt, Mycobacterium avium subsp. paratuberculosis
caccccgaucaggucag

SEQ ID NO: 896491 - RNA, 20 nt, Mycobacterium avium subsp. paratuberculosis
caccccgaugcggugccggg

SEQ ID NO: 896492 - RNA, 16 nt, Mycobacterium avium subsp. paratuberculosis
caccccgcagaacacc

SEQ ID NO: 896493 - RNA, 14 nt, Mycobacterium avium subsp. paratuberculosis
caccccgcccagcg

SEQ ID NO: 896494 - RNA, 14 nt, Mycobacterium avium subsp. paratuberculosis
cacccgccagcccg

SEQ ID NO: 896495 - RNA, 19 nt, Mycobacterium avium subsp. paratuberculosis
cacccgccagcccgcgucg

SEQ ID NO: 896496 - RNA, 16 nt, Mycobacterium avium subsp. paratuberculosis
cacccgccauggcggc

SEQ ID NO: 896497 - RNA, 18 nt, Mycobacterium avium subsp. paratuberculosis
cacccgccauggcggcau

SEQ ID NO: 896498 - RNA, 14 nt, Mycobacterium avium subsp. paratuberculosis
cacccgccccgccg

SEQ ID NO: 896499 - RNA, 18 nt, Mycobacterium avium subsp. paratuberculosis
cacccgccccgccgcggc

SEQ ID NO: 896500 - RNA, 20 nt, Mycobacterium avium subsp. paratuberculosis
cacccgccccgccgcggcca

SEQ ID NO: 896501 - RNA, 16 nt, Mycobacterium avium subsp. paratuberculosis
cacccgcccggacgcg

SEQ ID NO: 896502 - RNA, 14 nt, Mycobacterium avium subsp. paratuberculosis
cacccagcgggcga

SEQ ID NO: 896503 - RNA, 15 nt, Mycobacterium avium subsp. paratuberculosis
cacccagcgggcgac

SEQ ID NO: 896504 - RNA, 18 nt, Mycobacterium avium subsp. paratuberculosis
cacccagcgggcgacguc

SEQ ID NO: 896505 - RNA, 22 nt, Mycobacterium avium subsp. paratuberculosis
cacccagcgggcgacgucgggg

SEQ ID NO: 896506 - RNA, 13 nt, Mycobacterium avium subsp. paratuberculosis
cacccagcggcgc

SEQ ID NO: 896507 - RNA, 17 nt, Mycobacterium avium subsp. paratuberculosis
cacccagccgcugaacg

SEQ ID NO: 896508 - RNA, 20 nt, Mycobacterium avium subsp. paratuberculosis
cacccaggaaaaccagcgac

SEQ ID NO: 896509 - RNA, 14 nt, Mycobacterium avium subsp. paratuberculosis
cacccaggccaccc

SEQ ID NO: 896510 - RNA, 19 nt, Mycobacterium avium subsp. paratuberculosis
cacccagguguccggcccg

SEQ ID NO: 896511 - RNA, 14 nt, Mycobacterium avium subsp. paratuberculosis
cacccaggucaccg

SEQ ID NO: 896512 - RNA, 20 nt, Mycobacterium avium subsp. paratuberculosis
cacccaggucaugguggcgg

SEQ ID NO: 896513 - RNA, 23 nt, Mycobacterium avium subsp. paratuberculosis
cacccaggucaugguggcggcgc

SEQ ID NO: 896514 - RNA, 14 nt, Mycobacterium avium subsp. paratuberculosis
cacccccagcucga

SEQ ID NO: 896515 - RNA, 14 nt, Mycobacterium avium subsp. paratuberculosis
caccccaucggcca

SEQ ID NO: 896516 - RNA, 15 nt, Mycobacterium avium subsp. paratuberculosis
caccccaucggccag

SEQ ID NO: 896517 - RNA, 13 nt, Mycobacterium avium subsp. paratuberculosis
cacccccggggcc

SEQ ID NO: 896518 - RNA, 16 nt, Mycobacterium avium subsp. paratuberculosis
cacccccuacgccgug

SEQ ID NO: 896519 - RNA, 20 nt, Mycobacterium avium subsp. paratuberculosis
cacccccuucuccacgcucg

SEQ ID NO: 896520 - RNA, 17 nt, Mycobacterium avium subsp. paratuberculosis
caccccgaaccaguucg

SEQ ID NO: 896521 - RNA, 22 nt, Mycobacterium avium subsp. paratuberculosis
caccccgaaccgcccgcccggc

SEQ ID NO: 896522 - RNA, 22 nt, Mycobacterium avium subsp. paratuberculosis
cacccccgcgcugcccagcgcg

SEQ ID NO: 896523 - RNA, 13 nt, Mycobacterium avium subsp. paratuberculosis
cacccccggcgcg

SEQ ID NO: 896524 - RNA, 20 nt, Mycobacterium avium subsp. paratuberculosis
caccccccaguuucccgucg

SEQ ID NO: 896525 - RNA, 19 nt, Mycobacterium avium subsp. paratuberculosis
caccaggacgcgaccggcc

SEQ ID NO: 896526 - RNA, 20 nt, Mycobacterium avium subsp. paratuberculosis
caccaggagcaccugcgcga

SEQ ID NO: 896527 - RNA, 23 nt, Mycobacterium avium subsp. paratuberculosis
caccagggcgucgagcgcgucgu

SEQ ID NO: 896528 - RNA, 16 nt, Mycobacterium avium subsp. paratuberculosis
caccagguaggcgacc

SEQ ID NO: 896529 - RNA, 23 nt, Mycobacterium avium subsp. paratuberculosis
caccagguaggcgaccaugccca

SEQ ID NO: 896530 - RNA, 19 nt, Mycobacterium avium subsp. paratuberculosis
caccagguaggcgguggcg

SEQ ID NO: 896531 - RNA, 20 nt, Mycobacterium avium subsp. paratuberculosis
caccagguaggcgguggcgc

SEQ ID NO: 896532 - RNA, 18 nt, Mycobacterium avium subsp. paratuberculosis
caccagguaccggcgggc

SEQ ID NO: 896533 - RNA, 14 nt, Mycobacterium avium subsp. paratuberculosis
caccagggugucga

SEQ ID NO: 896534 - RNA, 14 nt, Mycobacterium avium subsp. paratuberculosis
caccagggugucgu

SEQ ID NO: 896535 - RNA, 16 nt, Mycobacterium avium subsp. paratuberculosis
caccaggccgaagacg

SEQ ID NO: 896536 - RNA, 13 nt, Mycobacterium avium subsp. paratuberculosis
caccaggccgacg

SEQ ID NO: 896537 - RNA, 20 nt, Mycobacterium avium subsp. paratuberculosis
caccagggucucgcgcagca

SEQ ID NO: 896538 - RNA, 22 nt, Mycobacterium avium subsp. paratuberculosis
caccagggucucgcgcagcacg

SEQ ID NO: 896539 - RNA, 20 nt, Mycobacterium avium subsp. paratuberculosis
caccagggucuucagcccgc

SEQ ID NO: 896540 - RNA, 22 nt, Mycobacterium avium subsp. paratuberculosis
caccagggucuucagcccgcgc

SEQ ID NO: 896541 - RNA, 20 nt, Mycobacterium avium subsp. paratuberculosis
caccagggugccccgcgacc

SEQ ID NO: 896542 - RNA, 21 nt, Mycobacterium avium subsp. paratuberculosis
caccagggugccccgcgaccg

SEQ ID NO: 896543 - RNA, 16 nt, Mycobacterium avium subsp. paratuberculosis
caccagggugccgccg

SEQ ID NO: 896544 - RNA, 19 nt, Mycobacterium avium subsp. paratuberculosis
caccagggugccgccgggc

SEQ ID NO: 896545 - RNA, 20 nt, Mycobacterium avium subsp. paratuberculosis
caccagggugcgcagcgcgu

SEQ ID NO: 896546 - RNA, 22 nt, Mycobacterium avium subsp. paratuberculosis
caccagggugcgcagcgcgucg

SEQ ID NO: 896547 - RNA, 17 nt, Mycobacterium avium subsp. paratuberculosis
caccaggguggccgcca

SEQ ID NO: 896548 - RNA, 18 nt, Mycobacterium avium subsp. paratuberculosis
cacccaccggcccagccg

SEQ ID NO: 896549 - RNA, 20 nt, Mycobacterium avium subsp. paratuberculosis
cacccaccggcccagccggc

SEQ ID NO: 896550 - RNA, 14 nt, Mycobacterium avium subsp. paratuberculosis
cacccaccggcgca

SEQ ID NO: 896551 - RNA, 15 nt, Mycobacterium avium subsp. paratuberculosis
cacccaccggcgcag

SEQ ID NO: 896552 - RNA, 24 nt, Mycobacterium avium subsp. paratuberculosis
caccaggucgagguccucggcgau

SEQ ID NO: 896553 - RNA, 15 nt, Mycobacterium avium subsp. paratuberculosis
caccaggucgcggua

SEQ ID NO: 896554 - RNA, 15 nt, Mycobacterium avium subsp. paratuberculosis
cacccacuggcggcc

SEQ ID NO: 896555 - RNA, 16 nt, Mycobacterium avium subsp. paratuberculosis
cacccacuggcggccg

SEQ ID NO: 896556 - RNA, 18 nt, Mycobacterium avium subsp. paratuberculosis
cacccacucccagccgcc

SEQ ID NO: 896557 - RNA, 15 nt, Mycobacterium avium subsp. paratuberculosis
cacccacucggacag

SEQ ID NO: 896558 - RNA, 19 nt, Mycobacterium avium subsp. paratuberculosis
cacccagaucgcccgggcg

SEQ ID NO: 896559 - RNA, 23 nt, Mycobacterium avium subsp. paratuberculosis
cacccagaucgcccgggcggcgg

SEQ ID NO: 896560 - RNA, 18 nt, Mycobacterium avium subsp. paratuberculosis
cacccagccguugggcag

SEQ ID NO: 896561 - RNA, 18 nt, Mycobacterium avium subsp. paratuberculosis
cacccagacguguggcac

SEQ ID NO: 896562 - RNA, 18 nt, Mycobacterium avium subsp. paratuberculosis
cacccagaugcccagcgg

SEQ ID NO: 896563 - RNA, 20 nt, Mycobacterium avium subsp. paratuberculosis
cacccagaugcccagcggca

SEQ ID NO: 896564 - RNA, 21 nt, Mycobacterium avium subsp. paratuberculosis
caccgaaucacccacggccac

SEQ ID NO: 896565 - RNA, 14 nt, Mycobacterium avium subsp. paratuberculosis
caccgaagccgacg

SEQ ID NO: 896566 - RNA, 16 nt, Mycobacterium avium subsp. paratuberculosis
caccgaagccgacguc

SEQ ID NO: 896567 - RNA, 19 nt, Mycobacterium avium subsp. paratuberculosis
caccgaagccgacgucgac

SEQ ID NO: 896568 - RNA, 18 nt, Mycobacterium avium subsp. paratuberculosis
caccgaaccggcgggguc

SEQ ID NO: 896569 - RNA, 16 nt, Mycobacterium avium subsp. paratuberculosis
caccgaacgccgaggu

SEQ ID NO: 896570 - RNA, 18 nt, Mycobacterium avium subsp. paratuberculosis
caccgaacgccgaggugc

SEQ ID NO: 896571 - RNA, 17 nt, Mycobacterium avium subsp. paratuberculosis
caccgaagaaccccgag

SEQ ID NO: 896572 - RNA, 17 nt, Mycobacterium avium subsp. paratuberculosis
caccgacagggccagcg

SEQ ID NO: 896573 - RNA, 20 nt, Mycobacterium avium subsp. paratuberculosis
caccgacagggccagcgcca

SEQ ID NO: 896574 - RNA, 19 nt, Mycobacterium avium subsp. paratuberculosis
caccgacaggucgaagggc

SEQ ID NO: 896575 - RNA, 17 nt, Mycobacterium avium subsp. paratuberculosis
caccgacagcacccggc

SEQ ID NO: 896576 - RNA, 19 nt, Mycobacterium avium subsp. paratuberculosis
caccgacagcacccggccc

SEQ ID NO: 896577 - RNA, 20 nt, Mycobacterium avium subsp. paratuberculosis
caccgacagcacccggcccc

SEQ ID NO: 896578 - RNA, 17 nt, Mycobacterium avium subsp. paratuberculosis
caccgacaugucgccgg

SEQ ID NO: 896579 - RNA, 18 nt, Mycobacterium avium subsp. paratuberculosis
caccgacaugucgccggg

SEQ ID NO: 896580 - RNA, 19 nt, Mycobacterium avium subsp. paratuberculosis
caccgacaugucgccgggc

SEQ ID NO: 896581 - RNA, 18 nt, Mycobacterium avium subsp. paratuberculosis
caccgaauuguccagcag

SEQ ID NO: 896582 - RNA, 18 nt, Mycobacterium avium subsp. paratuberculosis
caccgacaagggccgggc

SEQ ID NO: 896583 - RNA, 20 nt, Mycobacterium avium subsp. paratuberculosis
caccgacaagggccgggcgc

SEQ ID NO: 896584 - RNA, 14 nt, Mycobacterium avium subsp. paratuberculosis
caccgacaccaccg

SEQ ID NO: 896585 - RNA, 18 nt, Mycobacterium avium subsp. paratuberculosis
caccgacaccaccggccg

SEQ ID NO: 896586 - RNA, 13 nt, Mycobacterium avium subsp. paratuberculosis
caccgacaccccg

SEQ ID NO: 896587 - RNA, 15 nt, Mycobacterium avium subsp. paratuberculosis
caccgacaccggccg

SEQ ID NO: 896588 - RNA, 16 nt, Mycobacterium avium subsp. paratuberculosis
caccgaccagcgggau

SEQ ID NO: 896589 - RNA, 18 nt, Mycobacterium avium subsp. paratuberculosis
caccgaccccucggcggc

SEQ ID NO: 896590 - RNA, 22 nt, Mycobacterium avium subsp. paratuberculosis
caccgaccccucggcggccguc

SEQ ID NO: 896591 - RNA, 22 nt, Mycobacterium avium subsp. paratuberculosis
caccgacgaccaucagcgcccg

SEQ ID NO: 896592 - RNA, 21 nt, Mycobacterium avium subsp. paratuberculosis
caccgacgaccucggugucga

SEQ ID NO: 896593 - RNA, 13 nt, Mycobacterium avium subsp. paratuberculosis
caccgacgcaucc

SEQ ID NO: 896594 - RNA, 16 nt, Mycobacterium avium subsp. paratuberculosis
caccgacgccacgucg

SEQ ID NO: 896595 - RNA, 14 nt, Mycobacterium avium subsp. paratuberculosis
caccgacgccagcg

SEQ ID NO: 896596 - RNA, 16 nt, Mycobacterium avium subsp. paratuberculosis
caccgacuccuccggc

SEQ ID NO: 896597 - RNA, 14 nt, Mycobacterium avium subsp. paratuberculosis
caccgacugcgacg

SEQ ID NO: 896598 - RNA, 18 nt, Mycobacterium avium subsp. paratuberculosis
caccgacggagccgagca

SEQ ID NO: 896599 - RNA, 12 nt, Mycobacterium avium subsp. paratuberculosis
caccgacggccg

SEQ ID NO: 896600 - RNA, 13 nt, Mycobacterium avium subsp. paratuberculosis
caccgacggccgc

SEQ ID NO: 896601 - RNA, 14 nt, Mycobacterium avium subsp. paratuberculosis
caccgacggccgca

SEQ ID NO: 896602 - RNA, 16 nt, Mycobacterium avium subsp. paratuberculosis
caccgacgcggcgacc

SEQ ID NO: 896603 - RNA, 17 nt, Mycobacterium avium subsp. paratuberculosis
caccgacgcggcgacca

SEQ ID NO: 896604 - RNA, 15 nt, Mycobacterium avium subsp. paratuberculosis
caccgacgcgucgcg

SEQ ID NO: 896605 - RNA, 16 nt, Mycobacterium avium subsp. paratuberculosis
caccgacgcgucgcgg

SEQ ID NO: 896606 - RNA, 17 nt, Mycobacterium avium subsp. paratuberculosis
caccgacgcgucgcggc

SEQ ID NO: 896607 - RNA, 12 nt, Mycobacterium avium subsp. paratuberculosis
cacccgcggcgc

SEQ ID NO: 896608 - RNA, 22 nt, Mycobacterium avium subsp. paratuberculosis
cacccgcugauccagcagcgcc

SEQ ID NO: 896609 - RNA, 17 nt, Mycobacterium avium subsp. paratuberculosis
cacccgcugcaccagcc

SEQ ID NO: 896610 - RNA, 18 nt, Mycobacterium avium subsp. paratuberculosis
cacccgcugcaccagccc

SEQ ID NO: 896611 - RNA, 20 nt, Mycobacterium avium subsp. paratuberculosis
cacccgcugcagccgguccg

SEQ ID NO: 896612 - RNA, 22 nt, Mycobacterium avium subsp. paratuberculosis
cacccgcugcucgaccucggcg

SEQ ID NO: 896613 - RNA, 21 nt, Mycobacterium avium subsp. paratuberculosis
cacccggucgaugugcgcgcu

SEQ ID NO: 896614 - RNA, 23 nt, Mycobacterium avium subsp. paratuberculosis
cacccggucgccggugugaucga

SEQ ID NO: 896615 - RNA, 19 nt, Mycobacterium avium subsp. paratuberculosis
cacccgguugagcaccgca

SEQ ID NO: 896616 - RNA, 17 nt, Mycobacterium avium subsp. paratuberculosis
cacccgguccccggagu

SEQ ID NO: 896617 - RNA, 14 nt, Mycobacterium avium subsp. paratuberculosis
cacccgguccggcu

SEQ ID NO: 896618 - RNA, 20 nt, Mycobacterium avium subsp. paratuberculosis
cacccgguccggcuggucgg

SEQ ID NO: 896619 - RNA, 16 nt, Mycobacterium avium subsp. paratuberculosis
cacccgcuccaccgaa

SEQ ID NO: 896620 - RNA, 17 nt, Mycobacterium avium subsp. paratuberculosis
cacccgcucgccgauga

SEQ ID NO: 896621 - RNA, 14 nt, Mycobacterium avium subsp. paratuberculosis
cacccgcucggcga

SEQ ID NO: 896622 - RNA, 16 nt, Mycobacterium avium subsp. paratuberculosis
cacccgcucggcgauc

SEQ ID NO: 896623 - RNA, 14 nt, Mycobacterium avium subsp. paratuberculosis
cacccgcggaacgc

SEQ ID NO: 896624 - RNA, 17 nt, Mycobacterium avium subsp. paratuberculosis
cacccgcggaacgcuca

SEQ ID NO: 896625 - RNA, 17 nt, Mycobacterium avium subsp. paratuberculosis
cacccgcggcgcgauga

SEQ ID NO: 896626 - RNA, 14 nt, Mycobacterium avium subsp. paratuberculosis
cacccgcgggucgu

SEQ ID NO: 896627 - RNA, 22 nt, Mycobacterium avium subsp. paratuberculosis
cacccgcgggucgucgggcggc

SEQ ID NO: 896628 - RNA, 16 nt, Mycobacterium avium subsp. paratuberculosis
cacccgcggccgcugc

SEQ ID NO: 896629 - RNA, 17 nt, Mycobacterium avium subsp. paratuberculosis
cacccgcggccgcugcg

SEQ ID NO: 896630 - RNA, 20 nt, Mycobacterium avium subsp. paratuberculosis
cacccgcggccggcccagcg

SEQ ID NO: 896631 - RNA, 21 nt, Mycobacterium avium subsp. paratuberculosis
cacccgcggccggcccagcgc

SEQ ID NO: 896632 - RNA, 22 nt, Mycobacterium avium subsp. paratuberculosis
cacccgcggccggcccagcgcg

SEQ ID NO: 896633 - RNA, 19 nt, Mycobacterium avium subsp. paratuberculosis
cacccgugggccgaccggc

SEQ ID NO: 896634 - RNA, 21 nt, Mycobacterium avium subsp. paratuberculosis
cacccgugggccgaccggccg

SEQ ID NO: 896635 - RNA, 22 nt, Mycobacterium avium subsp. paratuberculosis
cacccgugggccgaccggccgg

SEQ ID NO: 896636 - RNA, 23 nt, Mycobacterium avium subsp. paratuberculosis
cacccguggugggcgaacagcag

SEQ ID NO: 896637 - RNA, 17 nt, Mycobacterium avium subsp. paratuberculosis
cacccuuuuccaucugg

SEQ ID NO: 896638 - RNA, 23 nt, Mycobacterium avium subsp. paratuberculosis
cacccuuuuccaucugggcgcgc

SEQ ID NO: 896639 - RNA, 19 nt, Mycobacterium avium subsp. paratuberculosis
cacccguuugaggcgagca

SEQ ID NO: 896640 - RNA, 14 nt, Mycobacterium avium subsp. paratuberculosis
cacccgucgacucg

SEQ ID NO: 896641 - RNA, 17 nt, Mycobacterium avium subsp. paratuberculosis
cacccgucgacucggcg

SEQ ID NO: 896642 - RNA, 22 nt, Mycobacterium avium subsp. paratuberculosis
cacccgucggugaaguuggcgg

SEQ ID NO: 896643 - RNA, 15 nt, Mycobacterium avium subsp. paratuberculosis
cacccguucggcguc

SEQ ID NO: 896644 - RNA, 16 nt, Mycobacterium avium subsp. paratuberculosis
cacccguucggcgucg

SEQ ID NO: 896645 - RNA, 14 nt, Mycobacterium avium subsp. paratuberculosis
caccgaaagccgua

SEQ ID NO: 896646 - RNA, 22 nt, Mycobacterium avium subsp. paratuberculosis
caccgaaagccguagcgcaaca

SEQ ID NO: 896647 - RNA, 16 nt, Mycobacterium avium subsp. paratuberculosis
caccgaaaagcccgcc

SEQ ID NO: 896648 - RNA, 20 nt, Mycobacterium avium subsp. paratuberculosis
caccgaaaagcccgccgccu

SEQ ID NO: 896649 - RNA, 19 nt, Mycobacterium avium subsp. paratuberculosis
caccgaaaccuugaucggc

SEQ ID NO: 896650 - RNA, 22 nt, Mycobacterium avium subsp. paratuberculosis
caccgaaaccuugaucggcccc

SEQ ID NO: 896651 - RNA, 15 nt, Mycobacterium avium subsp. paratuberculosis
caccgaacccaccag

SEQ ID NO: 896652 - RNA, 21 nt, Mycobacterium avium subsp. paratuberculosis
caccgaacccaccagcgccug

SEQ ID NO: 896653 - RNA, 21 nt, Mycobacterium avium subsp. paratuberculosis
caccgaacccggaucggccau

SEQ ID NO: 896654 - RNA, 16 nt, Mycobacterium avium subsp. paratuberculosis
caccgaaccgccccgc

SEQ ID NO: 896655 - RNA, 20 nt, Mycobacterium avium subsp. paratuberculosis
caccgaaccgccccgcgcga

SEQ ID NO: 896656 - RNA, 23 nt, Mycobacterium avium subsp. paratuberculosis
auagccuuugccgugcucggcgg

SEQ ID NO: 896657 - RNA, 12 nt, Mycobacterium avium subsp. paratuberculosis
auagccggccgc

SEQ ID NO: 896658 - RNA, 15 nt, Mycobacterium avium subsp. paratuberculosis
auagccggccgcguc

SEQ ID NO: 896659 - RNA, 20 nt, Mycobacterium avium subsp. paratuberculosis
auagccggccgcgucgccga

SEQ ID NO: 896660 - RNA, 23 nt, Mycobacterium avium subsp. paratuberculosis
auagccggccgcgucgccgacca

SEQ ID NO: 896661 - RNA, 20 nt, Mycobacterium avium subsp. paratuberculosis
auagccggugaucgcggcgc

SEQ ID NO: 896662 - RNA, 15 nt, Mycobacterium avium subsp. paratuberculosis
auagccgucggcgga

SEQ ID NO: 896663 - RNA, 15 nt, Mycobacterium avium subsp. paratuberculosis
auagccgucggcggc

SEQ ID NO: 896664 - RNA, 17 nt, Mycobacterium avium subsp. paratuberculosis
auagccgucggcggccu

SEQ ID NO: 896665 - RNA, 21 nt, Mycobacterium avium subsp. paratuberculosis
auagcccgccgcggcgaccgg

SEQ ID NO: 896666 - RNA, 16 nt, Mycobacterium avium subsp. paratuberculosis
auagccgagcggcgcc

SEQ ID NO: 896667 - RNA, 14 nt, Mycobacterium avium subsp. paratuberculosis
aucaauucgaagcc

SEQ ID NO: 896668 - RNA, 13 nt, Mycobacterium avium subsp. paratuberculosis
aucaacgcgccga

SEQ ID NO: 896669 - RNA, 16 nt, Mycobacterium avium subsp. paratuberculosis
aucaacgcgccgaaca

SEQ ID NO: 896670 - RNA, 22 nt, Mycobacterium avium subsp. paratuberculosis
aucaacgcgccgaacaacggcg

SEQ ID NO: 896671 - RNA, 16 nt, Mycobacterium avium subsp. paratuberculosis
aucaacgggucgagca

SEQ ID NO: 896672 - RNA, 14 nt, Mycobacterium avium subsp. paratuberculosis
aucaacugcaccag

SEQ ID NO: 896673 - RNA, 14 nt, Mycobacterium avium subsp. paratuberculosis
aucaacaggcccag

SEQ ID NO: 896674 - RNA, 15 nt, Mycobacterium avium subsp. paratuberculosis
aucaacaggcccagc

SEQ ID NO: 896675 - RNA, 18 nt, Mycobacterium avium subsp. paratuberculosis
aucaacaggcccagcagc

SEQ ID NO: 896676 - RNA, 19 nt, Mycobacterium avium subsp. paratuberculosis
aucaacaggcccagcagcg

SEQ ID NO: 896677 - RNA, 22 nt, Mycobacterium avium subsp. paratuberculosis
aucaacccgagcaccgggccga

SEQ ID NO: 896678 - RNA, 20 nt, Mycobacterium avium subsp. paratuberculosis
aucaaccgauuucggccagc

SEQ ID NO: 896679 - RNA, 20 nt, Mycobacterium avium subsp. paratuberculosis
aucagaugcucgucggucag

SEQ ID NO: 896680 - RNA, 23 nt, Mycobacterium avium subsp. paratuberculosis
aucagcaccacguugcgcccggc

SEQ ID NO: 896681 - RNA, 21 nt, Mycobacterium avium subsp. paratuberculosis
aucagcaccagguggcccgac

SEQ ID NO: 896682 - RNA, 13 nt, Mycobacterium avium subsp. paratuberculosis
aucagagcgggcc

SEQ ID NO: 896683 - RNA, 15 nt, Mycobacterium avium subsp. paratuberculosis
aucagccgagccggg

SEQ ID NO: 896684 - RNA, 21 nt, Mycobacterium avium subsp. paratuberculosis
aucagccgauacaugugccga

SEQ ID NO: 896685 - RNA, 22 nt, Mycobacterium avium subsp. paratuberculosis
aucagccgauacaugugccgau

SEQ ID NO: 896686 - RNA, 11 nt, Mycobacterium avium subsp. paratuberculosis
aucagccgccc

SEQ ID NO: 896687 - RNA, 13 nt, Mycobacterium avium subsp. paratuberculosis
aucagccgccguc

SEQ ID NO: 896688 - RNA, 15 nt, Mycobacterium avium subsp. paratuberculosis
aucagccgcgacagc

SEQ ID NO: 896689 - RNA, 19 nt, Mycobacterium avium subsp. paratuberculosis
aucagccggcgagcgcgcu

SEQ ID NO: 896690 - RNA, 19 nt, Mycobacterium avium subsp. paratuberculosis
aucagccggguagcgccgc

SEQ ID NO: 896691 - RNA, 16 nt, Mycobacterium avium subsp. paratuberculosis
aucagcccgcccacca

SEQ ID NO: 896692 - RNA, 19 nt, Mycobacterium avium subsp. paratuberculosis
aucagcccgcccaccacga

SEQ ID NO: 896693 - RNA, 14 nt, Mycobacterium avium subsp. paratuberculosis
aucagccaguugau

SEQ ID NO: 896694 - RNA, 20 nt, Mycobacterium avium subsp. paratuberculosis
aucagcgacucgaccccgcc

SEQ ID NO: 896695 - RNA, 23 nt, Mycobacterium avium subsp. paratuberculosis
aucagcgccagcaacacccagcc

SEQ ID NO: 896696 - RNA, 10 nt, Mycobacterium avium subsp. paratuberculosis
aucagcgccc

SEQ ID NO: 896697 - RNA, 20 nt, Mycobacterium avium subsp. paratuberculosis
aucagcgcccgcgcgggcug

SEQ ID NO: 896698 - RNA, 18 nt, Mycobacterium avium subsp. paratuberculosis
aucagcgcgcacagcgcc

SEQ ID NO: 896699 - RNA, 14 nt, Mycobacterium avium subsp. paratuberculosis
aucagcgcgcccag

SEQ ID NO: 896700 - RNA, 14 nt, Mycobacterium avium subsp. paratuberculosis
aucagcaccgacgc

SEQ ID NO: 896701 - RNA, 20 nt, Mycobacterium avium subsp. paratuberculosis
aucagcaccgacgcggcgac

SEQ ID NO: 896702 - RNA, 14 nt, Mycobacterium avium subsp. paratuberculosis
aucagcaccgccac

SEQ ID NO: 896703 - RNA, 13 nt, Mycobacterium avium subsp. paratuberculosis
aucagcaccgcga

SEQ ID NO: 896704 - RNA, 14 nt, Mycobacterium avium subsp. paratuberculosis
aucagcaccgcgaa

SEQ ID NO: 896705 - RNA, 15 nt, Mycobacterium avium subsp. paratuberculosis
aucagcaccggguga

SEQ ID NO: 896706 - RNA, 18 nt, Mycobacterium avium subsp. paratuberculosis
aucagcaccguccacagc

SEQ ID NO: 896707 - RNA, 23 nt, Mycobacterium avium subsp. paratuberculosis
aucagcaccguccacagccggcg

SEQ ID NO: 896708 - RNA, 22 nt, Mycobacterium avium subsp. paratuberculosis
aucagcagaugcgcgucgcggc

SEQ ID NO: 896709 - RNA, 18 nt, Mycobacterium avium subsp. paratuberculosis
aucagcagcacauccggu

SEQ ID NO: 896710 - RNA, 19 nt, Mycobacterium avium subsp. paratuberculosis
aucagcagcacauccgguu

SEQ ID NO: 896711 - RNA, 14 nt, Mycobacterium avium subsp. paratuberculosis
aucagcagcacccg

SEQ ID NO: 896712 - RNA, 16 nt, Mycobacterium avium subsp. paratuberculosis
aucagcagcaccggcg

SEQ ID NO: 896713 - RNA, 13 nt, Mycobacterium avium subsp. paratuberculosis
aucagcacgucgc

SEQ ID NO: 896714 - RNA, 22 nt, Mycobacterium avium subsp. paratuberculosis
aucagcacuucauggucgucgu

SEQ ID NO: 896715 - RNA, 15 nt, Mycobacterium avium subsp. paratuberculosis
aucagcagccgggcc

SEQ ID NO: 896716 - RNA, 20 nt, Mycobacterium avium subsp. paratuberculosis
aucagcagguugauccgcgc

SEQ ID NO: 896717 - RNA, 23 nt, Mycobacterium avium subsp. paratuberculosis
aucagcaggcccucggccagcca

SEQ ID NO: 896718 - RNA, 16 nt, Mycobacterium avium subsp. paratuberculosis
aucagcaggcuggcgg

SEQ ID NO: 896719 - RNA, 20 nt, Mycobacterium avium subsp. paratuberculosis
aucagcaggcuggcggcgau

SEQ ID NO: 896720 - RNA, 16 nt, Mycobacterium avium subsp. paratuberculosis
aucagcagcgccucgc

SEQ ID NO: 896721 - RNA, 16 nt, Mycobacterium avium subsp. paratuberculosis
aucagcaggaccaggc

SEQ ID NO: 896722 - RNA, 18 nt, Mycobacterium avium subsp. paratuberculosis
aucagcaggaccgggauc

SEQ ID NO: 896723 - RNA, 15 nt, Mycobacterium avium subsp. paratuberculosis
aucagcagugccccg

SEQ ID NO: 896724 - RNA, 16 nt, Mycobacterium avium subsp. paratuberculosis
aucagcaugccgguca

SEQ ID NO: 896725 - RNA, 16 nt, Mycobacterium avium subsp. paratuberculosis
aucagccacaccgccg

SEQ ID NO: 896726 - RNA, 18 nt, Mycobacterium avium subsp. paratuberculosis
aucagccacaccgccggc

SEQ ID NO: 896727 - RNA, 15 nt, Mycobacterium avium subsp. paratuberculosis
aucaccggcuugccg

SEQ ID NO: 896728 - RNA, 13 nt, Mycobacterium avium subsp. paratuberculosis
aucaccgggacac

SEQ ID NO: 896729 - RNA, 22 nt, Mycobacterium avium subsp. paratuberculosis
aucaccgcgguguugagcgcgu

SEQ ID NO: 896730 - RNA, 19 nt, Mycobacterium avium subsp. paratuberculosis
aucaccgcguagcgccgcc

SEQ ID NO: 896731 - RNA, 14 nt, Mycobacterium avium subsp. paratuberculosis
aucaccggaccggc

SEQ ID NO: 896732 - RNA, 20 nt, Mycobacterium avium subsp. paratuberculosis
aucaccggcacgugcggguu

SEQ ID NO: 896733 - RNA, 20 nt, Mycobacterium avium subsp. paratuberculosis
aucaccggcagcagcgcguc

SEQ ID NO: 896734 - RNA, 21 nt, Mycobacterium avium subsp. paratuberculosis
aucaccggcagcagcgcgucg

SEQ ID NO: 896735 - RNA, 16 nt, Mycobacterium avium subsp. paratuberculosis
aucacgacgcgaccga

SEQ ID NO: 896736 - RNA, 22 nt, Mycobacterium avium subsp. paratuberculosis
aucaccucggugaugucgacgu

SEQ ID NO: 896737 - RNA, 13 nt, Mycobacterium avium subsp. paratuberculosis
aucaccugcgggc

SEQ ID NO: 896738 - RNA, 19 nt, Mycobacterium avium subsp. paratuberculosis
aucaccugggagaacucga

SEQ ID NO: 896739 - RNA, 18 nt, Mycobacterium avium subsp. paratuberculosis
aucaccuggugcucgcgc

SEQ ID NO: 896740 - RNA, 19 nt, Mycobacterium avium subsp. paratuberculosis
aucaccuggugcucgcgcu

SEQ ID NO: 896741 - RNA, 23 nt, Mycobacterium avium subsp. paratuberculosis
aucaccuggugcucgcgcucguc

SEQ ID NO: 896742 - RNA, 18 nt, Mycobacterium avium subsp. paratuberculosis
aucaccuucugcgcgccg

SEQ ID NO: 896743 - RNA, 20 nt, Mycobacterium avium subsp. paratuberculosis
aucaccuucugcgcgccguc

SEQ ID NO: 896744 - RNA, 19 nt, Mycobacterium avium subsp. paratuberculosis
aucaccuugcccugcgugc

SEQ ID NO: 896745 - RNA, 19 nt, Mycobacterium avium subsp. paratuberculosis
aucacgcagaacucgucgc

SEQ ID NO: 896746 - RNA, 19 nt, Mycobacterium avium subsp. paratuberculosis
aucacgguggccgccacca

SEQ ID NO: 896747 - RNA, 19 nt, Mycobacterium avium subsp. paratuberculosis
aucacguguccgucgccgg

SEQ ID NO: 896748 - RNA, 20 nt, Mycobacterium avium subsp. paratuberculosis
aucaccgccagcgcgccgau

SEQ ID NO: 896749 - RNA, 21 nt, Mycobacterium avium subsp. paratuberculosis
aucaccgccagcgcgccgauc

SEQ ID NO: 896750 - RNA, 23 nt, Mycobacterium avium subsp. paratuberculosis
aucaccgccccgacgaucgcgcc

SEQ ID NO: 896751 - RNA, 14 nt, Mycobacterium avium subsp. paratuberculosis
aucaccgccgcggc

SEQ ID NO: 896752 - RNA, 14 nt, Mycobacterium avium subsp. paratuberculosis
aucaccgccgaggg

SEQ ID NO: 896753 - RNA, 20 nt, Mycobacterium avium subsp. paratuberculosis
aucaccgcgggcgcgccguc

SEQ ID NO: 896754 - RNA, 16 nt, Mycobacterium avium subsp. paratuberculosis
aucaccgcaccgacga

SEQ ID NO: 896755 - RNA, 15 nt, Mycobacterium avium subsp. paratuberculosis
aucacccggcgcgcg

SEQ ID NO: 896756 - RNA, 22 nt, Mycobacterium avium subsp. paratuberculosis
aucacccggcggcaccgcggcu

SEQ ID NO: 896757 - RNA, 22 nt, Mycobacterium avium subsp. paratuberculosis
aucacccgggucgagcggcccg

SEQ ID NO: 896758 - RNA, 16 nt, Mycobacterium avium subsp. paratuberculosis
aucacccucggcgucc

SEQ ID NO: 896759 - RNA, 13 nt, Mycobacterium avium subsp. paratuberculosis
aucaccagcggcu

SEQ ID NO: 896760 - RNA, 23 nt, Mycobacterium avium subsp. paratuberculosis
aucaccaugaucagcgccguggc

SEQ ID NO: 896761 - RNA, 13 nt, Mycobacterium avium subsp. paratuberculosis
aucacccagccgu

SEQ ID NO: 896762 - RNA, 18 nt, Mycobacterium avium subsp. paratuberculosis
aucacccccgacaccgug

SEQ ID NO: 896763 - RNA, 22 nt, Mycobacterium avium subsp. paratuberculosis
aucaccccgaagcucaucaccg

SEQ ID NO: 896764 - RNA, 14 nt, Mycobacterium avium subsp. paratuberculosis
aucacacgcgcgcc

SEQ ID NO: 896765 - RNA, 21 nt, Mycobacterium avium subsp. paratuberculosis
aucacacgcgcgccccggucc

SEQ ID NO: 896766 - RNA, 14 nt, Mycobacterium avium subsp. paratuberculosis
aucaccaccaccgc

SEQ ID NO: 896767 - RNA, 19 nt, Mycobacterium avium subsp. paratuberculosis
aucaccaaauagccgucgg

SEQ ID NO: 896768 - RNA, 19 nt, Mycobacterium avium subsp. paratuberculosis
aucaccaagcgcgacaagc

SEQ ID NO: 896769 - RNA, 14 nt, Mycobacterium avium subsp. paratuberculosis
aucaccaccgccgc

SEQ ID NO: 896770 - RNA, 15 nt, Mycobacterium avium subsp. paratuberculosis
aucaccacggucagg

SEQ ID NO: 896771 - RNA, 22 nt, Mycobacterium avium subsp. paratuberculosis
aucaccacggucagggccagca

SEQ ID NO: 896772 - RNA, 18 nt, Mycobacterium avium subsp. paratuberculosis
aucaccacgguggccgcg

SEQ ID NO: 896773 - RNA, 13 nt, Mycobacterium avium subsp. paratuberculosis
auagcacccgcuu

SEQ ID NO: 896774 - RNA, 13 nt, Mycobacterium avium subsp. paratuberculosis
auagagcaccgcg

SEQ ID NO: 896775 - RNA, 20 nt, Mycobacterium avium subsp. paratuberculosis
auacugcuugccgucgacgc

SEQ ID NO: 896776 - RNA, 21 nt, Mycobacterium avium subsp. paratuberculosis
auacccgaccagcaccgcggc

SEQ ID NO: 896777 - RNA, 13 nt, Mycobacterium avium subsp. paratuberculosis
auacccgcccagc

SEQ ID NO: 896778 - RNA, 14 nt, Mycobacterium avium subsp. paratuberculosis
auacagcagcugcg

SEQ ID NO: 896779 - RNA, 21 nt, Mycobacterium avium subsp. paratuberculosis
aguuggucugaaagugacggg

SEQ ID NO: 896780 - RNA, 13 nt, Mycobacterium avium subsp. paratuberculosis
aguuguagcgcag

SEQ ID NO: 896781 - RNA, 18 nt, Mycobacterium avium subsp. paratuberculosis
aguuucacgucggcgaug

SEQ ID NO: 896782 - RNA, 13 nt, Mycobacterium avium subsp. paratuberculosis
auaaagcgggccc

SEQ ID NO: 896783 - RNA, 19 nt, Mycobacterium avium subsp. paratuberculosis
aguuccgcgucggccccca

SEQ ID NO: 896784 - RNA, 21 nt, Mycobacterium avium subsp. paratuberculosis
aguucggugaacugcagcccg

SEQ ID NO: 896785 - RNA, 17 nt, Mycobacterium avium subsp. paratuberculosis
aguuccucgugcgugcg

SEQ ID NO: 896786 - RNA, 12 nt, Mycobacterium avium subsp. paratuberculosis
aguucggcgggg

SEQ ID NO: 896787 - RNA, 16 nt, Mycobacterium avium subsp. paratuberculosis
aguucguccacgcugg

SEQ ID NO: 896788 - RNA, 21 nt, Mycobacterium avium subsp. paratuberculosis
aguucugguaggcggccggga

SEQ ID NO: 896789 - RNA, 18 nt, Mycobacterium avium subsp. paratuberculosis
aguucugcuugagccgcc

SEQ ID NO: 896790 - RNA, 13 nt, Mycobacterium avium subsp. paratuberculosis
aguucuccagcac

SEQ ID NO: 896791 - RNA, 12 nt, Mycobacterium avium subsp. paratuberculosis
aguugcaccggc

SEQ ID NO: 896792 - RNA, 14 nt, Mycobacterium avium subsp. paratuberculosis
aguugcacggugua

SEQ ID NO: 896793 - RNA, 18 nt, Mycobacterium avium subsp. paratuberculosis
aguugcacucucgcggca

SEQ ID NO: 896794 - RNA, 15 nt, Mycobacterium avium subsp. paratuberculosis
agucgaagccgucca

SEQ ID NO: 896795 - RNA, 16 nt, Mycobacterium avium subsp. paratuberculosis
agucgaagccguggca

SEQ ID NO: 896796 - RNA, 22 nt, Mycobacterium avium subsp. paratuberculosis
agucgaagcggugcaccaccgu

SEQ ID NO: 896797 - RNA, 12 nt, Mycobacterium avium subsp. paratuberculosis
agucgaccaccc

SEQ ID NO: 896798 - RNA, 13 nt, Mycobacterium avium subsp. paratuberculosis
agucgaccacccg

SEQ ID NO: 896799 - RNA, 16 nt, Mycobacterium avium subsp. paratuberculosis
agucgaccacccgcag

SEQ ID NO: 896800 - RNA, 22 nt, Mycobacterium avium subsp. paratuberculosis
agucgaccacccgcagcucgcc

SEQ ID NO: 896801 - RNA, 12 nt, Mycobacterium avium subsp. paratuberculosis
agucgacggcgg

SEQ ID NO: 896802 - RNA, 21 nt, Mycobacterium avium subsp. paratuberculosis
agucgaccgggaucguguggc

SEQ ID NO: 896803 - RNA, 22 nt, Mycobacterium avium subsp. paratuberculosis
agucgaccgggaucguguggcc

SEQ ID NO: 896804 - RNA, 23 nt, Mycobacterium avium subsp. paratuberculosis
agucgaccggggcgccccgcugg

SEQ ID NO: 896805 - RNA, 14 nt, Mycobacterium avium subsp. paratuberculosis
agucgcagcagcag

SEQ ID NO: 896806 - RNA, 15 nt, Mycobacterium avium subsp. paratuberculosis
agucgcaggccccgg

SEQ ID NO: 896807 - RNA, 17 nt, Mycobacterium avium subsp. paratuberculosis
agucgcauaugcguggg

SEQ ID NO: 896808 - RNA, 22 nt, Mycobacterium avium subsp. paratuberculosis
agucgaugcccgcguccugcag

SEQ ID NO: 896809 - RNA, 21 nt, Mycobacterium avium subsp. paratuberculosis
agucgaugccgccccugcugg

SEQ ID NO: 896810 - RNA, 16 nt, Mycobacterium avium subsp. paratuberculosis
agucgauggccucguc

SEQ ID NO: 896811 - RNA, 15 nt, Mycobacterium avium subsp. paratuberculosis
agucgaugaccucgc

SEQ ID NO: 896812 - RNA, 17 nt, Mycobacterium avium subsp. paratuberculosis
agucgauucaucgccga

SEQ ID NO: 896813 - RNA, 21 nt, Mycobacterium avium subsp. paratuberculosis
agucgauugccgcggccgcgu

SEQ ID NO: 896814 - RNA, 21 nt, Mycobacterium avium subsp. paratuberculosis
agucgagggcuaaccaccggu

SEQ ID NO: 896815 - RNA, 19 nt, Mycobacterium avium subsp. paratuberculosis
agucgagguugaugccgac

SEQ ID NO: 896816 - RNA, 20 nt, Mycobacterium avium subsp. paratuberculosis
agucgacgugcucggcggcc

SEQ ID NO: 896817 - RNA, 18 nt, Mycobacterium avium subsp. paratuberculosis
agucgaucagcgacggcc

SEQ ID NO: 896818 - RNA, 13 nt, Mycobacterium avium subsp. paratuberculosis
agucgaucgccag

SEQ ID NO: 896819 - RNA, 14 nt, Mycobacterium avium subsp. paratuberculosis
agugguccaccgcc

SEQ ID NO: 896820 - RNA, 23 nt, Mycobacterium avium subsp. paratuberculosis
agugguggccgaacgggucggcg

SEQ ID NO: 896821 - RNA, 15 nt, Mycobacterium avium subsp. paratuberculosis
aguggucggccgccc

SEQ ID NO: 896822 - RNA, 23 nt, Mycobacterium avium subsp. paratuberculosis
aguucaugaucucguugcggcgc

SEQ ID NO: 896823 - RNA, 17 nt, Mycobacterium avium subsp. paratuberculosis
agugucagggcagcggu

SEQ ID NO: 896824 - RNA, 17 nt, Mycobacterium avium subsp. paratuberculosis
agugucggaaucggcgc

SEQ ID NO: 896825 - RNA, 17 nt, Mycobacterium avium subsp. paratuberculosis
agugucguggcgugccg

SEQ ID NO: 896826 - RNA, 19 nt, Mycobacterium avium subsp. paratuberculosis
agguugucgucgggcacca

SEQ ID NO: 896827 - RNA, 20 nt, Mycobacterium avium subsp. paratuberculosis
agguuggucagcagcagcgc

SEQ ID NO: 896828 - RNA, 22 nt, Mycobacterium avium subsp. paratuberculosis
agguuguagucggcgccgacgg

SEQ ID NO: 896829 - RNA, 18 nt, Mycobacterium avium subsp. paratuberculosis
agguuucgcucgucggcg

SEQ ID NO: 896830 - RNA, 16 nt, Mycobacterium avium subsp. paratuberculosis
agguucuccggcccgc

SEQ ID NO: 896831 - RNA, 21 nt, Mycobacterium avium subsp. paratuberculosis
agguucuucugcgcgaugucg

SEQ ID NO: 896832 - RNA, 22 nt, Mycobacterium avium subsp. paratuberculosis
agguuccaccgggcgucggcgg

SEQ ID NO: 896833 - RNA, 19 nt, Mycobacterium avium subsp. paratuberculosis
agguuccggugucgagccg

SEQ ID NO: 896834 - RNA, 18 nt, Mycobacterium avium subsp. paratuberculosis
agguugauccgcgcgucu

SEQ ID NO: 896835 - RNA, 14 nt, Mycobacterium avium subsp. paratuberculosis
agguugaugccgac

SEQ ID NO: 896836 - RNA, 18 nt, Mycobacterium avium subsp. paratuberculosis
agguugaugccgacgucg

SEQ ID NO: 896837 - RNA, 13 nt, Mycobacterium avium subsp. paratuberculosis
agguggggcacca

SEQ ID NO: 896838 - RNA, 19 nt, Mycobacterium avium subsp. paratuberculosis
aggugggguugaagcuggc

SEQ ID NO: 896839 - RNA, 17 nt, Mycobacterium avium subsp. paratuberculosis
aggugggcggccaccac

SEQ ID NO: 896840 - RNA, 18 nt, Mycobacterium avium subsp. paratuberculosis
agguggcguagucgucga

SEQ ID NO: 896841 - RNA, 13 nt, Mycobacterium avium subsp. paratuberculosis
agguggcgucggc

SEQ ID NO: 896842 - RNA, 20 nt, Mycobacterium avium subsp. paratuberculosis
agguggcgucggcgucgaac

SEQ ID NO: 896843 - RNA, 13 nt, Mycobacterium avium subsp. paratuberculosis
aggugggcagcgc

SEQ ID NO: 896844 - RNA, 14 nt, Mycobacterium avium subsp. paratuberculosis
aggugggcgcgcag

SEQ ID NO: 896845 - RNA, 19 nt, Mycobacterium avium subsp. paratuberculosis
aggugggcgcgcagcacca

SEQ ID NO: 896846 - RNA, 18 nt, Mycobacterium avium subsp. paratuberculosis
agguggcgccgguaggcg

SEQ ID NO: 896847 - RNA, 14 nt, Mycobacterium avium subsp. paratuberculosis
agguggcgccuccg

SEQ ID NO: 896848 - RNA, 15 nt, Mycobacterium avium subsp. paratuberculosis
agguggcgcccggag

SEQ ID NO: 896849 - RNA, 17 nt, Mycobacterium avium subsp. paratuberculosis
agguggcccgccacgug

SEQ ID NO: 896850 - RNA, 13 nt, Mycobacterium avium subsp. paratuberculosis
agguggccgccag

SEQ ID NO: 896851 - RNA, 18 nt, Mycobacterium avium subsp. paratuberculosis
agguggccgucgccucgc

SEQ ID NO: 896852 - RNA, 15 nt, Mycobacterium avium subsp. paratuberculosis
agguggcgaccaccg

SEQ ID NO: 896853 - RNA, 21 nt, Mycobacterium avium subsp. paratuberculosis
agguggaugcgagccagcugc

SEQ ID NO: 896854 - RNA, 15 nt, Mycobacterium avium subsp. paratuberculosis
agguggccagccggg

SEQ ID NO: 896855 - RNA, 16 nt, Mycobacterium avium subsp. paratuberculosis
agguggccagccgggc

SEQ ID NO: 896856 - RNA, 23 nt, Mycobacterium avium subsp. paratuberculosis
agguggacgagcagccgcaacca

SEQ ID NO: 896857 - RNA, 16 nt, Mycobacterium avium subsp. paratuberculosis
aggugcugucgucgcc

SEQ ID NO: 896858 - RNA, 20 nt, Mycobacterium avium subsp. paratuberculosis
aggugcgccgccgcgucgcc

SEQ ID NO: 896859 - RNA, 15 nt, Mycobacterium avium subsp. paratuberculosis
aggugcucgccggcg

SEQ ID NO: 896860 - RNA, 15 nt, Mycobacterium avium subsp. paratuberculosis
aggugcucgcgcagg

SEQ ID NO: 896861 - RNA, 20 nt, Mycobacterium avium subsp. paratuberculosis
aggugcugaacaaccccacc

SEQ ID NO: 896862 - RNA, 15 nt, Mycobacterium avium subsp. paratuberculosis
aggugcgccagaucg

SEQ ID NO: 896863 - RNA, 17 nt, Mycobacterium avium subsp. paratuberculosis
aggugcgcggucagcgc

SEQ ID NO: 896864 - RNA, 15 nt, Mycobacterium avium subsp. paratuberculosis
aggugcgggucucga

SEQ ID NO: 896865 - RNA, 22 nt, Mycobacterium avium subsp. paratuberculosis
aggugguuucggggucgccguc

SEQ ID NO: 896866 - RNA, 22 nt, Mycobacterium avium subsp. paratuberculosis
agguggugaacucuucgcagcg

SEQ ID NO: 896867 - RNA, 19 nt, Mycobacterium avium subsp. paratuberculosis
aggugugaggagucgggca

SEQ ID NO: 896868 - RNA, 15 nt, Mycobacterium avium subsp. paratuberculosis
agguguccggcccga

SEQ ID NO: 896869 - RNA, 15 nt, Mycobacterium avium subsp. paratuberculosis
aggugugcggcacga

SEQ ID NO: 896870 - RNA, 23 nt, Mycobacterium avium subsp. paratuberculosis
agguguuguaggagcugccggcg

SEQ ID NO: 896871 - RNA, 22 nt, Mycobacterium avium subsp. paratuberculosis
agguucauccccgcggccaccc

SEQ ID NO: 896872 - RNA, 23 nt, Mycobacterium avium subsp. paratuberculosis
agguucauguggaagccgcgauc

SEQ ID NO: 896873 - RNA, 12 nt, Mycobacterium avium subsp. paratuberculosis
agguucacgucg

SEQ ID NO: 896874 - RNA, 22 nt, Mycobacterium avium subsp. paratuberculosis
agguucagcccggcgcugcgcc

SEQ ID NO: 896875 - RNA, 12 nt, Mycobacterium avium subsp. paratuberculosis
aguccaccggcg

SEQ ID NO: 896876 - RNA, 19 nt, Mycobacterium avium subsp. paratuberculosis
agucauucugaauucggcc

SEQ ID NO: 896877 - RNA, 21 nt, Mycobacterium avium subsp. paratuberculosis
agucaucaccggggaucaccu

SEQ ID NO: 896878 - RNA, 23 nt, Mycobacterium avium subsp. paratuberculosis
aguaugcccgccgcugacgcggc

SEQ ID NO: 896879 - RNA, 13 nt, Mycobacterium avium subsp. paratuberculosis
aguccugcgccgc

SEQ ID NO: 896880 - RNA, 15 nt, Mycobacterium avium subsp. paratuberculosis
aguccgcggaggcga

SEQ ID NO: 896881 - RNA, 13 nt, Mycobacterium avium subsp. paratuberculosis
aguccgcgccggu

SEQ ID NO: 896882 - RNA, 13 nt, Mycobacterium avium subsp. paratuberculosis
agucccucggcga

SEQ ID NO: 896883 - RNA, 15 nt, Mycobacterium avium subsp. paratuberculosis
agucccgcgcggcgc

SEQ ID NO: 896884 - RNA, 18 nt, Mycobacterium avium subsp. paratuberculosis
agucccggcgcaccaggc

SEQ ID NO: 896885 - RNA, 20 nt, Mycobacterium avium subsp. paratuberculosis
aguccgacgagucgacgcug

SEQ ID NO: 896886 - RNA, 17 nt, Mycobacterium avium subsp. paratuberculosis
aguccgccagggugccg

SEQ ID NO: 896887 - RNA, 18 nt, Mycobacterium avium subsp. paratuberculosis
aguccgccgacagcggga

SEQ ID NO: 896888 - RNA, 13 nt, Mycobacterium avium subsp. paratuberculosis
aguccgccgccgg

SEQ ID NO: 896889 - RNA, 16 nt, Mycobacterium avium subsp. paratuberculosis
aguccgccgccgggcc

SEQ ID NO: 896890 - RNA, 14 nt, Mycobacterium avium subsp. paratuberculosis
aguccgccggagac

SEQ ID NO: 896891 - RNA, 18 nt, Mycobacterium avium subsp. paratuberculosis
aguaucgccacgccgacc

SEQ ID NO: 896892 - RNA, 20 nt, Mycobacterium avium subsp. paratuberculosis
aguacccgcgcauguuggug

SEQ ID NO: 896893 - RNA, 13 nt, Mycobacterium avium subsp. paratuberculosis
aguacaggccgua

SEQ ID NO: 896894 - RNA, 23 nt, Mycobacterium avium subsp. paratuberculosis
aguacaccucgagcuugccgucg

SEQ ID NO: 896895 - RNA, 21 nt, Mycobacterium avium subsp. paratuberculosis
aguacagcuaggccagcagcg

SEQ ID NO: 896896 - RNA, 16 nt, Mycobacterium avium subsp. paratuberculosis
agguagcccaugucgc

SEQ ID NO: 896897 - RNA, 15 nt, Mycobacterium avium subsp. paratuberculosis
agguagccgaggucg

SEQ ID NO: 896898 - RNA, 16 nt, Mycobacterium avium subsp. paratuberculosis
agguagccgcgcacca

SEQ ID NO: 896899 - RNA, 15 nt, Mycobacterium avium subsp. paratuberculosis
agguagcgcagcccg

SEQ ID NO: 896900 - RNA, 21 nt, Mycobacterium avium subsp. paratuberculosis
agguagaggcuguccagcagc

SEQ ID NO: 896901 - RNA, 19 nt, Mycobacterium avium subsp. paratuberculosis
agguagauucccaugucgc

SEQ ID NO: 896902 - RNA, 15 nt, Mycobacterium avium subsp. paratuberculosis
agguaccggcgggcg

SEQ ID NO: 896903 - RNA, 20 nt, Mycobacterium avium subsp. paratuberculosis
aggucagcagggugacgucg

SEQ ID NO: 896904 - RNA, 14 nt, Mycobacterium avium subsp. paratuberculosis
aggucaccgcggga

SEQ ID NO: 896905 - RNA, 22 nt, Mycobacterium avium subsp. paratuberculosis
aggucaccggaugcacgugcac

SEQ ID NO: 896906 - RNA, 14 nt, Mycobacterium avium subsp. paratuberculosis
agguagcgugcgcc

SEQ ID NO: 896907 - RNA, 14 nt, Mycobacterium avium subsp. paratuberculosis
agguaggcgccgcu

SEQ ID NO: 896908 - RNA, 20 nt, Mycobacterium avium subsp. paratuberculosis
aggucacccuccucgcggcg

SEQ ID NO: 896909 - RNA, 13 nt, Mycobacterium avium subsp. paratuberculosis
agggugucgaaca

SEQ ID NO: 896910 - RNA, 13 nt, Mycobacterium avium subsp. paratuberculosis
agggugucgauga

SEQ ID NO: 896911 - RNA, 20 nt, Mycobacterium avium subsp. paratuberculosis
aggguggggaucacgucggc

SEQ ID NO: 896912 - RNA, 14 nt, Mycobacterium avium subsp. paratuberculosis
aggguggccgccac

SEQ ID NO: 896913 - RNA, 16 nt, Mycobacterium avium subsp. paratuberculosis
aggguggucagcgucu

SEQ ID NO: 896914 - RNA, 20 nt, Mycobacterium avium subsp. paratuberculosis
aggguggucagcgucucggc

SEQ ID NO: 896915 - RNA, 21 nt, Mycobacterium avium subsp. paratuberculosis
aggguggugcccccgcccggc

SEQ ID NO: 896916 - RNA, 17 nt, Mycobacterium avium subsp. paratuberculosis
aggguggugguggugcc

SEQ ID NO: 896917 - RNA, 18 nt, Mycobacterium avium subsp. paratuberculosis
agggugcgcagcgcgucg

SEQ ID NO: 896918 - RNA, 11 nt, Mycobacterium avium subsp. paratuberculosis
agggugcgccg

SEQ ID NO: 896919 - RNA, 14 nt, Mycobacterium avium subsp. paratuberculosis
agggugcucagccg

SEQ ID NO: 896920 - RNA, 17 nt, Mycobacterium avium subsp. paratuberculosis
aggguggccagcaccgc

SEQ ID NO: 896921 - RNA, 20 nt, Mycobacterium avium subsp. paratuberculosis
aggguggccagcaccgcguc

SEQ ID NO: 896922 - RNA, 19 nt, Mycobacterium avium subsp. paratuberculosis
aggguggccagcacgcugc

SEQ ID NO: 896923 - RNA, 13 nt, Mycobacterium avium subsp. paratuberculosis
agggugccgcugc

SEQ ID NO: 896924 - RNA, 14 nt, Mycobacterium avium subsp. paratuberculosis
agggugccgcugcc

SEQ ID NO: 896925 - RNA, 18 nt, Mycobacterium avium subsp. paratuberculosis
agggugccccgcaccgcc

SEQ ID NO: 896926 - RNA, 18 nt, Mycobacterium avium subsp. paratuberculosis
agggugccccgcgaccgc

SEQ ID NO: 896927 - RNA, 22 nt, Mycobacterium avium subsp. paratuberculosis
agggugccgaacagcgacgucu

SEQ ID NO: 896928 - RNA, 16 nt, Mycobacterium avium subsp. paratuberculosis
agggugccgacgaccu

SEQ ID NO: 896929 - RNA, 16 nt, Mycobacterium avium subsp. paratuberculosis
agggugccgauguagg

SEQ ID NO: 896930 - RNA, 19 nt, Mycobacterium avium subsp. paratuberculosis
agggucaagauaccggccg

SEQ ID NO: 896931 - RNA, 20 nt, Mycobacterium avium subsp. paratuberculosis
agggucaagauaccggccgg

SEQ ID NO: 896932 - RNA, 20 nt, Mycobacterium avium subsp. paratuberculosis
agggcauccgggaggccagc

SEQ ID NO: 896933 - RNA, 19 nt, Mycobacterium avium subsp. paratuberculosis
agggcaucgggucguagag

SEQ ID NO: 896934 - RNA, 15 nt, Mycobacterium avium subsp. paratuberculosis
agggcagcgucccgu

SEQ ID NO: 896935 - RNA, 19 nt, Mycobacterium avium subsp. paratuberculosis
agggcagcgucccgucggc

SEQ ID NO: 896936 - RNA, 21 nt, Mycobacterium avium subsp. paratuberculosis
agggcagcgucccgucggcca

SEQ ID NO: 896937 - RNA, 14 nt, Mycobacterium avium subsp. paratuberculosis
agggcagggucgcg

SEQ ID NO: 896938 - RNA, 18 nt, Mycobacterium avium subsp. paratuberculosis
agggcagggucgcggagc

SEQ ID NO: 896939 - RNA, 15 nt, Mycobacterium avium subsp. paratuberculosis
agggcacaccggugc

SEQ ID NO: 896940 - RNA, 19 nt, Mycobacterium avium subsp. paratuberculosis
agggcagauaggcggcgac

SEQ ID NO: 896941 - RNA, 20 nt, Mycobacterium avium subsp. paratuberculosis
aggggcuuuugcgucugcuc

SEQ ID NO: 896942 - RNA, 13 nt, Mycobacterium avium subsp. paratuberculosis
aggggucggugcg

SEQ ID NO: 896943 - RNA, 16 nt, Mycobacterium avium subsp. paratuberculosis
aggggugggcgacgag

SEQ ID NO: 896944 - RNA, 20 nt, Mycobacterium avium subsp. paratuberculosis
aggggcuguccucccagcgc

SEQ ID NO: 896945 - RNA, 18 nt, Mycobacterium avium subsp. paratuberculosis
agggccaggccgugaucg

SEQ ID NO: 896946 - RNA, 14 nt, Mycobacterium avium subsp. paratuberculosis
agggccaccacgcc

SEQ ID NO: 896947 - RNA, 17 nt, Mycobacterium avium subsp. paratuberculosis
agggccaccacgccagc

SEQ ID NO: 896948 - RNA, 13 nt, Mycobacterium avium subsp. paratuberculosis
agggccaccgcgu

SEQ ID NO: 896949 - RNA, 16 nt, Mycobacterium avium subsp. paratuberculosis
agggccaccgcguaga

SEQ ID NO: 896950 - RNA, 13 nt, Mycobacterium avium subsp. paratuberculosis
agggccagcagcc

SEQ ID NO: 896951 - RNA, 15 nt, Mycobacterium avium subsp. paratuberculosis
agggccagcagucgu

SEQ ID NO: 896952 - RNA, 19 nt, Mycobacterium avium subsp. paratuberculosis
agggccagcagucgugacg

SEQ ID NO: 896953 - RNA, 21 nt, Mycobacterium avium subsp. paratuberculosis
agggccagccgaugcgcccgc

SEQ ID NO: 896954 - RNA, 22 nt, Mycobacterium avium subsp. paratuberculosis
aggucagcggcccgaucaccag

SEQ ID NO: 896955 - RNA, 16 nt, Mycobacterium avium subsp. paratuberculosis
aggucauggcgaccgc

SEQ ID NO: 896956 - RNA, 20 nt, Mycobacterium avium subsp. paratuberculosis
aggucgaccgcgcaccggcg

SEQ ID NO: 896957 - RNA, 17 nt, Mycobacterium avium subsp. paratuberculosis
aggucgaccggcucgcc

SEQ ID NO: 896958 - RNA, 21 nt, Mycobacterium avium subsp. paratuberculosis
agguccaccaggugaccggcc

SEQ ID NO: 896959 - RNA, 14 nt, Mycobacterium avium subsp. paratuberculosis
agguccaccccgcc

SEQ ID NO: 896960 - RNA, 17 nt, Mycobacterium avium subsp. paratuberculosis
agguccacccgccccgc

SEQ ID NO: 896961 - RNA, 18 nt, Mycobacterium avium subsp. paratuberculosis
agguccaccguugucucg

SEQ ID NO: 896962 - RNA, 23 nt, Mycobacterium avium subsp. paratuberculosis
agguccaccguugucucggcgcc

SEQ ID NO: 896963 - RNA, 16 nt, Mycobacterium avium subsp. paratuberculosis
aggucgaucucggcca

SEQ ID NO: 896964 - RNA, 23 nt, Mycobacterium avium subsp. paratuberculosis
aggucgaucugcggcacggugcg

SEQ ID NO: 896965 - RNA, 20 nt, Mycobacterium avium subsp. paratuberculosis
aggucgcacaccagcacggc

SEQ ID NO: 896966 - RNA, 18 nt, Mycobacterium avium subsp. paratuberculosis
aggucgcacaggaugccc

SEQ ID NO: 896967 - RNA, 14 nt, Mycobacterium avium subsp. paratuberculosis
aggucgaccaucug

SEQ ID NO: 896968 - RNA, 16 nt, Mycobacterium avium subsp. paratuberculosis
aggucgacgccccgcg

SEQ ID NO: 896969 - RNA, 14 nt, Mycobacterium avium subsp. paratuberculosis
aggucgacgggguc

SEQ ID NO: 896970 - RNA, 14 nt, Mycobacterium avium subsp. paratuberculosis
aggucgagcaccag

SEQ ID NO: 896971 - RNA, 15 nt, Mycobacterium avium subsp. paratuberculosis
aggucgaucagcggu

SEQ ID NO: 896972 - RNA, 15 nt, Mycobacterium avium subsp. paratuberculosis
aggucgcccggcucg

SEQ ID NO: 896973 - RNA, 18 nt, Mycobacterium avium subsp. paratuberculosis
aggucgcccggcucgccg

SEQ ID NO: 896974 - RNA, 19 nt, Mycobacterium avium subsp. paratuberculosis
aggucgccgacagcgucgu

SEQ ID NO: 896975 - RNA, 21 nt, Mycobacterium avium subsp. paratuberculosis
aggucggcgauggugaugcgg

SEQ ID NO: 896976 - RNA, 15 nt, Mycobacterium avium subsp. paratuberculosis
aggucgggacguccg

SEQ ID NO: 896977 - RNA, 19 nt, Mycobacterium avium subsp. paratuberculosis
aggucgggacguccgcgcg

SEQ ID NO: 896978 - RNA, 14 nt, Mycobacterium avium subsp. paratuberculosis
aggucgggccggcc

SEQ ID NO: 896979 - RNA, 15 nt, Mycobacterium avium subsp. paratuberculosis
aggucgggccggccg

SEQ ID NO: 896980 - RNA, 16 nt, Mycobacterium avium subsp. paratuberculosis
aggucgggccggccga

SEQ ID NO: 896981 - RNA, 20 nt, Mycobacterium avium subsp. paratuberculosis
aggucggcgggagccggcgg

SEQ ID NO: 896982 - RNA, 21 nt, Mycobacterium avium subsp. paratuberculosis
aggucggcgggagccggcggc

SEQ ID NO: 896983 - RNA, 20 nt, Mycobacterium avium subsp. paratuberculosis
aggucggcggucgcggugcc

SEQ ID NO: 896984 - RNA, 12 nt, Mycobacterium avium subsp. paratuberculosis
aggucggcgugc

SEQ ID NO: 896985 - RNA, 15 nt, Mycobacterium avium subsp. paratuberculosis
aggucgucgacgucc

SEQ ID NO: 896986 - RNA, 16 nt, Mycobacterium avium subsp. paratuberculosis
aggucgguggccacca

SEQ ID NO: 896987 - RNA, 17 nt, Mycobacterium avium subsp. paratuberculosis
aggucgguggccaccac

SEQ ID NO: 896988 - RNA, 20 nt, Mycobacterium avium subsp. paratuberculosis
aggucgucgagggccaccgg

SEQ ID NO: 896989 - RNA, 14 nt, Mycobacterium avium subsp. paratuberculosis
aggucgucggccag

SEQ ID NO: 896990 - RNA, 13 nt, Mycobacterium avium subsp. paratuberculosis
aggucgucgggcg

SEQ ID NO: 896991 - RNA, 16 nt, Mycobacterium avium subsp. paratuberculosis
aggucgucgggcgccg

SEQ ID NO: 896992 - RNA, 21 nt, Mycobacterium avium subsp. paratuberculosis
aggucggggcccguccccacc

SEQ ID NO: 896993 - RNA, 18 nt, Mycobacterium avium subsp. paratuberculosis
aggucggugccgcggcgc

SEQ ID NO: 896994 - RNA, 21 nt, Mycobacterium avium subsp. paratuberculosis
aggucggugcgcgggguggcg

SEQ ID NO: 896995 - RNA, 18 nt, Mycobacterium avium subsp. paratuberculosis
aggugauucgcgcggcgc

SEQ ID NO: 896996 - RNA, 18 nt, Mycobacterium avium subsp. paratuberculosis
aggugaugccguccagca

SEQ ID NO: 896997 - RNA, 21 nt, Mycobacterium avium subsp. paratuberculosis
aggugaugccguccagcaacg

SEQ ID NO: 896998 - RNA, 23 nt, Mycobacterium avium subsp. paratuberculosis
aggugaugccguccagcaacgcc

SEQ ID NO: 896999 - RNA, 24 nt, Mycobacterium avium subsp. paratuberculosis
aggugaugaaaaccgggcccucgu

SEQ ID NO: 897000 - RNA, 15 nt, Mycobacterium avium subsp. paratuberculosis
aggugaucgccagcc

SEQ ID NO: 897001 - RNA, 21 nt, Mycobacterium avium subsp. paratuberculosis
aggugaucgccucgaccaggc

SEQ ID NO: 897002 - RNA, 19 nt, Mycobacterium avium subsp. paratuberculosis
aggugaucgcgaacgcgcc

SEQ ID NO: 897003 - RNA, 20 nt, Mycobacterium avium subsp. paratuberculosis
aggugcauccagucggcgcc

SEQ ID NO: 897004 - RNA, 23 nt, Mycobacterium avium subsp. paratuberculosis
aggugcauccagucggcgccgau

SEQ ID NO: 897005 - RNA, 20 nt, Mycobacterium avium subsp. paratuberculosis
aggugcaucgccaccgucgu

SEQ ID NO: 897006 - RNA, 22 nt, Mycobacterium avium subsp. paratuberculosis
aggugcaccacccaggccaccc

SEQ ID NO: 897007 - RNA, 18 nt, Mycobacterium avium subsp. paratuberculosis
aggugcagcgggcuggcg

SEQ ID NO: 897008 - RNA, 18 nt, Mycobacterium avium subsp. paratuberculosis
aggugcagcugcaucucc

SEQ ID NO: 897009 - RNA, 15 nt, Mycobacterium avium subsp. paratuberculosis
aggugcgccgcucgu

SEQ ID NO: 897010 - RNA, 16 nt, Mycobacterium avium subsp. paratuberculosis
aggugcgccggauucg

SEQ ID NO: 897011 - RNA, 16 nt, Mycobacterium avium subsp. paratuberculosis
aggugccggcggcgcg

SEQ ID NO: 897012 - RNA, 15 nt, Mycobacterium avium subsp. paratuberculosis
aggugccggccgcga

SEQ ID NO: 897013 - RNA, 15 nt, Mycobacterium avium subsp. paratuberculosis
aggugccgcgcagca

SEQ ID NO: 897014 - RNA, 18 nt, Mycobacterium avium subsp. paratuberculosis
aggugccgcgcagcaccg

SEQ ID NO: 897015 - RNA, 15 nt, Mycobacterium avium subsp. paratuberculosis
aggugccgcgcggca

SEQ ID NO: 897016 - RNA, 14 nt, Mycobacterium avium subsp. paratuberculosis
aggugccccacgcc

SEQ ID NO: 897017 - RNA, 21 nt, Mycobacterium avium subsp. paratuberculosis
aggugcccgagcugaucgcgg

SEQ ID NO: 897018 - RNA, 23 nt, Mycobacterium avium subsp. paratuberculosis
aggugcccgagcugaucgcggcc

SEQ ID NO: 897019 - RNA, 21 nt, Mycobacterium avium subsp. paratuberculosis
aggugcccgggucgugcggcg

SEQ ID NO: 897020 - RNA, 12 nt, Mycobacterium avium subsp. paratuberculosis
aggugcccuccu

SEQ ID NO: 897021 - RNA, 18 nt, Mycobacterium avium subsp. paratuberculosis
aggugcccuccucgccgg

SEQ ID NO: 897022 - RNA, 21 nt, Mycobacterium avium subsp. paratuberculosis
aggugaauaccacugcgcgcc

SEQ ID NO: 897023 - RNA, 18 nt, Mycobacterium avium subsp. paratuberculosis
aggugaagccguugucga

SEQ ID NO: 897024 - RNA, 23 nt, Mycobacterium avium subsp. paratuberculosis
aggugaccaucgggucgucggcg

SEQ ID NO: 897025 - RNA, 14 nt, Mycobacterium avium subsp. paratuberculosis
aggugaacagcagc

SEQ ID NO: 897026 - RNA, 17 nt, Mycobacterium avium subsp. paratuberculosis
aggugaaccgcgacgcg

SEQ ID NO: 897027 - RNA, 13 nt, Mycobacterium avium subsp. paratuberculosis
aggugaccggccu

SEQ ID NO: 897028 - RNA, 14 nt, Mycobacterium avium subsp. paratuberculosis
aggugaccggccug

SEQ ID NO: 897029 - RNA, 18 nt, Mycobacterium avium subsp. paratuberculosis
aggugaccucgagcagcg

SEQ ID NO: 897030 - RNA, 19 nt, Mycobacterium avium subsp. paratuberculosis
aggugaccucgagcagcgc

SEQ ID NO: 897031 - RNA, 16 nt, Mycobacterium avium subsp. paratuberculosis
aggugacgaggcccac

SEQ ID NO: 897032 - RNA, 15 nt, Mycobacterium avium subsp. paratuberculosis
aggugacgucgccga

SEQ ID NO: 897033 - RNA, 16 nt, Mycobacterium avium subsp. paratuberculosis
aggugacgucgcgccg

SEQ ID NO: 897034 - RNA, 14 nt, Mycobacterium avium subsp. paratuberculosis
aggugagcaacgcc

SEQ ID NO: 897035 - RNA, 21 nt, Mycobacterium avium subsp. paratuberculosis
aggugaucaaagccgguggca

SEQ ID NO: 897036 - RNA, 15 nt, Mycobacterium avium subsp. paratuberculosis
aggucugcagcagcc

SEQ ID NO: 897037 - RNA, 22 nt, Mycobacterium avium subsp. paratuberculosis
aggucuuccggaugccggcuug

SEQ ID NO: 897038 - RNA, 21 nt, Mycobacterium avium subsp. paratuberculosis
aggucuccguugucgaggucg

SEQ ID NO: 897039 - RNA, 16 nt, Mycobacterium avium subsp. paratuberculosis
aggucguggcgccgag

SEQ ID NO: 897040 - RNA, 18 nt, Mycobacterium avium subsp. paratuberculosis
aggucguggcgccgagga

SEQ ID NO: 897041 - RNA, 16 nt, Mycobacterium avium subsp. paratuberculosis
aggucguucauucagc

SEQ ID NO: 897042 - RNA, 15 nt, Mycobacterium avium subsp. paratuberculosis
aggucguugccggug

SEQ ID NO: 897043 - RNA, 17 nt, Mycobacterium avium subsp. paratuberculosis
aggaugguggugcaggc

SEQ ID NO: 897044 - RNA, 13 nt, Mycobacterium avium subsp. paratuberculosis
aggaugucgccgc

SEQ ID NO: 897045 - RNA, 20 nt, Mycobacterium avium subsp. paratuberculosis
aggaugucggacucgcgccg

SEQ ID NO: 897046 - RNA, 19 nt, Mycobacterium avium subsp. paratuberculosis
aggauggggucgcgggcgc

SEQ ID NO: 897047 - RNA, 23 nt, Mycobacterium avium subsp. paratuberculosis
agcugcggaucgggcguggcguc

SEQ ID NO: 897048 - RNA, 23 nt, Mycobacterium avium subsp. paratuberculosis
agcugcgggaccagcgccucggc

SEQ ID NO: 897049 - RNA, 22 nt, Mycobacterium avium subsp. paratuberculosis
aggaugccgcccaccaccggcu

SEQ ID NO: 897050 - RNA, 15 nt, Mycobacterium avium subsp. paratuberculosis
agcugcgcgccccgg

SEQ ID NO: 897051 - RNA, 16 nt, Mycobacterium avium subsp. paratuberculosis
agcugcgcgccccggc

SEQ ID NO: 897052 - RNA, 14 nt, Mycobacterium avium subsp. paratuberculosis
agcugcgcgccggc

SEQ ID NO: 897053 - RNA, 23 nt, Mycobacterium avium subsp. paratuberculosis
agcugcgcgccggcggccgccgc

SEQ ID NO: 897054 - RNA, 22 nt, Mycobacterium avium subsp. paratuberculosis
agcugcgcccacgugccaucgc

SEQ ID NO: 897055 - RNA, 13 nt, Mycobacterium avium subsp. paratuberculosis
agcugcgccgcgu

SEQ ID NO: 897056 - RNA, 17 nt, Mycobacterium avium subsp. paratuberculosis
agcugcgccgcgucgac

SEQ ID NO: 897057 - RNA, 12 nt, Mycobacterium avium subsp. paratuberculosis
agcugcgccggc

SEQ ID NO: 897058 - RNA, 17 nt, Mycobacterium avium subsp. paratuberculosis
agcugcgaaucgucggc

SEQ ID NO: 897059 - RNA, 17 nt, Mycobacterium avium subsp. paratuberculosis
agcugcaacgcgucggc

SEQ ID NO: 897060 - RNA, 19 nt, Mycobacterium avium subsp. paratuberculosis
agcugcaacgcgucggcgc

SEQ ID NO: 897061 - RNA, 17 nt, Mycobacterium avium subsp. paratuberculosis
agcugauucgcgguggc

SEQ ID NO: 897062 - RNA, 18 nt, Mycobacterium avium subsp. paratuberculosis
agcugcacccaccggccc

SEQ ID NO: 897063 - RNA, 20 nt, Mycobacterium avium subsp. paratuberculosis
agcugcaccggggccggcgg

SEQ ID NO: 897064 - RNA, 21 nt, Mycobacterium avium subsp. paratuberculosis
agcugcaccggggccggcggg

SEQ ID NO: 897065 - RNA, 15 nt, Mycobacterium avium subsp. paratuberculosis
agcugcacgggcgug

SEQ ID NO: 897066 - RNA, 16 nt, Mycobacterium avium subsp. paratuberculosis
agcugcagccggccgg

SEQ ID NO: 897067 - RNA, 15 nt, Mycobacterium avium subsp. paratuberculosis
agcugccgaccagga

SEQ ID NO: 897068 - RNA, 14 nt, Mycobacterium avium subsp. paratuberculosis
agcugcccgccgac

SEQ ID NO: 897069 - RNA, 15 nt, Mycobacterium avium subsp. paratuberculosis
agcugcccaccagca

SEQ ID NO: 897070 - RNA, 14 nt, Mycobacterium avium subsp. paratuberculosis
agcugccccuucgc

SEQ ID NO: 897071 - RNA, 19 nt, Mycobacterium avium subsp. paratuberculosis
agcugccgcgacucggugu

SEQ ID NO: 897072 - RNA, 23 nt, Mycobacterium avium subsp. paratuberculosis
agcugccgcgacucggugucgcu

SEQ ID NO: 897073 - RNA, 19 nt, Mycobacterium avium subsp. paratuberculosis
agcugccggcggccgccgg

SEQ ID NO: 897074 - RNA, 21 nt, Mycobacterium avium subsp. paratuberculosis
agcugccggcggccgccggca

SEQ ID NO: 897075 - RNA, 22 nt, Mycobacterium avium subsp. paratuberculosis
agcugccggcggccgccggcac

SEQ ID NO: 897076 - RNA, 14 nt, Mycobacterium avium subsp. paratuberculosis
agcugccguugcgc

SEQ ID NO: 897077 - RNA, 18 nt, Mycobacterium avium subsp. paratuberculosis
agcugccguugcgccagc

SEQ ID NO: 897078 - RNA, 15 nt, Mycobacterium avium subsp. paratuberculosis
agcugccguccgggu

SEQ ID NO: 897079 - RNA, 22 nt, Mycobacterium avium subsp. paratuberculosis
aggauucucagcagcgggccga

SEQ ID NO: 897080 - RNA, 17 nt, Mycobacterium avium subsp. paratuberculosis
aggcaugggaucagcag

SEQ ID NO: 897081 - RNA, 20 nt, Mycobacterium avium subsp. paratuberculosis
aggcaugggaucagcagcac

SEQ ID NO: 897082 - RNA, 16 nt, Mycobacterium avium subsp. paratuberculosis
aggcaugggcgugccg

SEQ ID NO: 897083 - RNA, 14 nt, Mycobacterium avium subsp. paratuberculosis
aggcauuccaccgc

SEQ ID NO: 897084 - RNA, 16 nt, Mycobacterium avium subsp. paratuberculosis
aggcauuccaccgcgc

SEQ ID NO: 897085 - RNA, 14 nt, Mycobacterium avium subsp. paratuberculosis
aggccaacagcagc

SEQ ID NO: 897086 - RNA, 14 nt, Mycobacterium avium subsp. paratuberculosis
aggccaacucgcga

SEQ ID NO: 897087 - RNA, 17 nt, Mycobacterium avium subsp. paratuberculosis
aggccaacgagcgcgcc

SEQ ID NO: 897088 - RNA, 18 nt, Mycobacterium avium subsp. paratuberculosis
aggccaucagcccggcgu

SEQ ID NO: 897089 - RNA, 14 nt, Mycobacterium avium subsp. paratuberculosis
aggcccacccacuc

SEQ ID NO: 897090 - RNA, 15 nt, Mycobacterium avium subsp. paratuberculosis
aggccagggcccgca

SEQ ID NO: 897091 - RNA, 13 nt, Mycobacterium avium subsp. paratuberculosis
aggccaggaccgg

SEQ ID NO: 897092 - RNA, 19 nt, Mycobacterium avium subsp. paratuberculosis
aggccagcucgaccgcggc

SEQ ID NO: 897093 - RNA, 20 nt, Mycobacterium avium subsp. paratuberculosis
aggccagcucgaccgcggcg

SEQ ID NO: 897094 - RNA, 21 nt, Mycobacterium avium subsp. paratuberculosis
aggccagcucgaccgcggcga

SEQ ID NO: 897095 - RNA, 18 nt, Mycobacterium avium subsp. paratuberculosis
aggccacaugggccacgg

SEQ ID NO: 897096 - RNA, 17 nt, Mycobacterium avium subsp. paratuberculosis
aggccagcgcgugaucg

SEQ ID NO: 897097 - RNA, 19 nt, Mycobacterium avium subsp. paratuberculosis
aggccagcugcaccggggc

SEQ ID NO: 897098 - RNA, 22 nt, Mycobacterium avium subsp. paratuberculosis
aggccagcugcaccggggccgg

SEQ ID NO: 897099 - RNA, 19 nt, Mycobacterium avium subsp. paratuberculosis
aggccgcguagcucgccgc

SEQ ID NO: 897100 - RNA, 20 nt, Mycobacterium avium subsp. paratuberculosis
aggccgcguagcucgccgcg

SEQ ID NO: 897101 - RNA, 15 nt, Mycobacterium avium subsp. paratuberculosis
aggccgcgcugucca

SEQ ID NO: 897102 - RNA, 15 nt, Mycobacterium avium subsp. paratuberculosis
aggccgcggccgucg

SEQ ID NO: 897103 - RNA, 16 nt, Mycobacterium avium subsp. paratuberculosis
aggccgcggccgucgu

SEQ ID NO: 897104 - RNA, 13 nt, Mycobacterium avium subsp. paratuberculosis
aggccgcggcgac

SEQ ID NO: 897105 - RNA, 20 nt, Mycobacterium avium subsp. paratuberculosis
aggccgcggguggcgccaca

SEQ ID NO: 897106 - RNA, 22 nt, Mycobacterium avium subsp. paratuberculosis
aggccgcggucgccccggccgc

SEQ ID NO: 897107 - RNA, 12 nt, Mycobacterium avium subsp. paratuberculosis
aggccgcgccga

SEQ ID NO: 897108 - RNA, 12 nt, Mycobacterium avium subsp. paratuberculosis
aggccgccucgu

SEQ ID NO: 897109 - RNA, 15 nt, Mycobacterium avium subsp. paratuberculosis
aggccgcgagcacga

SEQ ID NO: 897110 - RNA, 20 nt, Mycobacterium avium subsp. paratuberculosis
aggccgcgagcacgacgucg

SEQ ID NO: 897111 - RNA, 22 nt, Mycobacterium avium subsp. paratuberculosis
aggccgcgagcacgacgucgac

SEQ ID NO: 897112 - RNA, 17 nt, Mycobacterium avium subsp. paratuberculosis
aggccgcgccgaucacg

SEQ ID NO: 897113 - RNA, 14 nt, Mycobacterium avium subsp. paratuberculosis
aggccgcgccgggc

SEQ ID NO: 897114 - RNA, 13 nt, Mycobacterium avium subsp. paratuberculosis
aggccgcgcuggc

SEQ ID NO: 897115 - RNA, 15 nt, Mycobacterium avium subsp. paratuberculosis
aggccgcgcuggcca

SEQ ID NO: 897116 - RNA, 16 nt, Mycobacterium avium subsp. paratuberculosis
aggccgcgcuggcgca

SEQ ID NO: 897117 - RNA, 22 nt, Mycobacterium avium subsp. paratuberculosis
aggccgcgcuggcgcaggcgcu

SEQ ID NO: 897118 - RNA, 14 nt, Mycobacterium avium subsp. paratuberculosis
aggccggccagcgg

SEQ ID NO: 897119 - RNA, 19 nt, Mycobacterium avium subsp. paratuberculosis
aggccggccugccaccgcg

SEQ ID NO: 897120 - RNA, 22 nt, Mycobacterium avium subsp. paratuberculosis
aggccggccugccggaugccgc

SEQ ID NO: 897121 - RNA, 22 nt, Mycobacterium avium subsp. paratuberculosis
aggccggccuugcucgccgcgu

SEQ ID NO: 897122 - RNA, 15 nt, Mycobacterium avium subsp. paratuberculosis
aggccggcagccggc

SEQ ID NO: 897123 - RNA, 18 nt, Mycobacterium avium subsp. paratuberculosis
aggccggcagccggcgcg

SEQ ID NO: 897124 - RNA, 21 nt, Mycobacterium avium subsp. paratuberculosis
aggccgggaaugucgcgcagc

SEQ ID NO: 897125 - RNA, 22 nt, Mycobacterium avium subsp. paratuberculosis
aggccgggauagagcaccgcgc

SEQ ID NO: 897126 - RNA, 14 nt, Mycobacterium avium subsp. paratuberculosis
aggccggcgccggg

SEQ ID NO: 897127 - RNA, 15 nt, Mycobacterium avium subsp. paratuberculosis
aggccggcgacgaua

SEQ ID NO: 897128 - RNA, 23 nt, Mycobacterium avium subsp. paratuberculosis
aggccggcgacgauaucggccgc

SEQ ID NO: 897129 - RNA, 17 nt, Mycobacterium avium subsp. paratuberculosis
aggccggcgacgccggc

SEQ ID NO: 897130 - RNA, 15 nt, Mycobacterium avium subsp. paratuberculosis
aggccggcgacggcg

SEQ ID NO: 897131 - RNA, 17 nt, Mycobacterium avium subsp. paratuberculosis
aggccggcgagcucgcg

SEQ ID NO: 897132 - RNA, 22 nt, Mycobacterium avium subsp. paratuberculosis
aggccggcgagcucgcggccgu

SEQ ID NO: 897133 - RNA, 22 nt, Mycobacterium avium subsp. paratuberculosis
aggcccuugccccaccaccgcc

SEQ ID NO: 897134 - RNA, 17 nt, Mycobacterium avium subsp. paratuberculosis
aggccgaacaccgucau

SEQ ID NO: 897135 - RNA, 15 nt, Mycobacterium avium subsp. paratuberculosis
aggccgaacagcagc

SEQ ID NO: 897136 - RNA, 21 nt, Mycobacterium avium subsp. paratuberculosis
aggccgaaccgcagccggauc

SEQ ID NO: 897137 - RNA, 22 nt, Mycobacterium avium subsp. paratuberculosis
aggccgaaccgcagccggauca

SEQ ID NO: 897138 - RNA, 12 nt, Mycobacterium avium subsp. paratuberculosis
aggcccccggcu

SEQ ID NO: 897139 - RNA, 16 nt, Mycobacterium avium subsp. paratuberculosis
aggcccaguccugcag

SEQ ID NO: 897140 - RNA, 11 nt, Mycobacterium avium subsp. paratuberculosis
aggcccaccgc

SEQ ID NO: 897141 - RNA, 18 nt, Mycobacterium avium subsp. paratuberculosis
aggcccaucgcggucagc

SEQ ID NO: 897142 - RNA, 12 nt, Mycobacterium avium subsp. paratuberculosis
aggcccagcgga

SEQ ID NO: 897143 - RNA, 20 nt, Mycobacterium avium subsp. paratuberculosis
aggcccagcucguugccggc

SEQ ID NO: 897144 - RNA, 13 nt, Mycobacterium avium subsp. paratuberculosis
aggcccaggcgac

SEQ ID NO: 897145 - RNA, 13 nt, Mycobacterium avium subsp. paratuberculosis
aggcccagcagca

SEQ ID NO: 897146 - RNA, 19 nt, Mycobacterium avium subsp. paratuberculosis
aggcccagcagcaccgcga

SEQ ID NO: 897147 - RNA, 15 nt, Mycobacterium avium subsp. paratuberculosis
aggcccagcagcgca

SEQ ID NO: 897148 - RNA, 12 nt, Mycobacterium avium subsp. paratuberculosis
aggcccagccca

SEQ ID NO: 897149 - RNA, 18 nt, Mycobacterium avium subsp. paratuberculosis
aggcccagcccgccgcgu

SEQ ID NO: 897150 - RNA, 18 nt, Mycobacterium avium subsp. paratuberculosis
aggcccagcccggcccca

SEQ ID NO: 897151 - RNA, 16 nt, Mycobacterium avium subsp. paratuberculosis
aggcccagcgaggcgg

SEQ ID NO: 897152 - RNA, 19 nt, Mycobacterium avium subsp. paratuberculosis
aggcccagcgaggcggcca

SEQ ID NO: 897153 - RNA, 18 nt, Mycobacterium avium subsp. paratuberculosis
aggccgccgggccgccga

SEQ ID NO: 897154 - RNA, 14 nt, Mycobacterium avium subsp. paratuberculosis
aggccgccccggcc

SEQ ID NO: 897155 - RNA, 15 nt, Mycobacterium avium subsp. paratuberculosis
aggccgccccggccg

SEQ ID NO: 897156 - RNA, 16 nt, Mycobacterium avium subsp. paratuberculosis
aggccgccccggccgc

SEQ ID NO: 897157 - RNA, 17 nt, Mycobacterium avium subsp. paratuberculosis
aggccgccccggccgcg

SEQ ID NO: 897158 - RNA, 18 nt, Mycobacterium avium subsp. paratuberculosis
aggccgccccggccgcgc

SEQ ID NO: 897159 - RNA, 13 nt, Mycobacterium avium subsp. paratuberculosis
aggccgcccggcc

SEQ ID NO: 897160 - RNA, 21 nt, Mycobacterium avium subsp. paratuberculosis
aggccgccagcucguccagcg

SEQ ID NO: 897161 - RNA, 13 nt, Mycobacterium avium subsp. paratuberculosis
aggccgccgcauu

SEQ ID NO: 897162 - RNA, 14 nt, Mycobacterium avium subsp. paratuberculosis
aggccgccgccacc

SEQ ID NO: 897163 - RNA, 16 nt, Mycobacterium avium subsp. paratuberculosis
aggccgccgccaccgu

SEQ ID NO: 897164 - RNA, 14 nt, Mycobacterium avium subsp. paratuberculosis
aggccgacguggag

SEQ ID NO: 897165 - RNA, 15 nt, Mycobacterium avium subsp. paratuberculosis
aggccgacgcuggcc

SEQ ID NO: 897166 - RNA, 14 nt, Mycobacterium avium subsp. paratuberculosis
aggccgacgccggc

SEQ ID NO: 897167 - RNA, 20 nt, Mycobacterium avium subsp. paratuberculosis
aggcuuggcccgccgccggc

SEQ ID NO: 897168 - RNA, 14 nt, Mycobacterium avium subsp. paratuberculosis
aggcuggcaucguc

SEQ ID NO: 897169 - RNA, 17 nt, Mycobacterium avium subsp. paratuberculosis
aggcuggcaucgucggc

SEQ ID NO: 897170 - RNA, 18 nt, Mycobacterium avium subsp. paratuberculosis
aggcuggcaucgucggcg

SEQ ID NO: 897171 - RNA, 22 nt, Mycobacterium avium subsp. paratuberculosis
aggcuggcaucgucggcgccgg

SEQ ID NO: 897172 - RNA, 17 nt, Mycobacterium avium subsp. paratuberculosis
aggcuggccagcucggc

SEQ ID NO: 897173 - RNA, 18 nt, Mycobacterium avium subsp. paratuberculosis
aggcuggccaggcuggcg

SEQ ID NO: 897174 - RNA, 17 nt, Mycobacterium avium subsp. paratuberculosis
aggcugcucggcgggcu

SEQ ID NO: 897175 - RNA, 16 nt, Mycobacterium avium subsp. paratuberculosis
agggacaugccgagca

SEQ ID NO: 897176 - RNA, 17 nt, Mycobacterium avium subsp. paratuberculosis
agggacaugccgagcag

SEQ ID NO: 897177 - RNA, 13 nt, Mycobacterium avium subsp. paratuberculosis
agggacugcgccg

SEQ ID NO: 897178 - RNA, 15 nt, Mycobacterium avium subsp. paratuberculosis
agggacugcgccggg

SEQ ID NO: 897179 - RNA, 20 nt, Mycobacterium avium subsp. paratuberculosis
aggcugacgcgaccgcgcgg

SEQ ID NO: 897180 - RNA, 22 nt, Mycobacterium avium subsp. paratuberculosis
aggcugacgcgaccgcgcggcg

SEQ ID NO: 897181 - RNA, 16 nt, Mycobacterium avium subsp. paratuberculosis
aggcucacguagucga

SEQ ID NO: 897182 - RNA, 15 nt, Mycobacterium avium subsp. paratuberculosis
aggcugaucucggcg

SEQ ID NO: 897183 - RNA, 18 nt, Mycobacterium avium subsp. paratuberculosis
aggcugaucucggcgguc

SEQ ID NO: 897184 - RNA, 16 nt, Mycobacterium avium subsp. paratuberculosis
aggcugccgcugcgcc

SEQ ID NO: 897185 - RNA, 17 nt, Mycobacterium avium subsp. paratuberculosis
aggcguuggacuccacc

SEQ ID NO: 897186 - RNA, 16 nt, Mycobacterium avium subsp. paratuberculosis
aggcguuggcccgcac

SEQ ID NO: 897187 - RNA, 21 nt, Mycobacterium avium subsp. paratuberculosis
aggcguuggcccgcacccgcc

SEQ ID NO: 897188 - RNA, 14 nt, Mycobacterium avium subsp. paratuberculosis
aggcguugcaccgc

SEQ ID NO: 897189 - RNA, 20 nt, Mycobacterium avium subsp. paratuberculosis
aggcguggguuccgccgucg

SEQ ID NO: 897190 - RNA, 21 nt, Mycobacterium avium subsp. paratuberculosis
aggcguggguuccgccgucga

SEQ ID NO: 897191 - RNA, 14 nt, Mycobacterium avium subsp. paratuberculosis
aggcgugccgcugg

SEQ ID NO: 897192 - RNA, 14 nt, Mycobacterium avium subsp. paratuberculosis
aggcgugcucgauc

SEQ ID NO: 897193 - RNA, 15 nt, Mycobacterium avium subsp. paratuberculosis
aggcgugcacccggu

SEQ ID NO: 897194 - RNA, 21 nt, Mycobacterium avium subsp. paratuberculosis
aggcggguguauucgcccacc

SEQ ID NO: 897195 - RNA, 13 nt, Mycobacterium avium subsp. paratuberculosis
aggcggucgaacg

SEQ ID NO: 897196 - RNA, 22 nt, Mycobacterium avium subsp. paratuberculosis
aggcggucgacuggucgucgag

SEQ ID NO: 897197 - RNA, 23 nt, Mycobacterium avium subsp. paratuberculosis
aggcggucgugucagggaugccc

SEQ ID NO: 897198 - RNA, 16 nt, Mycobacterium avium subsp. paratuberculosis
aggcgucgucggccca

SEQ ID NO: 897199 - RNA, 23 nt, Mycobacterium avium subsp. paratuberculosis
aggcgguggcgcacaacccggac

SEQ ID NO: 897200 - RNA, 21 nt, Mycobacterium avium subsp. paratuberculosis
aggcgggccaccacaguggcc

SEQ ID NO: 897201 - RNA, 23 nt, Mycobacterium avium subsp. paratuberculosis
aggcggaaugcaggaucgcggug

SEQ ID NO: 897202 - RNA, 22 nt, Mycobacterium avium subsp. paratuberculosis
aggcgggccagcucgaacaccg

SEQ ID NO: 897203 - RNA, 11 nt, Mycobacterium avium subsp. paratuberculosis
aggcgcucggc

SEQ ID NO: 897204 - RNA, 20 nt, Mycobacterium avium subsp. paratuberculosis
aggcgcucgcacaacccgcc

SEQ ID NO: 897205 - RNA, 14 nt, Mycobacterium avium subsp. paratuberculosis
aggcgcucggcccg

SEQ ID NO: 897206 - RNA, 22 nt, Mycobacterium avium subsp. paratuberculosis
aggcgcggucgguggcggugcc

SEQ ID NO: 897207 - RNA, 13 nt, Mycobacterium avium subsp. paratuberculosis
aggcgcucgucga

SEQ ID NO: 897208 - RNA, 18 nt, Mycobacterium avium subsp. paratuberculosis
aggcgcugggugcgggcu

SEQ ID NO: 897209 - RNA, 15 nt, Mycobacterium avium subsp. paratuberculosis
aggcgccccagcucc

SEQ ID NO: 897210 - RNA, 21 nt, Mycobacterium avium subsp. paratuberculosis
aggcgccgccgcgcaggccgc

SEQ ID NO: 897211 - RNA, 14 nt, Mycobacterium avium subsp. paratuberculosis
aggcgccgaugccc

SEQ ID NO: 897212 - RNA, 14 nt, Mycobacterium avium subsp. paratuberculosis
aggcgcggggcgcg

SEQ ID NO: 897213 - RNA, 12 nt, Mycobacterium avium subsp. paratuberculosis
aggcgcgggugu

SEQ ID NO: 897214 - RNA, 12 nt, Mycobacterium avium subsp. paratuberculosis
aggcgcggcgcg

SEQ ID NO: 897215 - RNA, 20 nt, Mycobacterium avium subsp. paratuberculosis
aggcgcgcuaacggcgcggc

SEQ ID NO: 897216 - RNA, 19 nt, Mycobacterium avium subsp. paratuberculosis
aggcgcgcggccagccccg

SEQ ID NO: 897217 - RNA, 21 nt, Mycobacterium avium subsp. paratuberculosis
aggcgcgcggccagccccggg

SEQ ID NO: 897218 - RNA, 17 nt, Mycobacterium avium subsp. paratuberculosis
aggccggugcuguccac

SEQ ID NO: 897219 - RNA, 23 nt, Mycobacterium avium subsp. paratuberculosis
aggccggucacccaggccgagua

SEQ ID NO: 897220 - RNA, 12 nt, Mycobacterium avium subsp. paratuberculosis
aggccggucagc

SEQ ID NO: 897221 - RNA, 17 nt, Mycobacterium avium subsp. paratuberculosis
aggccggucagcgacga

SEQ ID NO: 897222 - RNA, 21 nt, Mycobacterium avium subsp. paratuberculosis
aggccgggcagugcgcggcgu

SEQ ID NO: 897223 - RNA, 12 nt, Mycobacterium avium subsp. paratuberculosis
aggccggcggug

SEQ ID NO: 897224 - RNA, 15 nt, Mycobacterium avium subsp. paratuberculosis
aggccguagcggcuc

SEQ ID NO: 897225 - RNA, 15 nt, Mycobacterium avium subsp. paratuberculosis
aggccguccaccaga

SEQ ID NO: 897226 - RNA, 15 nt, Mycobacterium avium subsp. paratuberculosis
aggccguccagcagc

SEQ ID NO: 897227 - RNA, 14 nt, Mycobacterium avium subsp. paratuberculosis
aggccguuguggcc

SEQ ID NO: 897228 - RNA, 19 nt, Mycobacterium avium subsp. paratuberculosis
aggccguaucccaccacga

SEQ ID NO: 897229 - RNA, 16 nt, Mycobacterium avium subsp. paratuberculosis
aggccgucgaggcgcu

SEQ ID NO: 897230 - RNA, 18 nt, Mycobacterium avium subsp. paratuberculosis
aggccgucggcgcggccg

SEQ ID NO: 897231 - RNA, 21 nt, Mycobacterium avium subsp. paratuberculosis
aggccgucucgagccggcgca

SEQ ID NO: 897232 - RNA, 15 nt, Mycobacterium avium subsp. paratuberculosis
aggcgaucagcgcgc

SEQ ID NO: 897233 - RNA, 18 nt, Mycobacterium avium subsp. paratuberculosis
aggcgaucaucgccccgg

SEQ ID NO: 897234 - RNA, 16 nt, Mycobacterium avium subsp. paratuberculosis
aggcgaugaagccggc

SEQ ID NO: 897235 - RNA, 14 nt, Mycobacterium avium subsp. paratuberculosis
aggcgaugcccagc

SEQ ID NO: 897236 - RNA, 14 nt, Mycobacterium avium subsp. paratuberculosis
aggcgaugccgccg

SEQ ID NO: 897237 - RNA, 23 nt, Mycobacterium avium subsp. paratuberculosis
aggcgaugccgccgacgaugucg

SEQ ID NO: 897238 - RNA, 16 nt, Mycobacterium avium subsp. paratuberculosis
aggcgauggugccggc

SEQ ID NO: 897239 - RNA, 14 nt, Mycobacterium avium subsp. paratuberculosis
aggcgauggcgucg

SEQ ID NO: 897240 - RNA, 17 nt, Mycobacterium avium subsp. paratuberculosis
aggcgauggcgucggcc

SEQ ID NO: 897241 - RNA, 20 nt, Mycobacterium avium subsp. paratuberculosis
aggcgauggcgucggccagc

SEQ ID NO: 897242 - RNA, 24 nt, Mycobacterium avium subsp. paratuberculosis
aggcgccacaacuggucgugcucg

SEQ ID NO: 897243 - RNA, 16 nt, Mycobacterium avium subsp. paratuberculosis
aggcgccacagcagca

SEQ ID NO: 897244 - RNA, 14 nt, Mycobacterium avium subsp. paratuberculosis
aggcgaugucgacg

SEQ ID NO: 897245 - RNA, 15 nt, Mycobacterium avium subsp. paratuberculosis
aggcgaugucgacgu

SEQ ID NO: 897246 - RNA, 22 nt, Mycobacterium avium subsp. paratuberculosis
agcaccacguugcgcccggcca

SEQ ID NO: 897247 - RNA, 20 nt, Mycobacterium avium subsp. paratuberculosis
agcaccacuuccagcaccgg

SEQ ID NO: 897248 - RNA, 21 nt, Mycobacterium avium subsp. paratuberculosis
agcaccacuuccagcaccggc

SEQ ID NO: 897249 - RNA, 20 nt, Mycobacterium avium subsp. paratuberculosis
agcaccagaugcaccucgcc

SEQ ID NO: 897250 - RNA, 17 nt, Mycobacterium avium subsp. paratuberculosis
agcaccagcaccaccgu

SEQ ID NO: 897251 - RNA, 15 nt, Mycobacterium avium subsp. paratuberculosis
agcaccagcagccgg

SEQ ID NO: 897252 - RNA, 14 nt, Mycobacterium avium subsp. paratuberculosis
agcaccagcccgau

SEQ ID NO: 897253 - RNA, 23 nt, Mycobacterium avium subsp. paratuberculosis
agcaccagcccgaugccgccgag

SEQ ID NO: 897254 - RNA, 13 nt, Mycobacterium avium subsp. paratuberculosis
agcaccagcccgg

SEQ ID NO: 897255 - RNA, 14 nt, Mycobacterium avium subsp. paratuberculosis
agcaccagcccggc

SEQ ID NO: 897256 - RNA, 13 nt, Mycobacterium avium subsp. paratuberculosis
agcaccagcgccg

SEQ ID NO: 897257 - RNA, 15 nt, Mycobacterium avium subsp. paratuberculosis
agcaccagcgccgcg

SEQ ID NO: 897258 - RNA, 16 nt, Mycobacterium avium subsp. paratuberculosis
agcaccagcgccgcga

SEQ ID NO: 897259 - RNA, 18 nt, Mycobacterium avium subsp. paratuberculosis
agcaccagcgccgcgaug

SEQ ID NO: 897260 - RNA, 15 nt, Mycobacterium avium subsp. paratuberculosis
agcaccagcgucgac

SEQ ID NO: 897261 - RNA, 16 nt, Mycobacterium avium subsp. paratuberculosis
agcaccagcgucgacg

SEQ ID NO: 897262 - RNA, 17 nt, Mycobacterium avium subsp. paratuberculosis
agcaccagcgucgacgc

SEQ ID NO: 897263 - RNA, 22 nt, Mycobacterium avium subsp. paratuberculosis
agcaccagcguggccggcaggu

SEQ ID NO: 897264 - RNA, 22 nt, Mycobacterium avium subsp. paratuberculosis
agcaccaggcccucgccgcggu

SEQ ID NO: 897265 - RNA, 20 nt, Mycobacterium avium subsp. paratuberculosis
agcaccaggcugaccagcgc

SEQ ID NO: 897266 - RNA, 22 nt, Mycobacterium avium subsp. paratuberculosis
agcaccaggcugaccagcgccu

SEQ ID NO: 897267 - RNA, 13 nt, Mycobacterium avium subsp. paratuberculosis
agcaccauccgcg

SEQ ID NO: 897268 - RNA, 15 nt, Mycobacterium avium subsp. paratuberculosis
agcaccauccgcgcg

SEQ ID NO: 897269 - RNA, 14 nt, Mycobacterium avium subsp. paratuberculosis
agcaccaugaucag

SEQ ID NO: 897270 - RNA, 16 nt, Mycobacterium avium subsp. paratuberculosis
agcaccagguggcccg

SEQ ID NO: 897271 - RNA, 18 nt, Mycobacterium avium subsp. paratuberculosis
agcaccagguugucgccg

SEQ ID NO: 897272 - RNA, 20 nt, Mycobacterium avium subsp. paratuberculosis
agcaccagguugucgccgcg

SEQ ID NO: 897273 - RNA, 21 nt, Mycobacterium avium subsp. paratuberculosis
agcaccagguugucgccgcgc

SEQ ID NO: 897274 - RNA, 22 nt, Mycobacterium avium subsp. paratuberculosis
agcaccagguugucgccgcgcc

SEQ ID NO: 897275 - RNA, 24 nt, Mycobacterium avium subsp. paratuberculosis
agcaccagguugucgccgcgccag

SEQ ID NO: 897276 - RNA, 12 nt, Mycobacterium avium subsp. paratuberculosis
agcaccagcccg

SEQ ID NO: 897277 - RNA, 16 nt, Mycobacterium avium subsp. paratuberculosis
agcaccagucggccau

SEQ ID NO: 897278 - RNA, 19 nt, Mycobacterium avium subsp. paratuberculosis
agcaccaguugcaccggca

SEQ ID NO: 897279 - RNA, 20 nt, Mycobacterium avium subsp. paratuberculosis
agcaccaguugcaccggcac

SEQ ID NO: 897280 - RNA, 19 nt, Mycobacterium avium subsp. paratuberculosis
agcaauucggugacggcgu

SEQ ID NO: 897281 - RNA, 13 nt, Mycobacterium avium subsp. paratuberculosis
agcaaauccggca

SEQ ID NO: 897282 - RNA, 14 nt, Mycobacterium avium subsp. paratuberculosis
agcaaauccggcag

SEQ ID NO: 897283 - RNA, 23 nt, Mycobacterium avium subsp. paratuberculosis
agcaaauccggcagcgcucgucg

SEQ ID NO: 897284 - RNA, 13 nt, Mycobacterium avium subsp. paratuberculosis
agaugucgcggcg

SEQ ID NO: 897285 - RNA, 16 nt, Mycobacterium avium subsp. paratuberculosis
agauguugcggccggc

SEQ ID NO: 897286 - RNA, 16 nt, Mycobacterium avium subsp. paratuberculosis
agauguugcggcggcc

SEQ ID NO: 897287 - RNA, 20 nt, Mycobacterium avium subsp. paratuberculosis
agauguuggagaucucggcg

SEQ ID NO: 897288 - RNA, 19 nt, Mycobacterium avium subsp. paratuberculosis
agcaacaccuuucggccgc

SEQ ID NO: 897289 - RNA, 13 nt, Mycobacterium avium subsp. paratuberculosis
agcaaccgggaua

SEQ ID NO: 897290 - RNA, 13 nt, Mycobacterium avium subsp. paratuberculosis
agcaaccggguca

SEQ ID NO: 897291 - RNA, 14 nt, Mycobacterium avium subsp. paratuberculosis
agcaaccccgcggu

SEQ ID NO: 897292 - RNA, 20 nt, Mycobacterium avium subsp. paratuberculosis
agcaacccgccgagcgugaa

SEQ ID NO: 897293 - RNA, 19 nt, Mycobacterium avium subsp. paratuberculosis
agcaacaugauuccgccgg

SEQ ID NO: 897294 - RNA, 15 nt, Mycobacterium avium subsp. paratuberculosis
agcaacgccagcgcg

SEQ ID NO: 897295 - RNA, 16 nt, Mycobacterium avium subsp. paratuberculosis
agcaacggcggcggca

SEQ ID NO: 897296 - RNA, 22 nt, Mycobacterium avium subsp. paratuberculosis
agcaacgguacgugcgccggcg

SEQ ID NO: 897297 - RNA, 17 nt, Mycobacterium avium subsp. paratuberculosis
agcacggccgcggccag

SEQ ID NO: 897298 - RNA, 14 nt, Mycobacterium avium subsp. paratuberculosis
agcacggccgcggc

SEQ ID NO: 897299 - RNA, 20 nt, Mycobacterium avium subsp. paratuberculosis
agcacggccacugccccggc

SEQ ID NO: 897300 - RNA, 22 nt, Mycobacterium avium subsp. paratuberculosis
agcacggccacugccccggcga

SEQ ID NO: 897301 - RNA, 21 nt, Mycobacterium avium subsp. paratuberculosis
agcacggccagccagccgccc

SEQ ID NO: 897302 - RNA, 22 nt, Mycobacterium avium subsp. paratuberculosis
agcacggccagccagccgccca

SEQ ID NO: 897303 - RNA, 23 nt, Mycobacterium avium subsp. paratuberculosis
agcacggcauagauaccggccag

SEQ ID NO: 897304 - RNA, 18 nt, Mycobacterium avium subsp. paratuberculosis
agcacggccaccagcagc

SEQ ID NO: 897305 - RNA, 21 nt, Mycobacterium avium subsp. paratuberculosis
agcaccgccccggucaccccg

SEQ ID NO: 897306 - RNA, 15 nt, Mycobacterium avium subsp. paratuberculosis
agcaccgccgacauc

SEQ ID NO: 897307 - RNA, 17 nt, Mycobacterium avium subsp. paratuberculosis
agcaccgccgacaucgc

SEQ ID NO: 897308 - RNA, 17 nt, Mycobacterium avium subsp. paratuberculosis
agcaccgccgagccguc

SEQ ID NO: 897309 - RNA, 21 nt, Mycobacterium avium subsp. paratuberculosis
agcaccgccgagccgucgucg

SEQ ID NO: 897310 - RNA, 21 nt, Mycobacterium avium subsp. paratuberculosis
agcaccgccgcggccgcgaug

SEQ ID NO: 897311 - RNA, 14 nt, Mycobacterium avium subsp. paratuberculosis
agcaccgccgcggg

SEQ ID NO: 897312 - RNA, 15 nt, Mycobacterium avium subsp. paratuberculosis
agcaccgccggcgcc

SEQ ID NO: 897313 - RNA, 13 nt, Mycobacterium avium subsp. paratuberculosis
agcacgucgacgc

SEQ ID NO: 897314 - RNA, 16 nt, Mycobacterium avium subsp. paratuberculosis
agcacgucaccgcuga

SEQ ID NO: 897315 - RNA, 17 nt, Mycobacterium avium subsp. paratuberculosis
agcacggugaucagcag

SEQ ID NO: 897316 - RNA, 18 nt, Mycobacterium avium subsp. paratuberculosis
agcacggugaucagcagc

SEQ ID NO: 897317 - RNA, 15 nt, Mycobacterium avium subsp. paratuberculosis
agcacggugggcgcc

SEQ ID NO: 897318 - RNA, 16 nt, Mycobacterium avium subsp. paratuberculosis
agcacggugggcgccg

SEQ ID NO: 897319 - RNA, 19 nt, Mycobacterium avium subsp. paratuberculosis
agcacggugggcgccgggu

SEQ ID NO: 897320 - RNA, 23 nt, Mycobacterium avium subsp. paratuberculosis
agcacgggggaguagcgcgcgaa

SEQ ID NO: 897321 - RNA, 19 nt, Mycobacterium avium subsp. paratuberculosis
agcacgggaugaucggcgc

SEQ ID NO: 897322 - RNA, 13 nt, Mycobacterium avium subsp. paratuberculosis
agcacggcggcgc

SEQ ID NO: 897323 - RNA, 17 nt, Mycobacterium avium subsp. paratuberculosis
agcacggcggcgcugau

SEQ ID NO: 897324 - RNA, 13 nt, Mycobacterium avium subsp. paratuberculosis
agcacggcggcgu

SEQ ID NO: 897325 - RNA, 21 nt, Mycobacterium avium subsp. paratuberculosis
agcaccgagaucucgucgaug

SEQ ID NO: 897326 - RNA, 16 nt, Mycobacterium avium subsp. paratuberculosis
agcaccgccagcgccg

SEQ ID NO: 897327 - RNA, 19 nt, Mycobacterium avium subsp. paratuberculosis
agcaccgccagcgccggca

SEQ ID NO: 897328 - RNA, 18 nt, Mycobacterium avium subsp. paratuberculosis
agcaccgcauaggaccgg

SEQ ID NO: 897329 - RNA, 23 nt, Mycobacterium avium subsp. paratuberculosis
agcaccgcauggggcaguagcga

SEQ ID NO: 897330 - RNA, 16 nt, Mycobacterium avium subsp. paratuberculosis
agcaccgccacggcga

SEQ ID NO: 897331 - RNA, 20 nt, Mycobacterium avium subsp. paratuberculosis
agcaccgccagcauccgcug

SEQ ID NO: 897332 - RNA, 22 nt, Mycobacterium avium subsp. paratuberculosis
agcaccgacagucccaccagua

SEQ ID NO: 897333 - RNA, 15 nt, Mycobacterium avium subsp. paratuberculosis
agcaccgacgcggcg

SEQ ID NO: 897334 - RNA, 16 nt, Mycobacterium avium subsp. paratuberculosis
agcaccgacgcggcga

SEQ ID NO: 897335 - RNA, 19 nt, Mycobacterium avium subsp. paratuberculosis
agcaccgaaccggcggggu

SEQ ID NO: 897336 - RNA, 19 nt, Mycobacterium avium subsp. paratuberculosis
agcaccgaaucgccgagcu

SEQ ID NO: 897337 - RNA, 20 nt, Mycobacterium avium subsp. paratuberculosis
agcaccgaaucgccgagcuc

SEQ ID NO: 897338 - RNA, 16 nt, Mycobacterium avium subsp. paratuberculosis
agcacccccucggcgc

SEQ ID NO: 897339 - RNA, 18 nt, Mycobacterium avium subsp. paratuberculosis
agcacccccucggcgccg

SEQ ID NO: 897340 - RNA, 20 nt, Mycobacterium avium subsp. paratuberculosis
agcacccccucggcgccggu

SEQ ID NO: 897341 - RNA, 13 nt, Mycobacterium avium subsp. paratuberculosis
agcaccccgaucg

SEQ ID NO: 897342 - RNA, 15 nt, Mycobacterium avium subsp. paratuberculosis
agcaccccgccgcag

SEQ ID NO: 897343 - RNA, 16 nt, Mycobacterium avium subsp. paratuberculosis
agcaccccgccgcagc

SEQ ID NO: 897344 - RNA, 14 nt, Mycobacterium avium subsp. paratuberculosis
agcaccccggcggc

SEQ ID NO: 897345 - RNA, 16 nt, Mycobacterium avium subsp. paratuberculosis
agcaccccggcggccg

SEQ ID NO: 897346 - RNA, 19 nt, Mycobacterium avium subsp. paratuberculosis
agcaccccggcggccgcgu

SEQ ID NO: 897347 - RNA, 20 nt, Mycobacterium avium subsp. paratuberculosis
agcaccccggcggccgcguc

SEQ ID NO: 897348 - RNA, 22 nt, Mycobacterium avium subsp. paratuberculosis
agcaccccgucgagcagccgca

SEQ ID NO: 897349 - RNA, 16 nt, Mycobacterium avium subsp. paratuberculosis
agcaccccgucgaggu

SEQ ID NO: 897350 - RNA, 19 nt, Mycobacterium avium subsp. paratuberculosis
agcacccgacuucggcucg

SEQ ID NO: 897351 - RNA, 23 nt, Mycobacterium avium subsp. paratuberculosis
agcacccgacuucggcucggcga

SEQ ID NO: 897352 - RNA, 17 nt, Mycobacterium avium subsp. paratuberculosis
agcacccgcagccgcga

SEQ ID NO: 897353 - RNA, 23 nt, Mycobacterium avium subsp. paratuberculosis
agcacccgcucgcgggcccgcgc

SEQ ID NO: 897354 - RNA, 18 nt, Mycobacterium avium subsp. paratuberculosis
agcacccggaugucguag

SEQ ID NO: 897355 - RNA, 13 nt, Mycobacterium avium subsp. paratuberculosis
agcacccggcggg

SEQ ID NO: 897356 - RNA, 13 nt, Mycobacterium avium subsp. paratuberculosis
agcacccgggccu

SEQ ID NO: 897357 - RNA, 23 nt, Mycobacterium avium subsp. paratuberculosis
agcacccgggccugcggcggccg

SEQ ID NO: 897358 - RNA, 18 nt, Mycobacterium avium subsp. paratuberculosis
agcacguugugcucgucg

SEQ ID NO: 897359 - RNA, 16 nt, Mycobacterium avium subsp. paratuberculosis
agcacgucgggguggc

SEQ ID NO: 897360 - RNA, 20 nt, Mycobacterium avium subsp. paratuberculosis
agcacgucgggguggccggc

SEQ ID NO: 897361 - RNA, 14 nt, Mycobacterium avium subsp. paratuberculosis
agcacgucggucag

SEQ ID NO: 897362 - RNA, 17 nt, Mycobacterium avium subsp. paratuberculosis
agcacgucgagcaccgc

SEQ ID NO: 897363 - RNA, 14 nt, Mycobacterium avium subsp. paratuberculosis
agcacgugcccagc

SEQ ID NO: 897364 - RNA, 17 nt, Mycobacterium avium subsp. paratuberculosis
agcacgugcccagcccg

SEQ ID NO: 897365 - RNA, 21 nt, Mycobacterium avium subsp. paratuberculosis
agcacgugcccagcccgcgcg

SEQ ID NO: 897366 - RNA, 16 nt, Mycobacterium avium subsp. paratuberculosis
agcacgugcccgccgu

SEQ ID NO: 897367 - RNA, 21 nt, Mycobacterium avium subsp. paratuberculosis
agcacgugcccgccgugcgcc

SEQ ID NO: 897368 - RNA, 18 nt, Mycobacterium avium subsp. paratuberculosis
agcacguggccgggcucg

SEQ ID NO: 897369 - RNA, 19 nt, Mycobacterium avium subsp. paratuberculosis
agcacucgauggcggcgau

SEQ ID NO: 897370 - RNA, 15 nt, Mycobacterium avium subsp. paratuberculosis
agcagacccgccgcg

SEQ ID NO: 897371 - RNA, 17 nt, Mycobacterium avium subsp. paratuberculosis
agcagacccgccgcggc

SEQ ID NO: 897372 - RNA, 20 nt, Mycobacterium avium subsp. paratuberculosis
agcagacgcaaaagccccca

SEQ ID NO: 897373 - RNA, 21 nt, Mycobacterium avium subsp. paratuberculosis
agcagcacgaucgagccggug

SEQ ID NO: 897374 - RNA, 14 nt, Mycobacterium avium subsp. paratuberculosis
agcagcagcgccgc

SEQ ID NO: 897375 - RNA, 13 nt, Mycobacterium avium subsp. paratuberculosis
agcagcagcgccu

SEQ ID NO: 897376 - RNA, 12 nt, Mycobacterium avium subsp. paratuberculosis
agcagcagcgcg

SEQ ID NO: 897377 - RNA, 15 nt, Mycobacterium avium subsp. paratuberculosis
agcagcagcgcggug

SEQ ID NO: 897378 - RNA, 21 nt, Mycobacterium avium subsp. paratuberculosis
agcagcacgcccagcccgcgg

SEQ ID NO: 897379 - RNA, 23 nt, Mycobacterium avium subsp. paratuberculosis
agcagcacgcccagcccgcgggc

SEQ ID NO: 897380 - RNA, 13 nt, Mycobacterium avium subsp. paratuberculosis
agcagcacggcaa

SEQ ID NO: 897381 - RNA, 18 nt, Mycobacterium avium subsp. paratuberculosis
agcagcagaaccagcacc

SEQ ID NO: 897382 - RNA, 14 nt, Mycobacterium avium subsp. paratuberculosis
agcagcagaccgcg

SEQ ID NO: 897383 - RNA, 15 nt, Mycobacterium avium subsp. paratuberculosis
agcagcagaccgcga

SEQ ID NO: 897384 - RNA, 17 nt, Mycobacterium avium subsp. paratuberculosis
agcagcagaccgcgauc

SEQ ID NO: 897385 - RNA, 20 nt, Mycobacterium avium subsp. paratuberculosis
agcagcagaccgcgaucagc

SEQ ID NO: 897386 - RNA, 13 nt, Mycobacterium avium subsp. paratuberculosis
agcagcagccacg

SEQ ID NO: 897387 - RNA, 16 nt, Mycobacterium avium subsp. paratuberculosis
agcagcagcccgccga

SEQ ID NO: 897388 - RNA, 13 nt, Mycobacterium avium subsp. paratuberculosis
agcagcagccgcc

SEQ ID NO: 897389 - RNA, 16 nt, Mycobacterium avium subsp. paratuberculosis
agcagcagccgcgccg

SEQ ID NO: 897390 - RNA, 20 nt, Mycobacterium avium subsp. paratuberculosis
agcagacgugaaaucccccg

SEQ ID NO: 897391 - RNA, 19 nt, Mycobacterium avium subsp. paratuberculosis
agcagacggacacccgcgc

SEQ ID NO: 897392 - RNA, 14 nt, Mycobacterium avium subsp. paratuberculosis
agcagcacccgggc

SEQ ID NO: 897393 - RNA, 21 nt, Mycobacterium avium subsp. paratuberculosis
agcagcacccgggccugcggc

SEQ ID NO: 897394 - RNA, 23 nt, Mycobacterium avium subsp. paratuberculosis
agcagcacccggucgccggugug

SEQ ID NO: 897395 - RNA, 13 nt, Mycobacterium avium subsp. paratuberculosis
agcagcaccgcga

SEQ ID NO: 897396 - RNA, 14 nt, Mycobacterium avium subsp. paratuberculosis
agcagcaccgcgac

SEQ ID NO: 897397 - RNA, 13 nt, Mycobacterium avium subsp. paratuberculosis
agcagcaccggca

SEQ ID NO: 897398 - RNA, 14 nt, Mycobacterium avium subsp. paratuberculosis
agcagcaccggcac

SEQ ID NO: 897399 - RNA, 20 nt, Mycobacterium avium subsp. paratuberculosis
agcagcaccggcaccgcggc

SEQ ID NO: 897400 - RNA, 21 nt, Mycobacterium avium subsp. paratuberculosis
agcagcaccggcaccgcggcg

SEQ ID NO: 897401 - RNA, 15 nt, Mycobacterium avium subsp. paratuberculosis
agcagcaccggcgcc

SEQ ID NO: 897402 - RNA, 19 nt, Mycobacterium avium subsp. paratuberculosis
agaucaauucugcugcccg

SEQ ID NO: 897403 - RNA, 16 nt, Mycobacterium avium subsp. paratuberculosis
agaucaccacgguggc

SEQ ID NO: 897404 - RNA, 15 nt, Mycobacterium avium subsp. paratuberculosis
agaucaacagccgcc

SEQ ID NO: 897405 - RNA, 16 nt, Mycobacterium avium subsp. paratuberculosis
agaucaacagccgccc

SEQ ID NO: 897406 - RNA, 15 nt, Mycobacterium avium subsp. paratuberculosis
agaucagcaccaggu

SEQ ID NO: 897407 - RNA, 16 nt, Mycobacterium avium subsp. paratuberculosis
agaucagcaccgggug

SEQ ID NO: 897408 - RNA, 14 nt, Mycobacterium avium subsp. paratuberculosis
agaucagcaccguc

SEQ ID NO: 897409 - RNA, 21 nt, Mycobacterium avium subsp. paratuberculosis
agaucaccgcguagcgccgcc

SEQ ID NO: 897410 - RNA, 22 nt, Mycobacterium avium subsp. paratuberculosis
agaucaccgcguagcgccgccc

SEQ ID NO: 897411 - RNA, 12 nt, Mycobacterium avium subsp. paratuberculosis
agaucaccggca

SEQ ID NO: 897412 - RNA, 17 nt, Mycobacterium avium subsp. paratuberculosis
agaucagcaggcuggcg

SEQ ID NO: 897413 - RNA, 11 nt, Mycobacterium avium subsp. paratuberculosis
agaucagcgaa

SEQ ID NO: 897414 - RNA, 12 nt, Mycobacterium avium subsp. paratuberculosis
agaucagcgccu

SEQ ID NO: 897415 - RNA, 15 nt, Mycobacterium avium subsp. paratuberculosis
agaucgacgccgacc

SEQ ID NO: 897416 - RNA, 15 nt, Mycobacterium avium subsp. paratuberculosis
agaucgacgccgcgg

SEQ ID NO: 897417 - RNA, 17 nt, Mycobacterium avium subsp. paratuberculosis
agaucgacgcugaccag

SEQ ID NO: 897418 - RNA, 17 nt, Mycobacterium avium subsp. paratuberculosis
agaucgccagcaccggc

SEQ ID NO: 897419 - RNA, 14 nt, Mycobacterium avium subsp. paratuberculosis
agaucgccagcgcc

SEQ ID NO: 897420 - RNA, 20 nt, Mycobacterium avium subsp. paratuberculosis
agaucgccccggggguagcg

SEQ ID NO: 897421 - RNA, 15 nt, Mycobacterium avium subsp. paratuberculosis
agaucgccugcaggg

SEQ ID NO: 897422 - RNA, 19 nt, Mycobacterium avium subsp. paratuberculosis
agaucgcgguggcgcccgc

SEQ ID NO: 897423 - RNA, 20 nt, Mycobacterium avium subsp. paratuberculosis
agaucgagcugggcccgcgc

SEQ ID NO: 897424 - RNA, 15 nt, Mycobacterium avium subsp. paratuberculosis
agaucgcccgccgcg

SEQ ID NO: 897425 - RNA, 16 nt, Mycobacterium avium subsp. paratuberculosis
agaucgcccgccgcga

SEQ ID NO: 897426 - RNA, 17 nt, Mycobacterium avium subsp. paratuberculosis
agaucgcccgggcggcg

SEQ ID NO: 897427 - RNA, 19 nt, Mycobacterium avium subsp. paratuberculosis
agaucgccuggcagcugcc

SEQ ID NO: 897428 - RNA, 15 nt, Mycobacterium avium subsp. paratuberculosis
agaucggccagcgcg

SEQ ID NO: 897429 - RNA, 19 nt, Mycobacterium avium subsp. paratuberculosis
agaucggccagcgcggccg

SEQ ID NO: 897430 - RNA, 21 nt, Mycobacterium avium subsp. paratuberculosis
agaucggggccuugacucccu

SEQ ID NO: 897431 - RNA, 21 nt, Mycobacterium avium subsp. paratuberculosis
agaucguagggcucggcgucg

SEQ ID NO: 897432 - RNA, 14 nt, Mycobacterium avium subsp. paratuberculosis
agaucgucgucccg

SEQ ID NO: 897433 - RNA, 18 nt, Mycobacterium avium subsp. paratuberculosis
agaucgucucggccagcc

SEQ ID NO: 897434 - RNA, 18 nt, Mycobacterium avium subsp. paratuberculosis
agaucgucuugaccgccc

SEQ ID NO: 897435 - RNA, 19 nt, Mycobacterium avium subsp. paratuberculosis
agaucgucuugaccgcccg

SEQ ID NO: 897436 - RNA, 19 nt, Mycobacterium avium subsp. paratuberculosis
agaucuccgccuucgacga

SEQ ID NO: 897437 - RNA, 19 nt, Mycobacterium avium subsp. paratuberculosis
agaucuccgggaacgcggc

SEQ ID NO: 897438 - RNA, 17 nt, Mycobacterium avium subsp. paratuberculosis
agaucuccucggacccg

SEQ ID NO: 897439 - RNA, 14 nt, Mycobacterium avium subsp. paratuberculosis
agaucucgcgccgc

SEQ ID NO: 897440 - RNA, 21 nt, Mycobacterium avium subsp. paratuberculosis
agaucugccggugccgccggc

SEQ ID NO: 897441 - RNA, 19 nt, Mycobacterium avium subsp. paratuberculosis
agaucguguccgcgccggc

SEQ ID NO: 897442 - RNA, 12 nt, Mycobacterium avium subsp. paratuberculosis
agaucucggcgu

SEQ ID NO: 897443 - RNA, 21 nt, Mycobacterium avium subsp. paratuberculosis
agaugcccacccgcucggcga

SEQ ID NO: 897444 - RNA, 15 nt, Mycobacterium avium subsp. paratuberculosis
agaugccccaggcga

SEQ ID NO: 897445 - RNA, 15 nt, Mycobacterium avium subsp. paratuberculosis
agaugcccgccccgc

SEQ ID NO: 897446 - RNA, 16 nt, Mycobacterium avium subsp. paratuberculosis
agaugaucagccgccc

SEQ ID NO: 897447 - RNA, 13 nt, Mycobacterium avium subsp. paratuberculosis
agaugagccgcag

SEQ ID NO: 897448 - RNA, 17 nt, Mycobacterium avium subsp. paratuberculosis
agaugagccgcagccgg

SEQ ID NO: 897449 - RNA, 21 nt, Mycobacterium avium subsp. paratuberculosis
agaugauugcgugcccggcca

SEQ ID NO: 897450 - RNA, 19 nt, Mycobacterium avium subsp. paratuberculosis
agaugccgccgccagcgcg

SEQ ID NO: 897451 - RNA, 14 nt, Mycobacterium avium subsp. paratuberculosis
agaugcgccgcgga

SEQ ID NO: 897452 - RNA, 22 nt, Mycobacterium avium subsp. paratuberculosis
agaugcgccggguccagccgcg

SEQ ID NO: 897453 - RNA, 16 nt, Mycobacterium avium subsp. paratuberculosis
agaugcgucaacccgu

SEQ ID NO: 897454 - RNA, 19 nt, Mycobacterium avium subsp. paratuberculosis
agaugcuucagcccucgag

SEQ ID NO: 897455 - RNA, 17 nt, Mycobacterium avium subsp. paratuberculosis
agaugcgcgucgcggcg

SEQ ID NO: 897456 - RNA, 18 nt, Mycobacterium avium subsp. paratuberculosis
agaugcgcgucgcggcgc

SEQ ID NO: 897457 - RNA, 17 nt, Mycobacterium avium subsp. paratuberculosis
agaugcggcaccagccc

SEQ ID NO: 897458 - RNA, 18 nt, Mycobacterium avium subsp. paratuberculosis
agaugcggcaccagcccg

SEQ ID NO: 897459 - RNA, 21 nt, Mycobacterium avium subsp. paratuberculosis
agaugcggcaccagcccgccg

SEQ ID NO: 897460 - RNA, 17 nt, Mycobacterium avium subsp. paratuberculosis
agaugcggcccagcccg

SEQ ID NO: 897461 - RNA, 24 nt, Mycobacterium avium subsp. paratuberculosis
agaugccgggcuccgcguucgacc

SEQ ID NO: 897462 - RNA, 16 nt, Mycobacterium avium subsp. paratuberculosis
agauggccagcaccac

SEQ ID NO: 897463 - RNA, 19 nt, Mycobacterium avium subsp. paratuberculosis
agauggccagcaccaccgc

SEQ ID NO: 897464 - RNA, 20 nt, Mycobacterium avium subsp. paratuberculosis
agauggccagcaccaccgcg

SEQ ID NO: 897465 - RNA, 21 nt, Mycobacterium avium subsp. paratuberculosis
agauggccagcaccaccgcga

SEQ ID NO: 897466 - RNA, 14 nt, Mycobacterium avium subsp. paratuberculosis
agauggccagcgcg

SEQ ID NO: 897467 - RNA, 23 nt, Mycobacterium avium subsp. paratuberculosis
agauggccagguaguggugggcg

SEQ ID NO: 897468 - RNA, 15 nt, Mycobacterium avium subsp. paratuberculosis
agaugggcgccgagu

SEQ ID NO: 897469 - RNA, 20 nt, Mycobacterium avium subsp. paratuberculosis
agauggucgccgacgguggc

SEQ ID NO: 897470 - RNA, 20 nt, Mycobacterium avium subsp. paratuberculosis
agauggucgcgccgcggcgc

SEQ ID NO: 897471 - RNA, 19 nt, Mycobacterium avium subsp. paratuberculosis
agauggucgggacgucggc

SEQ ID NO: 897472 - RNA, 15 nt, Mycobacterium avium subsp. paratuberculosis
agauggugaaguugc

SEQ ID NO: 897473 - RNA, 15 nt, Mycobacterium avium subsp. paratuberculosis
agaugguggccgucg

SEQ ID NO: 897474 - RNA, 17 nt, Mycobacterium avium subsp. paratuberculosis
agaugguggccgucggc

SEQ ID NO: 897475 - RNA, 19 nt, Mycobacterium avium subsp. paratuberculosis
agaugguggucaccaccac

SEQ ID NO: 897476 - RNA, 17 nt, Mycobacterium avium subsp. paratuberculosis
agaggcccggcagccgg

SEQ ID NO: 897477 - RNA, 18 nt, Mycobacterium avium subsp. paratuberculosis
agaggcggcgaccgcgac

SEQ ID NO: 897478 - RNA, 18 nt, Mycobacterium avium subsp. paratuberculosis
agagggccauccggccgg

SEQ ID NO: 897479 - RNA, 20 nt, Mycobacterium avium subsp. paratuberculosis
agagggccauccggccggcg

SEQ ID NO: 897480 - RNA, 15 nt, Mycobacterium avium subsp. paratuberculosis
agaggugcagcgggc

SEQ ID NO: 897481 - RNA, 20 nt, Mycobacterium avium subsp. paratuberculosis
agagggcgugacgccgcugc

SEQ ID NO: 897482 - RNA, 17 nt, Mycobacterium avium subsp. paratuberculosis
agagcuacggacgcauc

SEQ ID NO: 897483 - RNA, 13 nt, Mycobacterium avium subsp. paratuberculosis
agagcaccgcgcu

SEQ ID NO: 897484 - RNA, 20 nt, Mycobacterium avium subsp. paratuberculosis
agacucacggcggcagcgcg

SEQ ID NO: 897485 - RNA, 14 nt, Mycobacterium avium subsp. paratuberculosis
agacucagcccggc

SEQ ID NO: 897486 - RNA, 14 nt, Mycobacterium avium subsp. paratuberculosis
agacguggcggcgg

SEQ ID NO: 897487 - RNA, 12 nt, Mycobacterium avium subsp. paratuberculosis
agacgugcacgu

SEQ ID NO: 897488 - RNA, 14 nt, Mycobacterium avium subsp. paratuberculosis
agacgucggccggg

SEQ ID NO: 897489 - RNA, 21 nt, Mycobacterium avium subsp. paratuberculosis
agacgucgggcugggcggggu

SEQ ID NO: 897490 - RNA, 23 nt, Mycobacterium avium subsp. paratuberculosis
agacguggucgggcaugccggcc

SEQ ID NO: 897491 - RNA, 19 nt, Mycobacterium avium subsp. paratuberculosis
agacguguggcacccgggu

SEQ ID NO: 897492 - RNA, 18 nt, Mycobacterium avium subsp. paratuberculosis
agacguucuccccgccgg

SEQ ID NO: 897493 - RNA, 19 nt, Mycobacterium avium subsp. paratuberculosis
agacguugccgaucccggc

SEQ ID NO: 897494 - RNA, 20 nt, Mycobacterium avium subsp. paratuberculosis
agacguugccgaucccggcc

SEQ ID NO: 897495 - RNA, 14 nt, Mycobacterium avium subsp. paratuberculosis
agacguccucgguc

SEQ ID NO: 897496 - RNA, 22 nt, Mycobacterium avium subsp. paratuberculosis
agacguccucggucucguccag

SEQ ID NO: 897497 - RNA, 11 nt, Mycobacterium avium subsp. paratuberculosis
agacgucgacc

SEQ ID NO: 897498 - RNA, 16 nt, Mycobacterium avium subsp. paratuberculosis
agaaaauccagaacag

SEQ ID NO: 897499 - RNA, 13 nt, Mycobacterium avium subsp. paratuberculosis
agccacgccgaca

SEQ ID NO: 897500 - RNA, 12 nt, Mycobacterium avium subsp. paratuberculosis
agccacgccggc

SEQ ID NO: 897501 - RNA, 14 nt, Mycobacterium avium subsp. paratuberculosis
agccacgccggcac

SEQ ID NO: 897502 - RNA, 15 nt, Mycobacterium avium subsp. paratuberculosis
agccacgagcccagc

SEQ ID NO: 897503 - RNA, 16 nt, Mycobacterium avium subsp. paratuberculosis
agccacgagcccagcc

SEQ ID NO: 897504 - RNA, 20 nt, Mycobacterium avium subsp. paratuberculosis
agccacgagcccagccgucg

SEQ ID NO: 897505 - RNA, 16 nt, Mycobacterium avium subsp. paratuberculosis
agccagaccucgccga

SEQ ID NO: 897506 - RNA, 17 nt, Mycobacterium avium subsp. paratuberculosis
agccagaccucgccgac

SEQ ID NO: 897507 - RNA, 21 nt, Mycobacterium avium subsp. paratuberculosis
agccagaucgaggccagcgcg

SEQ ID NO: 897508 - RNA, 16 nt, Mycobacterium avium subsp. paratuberculosis
agccagcccagccgcc

SEQ ID NO: 897509 - RNA, 15 nt, Mycobacterium avium subsp. paratuberculosis
agccagcccgcgcaa

SEQ ID NO: 897510 - RNA, 22 nt, Mycobacterium avium subsp. paratuberculosis
agccagcccguggccagcgcca

SEQ ID NO: 897511 - RNA, 18 nt, Mycobacterium avium subsp. paratuberculosis
agccauaaaccggccggc

SEQ ID NO: 897512 - RNA, 19 nt, Mycobacterium avium subsp. paratuberculosis
agccauaaaccggccggcg

SEQ ID NO: 897513 - RNA, 15 nt, Mycobacterium avium subsp. paratuberculosis
agccaguucgccagc

SEQ ID NO: 897514 - RNA, 17 nt, Mycobacterium avium subsp. paratuberculosis
agccaguugaucagccc

SEQ ID NO: 897515 - RNA, 18 nt, Mycobacterium avium subsp. paratuberculosis
agccaguugaucagcccg

SEQ ID NO: 897516 - RNA, 14 nt, Mycobacterium avium subsp. paratuberculosis
agccagucgccggc

SEQ ID NO: 897517 - RNA, 15 nt, Mycobacterium avium subsp. paratuberculosis
agccagucgccggcc

SEQ ID NO: 897518 - RNA, 18 nt, Mycobacterium avium subsp. paratuberculosis
agccauacugacgccggu

SEQ ID NO: 897519 - RNA, 23 nt, Mycobacterium avium subsp. paratuberculosis
agccauggcggcccgcgccggcg

SEQ ID NO: 897520 - RNA, 19 nt, Mycobacterium avium subsp. paratuberculosis
agccaugggucucggcgag

SEQ ID NO: 897521 - RNA, 17 nt, Mycobacterium avium subsp. paratuberculosis
agccaucagaacgcccg

SEQ ID NO: 897522 - RNA, 18 nt, Mycobacterium avium subsp. paratuberculosis
agccaucagaacgcccgc

SEQ ID NO: 897523 - RNA, 17 nt, Mycobacterium avium subsp. paratuberculosis
agccagccuggcggcga

SEQ ID NO: 897524 - RNA, 18 nt, Mycobacterium avium subsp. paratuberculosis
agccagccuggcggcgac

SEQ ID NO: 897525 - RNA, 20 nt, Mycobacterium avium subsp. paratuberculosis
agccagccggugcggucggc

SEQ ID NO: 897526 - RNA, 21 nt, Mycobacterium avium subsp. paratuberculosis
agccagccggugcggucggcg

SEQ ID NO: 897527 - RNA, 14 nt, Mycobacterium avium subsp. paratuberculosis
agccagccgguggc

SEQ ID NO: 897528 - RNA, 20 nt, Mycobacterium avium subsp. paratuberculosis
agccagccgguggcggccac

SEQ ID NO: 897529 - RNA, 16 nt, Mycobacterium avium subsp. paratuberculosis
agccagccgcccagca

SEQ ID NO: 897530 - RNA, 13 nt, Mycobacterium avium subsp. paratuberculosis
agccagccgcgcc

SEQ ID NO: 897531 - RNA, 14 nt, Mycobacterium avium subsp. paratuberculosis
agccagccgcgccg

SEQ ID NO: 897532 - RNA, 16 nt, Mycobacterium avium subsp. paratuberculosis
agccagccgcgccgcg

SEQ ID NO: 897533 - RNA, 14 nt, Mycobacterium avium subsp. paratuberculosis
agccagcgcccggc

SEQ ID NO: 897534 - RNA, 20 nt, Mycobacterium avium subsp. paratuberculosis
agccagccgucccgccgucu

SEQ ID NO: 897535 - RNA, 14 nt, Mycobacterium avium subsp. paratuberculosis
agccagcgggccga

SEQ ID NO: 897536 - RNA, 15 nt, Mycobacterium avium subsp. paratuberculosis
agccagcucggcgua

SEQ ID NO: 897537 - RNA, 21 nt, Mycobacterium avium subsp. paratuberculosis
agccagcugcgcgucggccgc

SEQ ID NO: 897538 - RNA, 22 nt, Mycobacterium avium subsp. paratuberculosis
agccagcuggugaagcugccga

SEQ ID NO: 897539 - RNA, 16 nt, Mycobacterium avium subsp. paratuberculosis
agccaggccgucggcg

SEQ ID NO: 897540 - RNA, 20 nt, Mycobacterium avium subsp. paratuberculosis
agcagggcaccgacggccgc

SEQ ID NO: 897541 - RNA, 18 nt, Mycobacterium avium subsp. paratuberculosis
agcaggcggaucggcccg

SEQ ID NO: 897542 - RNA, 13 nt, Mycobacterium avium subsp. paratuberculosis
agcagggcgccga

SEQ ID NO: 897543 - RNA, 14 nt, Mycobacterium avium subsp. paratuberculosis
agcagggcgccgac

SEQ ID NO: 897544 - RNA, 18 nt, Mycobacterium avium subsp. paratuberculosis
agcagggccucgccguug

SEQ ID NO: 897545 - RNA, 16 nt, Mycobacterium avium subsp. paratuberculosis
agcagggccagcggca

SEQ ID NO: 897546 - RNA, 23 nt, Mycobacterium avium subsp. paratuberculosis
agcagguugcgguguugcgcagc

SEQ ID NO: 897547 - RNA, 20 nt, Mycobacterium avium subsp. paratuberculosis
agcagguuguagucggcgcc

SEQ ID NO: 897548 - RNA, 23 nt, Mycobacterium avium subsp. paratuberculosis
agcagguuguagucggcgccgac

SEQ ID NO: 897549 - RNA, 14 nt, Mycobacterium avium subsp. paratuberculosis
agcaggugcaccac

SEQ ID NO: 897550 - RNA, 16 nt, Mycobacterium avium subsp. paratuberculosis
agcaggugcaccaccc

SEQ ID NO: 897551 - RNA, 16 nt, Mycobacterium avium subsp. paratuberculosis
agcaggugcaucgacc

SEQ ID NO: 897552 - RNA, 19 nt, Mycobacterium avium subsp. paratuberculosis
agcaggugcaucgaccggc

SEQ ID NO: 897553 - RNA, 20 nt, Mycobacterium avium subsp. paratuberculosis
agcaggugcaucgccaccgu

SEQ ID NO: 897554 - RNA, 15 nt, Mycobacterium avium subsp. paratuberculosis
agcagggcgcgcauc

SEQ ID NO: 897555 - RNA, 23 nt, Mycobacterium avium subsp. paratuberculosis
agcagggcgcgcaucugcucggc

SEQ ID NO: 897556 - RNA, 17 nt, Mycobacterium avium subsp. paratuberculosis
agcagggcggcaccgau

SEQ ID NO: 897557 - RNA, 21 nt, Mycobacterium avium subsp. paratuberculosis
agcagggcggcaccgaucggc

SEQ ID NO: 897558 - RNA, 18 nt, Mycobacterium avium subsp. paratuberculosis
agcagccagucggucaac

SEQ ID NO: 897559 - RNA, 20 nt, Mycobacterium avium subsp. paratuberculosis
agcagccagucggucaacgu

SEQ ID NO: 897560 - RNA, 13 nt, Mycobacterium avium subsp. paratuberculosis
agcagcccgccga

SEQ ID NO: 897561 - RNA, 14 nt, Mycobacterium avium subsp. paratuberculosis
agcagcccgccgau

SEQ ID NO: 897562 - RNA, 14 nt, Mycobacterium avium subsp. paratuberculosis
agcagcccggccag

SEQ ID NO: 897563 - RNA, 15 nt, Mycobacterium avium subsp. paratuberculosis
agcagcccggccagc

SEQ ID NO: 897564 - RNA, 16 nt, Mycobacterium avium subsp. paratuberculosis
agcagcccggccagcc

SEQ ID NO: 897565 - RNA, 15 nt, Mycobacterium avium subsp. paratuberculosis
agcaggcggacggcg

SEQ ID NO: 897566 - RNA, 17 nt, Mycobacterium avium subsp. paratuberculosis
agcaggcggacggcgac

SEQ ID NO: 897567 - RNA, 15 nt, Mycobacterium avium subsp. paratuberculosis
agcaggcgccggucg

SEQ ID NO: 897568 - RNA, 20 nt, Mycobacterium avium subsp. paratuberculosis
agcaggcgcgccgagcgcug

SEQ ID NO: 897569 - RNA, 21 nt, Mycobacterium avium subsp. paratuberculosis
agcagccacgacaccagcguc

SEQ ID NO: 897570 - RNA, 17 nt, Mycobacterium avium subsp. paratuberculosis
agcagccacgccagcca

SEQ ID NO: 897571 - RNA, 15 nt, Mycobacterium avium subsp. paratuberculosis
agcagccaggacagc

SEQ ID NO: 897572 - RNA, 21 nt, Mycobacterium avium subsp. paratuberculosis
agcagccaggacagcgucagc

SEQ ID NO: 897573 - RNA, 18 nt, Mycobacterium avium subsp. paratuberculosis
agcaugcccacgccgucg

SEQ ID NO: 897574 - RNA, 20 nt, Mycobacterium avium subsp. paratuberculosis
agcaugcccacgccgucgac

SEQ ID NO: 897575 - RNA, 17 nt, Mycobacterium avium subsp. paratuberculosis
agcaugacgaacucguu

SEQ ID NO: 897576 - RNA, 15 nt, Mycobacterium avium subsp. paratuberculosis
agcaugaucaccgcc

SEQ ID NO: 897577 - RNA, 23 nt, Mycobacterium avium subsp. paratuberculosis
agcaugaagaucagcaccgucca

SEQ ID NO: 897578 - RNA, 13 nt, Mycobacterium avium subsp. paratuberculosis
agcauccggcgca

SEQ ID NO: 897579 - RNA, 23 nt, Mycobacterium avium subsp. paratuberculosis
agcauccggcgcacggcgcccag

SEQ ID NO: 897580 - RNA, 14 nt, Mycobacterium avium subsp. paratuberculosis
agcaucagcugccg

SEQ ID NO: 897581 - RNA, 16 nt, Mycobacterium avium subsp. paratuberculosis
agcaucagcugccguc

SEQ ID NO: 897582 - RNA, 16 nt, Mycobacterium avium subsp. paratuberculosis
agcaucauugagccgc

SEQ ID NO: 897583 - RNA, 24 nt, Mycobacterium avium subsp. paratuberculosis
agcauccccuuggugcggucgaug

SEQ ID NO: 897584 - RNA, 14 nt, Mycobacterium avium subsp. paratuberculosis
agcauccagguggc

SEQ ID NO: 897585 - RNA, 21 nt, Mycobacterium avium subsp. paratuberculosis
agcauccgcaacgugcgccgg

SEQ ID NO: 897586 - RNA, 12 nt, Mycobacterium avium subsp. paratuberculosis
agcauccgccga

SEQ ID NO: 897587 - RNA, 13 nt, Mycobacterium avium subsp. paratuberculosis
agcagugcaucgc

SEQ ID NO: 897588 - RNA, 13 nt, Mycobacterium avium subsp. paratuberculosis
agcagugccacca

SEQ ID NO: 897589 - RNA, 13 nt, Mycobacterium avium subsp. paratuberculosis
agcaggugcgcca

SEQ ID NO: 897590 - RNA, 22 nt, Mycobacterium avium subsp. paratuberculosis
agcaguaugcccgccgcugacg

SEQ ID NO: 897591 - RNA, 13 nt, Mycobacterium avium subsp. paratuberculosis
agcagucggccug

SEQ ID NO: 897592 - RNA, 19 nt, Mycobacterium avium subsp. paratuberculosis
agcagucggccugcagcuc

SEQ ID NO: 897593 - RNA, 13 nt, Mycobacterium avium subsp. paratuberculosis
agcagucgugacg

SEQ ID NO: 897594 - RNA, 21 nt, Mycobacterium avium subsp. paratuberculosis
agcagucgugacgcggcgucg

SEQ ID NO: 897595 - RNA, 14 nt, Mycobacterium avium subsp. paratuberculosis
agcaguccggcggu

SEQ ID NO: 897596 - RNA, 12 nt, Mycobacterium avium subsp. paratuberculosis
agccaugccggg

SEQ ID NO: 897597 - RNA, 12 nt, Mycobacterium avium subsp. paratuberculosis
agccauucgucg

SEQ ID NO: 897598 - RNA, 16 nt, Mycobacterium avium subsp. paratuberculosis
agcccaagugcccgcg

SEQ ID NO: 897599 - RNA, 18 nt, Mycobacterium avium subsp. paratuberculosis
agcccaccgcgcccagcc

SEQ ID NO: 897600 - RNA, 14 nt, Mycobacterium avium subsp. paratuberculosis
agcccaccgcggug

SEQ ID NO: 897601 - RNA, 19 nt, Mycobacterium avium subsp. paratuberculosis
agcccaccgcggugaccgc

SEQ ID NO: 897602 - RNA, 14 nt, Mycobacterium avium subsp. paratuberculosis
agcccaggcccagc

SEQ ID NO: 897603 - RNA, 19 nt, Mycobacterium avium subsp. paratuberculosis
agcccaggcccagcagcac

SEQ ID NO: 897604 - RNA, 12 nt, Mycobacterium avium subsp. paratuberculosis
agcccagcgcgu

SEQ ID NO: 897605 - RNA, 14 nt, Mycobacterium avium subsp. paratuberculosis
agcccagcgcguug

SEQ ID NO: 897606 - RNA, 16 nt, Mycobacterium avium subsp. paratuberculosis
agcccagcgcguugcg

SEQ ID NO: 897607 - RNA, 21 nt, Mycobacterium avium subsp. paratuberculosis
agcccagcgcguugcggccgu

SEQ ID NO: 897608 - RNA, 13 nt, Mycobacterium avium subsp. paratuberculosis
agcccagcguggu

SEQ ID NO: 897609 - RNA, 17 nt, Mycobacterium avium subsp. paratuberculosis
agcccagcugcgcggag

SEQ ID NO: 897610 - RNA, 20 nt, Mycobacterium avium subsp. paratuberculosis
agcccagcuuggcgcccuug

SEQ ID NO: 897611 - RNA, 16 nt, Mycobacterium avium subsp. paratuberculosis
agcccagccagccggu

SEQ ID NO: 897612 - RNA, 17 nt, Mycobacterium avium subsp. paratuberculosis
agcccagccagccggug

SEQ ID NO: 897613 - RNA, 14 nt, Mycobacterium avium subsp. paratuberculosis
agcccagccgccag

SEQ ID NO: 897614 - RNA, 14 nt, Mycobacterium avium subsp. paratuberculosis
agcccagccgucgc

SEQ ID NO: 897615 - RNA, 21 nt, Mycobacterium avium subsp. paratuberculosis
agcccaucccgauccgcgccg

SEQ ID NO: 897616 - RNA, 16 nt, Mycobacterium avium subsp. paratuberculosis
agccccaggcccgguu

SEQ ID NO: 897617 - RNA, 13 nt, Mycobacterium avium subsp. paratuberculosis
agccccagcacga

SEQ ID NO: 897618 - RNA, 14 nt, Mycobacterium avium subsp. paratuberculosis
agccccaccggcca

SEQ ID NO: 897619 - RNA, 15 nt, Mycobacterium avium subsp. paratuberculosis
agccccaccggccac

SEQ ID NO: 897620 - RNA, 13 nt, Mycobacterium avium subsp. paratuberculosis
agccccaccaccg

SEQ ID NO: 897621 - RNA, 14 nt, Mycobacterium avium subsp. paratuberculosis
agccccaccaccgc

SEQ ID NO: 897622 - RNA, 17 nt, Mycobacterium avium subsp. paratuberculosis
agccccaccaccgccac

SEQ ID NO: 897623 - RNA, 18 nt, Mycobacterium avium subsp. paratuberculosis
agccccaccaccgccacc

SEQ ID NO: 897624 - RNA, 23 nt, Mycobacterium avium subsp. paratuberculosis
agccccaccaccgccaccagcgc

SEQ ID NO: 897625 - RNA, 14 nt, Mycobacterium avium subsp. paratuberculosis
agcccaugucgccg

SEQ ID NO: 897626 - RNA, 15 nt, Mycobacterium avium subsp. paratuberculosis
agcccaugucgccgg

SEQ ID NO: 897627 - RNA, 17 nt, Mycobacterium avium subsp. paratuberculosis
agcccaugucgccggug

SEQ ID NO: 897628 - RNA, 23 nt, Mycobacterium avium subsp. paratuberculosis
agcccaugucgccggugcugguc

SEQ ID NO: 897629 - RNA, 19 nt, Mycobacterium avium subsp. paratuberculosis
agcccgaucgccagcgccc

SEQ ID NO: 897630 - RNA, 19 nt, Mycobacterium avium subsp. paratuberculosis
agcccgaucucgcggucga

SEQ ID NO: 897631 - RNA, 16 nt, Mycobacterium avium subsp. paratuberculosis
agcccgaucacccccg

SEQ ID NO: 897632 - RNA, 17 nt, Mycobacterium avium subsp. paratuberculosis
agcccgaucacccccga

SEQ ID NO: 897633 - RNA, 21 nt, Mycobacterium avium subsp. paratuberculosis
agcccgaucacccccgacacc

SEQ ID NO: 897634 - RNA, 19 nt, Mycobacterium avium subsp. paratuberculosis
agcccgagcgucacgccag

SEQ ID NO: 897635 - RNA, 16 nt, Mycobacterium avium subsp. paratuberculosis
agcccgaugcuggcca

SEQ ID NO: 897636 - RNA, 21 nt, Mycobacterium avium subsp. paratuberculosis
agcccgaugcuggccaucgcc

SEQ ID NO: 897637 - RNA, 17 nt, Mycobacterium avium subsp. paratuberculosis
agcccgcagcgaacgcg

SEQ ID NO: 897638 - RNA, 23 nt, Mycobacterium avium subsp. paratuberculosis
agcccgcauuccgucuuggccag

SEQ ID NO: 897639 - RNA, 17 nt, Mycobacterium avium subsp. paratuberculosis
agcccgcccagcgccac

SEQ ID NO: 897640 - RNA, 16 nt, Mycobacterium avium subsp. paratuberculosis
agcccgcccaccacga

SEQ ID NO: 897641 - RNA, 19 nt, Mycobacterium avium subsp. paratuberculosis
agcccgccgaaccagaucg

SEQ ID NO: 897642 - RNA, 16 nt, Mycobacterium avium subsp. paratuberculosis
agcccgccgaccaccu

SEQ ID NO: 897643 - RNA, 15 nt, Mycobacterium avium subsp. paratuberculosis
agcccgccggcggcg

SEQ ID NO: 897644 - RNA, 13 nt, Mycobacterium avium subsp. paratuberculosis
agcccgccgggau

SEQ ID NO: 897645 - RNA, 23 nt, Mycobacterium avium subsp. paratuberculosis
agcccgccgggaugcgccaccga

SEQ ID NO: 897646 - RNA, 24 nt, Mycobacterium avium subsp. paratuberculosis
agcccgccgggaugcgccaccgac

SEQ ID NO: 897647 - RNA, 13 nt, Mycobacterium avium subsp. paratuberculosis
agcccgccgggcu

SEQ ID NO: 897648 - RNA, 14 nt, Mycobacterium avium subsp. paratuberculosis
agcccccaccgcgc

SEQ ID NO: 897649 - RNA, 15 nt, Mycobacterium avium subsp. paratuberculosis
agcccccaccgcgcc

SEQ ID NO: 897650 - RNA, 22 nt, Mycobacterium avium subsp. paratuberculosis
agcccccgcgggucgucgacgu

SEQ ID NO: 897651 - RNA, 15 nt, Mycobacterium avium subsp. paratuberculosis
agccccggaccggag

SEQ ID NO: 897652 - RNA, 19 nt, Mycobacterium avium subsp. paratuberculosis
agccccgccaggcggcgac

SEQ ID NO: 897653 - RNA, 16 nt, Mycobacterium avium subsp. paratuberculosis
agccccgagccgcgga

SEQ ID NO: 897654 - RNA, 18 nt, Mycobacterium avium subsp. paratuberculosis
agcccgaacacgggcggc

SEQ ID NO: 897655 - RNA, 20 nt, Mycobacterium avium subsp. paratuberculosis
agcccgaacagccgggcggc

SEQ ID NO: 897656 - RNA, 15 nt, Mycobacterium avium subsp. paratuberculosis
agcccgagaucgacg

SEQ ID NO: 897657 - RNA, 15 nt, Mycobacterium avium subsp. paratuberculosis
agcccgagcggcauc

SEQ ID NO: 897658 - RNA, 22 nt, Mycobacterium avium subsp. paratuberculosis
agcccgacaucugccgggcggc

SEQ ID NO: 897659 - RNA, 19 nt, Mycobacterium avium subsp. paratuberculosis
agcccgaccaccuccccgc

SEQ ID NO: 897660 - RNA, 13 nt, Mycobacterium avium subsp. paratuberculosis
agcccgacccggc

SEQ ID NO: 897661 - RNA, 16 nt, Mycobacterium avium subsp. paratuberculosis
agccccuuaccggccg

SEQ ID NO: 897662 - RNA, 16 nt, Mycobacterium avium subsp. paratuberculosis
agccccucgccgggcg

SEQ ID NO: 897663 - RNA, 15 nt, Mycobacterium avium subsp. paratuberculosis
agccccugcaccacg

SEQ ID NO: 897664 - RNA, 22 nt, Mycobacterium avium subsp. paratuberculosis
agccccgggaaccagcccaggu

SEQ ID NO: 897665 - RNA, 23 nt, Mycobacterium avium subsp. paratuberculosis
agccccgggaaccagcccagguc

SEQ ID NO: 897666 - RNA, 16 nt, Mycobacterium avium subsp. paratuberculosis
agccccucccaccacg

SEQ ID NO: 897667 - RNA, 13 nt, Mycobacterium avium subsp. paratuberculosis
agccgacgggauc

SEQ ID NO: 897668 - RNA, 22 nt, Mycobacterium avium subsp. paratuberculosis
agccgagcgguccaacgggcuc

SEQ ID NO: 897669 - RNA, 15 nt, Mycobacterium avium subsp. paratuberculosis
agccgaccucggcga

SEQ ID NO: 897670 - RNA, 16 nt, Mycobacterium avium subsp. paratuberculosis
agccgaccucggcgac

SEQ ID NO: 897671 - RNA, 18 nt, Mycobacterium avium subsp. paratuberculosis
agccgaccucggcgacga

SEQ ID NO: 897672 - RNA, 20 nt, Mycobacterium avium subsp. paratuberculosis
agccgaccuugacccaggcc

SEQ ID NO: 897673 - RNA, 15 nt, Mycobacterium avium subsp. paratuberculosis
agccgaccgccccgc

SEQ ID NO: 897674 - RNA, 15 nt, Mycobacterium avium subsp. paratuberculosis
agccgaggucgccga

SEQ ID NO: 897675 - RNA, 23 nt, Mycobacterium avium subsp. paratuberculosis
agccgaggucgccgacgccgucg

SEQ ID NO: 897676 - RNA, 18 nt, Mycobacterium avium subsp. paratuberculosis
agccgauacaugugccga

SEQ ID NO: 897677 - RNA, 17 nt, Mycobacterium avium subsp. paratuberculosis
agccgaggccgauggcg

SEQ ID NO: 897678 - RNA, 16 nt, Mycobacterium avium subsp. paratuberculosis
agccgaggucgccggu

SEQ ID NO: 897679 - RNA, 18 nt, Mycobacterium avium subsp. paratuberculosis
agccgaggucgcggcggc

SEQ ID NO: 897680 - RNA, 19 nt, Mycobacterium avium subsp. paratuberculosis
agccgaggucgcggcggcc

SEQ ID NO: 897681 - RNA, 20 nt, Mycobacterium avium subsp. paratuberculosis
agccgaggucgcggcggccg

SEQ ID NO: 897682 - RNA, 22 nt, Mycobacterium avium subsp. paratuberculosis
agccgaggucgcggcggccggc

SEQ ID NO: 897683 - RNA, 21 nt, Mycobacterium avium subsp. paratuberculosis
agccgaggucuuucaucgccc

SEQ ID NO: 897684 - RNA, 20 nt, Mycobacterium avium subsp. paratuberculosis
agccgcccagcaucgccgcg

SEQ ID NO: 897685 - RNA, 13 nt, Mycobacterium avium subsp. paratuberculosis
agccgaucgacga

SEQ ID NO: 897686 - RNA, 23 nt, Mycobacterium avium subsp. paratuberculosis
agccgaucgccuccgucagcgcc

SEQ ID NO: 897687 - RNA, 14 nt, Mycobacterium avium subsp. paratuberculosis
agccgaucgcggcg

SEQ ID NO: 897688 - RNA, 17 nt, Mycobacterium avium subsp. paratuberculosis
agccgaucaccggcgcg

SEQ ID NO: 897689 - RNA, 20 nt, Mycobacterium avium subsp. paratuberculosis
agccgaucaccggcgcguug

SEQ ID NO: 897690 - RNA, 16 nt, Mycobacterium avium subsp. paratuberculosis
agccgcgaacgccucg

SEQ ID NO: 897691 - RNA, 18 nt, Mycobacterium avium subsp. paratuberculosis
agccgcgaacgccucggc

SEQ ID NO: 897692 - RNA, 20 nt, Mycobacterium avium subsp. paratuberculosis
agccgcgaacgccucggcga

SEQ ID NO: 897693 - RNA, 15 nt, Mycobacterium avium subsp. paratuberculosis
agccgccgagccggc

SEQ ID NO: 897694 - RNA, 17 nt, Mycobacterium avium subsp. paratuberculosis
agccgccgagccggcac

SEQ ID NO: 897695 - RNA, 12 nt, Mycobacterium avium subsp. paratuberculosis
agccgccgagcg

SEQ ID NO: 897696 - RNA, 13 nt, Mycobacterium avium subsp. paratuberculosis
agccgccgccggc

SEQ ID NO: 897697 - RNA, 12 nt, Mycobacterium avium subsp. paratuberculosis
agccgccccgau

SEQ ID NO: 897698 - RNA, 16 nt, Mycobacterium avium subsp. paratuberculosis
agccgccgacgguggc

SEQ ID NO: 897699 - RNA, 17 nt, Mycobacterium avium subsp. paratuberculosis
agccgcccugcccgucg

SEQ ID NO: 897700 - RNA, 14 nt, Mycobacterium avium subsp. paratuberculosis
agccgcccggcgcc

SEQ ID NO: 897701 - RNA, 18 nt, Mycobacterium avium subsp. paratuberculosis
agccgcccggcgccccgc

SEQ ID NO: 897702 - RNA, 16 nt, Mycobacterium avium subsp. paratuberculosis
agcccggccccaccgc

SEQ ID NO: 897703 - RNA, 14 nt, Mycobacterium avium subsp. paratuberculosis
agcccuaccggcuc

SEQ ID NO: 897704 - RNA, 21 nt, Mycobacterium avium subsp. paratuberculosis
agcccguugucgagcaccgcg

SEQ ID NO: 897705 - RNA, 22 nt, Mycobacterium avium subsp. paratuberculosis
agcccguugucgagcaccgcga

SEQ ID NO: 897706 - RNA, 16 nt, Mycobacterium avium subsp. paratuberculosis
agcccuacccguccag

SEQ ID NO: 897707 - RNA, 24 nt, Mycobacterium avium subsp. paratuberculosis
agcccucgagccauaaaccggccg

SEQ ID NO: 897708 - RNA, 13 nt, Mycobacterium avium subsp. paratuberculosis
agcccugcaggua

SEQ ID NO: 897709 - RNA, 20 nt, Mycobacterium avium subsp. paratuberculosis
agcccugcagguagguggcc

SEQ ID NO: 897710 - RNA, 18 nt, Mycobacterium avium subsp. paratuberculosis
agcccugcgccagcagca

SEQ ID NO: 897711 - RNA, 12 nt, Mycobacterium avium subsp. paratuberculosis
agcccugcucgg

SEQ ID NO: 897712 - RNA, 13 nt, Mycobacterium avium subsp. paratuberculosis
agccgacagucgc

SEQ ID NO: 897713 - RNA, 15 nt, Mycobacterium avium subsp. paratuberculosis
agccgacaccggguc

SEQ ID NO: 897714 - RNA, 20 nt, Mycobacterium avium subsp. paratuberculosis
agccgaccaacgggcggcgg

SEQ ID NO: 897715 - RNA, 12 nt, Mycobacterium avium subsp. paratuberculosis
agccgaccagcg

SEQ ID NO: 897716 - RNA, 14 nt, Mycobacterium avium subsp. paratuberculosis
agcccuucgcggug

SEQ ID NO: 897717 - RNA, 13 nt, Mycobacterium avium subsp. paratuberculosis
agcccggccgccg

SEQ ID NO: 897718 - RNA, 14 nt, Mycobacterium avium subsp. paratuberculosis
agcccggccgccga

SEQ ID NO: 897719 - RNA, 20 nt, Mycobacterium avium subsp. paratuberculosis
agcccggccaguccggcagc

SEQ ID NO: 897720 - RNA, 17 nt, Mycobacterium avium subsp. paratuberculosis
agcccggccgccgagga

SEQ ID NO: 897721 - RNA, 14 nt, Mycobacterium avium subsp. paratuberculosis
agcccggccgcggc

SEQ ID NO: 897722 - RNA, 17 nt, Mycobacterium avium subsp. paratuberculosis
agcccggcccgcaucga

SEQ ID NO: 897723 - RNA, 14 nt, Mycobacterium avium subsp. paratuberculosis
agcccggcccgucg

SEQ ID NO: 897724 - RNA, 17 nt, Mycobacterium avium subsp. paratuberculosis
agcccggcccgucgagc

SEQ ID NO: 897725 - RNA, 22 nt, Mycobacterium avium subsp. paratuberculosis
agcccggccgaggucaccaccg

SEQ ID NO: 897726 - RNA, 13 nt, Mycobacterium avium subsp. paratuberculosis
agcccggccagca

SEQ ID NO: 897727 - RNA, 17 nt, Mycobacterium avium subsp. paratuberculosis
agcccggaaucgucggc

SEQ ID NO: 897728 - RNA, 17 nt, Mycobacterium avium subsp. paratuberculosis
agcccggaguagccggu

SEQ ID NO: 897729 - RNA, 16 nt, Mycobacterium avium subsp. paratuberculosis
agcccgcugaccaggc

SEQ ID NO: 897730 - RNA, 19 nt, Mycobacterium avium subsp. paratuberculosis
agcccgcugaccaggccga

SEQ ID NO: 897731 - RNA, 23 nt, Mycobacterium avium subsp. paratuberculosis
agcccggaaaaccccaccccgag

SEQ ID NO: 897732 - RNA, 16 nt, Mycobacterium avium subsp. paratuberculosis
agcccgcguccagcag

SEQ ID NO: 897733 - RNA, 19 nt, Mycobacterium avium subsp. paratuberculosis
agcccgccgggcugaccgu

SEQ ID NO: 897734 - RNA, 14 nt, Mycobacterium avium subsp. paratuberculosis
agcccgccgucggc

SEQ ID NO: 897735 - RNA, 19 nt, Mycobacterium avium subsp. paratuberculosis
agcccgcgcaauacccgac

SEQ ID NO: 897736 - RNA, 22 nt, Mycobacterium avium subsp. paratuberculosis
agcccgcgcaauacccgaccag

SEQ ID NO: 897737 - RNA, 14 nt, Mycobacterium avium subsp. paratuberculosis
agcccgccgcggcg

SEQ ID NO: 897738 - RNA, 15 nt, Mycobacterium avium subsp. paratuberculosis
agcccgccgcggcga

SEQ ID NO: 897739 - RNA, 16 nt, Mycobacterium avium subsp. paratuberculosis
agcccgccgcggcgac

SEQ ID NO: 897740 - RNA, 23 nt, Mycobacterium avium subsp. paratuberculosis
agcgcauccucauagccggccgc

SEQ ID NO: 897741 - RNA, 14 nt, Mycobacterium avium subsp. paratuberculosis
agcgcaucgccggc

SEQ ID NO: 897742 - RNA, 15 nt, Mycobacterium avium subsp. paratuberculosis
agcgcaucgccggcg

SEQ ID NO: 897743 - RNA, 18 nt, Mycobacterium avium subsp. paratuberculosis
agcgcaucgccggcgaug

SEQ ID NO: 897744 - RNA, 16 nt, Mycobacterium avium subsp. paratuberculosis
agcgcaucgccggcgc

SEQ ID NO: 897745 - RNA, 20 nt, Mycobacterium avium subsp. paratuberculosis
agcgcaucgccggcgcgcug

SEQ ID NO: 897746 - RNA, 17 nt, Mycobacterium avium subsp. paratuberculosis
agcgcauccgacaccgc

SEQ ID NO: 897747 - RNA, 20 nt, Mycobacterium avium subsp. paratuberculosis
agcgcauccgacaccgccuu

SEQ ID NO: 897748 - RNA, 17 nt, Mycobacterium avium subsp. paratuberculosis
agcgcauaggccgcgag

SEQ ID NO: 897749 - RNA, 14 nt, Mycobacterium avium subsp. paratuberculosis
agcgcagcgccucg

SEQ ID NO: 897750 - RNA, 17 nt, Mycobacterium avium subsp. paratuberculosis
agcgcagugcggacgcc

SEQ ID NO: 897751 - RNA, 16 nt, Mycobacterium avium subsp. paratuberculosis
agcgcagcaucuccga

SEQ ID NO: 897752 - RNA, 12 nt, Mycobacterium avium subsp. paratuberculosis
agcgcaggccgu

SEQ ID NO: 897753 - RNA, 15 nt, Mycobacterium avium subsp. paratuberculosis
agcgcacgucgccgc

SEQ ID NO: 897754 - RNA, 11 nt, Mycobacterium avium subsp. paratuberculosis
agcgcagcauc

SEQ ID NO: 897755 - RNA, 14 nt, Mycobacterium avium subsp. paratuberculosis
agcgcagcaucacg

SEQ ID NO: 897756 - RNA, 17 nt, Mycobacterium avium subsp. paratuberculosis
agcgcagcaucacgucg

SEQ ID NO: 897757 - RNA, 21 nt, Mycobacterium avium subsp. paratuberculosis
agcgcagcaucacgucggcga

SEQ ID NO: 897758 - RNA, 13 nt, Mycobacterium avium subsp. paratuberculosis
agcgcagcccggu

SEQ ID NO: 897759 - RNA, 16 nt, Mycobacterium avium subsp. paratuberculosis
agcgcagcaccaggcc

SEQ ID NO: 897760 - RNA, 17 nt, Mycobacterium avium subsp. paratuberculosis
agcgcagcaccaggccc

SEQ ID NO: 897761 - RNA, 14 nt, Mycobacterium avium subsp. paratuberculosis
agcgcaccgcggag

SEQ ID NO: 897762 - RNA, 20 nt, Mycobacterium avium subsp. paratuberculosis
agcgcacacagcagcagcac

SEQ ID NO: 897763 - RNA, 14 nt, Mycobacterium avium subsp. paratuberculosis
agcgaucggcggcu

SEQ ID NO: 897764 - RNA, 15 nt, Mycobacterium avium subsp. paratuberculosis
agcgaggucucccgg

SEQ ID NO: 897765 - RNA, 19 nt, Mycobacterium avium subsp. paratuberculosis
agcgaguccagccagccgc

SEQ ID NO: 897766 - RNA, 21 nt, Mycobacterium avium subsp. paratuberculosis
agcgagucgaaggcgcgggcg

SEQ ID NO: 897767 - RNA, 12 nt, Mycobacterium avium subsp. paratuberculosis
agcgagucgaug

SEQ ID NO: 897768 - RNA, 16 nt, Mycobacterium avium subsp. paratuberculosis
agcgagucgaugaccu

SEQ ID NO: 897769 - RNA, 17 nt, Mycobacterium avium subsp. paratuberculosis
agcgagugccggccagc

SEQ ID NO: 897770 - RNA, 19 nt, Mycobacterium avium subsp. paratuberculosis
agcgaguuggccaucguca

SEQ ID NO: 897771 - RNA, 18 nt, Mycobacterium avium subsp. paratuberculosis
agcgagugguaccgggug

SEQ ID NO: 897772 - RNA, 22 nt, Mycobacterium avium subsp. paratuberculosis
agcgauacccguugcgccccac

SEQ ID NO: 897773 - RNA, 18 nt, Mycobacterium avium subsp. paratuberculosis
agcgacagcgcgucggcc

SEQ ID NO: 897774 - RNA, 23 nt, Mycobacterium avium subsp. paratuberculosis
agcgacagcgcgucggccagcgc

SEQ ID NO: 897775 - RNA, 13 nt, Mycobacterium avium subsp. paratuberculosis
agcgacagcaccc

SEQ ID NO: 897776 - RNA, 16 nt, Mycobacterium avium subsp. paratuberculosis
agcgacagggugccga

SEQ ID NO: 897777 - RNA, 22 nt, Mycobacterium avium subsp. paratuberculosis
agcgacagggugccgaacagcg

SEQ ID NO: 897778 - RNA, 23 nt, Mycobacterium avium subsp. paratuberculosis
agcgagaucccgguucccggcac

SEQ ID NO: 897779 - RNA, 13 nt, Mycobacterium avium subsp. paratuberculosis
agcgagcccagcu

SEQ ID NO: 897780 - RNA, 17 nt, Mycobacterium avium subsp. paratuberculosis
agcgagcccagcugcgc

SEQ ID NO: 897781 - RNA, 13 nt, Mycobacterium avium subsp. paratuberculosis
agcgaccagcgcg

SEQ ID NO: 897782 - RNA, 15 nt, Mycobacterium avium subsp. paratuberculosis
agcgaccagcgcgcc

SEQ ID NO: 897783 - RNA, 20 nt, Mycobacterium avium subsp. paratuberculosis
agcgaggacgucgagcggcg

SEQ ID NO: 897784 - RNA, 18 nt, Mycobacterium avium subsp. paratuberculosis
agcgaggcgacgucgaac

SEQ ID NO: 897785 - RNA, 24 nt, Mycobacterium avium subsp. paratuberculosis
agcgaggcgccacaacuggucgug

SEQ ID NO: 897786 - RNA, 20 nt, Mycobacterium avium subsp. paratuberculosis
agcgaggcgcgcagguagcc

SEQ ID NO: 897787 - RNA, 15 nt, Mycobacterium avium subsp. paratuberculosis
agcgagccgucgacc

SEQ ID NO: 897788 - RNA, 22 nt, Mycobacterium avium subsp. paratuberculosis
agcgagcgggcacgccgccgcg

SEQ ID NO: 897789 - RNA, 17 nt, Mycobacterium avium subsp. paratuberculosis
agcgagcucaggccggc

SEQ ID NO: 897790 - RNA, 19 nt, Mycobacterium avium subsp. paratuberculosis
agcgagcucaggccggccu

SEQ ID NO: 897791 - RNA, 14 nt, Mycobacterium avium subsp. paratuberculosis
agcgagcugccggc

SEQ ID NO: 897792 - RNA, 16 nt, Mycobacterium avium subsp. paratuberculosis
agcgagcugccggcgg

SEQ ID NO: 897793 - RNA, 18 nt, Mycobacterium avium subsp. paratuberculosis
agcgagcugccggcggcc

SEQ ID NO: 897794 - RNA, 20 nt, Mycobacterium avium subsp. paratuberculosis
agcgagcugccggcggccgc

SEQ ID NO: 897795 - RNA, 14 nt, Mycobacterium avium subsp. paratuberculosis
agcgaauccgggug

SEQ ID NO: 897796 - RNA, 21 nt, Mycobacterium avium subsp. paratuberculosis
agcgaaucgaccggguuggcg

SEQ ID NO: 897797 - RNA, 21 nt, Mycobacterium avium subsp. paratuberculosis
agcgaauggcaauacgccucg

SEQ ID NO: 897798 - RNA, 17 nt, Mycobacterium avium subsp. paratuberculosis
agcgacaaaggaggggc

SEQ ID NO: 897799 - RNA, 21 nt, Mycobacterium avium subsp. paratuberculosis
agcgacaaaggaggggcgcgg

SEQ ID NO: 897800 - RNA, 16 nt, Mycobacterium avium subsp. paratuberculosis
agcgacaacagcacga

SEQ ID NO: 897801 - RNA, 14 nt, Mycobacterium avium subsp. paratuberculosis
agcgacaacggccc

SEQ ID NO: 897802 - RNA, 18 nt, Mycobacterium avium subsp. paratuberculosis
agcgacaacggcccccac

SEQ ID NO: 897803 - RNA, 16 nt, Mycobacterium avium subsp. paratuberculosis
agcgacaacgggccgc

SEQ ID NO: 897804 - RNA, 15 nt, Mycobacterium avium subsp. paratuberculosis
agccguugccgccgc

SEQ ID NO: 897805 - RNA, 18 nt, Mycobacterium avium subsp. paratuberculosis
agccuugcuggcggccuu

SEQ ID NO: 897806 - RNA, 16 nt, Mycobacterium avium subsp. paratuberculosis
agccuuggucgcggcc

SEQ ID NO: 897807 - RNA, 18 nt, Mycobacterium avium subsp. paratuberculosis
agccuuggucgcggccuu

SEQ ID NO: 897808 - RNA, 16 nt, Mycobacterium avium subsp. paratuberculosis
agccuacggcgccggu

SEQ ID NO: 897809 - RNA, 19 nt, Mycobacterium avium subsp. paratuberculosis
agccguuugaugccguccg

SEQ ID NO: 897810 - RNA, 18 nt, Mycobacterium avium subsp. paratuberculosis
agccguuuggcgccgccc

SEQ ID NO: 897811 - RNA, 19 nt, Mycobacterium avium subsp. paratuberculosis
agccguuuggcgccgccca

SEQ ID NO: 897812 - RNA, 20 nt, Mycobacterium avium subsp. paratuberculosis
agccuucuucgccgcagccu

SEQ ID NO: 897813 - RNA, 13 nt, Mycobacterium avium subsp. paratuberculosis
agccuucuugacc

SEQ ID NO: 897814 - RNA, 18 nt, Mycobacterium avium subsp. paratuberculosis
agccuucuugaccgcagc

SEQ ID NO: 897815 - RNA, 20 nt, Mycobacterium avium subsp. paratuberculosis
agccuucuugaccgcagccu

SEQ ID NO: 897816 - RNA, 15 nt, Mycobacterium avium subsp. paratuberculosis
agccguucccggcag

SEQ ID NO: 897817 - RNA, 15 nt, Mycobacterium avium subsp. paratuberculosis
agccguucgcgccga

SEQ ID NO: 897818 - RNA, 16 nt, Mycobacterium avium subsp. paratuberculosis
agccguucgcgccgag

SEQ ID NO: 897819 - RNA, 17 nt, Mycobacterium avium subsp. paratuberculosis
agccguucgcgccgaga

SEQ ID NO: 897820 - RNA, 14 nt, Mycobacterium avium subsp. paratuberculosis
agccguucgcugcc

SEQ ID NO: 897821 - RNA, 20 nt, Mycobacterium avium subsp. paratuberculosis
agccguucgcugcccucggu

SEQ ID NO: 897822 - RNA, 21 nt, Mycobacterium avium subsp. paratuberculosis
agccguucgcugcccucgguc

SEQ ID NO: 897823 - RNA, 16 nt, Mycobacterium avium subsp. paratuberculosis
agccguugacgguguu

SEQ ID NO: 897824 - RNA, 13 nt, Mycobacterium avium subsp. paratuberculosis
agccguugccgcc

SEQ ID NO: 897825 - RNA, 15 nt, Mycobacterium avium subsp. paratuberculosis
agccgugccccaggu

SEQ ID NO: 897826 - RNA, 13 nt, Mycobacterium avium subsp. paratuberculosis
agccgugcccgag

SEQ ID NO: 897827 - RNA, 14 nt, Mycobacterium avium subsp. paratuberculosis
agccgugcccgcgg

SEQ ID NO: 897828 - RNA, 12 nt, Mycobacterium avium subsp. paratuberculosis
agccgugcacgc

SEQ ID NO: 897829 - RNA, 13 nt, Mycobacterium avium subsp. paratuberculosis
agccgugcacgcc

SEQ ID NO: 897830 - RNA, 14 nt, Mycobacterium avium subsp. paratuberculosis
agccgugcacgccg

SEQ ID NO: 897831 - RNA, 17 nt, Mycobacterium avium subsp. paratuberculosis
agccgugcacgccgucg

SEQ ID NO: 897832 - RNA, 19 nt, Mycobacterium avium subsp. paratuberculosis
agccgugcacgccgucgug

SEQ ID NO: 897833 - RNA, 19 nt, Mycobacterium avium subsp. paratuberculosis
agccgugcagcgcccagcc

SEQ ID NO: 897834 - RNA, 21 nt, Mycobacterium avium subsp. paratuberculosis
agccgugcaucgggcgcucgg

SEQ ID NO: 897835 - RNA, 22 nt, Mycobacterium avium subsp. paratuberculosis
agccgugcaucgggcgcucggc

SEQ ID NO: 897836 - RNA, 21 nt, Mycobacterium avium subsp. paratuberculosis
agccgugcggcuugcccguuc

SEQ ID NO: 897837 - RNA, 12 nt, Mycobacterium avium subsp. paratuberculosis
agccgugcuggg

SEQ ID NO: 897838 - RNA, 15 nt, Mycobacterium avium subsp. paratuberculosis
agccgugggugccga

SEQ ID NO: 897839 - RNA, 19 nt, Mycobacterium avium subsp. paratuberculosis
agccgugggugccgacgag

SEQ ID NO: 897840 - RNA, 18 nt, Mycobacterium avium subsp. paratuberculosis
agccgugggugucggcga

SEQ ID NO: 897841 - RNA, 19 nt, Mycobacterium avium subsp. paratuberculosis
agccgugggugucggcgaa

SEQ ID NO: 897842 - RNA, 13 nt, Mycobacterium avium subsp. paratuberculosis
agccgugacccgc

SEQ ID NO: 897843 - RNA, 14 nt, Mycobacterium avium subsp. paratuberculosis
agccgugacccgcc

SEQ ID NO: 897844 - RNA, 22 nt, Mycobacterium avium subsp. paratuberculosis
agccgucgucguccgcaaccgc

SEQ ID NO: 897845 - RNA, 19 nt, Mycobacterium avium subsp. paratuberculosis
agccgucguugcgggcggc

SEQ ID NO: 897846 - RNA, 20 nt, Mycobacterium avium subsp. paratuberculosis
agccgucguugcgggcggcg

SEQ ID NO: 897847 - RNA, 21 nt, Mycobacterium avium subsp. paratuberculosis
agccgucguugcgggcggcgc

SEQ ID NO: 897848 - RNA, 18 nt, Mycobacterium avium subsp. paratuberculosis
agccgucucggagcggug

SEQ ID NO: 897849 - RNA, 14 nt, Mycobacterium avium subsp. paratuberculosis
agccgucgcaccgc

SEQ ID NO: 897850 - RNA, 18 nt, Mycobacterium avium subsp. paratuberculosis
agccgucgcaucagcucg

SEQ ID NO: 897851 - RNA, 22 nt, Mycobacterium avium subsp. paratuberculosis
agccgucgcaucagcucggcag

SEQ ID NO: 897852 - RNA, 12 nt, Mycobacterium avium subsp. paratuberculosis
agccgucggcgg

SEQ ID NO: 897853 - RNA, 23 nt, Mycobacterium avium subsp. paratuberculosis
agccgucggcggaggucauggcg

SEQ ID NO: 897854 - RNA, 16 nt, Mycobacterium avium subsp. paratuberculosis
agccgucggcggccuu

SEQ ID NO: 897855 - RNA, 17 nt, Mycobacterium avium subsp. paratuberculosis
agccgucggcggccuug

SEQ ID NO: 897856 - RNA, 22 nt, Mycobacterium avium subsp. paratuberculosis
agccgucggcuuccuccucggc

SEQ ID NO: 897857 - RNA, 16 nt, Mycobacterium avium subsp. paratuberculosis
agccgucguaggcgcg

SEQ ID NO: 897858 - RNA, 19 nt, Mycobacterium avium subsp. paratuberculosis
agccgucccuguucgcgcc

SEQ ID NO: 897859 - RNA, 18 nt, Mycobacterium avium subsp. paratuberculosis
agccgcgcgagcaucacc

SEQ ID NO: 897860 - RNA, 21 nt, Mycobacterium avium subsp. paratuberculosis
agccgcgcgagcaucaccguc

SEQ ID NO: 897861 - RNA, 19 nt, Mycobacterium avium subsp. paratuberculosis
agccgcgcccgauggaggu

SEQ ID NO: 897862 - RNA, 13 nt, Mycobacterium avium subsp. paratuberculosis
agccgcgccgacg

SEQ ID NO: 897863 - RNA, 13 nt, Mycobacterium avium subsp. paratuberculosis
agccgcgccgccg

SEQ ID NO: 897864 - RNA, 14 nt, Mycobacterium avium subsp. paratuberculosis
agccgcgccgccgc

SEQ ID NO: 897865 - RNA, 19 nt, Mycobacterium avium subsp. paratuberculosis
agccgucgccgcgcccgcc

SEQ ID NO: 897866 - RNA, 22 nt, Mycobacterium avium subsp. paratuberculosis
agccgucgccgcgcccgccggc

SEQ ID NO: 897867 - RNA, 12 nt, Mycobacterium avium subsp. paratuberculosis
agccgucgaucu

SEQ ID NO: 897868 - RNA, 23 nt, Mycobacterium avium subsp. paratuberculosis
agccgucgaagaugaccugaucg

SEQ ID NO: 897869 - RNA, 16 nt, Mycobacterium avium subsp. paratuberculosis
agccgucgaccccgcc

SEQ ID NO: 897870 - RNA, 18 nt, Mycobacterium avium subsp. paratuberculosis
agccgucgaccccgccgg

SEQ ID NO: 897871 - RNA, 19 nt, Mycobacterium avium subsp. paratuberculosis
agccgucgaccccgccggc

SEQ ID NO: 897872 - RNA, 21 nt, Mycobacterium avium subsp. paratuberculosis
agccgucgaccccgccggccc

SEQ ID NO: 897873 - RNA, 16 nt, Mycobacterium avium subsp. paratuberculosis
agccgucgaccggguc

SEQ ID NO: 897874 - RNA, 15 nt, Mycobacterium avium subsp. paratuberculosis
agccgccgccgacca

SEQ ID NO: 897875 - RNA, 12 nt, Mycobacterium avium subsp. paratuberculosis
agccgcgaucgg

SEQ ID NO: 897876 - RNA, 15 nt, Mycobacterium avium subsp. paratuberculosis
agccgcgacgguugu

SEQ ID NO: 897877 - RNA, 19 nt, Mycobacterium avium subsp. paratuberculosis
agccgcgcaccacgguggc

SEQ ID NO: 897878 - RNA, 20 nt, Mycobacterium avium subsp. paratuberculosis
agccgcgcaccacgguggcg

SEQ ID NO: 897879 - RNA, 20 nt, Mycobacterium avium subsp. paratuberculosis
agccgcgccaccgcggggcu

SEQ ID NO: 897880 - RNA, 12 nt, Mycobacterium avium subsp. paratuberculosis
agcgcgccgucg

SEQ ID NO: 897881 - RNA, 13 nt, Mycobacterium avium subsp. paratuberculosis
agcgcgccggggu

SEQ ID NO: 897882 - RNA, 13 nt, Mycobacterium avium subsp. paratuberculosis
agcgcgcgaccgc

SEQ ID NO: 897883 - RNA, 15 nt, Mycobacterium avium subsp. paratuberculosis
agcgcgcgaccgcga

SEQ ID NO: 897884 - RNA, 21 nt, Mycobacterium avium subsp. paratuberculosis
agcgcgcgaccgcgaugcgac

SEQ ID NO: 897885 - RNA, 20 nt, Mycobacterium avium subsp. paratuberculosis
agcgcgcgaucagcgccguc

SEQ ID NO: 897886 - RNA, 14 nt, Mycobacterium avium subsp. paratuberculosis
agcgcgcgaucgcc

SEQ ID NO: 897887 - RNA, 18 nt, Mycobacterium avium subsp. paratuberculosis
agcgcgcgaucgccggug

SEQ ID NO: 897888 - RNA, 21 nt, Mycobacterium avium subsp. paratuberculosis
agcgcgcacaauucggucagc

SEQ ID NO: 897889 - RNA, 14 nt, Mycobacterium avium subsp. paratuberculosis
agcgcgcacagcgc

SEQ ID NO: 897890 - RNA, 16 nt, Mycobacterium avium subsp. paratuberculosis
agcgcgcacagcgcca

SEQ ID NO: 897891 - RNA, 19 nt, Mycobacterium avium subsp. paratuberculosis
agcgcgcagaacaccaccg

SEQ ID NO: 897892 - RNA, 14 nt, Mycobacterium avium subsp. paratuberculosis
agcgcgccggcccg

SEQ ID NO: 897893 - RNA, 15 nt, Mycobacterium avium subsp. paratuberculosis
agcgcgccggcccga

SEQ ID NO: 897894 - RNA, 13 nt, Mycobacterium avium subsp. paratuberculosis
agcgcgccggccg

SEQ ID NO: 897895 - RNA, 14 nt, Mycobacterium avium subsp. paratuberculosis
agcgcgccggccgg

SEQ ID NO: 897896 - RNA, 14 nt, Mycobacterium avium subsp. paratuberculosis
agcgcgaugccggc

SEQ ID NO: 897897 - RNA, 17 nt, Mycobacterium avium subsp. paratuberculosis
agcgcgaugccggccag

SEQ ID NO: 897898 - RNA, 22 nt, Mycobacterium avium subsp. paratuberculosis
agcgcgauccggggggcggggu

SEQ ID NO: 897899 - RNA, 21 nt, Mycobacterium avium subsp. paratuberculosis
agcgcgaggcgcaguagccga

SEQ ID NO: 897900 - RNA, 14 nt, Mycobacterium avium subsp. paratuberculosis
agcgcgaggucgac

SEQ ID NO: 897901 - RNA, 18 nt, Mycobacterium avium subsp. paratuberculosis
agcgcggcggucgcgcgc

SEQ ID NO: 897902 - RNA, 19 nt, Mycobacterium avium subsp. paratuberculosis
agcgcggcggucgcgcgcc

SEQ ID NO: 897903 - RNA, 21 nt, Mycobacterium avium subsp. paratuberculosis
agcgcgguggucagcaccggc

SEQ ID NO: 897904 - RNA, 21 nt, Mycobacterium avium subsp. paratuberculosis
agcgcgguggucagcggcgcc

SEQ ID NO: 897905 - RNA, 15 nt, Mycobacterium avium subsp. paratuberculosis
agcgcggcgggccag

SEQ ID NO: 897906 - RNA, 14 nt, Mycobacterium avium subsp. paratuberculosis
agcgcggcggccag

SEQ ID NO: 897907 - RNA, 17 nt, Mycobacterium avium subsp. paratuberculosis
agcgcggcggccagcuc

SEQ ID NO: 897908 - RNA, 15 nt, Mycobacterium avium subsp. paratuberculosis
agcgcggcggcgccg

SEQ ID NO: 897909 - RNA, 22 nt, Mycobacterium avium subsp. paratuberculosis
agcgcggcggcgccgucgccga

SEQ ID NO: 897910 - RNA, 12 nt, Mycobacterium avium subsp. paratuberculosis
agcgcggcgaug

SEQ ID NO: 897911 - RNA, 22 nt, Mycobacterium avium subsp. paratuberculosis
agcgcggcgacauuggccgcgc

SEQ ID NO: 897912 - RNA, 19 nt, Mycobacterium avium subsp. paratuberculosis
agcgcggcccgcggcguca

SEQ ID NO: 897913 - RNA, 21 nt, Mycobacterium avium subsp. paratuberculosis
agcgcggccgggcgccccgac

SEQ ID NO: 897914 - RNA, 17 nt, Mycobacterium avium subsp. paratuberculosis
agcgcggccgcccgucg

SEQ ID NO: 897915 - RNA, 13 nt, Mycobacterium avium subsp. paratuberculosis
agcgcggccgggc

SEQ ID NO: 897916 - RNA, 13 nt, Mycobacterium avium subsp. paratuberculosis
agcgcgcggccca

SEQ ID NO: 897917 - RNA, 21 nt, Mycobacterium avium subsp. paratuberculosis
agcgcgcggcccagcgucaac

SEQ ID NO: 897918 - RNA, 12 nt, Mycobacterium avium subsp. paratuberculosis
agcgcgcgggcg

SEQ ID NO: 897919 - RNA, 18 nt, Mycobacterium avium subsp. paratuberculosis
agcgcgucgaggucgcgc

SEQ ID NO: 897920 - RNA, 21 nt, Mycobacterium avium subsp. paratuberculosis
agcgcgucgaggucgcgcagc

SEQ ID NO: 897921 - RNA, 14 nt, Mycobacterium avium subsp. paratuberculosis
agcgcguccaggug

SEQ ID NO: 897922 - RNA, 20 nt, Mycobacterium avium subsp. paratuberculosis
agcgcguccaggugcgccgc

SEQ ID NO: 897923 - RNA, 16 nt, Mycobacterium avium subsp. paratuberculosis
agcgcguccaaccgcg

SEQ ID NO: 897924 - RNA, 20 nt, Mycobacterium avium subsp. paratuberculosis
agcgcgguguacagcgcgcc

SEQ ID NO: 897925 - RNA, 22 nt, Mycobacterium avium subsp. paratuberculosis
agcgcgguguacagcgcgccgc

SEQ ID NO: 897926 - RNA, 19 nt, Mycobacterium avium subsp. paratuberculosis
agcgcggugugcggcggcu

SEQ ID NO: 897927 - RNA, 16 nt, Mycobacterium avium subsp. paratuberculosis
agcgcguaggugcggu

SEQ ID NO: 897928 - RNA, 18 nt, Mycobacterium avium subsp. paratuberculosis
agcgcguagucggcgucg

SEQ ID NO: 897929 - RNA, 23 nt, Mycobacterium avium subsp. paratuberculosis
agcgcguagucggcgucggccac

SEQ ID NO: 897930 - RNA, 20 nt, Mycobacterium avium subsp. paratuberculosis
agcgcguugcggccguccag

SEQ ID NO: 897931 - RNA, 14 nt, Mycobacterium avium subsp. paratuberculosis
agcgcgucgaccag

SEQ ID NO: 897932 - RNA, 18 nt, Mycobacterium avium subsp. paratuberculosis
agcgcgucgaccagccgc

SEQ ID NO: 897933 - RNA, 12 nt, Mycobacterium avium subsp. paratuberculosis
agcgcgucgacg

SEQ ID NO: 897934 - RNA, 24 nt, Mycobacterium avium subsp. paratuberculosis
agcgcgucgcgcccggcgucggug

SEQ ID NO: 897935 - RNA, 20 nt, Mycobacterium avium subsp. paratuberculosis
agcgcgucgcacagcgccgc

SEQ ID NO: 897936 - RNA, 21 nt, Mycobacterium avium subsp. paratuberculosis
agcgcgucgcacagcgccgcg

SEQ ID NO: 897937 - RNA, 22 nt, Mycobacterium avium subsp. paratuberculosis
agcgcgucgcacagcgccgcgu

SEQ ID NO: 897938 - RNA, 19 nt, Mycobacterium avium subsp. paratuberculosis
agcgcuaacaaaagcccga

SEQ ID NO: 897939 - RNA, 23 nt, Mycobacterium avium subsp. paratuberculosis
agcgcuaacaaaagcccgagauc

SEQ ID NO: 897940 - RNA, 22 nt, Mycobacterium avium subsp. paratuberculosis
agcgcuaaccgcgggcaucgcc

SEQ ID NO: 897941 - RNA, 21 nt, Mycobacterium avium subsp. paratuberculosis
agcgcuaccgcgcucaccguc

SEQ ID NO: 897942 - RNA, 15 nt, Mycobacterium avium subsp. paratuberculosis
agcgcuugucgcaga

SEQ ID NO: 897943 - RNA, 14 nt, Mycobacterium avium subsp. paratuberculosis
agcgcuuucgccga

SEQ ID NO: 897944 - RNA, 15 nt, Mycobacterium avium subsp. paratuberculosis
agcgcuuucgccgaa

SEQ ID NO: 897945 - RNA, 19 nt, Mycobacterium avium subsp. paratuberculosis
agcgcuuucgcuggucgcg

SEQ ID NO: 897946 - RNA, 20 nt, Mycobacterium avium subsp. paratuberculosis
agcgcuuucgcuggucgcga

SEQ ID NO: 897947 - RNA, 16 nt, Mycobacterium avium subsp. paratuberculosis
agcggaaacgacgucg

SEQ ID NO: 897948 - RNA, 20 nt, Mycobacterium avium subsp. paratuberculosis
agcggaaacgacgucgccac

SEQ ID NO: 897949 - RNA, 17 nt, Mycobacterium avium subsp. paratuberculosis
agcgcuuggcggagagc

SEQ ID NO: 897950 - RNA, 23 nt, Mycobacterium avium subsp. paratuberculosis
agcgcugaaccgguagucgucga

SEQ ID NO: 897951 - RNA, 19 nt, Mycobacterium avium subsp. paratuberculosis
agcgcucgucguagucgag

SEQ ID NO: 897952 - RNA, 23 nt, Mycobacterium avium subsp. paratuberculosis
agcgcucgucgucggagacguug

SEQ ID NO: 897953 - RNA, 14 nt, Mycobacterium avium subsp. paratuberculosis
agcgcucggucagg

SEQ ID NO: 897954 - RNA, 20 nt, Mycobacterium avium subsp. paratuberculosis
agcgcucggucaggcccagg

SEQ ID NO: 897955 - RNA, 15 nt, Mycobacterium avium subsp. paratuberculosis
agcgcuccaccaccg

SEQ ID NO: 897956 - RNA, 18 nt, Mycobacterium avium subsp. paratuberculosis
agcgcuccugcagcgcgg

SEQ ID NO: 897957 - RNA, 23 nt, Mycobacterium avium subsp. paratuberculosis
agcgcuccugcagcgcggcgauc

SEQ ID NO: 897958 - RNA, 20 nt, Mycobacterium avium subsp. paratuberculosis
agcgccucggccucgucgac

SEQ ID NO: 897959 - RNA, 22 nt, Mycobacterium avium subsp. paratuberculosis
agcgccucggccucgucgacgu

SEQ ID NO: 897960 - RNA, 21 nt, Mycobacterium avium subsp. paratuberculosis
agcgccucggcgaucggccgc

SEQ ID NO: 897961 - RNA, 17 nt, Mycobacterium avium subsp. paratuberculosis
agcgccucgcggucgac

SEQ ID NO: 897962 - RNA, 22 nt, Mycobacterium avium subsp. paratuberculosis
agcgccucgcuaaucgccgcgc

SEQ ID NO: 897963 - RNA, 18 nt, Mycobacterium avium subsp. paratuberculosis
agcgccucggcgggccgc

SEQ ID NO: 897964 - RNA, 17 nt, Mycobacterium avium subsp. paratuberculosis
agcgccucggcgucacc

SEQ ID NO: 897965 - RNA, 18 nt, Mycobacterium avium subsp. paratuberculosis
agcgcgacgggcacccgc

SEQ ID NO: 897966 - RNA, 13 nt, Mycobacterium avium subsp. paratuberculosis
agcgcgacgggcu

SEQ ID NO: 897967 - RNA, 22 nt, Mycobacterium avium subsp. paratuberculosis
agcgcgacgggcugcugcacgu

SEQ ID NO: 897968 - RNA, 15 nt, Mycobacterium avium subsp. paratuberculosis
agcgcgacgcacgcc

SEQ ID NO: 897969 - RNA, 14 nt, Mycobacterium avium subsp. paratuberculosis
agcgcgacgucgac

SEQ ID NO: 897970 - RNA, 16 nt, Mycobacterium avium subsp. paratuberculosis
agcgcgacgugccggc

SEQ ID NO: 897971 - RNA, 18 nt, Mycobacterium avium subsp. paratuberculosis
agcgcgacgugccggcga

SEQ ID NO: 897972 - RNA, 20 nt, Mycobacterium avium subsp. paratuberculosis
agcgcgacgugccggcgaug

SEQ ID NO: 897973 - RNA, 19 nt, Mycobacterium avium subsp. paratuberculosis
agcgcgacgccgacgccca

SEQ ID NO: 897974 - RNA, 16 nt, Mycobacterium avium subsp. paratuberculosis
agcgcgacgcgcaugc

SEQ ID NO: 897975 - RNA, 21 nt, Mycobacterium avium subsp. paratuberculosis
agcgccucgagcaacggccgc

SEQ ID NO: 897976 - RNA, 23 nt, Mycobacterium avium subsp. paratuberculosis
agcgccucgagcaacggccgcag

SEQ ID NO: 897977 - RNA, 20 nt, Mycobacterium avium subsp. paratuberculosis
agcgccucgagcaccacggc

SEQ ID NO: 897978 - RNA, 22 nt, Mycobacterium avium subsp. paratuberculosis
agcgccucgagcaccacggccc

SEQ ID NO: 897979 - RNA, 22 nt, Mycobacterium avium subsp. paratuberculosis
agcgccggacucgaagaucgcc

SEQ ID NO: 897980 - RNA, 22 nt, Mycobacterium avium subsp. paratuberculosis
agcgccggcaccagcagccgca

SEQ ID NO: 897981 - RNA, 20 nt, Mycobacterium avium subsp. paratuberculosis
agcgccggcagcaaccggcg

SEQ ID NO: 897982 - RNA, 23 nt, Mycobacterium avium subsp. paratuberculosis
agcgccggcagcaaccggcggcu

SEQ ID NO: 897983 - RNA, 15 nt, Mycobacterium avium subsp. paratuberculosis
agcgccgcuucgucg

SEQ ID NO: 897984 - RNA, 19 nt, Mycobacterium avium subsp. paratuberculosis
agcgccgcuucgucgccgg

SEQ ID NO: 897985 - RNA, 20 nt, Mycobacterium avium subsp. paratuberculosis
agcgccgcuucgucgccggc

SEQ ID NO: 897986 - RNA, 22 nt, Mycobacterium avium subsp. paratuberculosis
agcgccgcggcgaaaacgccug

SEQ ID NO: 897987 - RNA, 24 nt, Mycobacterium avium subsp. paratuberculosis
agcgccgcggcgaaaacgccugcg

SEQ ID NO: 897988 - RNA, 13 nt, Mycobacterium avium subsp. paratuberculosis
agcgccgcggcgc

SEQ ID NO: 897989 - RNA, 14 nt, Mycobacterium avium subsp. paratuberculosis
agcgccgcggcgcc

SEQ ID NO: 897990 - RNA, 17 nt, Mycobacterium avium subsp. paratuberculosis
agcgccgcggccaccgg

SEQ ID NO: 897991 - RNA, 19 nt, Mycobacterium avium subsp. paratuberculosis
agcgccgcggccagccggu

SEQ ID NO: 897992 - RNA, 13 nt, Mycobacterium avium subsp. paratuberculosis
agcgcccggccgu

SEQ ID NO: 897993 - RNA, 21 nt, Mycobacterium avium subsp. paratuberculosis
agcgcccgggcguucccgcgc

SEQ ID NO: 897994 - RNA, 22 nt, Mycobacterium avium subsp. paratuberculosis
agcgcccgggcguucccgcgcg

SEQ ID NO: 897995 - RNA, 19 nt, Mycobacterium avium subsp. paratuberculosis
agcgccgcgcgcgcggccu

SEQ ID NO: 897996 - RNA, 22 nt, Mycobacterium avium subsp. paratuberculosis
agcgcaugccgaacaacagggc

SEQ ID NO: 897997 - RNA, 20 nt, Mycobacterium avium subsp. paratuberculosis
agcgcaugaugcccaggccc

SEQ ID NO: 897998 - RNA, 22 nt, Mycobacterium avium subsp. paratuberculosis
agcgcaugaugcccaggcccac

SEQ ID NO: 897999 - RNA, 21 nt, Mycobacterium avium subsp. paratuberculosis
agcgccacgcucaugcccgcc

SEQ ID NO: 898000 - RNA, 16 nt, Mycobacterium avium subsp. paratuberculosis
agcgccacggggcgcc

SEQ ID NO: 898001 - RNA, 17 nt, Mycobacterium avium subsp. paratuberculosis
agcgccacggggcgccg

SEQ ID NO: 898002 - RNA, 21 nt, Mycobacterium avium subsp. paratuberculosis
agcgccacggggcgccgcugc

SEQ ID NO: 898003 - RNA, 21 nt, Mycobacterium avium subsp. paratuberculosis
agcgccacgguggcggucagg

SEQ ID NO: 898004 - RNA, 14 nt, Mycobacterium avium subsp. paratuberculosis
agcgccacaucagc

SEQ ID NO: 898005 - RNA, 16 nt, Mycobacterium avium subsp. paratuberculosis
agcgccacaucagcuc

SEQ ID NO: 898006 - RNA, 15 nt, Mycobacterium avium subsp. paratuberculosis
agcgccaccagcacc

SEQ ID NO: 898007 - RNA, 16 nt, Mycobacterium avium subsp. paratuberculosis
agcgccaccagcaccg

SEQ ID NO: 898008 - RNA, 19 nt, Mycobacterium avium subsp. paratuberculosis
agcgccaccagcaccggga

SEQ ID NO: 898009 - RNA, 13 nt, Mycobacterium avium subsp. paratuberculosis
agcgccacccccc

SEQ ID NO: 898010 - RNA, 13 nt, Mycobacterium avium subsp. paratuberculosis
agcgccaccccga

SEQ ID NO: 898011 - RNA, 20 nt, Mycobacterium avium subsp. paratuberculosis
agcgccaccccgaacccggc

SEQ ID NO: 898012 - RNA, 14 nt, Mycobacterium avium subsp. paratuberculosis
agcgcccgcgcgcu

SEQ ID NO: 898013 - RNA, 16 nt, Mycobacterium avium subsp. paratuberculosis
agcgcccgcgcguggg

SEQ ID NO: 898014 - RNA, 21 nt, Mycobacterium avium subsp. paratuberculosis
agcgcccgcgggugcagccgg

SEQ ID NO: 898015 - RNA, 23 nt, Mycobacterium avium subsp. paratuberculosis
agcgcccgcuugauggcggcgcg

SEQ ID NO: 898016 - RNA, 16 nt, Mycobacterium avium subsp. paratuberculosis
agcgcccggcagcggu

SEQ ID NO: 898017 - RNA, 19 nt, Mycobacterium avium subsp. paratuberculosis
agcgcccggccagccggcc

SEQ ID NO: 898018 - RNA, 14 nt, Mycobacterium avium subsp. paratuberculosis
agcgcccgauuccc

SEQ ID NO: 898019 - RNA, 18 nt, Mycobacterium avium subsp. paratuberculosis
agcgcccgauuccccggc

SEQ ID NO: 898020 - RNA, 19 nt, Mycobacterium avium subsp. paratuberculosis
agcgcccgauuccccggcg

SEQ ID NO: 898021 - RNA, 20 nt, Mycobacterium avium subsp. paratuberculosis
agcgcccgauuccccggcgu

SEQ ID NO: 898022 - RNA, 19 nt, Mycobacterium avium subsp. paratuberculosis
agcgcccgauucgcggcca

SEQ ID NO: 898023 - RNA, 21 nt, Mycobacterium avium subsp. paratuberculosis
agcgcccgcccggcccggcgc

SEQ ID NO: 898024 - RNA, 18 nt, Mycobacterium avium subsp. paratuberculosis
agcgccccgguccggcug

SEQ ID NO: 898025 - RNA, 19 nt, Mycobacterium avium subsp. paratuberculosis
agcgcccagccgagccggg

SEQ ID NO: 898026 - RNA, 12 nt, Mycobacterium avium subsp. paratuberculosis
agcgcccaggcg

SEQ ID NO: 898027 - RNA, 20 nt, Mycobacterium avium subsp. paratuberculosis
agcgcccaggcgugcgcgug

SEQ ID NO: 898028 - RNA, 21 nt, Mycobacterium avium subsp. paratuberculosis
agcgccccagggccucggcga

SEQ ID NO: 898029 - RNA, 22 nt, Mycobacterium avium subsp. paratuberculosis
agcgccccagggccucggcgac

SEQ ID NO: 898030 - RNA, 15 nt, Mycobacterium avium subsp. paratuberculosis
agcgccagcguggcc

SEQ ID NO: 898031 - RNA, 17 nt, Mycobacterium avium subsp. paratuberculosis
agcgccagcguggccag

SEQ ID NO: 898032 - RNA, 18 nt, Mycobacterium avium subsp. paratuberculosis
agcgccagcguggccagc

SEQ ID NO: 898033 - RNA, 18 nt, Mycobacterium avium subsp. paratuberculosis
agcgccagcggcuugccg

SEQ ID NO: 898034 - RNA, 22 nt, Mycobacterium avium subsp. paratuberculosis
agcgccagcggcuugccguugu

SEQ ID NO: 898035 - RNA, 18 nt, Mycobacterium avium subsp. paratuberculosis
agcgccagcgccagcgug

SEQ ID NO: 898036 - RNA, 12 nt, Mycobacterium avium subsp. paratuberculosis
agcgccagcgcg

SEQ ID NO: 898037 - RNA, 14 nt, Mycobacterium avium subsp. paratuberculosis
agcgccagcgcgcc

SEQ ID NO: 898038 - RNA, 17 nt, Mycobacterium avium subsp. paratuberculosis
agcgccagcgcgcccgc

SEQ ID NO: 898039 - RNA, 15 nt, Mycobacterium avium subsp. paratuberculosis
agcgccagcgcggug

SEQ ID NO: 898040 - RNA, 17 nt, Mycobacterium avium subsp. paratuberculosis
agcgccagcgcggugcc

SEQ ID NO: 898041 - RNA, 23 nt, Mycobacterium avium subsp. paratuberculosis
agcgccagcaccgggcccagcuc

SEQ ID NO: 898042 - RNA, 17 nt, Mycobacterium avium subsp. paratuberculosis
agcgccagcacggccac

SEQ ID NO: 898043 - RNA, 16 nt, Mycobacterium avium subsp. paratuberculosis
agcgccagcagcggca

SEQ ID NO: 898044 - RNA, 18 nt, Mycobacterium avium subsp. paratuberculosis
agcgccagcagcggcacc

SEQ ID NO: 898045 - RNA, 14 nt, Mycobacterium avium subsp. paratuberculosis
agcgccagcaccgc

SEQ ID NO: 898046 - RNA, 17 nt, Mycobacterium avium subsp. paratuberculosis
agcguucacgucgauca

SEQ ID NO: 898047 - RNA, 20 nt, Mycobacterium avium subsp. paratuberculosis
agcguguugagcucgcggcg

SEQ ID NO: 898048 - RNA, 22 nt, Mycobacterium avium subsp. paratuberculosis
agcguguugagcucgcggcgca

SEQ ID NO: 898049 - RNA, 14 nt, Mycobacterium avium subsp. paratuberculosis
agcguuccggcggc

SEQ ID NO: 898050 - RNA, 18 nt, Mycobacterium avium subsp. paratuberculosis
agcguuccggcggccggc

SEQ ID NO: 898051 - RNA, 20 nt, Mycobacterium avium subsp. paratuberculosis
agcguuccagcacccggccc

SEQ ID NO: 898052 - RNA, 19 nt, Mycobacterium avium subsp. paratuberculosis
agcgugggcaccggcaccg

SEQ ID NO: 898053 - RNA, 21 nt, Mycobacterium avium subsp. paratuberculosis
agcgugggcaccggcaccgcc

SEQ ID NO: 898054 - RNA, 22 nt, Mycobacterium avium subsp. paratuberculosis
agcgugggcaccggcaccgccc

SEQ ID NO: 898055 - RNA, 22 nt, Mycobacterium avium subsp. paratuberculosis
agcguggguucgaaucccaucg

SEQ ID NO: 898056 - RNA, 18 nt, Mycobacterium avium subsp. paratuberculosis
agcguggcgaacgcgacc

SEQ ID NO: 898057 - RNA, 15 nt, Mycobacterium avium subsp. paratuberculosis
agcgugugcguggug

SEQ ID NO: 898058 - RNA, 17 nt, Mycobacterium avium subsp. paratuberculosis
agcguggcgcgccccgg

SEQ ID NO: 898059 - RNA, 23 nt, Mycobacterium avium subsp. paratuberculosis
agcgugucgcgcaaugccaucgu

SEQ ID NO: 898060 - RNA, 15 nt, Mycobacterium avium subsp. paratuberculosis
agcgugucggcgauc

SEQ ID NO: 898061 - RNA, 20 nt, Mycobacterium avium subsp. paratuberculosis
agcguggucuccuggccgcc

SEQ ID NO: 898062 - RNA, 23 nt, Mycobacterium avium subsp. paratuberculosis
agcguggucuccuggccgccgug

SEQ ID NO: 898063 - RNA, 14 nt, Mycobacterium avium subsp. paratuberculosis
agcgugcacacccg

SEQ ID NO: 898064 - RNA, 20 nt, Mycobacterium avium subsp. paratuberculosis
agcgugcacacccgcagcga

SEQ ID NO: 898065 - RNA, 20 nt, Mycobacterium avium subsp. paratuberculosis
agcgugacagucgaccucgc

SEQ ID NO: 898066 - RNA, 21 nt, Mycobacterium avium subsp. paratuberculosis
agcgugaacuuaacuucacgc

SEQ ID NO: 898067 - RNA, 15 nt, Mycobacterium avium subsp. paratuberculosis
agcgugacgucgacg

SEQ ID NO: 898068 - RNA, 14 nt, Mycobacterium avium subsp. paratuberculosis
agcgugacgccggg

SEQ ID NO: 898069 - RNA, 21 nt, Mycobacterium avium subsp. paratuberculosis
agcgugacgccgggccgccgc

SEQ ID NO: 898070 - RNA, 20 nt, Mycobacterium avium subsp. paratuberculosis
agcgugacgcucgcguggcc

SEQ ID NO: 898071 - RNA, 12 nt, Mycobacterium avium subsp. paratuberculosis
agcgugccgccg

SEQ ID NO: 898072 - RNA, 13 nt, Mycobacterium avium subsp. paratuberculosis
agcgugccgucca

SEQ ID NO: 898073 - RNA, 14 nt, Mycobacterium avium subsp. paratuberculosis
agcgugcccgcgcc

SEQ ID NO: 898074 - RNA, 17 nt, Mycobacterium avium subsp. paratuberculosis
agcgugcccgcgcccac

SEQ ID NO: 898075 - RNA, 18 nt, Mycobacterium avium subsp. paratuberculosis
agcgugcugacgucgucg

SEQ ID NO: 898076 - RNA, 16 nt, Mycobacterium avium subsp. paratuberculosis
agcgugcucaugucgg

SEQ ID NO: 898077 - RNA, 22 nt, Mycobacterium avium subsp. paratuberculosis
agcguggcagcggucggcggcu

SEQ ID NO: 898078 - RNA, 16 nt, Mycobacterium avium subsp. paratuberculosis
agcguggacaccgcac

SEQ ID NO: 898079 - RNA, 18 nt, Mycobacterium avium subsp. paratuberculosis
agcgucgccagccgccgg

SEQ ID NO: 898080 - RNA, 17 nt, Mycobacterium avium subsp. paratuberculosis
agcgucgccgccccgag

SEQ ID NO: 898081 - RNA, 20 nt, Mycobacterium avium subsp. paratuberculosis
agcgucgaguuguugggccg

SEQ ID NO: 898082 - RNA, 18 nt, Mycobacterium avium subsp. paratuberculosis
agcgucgaugugggccgc

SEQ ID NO: 898083 - RNA, 21 nt, Mycobacterium avium subsp. paratuberculosis
agcgucgaugugggccgcagc

SEQ ID NO: 898084 - RNA, 22 nt, Mycobacterium avium subsp. paratuberculosis
agcgucgaugugggccgcagca

SEQ ID NO: 898085 - RNA, 19 nt, Mycobacterium avium subsp. paratuberculosis
agcguccggagaaccgcuc

SEQ ID NO: 898086 - RNA, 20 nt, Mycobacterium avium subsp. paratuberculosis
agcgugaaguuaacuucacg

SEQ ID NO: 898087 - RNA, 20 nt, Mycobacterium avium subsp. paratuberculosis
agcgugaaguuaguuucacg

SEQ ID NO: 898088 - RNA, 21 nt, Mycobacterium avium subsp. paratuberculosis
agcgugaaguuaguuucacgc

SEQ ID NO: 898089 - RNA, 18 nt, Mycobacterium avium subsp. paratuberculosis
agcgucggcgugcccgcc

SEQ ID NO: 898090 - RNA, 19 nt, Mycobacterium avium subsp. paratuberculosis
agcgucggcgugcccgccg

SEQ ID NO: 898091 - RNA, 19 nt, Mycobacterium avium subsp. paratuberculosis
agcgucuuggacgcccggu

SEQ ID NO: 898092 - RNA, 16 nt, Mycobacterium avium subsp. paratuberculosis
agcgucuuguuggcga

SEQ ID NO: 898093 - RNA, 20 nt, Mycobacterium avium subsp. paratuberculosis
agcgugaaacuagcuucacg

SEQ ID NO: 898094 - RNA, 21 nt, Mycobacterium avium subsp. paratuberculosis
agcgugaaacuagcuucacgc

SEQ ID NO: 898095 - RNA, 20 nt, Mycobacterium avium subsp. paratuberculosis
agcgugaaacuaguuucacg

SEQ ID NO: 898096 - RNA, 14 nt, Mycobacterium avium subsp. paratuberculosis
agcgugaacaccgc

SEQ ID NO: 898097 - RNA, 16 nt, Mycobacterium avium subsp. paratuberculosis
agcgugaacaccgcgu

SEQ ID NO: 898098 - RNA, 21 nt, Mycobacterium avium subsp. paratuberculosis
agcgugaacaccgcguuggcc

SEQ ID NO: 898099 - RNA, 23 nt, Mycobacterium avium subsp. paratuberculosis
agcgugaacagcgcccggccgug

SEQ ID NO: 898100 - RNA, 16 nt, Mycobacterium avium subsp. paratuberculosis
agcgucgcggccggga

SEQ ID NO: 898101 - RNA, 13 nt, Mycobacterium avium subsp. paratuberculosis
agcgucgcgauca

SEQ ID NO: 898102 - RNA, 12 nt, Mycobacterium avium subsp. paratuberculosis
agcgucgcggcc

SEQ ID NO: 898103 - RNA, 17 nt, Mycobacterium avium subsp. paratuberculosis
agcggugaaacgccugc

SEQ ID NO: 898104 - RNA, 21 nt, Mycobacterium avium subsp. paratuberculosis
agcggugacaucgccaccugg

SEQ ID NO: 898105 - RNA, 23 nt, Mycobacterium avium subsp. paratuberculosis
agcggugaucgcgucaaccaccg

SEQ ID NO: 898106 - RNA, 16 nt, Mycobacterium avium subsp. paratuberculosis
agcggugcaccaccgu

SEQ ID NO: 898107 - RNA, 17 nt, Mycobacterium avium subsp. paratuberculosis
agcggugcaccaccgug

SEQ ID NO: 898108 - RNA, 19 nt, Mycobacterium avium subsp. paratuberculosis
agcggucgcggaaccggcc

SEQ ID NO: 898109 - RNA, 20 nt, Mycobacterium avium subsp. paratuberculosis
agcggucgcggaaccggccg

SEQ ID NO: 898110 - RNA, 23 nt, Mycobacterium avium subsp. paratuberculosis
agcggucgcggaaccggccgggg

SEQ ID NO: 898111 - RNA, 14 nt, Mycobacterium avium subsp. paratuberculosis
agcgguggccacgc

SEQ ID NO: 898112 - RNA, 21 nt, Mycobacterium avium subsp. paratuberculosis
agcgguccucgaaccgcuugc

SEQ ID NO: 898113 - RNA, 14 nt, Mycobacterium avium subsp. paratuberculosis
agcggucgccccag

SEQ ID NO: 898114 - RNA, 22 nt, Mycobacterium avium subsp. paratuberculosis
agcggucgccccagaacugguc

SEQ ID NO: 898115 - RNA, 21 nt, Mycobacterium avium subsp. paratuberculosis
agcggguucuucagggcggug

SEQ ID NO: 898116 - RNA, 18 nt, Mycobacterium avium subsp. paratuberculosis
agcgggugauggccgccg

SEQ ID NO: 898117 - RNA, 22 nt, Mycobacterium avium subsp. paratuberculosis
agcgggugaaucgacaccgcac

SEQ ID NO: 898118 - RNA, 16 nt, Mycobacterium avium subsp. paratuberculosis
agcgggcacgccgccg

SEQ ID NO: 898119 - RNA, 13 nt, Mycobacterium avium subsp. paratuberculosis
agcgggauggaca

SEQ ID NO: 898120 - RNA, 17 nt, Mycobacterium avium subsp. paratuberculosis
agcgggauuggcgccac

SEQ ID NO: 898121 - RNA, 20 nt, Mycobacterium avium subsp. paratuberculosis
agcgggauuggcgccacugc

SEQ ID NO: 898122 - RNA, 20 nt, Mycobacterium avium subsp. paratuberculosis
agcggcuuggccgugcaggg

SEQ ID NO: 898123 - RNA, 12 nt, Mycobacterium avium subsp. paratuberculosis
agcgggacagca

SEQ ID NO: 898124 - RNA, 17 nt, Mycobacterium avium subsp. paratuberculosis
agcgggacugcagcgcg

SEQ ID NO: 898125 - RNA, 20 nt, Mycobacterium avium subsp. paratuberculosis
agcgggacugcagcgcggug

SEQ ID NO: 898126 - RNA, 16 nt, Mycobacterium avium subsp. paratuberculosis
agcgggagccggccag

SEQ ID NO: 898127 - RNA, 21 nt, Mycobacterium avium subsp. paratuberculosis
agcgggauacccaugaucgcc

SEQ ID NO: 898128 - RNA, 17 nt, Mycobacterium avium subsp. paratuberculosis
agcgggauccccaccgu

SEQ ID NO: 898129 - RNA, 15 nt, Mycobacterium avium subsp. paratuberculosis
agcgggacgcgcaga

SEQ ID NO: 898130 - RNA, 16 nt, Mycobacterium avium subsp. paratuberculosis
agcgggacugcagcgc

SEQ ID NO: 898131 - RNA, 16 nt, Mycobacterium avium subsp. paratuberculosis
agcgggaucugcgccg

SEQ ID NO: 898132 - RNA, 17 nt, Mycobacterium avium subsp. paratuberculosis
agcgggaucugcgccgc

SEQ ID NO: 898133 - RNA, 22 nt, Mycobacterium avium subsp. paratuberculosis
agcgggguuuuugauugcgcgg

SEQ ID NO: 898134 - RNA, 13 nt, Mycobacterium avium subsp. paratuberculosis
agcgggcccgggc

SEQ ID NO: 898135 - RNA, 13 nt, Mycobacterium avium subsp. paratuberculosis
agcgggccgacag

SEQ ID NO: 898136 - RNA, 19 nt, Mycobacterium avium subsp. paratuberculosis
agcgggccgacagcacgcc

SEQ ID NO: 898137 - RNA, 21 nt, Mycobacterium avium subsp. paratuberculosis
agcgggccgagcguucggcgc

SEQ ID NO: 898138 - RNA, 17 nt, Mycobacterium avium subsp. paratuberculosis
agcggguccagccgccg

SEQ ID NO: 898139 - RNA, 18 nt, Mycobacterium avium subsp. paratuberculosis
agcgggucggccggcggg

SEQ ID NO: 898140 - RNA, 16 nt, Mycobacterium avium subsp. paratuberculosis
agcgggucgucgggcc

SEQ ID NO: 898141 - RNA, 16 nt, Mycobacterium avium subsp. paratuberculosis
agcgggugaaucgaca

SEQ ID NO: 898142 - RNA, 20 nt, Mycobacterium avium subsp. paratuberculosis
agcgggugaaucgacaccgc

SEQ ID NO: 898143 - RNA, 20 nt, Mycobacterium avium subsp. paratuberculosis
agcggcuguagcacccggcc

SEQ ID NO: 898144 - RNA, 21 nt, Mycobacterium avium subsp. paratuberculosis
agcggcuguagcacccggccg

SEQ ID NO: 898145 - RNA, 23 nt, Mycobacterium avium subsp. paratuberculosis
agcggcugucguagcggcccagg

SEQ ID NO: 898146 - RNA, 15 nt, Mycobacterium avium subsp. paratuberculosis
agcggcugcuggucg

SEQ ID NO: 898147 - RNA, 19 nt, Mycobacterium avium subsp. paratuberculosis
agcggcugcuggucgacgu

SEQ ID NO: 898148 - RNA, 19 nt, Mycobacterium avium subsp. paratuberculosis
agcggcuugaccggcucgc

SEQ ID NO: 898149 - RNA, 20 nt, Mycobacterium avium subsp. paratuberculosis
agcggcuugaccggcucgcc

SEQ ID NO: 898150 - RNA, 16 nt, Mycobacterium avium subsp. paratuberculosis
agcggcuugccgccgc

SEQ ID NO: 898151 - RNA, 21 nt, Mycobacterium avium subsp. paratuberculosis
agcgggaacaccacgucgucc

SEQ ID NO: 898152 - RNA, 17 nt, Mycobacterium avium subsp. paratuberculosis
agcgggaacgcgucgaa

SEQ ID NO: 898153 - RNA, 19 nt, Mycobacterium avium subsp. paratuberculosis
agcgggaacgcgucgaaca

SEQ ID NO: 898154 - RNA, 16 nt, Mycobacterium avium subsp. paratuberculosis
agcgggaagccgaggu

SEQ ID NO: 898155 - RNA, 15 nt, Mycobacterium avium subsp. paratuberculosis
agcgggaagcugcug

SEQ ID NO: 898156 - RNA, 17 nt, Mycobacterium avium subsp. paratuberculosis
agcggcuaagccggcgu

SEQ ID NO: 898157 - RNA, 18 nt, Mycobacterium avium subsp. paratuberculosis
agcggcugcugcagcgcc

SEQ ID NO: 898158 - RNA, 21 nt, Mycobacterium avium subsp. paratuberculosis
agcggcugcugcagcgcccgg

SEQ ID NO: 898159 - RNA, 14 nt, Mycobacterium avium subsp. paratuberculosis
agcggcucgcgggu

SEQ ID NO: 898160 - RNA, 19 nt, Mycobacterium avium subsp. paratuberculosis
agcggcugacccgcccggg

SEQ ID NO: 898161 - RNA, 21 nt, Mycobacterium avium subsp. paratuberculosis
agcggcugacccgcccgggug

SEQ ID NO: 898162 - RNA, 22 nt, Mycobacterium avium subsp. paratuberculosis
agcggcugaccgagcggcgcug

SEQ ID NO: 898163 - RNA, 12 nt, Mycobacterium avium subsp. paratuberculosis
agcggcugcagc

SEQ ID NO: 898164 - RNA, 20 nt, Mycobacterium avium subsp. paratuberculosis
agcggcugcagcagaugcgc

SEQ ID NO: 898165 - RNA, 21 nt, Mycobacterium avium subsp. paratuberculosis
agcggcgugcugcgcagcagc

SEQ ID NO: 898166 - RNA, 22 nt, Mycobacterium avium subsp. paratuberculosis
agcggcgugcugcgcagcagcg

SEQ ID NO: 898167 - RNA, 16 nt, Mycobacterium avium subsp. paratuberculosis
agcggcgcgccgggca

SEQ ID NO: 898168 - RNA, 14 nt, Mycobacterium avium subsp. paratuberculosis
agcggcgugaccgg

SEQ ID NO: 898169 - RNA, 17 nt, Mycobacterium avium subsp. paratuberculosis
agcggcgugaccgggaa

SEQ ID NO: 898170 - RNA, 15 nt, Mycobacterium avium subsp. paratuberculosis
agcggcgcgcgccgc

SEQ ID NO: 898171 - RNA, 17 nt, Mycobacterium avium subsp. paratuberculosis
agcggcgucgucgucga

SEQ ID NO: 898172 - RNA, 21 nt, Mycobacterium avium subsp. paratuberculosis
agcggcgccgggaucggcagc

SEQ ID NO: 898173 - RNA, 21 nt, Mycobacterium avium subsp. paratuberculosis
agcggcgccgcagcucguugu

SEQ ID NO: 898174 - RNA, 13 nt, Mycobacterium avium subsp. paratuberculosis
agcggcgccaggu

SEQ ID NO: 898175 - RNA, 20 nt, Mycobacterium avium subsp. paratuberculosis
agcggcgcccacggccacca

SEQ ID NO: 898176 - RNA, 20 nt, Mycobacterium avium subsp. paratuberculosis
agcggcgcacgcagugccgc

SEQ ID NO: 898177 - RNA, 21 nt, Mycobacterium avium subsp. paratuberculosis
agcggcgcacgcagugccgca

SEQ ID NO: 898178 - RNA, 13 nt, Mycobacterium avium subsp. paratuberculosis
agcggcgccaccg

SEQ ID NO: 898179 - RNA, 14 nt, Mycobacterium avium subsp. paratuberculosis
agcggcgccaccgg

SEQ ID NO: 898180 - RNA, 15 nt, Mycobacterium avium subsp. paratuberculosis
agcggcgccaccggc

SEQ ID NO: 898181 - RNA, 16 nt, Mycobacterium avium subsp. paratuberculosis
agcggcgccaccggga

SEQ ID NO: 898182 - RNA, 14 nt, Mycobacterium avium subsp. paratuberculosis
agcggcgccacgug

SEQ ID NO: 898183 - RNA, 14 nt, Mycobacterium avium subsp. paratuberculosis
agcggcaacacgcc

SEQ ID NO: 898184 - RNA, 16 nt, Mycobacterium avium subsp. paratuberculosis
agcggauugaccagca

SEQ ID NO: 898185 - RNA, 17 nt, Mycobacterium avium subsp. paratuberculosis
agcggauugaccagcac

SEQ ID NO: 898186 - RNA, 23 nt, Mycobacterium avium subsp. paratuberculosis
agcggauugaccagcacguugug

SEQ ID NO: 898187 - RNA, 21 nt, Mycobacterium avium subsp. paratuberculosis
agcggcaaaauagcugcgaca

SEQ ID NO: 898188 - RNA, 18 nt, Mycobacterium avium subsp. paratuberculosis
agcggauggcgacggcga

SEQ ID NO: 898189 - RNA, 15 nt, Mycobacterium avium subsp. paratuberculosis
agcggauggcgccgu

SEQ ID NO: 898190 - RNA, 17 nt, Mycobacterium avium subsp. paratuberculosis
agcggauggcgccgucg

SEQ ID NO: 898191 - RNA, 18 nt, Mycobacterium avium subsp. paratuberculosis
agcggauggcgccgucga

SEQ ID NO: 898192 - RNA, 19 nt, Mycobacterium avium subsp. paratuberculosis
agcggaaucgcccgggcca

SEQ ID NO: 898193 - RNA, 19 nt, Mycobacterium avium subsp. paratuberculosis
agcggaaugaacgcggcca

SEQ ID NO: 898194 - RNA, 18 nt, Mycobacterium avium subsp. paratuberculosis
agcggaagcugccguugc

SEQ ID NO: 898195 - RNA, 18 nt, Mycobacterium avium subsp. paratuberculosis
agcggaucccgguucccg

SEQ ID NO: 898196 - RNA, 22 nt, Mycobacterium avium subsp. paratuberculosis
agcggaucgagguagcgugcgc

SEQ ID NO: 898197 - RNA, 14 nt, Mycobacterium avium subsp. paratuberculosis
agcggaucggccug

SEQ ID NO: 898198 - RNA, 17 nt, Mycobacterium avium subsp. paratuberculosis
agcggaucggcggcgac

SEQ ID NO: 898199 - RNA, 20 nt, Mycobacterium avium subsp. paratuberculosis
agcucagcugcugcgcggcg

SEQ ID NO: 898200 - RNA, 13 nt, Mycobacterium avium subsp. paratuberculosis
agcucaggugcga

SEQ ID NO: 898201 - RNA, 17 nt, Mycobacterium avium subsp. paratuberculosis
agcucaggugcgacgcc

SEQ ID NO: 898202 - RNA, 17 nt, Mycobacterium avium subsp. paratuberculosis
agcucauacagcggcgc

SEQ ID NO: 898203 - RNA, 23 nt, Mycobacterium avium subsp. paratuberculosis
agcucaccgacaagggccgggcg

SEQ ID NO: 898204 - RNA, 15 nt, Mycobacterium avium subsp. paratuberculosis
agcucagccacgccg

SEQ ID NO: 898205 - RNA, 18 nt, Mycobacterium avium subsp. paratuberculosis
agcucagccacgccggca

SEQ ID NO: 898206 - RNA, 19 nt, Mycobacterium avium subsp. paratuberculosis
agcucagccacgccggcac

SEQ ID NO: 898207 - RNA, 14 nt, Mycobacterium avium subsp. paratuberculosis
agcucagcgcgcac

SEQ ID NO: 898208 - RNA, 20 nt, Mycobacterium avium subsp. paratuberculosis
agcucaugguguuccaccag

SEQ ID NO: 898209 - RNA, 17 nt, Mycobacterium avium subsp. paratuberculosis
agcucaugugggggguc

SEQ ID NO: 898210 - RNA, 18 nt, Mycobacterium avium subsp. paratuberculosis
agcucauguggggggucg

SEQ ID NO: 898211 - RNA, 12 nt, Mycobacterium avium subsp. paratuberculosis
agcuccacgccg

SEQ ID NO: 898212 - RNA, 14 nt, Mycobacterium avium subsp. paratuberculosis
agcuccacgccgcc

SEQ ID NO: 898213 - RNA, 16 nt, Mycobacterium avium subsp. paratuberculosis
agcuccacgccgccgg

SEQ ID NO: 898214 - RNA, 21 nt, Mycobacterium avium subsp. paratuberculosis
agcuccacgccgccgggaaca

SEQ ID NO: 898215 - RNA, 18 nt, Mycobacterium avium subsp. paratuberculosis
agcuccaccugcggcacc

SEQ ID NO: 898216 - RNA, 18 nt, Mycobacterium avium subsp. paratuberculosis
agcuccagcgaguuggcc

SEQ ID NO: 898217 - RNA, 20 nt, Mycobacterium avium subsp. paratuberculosis
agcucccccgacaccgccag

SEQ ID NO: 898218 - RNA, 14 nt, Mycobacterium avium subsp. paratuberculosis
agcucccccggcgu

SEQ ID NO: 898219 - RNA, 19 nt, Mycobacterium avium subsp. paratuberculosis
agcucccccggcgugagcg

SEQ ID NO: 898220 - RNA, 22 nt, Mycobacterium avium subsp. paratuberculosis
agcuccaucgacggaucgcccu

SEQ ID NO: 898221 - RNA, 21 nt, Mycobacterium avium subsp. paratuberculosis
agcucccgagcaucgccgagc

SEQ ID NO: 898222 - RNA, 15 nt, Mycobacterium avium subsp. paratuberculosis
agcucccgggcggcg

SEQ ID NO: 898223 - RNA, 18 nt, Mycobacterium avium subsp. paratuberculosis
agcucccgggcggcgccg

SEQ ID NO: 898224 - RNA, 16 nt, Mycobacterium avium subsp. paratuberculosis
agcuccgccgacacca

SEQ ID NO: 898225 - RNA, 16 nt, Mycobacterium avium subsp. paratuberculosis
agcuccgcggccagcu

SEQ ID NO: 898226 - RNA, 20 nt, Mycobacterium avium subsp. paratuberculosis
agcuccuugagccgccgcgg

SEQ ID NO: 898227 - RNA, 21 nt, Mycobacterium avium subsp. paratuberculosis
agcuccuugagccgccgcggc

SEQ ID NO: 898228 - RNA, 16 nt, Mycobacterium avium subsp. paratuberculosis
agcuccuccugcggug

SEQ ID NO: 898229 - RNA, 14 nt, Mycobacterium avium subsp. paratuberculosis
agcuccucggccag

SEQ ID NO: 898230 - RNA, 20 nt, Mycobacterium avium subsp. paratuberculosis
agcguuuccuggugcaccag

SEQ ID NO: 898231 - RNA, 22 nt, Mycobacterium avium subsp. paratuberculosis
agcguuuccuggugcaccaggu

SEQ ID NO: 898232 - RNA, 19 nt, Mycobacterium avium subsp. paratuberculosis
agcguuuccagcgccggca

SEQ ID NO: 898233 - RNA, 22 nt, Mycobacterium avium subsp. paratuberculosis
agcuaaaccccacggccgcaac

SEQ ID NO: 898234 - RNA, 16 nt, Mycobacterium avium subsp. paratuberculosis
agcguugcgccagcag

SEQ ID NO: 898235 - RNA, 23 nt, Mycobacterium avium subsp. paratuberculosis
agcguugcgcguucaagccgccg

SEQ ID NO: 898236 - RNA, 17 nt, Mycobacterium avium subsp. paratuberculosis
agcguucuccacccgcc

SEQ ID NO: 898237 - RNA, 18 nt, Mycobacterium avium subsp. paratuberculosis
agcguugccggccgaagu

SEQ ID NO: 898238 - RNA, 19 nt, Mycobacterium avium subsp. paratuberculosis
agcguugccgcgcgcccgc

SEQ ID NO: 898239 - RNA, 17 nt, Mycobacterium avium subsp. paratuberculosis
agcuagcuucacgcucg

SEQ ID NO: 898240 - RNA, 19 nt, Mycobacterium avium subsp. paratuberculosis
agcuagcuucacgcucggc

SEQ ID NO: 898241 - RNA, 15 nt, Mycobacterium avium subsp. paratuberculosis
agcuaggcggccggg

SEQ ID NO: 898242 - RNA, 13 nt, Mycobacterium avium subsp. paratuberculosis
agcuaacgccagc

SEQ ID NO: 898243 - RNA, 19 nt, Mycobacterium avium subsp. paratuberculosis
agcuaguuucacgcucggc

SEQ ID NO: 898244 - RNA, 23 nt, Mycobacterium avium subsp. paratuberculosis
agcuaguuucacguucgcggucg

SEQ ID NO: 898245 - RNA, 23 nt, Mycobacterium avium subsp. paratuberculosis
agcugauagcccgccgcggcgac

SEQ ID NO: 898246 - RNA, 15 nt, Mycobacterium avium subsp. paratuberculosis
agcugauagccgccc

SEQ ID NO: 898247 - RNA, 17 nt, Mycobacterium avium subsp. paratuberculosis
agcugaucgcggccggc

SEQ ID NO: 898248 - RNA, 16 nt, Mycobacterium avium subsp. paratuberculosis
agcugaucgcgucgac

SEQ ID NO: 898249 - RNA, 22 nt, Mycobacterium avium subsp. paratuberculosis
agcugaucgcgucgacggcgcc

SEQ ID NO: 898250 - RNA, 14 nt, Mycobacterium avium subsp. paratuberculosis
agcugaccggccac

SEQ ID NO: 898251 - RNA, 15 nt, Mycobacterium avium subsp. paratuberculosis
agcugacgggccggc

SEQ ID NO: 898252 - RNA, 20 nt, Mycobacterium avium subsp. paratuberculosis
agcugacgggccggcggggu

SEQ ID NO: 898253 - RNA, 15 nt, Mycobacterium avium subsp. paratuberculosis
agcugaccggcgauc

SEQ ID NO: 898254 - RNA, 22 nt, Mycobacterium avium subsp. paratuberculosis
agcugaagguuguucugcucga

SEQ ID NO: 898255 - RNA, 14 nt, Mycobacterium avium subsp. paratuberculosis
agcugaaguucacc

SEQ ID NO: 898256 - RNA, 19 nt, Mycobacterium avium subsp. paratuberculosis
agcugaaguucaccaccgc

SEQ ID NO: 898257 - RNA, 16 nt, Mycobacterium avium subsp. paratuberculosis
agcugacacccgacga

SEQ ID NO: 898258 - RNA, 20 nt, Mycobacterium avium subsp. paratuberculosis
agcugaacacgaacccggcg

SEQ ID NO: 898259 - RNA, 23 nt, Mycobacterium avium subsp. paratuberculosis
agcucuugaaucgguucggccag

SEQ ID NO: 898260 - RNA, 17 nt, Mycobacterium avium subsp. paratuberculosis
agcucuucgauggccau

SEQ ID NO: 898261 - RNA, 16 nt, Mycobacterium avium subsp. paratuberculosis
agcucguugccggcgg

SEQ ID NO: 898262 - RNA, 20 nt, Mycobacterium avium subsp. paratuberculosis
agcucguugccggcggccag

SEQ ID NO: 898263 - RNA, 20 nt, Mycobacterium avium subsp. paratuberculosis
agcucgucggguguggcgcc

SEQ ID NO: 898264 - RNA, 21 nt, Mycobacterium avium subsp. paratuberculosis
agcucgucggguguggcgccg

SEQ ID NO: 898265 - RNA, 22 nt, Mycobacterium avium subsp. paratuberculosis
agcucgucggguguggcgccgu

SEQ ID NO: 898266 - RNA, 22 nt, Mycobacterium avium subsp. paratuberculosis
agcucgucguacucgggugagu

SEQ ID NO: 898267 - RNA, 16 nt, Mycobacterium avium subsp. paratuberculosis
agcucgugauggucca

SEQ ID NO: 898268 - RNA, 15 nt, Mycobacterium avium subsp. paratuberculosis
agcucguggcgggcc

SEQ ID NO: 898269 - RNA, 23 nt, Mycobacterium avium subsp. paratuberculosis
agcucguggcgggcccgggcgcu

SEQ ID NO: 898270 - RNA, 20 nt, Mycobacterium avium subsp. paratuberculosis
agcucgugguagaugucgcg

SEQ ID NO: 898271 - RNA, 22 nt, Mycobacterium avium subsp. paratuberculosis
agcucugguuuuacacaccagc

SEQ ID NO: 898272 - RNA, 15 nt, Mycobacterium avium subsp. paratuberculosis
agcucgucgacgucc

SEQ ID NO: 898273 - RNA, 13 nt, Mycobacterium avium subsp. paratuberculosis
agcucgucgccga

SEQ ID NO: 898274 - RNA, 17 nt, Mycobacterium avium subsp. paratuberculosis
agcucgucgccgaccag

SEQ ID NO: 898275 - RNA, 22 nt, Mycobacterium avium subsp. paratuberculosis
agcucggugaugaucgccgggu

SEQ ID NO: 898276 - RNA, 18 nt, Mycobacterium avium subsp. paratuberculosis
agcucggugcgcauggcg

SEQ ID NO: 898277 - RNA, 23 nt, Mycobacterium avium subsp. paratuberculosis
agcucgguggcgucggcggccug

SEQ ID NO: 898278 - RNA, 18 nt, Mycobacterium avium subsp. paratuberculosis
agcucgucagcgcgggcc

SEQ ID NO: 898279 - RNA, 15 nt, Mycobacterium avium subsp. paratuberculosis
agcucguccagcgug

SEQ ID NO: 898280 - RNA, 18 nt, Mycobacterium avium subsp. paratuberculosis
agcucguccagcgugccg

SEQ ID NO: 898281 - RNA, 23 nt, Mycobacterium avium subsp. paratuberculosis
agcucguccagcgugccgcgcac

SEQ ID NO: 898282 - RNA, 16 nt, Mycobacterium avium subsp. paratuberculosis
agcucggcggccgggu

SEQ ID NO: 898283 - RNA, 17 nt, Mycobacterium avium subsp. paratuberculosis
agcucggucgcggucgg

SEQ ID NO: 898284 - RNA, 19 nt, Mycobacterium avium subsp. paratuberculosis
agcucggucgcggucggcg

SEQ ID NO: 898285 - RNA, 21 nt, Mycobacterium avium subsp. paratuberculosis
agcucggucgcggucggcgcc

SEQ ID NO: 898286 - RNA, 22 nt, Mycobacterium avium subsp. paratuberculosis
agcucgggguaguucagcgcgc

SEQ ID NO: 898287 - RNA, 15 nt, Mycobacterium avium subsp. paratuberculosis
agcucggggucggcg

SEQ ID NO: 898288 - RNA, 23 nt, Mycobacterium avium subsp. paratuberculosis
agcucggggucggcgucgggccg

SEQ ID NO: 898289 - RNA, 22 nt, Mycobacterium avium subsp. paratuberculosis
agcucggucaccagcggcccgc

SEQ ID NO: 898290 - RNA, 17 nt, Mycobacterium avium subsp. paratuberculosis
agcucggucagccgggc

SEQ ID NO: 898291 - RNA, 23 nt, Mycobacterium avium subsp. paratuberculosis
agcucgcguucgggcccggccgc

SEQ ID NO: 898292 - RNA, 17 nt, Mycobacterium avium subsp. paratuberculosis
agcucgcugagcgggac

SEQ ID NO: 898293 - RNA, 16 nt, Mycobacterium avium subsp. paratuberculosis
agcucgcgucgacguc

SEQ ID NO: 898294 - RNA, 17 nt, Mycobacterium avium subsp. paratuberculosis
agcucgcgucgacgucg

SEQ ID NO: 898295 - RNA, 12 nt, Mycobacterium avium subsp. paratuberculosis
agcucgcguacg

SEQ ID NO: 898296 - RNA, 15 nt, Mycobacterium avium subsp. paratuberculosis
agcucgcguacgacc

SEQ ID NO: 898297 - RNA, 13 nt, Mycobacterium avium subsp. paratuberculosis
agcucgcguagcg

SEQ ID NO: 898298 - RNA, 19 nt, Mycobacterium avium subsp. paratuberculosis
agcucggccaccagcgccc

SEQ ID NO: 898299 - RNA, 20 nt, Mycobacterium avium subsp. paratuberculosis
agcucggccaccagcgcccg

SEQ ID NO: 898300 - RNA, 20 nt, Mycobacterium avium subsp. paratuberculosis
agcucgcgcugaagccgcug

SEQ ID NO: 898301 - RNA, 12 nt, Mycobacterium avium subsp. paratuberculosis
agcucgcgcugc

SEQ ID NO: 898302 - RNA, 14 nt, Mycobacterium avium subsp. paratuberculosis
agcucgcgcugcau

SEQ ID NO: 898303 - RNA, 20 nt, Mycobacterium avium subsp. paratuberculosis
agcucgcgcugcaugccggu

SEQ ID NO: 898304 - RNA, 12 nt, Mycobacterium avium subsp. paratuberculosis
agcucgcggcgc

SEQ ID NO: 898305 - RNA, 13 nt, Mycobacterium avium subsp. paratuberculosis
agcucgcggcgca

SEQ ID NO: 898306 - RNA, 14 nt, Mycobacterium avium subsp. paratuberculosis
agcucgcggcgcag

SEQ ID NO: 898307 - RNA, 17 nt, Mycobacterium avium subsp. paratuberculosis
agcucgcggcgcagcuc

SEQ ID NO: 898308 - RNA, 14 nt, Mycobacterium avium subsp. paratuberculosis
agcucggcggcccg

SEQ ID NO: 898309 - RNA, 18 nt, Mycobacterium avium subsp. paratuberculosis
agcucggcggcccgccgg

SEQ ID NO: 898310 - RNA, 14 nt, Mycobacterium avium subsp. paratuberculosis
agcucgggcagcgu

SEQ ID NO: 898311 - RNA, 15 nt, Mycobacterium avium subsp. paratuberculosis
agcucggcccgcugc

SEQ ID NO: 898312 - RNA, 21 nt, Mycobacterium avium subsp. paratuberculosis
agcucggcccgcugcgcggcc

SEQ ID NO: 898313 - RNA, 15 nt, Mycobacterium avium subsp. paratuberculosis
agcucggaguaggcg

SEQ ID NO: 898314 - RNA, 14 nt, Mycobacterium avium subsp. paratuberculosis
agcucgcgcccggc

SEQ ID NO: 898315 - RNA, 17 nt, Mycobacterium avium subsp. paratuberculosis
agcucgcgcccggccag

SEQ ID NO: 898316 - RNA, 15 nt, Mycobacterium avium subsp. paratuberculosis
agcucgcgccgaccc

SEQ ID NO: 898317 - RNA, 20 nt, Mycobacterium avium subsp. paratuberculosis
agcucgcgccgacccgcccg

SEQ ID NO: 898318 - RNA, 17 nt, Mycobacterium avium subsp. paratuberculosis
agcucgccggcgcgcag

SEQ ID NO: 898319 - RNA, 20 nt, Mycobacterium avium subsp. paratuberculosis
agcucgccgguggcggcgac

SEQ ID NO: 898320 - RNA, 13 nt, Mycobacterium avium subsp. paratuberculosis
agcucgcgcagcc

SEQ ID NO: 898321 - RNA, 18 nt, Mycobacterium avium subsp. paratuberculosis
agcucgcgcagccggccg

SEQ ID NO: 898322 - RNA, 16 nt, Mycobacterium avium subsp. paratuberculosis
agcucgcgaagcgcga

SEQ ID NO: 898323 - RNA, 17 nt, Mycobacterium avium subsp. paratuberculosis
agcucgcgaagcgcgau

SEQ ID NO: 898324 - RNA, 19 nt, Mycobacterium avium subsp. paratuberculosis
agcucgcagucgaucagcg

SEQ ID NO: 898325 - RNA, 12 nt, Mycobacterium avium subsp. paratuberculosis
agcucgacgaug

SEQ ID NO: 898326 - RNA, 20 nt, Mycobacterium avium subsp. paratuberculosis
agcucgaugccguucgcgcc

SEQ ID NO: 898327 - RNA, 15 nt, Mycobacterium avium subsp. paratuberculosis
agcucgcccagcacc

SEQ ID NO: 898328 - RNA, 21 nt, Mycobacterium avium subsp. paratuberculosis
agcucgcccagcaccgucugc

SEQ ID NO: 898329 - RNA, 14 nt, Mycobacterium avium subsp. paratuberculosis
agcucgccgagcgu

SEQ ID NO: 898330 - RNA, 15 nt, Mycobacterium avium subsp. paratuberculosis
agcucgccgagcgug

SEQ ID NO: 898331 - RNA, 14 nt, Mycobacterium avium subsp. paratuberculosis
agcucgccgccgac

SEQ ID NO: 898332 - RNA, 15 nt, Mycobacterium avium subsp. paratuberculosis
agcucgccgcggcca

SEQ ID NO: 898333 - RNA, 18 nt, Mycobacterium avium subsp. paratuberculosis
agcucgccgcggccacgc

SEQ ID NO: 898334 - RNA, 21 nt, Mycobacterium avium subsp. paratuberculosis
agcucgccgcggccacgcucg

SEQ ID NO: 898335 - RNA, 13 nt, Mycobacterium avium subsp. paratuberculosis
agcucgccggccg

SEQ ID NO: 898336 - RNA, 16 nt, Mycobacterium avium subsp. paratuberculosis
agcucgccggccgcgg

SEQ ID NO: 898337 - RNA, 18 nt, Mycobacterium avium subsp. paratuberculosis
agcucgaggccgcgggcg

SEQ ID NO: 898338 - RNA, 18 nt, Mycobacterium avium subsp. paratuberculosis
agcucgaucacccagguc

SEQ ID NO: 898339 - RNA, 16 nt, Mycobacterium avium subsp. paratuberculosis
agcucgaucgccgcgc

SEQ ID NO: 898340 - RNA, 17 nt, Mycobacterium avium subsp. paratuberculosis
agcucgaccagccgggu

SEQ ID NO: 898341 - RNA, 18 nt, Mycobacterium avium subsp. paratuberculosis
agcucgacaucggccgcc

SEQ ID NO: 898342 - RNA, 15 nt, Mycobacterium avium subsp. paratuberculosis
agcucgaaccuggag

SEQ ID NO: 898343 - RNA, 23 nt, Mycobacterium avium subsp. paratuberculosis
agcucgaaggugaccaucggguc

SEQ ID NO: 898344 - RNA, 19 nt, Mycobacterium avium subsp. paratuberculosis
agcucgaaggugcccgcau

SEQ ID NO: 898345 - RNA, 21 nt, Mycobacterium avium subsp. paratuberculosis
agcucgaaggugcccgcaucg

SEQ ID NO: 898346 - RNA, 14 nt, Mycobacterium avium subsp. paratuberculosis
ccacaaacagcgcg

SEQ ID NO: 898347 - RNA, 18 nt, Mycobacterium avium subsp. paratuberculosis
ccacaaacagcgcggccg

SEQ ID NO: 898348 - RNA, 19 nt, Mycobacterium avium subsp. paratuberculosis
ccacaacagguucgacagc

SEQ ID NO: 898349 - RNA, 16 nt, Mycobacterium avium subsp. paratuberculosis
ccacaacaugucccgg

SEQ ID NO: 898350 - RNA, 18 nt, Mycobacterium avium subsp. paratuberculosis
ccacaacaugucccgggc

SEQ ID NO: 898351 - RNA, 22 nt, Mycobacterium avium subsp. paratuberculosis
ccacaauggauccgaucagcag

SEQ ID NO: 898352 - RNA, 12 nt, Mycobacterium avium subsp. paratuberculosis
ccacaacuggcc

SEQ ID NO: 898353 - RNA, 14 nt, Mycobacterium avium subsp. paratuberculosis
ccacaacuggccgg

SEQ ID NO: 898354 - RNA, 15 nt, Mycobacterium avium subsp. paratuberculosis
ccacaacuggccggg

SEQ ID NO: 898355 - RNA, 18 nt, Mycobacterium avium subsp. paratuberculosis
ccaaugcgccggcggccg

SEQ ID NO: 898356 - RNA, 19 nt, Mycobacterium avium subsp. paratuberculosis
ccaaugaucugggccgcca

SEQ ID NO: 898357 - RNA, 17 nt, Mycobacterium avium subsp. paratuberculosis
ccaaugguuuucgucga

SEQ ID NO: 898358 - RNA, 15 nt, Mycobacterium avium subsp. paratuberculosis
ccaaugucacggcgg

SEQ ID NO: 898359 - RNA, 16 nt, Mycobacterium avium subsp. paratuberculosis
ccaaugucacggcggg

SEQ ID NO: 898360 - RNA, 16 nt, Mycobacterium avium subsp. paratuberculosis
ccaauccggcgggccu

SEQ ID NO: 898361 - RNA, 23 nt, Mycobacterium avium subsp. paratuberculosis
ccaauccggcgggccucgccgcu

SEQ ID NO: 898362 - RNA, 18 nt, Mycobacterium avium subsp. paratuberculosis
ccaaggucuccgggcugu

SEQ ID NO: 898363 - RNA, 13 nt, Mycobacterium avium subsp. paratuberculosis
ccaaggucgccgg

SEQ ID NO: 898364 - RNA, 19 nt, Mycobacterium avium subsp. paratuberculosis
ccaaccaggcgcucgucga

SEQ ID NO: 898365 - RNA, 20 nt, Mycobacterium avium subsp. paratuberculosis
ccaaccaggucgcggcgcug

SEQ ID NO: 898366 - RNA, 20 nt, Mycobacterium avium subsp. paratuberculosis
ccaacaucgacgugccguug

SEQ ID NO: 898367 - RNA, 19 nt, Mycobacterium avium subsp. paratuberculosis
ccaccacacccgcggccgc

SEQ ID NO: 898368 - RNA, 21 nt, Mycobacterium avium subsp. paratuberculosis
ccaccacacccgcggccgcug

SEQ ID NO: 898369 - RNA, 20 nt, Mycobacterium avium subsp. paratuberculosis
ccaccacauucccgccgccg

SEQ ID NO: 898370 - RNA, 21 nt, Mycobacterium avium subsp. paratuberculosis
ccaccacauuggcgaccgcgg

SEQ ID NO: 898371 - RNA, 13 nt, Mycobacterium avium subsp. paratuberculosis
ccaccaccacgag

SEQ ID NO: 898372 - RNA, 15 nt, Mycobacterium avium subsp. paratuberculosis
ccaccaccacggggc

SEQ ID NO: 898373 - RNA, 13 nt, Mycobacterium avium subsp. paratuberculosis
ccaccaccagcgg

SEQ ID NO: 898374 - RNA, 15 nt, Mycobacterium avium subsp. paratuberculosis
ccaccaccagcgggc

SEQ ID NO: 898375 - RNA, 18 nt, Mycobacterium avium subsp. paratuberculosis
ccaccaccagucggcgcg

SEQ ID NO: 898376 - RNA, 19 nt, Mycobacterium avium subsp. paratuberculosis
ccaccaccagucggcgcgu

SEQ ID NO: 898377 - RNA, 15 nt, Mycobacterium avium subsp. paratuberculosis
ccaccacggcgucgc

SEQ ID NO: 898378 - RNA, 21 nt, Mycobacterium avium subsp. paratuberculosis
ccaccacggcgucgcugaacg

SEQ ID NO: 898379 - RNA, 14 nt, Mycobacterium avium subsp. paratuberculosis
ccaccacggggcgg

SEQ ID NO: 898380 - RNA, 14 nt, Mycobacterium avium subsp. paratuberculosis
ccaccacgguggcg

SEQ ID NO: 898381 - RNA, 22 nt, Mycobacterium avium subsp. paratuberculosis
ccaccacgguggcgccggcauc

SEQ ID NO: 898382 - RNA, 20 nt, Mycobacterium avium subsp. paratuberculosis
ccaccacguacuccugcgcg

SEQ ID NO: 898383 - RNA, 12 nt, Mycobacterium avium subsp. paratuberculosis
ccaccacguagg

SEQ ID NO: 898384 - RNA, 23 nt, Mycobacterium avium subsp. paratuberculosis
ccaccacguaggcgaucagcgcg

SEQ ID NO: 898385 - RNA, 13 nt, Mycobacterium avium subsp. paratuberculosis
ccaccacggcgcc

SEQ ID NO: 898386 - RNA, 12 nt, Mycobacterium avium subsp. paratuberculosis
ccaccaccggcu

SEQ ID NO: 898387 - RNA, 13 nt, Mycobacterium avium subsp. paratuberculosis
ccaccaccgguga

SEQ ID NO: 898388 - RNA, 15 nt, Mycobacterium avium subsp. paratuberculosis
ccaccaccgcgccgu

SEQ ID NO: 898389 - RNA, 18 nt, Mycobacterium avium subsp. paratuberculosis
ccaccaccgcgccgucgu

SEQ ID NO: 898390 - RNA, 19 nt, Mycobacterium avium subsp. paratuberculosis
ccaccacgaggaccagcau

SEQ ID NO: 898391 - RNA, 19 nt, Mycobacterium avium subsp. paratuberculosis
ccaccacgcuggccccggu

SEQ ID NO: 898392 - RNA, 13 nt, Mycobacterium avium subsp. paratuberculosis
ccaccacggccau

SEQ ID NO: 898393 - RNA, 15 nt, Mycobacterium avium subsp. paratuberculosis
ccaccacggccgcag

SEQ ID NO: 898394 - RNA, 18 nt, Mycobacterium avium subsp. paratuberculosis
ccaccacggccgcagcgg

SEQ ID NO: 898395 - RNA, 20 nt, Mycobacterium avium subsp. paratuberculosis
ccaccacggccgcagcggca

SEQ ID NO: 898396 - RNA, 14 nt, Mycobacterium avium subsp. paratuberculosis
ccaccacggccgcc

SEQ ID NO: 898397 - RNA, 17 nt, Mycobacterium avium subsp. paratuberculosis
ccaccacggccgccgag

SEQ ID NO: 898398 - RNA, 12 nt, Mycobacterium avium subsp. paratuberculosis
ccaccaccggcc

SEQ ID NO: 898399 - RNA, 15 nt, Mycobacterium avium subsp. paratuberculosis
ccaccaccggccgcg

SEQ ID NO: 898400 - RNA, 17 nt, Mycobacterium avium subsp. paratuberculosis
ccaccaccggccgcgcg

SEQ ID NO: 898401 - RNA, 13 nt, Mycobacterium avium subsp. paratuberculosis
ccaccaccgagcc

SEQ ID NO: 898402 - RNA, 15 nt, Mycobacterium avium subsp. paratuberculosis
ccaccaccgagccgg

SEQ ID NO: 898403 - RNA, 18 nt, Mycobacterium avium subsp. paratuberculosis
ccaccaccgccaccagcg

SEQ ID NO: 898404 - RNA, 13 nt, Mycobacterium avium subsp. paratuberculosis
ccaccaccgcgcc

SEQ ID NO: 898405 - RNA, 14 nt, Mycobacterium avium subsp. paratuberculosis
ccaccaccgcgccg

SEQ ID NO: 898406 - RNA, 20 nt, Mycobacterium avium subsp. paratuberculosis
ccaccaccuccucgcgggcg

SEQ ID NO: 898407 - RNA, 21 nt, Mycobacterium avium subsp. paratuberculosis
ccaccaccuccucgcgggcga

SEQ ID NO: 898408 - RNA, 17 nt, Mycobacterium avium subsp. paratuberculosis
ccaccaccucgcgggcg

SEQ ID NO: 898409 - RNA, 12 nt, Mycobacterium avium subsp. paratuberculosis
ccaccacgaacc

SEQ ID NO: 898410 - RNA, 24 nt, Mycobacterium avium subsp. paratuberculosis
ccaccacgaaccaggcgccggcca

SEQ ID NO: 898411 - RNA, 20 nt, Mycobacterium avium subsp. paratuberculosis
ccaccacgaccagugcccgg

SEQ ID NO: 898412 - RNA, 13 nt, Mycobacterium avium subsp. paratuberculosis
ccaccacgacgcc

SEQ ID NO: 898413 - RNA, 16 nt, Mycobacterium avium subsp. paratuberculosis
ccaccacgacgccggg

SEQ ID NO: 898414 - RNA, 20 nt, Mycobacterium avium subsp. paratuberculosis
ccaccacgacgccgggcgcc

SEQ ID NO: 898415 - RNA, 13 nt, Mycobacterium avium subsp. paratuberculosis
ccaccacgacggg

SEQ ID NO: 898416 - RNA, 14 nt, Mycobacterium avium subsp. paratuberculosis
ccaccacgacgggg

SEQ ID NO: 898417 - RNA, 15 nt, Mycobacterium avium subsp. paratuberculosis
ccaccaccgccggcc

SEQ ID NO: 898418 - RNA, 13 nt, Mycobacterium avium subsp. paratuberculosis
ccaccaccgacac

SEQ ID NO: 898419 - RNA, 21 nt, Mycobacterium avium subsp. paratuberculosis
ccaccacccggaagaacucgu

SEQ ID NO: 898420 - RNA, 14 nt, Mycobacterium avium subsp. paratuberculosis
ccacaccaccaccg

SEQ ID NO: 898421 - RNA, 18 nt, Mycobacterium avium subsp. paratuberculosis
ccacacaggaccagcacu

SEQ ID NO: 898422 - RNA, 18 nt, Mycobacterium avium subsp. paratuberculosis
ccacacggcaggcggccc

SEQ ID NO: 898423 - RNA, 14 nt, Mycobacterium avium subsp. paratuberculosis
ccacacguccugga

SEQ ID NO: 898424 - RNA, 20 nt, Mycobacterium avium subsp. paratuberculosis
ccacacguccuggacgucgu

SEQ ID NO: 898425 - RNA, 17 nt, Mycobacterium avium subsp. paratuberculosis
ccacacguugagcccgg

SEQ ID NO: 898426 - RNA, 20 nt, Mycobacterium avium subsp. paratuberculosis
ccacacuggcgugacgcucg

SEQ ID NO: 898427 - RNA, 22 nt, Mycobacterium avium subsp. paratuberculosis
ccacagcaugaagaucagcacc

SEQ ID NO: 898428 - RNA, 23 nt, Mycobacterium avium subsp. paratuberculosis
ccacagcaugaagaucagcaccg

SEQ ID NO: 898429 - RNA, 15 nt, Mycobacterium avium subsp. paratuberculosis
ccacagcagcaccag

SEQ ID NO: 898430 - RNA, 15 nt, Mycobacterium avium subsp. paratuberculosis
ccacagccggcggcu

SEQ ID NO: 898431 - RNA, 20 nt, Mycobacterium avium subsp. paratuberculosis
ccacagcgacagggugccga

SEQ ID NO: 898432 - RNA, 14 nt, Mycobacterium avium subsp. paratuberculosis
ccacagcgccucgc

SEQ ID NO: 898433 - RNA, 20 nt, Mycobacterium avium subsp. paratuberculosis
ccacagcgccucgcggucga

SEQ ID NO: 898434 - RNA, 17 nt, Mycobacterium avium subsp. paratuberculosis
ccacagcgccucgucga

SEQ ID NO: 898435 - RNA, 22 nt, Mycobacterium avium subsp. paratuberculosis
ccacagcgccucgucgagccgg

SEQ ID NO: 898436 - RNA, 17 nt, Mycobacterium avium subsp. paratuberculosis
ccacagcgguucggcga

SEQ ID NO: 898437 - RNA, 22 nt, Mycobacterium avium subsp. paratuberculosis
ccacagcgguucggcgacgcug

SEQ ID NO: 898438 - RNA, 15 nt, Mycobacterium avium subsp. paratuberculosis
ccacagcgucucgac

SEQ ID NO: 898439 - RNA, 11 nt, Mycobacterium avium subsp. paratuberculosis
ccacagcggcg

SEQ ID NO: 898440 - RNA, 14 nt, Mycobacterium avium subsp. paratuberculosis
ccacagcgccagca

SEQ ID NO: 898441 - RNA, 15 nt, Mycobacterium avium subsp. paratuberculosis
ccacagcgccagcac

SEQ ID NO: 898442 - RNA, 17 nt, Mycobacterium avium subsp. paratuberculosis
ccacagcgccagcacgg

SEQ ID NO: 898443 - RNA, 18 nt, Mycobacterium avium subsp. paratuberculosis
ccacagcgcgaauccggu

SEQ ID NO: 898444 - RNA, 15 nt, Mycobacterium avium subsp. paratuberculosis
ccacagcgcgcccca

SEQ ID NO: 898445 - RNA, 16 nt, Mycobacterium avium subsp. paratuberculosis
ccacaggccgaacagc

SEQ ID NO: 898446 - RNA, 19 nt, Mycobacterium avium subsp. paratuberculosis
ccacaggacguugaggcgg

SEQ ID NO: 898447 - RNA, 16 nt, Mycobacterium avium subsp. paratuberculosis
ccacagcucgggcagc

SEQ ID NO: 898448 - RNA, 20 nt, Mycobacterium avium subsp. paratuberculosis
ccacagcugacgggccggcg

SEQ ID NO: 898449 - RNA, 21 nt, Mycobacterium avium subsp. paratuberculosis
ccacagcugacgggccggcgg

SEQ ID NO: 898450 - RNA, 16 nt, Mycobacterium avium subsp. paratuberculosis
ccacagcugccggccg

SEQ ID NO: 898451 - RNA, 17 nt, Mycobacterium avium subsp. paratuberculosis
ccacagcugccggccgu

SEQ ID NO: 898452 - RNA, 14 nt, Mycobacterium avium subsp. paratuberculosis
ccaccgcucgucgg

SEQ ID NO: 898453 - RNA, 19 nt, Mycobacterium avium subsp. paratuberculosis
ccaccggaagcgcgcaucg

SEQ ID NO: 898454 - RNA, 13 nt, Mycobacterium avium subsp. paratuberculosis
ccaccgcgguggg

SEQ ID NO: 898455 - RNA, 15 nt, Mycobacterium avium subsp. paratuberculosis
ccaccgcggugagcg

SEQ ID NO: 898456 - RNA, 19 nt, Mycobacterium avium subsp. paratuberculosis
ccaccgcggugagcggccg

SEQ ID NO: 898457 - RNA, 21 nt, Mycobacterium avium subsp. paratuberculosis
ccaccgcggugagcggccgca

SEQ ID NO: 898458 - RNA, 22 nt, Mycobacterium avium subsp. paratuberculosis
ccaccgcggugagcggccgcag

SEQ ID NO: 898459 - RNA, 16 nt, Mycobacterium avium subsp. paratuberculosis
ccaccgcguccgcggu

SEQ ID NO: 898460 - RNA, 12 nt, Mycobacterium avium subsp. paratuberculosis
ccaccgcgucgc

SEQ ID NO: 898461 - RNA, 22 nt, Mycobacterium avium subsp. paratuberculosis
ccaccgcgucgcagugccggug

SEQ ID NO: 898462 - RNA, 17 nt, Mycobacterium avium subsp. paratuberculosis
ccaccgcgucggaggcc

SEQ ID NO: 898463 - RNA, 24 nt, Mycobacterium avium subsp. paratuberculosis
ccaccgcguugaucagcgccaggu

SEQ ID NO: 898464 - RNA, 14 nt, Mycobacterium avium subsp. paratuberculosis
ccaccggcaaucgg

SEQ ID NO: 898465 - RNA, 18 nt, Mycobacterium avium subsp. paratuberculosis
ccaccggcaaucgggacg

SEQ ID NO: 898466 - RNA, 12 nt, Mycobacterium avium subsp. paratuberculosis
ccaccggcacca

SEQ ID NO: 898467 - RNA, 18 nt, Mycobacterium avium subsp. paratuberculosis
ccaccgcugggcggcgcg

SEQ ID NO: 898468 - RNA, 20 nt, Mycobacterium avium subsp. paratuberculosis
ccaccgcugggcggcgcggc

SEQ ID NO: 898469 - RNA, 15 nt, Mycobacterium avium subsp. paratuberculosis
ccaccgcuguggaca

SEQ ID NO: 898470 - RNA, 13 nt, Mycobacterium avium subsp. paratuberculosis
ccaccggagcggc

SEQ ID NO: 898471 - RNA, 15 nt, Mycobacterium avium subsp. paratuberculosis
ccaccggagcggcgg

SEQ ID NO: 898472 - RNA, 18 nt, Mycobacterium avium subsp. paratuberculosis
ccaccggcaaccgccacg

SEQ ID NO: 898473 - RNA, 19 nt, Mycobacterium avium subsp. paratuberculosis
ccaccggcuuggccacgau

SEQ ID NO: 898474 - RNA, 14 nt, Mycobacterium avium subsp. paratuberculosis
ccaccgggcgucgg

SEQ ID NO: 898475 - RNA, 16 nt, Mycobacterium avium subsp. paratuberculosis
ccaccgggcgucggcg

SEQ ID NO: 898476 - RNA, 17 nt, Mycobacterium avium subsp. paratuberculosis
ccaccggcgcgacggcg

SEQ ID NO: 898477 - RNA, 22 nt, Mycobacterium avium subsp. paratuberculosis
ccaccgggaucacccucggcgu

SEQ ID NO: 898478 - RNA, 14 nt, Mycobacterium avium subsp. paratuberculosis
ccaccggcuggccg

SEQ ID NO: 898479 - RNA, 20 nt, Mycobacterium avium subsp. paratuberculosis
ccaccggcuccuugcgccgc

SEQ ID NO: 898480 - RNA, 11 nt, Mycobacterium avium subsp. paratuberculosis
ccaccggcgcg

SEQ ID NO: 898481 - RNA, 15 nt, Mycobacterium avium subsp. paratuberculosis
ccaccggcccagccg

SEQ ID NO: 898482 - RNA, 18 nt, Mycobacterium avium subsp. paratuberculosis
ccaccggcccagccggcg

SEQ ID NO: 898483 - RNA, 13 nt, Mycobacterium avium subsp. paratuberculosis
ccaccggccgguc

SEQ ID NO: 898484 - RNA, 12 nt, Mycobacterium avium subsp. paratuberculosis
ccaccggcacgg

SEQ ID NO: 898485 - RNA, 17 nt, Mycobacterium avium subsp. paratuberculosis
ccaccggcacggcaccg

SEQ ID NO: 898486 - RNA, 21 nt, Mycobacterium avium subsp. paratuberculosis
ccaccggcacggcaccgcgag

SEQ ID NO: 898487 - RNA, 12 nt, Mycobacterium avium subsp. paratuberculosis
ccaccggcaucg

SEQ ID NO: 898488 - RNA, 20 nt, Mycobacterium avium subsp. paratuberculosis
ccaccggccacucgcguccc

SEQ ID NO: 898489 - RNA, 12 nt, Mycobacterium avium subsp. paratuberculosis
ccaccggcccgg

SEQ ID NO: 898490 - RNA, 14 nt, Mycobacterium avium subsp. paratuberculosis
ccaccggcccggcc

SEQ ID NO: 898491 - RNA, 15 nt, Mycobacterium avium subsp. paratuberculosis
ccaccggcccggccg

SEQ ID NO: 898492 - RNA, 20 nt, Mycobacterium avium subsp. paratuberculosis
ccaccggcccggccggcgcg

SEQ ID NO: 898493 - RNA, 16 nt, Mycobacterium avium subsp. paratuberculosis
ccaccggcccggcggg

SEQ ID NO: 898494 - RNA, 23 nt, Mycobacterium avium subsp. paratuberculosis
ccaccggccgauggcccaggccg

SEQ ID NO: 898495 - RNA, 15 nt, Mycobacterium avium subsp. paratuberculosis
ccaccggccgcccgg

SEQ ID NO: 898496 - RNA, 17 nt, Mycobacterium avium subsp. paratuberculosis
ccaccggccgcccggcg

SEQ ID NO: 898497 - RNA, 18 nt, Mycobacterium avium subsp. paratuberculosis
ccaccggccgcccggcga

SEQ ID NO: 898498 - RNA, 19 nt, Mycobacterium avium subsp. paratuberculosis
ccaccggccgcccggcgag

SEQ ID NO: 898499 - RNA, 12 nt, Mycobacterium avium subsp. paratuberculosis
ccaccggccgcg

SEQ ID NO: 898500 - RNA, 13 nt, Mycobacterium avium subsp. paratuberculosis
ccaccgcggccag

SEQ ID NO: 898501 - RNA, 18 nt, Mycobacterium avium subsp. paratuberculosis
ccaccgcggccagcugcg

SEQ ID NO: 898502 - RNA, 13 nt, Mycobacterium avium subsp. paratuberculosis
ccaccgcgcggcg

SEQ ID NO: 898503 - RNA, 15 nt, Mycobacterium avium subsp. paratuberculosis
ccaccgcgcggcgca

SEQ ID NO: 898504 - RNA, 22 nt, Mycobacterium avium subsp. paratuberculosis
ccaccgcgccggcggcggcggu

SEQ ID NO: 898505 - RNA, 13 nt, Mycobacterium avium subsp. paratuberculosis
ccaccgcgccguc

SEQ ID NO: 898506 - RNA, 14 nt, Mycobacterium avium subsp. paratuberculosis
ccaccgcgcgcggg

SEQ ID NO: 898507 - RNA, 19 nt, Mycobacterium avium subsp. paratuberculosis
ccaccgcgcgcugccgcgc

SEQ ID NO: 898508 - RNA, 20 nt, Mycobacterium avium subsp. paratuberculosis
ccaccgcgcgcugccgcgcc

SEQ ID NO: 898509 - RNA, 14 nt, Mycobacterium avium subsp. paratuberculosis
ccaccgcggcggcc

SEQ ID NO: 898510 - RNA, 15 nt, Mycobacterium avium subsp. paratuberculosis
ccaccgcggcgauga

SEQ ID NO: 898511 - RNA, 14 nt, Mycobacterium avium subsp. paratuberculosis
ccaccgcggcgccg

SEQ ID NO: 898512 - RNA, 15 nt, Mycobacterium avium subsp. paratuberculosis
ccaccgcggcgccgu

SEQ ID NO: 898513 - RNA, 13 nt, Mycobacterium avium subsp. paratuberculosis
ccaccgcggcgcg

SEQ ID NO: 898514 - RNA, 19 nt, Mycobacterium avium subsp. paratuberculosis
ccaccgcggcgcgcggccg

SEQ ID NO: 898515 - RNA, 21 nt, Mycobacterium avium subsp. paratuberculosis
ccaccgcggcgcgcggccgcg

SEQ ID NO: 898516 - RNA, 14 nt, Mycobacterium avium subsp. paratuberculosis
ccaccgcgcggcgg

SEQ ID NO: 898517 - RNA, 21 nt, Mycobacterium avium subsp. paratuberculosis
ccaccgcggcguugcccgggu

SEQ ID NO: 898518 - RNA, 21 nt, Mycobacterium avium subsp. paratuberculosis
ccaccgcggggcugggcgcca

SEQ ID NO: 898519 - RNA, 15 nt, Mycobacterium avium subsp. paratuberculosis
ccaccgcgacacguc

SEQ ID NO: 898520 - RNA, 17 nt, Mycobacterium avium subsp. paratuberculosis
ccaccgcgacacgucga

SEQ ID NO: 898521 - RNA, 17 nt, Mycobacterium avium subsp. paratuberculosis
ccaccgcgacccggccg

SEQ ID NO: 898522 - RNA, 19 nt, Mycobacterium avium subsp. paratuberculosis
ccaccgcgacccggccgag

SEQ ID NO: 898523 - RNA, 20 nt, Mycobacterium avium subsp. paratuberculosis
ccaccgcgaaagcgucggcu

SEQ ID NO: 898524 - RNA, 14 nt, Mycobacterium avium subsp. paratuberculosis
ccaccgcgacgccc

SEQ ID NO: 898525 - RNA, 22 nt, Mycobacterium avium subsp. paratuberculosis
ccaccgcgacgcugccggggcg

SEQ ID NO: 898526 - RNA, 22 nt, Mycobacterium avium subsp. paratuberculosis
ccaccgcgcaaccgggccgcac

SEQ ID NO: 898527 - RNA, 16 nt, Mycobacterium avium subsp. paratuberculosis
ccaccgcgcccacccg

SEQ ID NO: 898528 - RNA, 23 nt, Mycobacterium avium subsp. paratuberculosis
ccaccgcgcccagccccagcacg

SEQ ID NO: 898529 - RNA, 18 nt, Mycobacterium avium subsp. paratuberculosis
ccaccgcgccccggcgca

SEQ ID NO: 898530 - RNA, 11 nt, Mycobacterium avium subsp. paratuberculosis
ccaccgcgccg

SEQ ID NO: 898531 - RNA, 12 nt, Mycobacterium avium subsp. paratuberculosis
ccaccgcgccgg

SEQ ID NO: 898532 - RNA, 18 nt, Mycobacterium avium subsp. paratuberculosis
ccaccgcgccgucgucga

SEQ ID NO: 898533 - RNA, 14 nt, Mycobacterium avium subsp. paratuberculosis
ccaccgcgccgugg

SEQ ID NO: 898534 - RNA, 21 nt, Mycobacterium avium subsp. paratuberculosis
ccaccgcgcgcaacgaggcgg

SEQ ID NO: 898535 - RNA, 18 nt, Mycobacterium avium subsp. paratuberculosis
ccaccgccccagccgacc

SEQ ID NO: 898536 - RNA, 15 nt, Mycobacterium avium subsp. paratuberculosis
ccaccgccaucucgg

SEQ ID NO: 898537 - RNA, 14 nt, Mycobacterium avium subsp. paratuberculosis
ccaccgcccgaacc

SEQ ID NO: 898538 - RNA, 21 nt, Mycobacterium avium subsp. paratuberculosis
ccaccgcccgaaccgcgucca

SEQ ID NO: 898539 - RNA, 20 nt, Mycobacterium avium subsp. paratuberculosis
ccaccgcccgcugaccgccg

SEQ ID NO: 898540 - RNA, 22 nt, Mycobacterium avium subsp. paratuberculosis
ccaccgcccgcugaccgccgcg

SEQ ID NO: 898541 - RNA, 14 nt, Mycobacterium avium subsp. paratuberculosis
ccaccgcccggaug

SEQ ID NO: 898542 - RNA, 21 nt, Mycobacterium avium subsp. paratuberculosis
ccaccgcccggaugccggcgc

SEQ ID NO: 898543 - RNA, 15 nt, Mycobacterium avium subsp. paratuberculosis
ccaccgccacggcgg

SEQ ID NO: 898544 - RNA, 12 nt, Mycobacterium avium subsp. paratuberculosis
ccaccgccacca

SEQ ID NO: 898545 - RNA, 14 nt, Mycobacterium avium subsp. paratuberculosis
ccaccgccaccagc

SEQ ID NO: 898546 - RNA, 14 nt, Mycobacterium avium subsp. paratuberculosis
ccaccgccugcgcg

SEQ ID NO: 898547 - RNA, 16 nt, Mycobacterium avium subsp. paratuberculosis
ccaccgccugcgcgau

SEQ ID NO: 898548 - RNA, 12 nt, Mycobacterium avium subsp. paratuberculosis
ccaccgccggcc

SEQ ID NO: 898549 - RNA, 15 nt, Mycobacterium avium subsp. paratuberculosis
ccaccgccggcccgg

SEQ ID NO: 898550 - RNA, 16 nt, Mycobacterium avium subsp. paratuberculosis
ccaccgccggcccggc

SEQ ID NO: 898551 - RNA, 18 nt, Mycobacterium avium subsp. paratuberculosis
ccaccgccggcccggcgu

SEQ ID NO: 898552 - RNA, 18 nt, Mycobacterium avium subsp. paratuberculosis
ccaccgccgucaccgcca

SEQ ID NO: 898553 - RNA, 19 nt, Mycobacterium avium subsp. paratuberculosis
ccaccgccgucaccgccag

SEQ ID NO: 898554 - RNA, 16 nt, Mycobacterium avium subsp. paratuberculosis
ccaccgccgccagcag

SEQ ID NO: 898555 - RNA, 21 nt, Mycobacterium avium subsp. paratuberculosis
ccaccgccgccagcagcagcg

SEQ ID NO: 898556 - RNA, 14 nt, Mycobacterium avium subsp. paratuberculosis
ccaccgccgccgac

SEQ ID NO: 898557 - RNA, 14 nt, Mycobacterium avium subsp. paratuberculosis
ccaccgccgcgccg

SEQ ID NO: 898558 - RNA, 15 nt, Mycobacterium avium subsp. paratuberculosis
ccaccgccgcgccga

SEQ ID NO: 898559 - RNA, 12 nt, Mycobacterium avium subsp. paratuberculosis
ccaccgccgaug

SEQ ID NO: 898560 - RNA, 13 nt, Mycobacterium avium subsp. paratuberculosis
ccaccgccgccag

SEQ ID NO: 898561 - RNA, 14 nt, Mycobacterium avium subsp. paratuberculosis
ccaccgccgcugcg

SEQ ID NO: 898562 - RNA, 21 nt, Mycobacterium avium subsp. paratuberculosis
ccaccagcgggcugugccggc

SEQ ID NO: 898563 - RNA, 15 nt, Mycobacterium avium subsp. paratuberculosis
ccaccagcgcagguc

SEQ ID NO: 898564 - RNA, 14 nt, Mycobacterium avium subsp. paratuberculosis
ccaccagcgccugg

SEQ ID NO: 898565 - RNA, 12 nt, Mycobacterium avium subsp. paratuberculosis
ccaccagcggcc

SEQ ID NO: 898566 - RNA, 13 nt, Mycobacterium avium subsp. paratuberculosis
ccaccagcggccg

SEQ ID NO: 898567 - RNA, 14 nt, Mycobacterium avium subsp. paratuberculosis
ccaccagcggccgg

SEQ ID NO: 898568 - RNA, 16 nt, Mycobacterium avium subsp. paratuberculosis
ccaccagcggccgucg

SEQ ID NO: 898569 - RNA, 17 nt, Mycobacterium avium subsp. paratuberculosis
ccaccagcggccgucgc

SEQ ID NO: 898570 - RNA, 21 nt, Mycobacterium avium subsp. paratuberculosis
ccaccagcggccgucgccggg

SEQ ID NO: 898571 - RNA, 17 nt, Mycobacterium avium subsp. paratuberculosis
ccaccagcgcggccacc

SEQ ID NO: 898572 - RNA, 13 nt, Mycobacterium avium subsp. paratuberculosis
ccaccagcgcggu

SEQ ID NO: 898573 - RNA, 12 nt, Mycobacterium avium subsp. paratuberculosis
ccaccagcgugc

SEQ ID NO: 898574 - RNA, 19 nt, Mycobacterium avium subsp. paratuberculosis
ccaccagcguuccagcacc

SEQ ID NO: 898575 - RNA, 15 nt, Mycobacterium avium subsp. paratuberculosis
ccaccagcucgucgc

SEQ ID NO: 898576 - RNA, 16 nt, Mycobacterium avium subsp. paratuberculosis
ccaccagcucgucgcc

SEQ ID NO: 898577 - RNA, 20 nt, Mycobacterium avium subsp. paratuberculosis
ccacccacucccagccgccg

SEQ ID NO: 898578 - RNA, 21 nt, Mycobacterium avium subsp. paratuberculosis
ccacccacucccagccgccgg

SEQ ID NO: 898579 - RNA, 23 nt, Mycobacterium avium subsp. paratuberculosis
ccacccacucccagccgccggcc

SEQ ID NO: 898580 - RNA, 12 nt, Mycobacterium avium subsp. paratuberculosis
ccacccaggcca

SEQ ID NO: 898581 - RNA, 16 nt, Mycobacterium avium subsp. paratuberculosis
ccacccaggccacccg

SEQ ID NO: 898582 - RNA, 20 nt, Mycobacterium avium subsp. paratuberculosis
ccacccaggccacccgggcg

SEQ ID NO: 898583 - RNA, 21 nt, Mycobacterium avium subsp. paratuberculosis
ccacccaggccacccgggcgc

SEQ ID NO: 898584 - RNA, 22 nt, Mycobacterium avium subsp. paratuberculosis
ccacccagguggaugcgagcca

SEQ ID NO: 898585 - RNA, 20 nt, Mycobacterium avium subsp. paratuberculosis
ccacccagguguccggcccg

SEQ ID NO: 898586 - RNA, 22 nt, Mycobacterium avium subsp. paratuberculosis
ccacccagguguccggcccgau

SEQ ID NO: 898587 - RNA, 23 nt, Mycobacterium avium subsp. paratuberculosis
ccacccagguguccggcccgaug

SEQ ID NO: 898588 - RNA, 19 nt, Mycobacterium avium subsp. paratuberculosis
ccaccccgaacccggccag

SEQ ID NO: 898589 - RNA, 12 nt, Mycobacterium avium subsp. paratuberculosis
ccaccccaggcg

SEQ ID NO: 898590 - RNA, 20 nt, Mycobacterium avium subsp. paratuberculosis
ccaccccgagcucgggcgcg

SEQ ID NO: 898591 - RNA, 17 nt, Mycobacterium avium subsp. paratuberculosis
ccaccccgaucggggcc

SEQ ID NO: 898592 - RNA, 16 nt, Mycobacterium avium subsp. paratuberculosis
ccaccccgccaaucac

SEQ ID NO: 898593 - RNA, 12 nt, Mycobacterium avium subsp. paratuberculosis
ccaccccggcgg

SEQ ID NO: 898594 - RNA, 21 nt, Mycobacterium avium subsp. paratuberculosis
ccaccccggcggucggaucga

SEQ ID NO: 898595 - RNA, 22 nt, Mycobacterium avium subsp. paratuberculosis
ccaccccgggaacgacggugcg

SEQ ID NO: 898596 - RNA, 12 nt, Mycobacterium avium subsp. paratuberculosis
ccacccgcacgg

SEQ ID NO: 898597 - RNA, 23 nt, Mycobacterium avium subsp. paratuberculosis
ccacccgcacggucgcggugucg

SEQ ID NO: 898598 - RNA, 16 nt, Mycobacterium avium subsp. paratuberculosis
ccacccgcagcgaggc

SEQ ID NO: 898599 - RNA, 16 nt, Mycobacterium avium subsp. paratuberculosis
ccacccgcagcgcggc

SEQ ID NO: 898600 - RNA, 18 nt, Mycobacterium avium subsp. paratuberculosis
ccacccgcagggcgccgg

SEQ ID NO: 898601 - RNA, 19 nt, Mycobacterium avium subsp. paratuberculosis
ccacccgaugaccggcccg

SEQ ID NO: 898602 - RNA, 22 nt, Mycobacterium avium subsp. paratuberculosis
ccacccgaugaccggcccggcg

SEQ ID NO: 898603 - RNA, 14 nt, Mycobacterium avium subsp. paratuberculosis
ccacccgggcgccg

SEQ ID NO: 898604 - RNA, 15 nt, Mycobacterium avium subsp. paratuberculosis
ccacccgggcgccgg

SEQ ID NO: 898605 - RNA, 20 nt, Mycobacterium avium subsp. paratuberculosis
ccacccugccgaccugcgcg

SEQ ID NO: 898606 - RNA, 20 nt, Mycobacterium avium subsp. paratuberculosis
ccacccugcgcaccgcggau

SEQ ID NO: 898607 - RNA, 14 nt, Mycobacterium avium subsp. paratuberculosis
ccacccgucgguga

SEQ ID NO: 898608 - RNA, 20 nt, Mycobacterium avium subsp. paratuberculosis
ccacccguuccucgacguag

SEQ ID NO: 898609 - RNA, 21 nt, Mycobacterium avium subsp. paratuberculosis
ccacccguuccucgacguagg

SEQ ID NO: 898610 - RNA, 18 nt, Mycobacterium avium subsp. paratuberculosis
ccacccguuggcaggccc

SEQ ID NO: 898611 - RNA, 15 nt, Mycobacterium avium subsp. paratuberculosis
ccacccucgccgccg

SEQ ID NO: 898612 - RNA, 20 nt, Mycobacterium avium subsp. paratuberculosis
ccacccucgccgccgccgau

SEQ ID NO: 898613 - RNA, 12 nt, Mycobacterium avium subsp. paratuberculosis
ccacccggggcc

SEQ ID NO: 898614 - RNA, 17 nt, Mycobacterium avium subsp. paratuberculosis
ccacccggggccguccg

SEQ ID NO: 898615 - RNA, 22 nt, Mycobacterium avium subsp. paratuberculosis
ccacccggggccguccgggaua

SEQ ID NO: 898616 - RNA, 16 nt, Mycobacterium avium subsp. paratuberculosis
ccacccggucgacgau

SEQ ID NO: 898617 - RNA, 22 nt, Mycobacterium avium subsp. paratuberculosis
ccacccggucgacgauggcccg

SEQ ID NO: 898618 - RNA, 15 nt, Mycobacterium avium subsp. paratuberculosis
ccacccggucgaugu

SEQ ID NO: 898619 - RNA, 13 nt, Mycobacterium avium subsp. paratuberculosis
ccacccggcgggc

SEQ ID NO: 898620 - RNA, 15 nt, Mycobacterium avium subsp. paratuberculosis
ccacccggcgggcca

SEQ ID NO: 898621 - RNA, 20 nt, Mycobacterium avium subsp. paratuberculosis
ccacccggugggacugggcg

SEQ ID NO: 898622 - RNA, 16 nt, Mycobacterium avium subsp. paratuberculosis
ccacccggacgaugac

SEQ ID NO: 898623 - RNA, 20 nt, Mycobacterium avium subsp. paratuberculosis
ccacccggaugucgugcggu

SEQ ID NO: 898624 - RNA, 13 nt, Mycobacterium avium subsp. paratuberculosis
ccacccgcgccgg

SEQ ID NO: 898625 - RNA, 12 nt, Mycobacterium avium subsp. paratuberculosis
ccacccgcgccg

SEQ ID NO: 898626 - RNA, 22 nt, Mycobacterium avium subsp. paratuberculosis
ccacccgcaccucgcccggcuc

SEQ ID NO: 898627 - RNA, 23 nt, Mycobacterium avium subsp. paratuberculosis
ccacccgcaccucgcccggcucg

SEQ ID NO: 898628 - RNA, 18 nt, Mycobacterium avium subsp. paratuberculosis
ccacccgcacgcccgggc

SEQ ID NO: 898629 - RNA, 15 nt, Mycobacterium avium subsp. paratuberculosis
ccacccgcaugcuga

SEQ ID NO: 898630 - RNA, 14 nt, Mycobacterium avium subsp. paratuberculosis
ccacccgcggccgg

SEQ ID NO: 898631 - RNA, 16 nt, Mycobacterium avium subsp. paratuberculosis
ccacccgcggccggcc

SEQ ID NO: 898632 - RNA, 21 nt, Mycobacterium avium subsp. paratuberculosis
ccaccgagaucaugccggcga

SEQ ID NO: 898633 - RNA, 17 nt, Mycobacterium avium subsp. paratuberculosis
ccaccgagugcggcgcg

SEQ ID NO: 898634 - RNA, 22 nt, Mycobacterium avium subsp. paratuberculosis
ccaccgagugcggcgcggugcg

SEQ ID NO: 898635 - RNA, 18 nt, Mycobacterium avium subsp. paratuberculosis
ccaccgaugcccgacacc

SEQ ID NO: 898636 - RNA, 14 nt, Mycobacterium avium subsp. paratuberculosis
ccaccgaugcgggc

SEQ ID NO: 898637 - RNA, 18 nt, Mycobacterium avium subsp. paratuberculosis
ccaccgaucgcgagggcc

SEQ ID NO: 898638 - RNA, 19 nt, Mycobacterium avium subsp. paratuberculosis
ccaccgagaucaugccggc

SEQ ID NO: 898639 - RNA, 20 nt, Mycobacterium avium subsp. paratuberculosis
ccaccgagaucaugccggcg

SEQ ID NO: 898640 - RNA, 16 nt, Mycobacterium avium subsp. paratuberculosis
ccaccgagccggcguc

SEQ ID NO: 898641 - RNA, 21 nt, Mycobacterium avium subsp. paratuberculosis
ccaccgagccggcgucgccgc

SEQ ID NO: 898642 - RNA, 20 nt, Mycobacterium avium subsp. paratuberculosis
ccaccgagccggugccgccc

SEQ ID NO: 898643 - RNA, 20 nt, Mycobacterium avium subsp. paratuberculosis
ccaccgaggugacgucgcgc

SEQ ID NO: 898644 - RNA, 23 nt, Mycobacterium avium subsp. paratuberculosis
ccaccgaggugacgucgcgccgc

SEQ ID NO: 898645 - RNA, 15 nt, Mycobacterium avium subsp. paratuberculosis
ccaccgagguggccc

SEQ ID NO: 898646 - RNA, 16 nt, Mycobacterium avium subsp. paratuberculosis
ccaccgagguggccca

SEQ ID NO: 898647 - RNA, 20 nt, Mycobacterium avium subsp. paratuberculosis
ccaccgaaucacccacggcc

SEQ ID NO: 898648 - RNA, 21 nt, Mycobacterium avium subsp. paratuberculosis
ccaccgaaucacccacggcca

SEQ ID NO: 898649 - RNA, 16 nt, Mycobacterium avium subsp. paratuberculosis
ccaccgacagccggac

SEQ ID NO: 898650 - RNA, 14 nt, Mycobacterium avium subsp. paratuberculosis
ccaccgacaucgaa

SEQ ID NO: 898651 - RNA, 15 nt, Mycobacterium avium subsp. paratuberculosis
ccaccgacgcggcgg

SEQ ID NO: 898652 - RNA, 19 nt, Mycobacterium avium subsp. paratuberculosis
ccaccgacgcgucgcggcg

SEQ ID NO: 898653 - RNA, 15 nt, Mycobacterium avium subsp. paratuberculosis
ccaccgacaccaccg

SEQ ID NO: 898654 - RNA, 18 nt, Mycobacterium avium subsp. paratuberculosis
ccaccgacaccaccggcc

SEQ ID NO: 898655 - RNA, 18 nt, Mycobacterium avium subsp. paratuberculosis
ccaccgaaaagcccgccg

SEQ ID NO: 898656 - RNA, 21 nt, Mycobacterium avium subsp. paratuberculosis
ccaccgaaaagcccgccgccu

SEQ ID NO: 898657 - RNA, 22 nt, Mycobacterium avium subsp. paratuberculosis
ccaccgaaaagcccgccgccuc

SEQ ID NO: 898658 - RNA, 17 nt, Mycobacterium avium subsp. paratuberculosis
cauugauauugaucgag

SEQ ID NO: 898659 - RNA, 19 nt, Mycobacterium avium subsp. paratuberculosis
cauugagccgcucgccggg

SEQ ID NO: 898660 - RNA, 13 nt, Mycobacterium avium subsp. paratuberculosis
ccaacaacucggg

SEQ ID NO: 898661 - RNA, 24 nt, Mycobacterium avium subsp. paratuberculosis
ccaacaacucggguguggacggcg

SEQ ID NO: 898662 - RNA, 23 nt, Mycobacterium avium subsp. paratuberculosis
ccaacaccagggugucgaugacg

SEQ ID NO: 898663 - RNA, 16 nt, Mycobacterium avium subsp. paratuberculosis
ccaacacggcggcgcg

SEQ ID NO: 898664 - RNA, 18 nt, Mycobacterium avium subsp. paratuberculosis
ccaacacgccccgacagg

SEQ ID NO: 898665 - RNA, 23 nt, Mycobacterium avium subsp. paratuberculosis
ccaacagugcgcaggcggcgcgc

SEQ ID NO: 898666 - RNA, 22 nt, Mycobacterium avium subsp. paratuberculosis
ccaacagcagcagaaccagcac

SEQ ID NO: 898667 - RNA, 20 nt, Mycobacterium avium subsp. paratuberculosis
ccaacagcagcgccgcggcc

SEQ ID NO: 898668 - RNA, 19 nt, Mycobacterium avium subsp. paratuberculosis
cauuucggacggcgacggc

SEQ ID NO: 898669 - RNA, 19 nt, Mycobacterium avium subsp. paratuberculosis
ccaaaaacugcgcgucgga

SEQ ID NO: 898670 - RNA, 17 nt, Mycobacterium avium subsp. paratuberculosis
cauguucggggcggaug

SEQ ID NO: 898671 - RNA, 20 nt, Mycobacterium avium subsp. paratuberculosis
cauguugugcccgacggcgc

SEQ ID NO: 898672 - RNA, 15 nt, Mycobacterium avium subsp. paratuberculosis
cauuccgucuuggcc

SEQ ID NO: 898673 - RNA, 21 nt, Mycobacterium avium subsp. paratuberculosis
cauuccgucuuggccaggccc

SEQ ID NO: 898674 - RNA, 13 nt, Mycobacterium avium subsp. paratuberculosis
cauucggcgacgc

SEQ ID NO: 898675 - RNA, 20 nt, Mycobacterium avium subsp. paratuberculosis
cauucggcgacgcucaggcg

SEQ ID NO: 898676 - RNA, 20 nt, Mycobacterium avium subsp. paratuberculosis
cauucggggccaccaggccg

SEQ ID NO: 898677 - RNA, 15 nt, Mycobacterium avium subsp. paratuberculosis
cauggcuuccgccga

SEQ ID NO: 898678 - RNA, 17 nt, Mycobacterium avium subsp. paratuberculosis
cauggcuuccgccgaga

SEQ ID NO: 898679 - RNA, 22 nt, Mycobacterium avium subsp. paratuberculosis
cauggcgaucaccccggcgacg

SEQ ID NO: 898680 - RNA, 14 nt, Mycobacterium avium subsp. paratuberculosis
cauggcuggcggca

SEQ ID NO: 898681 - RNA, 14 nt, Mycobacterium avium subsp. paratuberculosis
cauggcgcaccgcg

SEQ ID NO: 898682 - RNA, 15 nt, Mycobacterium avium subsp. paratuberculosis
cauggcgaccgcgac

SEQ ID NO: 898683 - RNA, 17 nt, Mycobacterium avium subsp. paratuberculosis
cauggcgaugacgucgu

SEQ ID NO: 898684 - RNA, 20 nt, Mycobacterium avium subsp. paratuberculosis
cauggcgaugacgucgucgc

SEQ ID NO: 898685 - RNA, 23 nt, Mycobacterium avium subsp. paratuberculosis
cauggcgaugacgucgucgcggc

SEQ ID NO: 898686 - RNA, 20 nt, Mycobacterium avium subsp. paratuberculosis
caugggcaucgucucggacc

SEQ ID NO: 898687 - RNA, 22 nt, Mycobacterium avium subsp. paratuberculosis
caugggcaucgucucggaccgg

SEQ ID NO: 898688 - RNA, 14 nt, Mycobacterium avium subsp. paratuberculosis
caugggcgugccgg

SEQ ID NO: 898689 - RNA, 23 nt, Mycobacterium avium subsp. paratuberculosis
caugggcgcguuggccggcugga

SEQ ID NO: 898690 - RNA, 14 nt, Mycobacterium avium subsp. paratuberculosis
caugcugccgccgg

SEQ ID NO: 898691 - RNA, 17 nt, Mycobacterium avium subsp. paratuberculosis
caugcugaucuuggcac

SEQ ID NO: 898692 - RNA, 17 nt, Mycobacterium avium subsp. paratuberculosis
caugcuggcacuccuug

SEQ ID NO: 898693 - RNA, 14 nt, Mycobacterium avium subsp. paratuberculosis
cauggccgucgggu

SEQ ID NO: 898694 - RNA, 21 nt, Mycobacterium avium subsp. paratuberculosis
cauggccgucgggucggcgag

SEQ ID NO: 898695 - RNA, 20 nt, Mycobacterium avium subsp. paratuberculosis
cauggccggcgaaccgccgc

SEQ ID NO: 898696 - RNA, 21 nt, Mycobacterium avium subsp. paratuberculosis
cauggccggcgaaccgccgca

SEQ ID NO: 898697 - RNA, 22 nt, Mycobacterium avium subsp. paratuberculosis
cauggccuccccauccgcggcc

SEQ ID NO: 898698 - RNA, 23 nt, Mycobacterium avium subsp. paratuberculosis
cauggccuccccauccgcggcca

SEQ ID NO: 898699 - RNA, 17 nt, Mycobacterium avium subsp. paratuberculosis
cauggcgaacacgucgg

SEQ ID NO: 898700 - RNA, 18 nt, Mycobacterium avium subsp. paratuberculosis
cauggcgaacacgucggc

SEQ ID NO: 898701 - RNA, 17 nt, Mycobacterium avium subsp. paratuberculosis
cauggccuugacgucgg

SEQ ID NO: 898702 - RNA, 20 nt, Mycobacterium avium subsp. paratuberculosis
cauggcgaacacgucggcca

SEQ ID NO: 898703 - RNA, 23 nt, Mycobacterium avium subsp. paratuberculosis
cauggcgaacacgucggccagcg

SEQ ID NO: 898704 - RNA, 15 nt, Mycobacterium avium subsp. paratuberculosis
cauguacaggaucaa

SEQ ID NO: 898705 - RNA, 13 nt, Mycobacterium avium subsp. paratuberculosis
cauguaccaggcg

SEQ ID NO: 898706 - RNA, 18 nt, Mycobacterium avium subsp. paratuberculosis
caugguguuccaccagcg

SEQ ID NO: 898707 - RNA, 19 nt, Mycobacterium avium subsp. paratuberculosis
cauggugucaggaucgccg

SEQ ID NO: 898708 - RNA, 21 nt, Mycobacterium avium subsp. paratuberculosis
cauggugucaggaucgccggu

SEQ ID NO: 898709 - RNA, 14 nt, Mycobacterium avium subsp. paratuberculosis
caugguggcggcgc

SEQ ID NO: 898710 - RNA, 16 nt, Mycobacterium avium subsp. paratuberculosis
caugguggcggcgccg

SEQ ID NO: 898711 - RNA, 17 nt, Mycobacterium avium subsp. paratuberculosis
caugguggcggcgccgg

SEQ ID NO: 898712 - RNA, 13 nt, Mycobacterium avium subsp. paratuberculosis
caugucgccgggc

SEQ ID NO: 898713 - RNA, 14 nt, Mycobacterium avium subsp. paratuberculosis
caugucgccggugc

SEQ ID NO: 898714 - RNA, 14 nt, Mycobacterium avium subsp. paratuberculosis
caugucggcgucgc

SEQ ID NO: 898715 - RNA, 23 nt, Mycobacterium avium subsp. paratuberculosis
caugucggcgucgccgagccgcg

SEQ ID NO: 898716 - RNA, 14 nt, Mycobacterium avium subsp. paratuberculosis
cauguagcggucgu

SEQ ID NO: 898717 - RNA, 15 nt, Mycobacterium avium subsp. paratuberculosis
cauguagcgcuggua

SEQ ID NO: 898718 - RNA, 17 nt, Mycobacterium avium subsp. paratuberculosis
cauguagcggucguaga

SEQ ID NO: 898719 - RNA, 22 nt, Mycobacterium avium subsp. paratuberculosis
cauguggggggucggagcgcuc

SEQ ID NO: 898720 - RNA, 16 nt, Mycobacterium avium subsp. paratuberculosis
caugugccacagguac

SEQ ID NO: 898721 - RNA, 19 nt, Mycobacterium avium subsp. paratuberculosis
cauguuccagaaccggcag

SEQ ID NO: 898722 - RNA, 22 nt, Mycobacterium avium subsp. paratuberculosis
caugugccgaugucugaucgcg

SEQ ID NO: 898723 - RNA, 17 nt, Mycobacterium avium subsp. paratuberculosis
caugugccgcaucuggu

SEQ ID NO: 898724 - RNA, 19 nt, Mycobacterium avium subsp. paratuberculosis
caugugaccggggucggcg

SEQ ID NO: 898725 - RNA, 15 nt, Mycobacterium avium subsp. paratuberculosis
cauguggaagccgcg

SEQ ID NO: 898726 - RNA, 22 nt, Mycobacterium avium subsp. paratuberculosis
cauguggaagccgcgaucggcg

SEQ ID NO: 898727 - RNA, 13 nt, Mycobacterium avium subsp. paratuberculosis
caugugcucggcg

SEQ ID NO: 898728 - RNA, 15 nt, Mycobacterium avium subsp. paratuberculosis
caugugcucggcgag

SEQ ID NO: 898729 - RNA, 18 nt, Mycobacterium avium subsp. paratuberculosis
caugugauuacuccucgc

SEQ ID NO: 898730 - RNA, 16 nt, Mycobacterium avium subsp. paratuberculosis
caugucgucggcggac

SEQ ID NO: 898731 - RNA, 17 nt, Mycobacterium avium subsp. paratuberculosis
caugucguugacgcugg

SEQ ID NO: 898732 - RNA, 20 nt, Mycobacterium avium subsp. paratuberculosis
caugucguugaugccgucga

SEQ ID NO: 898733 - RNA, 16 nt, Mycobacterium avium subsp. paratuberculosis
caugucguacgggcgc

SEQ ID NO: 898734 - RNA, 19 nt, Mycobacterium avium subsp. paratuberculosis
caugucguacgggcgcagc

SEQ ID NO: 898735 - RNA, 20 nt, Mycobacterium avium subsp. paratuberculosis
caugucguacgggcgcagcg

SEQ ID NO: 898736 - RNA, 20 nt, Mycobacterium avium subsp. paratuberculosis
caugucguaguagcggauca

SEQ ID NO: 898737 - RNA, 21 nt, Mycobacterium avium subsp. paratuberculosis
caugucgguaaggcaggcacu

SEQ ID NO: 898738 - RNA, 18 nt, Mycobacterium avium subsp. paratuberculosis
caugucgguggacagcgc

SEQ ID NO: 898739 - RNA, 20 nt, Mycobacterium avium subsp. paratuberculosis
caugauggugggcaccgcga

SEQ ID NO: 898740 - RNA, 15 nt, Mycobacterium avium subsp. paratuberculosis
caugauguagcggcg

SEQ ID NO: 898741 - RNA, 19 nt, Mycobacterium avium subsp. paratuberculosis
caugauguagcggcggucg

SEQ ID NO: 898742 - RNA, 22 nt, Mycobacterium avium subsp. paratuberculosis
caugauguagcggcggucggcg

SEQ ID NO: 898743 - RNA, 11 nt, Mycobacterium avium subsp. paratuberculosis
caucggcgugu

SEQ ID NO: 898744 - RNA, 17 nt, Mycobacterium avium subsp. paratuberculosis
caucggcucgaucguca

SEQ ID NO: 898745 - RNA, 14 nt, Mycobacterium avium subsp. paratuberculosis
caucggcucguagc

SEQ ID NO: 898746 - RNA, 14 nt, Mycobacterium avium subsp. paratuberculosis
caucggcggaagcu

SEQ ID NO: 898747 - RNA, 20 nt, Mycobacterium avium subsp. paratuberculosis
caucggcggaagcucaucga

SEQ ID NO: 898748 - RNA, 13 nt, Mycobacterium avium subsp. paratuberculosis
caucggcgccgga

SEQ ID NO: 898749 - RNA, 18 nt, Mycobacterium avium subsp. paratuberculosis
caucggcgcccucgccga

SEQ ID NO: 898750 - RNA, 14 nt, Mycobacterium avium subsp. paratuberculosis
caucggcgccgacg

SEQ ID NO: 898751 - RNA, 13 nt, Mycobacterium avium subsp. paratuberculosis
caucggcgacgcc

SEQ ID NO: 898752 - RNA, 16 nt, Mycobacterium avium subsp. paratuberculosis
caucggcgacgccgcc

SEQ ID NO: 898753 - RNA, 17 nt, Mycobacterium avium subsp. paratuberculosis
caucggcgacgccgccg

SEQ ID NO: 898754 - RNA, 20 nt, Mycobacterium avium subsp. paratuberculosis
caucggcgacgccgccgucg

SEQ ID NO: 898755 - RNA, 17 nt, Mycobacterium avium subsp. paratuberculosis
caugauuccgccgggcg

SEQ ID NO: 898756 - RNA, 22 nt, Mycobacterium avium subsp. paratuberculosis
caugcccaccaucccgccgccg

SEQ ID NO: 898757 - RNA, 23 nt, Mycobacterium avium subsp. paratuberculosis
caugcccaccaucccgccgccga

SEQ ID NO: 898758 - RNA, 21 nt, Mycobacterium avium subsp. paratuberculosis
caugcaccggugcaccgcgcg

SEQ ID NO: 898759 - RNA, 20 nt, Mycobacterium avium subsp. paratuberculosis
caugcccaugucgaucggcu

SEQ ID NO: 898760 - RNA, 16 nt, Mycobacterium avium subsp. paratuberculosis
caugcccacgccgucg

SEQ ID NO: 898761 - RNA, 16 nt, Mycobacterium avium subsp. paratuberculosis
caugcccagcaguccg

SEQ ID NO: 898762 - RNA, 19 nt, Mycobacterium avium subsp. paratuberculosis
caugcccgcggugcagucg

SEQ ID NO: 898763 - RNA, 13 nt, Mycobacterium avium subsp. paratuberculosis
caugcccgccacg

SEQ ID NO: 898764 - RNA, 21 nt, Mycobacterium avium subsp. paratuberculosis
caugcccgccacggccagcac

SEQ ID NO: 898765 - RNA, 23 nt, Mycobacterium avium subsp. paratuberculosis
caugcccgcccacgggucgccga

SEQ ID NO: 898766 - RNA, 17 nt, Mycobacterium avium subsp. paratuberculosis
caugccccaggugacgc

SEQ ID NO: 898767 - RNA, 19 nt, Mycobacterium avium subsp. paratuberculosis
caugccccaggugacgccg

SEQ ID NO: 898768 - RNA, 23 nt, Mycobacterium avium subsp. paratuberculosis
caugccggagaugaauucggcga

SEQ ID NO: 898769 - RNA, 21 nt, Mycobacterium avium subsp. paratuberculosis
caugccgggcaggaugccgcg

SEQ ID NO: 898770 - RNA, 14 nt, Mycobacterium avium subsp. paratuberculosis
caugccggcgccga

SEQ ID NO: 898771 - RNA, 14 nt, Mycobacterium avium subsp. paratuberculosis
caugccggcgucca

SEQ ID NO: 898772 - RNA, 14 nt, Mycobacterium avium subsp. paratuberculosis
caugccgcccauca

SEQ ID NO: 898773 - RNA, 18 nt, Mycobacterium avium subsp. paratuberculosis
caugccgcccaucacccc

SEQ ID NO: 898774 - RNA, 23 nt, Mycobacterium avium subsp. paratuberculosis
caugccgcccaucaccccgaagc

SEQ ID NO: 898775 - RNA, 16 nt, Mycobacterium avium subsp. paratuberculosis
caugcccggcgacggc

SEQ ID NO: 898776 - RNA, 18 nt, Mycobacterium avium subsp. paratuberculosis
caugccgccgaccgccga

SEQ ID NO: 898777 - RNA, 17 nt, Mycobacterium avium subsp. paratuberculosis
caugcccgggcgacuuc

SEQ ID NO: 898778 - RNA, 15 nt, Mycobacterium avium subsp. paratuberculosis
caugcguuugccguc

SEQ ID NO: 898779 - RNA, 16 nt, Mycobacterium avium subsp. paratuberculosis
caugcguuugccgucg

SEQ ID NO: 898780 - RNA, 23 nt, Mycobacterium avium subsp. paratuberculosis
ccagcguuugagcaccucuucga

SEQ ID NO: 898781 - RNA, 18 nt, Mycobacterium avium subsp. paratuberculosis
ccagcguuuccagcgccg

SEQ ID NO: 898782 - RNA, 19 nt, Mycobacterium avium subsp. paratuberculosis
ccagcguuuccagcgccgg

SEQ ID NO: 898783 - RNA, 22 nt, Mycobacterium avium subsp. paratuberculosis
ccagcguuuccuggugcaccag

SEQ ID NO: 898784 - RNA, 14 nt, Mycobacterium avium subsp. paratuberculosis
ccagcguucgucgc

SEQ ID NO: 898785 - RNA, 23 nt, Mycobacterium avium subsp. paratuberculosis
ccagcguucgucgccggugagca

SEQ ID NO: 898786 - RNA, 16 nt, Mycobacterium avium subsp. paratuberculosis
ccagcgugguaacgga

SEQ ID NO: 898787 - RNA, 14 nt, Mycobacterium avium subsp. paratuberculosis
ccagcgugucgccg

SEQ ID NO: 898788 - RNA, 15 nt, Mycobacterium avium subsp. paratuberculosis
ccagcgugucggcga

SEQ ID NO: 898789 - RNA, 16 nt, Mycobacterium avium subsp. paratuberculosis
ccagcgugucggcgau

SEQ ID NO: 898790 - RNA, 17 nt, Mycobacterium avium subsp. paratuberculosis
ccagcgugucggcgauc

SEQ ID NO: 898791 - RNA, 23 nt, Mycobacterium avium subsp. paratuberculosis
ccagcguguggcccugcgucauc

SEQ ID NO: 898792 - RNA, 14 nt, Mycobacterium avium subsp. paratuberculosis
ccagcguguugagc

SEQ ID NO: 898793 - RNA, 23 nt, Mycobacterium avium subsp. paratuberculosis
ccagcguguugagcucgcggcgc

SEQ ID NO: 898794 - RNA, 20 nt, Mycobacterium avium subsp. paratuberculosis
ccagcggcaacugggcggcc

SEQ ID NO: 898795 - RNA, 21 nt, Mycobacterium avium subsp. paratuberculosis
ccagcggcaacugggcggccu

SEQ ID NO: 898796 - RNA, 15 nt, Mycobacterium avium subsp. paratuberculosis
ccagcggaucggcgg

SEQ ID NO: 898797 - RNA, 20 nt, Mycobacterium avium subsp. paratuberculosis
ccagcggaucggcggucccg

SEQ ID NO: 898798 - RNA, 23 nt, Mycobacterium avium subsp. paratuberculosis
ccagcggccgaucauggucggcg

SEQ ID NO: 898799 - RNA, 17 nt, Mycobacterium avium subsp. paratuberculosis
ccagcggccgcagcgcg

SEQ ID NO: 898800 - RNA, 18 nt, Mycobacterium avium subsp. paratuberculosis
ccagcggccgcagcgcga

SEQ ID NO: 898801 - RNA, 13 nt, Mycobacterium avium subsp. paratuberculosis
ccagcggcgcacc

SEQ ID NO: 898802 - RNA, 13 nt, Mycobacterium avium subsp. paratuberculosis
ccagcggcgaugc

SEQ ID NO: 898803 - RNA, 12 nt, Mycobacterium avium subsp. paratuberculosis
ccagcggcgcac

SEQ ID NO: 898804 - RNA, 17 nt, Mycobacterium avium subsp. paratuberculosis
ccagcggccgucgccgg

SEQ ID NO: 898805 - RNA, 19 nt, Mycobacterium avium subsp. paratuberculosis
ccagcggccgucgccgggc

SEQ ID NO: 898806 - RNA, 20 nt, Mycobacterium avium subsp. paratuberculosis
ccagcggccggaacagcugg

SEQ ID NO: 898807 - RNA, 14 nt, Mycobacterium avium subsp. paratuberculosis
ccagcggccgggcg

SEQ ID NO: 898808 - RNA, 12 nt, Mycobacterium avium subsp. paratuberculosis
ccagcggcggcc

SEQ ID NO: 898809 - RNA, 13 nt, Mycobacterium avium subsp. paratuberculosis
ccagcggcggccc

SEQ ID NO: 898810 - RNA, 15 nt, Mycobacterium avium subsp. paratuberculosis
ccagcggcgcgucgc

SEQ ID NO: 898811 - RNA, 15 nt, Mycobacterium avium subsp. paratuberculosis
ccagcggcgcggccg

SEQ ID NO: 898812 - RNA, 16 nt, Mycobacterium avium subsp. paratuberculosis
ccagcggcgccggguc

SEQ ID NO: 898813 - RNA, 21 nt, Mycobacterium avium subsp. paratuberculosis
ccagcggcgccgggucaccgg

SEQ ID NO: 898814 - RNA, 16 nt, Mycobacterium avium subsp. paratuberculosis
ccagcggcgcgccggg

SEQ ID NO: 898815 - RNA, 17 nt, Mycobacterium avium subsp. paratuberculosis
ccagcggcgcgccgggc

SEQ ID NO: 898816 - RNA, 19 nt, Mycobacterium avium subsp. paratuberculosis
ccagcggcgcgccgggcag

SEQ ID NO: 898817 - RNA, 13 nt, Mycobacterium avium subsp. paratuberculosis
ccagcggcgccgg

SEQ ID NO: 898818 - RNA, 16 nt, Mycobacterium avium subsp. paratuberculosis
ccagcggcgcaccgug

SEQ ID NO: 898819 - RNA, 17 nt, Mycobacterium avium subsp. paratuberculosis
ccagcggcgcccacggc

SEQ ID NO: 898820 - RNA, 12 nt, Mycobacterium avium subsp. paratuberculosis
ccagcggcgccg

SEQ ID NO: 898821 - RNA, 13 nt, Mycobacterium avium subsp. paratuberculosis
ccagcggcgccga

SEQ ID NO: 898822 - RNA, 17 nt, Mycobacterium avium subsp. paratuberculosis
ccagcuccguccaccgg

SEQ ID NO: 898823 - RNA, 18 nt, Mycobacterium avium subsp. paratuberculosis
ccagcuccguccaccggc

SEQ ID NO: 898824 - RNA, 21 nt, Mycobacterium avium subsp. paratuberculosis
ccagcuccguccaccggcacg

SEQ ID NO: 898825 - RNA, 15 nt, Mycobacterium avium subsp. paratuberculosis
ccagcuccucggcca

SEQ ID NO: 898826 - RNA, 16 nt, Mycobacterium avium subsp. paratuberculosis
ccagcuccucggccag

SEQ ID NO: 898827 - RNA, 19 nt, Mycobacterium avium subsp. paratuberculosis
ccagcuccucggccagcac

SEQ ID NO: 898828 - RNA, 16 nt, Mycobacterium avium subsp. paratuberculosis
ccagcuccucggucag

SEQ ID NO: 898829 - RNA, 17 nt, Mycobacterium avium subsp. paratuberculosis
ccagcucgagcaucacg

SEQ ID NO: 898830 - RNA, 21 nt, Mycobacterium avium subsp. paratuberculosis
ccagcucgagcaucacgaacc

SEQ ID NO: 898831 - RNA, 20 nt, Mycobacterium avium subsp. paratuberculosis
ccagcucgaggccgcgggcg

SEQ ID NO: 898832 - RNA, 12 nt, Mycobacterium avium subsp. paratuberculosis
ccagcucgccga

SEQ ID NO: 898833 - RNA, 20 nt, Mycobacterium avium subsp. paratuberculosis
ccagcucgaacaccgucgag

SEQ ID NO: 898834 - RNA, 19 nt, Mycobacterium avium subsp. paratuberculosis
ccagcuccuggaagaaguc

SEQ ID NO: 898835 - RNA, 15 nt, Mycobacterium avium subsp. paratuberculosis
ccagcucgaccgcgg

SEQ ID NO: 898836 - RNA, 19 nt, Mycobacterium avium subsp. paratuberculosis
ccagcucgaccgcggcgau

SEQ ID NO: 898837 - RNA, 20 nt, Mycobacterium avium subsp. paratuberculosis
ccagcucaccggccagggcc

SEQ ID NO: 898838 - RNA, 15 nt, Mycobacterium avium subsp. paratuberculosis
ccagcucaccgggag

SEQ ID NO: 898839 - RNA, 19 nt, Mycobacterium avium subsp. paratuberculosis
ccagcucagacugccgagc

SEQ ID NO: 898840 - RNA, 13 nt, Mycobacterium avium subsp. paratuberculosis
ccagcuccacgcg

SEQ ID NO: 898841 - RNA, 21 nt, Mycobacterium avium subsp. paratuberculosis
ccagcuccacgcguagccgac

SEQ ID NO: 898842 - RNA, 14 nt, Mycobacterium avium subsp. paratuberculosis
ccagcuccagcagc

SEQ ID NO: 898843 - RNA, 23 nt, Mycobacterium avium subsp. paratuberculosis
ccagcucccaggacgcggugacg

SEQ ID NO: 898844 - RNA, 14 nt, Mycobacterium avium subsp. paratuberculosis
ccagcucccgggcg

SEQ ID NO: 898845 - RNA, 15 nt, Mycobacterium avium subsp. paratuberculosis
ccagcucccgggcgg

SEQ ID NO: 898846 - RNA, 21 nt, Mycobacterium avium subsp. paratuberculosis
ccagcucccgggcggcgccga

SEQ ID NO: 898847 - RNA, 14 nt, Mycobacterium avium subsp. paratuberculosis
ccagcuccgccgac

SEQ ID NO: 898848 - RNA, 19 nt, Mycobacterium avium subsp. paratuberculosis
ccagcuccgccgacaccag

SEQ ID NO: 898849 - RNA, 20 nt, Mycobacterium avium subsp. paratuberculosis
ccagcuccgcggccagcucg

SEQ ID NO: 898850 - RNA, 15 nt, Mycobacterium avium subsp. paratuberculosis
ccagcucguccagcg

SEQ ID NO: 898851 - RNA, 14 nt, Mycobacterium avium subsp. paratuberculosis
ccagcucggcgugg

SEQ ID NO: 898852 - RNA, 23 nt, Mycobacterium avium subsp. paratuberculosis
ccagcucggugaucugcaccagc

SEQ ID NO: 898853 - RNA, 12 nt, Mycobacterium avium subsp. paratuberculosis
ccagcucggugc

SEQ ID NO: 898854 - RNA, 13 nt, Mycobacterium avium subsp. paratuberculosis
ccagcucggugcg

SEQ ID NO: 898855 - RNA, 18 nt, Mycobacterium avium subsp. paratuberculosis
ccagcucggcggccgggu

SEQ ID NO: 898856 - RNA, 12 nt, Mycobacterium avium subsp. paratuberculosis
ccagcucggcgc

SEQ ID NO: 898857 - RNA, 14 nt, Mycobacterium avium subsp. paratuberculosis
ccagcucggcgcug

SEQ ID NO: 898858 - RNA, 22 nt, Mycobacterium avium subsp. paratuberculosis
ccagcucggcgcugucggcggg

SEQ ID NO: 898859 - RNA, 13 nt, Mycobacterium avium subsp. paratuberculosis
ccagcucggcggc

SEQ ID NO: 898860 - RNA, 14 nt, Mycobacterium avium subsp. paratuberculosis
ccagcucggcggcc

SEQ ID NO: 898861 - RNA, 17 nt, Mycobacterium avium subsp. paratuberculosis
ccagcucggcggccaug

SEQ ID NO: 898862 - RNA, 15 nt, Mycobacterium avium subsp. paratuberculosis
ccagcucggcggccg

SEQ ID NO: 898863 - RNA, 13 nt, Mycobacterium avium subsp. paratuberculosis
ccagcucggucag

SEQ ID NO: 898864 - RNA, 14 nt, Mycobacterium avium subsp. paratuberculosis
ccagcucggucagc

SEQ ID NO: 898865 - RNA, 19 nt, Mycobacterium avium subsp. paratuberculosis
ccagcucggucagccgggc

SEQ ID NO: 898866 - RNA, 22 nt, Mycobacterium avium subsp. paratuberculosis
ccagcucggucagccgggcggc

SEQ ID NO: 898867 - RNA, 22 nt, Mycobacterium avium subsp. paratuberculosis
ccagcucgcguucgggcccggc

SEQ ID NO: 898868 - RNA, 13 nt, Mycobacterium avium subsp. paratuberculosis
ccagcucgccgau

SEQ ID NO: 898869 - RNA, 14 nt, Mycobacterium avium subsp. paratuberculosis
ccagcucgccgaug

SEQ ID NO: 898870 - RNA, 24 nt, Mycobacterium avium subsp. paratuberculosis
ccagcucgccgauguggcgggcgu

SEQ ID NO: 898871 - RNA, 15 nt, Mycobacterium avium subsp. paratuberculosis
ccagcucgccgccga

SEQ ID NO: 898872 - RNA, 17 nt, Mycobacterium avium subsp. paratuberculosis
ccagcucgccgccgacg

SEQ ID NO: 898873 - RNA, 14 nt, Mycobacterium avium subsp. paratuberculosis
ccagcucgacgacu

SEQ ID NO: 898874 - RNA, 17 nt, Mycobacterium avium subsp. paratuberculosis
ccagcucggcccgcugc

SEQ ID NO: 898875 - RNA, 17 nt, Mycobacterium avium subsp. paratuberculosis
ccagcugaacacgaacc

SEQ ID NO: 898876 - RNA, 17 nt, Mycobacterium avium subsp. paratuberculosis
ccagcucguugccggcg

SEQ ID NO: 898877 - RNA, 14 nt, Mycobacterium avium subsp. paratuberculosis
ccagcucgucgagc

SEQ ID NO: 898878 - RNA, 20 nt, Mycobacterium avium subsp. paratuberculosis
ccagcucgucgagccggccg

SEQ ID NO: 898879 - RNA, 12 nt, Mycobacterium avium subsp. paratuberculosis
ccagcucgucgc

SEQ ID NO: 898880 - RNA, 18 nt, Mycobacterium avium subsp. paratuberculosis
ccagcugcacccaccggc

SEQ ID NO: 898881 - RNA, 14 nt, Mycobacterium avium subsp. paratuberculosis
ccagcugcaccggg

SEQ ID NO: 898882 - RNA, 15 nt, Mycobacterium avium subsp. paratuberculosis
ccagcugcaccgggg

SEQ ID NO: 898883 - RNA, 16 nt, Mycobacterium avium subsp. paratuberculosis
ccagcugcaccggggc

SEQ ID NO: 898884 - RNA, 17 nt, Mycobacterium avium subsp. paratuberculosis
ccagcugcaccggggcc

SEQ ID NO: 898885 - RNA, 18 nt, Mycobacterium avium subsp. paratuberculosis
ccagcugcaccggggccg

SEQ ID NO: 898886 - RNA, 21 nt, Mycobacterium avium subsp. paratuberculosis
ccagcugcaccggggccggcg

SEQ ID NO: 898887 - RNA, 19 nt, Mycobacterium avium subsp. paratuberculosis
ccagcugcgaaucgucggc

SEQ ID NO: 898888 - RNA, 20 nt, Mycobacterium avium subsp. paratuberculosis
ccagcugcgaaucgucggcg

SEQ ID NO: 898889 - RNA, 24 nt, Mycobacterium avium subsp. paratuberculosis
ccagcugcgaaucgucggcgaugg

SEQ ID NO: 898890 - RNA, 14 nt, Mycobacterium avium subsp. paratuberculosis
ccagcugcgcgccg

SEQ ID NO: 898891 - RNA, 17 nt, Mycobacterium avium subsp. paratuberculosis
ccagcugcgcgccggcg

SEQ ID NO: 898892 - RNA, 19 nt, Mycobacterium avium subsp. paratuberculosis
ccagcugcgcgccggcggc

SEQ ID NO: 898893 - RNA, 20 nt, Mycobacterium avium subsp. paratuberculosis
ccagcugcgcgccggcggcc

SEQ ID NO: 898894 - RNA, 17 nt, Mycobacterium avium subsp. paratuberculosis
ccagcugauucgcggug

SEQ ID NO: 898895 - RNA, 23 nt, Mycobacterium avium subsp. paratuberculosis
ccagcugauuguugacggugacc

SEQ ID NO: 898896 - RNA, 19 nt, Mycobacterium avium subsp. paratuberculosis
ccagcugcccgccgacgcc

SEQ ID NO: 898897 - RNA, 20 nt, Mycobacterium avium subsp. paratuberculosis
ccagcuggagaggcccggca

SEQ ID NO: 898898 - RNA, 21 nt, Mycobacterium avium subsp. paratuberculosis
ccagcuggagaggcccggcag

SEQ ID NO: 898899 - RNA, 22 nt, Mycobacterium avium subsp. paratuberculosis
ccagcuggagaggcccggcagc

SEQ ID NO: 898900 - RNA, 23 nt, Mycobacterium avium subsp. paratuberculosis
ccagcuggagaggcccggcagcc

SEQ ID NO: 898901 - RNA, 22 nt, Mycobacterium avium subsp. paratuberculosis
ccagcuggauggcgcccagccc

SEQ ID NO: 898902 - RNA, 23 nt, Mycobacterium avium subsp. paratuberculosis
ccagcuggauggcgcccagcccg

SEQ ID NO: 898903 - RNA, 15 nt, Mycobacterium avium subsp. paratuberculosis
ccagcugcgcgucgg

SEQ ID NO: 898904 - RNA, 17 nt, Mycobacterium avium subsp. paratuberculosis
ccagcugcgcgucggcc

SEQ ID NO: 898905 - RNA, 22 nt, Mycobacterium avium subsp. paratuberculosis
ccagcugcggaaaugcccgcgc

SEQ ID NO: 898906 - RNA, 12 nt, Mycobacterium avium subsp. paratuberculosis
ccagcugcgggu

SEQ ID NO: 898907 - RNA, 22 nt, Mycobacterium avium subsp. paratuberculosis
ccagcugcggguugcgggccag

SEQ ID NO: 898908 - RNA, 17 nt, Mycobacterium avium subsp. paratuberculosis
ccagcugucccagugcg

SEQ ID NO: 898909 - RNA, 15 nt, Mycobacterium avium subsp. paratuberculosis
ccagcugucgggugg

SEQ ID NO: 898910 - RNA, 23 nt, Mycobacterium avium subsp. paratuberculosis
ccagcuguugacgggccgcggcc

SEQ ID NO: 898911 - RNA, 23 nt, Mycobacterium avium subsp. paratuberculosis
ccagcuggguggucaccagcgcg

SEQ ID NO: 898912 - RNA, 17 nt, Mycobacterium avium subsp. paratuberculosis
ccagcuggugaagcugc

SEQ ID NO: 898913 - RNA, 21 nt, Mycobacterium avium subsp. paratuberculosis
ccagcuggugaagcugccgac

SEQ ID NO: 898914 - RNA, 16 nt, Mycobacterium avium subsp. paratuberculosis
ccagcugggccagcgc

SEQ ID NO: 898915 - RNA, 14 nt, Mycobacterium avium subsp. paratuberculosis
ccagcugggccgcc

SEQ ID NO: 898916 - RNA, 15 nt, Mycobacterium avium subsp. paratuberculosis
ccagcugggccgcca

SEQ ID NO: 898917 - RNA, 23 nt, Mycobacterium avium subsp. paratuberculosis
ccagcugggccgccagccgguac

SEQ ID NO: 898918 - RNA, 23 nt, Mycobacterium avium subsp. paratuberculosis
ccagcugggaggcgcacaacgag

SEQ ID NO: 898919 - RNA, 15 nt, Mycobacterium avium subsp. paratuberculosis
ccagcugggcagcca

SEQ ID NO: 898920 - RNA, 16 nt, Mycobacterium avium subsp. paratuberculosis
ccagcugggcagccag

SEQ ID NO: 898921 - RNA, 16 nt, Mycobacterium avium subsp. paratuberculosis
ccagcuucgggcgcgc

SEQ ID NO: 898922 - RNA, 18 nt, Mycobacterium avium subsp. paratuberculosis
ccagcuucucggcguccc

SEQ ID NO: 898923 - RNA, 19 nt, Mycobacterium avium subsp. paratuberculosis
ccagcugggcagccagauc

SEQ ID NO: 898924 - RNA, 13 nt, Mycobacterium avium subsp. paratuberculosis
ccagcuucaccgg

SEQ ID NO: 898925 - RNA, 14 nt, Mycobacterium avium subsp. paratuberculosis
ccagcuucaccggu

SEQ ID NO: 898926 - RNA, 15 nt, Mycobacterium avium subsp. paratuberculosis
ccagcuucaccgguc

SEQ ID NO: 898927 - RNA, 17 nt, Mycobacterium avium subsp. paratuberculosis
ccagcuucaccggucgg

SEQ ID NO: 898928 - RNA, 21 nt, Mycobacterium avium subsp. paratuberculosis
ccagcuucaccggucgggcca

SEQ ID NO: 898929 - RNA, 17 nt, Mycobacterium avium subsp. paratuberculosis
ccaggaaaaccagcgac

SEQ ID NO: 898930 - RNA, 20 nt, Mycobacterium avium subsp. paratuberculosis
ccaggaaaaccagcgacgcc

SEQ ID NO: 898931 - RNA, 23 nt, Mycobacterium avium subsp. paratuberculosis
ccaggaacacggcucgggggccg

SEQ ID NO: 898932 - RNA, 18 nt, Mycobacterium avium subsp. paratuberculosis
ccaggaaccacaccccgg

SEQ ID NO: 898933 - RNA, 21 nt, Mycobacterium avium subsp. paratuberculosis
ccaggaaccacaccccggcca

SEQ ID NO: 898934 - RNA, 17 nt, Mycobacterium avium subsp. paratuberculosis
ccaggaaacggcccauc

SEQ ID NO: 898935 - RNA, 17 nt, Mycobacterium avium subsp. paratuberculosis
ccagcuugaccacccgg

SEQ ID NO: 898936 - RNA, 23 nt, Mycobacterium avium subsp. paratuberculosis
ccagcuuggcgcccuugccgaug

SEQ ID NO: 898937 - RNA, 17 nt, Mycobacterium avium subsp. paratuberculosis
ccagcuuuccggccgcc

SEQ ID NO: 898938 - RNA, 22 nt, Mycobacterium avium subsp. paratuberculosis
ccaggaacgacacguggaccga

SEQ ID NO: 898939 - RNA, 14 nt, Mycobacterium avium subsp. paratuberculosis
ccaggaacgcgccg

SEQ ID NO: 898940 - RNA, 18 nt, Mycobacterium avium subsp. paratuberculosis
ccaggaacgcgccggcgc

SEQ ID NO: 898941 - RNA, 19 nt, Mycobacterium avium subsp. paratuberculosis
ccaggaacgcgccggcgca

SEQ ID NO: 898942 - RNA, 16 nt, Mycobacterium avium subsp. paratuberculosis
ccaggaacggcacccg

SEQ ID NO: 898943 - RNA, 19 nt, Mycobacterium avium subsp. paratuberculosis
ccaggaacggcacccgcag

SEQ ID NO: 898944 - RNA, 16 nt, Mycobacterium avium subsp. paratuberculosis
ccaggaacggcgccau

SEQ ID NO: 898945 - RNA, 17 nt, Mycobacterium avium subsp. paratuberculosis
ccaggaagaugccgauc

SEQ ID NO: 898946 - RNA, 15 nt, Mycobacterium avium subsp. paratuberculosis
ccaggaagaacccgg

SEQ ID NO: 898947 - RNA, 14 nt, Mycobacterium avium subsp. paratuberculosis
ccaggaccacccac

SEQ ID NO: 898948 - RNA, 23 nt, Mycobacterium avium subsp. paratuberculosis
ccaggaccacccacucccagccg

SEQ ID NO: 898949 - RNA, 17 nt, Mycobacterium avium subsp. paratuberculosis
ccaggaauaacgccggc

SEQ ID NO: 898950 - RNA, 16 nt, Mycobacterium avium subsp. paratuberculosis
ccaggaagccggcgac

SEQ ID NO: 898951 - RNA, 19 nt, Mycobacterium avium subsp. paratuberculosis
ccaggaagccggcgacgac

SEQ ID NO: 898952 - RNA, 20 nt, Mycobacterium avium subsp. paratuberculosis
ccaggaaguacaccaccgcg

SEQ ID NO: 898953 - RNA, 20 nt, Mycobacterium avium subsp. paratuberculosis
ccaggaaguacucggucacc

SEQ ID NO: 898954 - RNA, 23 nt, Mycobacterium avium subsp. paratuberculosis
ccaggaaguacucggucaccucg

SEQ ID NO: 898955 - RNA, 18 nt, Mycobacterium avium subsp. paratuberculosis
ccaggaaguagccggcca

SEQ ID NO: 898956 - RNA, 24 nt, Mycobacterium avium subsp. paratuberculosis
ccaggaaguagccggccagcgucg

SEQ ID NO: 898957 - RNA, 22 nt, Mycobacterium avium subsp. paratuberculosis
ccaggaaggccaguucgacgau

SEQ ID NO: 898958 - RNA, 14 nt, Mycobacterium avium subsp. paratuberculosis
ccaggagcaccugc

SEQ ID NO: 898959 - RNA, 18 nt, Mycobacterium avium subsp. paratuberculosis
ccaggagcaccugcgcga

SEQ ID NO: 898960 - RNA, 12 nt, Mycobacterium avium subsp. paratuberculosis
ccaggacggcgc

SEQ ID NO: 898961 - RNA, 14 nt, Mycobacterium avium subsp. paratuberculosis
ccaggacggcgcgg

SEQ ID NO: 898962 - RNA, 15 nt, Mycobacterium avium subsp. paratuberculosis
ccaggacggcgcggu

SEQ ID NO: 898963 - RNA, 12 nt, Mycobacterium avium subsp. paratuberculosis
ccaggacgucgg

SEQ ID NO: 898964 - RNA, 15 nt, Mycobacterium avium subsp. paratuberculosis
ccaggacgucggccg

SEQ ID NO: 898965 - RNA, 20 nt, Mycobacterium avium subsp. paratuberculosis
ccaggacgucggccggcugc

SEQ ID NO: 898966 - RNA, 15 nt, Mycobacterium avium subsp. paratuberculosis
ccaggacgcgaccgg

SEQ ID NO: 898967 - RNA, 16 nt, Mycobacterium avium subsp. paratuberculosis
ccaggacgcggugacg

SEQ ID NO: 898968 - RNA, 13 nt, Mycobacterium avium subsp. paratuberculosis
ccaggaccagcgg

SEQ ID NO: 898969 - RNA, 15 nt, Mycobacterium avium subsp. paratuberculosis
ccaggaccagcgggu

SEQ ID NO: 898970 - RNA, 14 nt, Mycobacterium avium subsp. paratuberculosis
ccaggaccgcgcgc

SEQ ID NO: 898971 - RNA, 16 nt, Mycobacterium avium subsp. paratuberculosis
ccaggaccgcgcgccg

SEQ ID NO: 898972 - RNA, 14 nt, Mycobacterium avium subsp. paratuberculosis
ccagcgcucgacga

SEQ ID NO: 898973 - RNA, 19 nt, Mycobacterium avium subsp. paratuberculosis
ccagcgcucgacgaggcgg

SEQ ID NO: 898974 - RNA, 21 nt, Mycobacterium avium subsp. paratuberculosis
ccagcgcucgacgaggcgggc

SEQ ID NO: 898975 - RNA, 13 nt, Mycobacterium avium subsp. paratuberculosis
ccagcgcuggccg

SEQ ID NO: 898976 - RNA, 16 nt, Mycobacterium avium subsp. paratuberculosis
ccagcgcuggccggcc

SEQ ID NO: 898977 - RNA, 18 nt, Mycobacterium avium subsp. paratuberculosis
ccagcgcuggccggccac

SEQ ID NO: 898978 - RNA, 16 nt, Mycobacterium avium subsp. paratuberculosis
ccagcgcugguaccgg

SEQ ID NO: 898979 - RNA, 22 nt, Mycobacterium avium subsp. paratuberculosis
ccagcgcguugaagcugacgau

SEQ ID NO: 898980 - RNA, 19 nt, Mycobacterium avium subsp. paratuberculosis
ccagcgcguugcggccguc

SEQ ID NO: 898981 - RNA, 16 nt, Mycobacterium avium subsp. paratuberculosis
ccagcgcgucggccag

SEQ ID NO: 898982 - RNA, 22 nt, Mycobacterium avium subsp. paratuberculosis
ccagcgcgucggccagcaccac

SEQ ID NO: 898983 - RNA, 13 nt, Mycobacterium avium subsp. paratuberculosis
ccagcgcgugauc

SEQ ID NO: 898984 - RNA, 17 nt, Mycobacterium avium subsp. paratuberculosis
ccagcgcgugcggggug

SEQ ID NO: 898985 - RNA, 18 nt, Mycobacterium avium subsp. paratuberculosis
ccagcggaaccgggggcc

SEQ ID NO: 898986 - RNA, 19 nt, Mycobacterium avium subsp. paratuberculosis
ccagcggaaccgggggccg

SEQ ID NO: 898987 - RNA, 23 nt, Mycobacterium avium subsp. paratuberculosis
ccagcggaaccgggggccgucac

SEQ ID NO: 898988 - RNA, 18 nt, Mycobacterium avium subsp. paratuberculosis
ccagcggaucgagguagc

SEQ ID NO: 898989 - RNA, 12 nt, Mycobacterium avium subsp. paratuberculosis
ccagcggagcgu

SEQ ID NO: 898990 - RNA, 15 nt, Mycobacterium avium subsp. paratuberculosis
ccagcgcgucggcca

SEQ ID NO: 898991 - RNA, 20 nt, Mycobacterium avium subsp. paratuberculosis
ccagcgcgucgcacagcgcc

SEQ ID NO: 898992 - RNA, 22 nt, Mycobacterium avium subsp. paratuberculosis
ccagcgcgucgcacagcgccgc

SEQ ID NO: 898993 - RNA, 13 nt, Mycobacterium avium subsp. paratuberculosis
ccagcgcggugug

SEQ ID NO: 898994 - RNA, 18 nt, Mycobacterium avium subsp. paratuberculosis
ccagcgcggugugcggcg

SEQ ID NO: 898995 - RNA, 22 nt, Mycobacterium avium subsp. paratuberculosis
ccagcgcggugugcggcggcuc

SEQ ID NO: 898996 - RNA, 14 nt, Mycobacterium avium subsp. paratuberculosis
ccagcgcgguggcc

SEQ ID NO: 898997 - RNA, 21 nt, Mycobacterium avium subsp. paratuberculosis
ccagcgcguagucggcgucgg

SEQ ID NO: 898998 - RNA, 23 nt, Mycobacterium avium subsp. paratuberculosis
ccagcgcguagucggcgucggcc

SEQ ID NO: 898999 - RNA, 15 nt, Mycobacterium avium subsp. paratuberculosis
ccagcgcggcggcca

SEQ ID NO: 899000 - RNA, 19 nt, Mycobacterium avium subsp. paratuberculosis
ccagcgcggggucggccag

SEQ ID NO: 899001 - RNA, 13 nt, Mycobacterium avium subsp. paratuberculosis
ccagcgcggucaa

SEQ ID NO: 899002 - RNA, 24 nt, Mycobacterium avium subsp. paratuberculosis
ccagcgcggucgccaccaccagcg

SEQ ID NO: 899003 - RNA, 15 nt, Mycobacterium avium subsp. paratuberculosis
ccagcgcggucucga

SEQ ID NO: 899004 - RNA, 12 nt, Mycobacterium avium subsp. paratuberculosis
ccagcgcgguga

SEQ ID NO: 899005 - RNA, 21 nt, Mycobacterium avium subsp. paratuberculosis
ccagcgcggugaagucggugc

SEQ ID NO: 899006 - RNA, 13 nt, Mycobacterium avium subsp. paratuberculosis
ccagcgcggugag

SEQ ID NO: 899007 - RNA, 14 nt, Mycobacterium avium subsp. paratuberculosis
ccagcgcggugaug

SEQ ID NO: 899008 - RNA, 15 nt, Mycobacterium avium subsp. paratuberculosis
ccagcgcggugccca

SEQ ID NO: 899009 - RNA, 16 nt, Mycobacterium avium subsp. paratuberculosis
ccagcgcggugcccag

SEQ ID NO: 899010 - RNA, 23 nt, Mycobacterium avium subsp. paratuberculosis
ccagcgcggugcccagccaggcc

SEQ ID NO: 899011 - RNA, 14 nt, Mycobacterium avium subsp. paratuberculosis
ccagcgcggugccg

SEQ ID NO: 899012 - RNA, 15 nt, Mycobacterium avium subsp. paratuberculosis
ccagcgcggugccgg

SEQ ID NO: 899013 - RNA, 16 nt, Mycobacterium avium subsp. paratuberculosis
ccagcgcggcgucacc

SEQ ID NO: 899014 - RNA, 17 nt, Mycobacterium avium subsp. paratuberculosis
ccagcgcggcggcgccg

SEQ ID NO: 899015 - RNA, 18 nt, Mycobacterium avium subsp. paratuberculosis
ccagcgcggcggcgccgu

SEQ ID NO: 899016 - RNA, 19 nt, Mycobacterium avium subsp. paratuberculosis
ccagcgcggcggcgccguc

SEQ ID NO: 899017 - RNA, 16 nt, Mycobacterium avium subsp. paratuberculosis
ccagcgcggcgaucag

SEQ ID NO: 899018 - RNA, 12 nt, Mycobacterium avium subsp. paratuberculosis
ccagcgcggcgg

SEQ ID NO: 899019 - RNA, 15 nt, Mycobacterium avium subsp. paratuberculosis
ccagcgcggccgggc

SEQ ID NO: 899020 - RNA, 16 nt, Mycobacterium avium subsp. paratuberculosis
ccagcgcggccaccac

SEQ ID NO: 899021 - RNA, 21 nt, Mycobacterium avium subsp. paratuberculosis
ccagcgcggccaccaccacgg

SEQ ID NO: 899022 - RNA, 14 nt, Mycobacterium avium subsp. paratuberculosis
ccagcgcgaacagc

SEQ ID NO: 899023 - RNA, 16 nt, Mycobacterium avium subsp. paratuberculosis
ccagcgcgaacagcgc

SEQ ID NO: 899024 - RNA, 20 nt, Mycobacterium avium subsp. paratuberculosis
ccagcgcgaacagcgcggcc

SEQ ID NO: 899025 - RNA, 17 nt, Mycobacterium avium subsp. paratuberculosis
ccagcgccuucggcgcc

SEQ ID NO: 899026 - RNA, 18 nt, Mycobacterium avium subsp. paratuberculosis
ccagcgccuucggcgcca

SEQ ID NO: 899027 - RNA, 19 nt, Mycobacterium avium subsp. paratuberculosis
ccagcgccuucggcgccag

SEQ ID NO: 899028 - RNA, 17 nt, Mycobacterium avium subsp. paratuberculosis
ccagcgcccgcccggac

SEQ ID NO: 899029 - RNA, 20 nt, Mycobacterium avium subsp. paratuberculosis
ccagcgcccgcccggacacc

SEQ ID NO: 899030 - RNA, 14 nt, Mycobacterium avium subsp. paratuberculosis
ccagcgcccgccgc

SEQ ID NO: 899031 - RNA, 19 nt, Mycobacterium avium subsp. paratuberculosis
ccagcgccucggccugcgc

SEQ ID NO: 899032 - RNA, 24 nt, Mycobacterium avium subsp. paratuberculosis
ccagcgccucggccugcgcccggc

SEQ ID NO: 899033 - RNA, 15 nt, Mycobacterium avium subsp. paratuberculosis
ccagcgccucggcgu

SEQ ID NO: 899034 - RNA, 16 nt, Mycobacterium avium subsp. paratuberculosis
ccagcgccucggcguc

SEQ ID NO: 899035 - RNA, 23 nt, Mycobacterium avium subsp. paratuberculosis
ccagcgccucggcgucaccgcgg

SEQ ID NO: 899036 - RNA, 14 nt, Mycobacterium avium subsp. paratuberculosis
ccagcgcggacacc

SEQ ID NO: 899037 - RNA, 14 nt, Mycobacterium avium subsp. paratuberculosis
ccagcgcgaggucc

SEQ ID NO: 899038 - RNA, 15 nt, Mycobacterium avium subsp. paratuberculosis
ccagcgcgaggucga

SEQ ID NO: 899039 - RNA, 16 nt, Mycobacterium avium subsp. paratuberculosis
ccagcgcgaucgccgg

SEQ ID NO: 899040 - RNA, 14 nt, Mycobacterium avium subsp. paratuberculosis
ccagcgcgcacgcg

SEQ ID NO: 899041 - RNA, 18 nt, Mycobacterium avium subsp. paratuberculosis
ccagcgcgcacgcggaca

SEQ ID NO: 899042 - RNA, 15 nt, Mycobacterium avium subsp. paratuberculosis
ccagcgcgaccgccc

SEQ ID NO: 899043 - RNA, 21 nt, Mycobacterium avium subsp. paratuberculosis
ccagcgcgaccgcccgggcca

SEQ ID NO: 899044 - RNA, 14 nt, Mycobacterium avium subsp. paratuberculosis
ccagcgcgacggcc

SEQ ID NO: 899045 - RNA, 13 nt, Mycobacterium avium subsp. paratuberculosis
ccagcgcacacag

SEQ ID NO: 899046 - RNA, 16 nt, Mycobacterium avium subsp. paratuberculosis
ccagcgcacacagcag

SEQ ID NO: 899047 - RNA, 18 nt, Mycobacterium avium subsp. paratuberculosis
ccagcgauucccgccgga

SEQ ID NO: 899048 - RNA, 14 nt, Mycobacterium avium subsp. paratuberculosis
ccagcgcaaccgcg

SEQ ID NO: 899049 - RNA, 16 nt, Mycobacterium avium subsp. paratuberculosis
ccagcgcaaccgcggc

SEQ ID NO: 899050 - RNA, 18 nt, Mycobacterium avium subsp. paratuberculosis
ccagcgcaaccgcggcgg

SEQ ID NO: 899051 - RNA, 13 nt, Mycobacterium avium subsp. paratuberculosis
ccagcgcaacggc

SEQ ID NO: 899052 - RNA, 15 nt, Mycobacterium avium subsp. paratuberculosis
ccagcgcaacggcgu

SEQ ID NO: 899053 - RNA, 16 nt, Mycobacterium avium subsp. paratuberculosis
ccagcgcaacggcguc

SEQ ID NO: 899054 - RNA, 18 nt, Mycobacterium avium subsp. paratuberculosis
ccagcgccaugccgccga

SEQ ID NO: 899055 - RNA, 15 nt, Mycobacterium avium subsp. paratuberculosis
ccagcgccccgccgg

SEQ ID NO: 899056 - RNA, 19 nt, Mycobacterium avium subsp. paratuberculosis
ccagcgccccgccggggga

SEQ ID NO: 899057 - RNA, 14 nt, Mycobacterium avium subsp. paratuberculosis
ccagcgccacgggu

SEQ ID NO: 899058 - RNA, 20 nt, Mycobacterium avium subsp. paratuberculosis
ccagcgccacgguggcgguc

SEQ ID NO: 899059 - RNA, 21 nt, Mycobacterium avium subsp. paratuberculosis
ccagcgccacuggcuggucac

SEQ ID NO: 899060 - RNA, 14 nt, Mycobacterium avium subsp. paratuberculosis
ccagcgacagcacc

SEQ ID NO: 899061 - RNA, 15 nt, Mycobacterium avium subsp. paratuberculosis
ccagcgacagcaccc

SEQ ID NO: 899062 - RNA, 17 nt, Mycobacterium avium subsp. paratuberculosis
ccagcgacaacagcacg

SEQ ID NO: 899063 - RNA, 18 nt, Mycobacterium avium subsp. paratuberculosis
ccagcgacaacagcacga

SEQ ID NO: 899064 - RNA, 19 nt, Mycobacterium avium subsp. paratuberculosis
ccagcgacaacagcacgaa

SEQ ID NO: 899065 - RNA, 15 nt, Mycobacterium avium subsp. paratuberculosis
ccagcgacaacgugg

SEQ ID NO: 899066 - RNA, 18 nt, Mycobacterium avium subsp. paratuberculosis
ccagcgacaacguggugu

SEQ ID NO: 899067 - RNA, 19 nt, Mycobacterium avium subsp. paratuberculosis
ccagcgacaacguggugug

SEQ ID NO: 899068 - RNA, 16 nt, Mycobacterium avium subsp. paratuberculosis
ccagcgaaucgaccgg

SEQ ID NO: 899069 - RNA, 19 nt, Mycobacterium avium subsp. paratuberculosis
ccagcgauacccguugcgc

SEQ ID NO: 899070 - RNA, 20 nt, Mycobacterium avium subsp. paratuberculosis
ccagcgagucgaugaccucg

SEQ ID NO: 899071 - RNA, 21 nt, Mycobacterium avium subsp. paratuberculosis
ccagcgagucgaugaccucgc

SEQ ID NO: 899072 - RNA, 19 nt, Mycobacterium avium subsp. paratuberculosis
ccagcgaguuggccaucgu

SEQ ID NO: 899073 - RNA, 18 nt, Mycobacterium avium subsp. paratuberculosis
ccagcgaccgcaggucga

SEQ ID NO: 899074 - RNA, 20 nt, Mycobacterium avium subsp. paratuberculosis
ccagcgaguccagccagccg

SEQ ID NO: 899075 - RNA, 21 nt, Mycobacterium avium subsp. paratuberculosis
ccagccgucguugcgggcggc

SEQ ID NO: 899076 - RNA, 16 nt, Mycobacterium avium subsp. paratuberculosis
ccagccgugcggcggc

SEQ ID NO: 899077 - RNA, 18 nt, Mycobacterium avium subsp. paratuberculosis
ccagccgugcggcggcgg

SEQ ID NO: 899078 - RNA, 20 nt, Mycobacterium avium subsp. paratuberculosis
ccagccguugggcagcucgg

SEQ ID NO: 899079 - RNA, 18 nt, Mycobacterium avium subsp. paratuberculosis
ccagccguucgcgcacgg

SEQ ID NO: 899080 - RNA, 22 nt, Mycobacterium avium subsp. paratuberculosis
ccagccguucgcgcacggcgcg

SEQ ID NO: 899081 - RNA, 21 nt, Mycobacterium avium subsp. paratuberculosis
ccagccuugcagccgcugccg

SEQ ID NO: 899082 - RNA, 20 nt, Mycobacterium avium subsp. paratuberculosis
ccagccuggcggcgacccgg

SEQ ID NO: 899083 - RNA, 17 nt, Mycobacterium avium subsp. paratuberculosis
ccagccucuugaacgcg

SEQ ID NO: 899084 - RNA, 17 nt, Mycobacterium avium subsp. paratuberculosis
ccagccuucgccgcacg

SEQ ID NO: 899085 - RNA, 13 nt, Mycobacterium avium subsp. paratuberculosis
ccagcaucgccgc

SEQ ID NO: 899086 - RNA, 16 nt, Mycobacterium avium subsp. paratuberculosis
ccagcaugaucaccgc

SEQ ID NO: 899087 - RNA, 20 nt, Mycobacterium avium subsp. paratuberculosis
ccagcaugaucaccgccagc

SEQ ID NO: 899088 - RNA, 15 nt, Mycobacterium avium subsp. paratuberculosis
ccagccggacagcgg

SEQ ID NO: 899089 - RNA, 18 nt, Mycobacterium avium subsp. paratuberculosis
ccagcaugcgccagagcg

SEQ ID NO: 899090 - RNA, 21 nt, Mycobacterium avium subsp. paratuberculosis
ccagcaugcgccagagcgcga

SEQ ID NO: 899091 - RNA, 13 nt, Mycobacterium avium subsp. paratuberculosis
ccagccggcccgc

SEQ ID NO: 899092 - RNA, 15 nt, Mycobacterium avium subsp. paratuberculosis
ccagccggccgacgc

SEQ ID NO: 899093 - RNA, 17 nt, Mycobacterium avium subsp. paratuberculosis
ccagccggccgacgcgg

SEQ ID NO: 899094 - RNA, 20 nt, Mycobacterium avium subsp. paratuberculosis
ccagccggccgacgcggccu

SEQ ID NO: 899095 - RNA, 16 nt, Mycobacterium avium subsp. paratuberculosis
ccagccggccgcugag

SEQ ID NO: 899096 - RNA, 12 nt, Mycobacterium avium subsp. paratuberculosis
ccagccggccgg

SEQ ID NO: 899097 - RNA, 14 nt, Mycobacterium avium subsp. paratuberculosis
ccagccggccggcg

SEQ ID NO: 899098 - RNA, 15 nt, Mycobacterium avium subsp. paratuberculosis
ccagccggccggcga

SEQ ID NO: 899099 - RNA, 21 nt, Mycobacterium avium subsp. paratuberculosis
ccagccgguacggaucgccgg

SEQ ID NO: 899100 - RNA, 15 nt, Mycobacterium avium subsp. paratuberculosis
ccagccgggccgagc

SEQ ID NO: 899101 - RNA, 21 nt, Mycobacterium avium subsp. paratuberculosis
ccagccgggccgagcgcgccg

SEQ ID NO: 899102 - RNA, 22 nt, Mycobacterium avium subsp. paratuberculosis
ccagccgggccgagcgcgccgc

SEQ ID NO: 899103 - RNA, 17 nt, Mycobacterium avium subsp. paratuberculosis
ccagccgggcgaccguc

SEQ ID NO: 899104 - RNA, 13 nt, Mycobacterium avium subsp. paratuberculosis
ccagccggcggug

SEQ ID NO: 899105 - RNA, 15 nt, Mycobacterium avium subsp. paratuberculosis
ccagccggcgcacca

SEQ ID NO: 899106 - RNA, 17 nt, Mycobacterium avium subsp. paratuberculosis
ccagccggcgcaccagg

SEQ ID NO: 899107 - RNA, 13 nt, Mycobacterium avium subsp. paratuberculosis
ccagccgggggau

SEQ ID NO: 899108 - RNA, 19 nt, Mycobacterium avium subsp. paratuberculosis
ccagccgggggaucaccuc

SEQ ID NO: 899109 - RNA, 17 nt, Mycobacterium avium subsp. paratuberculosis
ccagccgguaugcgauc

SEQ ID NO: 899110 - RNA, 20 nt, Mycobacterium avium subsp. paratuberculosis
ccagccgguaugcgaucgcg

SEQ ID NO: 899111 - RNA, 16 nt, Mycobacterium avium subsp. paratuberculosis
ccagccggucgccggg

SEQ ID NO: 899112 - RNA, 19 nt, Mycobacterium avium subsp. paratuberculosis
ccagccggucgccgggccg

SEQ ID NO: 899113 - RNA, 12 nt, Mycobacterium avium subsp. paratuberculosis
ccagccggucgu

SEQ ID NO: 899114 - RNA, 12 nt, Mycobacterium avium subsp. paratuberculosis
ccagccggugcg

SEQ ID NO: 899115 - RNA, 17 nt, Mycobacterium avium subsp. paratuberculosis
ccagccggugcgagccg

SEQ ID NO: 899116 - RNA, 13 nt, Mycobacterium avium subsp. paratuberculosis
ccagccggugcug

SEQ ID NO: 899117 - RNA, 24 nt, Mycobacterium avium subsp. paratuberculosis
ccagccggugcugacccggucgcg

SEQ ID NO: 899118 - RNA, 15 nt, Mycobacterium avium subsp. paratuberculosis
ccagccgguggcggc

SEQ ID NO: 899119 - RNA, 16 nt, Mycobacterium avium subsp. paratuberculosis
ccagccgguggcggcc

SEQ ID NO: 899120 - RNA, 23 nt, Mycobacterium avium subsp. paratuberculosis
ccagccggucuuggacagcagca

SEQ ID NO: 899121 - RNA, 19 nt, Mycobacterium avium subsp. paratuberculosis
ccagccgguugcgguggcc

SEQ ID NO: 899122 - RNA, 17 nt, Mycobacterium avium subsp. paratuberculosis
ccagccgucccgccguc

SEQ ID NO: 899123 - RNA, 15 nt, Mycobacterium avium subsp. paratuberculosis
ccagccgucgcaccg

SEQ ID NO: 899124 - RNA, 14 nt, Mycobacterium avium subsp. paratuberculosis
ccagccgucgccgc

SEQ ID NO: 899125 - RNA, 15 nt, Mycobacterium avium subsp. paratuberculosis
ccagccgucgccgcg

SEQ ID NO: 899126 - RNA, 21 nt, Mycobacterium avium subsp. paratuberculosis
ccagccgucgccgcgcccgcc

SEQ ID NO: 899127 - RNA, 16 nt, Mycobacterium avium subsp. paratuberculosis
ccacuucuccacgccg

SEQ ID NO: 899128 - RNA, 17 nt, Mycobacterium avium subsp. paratuberculosis
ccacuucuccacgccga

SEQ ID NO: 899129 - RNA, 21 nt, Mycobacterium avium subsp. paratuberculosis
ccacuucuccacgccgacgaa

SEQ ID NO: 899130 - RNA, 14 nt, Mycobacterium avium subsp. paratuberculosis
ccacuucuggcgcu

SEQ ID NO: 899131 - RNA, 17 nt, Mycobacterium avium subsp. paratuberculosis
ccacugccaagacgucc

SEQ ID NO: 899132 - RNA, 15 nt, Mycobacterium avium subsp. paratuberculosis
ccacgucgaugccga

SEQ ID NO: 899133 - RNA, 14 nt, Mycobacterium avium subsp. paratuberculosis
ccacguccccgggc

SEQ ID NO: 899134 - RNA, 17 nt, Mycobacterium avium subsp. paratuberculosis
ccacguccccgggcgug

SEQ ID NO: 899135 - RNA, 16 nt, Mycobacterium avium subsp. paratuberculosis
ccacguccgcggugag

SEQ ID NO: 899136 - RNA, 22 nt, Mycobacterium avium subsp. paratuberculosis
ccacguccaccagcaccaggcg

SEQ ID NO: 899137 - RNA, 18 nt, Mycobacterium avium subsp. paratuberculosis
ccacgucgaagcccgggu

SEQ ID NO: 899138 - RNA, 20 nt, Mycobacterium avium subsp. paratuberculosis
ccacucgggaaaugcgucgg

SEQ ID NO: 899139 - RNA, 18 nt, Mycobacterium avium subsp. paratuberculosis
ccacucgggccagcccau

SEQ ID NO: 899140 - RNA, 14 nt, Mycobacterium avium subsp. paratuberculosis
ccacucgggcggcc

SEQ ID NO: 899141 - RNA, 19 nt, Mycobacterium avium subsp. paratuberculosis
ccacucgggcggccgcgga

SEQ ID NO: 899142 - RNA, 21 nt, Mycobacterium avium subsp. paratuberculosis
ccacucgccgcgaacgacgac

SEQ ID NO: 899143 - RNA, 20 nt, Mycobacterium avium subsp. paratuberculosis
ccacucgcguccccgcgccg

SEQ ID NO: 899144 - RNA, 20 nt, Mycobacterium avium subsp. paratuberculosis
ccacucggacagguggccga

SEQ ID NO: 899145 - RNA, 12 nt, Mycobacterium avium subsp. paratuberculosis
ccacucggccac

SEQ ID NO: 899146 - RNA, 14 nt, Mycobacterium avium subsp. paratuberculosis
ccacucgucgaugu

SEQ ID NO: 899147 - RNA, 13 nt, Mycobacterium avium subsp. paratuberculosis
ccacugagcgcag

SEQ ID NO: 899148 - RNA, 18 nt, Mycobacterium avium subsp. paratuberculosis
ccagacgcgggcgcccag

SEQ ID NO: 899149 - RNA, 20 nt, Mycobacterium avium subsp. paratuberculosis
ccagacgguuccaccggucg

SEQ ID NO: 899150 - RNA, 16 nt, Mycobacterium avium subsp. paratuberculosis
ccagacguccagcgcc

SEQ ID NO: 899151 - RNA, 22 nt, Mycobacterium avium subsp. paratuberculosis
ccagacguccagcgccgccauc

SEQ ID NO: 899152 - RNA, 21 nt, Mycobacterium avium subsp. paratuberculosis
ccagacugaugcccucgccgg

SEQ ID NO: 899153 - RNA, 15 nt, Mycobacterium avium subsp. paratuberculosis
ccagacugcgcaccg

SEQ ID NO: 899154 - RNA, 17 nt, Mycobacterium avium subsp. paratuberculosis
ccagacugcgcaccgcc

SEQ ID NO: 899155 - RNA, 19 nt, Mycobacterium avium subsp. paratuberculosis
ccagacugcgcaccgccag

SEQ ID NO: 899156 - RNA, 20 nt, Mycobacterium avium subsp. paratuberculosis
ccagacugcgcaccgccagc

SEQ ID NO: 899157 - RNA, 22 nt, Mycobacterium avium subsp. paratuberculosis
ccagacugcgcaccgccagcac

SEQ ID NO: 899158 - RNA, 18 nt, Mycobacterium avium subsp. paratuberculosis
ccagacguguggcacccg

SEQ ID NO: 899159 - RNA, 15 nt, Mycobacterium avium subsp. paratuberculosis
ccagacgucggcgua

SEQ ID NO: 899160 - RNA, 16 nt, Mycobacterium avium subsp. paratuberculosis
ccagacucacggcggc

SEQ ID NO: 899161 - RNA, 17 nt, Mycobacterium avium subsp. paratuberculosis
ccagacucacggcggca

SEQ ID NO: 899162 - RNA, 18 nt, Mycobacterium avium subsp. paratuberculosis
ccagacucacggcggcag

SEQ ID NO: 899163 - RNA, 19 nt, Mycobacterium avium subsp. paratuberculosis
ccagacucacggcggcagc

SEQ ID NO: 899164 - RNA, 22 nt, Mycobacterium avium subsp. paratuberculosis
ccagacucacggcggcagcgcg

SEQ ID NO: 899165 - RNA, 17 nt, Mycobacterium avium subsp. paratuberculosis
ccagaacagccagucga

SEQ ID NO: 899166 - RNA, 15 nt, Mycobacterium avium subsp. paratuberculosis
ccagaacggcggcag

SEQ ID NO: 899167 - RNA, 14 nt, Mycobacterium avium subsp. paratuberculosis
ccagaaccgcucgg

SEQ ID NO: 899168 - RNA, 16 nt, Mycobacterium avium subsp. paratuberculosis
ccagaaccgcucggcg

SEQ ID NO: 899169 - RNA, 22 nt, Mycobacterium avium subsp. paratuberculosis
ccagaaccgcucggcggcgccg

SEQ ID NO: 899170 - RNA, 13 nt, Mycobacterium avium subsp. paratuberculosis
ccagaaccggcaa

SEQ ID NO: 899171 - RNA, 13 nt, Mycobacterium avium subsp. paratuberculosis
ccagaaccggcag

SEQ ID NO: 899172 - RNA, 13 nt, Mycobacterium avium subsp. paratuberculosis
ccagaacucggcg

SEQ ID NO: 899173 - RNA, 23 nt, Mycobacterium avium subsp. paratuberculosis
ccagaacugggccgccgucgcca

SEQ ID NO: 899174 - RNA, 22 nt, Mycobacterium avium subsp. paratuberculosis
ccagaagaucugccggugccgc

SEQ ID NO: 899175 - RNA, 16 nt, Mycobacterium avium subsp. paratuberculosis
ccagaaguggucgauc

SEQ ID NO: 899176 - RNA, 15 nt, Mycobacterium avium subsp. paratuberculosis
ccacggagcgcccgg

SEQ ID NO: 899177 - RNA, 20 nt, Mycobacterium avium subsp. paratuberculosis
ccacgcuguagggccaccac

SEQ ID NO: 899178 - RNA, 23 nt, Mycobacterium avium subsp. paratuberculosis
ccacgcuguagggccaccacgcc

SEQ ID NO: 899179 - RNA, 17 nt, Mycobacterium avium subsp. paratuberculosis
ccacgcuggugugacgc

SEQ ID NO: 899180 - RNA, 21 nt, Mycobacterium avium subsp. paratuberculosis
ccacgcuggugugacgcucgc

SEQ ID NO: 899181 - RNA, 18 nt, Mycobacterium avium subsp. paratuberculosis
ccacgcuggcggugucga

SEQ ID NO: 899182 - RNA, 13 nt, Mycobacterium avium subsp. paratuberculosis
ccacgcuggcguc

SEQ ID NO: 899183 - RNA, 21 nt, Mycobacterium avium subsp. paratuberculosis
ccacgcuggcguccaggucgc

SEQ ID NO: 899184 - RNA, 20 nt, Mycobacterium avium subsp. paratuberculosis
ccacgcuggcgugacgcucg

SEQ ID NO: 899185 - RNA, 18 nt, Mycobacterium avium subsp. paratuberculosis
ccaccgucaccgccgcac

SEQ ID NO: 899186 - RNA, 14 nt, Mycobacterium avium subsp. paratuberculosis
ccaccgguggccgg

SEQ ID NO: 899187 - RNA, 17 nt, Mycobacterium avium subsp. paratuberculosis
ccaccgguggccgggag

SEQ ID NO: 899188 - RNA, 14 nt, Mycobacterium avium subsp. paratuberculosis
ccaccggggucacc

SEQ ID NO: 899189 - RNA, 12 nt, Mycobacterium avium subsp. paratuberculosis
ccaccgggucgc

SEQ ID NO: 899190 - RNA, 18 nt, Mycobacterium avium subsp. paratuberculosis
ccaccggugacgaccggc

SEQ ID NO: 899191 - RNA, 21 nt, Mycobacterium avium subsp. paratuberculosis
ccaccggugacgaccggcagc

SEQ ID NO: 899192 - RNA, 12 nt, Mycobacterium avium subsp. paratuberculosis
ccacgcucggcg

SEQ ID NO: 899193 - RNA, 14 nt, Mycobacterium avium subsp. paratuberculosis
ccacgcucggcgag

SEQ ID NO: 899194 - RNA, 15 nt, Mycobacterium avium subsp. paratuberculosis
ccacgcucggcggcg

SEQ ID NO: 899195 - RNA, 17 nt, Mycobacterium avium subsp. paratuberculosis
ccacgcucggcggcgcg

SEQ ID NO: 899196 - RNA, 18 nt, Mycobacterium avium subsp. paratuberculosis
ccacgcucggcggcgcgc

SEQ ID NO: 899197 - RNA, 13 nt, Mycobacterium avium subsp. paratuberculosis
ccacgcucgacgc

SEQ ID NO: 899198 - RNA, 19 nt, Mycobacterium avium subsp. paratuberculosis
ccacgcucgacgcgucgac

SEQ ID NO: 899199 - RNA, 15 nt, Mycobacterium avium subsp. paratuberculosis
ccacgcucgccagac

SEQ ID NO: 899200 - RNA, 17 nt, Mycobacterium avium subsp. paratuberculosis
ccacgcucgccagaccg

SEQ ID NO: 899201 - RNA, 18 nt, Mycobacterium avium subsp. paratuberculosis
ccacgcucgccagaccgg

SEQ ID NO: 899202 - RNA, 19 nt, Mycobacterium avium subsp. paratuberculosis
ccacgcucgccagaccggu

SEQ ID NO: 899203 - RNA, 23 nt, Mycobacterium avium subsp. paratuberculosis
ccacgcucucgccggucagcacg

SEQ ID NO: 899204 - RNA, 15 nt, Mycobacterium avium subsp. paratuberculosis
ccacggccagcaccg

SEQ ID NO: 899205 - RNA, 17 nt, Mycobacterium avium subsp. paratuberculosis
ccacggccagcaccgcc

SEQ ID NO: 899206 - RNA, 13 nt, Mycobacterium avium subsp. paratuberculosis
ccacggccgccga

SEQ ID NO: 899207 - RNA, 12 nt, Mycobacterium avium subsp. paratuberculosis
ccacggccgcgg

SEQ ID NO: 899208 - RNA, 15 nt, Mycobacterium avium subsp. paratuberculosis
ccacggccgcggccc

SEQ ID NO: 899209 - RNA, 17 nt, Mycobacterium avium subsp. paratuberculosis
ccacggccgcggcccgg

SEQ ID NO: 899210 - RNA, 19 nt, Mycobacterium avium subsp. paratuberculosis
ccacggccgcggcccggcc

SEQ ID NO: 899211 - RNA, 23 nt, Mycobacterium avium subsp. paratuberculosis
ccacggccgcggcccggccacca

SEQ ID NO: 899212 - RNA, 14 nt, Mycobacterium avium subsp. paratuberculosis
ccacggcaugguga

SEQ ID NO: 899213 - RNA, 18 nt, Mycobacterium avium subsp. paratuberculosis
ccacggcacgucgagggu

SEQ ID NO: 899214 - RNA, 15 nt, Mycobacterium avium subsp. paratuberculosis
ccacggccaccacgg

SEQ ID NO: 899215 - RNA, 21 nt, Mycobacterium avium subsp. paratuberculosis
ccacggccaccacggcaccgc

SEQ ID NO: 899216 - RNA, 16 nt, Mycobacterium avium subsp. paratuberculosis
ccacgggaugcggcac

SEQ ID NO: 899217 - RNA, 11 nt, Mycobacterium avium subsp. paratuberculosis
ccacggccgca

SEQ ID NO: 899218 - RNA, 21 nt, Mycobacterium avium subsp. paratuberculosis
ccacggcccgcgccccggcgg

SEQ ID NO: 899219 - RNA, 20 nt, Mycobacterium avium subsp. paratuberculosis
ccacggcgacgaccaccagg

SEQ ID NO: 899220 - RNA, 13 nt, Mycobacterium avium subsp. paratuberculosis
ccacggccggcag

SEQ ID NO: 899221 - RNA, 15 nt, Mycobacterium avium subsp. paratuberculosis
ccacggccggcagca

SEQ ID NO: 899222 - RNA, 18 nt, Mycobacterium avium subsp. paratuberculosis
ccacggccggcagcaucg

SEQ ID NO: 899223 - RNA, 13 nt, Mycobacterium avium subsp. paratuberculosis
ccacggucacagc

SEQ ID NO: 899224 - RNA, 15 nt, Mycobacterium avium subsp. paratuberculosis
ccacggucacagccg

SEQ ID NO: 899225 - RNA, 17 nt, Mycobacterium avium subsp. paratuberculosis
ccacggucacagccgcg

SEQ ID NO: 899226 - RNA, 15 nt, Mycobacterium avium subsp. paratuberculosis
ccacggucaccccga

SEQ ID NO: 899227 - RNA, 14 nt, Mycobacterium avium subsp. paratuberculosis
ccacgggucgccga

SEQ ID NO: 899228 - RNA, 15 nt, Mycobacterium avium subsp. paratuberculosis
ccacgggucgccgau

SEQ ID NO: 899229 - RNA, 23 nt, Mycobacterium avium subsp. paratuberculosis
ccacgggucgccgaucucggcca

SEQ ID NO: 899230 - RNA, 16 nt, Mycobacterium avium subsp. paratuberculosis
ccacgggucgccgugg

SEQ ID NO: 899231 - RNA, 20 nt, Mycobacterium avium subsp. paratuberculosis
ccacgggucggucggcccgc

SEQ ID NO: 899232 - RNA, 20 nt, Mycobacterium avium subsp. paratuberculosis
ccacggguuggggccgcgga

SEQ ID NO: 899233 - RNA, 23 nt, Mycobacterium avium subsp. paratuberculosis
ccacggggcgccgcugcgggcca

SEQ ID NO: 899234 - RNA, 17 nt, Mycobacterium avium subsp. paratuberculosis
ccacgggcggucggacg

SEQ ID NO: 899235 - RNA, 21 nt, Mycobacterium avium subsp. paratuberculosis
ccacgggcggucggacgcggg

SEQ ID NO: 899236 - RNA, 23 nt, Mycobacterium avium subsp. paratuberculosis
ccacgggcggucggacgcgggga

SEQ ID NO: 899237 - RNA, 15 nt, Mycobacterium avium subsp. paratuberculosis
ccacguacaccggga

SEQ ID NO: 899238 - RNA, 17 nt, Mycobacterium avium subsp. paratuberculosis
ccacguacuccugcgcg

SEQ ID NO: 899239 - RNA, 13 nt, Mycobacterium avium subsp. paratuberculosis
ccacgucaccgac

SEQ ID NO: 899240 - RNA, 18 nt, Mycobacterium avium subsp. paratuberculosis
ccacguaguccgacgauc

SEQ ID NO: 899241 - RNA, 21 nt, Mycobacterium avium subsp. paratuberculosis
ccacguaggcgaucagcgcgc

SEQ ID NO: 899242 - RNA, 17 nt, Mycobacterium avium subsp. paratuberculosis
ccacguaggcgaugucg

SEQ ID NO: 899243 - RNA, 13 nt, Mycobacterium avium subsp. paratuberculosis
ccagauucaccag

SEQ ID NO: 899244 - RNA, 16 nt, Mycobacterium avium subsp. paratuberculosis
ccagauucaccagcgc

SEQ ID NO: 899245 - RNA, 17 nt, Mycobacterium avium subsp. paratuberculosis
ccagauucaccagcgcc

SEQ ID NO: 899246 - RNA, 21 nt, Mycobacterium avium subsp. paratuberculosis
ccagacguuuccguccggcga

SEQ ID NO: 899247 - RNA, 21 nt, Mycobacterium avium subsp. paratuberculosis
ccagagcgcgaaaaccagcac

SEQ ID NO: 899248 - RNA, 22 nt, Mycobacterium avium subsp. paratuberculosis
ccagagcgcgaaaaccagcacc

SEQ ID NO: 899249 - RNA, 23 nt, Mycobacterium avium subsp. paratuberculosis
ccagagcgcgaaaaccagcaccg

SEQ ID NO: 899250 - RNA, 22 nt, Mycobacterium avium subsp. paratuberculosis
ccagagcaucagggcguugauc

SEQ ID NO: 899251 - RNA, 20 nt, Mycobacterium avium subsp. paratuberculosis
ccagcaaccccgcggugcac

SEQ ID NO: 899252 - RNA, 21 nt, Mycobacterium avium subsp. paratuberculosis
ccagcaaccccgcggugcacg

SEQ ID NO: 899253 - RNA, 23 nt, Mycobacterium avium subsp. paratuberculosis
ccagcaacaccuuucggccgcgg

SEQ ID NO: 899254 - RNA, 16 nt, Mycobacterium avium subsp. paratuberculosis
ccagcaacagcagcgg

SEQ ID NO: 899255 - RNA, 14 nt, Mycobacterium avium subsp. paratuberculosis
ccagcaaccgccgu

SEQ ID NO: 899256 - RNA, 16 nt, Mycobacterium avium subsp. paratuberculosis
ccagcaacgacccggc

SEQ ID NO: 899257 - RNA, 20 nt, Mycobacterium avium subsp. paratuberculosis
ccagcaacgacccggccacc

SEQ ID NO: 899258 - RNA, 21 nt, Mycobacterium avium subsp. paratuberculosis
ccagcaacgacccggccaccg

SEQ ID NO: 899259 - RNA, 16 nt, Mycobacterium avium subsp. paratuberculosis
ccagcaacgccgacau

SEQ ID NO: 899260 - RNA, 15 nt, Mycobacterium avium subsp. paratuberculosis
ccagcaaaaccccgc

SEQ ID NO: 899261 - RNA, 22 nt, Mycobacterium avium subsp. paratuberculosis
ccagcaaacccagcaccaacag

SEQ ID NO: 899262 - RNA, 15 nt, Mycobacterium avium subsp. paratuberculosis
ccagcaacaccagcu

SEQ ID NO: 899263 - RNA, 18 nt, Mycobacterium avium subsp. paratuberculosis
ccagcaacaccagcugga

SEQ ID NO: 899264 - RNA, 19 nt, Mycobacterium avium subsp. paratuberculosis
ccagcaacacccagccgcu

SEQ ID NO: 899265 - RNA, 13 nt, Mycobacterium avium subsp. paratuberculosis
ccagcaccaccac

SEQ ID NO: 899266 - RNA, 15 nt, Mycobacterium avium subsp. paratuberculosis
ccagcaccaccacgc

SEQ ID NO: 899267 - RNA, 18 nt, Mycobacterium avium subsp. paratuberculosis
ccagcaccaccacgcugg

SEQ ID NO: 899268 - RNA, 22 nt, Mycobacterium avium subsp. paratuberculosis
ccagcaccaccacguugcgcgg

SEQ ID NO: 899269 - RNA, 21 nt, Mycobacterium avium subsp. paratuberculosis
ccagcaccacccggucgaugu

SEQ ID NO: 899270 - RNA, 12 nt, Mycobacterium avium subsp. paratuberculosis
ccagcaccaccg

SEQ ID NO: 899271 - RNA, 14 nt, Mycobacterium avium subsp. paratuberculosis
ccagcaccaccgcg

SEQ ID NO: 899272 - RNA, 14 nt, Mycobacterium avium subsp. paratuberculosis
ccagcacaacgccu

SEQ ID NO: 899273 - RNA, 19 nt, Mycobacterium avium subsp. paratuberculosis
ccagcacagccgucgcacu

SEQ ID NO: 899274 - RNA, 17 nt, Mycobacterium avium subsp. paratuberculosis
ccagcacagcgaggcga

SEQ ID NO: 899275 - RNA, 15 nt, Mycobacterium avium subsp. paratuberculosis
ccagcaccagcgcgc

SEQ ID NO: 899276 - RNA, 14 nt, Mycobacterium avium subsp. paratuberculosis
ccagcaccagcagc

SEQ ID NO: 899277 - RNA, 17 nt, Mycobacterium avium subsp. paratuberculosis
ccagcaccagcagccgg

SEQ ID NO: 899278 - RNA, 15 nt, Mycobacterium avium subsp. paratuberculosis
ccagcaccagcccga

SEQ ID NO: 899279 - RNA, 16 nt, Mycobacterium avium subsp. paratuberculosis
ccagcaccagcccgau

SEQ ID NO: 899280 - RNA, 14 nt, Mycobacterium avium subsp. paratuberculosis
ccagcaccagcgug

SEQ ID NO: 899281 - RNA, 23 nt, Mycobacterium avium subsp. paratuberculosis
ccagcaccaggaaggcgaccgcg

SEQ ID NO: 899282 - RNA, 20 nt, Mycobacterium avium subsp. paratuberculosis
ccagcaccaguucgcguacc

SEQ ID NO: 899283 - RNA, 14 nt, Mycobacterium avium subsp. paratuberculosis
ccagcaccaccgug

SEQ ID NO: 899284 - RNA, 15 nt, Mycobacterium avium subsp. paratuberculosis
ccagcaccaccgugg

SEQ ID NO: 899285 - RNA, 16 nt, Mycobacterium avium subsp. paratuberculosis
ccagcaccaccguggc

SEQ ID NO: 899286 - RNA, 20 nt, Mycobacterium avium subsp. paratuberculosis
ccagcaccaccguggcgaug

SEQ ID NO: 899287 - RNA, 19 nt, Mycobacterium avium subsp. paratuberculosis
ccagcaccaccucgcgcgg

SEQ ID NO: 899288 - RNA, 23 nt, Mycobacterium avium subsp. paratuberculosis
ccagcaccaccucgcgcggggcg

SEQ ID NO: 899289 - RNA, 15 nt, Mycobacterium avium subsp. paratuberculosis
ccagcaccaccuugu

SEQ ID NO: 899290 - RNA, 15 nt, Mycobacterium avium subsp. paratuberculosis
ccagcaccacgguga

SEQ ID NO: 899291 - RNA, 20 nt, Mycobacterium avium subsp. paratuberculosis
ccagcaccacguccgcggug

SEQ ID NO: 899292 - RNA, 13 nt, Mycobacterium avium subsp. paratuberculosis
ccagcaccagcac

SEQ ID NO: 899293 - RNA, 14 nt, Mycobacterium avium subsp. paratuberculosis
ccagcaccagcacg

SEQ ID NO: 899294 - RNA, 15 nt, Mycobacterium avium subsp. paratuberculosis
ccagcaccagcacgg

SEQ ID NO: 899295 - RNA, 18 nt, Mycobacterium avium subsp. paratuberculosis
ccagcacccagcacagcg

SEQ ID NO: 899296 - RNA, 19 nt, Mycobacterium avium subsp. paratuberculosis
ccagcaccauccagugcag

SEQ ID NO: 899297 - RNA, 16 nt, Mycobacterium avium subsp. paratuberculosis
ccagcaccccggucca

SEQ ID NO: 899298 - RNA, 17 nt, Mycobacterium avium subsp. paratuberculosis
ccagcaccccgguccag

SEQ ID NO: 899299 - RNA, 16 nt, Mycobacterium avium subsp. paratuberculosis
ccagcacccgcucgcc

SEQ ID NO: 899300 - RNA, 23 nt, Mycobacterium avium subsp. paratuberculosis
ccagcacccgcucgccgaugacg

SEQ ID NO: 899301 - RNA, 17 nt, Mycobacterium avium subsp. paratuberculosis
ccagcacccgcaacgcg

SEQ ID NO: 899302 - RNA, 18 nt, Mycobacterium avium subsp. paratuberculosis
ccagcacccgcaacgcgc

SEQ ID NO: 899303 - RNA, 13 nt, Mycobacterium avium subsp. paratuberculosis
ccagcacccggcc

SEQ ID NO: 899304 - RNA, 14 nt, Mycobacterium avium subsp. paratuberculosis
ccagcacccggccc

SEQ ID NO: 899305 - RNA, 21 nt, Mycobacterium avium subsp. paratuberculosis
ccagcacccggcccacgccgu

SEQ ID NO: 899306 - RNA, 20 nt, Mycobacterium avium subsp. paratuberculosis
ccagcagcuucaugcccgcg

SEQ ID NO: 899307 - RNA, 22 nt, Mycobacterium avium subsp. paratuberculosis
ccagcagcugcgcgucgaagaa

SEQ ID NO: 899308 - RNA, 14 nt, Mycobacterium avium subsp. paratuberculosis
ccagcaggacgcgc

SEQ ID NO: 899309 - RNA, 21 nt, Mycobacterium avium subsp. paratuberculosis
ccagcaggacgcgcccggcga

SEQ ID NO: 899310 - RNA, 21 nt, Mycobacterium avium subsp. paratuberculosis
ccagcaggaucuggugcgcgc

SEQ ID NO: 899311 - RNA, 22 nt, Mycobacterium avium subsp. paratuberculosis
ccagcaggaugaugaccgacau

SEQ ID NO: 899312 - RNA, 13 nt, Mycobacterium avium subsp. paratuberculosis
ccagcagcguggg

SEQ ID NO: 899313 - RNA, 12 nt, Mycobacterium avium subsp. paratuberculosis
ccagcagcgugg

SEQ ID NO: 899314 - RNA, 16 nt, Mycobacterium avium subsp. paratuberculosis
ccagcagccagcuggu

SEQ ID NO: 899315 - RNA, 22 nt, Mycobacterium avium subsp. paratuberculosis
ccagcagcgucacgucgacggc

SEQ ID NO: 899316 - RNA, 21 nt, Mycobacterium avium subsp. paratuberculosis
ccagcagcggggugugcucgg

SEQ ID NO: 899317 - RNA, 23 nt, Mycobacterium avium subsp. paratuberculosis
ccagcagcggcuuggucaccagc

SEQ ID NO: 899318 - RNA, 14 nt, Mycobacterium avium subsp. paratuberculosis
ccagcagccgcgcg

SEQ ID NO: 899319 - RNA, 15 nt, Mycobacterium avium subsp. paratuberculosis
ccagcagccgcgcga

SEQ ID NO: 899320 - RNA, 12 nt, Mycobacterium avium subsp. paratuberculosis
ccagcagccgcu

SEQ ID NO: 899321 - RNA, 14 nt, Mycobacterium avium subsp. paratuberculosis
ccagcagccgguac

SEQ ID NO: 899322 - RNA, 16 nt, Mycobacterium avium subsp. paratuberculosis
ccagcagccgguacag

SEQ ID NO: 899323 - RNA, 15 nt, Mycobacterium avium subsp. paratuberculosis
ccagcagccugcccc

SEQ ID NO: 899324 - RNA, 18 nt, Mycobacterium avium subsp. paratuberculosis
ccagcagcggccggcgca

SEQ ID NO: 899325 - RNA, 19 nt, Mycobacterium avium subsp. paratuberculosis
ccagcagcggccggcgcag

SEQ ID NO: 899326 - RNA, 18 nt, Mycobacterium avium subsp. paratuberculosis
ccagcagucgugacgcgg

SEQ ID NO: 899327 - RNA, 19 nt, Mycobacterium avium subsp. paratuberculosis
ccagcagucgugacgcggc

SEQ ID NO: 899328 - RNA, 14 nt, Mycobacterium avium subsp. paratuberculosis
ccagcaucgccgcg

SEQ ID NO: 899329 - RNA, 17 nt, Mycobacterium avium subsp. paratuberculosis
ccagcaucgccgcggug

SEQ ID NO: 899330 - RNA, 19 nt, Mycobacterium avium subsp. paratuberculosis
ccagcaucgccgcggugcg

SEQ ID NO: 899331 - RNA, 17 nt, Mycobacterium avium subsp. paratuberculosis
ccagcaguccggcgguc

SEQ ID NO: 899332 - RNA, 19 nt, Mycobacterium avium subsp. paratuberculosis
ccagcaguccggcggucag

SEQ ID NO: 899333 - RNA, 20 nt, Mycobacterium avium subsp. paratuberculosis
ccagcaguccggcggucagc

SEQ ID NO: 899334 - RNA, 21 nt, Mycobacterium avium subsp. paratuberculosis
ccagcaguccggcggucagca

SEQ ID NO: 899335 - RNA, 23 nt, Mycobacterium avium subsp. paratuberculosis
ccagcaguccggcggucagcacc

SEQ ID NO: 899336 - RNA, 23 nt, Mycobacterium avium subsp. paratuberculosis
ccagcaggucgaaggcggccgcg

SEQ ID NO: 899337 - RNA, 14 nt, Mycobacterium avium subsp. paratuberculosis
ccagcaggucgauc

SEQ ID NO: 899338 - RNA, 15 nt, Mycobacterium avium subsp. paratuberculosis
ccagcagguccgccg

SEQ ID NO: 899339 - RNA, 22 nt, Mycobacterium avium subsp. paratuberculosis
ccagcagguccgccggugccag

SEQ ID NO: 899340 - RNA, 18 nt, Mycobacterium avium subsp. paratuberculosis
ccagcaggucgucgacgu

SEQ ID NO: 899341 - RNA, 18 nt, Mycobacterium avium subsp. paratuberculosis
ccagcagcccggccagcc

SEQ ID NO: 899342 - RNA, 17 nt, Mycobacterium avium subsp. paratuberculosis
ccagcagcagcgcggca

SEQ ID NO: 899343 - RNA, 19 nt, Mycobacterium avium subsp. paratuberculosis
ccagcacggugaugcgggu

SEQ ID NO: 899344 - RNA, 18 nt, Mycobacterium avium subsp. paratuberculosis
ccagcagcagcgccgcca

SEQ ID NO: 899345 - RNA, 19 nt, Mycobacterium avium subsp. paratuberculosis
ccagcagcagcgccgccac

SEQ ID NO: 899346 - RNA, 23 nt, Mycobacterium avium subsp. paratuberculosis
ccagcagcagcgccgccaccggc

SEQ ID NO: 899347 - RNA, 23 nt, Mycobacterium avium subsp. paratuberculosis
ccagcagcagcaggucgucgauc

SEQ ID NO: 899348 - RNA, 14 nt, Mycobacterium avium subsp. paratuberculosis
ccagcagcagcccg

SEQ ID NO: 899349 - RNA, 19 nt, Mycobacterium avium subsp. paratuberculosis
ccagcagcagcccgccgau

SEQ ID NO: 899350 - RNA, 20 nt, Mycobacterium avium subsp. paratuberculosis
ccagcagcagcccgccgaug

SEQ ID NO: 899351 - RNA, 16 nt, Mycobacterium avium subsp. paratuberculosis
ccagcagcagccgcgc

SEQ ID NO: 899352 - RNA, 15 nt, Mycobacterium avium subsp. paratuberculosis
ccagcacgucaccgc

SEQ ID NO: 899353 - RNA, 21 nt, Mycobacterium avium subsp. paratuberculosis
ccagcacgucgggguggccgg

SEQ ID NO: 899354 - RNA, 23 nt, Mycobacterium avium subsp. paratuberculosis
ccagcacgucgggguggccggcc

SEQ ID NO: 899355 - RNA, 16 nt, Mycobacterium avium subsp. paratuberculosis
ccagcacgugaugcag

SEQ ID NO: 899356 - RNA, 17 nt, Mycobacterium avium subsp. paratuberculosis
ccagcacgugaugcagc

SEQ ID NO: 899357 - RNA, 20 nt, Mycobacterium avium subsp. paratuberculosis
ccagcacgugaugcagcuga

SEQ ID NO: 899358 - RNA, 12 nt, Mycobacterium avium subsp. paratuberculosis
ccagcacggcgg

SEQ ID NO: 899359 - RNA, 13 nt, Mycobacterium avium subsp. paratuberculosis
ccagcacggcggc

SEQ ID NO: 899360 - RNA, 18 nt, Mycobacterium avium subsp. paratuberculosis
ccagcacggcggcgcuga

SEQ ID NO: 899361 - RNA, 17 nt, Mycobacterium avium subsp. paratuberculosis
ccagcacggcggcgugc

SEQ ID NO: 899362 - RNA, 13 nt, Mycobacterium avium subsp. paratuberculosis
ccagcacggucag

SEQ ID NO: 899363 - RNA, 18 nt, Mycobacterium avium subsp. paratuberculosis
ccagcacggucagcggcc

SEQ ID NO: 899364 - RNA, 22 nt, Mycobacterium avium subsp. paratuberculosis
ccagcacggucagcggccagcc

SEQ ID NO: 899365 - RNA, 20 nt, Mycobacterium avium subsp. paratuberculosis
ccagcacggucccguccauc

SEQ ID NO: 899366 - RNA, 12 nt, Mycobacterium avium subsp. paratuberculosis
ccagcacggcga

SEQ ID NO: 899367 - RNA, 12 nt, Mycobacterium avium subsp. paratuberculosis
ccagcacggcca

SEQ ID NO: 899368 - RNA, 14 nt, Mycobacterium avium subsp. paratuberculosis
ccagcacggccacc

SEQ ID NO: 899369 - RNA, 17 nt, Mycobacterium avium subsp. paratuberculosis
ccagcacggccaccagc

SEQ ID NO: 899370 - RNA, 22 nt, Mycobacterium avium subsp. paratuberculosis
ccagcacggccagccagccgcc

SEQ ID NO: 899371 - RNA, 20 nt, Mycobacterium avium subsp. paratuberculosis
ccagcacggccgccaggaug

SEQ ID NO: 899372 - RNA, 11 nt, Mycobacterium avium subsp. paratuberculosis
ccagcaccgcg

SEQ ID NO: 899373 - RNA, 17 nt, Mycobacterium avium subsp. paratuberculosis
ccagcaccgagaucucg

SEQ ID NO: 899374 - RNA, 23 nt, Mycobacterium avium subsp. paratuberculosis
ccagcaccgagaucucgucgaug

SEQ ID NO: 899375 - RNA, 18 nt, Mycobacterium avium subsp. paratuberculosis
ccagcaccgcgacgaucg

SEQ ID NO: 899376 - RNA, 12 nt, Mycobacterium avium subsp. paratuberculosis
ccagcaccgcgg

SEQ ID NO: 899377 - RNA, 13 nt, Mycobacterium avium subsp. paratuberculosis
ccagcaccgcggc

SEQ ID NO: 899378 - RNA, 15 nt, Mycobacterium avium subsp. paratuberculosis
ccagcaccgcggccg

SEQ ID NO: 899379 - RNA, 17 nt, Mycobacterium avium subsp. paratuberculosis
ccagcaccgcggccguc

SEQ ID NO: 899380 - RNA, 14 nt, Mycobacterium avium subsp. paratuberculosis
ccagcaccgcggcg

SEQ ID NO: 899381 - RNA, 16 nt, Mycobacterium avium subsp. paratuberculosis
ccagcaccgcggcgau

SEQ ID NO: 899382 - RNA, 17 nt, Mycobacterium avium subsp. paratuberculosis
ccagcaccgcggcguag

SEQ ID NO: 899383 - RNA, 21 nt, Mycobacterium avium subsp. paratuberculosis
ccagcaccgcgggggcggccg

SEQ ID NO: 899384 - RNA, 19 nt, Mycobacterium avium subsp. paratuberculosis
ccagcaccggaugcucacc

SEQ ID NO: 899385 - RNA, 20 nt, Mycobacterium avium subsp. paratuberculosis
ccagcaccggaugcucaccg

SEQ ID NO: 899386 - RNA, 23 nt, Mycobacterium avium subsp. paratuberculosis
ccagcaccggaugcucaccgguc

SEQ ID NO: 899387 - RNA, 12 nt, Mycobacterium avium subsp. paratuberculosis
ccagcaccggca

SEQ ID NO: 899388 - RNA, 13 nt, Mycobacterium avium subsp. paratuberculosis
ccagcaccgccac

SEQ ID NO: 899389 - RNA, 16 nt, Mycobacterium avium subsp. paratuberculosis
ccagcaccgccaccgg

SEQ ID NO: 899390 - RNA, 16 nt, Mycobacterium avium subsp. paratuberculosis
ccagcaccgccagcgc

SEQ ID NO: 899391 - RNA, 12 nt, Mycobacterium avium subsp. paratuberculosis
ccagcaccgccc

SEQ ID NO: 899392 - RNA, 23 nt, Mycobacterium avium subsp. paratuberculosis
ccagcaccgccccggucaccccg

SEQ ID NO: 899393 - RNA, 16 nt, Mycobacterium avium subsp. paratuberculosis
ccagcaccgccgcggc

SEQ ID NO: 899394 - RNA, 18 nt, Mycobacterium avium subsp. paratuberculosis
ccagcaccgccgcggccg

SEQ ID NO: 899395 - RNA, 20 nt, Mycobacterium avium subsp. paratuberculosis
ccagcaccgccgcggccgcg

SEQ ID NO: 899396 - RNA, 21 nt, Mycobacterium avium subsp. paratuberculosis
ccagcaccgccgcggccgcga

SEQ ID NO: 899397 - RNA, 13 nt, Mycobacterium avium subsp. paratuberculosis
ccagcaccgccgg

SEQ ID NO: 899398 - RNA, 14 nt, Mycobacterium avium subsp. paratuberculosis
ccagcaccgccggc

SEQ ID NO: 899399 - RNA, 18 nt, Mycobacterium avium subsp. paratuberculosis
ccagcaccgccggcgccg

SEQ ID NO: 899400 - RNA, 13 nt, Mycobacterium avium subsp. paratuberculosis
ccagcacgcugcg

SEQ ID NO: 899401 - RNA, 21 nt, Mycobacterium avium subsp. paratuberculosis
ccagcacgcugcggaugucgg

SEQ ID NO: 899402 - RNA, 17 nt, Mycobacterium avium subsp. paratuberculosis
ccagcacgccggucagc

SEQ ID NO: 899403 - RNA, 15 nt, Mycobacterium avium subsp. paratuberculosis
ccagcaccggcuggu

SEQ ID NO: 899404 - RNA, 22 nt, Mycobacterium avium subsp. paratuberculosis
ccagcaccggcuggucggcggg

SEQ ID NO: 899405 - RNA, 16 nt, Mycobacterium avium subsp. paratuberculosis
ccagcaccucgaacgc

SEQ ID NO: 899406 - RNA, 19 nt, Mycobacterium avium subsp. paratuberculosis
ccagcaccucgaacgccgg

SEQ ID NO: 899407 - RNA, 12 nt, Mycobacterium avium subsp. paratuberculosis
ccagcaccggcg

SEQ ID NO: 899408 - RNA, 13 nt, Mycobacterium avium subsp. paratuberculosis
ccagcaccggcgc

SEQ ID NO: 899409 - RNA, 16 nt, Mycobacterium avium subsp. paratuberculosis
ccagcaccggcgccau

SEQ ID NO: 899410 - RNA, 22 nt, Mycobacterium avium subsp. paratuberculosis
ccagcaccggcgccccgggcag

SEQ ID NO: 899411 - RNA, 14 nt, Mycobacterium avium subsp. paratuberculosis
ccagcaccggcgcg

SEQ ID NO: 899412 - RNA, 15 nt, Mycobacterium avium subsp. paratuberculosis
ccagcaccggcgcgc

SEQ ID NO: 899413 - RNA, 17 nt, Mycobacterium avium subsp. paratuberculosis
ccagcaccggcgcgccg

SEQ ID NO: 899414 - RNA, 15 nt, Mycobacterium avium subsp. paratuberculosis
ccagcaccgggccca

SEQ ID NO: 899415 - RNA, 16 nt, Mycobacterium avium subsp. paratuberculosis
ccagcaccgggcccag

SEQ ID NO: 899416 - RNA, 14 nt, Mycobacterium avium subsp. paratuberculosis
ccagcaccgucggc

SEQ ID NO: 899417 - RNA, 16 nt, Mycobacterium avium subsp. paratuberculosis
ccagcaccgucugcgc

SEQ ID NO: 899418 - RNA, 17 nt, Mycobacterium avium subsp. paratuberculosis
ccagcaccgucugcgcc

SEQ ID NO: 899419 - RNA, 23 nt, Mycobacterium avium subsp. paratuberculosis
ccagcaccgucugcgccgucacc

SEQ ID NO: 899420 - RNA, 13 nt, Mycobacterium avium subsp. paratuberculosis
ccaucugggcgcg

SEQ ID NO: 899421 - RNA, 15 nt, Mycobacterium avium subsp. paratuberculosis
ccaugaaccggucgu

SEQ ID NO: 899422 - RNA, 18 nt, Mycobacterium avium subsp. paratuberculosis
ccaucgcggcccccacgc

SEQ ID NO: 899423 - RNA, 12 nt, Mycobacterium avium subsp. paratuberculosis
ccaucgcggccg

SEQ ID NO: 899424 - RNA, 13 nt, Mycobacterium avium subsp. paratuberculosis
ccaucgcggccgc

SEQ ID NO: 899425 - RNA, 14 nt, Mycobacterium avium subsp. paratuberculosis
ccaucgcggcguug

SEQ ID NO: 899426 - RNA, 19 nt, Mycobacterium avium subsp. paratuberculosis
ccaucgcggucagcgucug

SEQ ID NO: 899427 - RNA, 17 nt, Mycobacterium avium subsp. paratuberculosis
ccaugaacgcgucgccg

SEQ ID NO: 899428 - RNA, 21 nt, Mycobacterium avium subsp. paratuberculosis
ccaugaacggcagcucgucga

SEQ ID NO: 899429 - RNA, 23 nt, Mycobacterium avium subsp. paratuberculosis
ccaugaacuccgacuccagcagc

SEQ ID NO: 899430 - RNA, 15 nt, Mycobacterium avium subsp. paratuberculosis
ccaugaacucgucca

SEQ ID NO: 899431 - RNA, 16 nt, Mycobacterium avium subsp. paratuberculosis
ccaugaacucguccac

SEQ ID NO: 899432 - RNA, 18 nt, Mycobacterium avium subsp. paratuberculosis
ccaugaacucguccaccg

SEQ ID NO: 899433 - RNA, 22 nt, Mycobacterium avium subsp. paratuberculosis
ccaugaagccguugccgccgcg

SEQ ID NO: 899434 - RNA, 19 nt, Mycobacterium avium subsp. paratuberculosis
ccaucuucacgugcgcggc

SEQ ID NO: 899435 - RNA, 16 nt, Mycobacterium avium subsp. paratuberculosis
ccauggcgcaccgcgg

SEQ ID NO: 899436 - RNA, 19 nt, Mycobacterium avium subsp. paratuberculosis
ccauggcgcaccgcggccu

SEQ ID NO: 899437 - RNA, 20 nt, Mycobacterium avium subsp. paratuberculosis
ccaugccccaggugacgccg

SEQ ID NO: 899438 - RNA, 23 nt, Mycobacterium avium subsp. paratuberculosis
ccaugccgccgaagcccgacauc

SEQ ID NO: 899439 - RNA, 13 nt, Mycobacterium avium subsp. paratuberculosis
ccaugccgccgac

SEQ ID NO: 899440 - RNA, 20 nt, Mycobacterium avium subsp. paratuberculosis
ccaugccgccgaccgccgag

SEQ ID NO: 899441 - RNA, 21 nt, Mycobacterium avium subsp. paratuberculosis
ccaugauguagcggcggucgg

SEQ ID NO: 899442 - RNA, 16 nt, Mycobacterium avium subsp. paratuberculosis
ccauccagcgccgcag

SEQ ID NO: 899443 - RNA, 17 nt, Mycobacterium avium subsp. paratuberculosis
ccauccagcgccgcagc

SEQ ID NO: 899444 - RNA, 16 nt, Mycobacterium avium subsp. paratuberculosis
ccaucccgauccgcgc

SEQ ID NO: 899445 - RNA, 19 nt, Mycobacterium avium subsp. paratuberculosis
ccaucccgauccgcgccgc

SEQ ID NO: 899446 - RNA, 21 nt, Mycobacterium avium subsp. paratuberculosis
ccaucccgauccgcgccgccg

SEQ ID NO: 899447 - RNA, 12 nt, Mycobacterium avium subsp. paratuberculosis
ccauccagcgcc

SEQ ID NO: 899448 - RNA, 17 nt, Mycobacterium avium subsp. paratuberculosis
ccauccacucgggccag

SEQ ID NO: 899449 - RNA, 20 nt, Mycobacterium avium subsp. paratuberculosis
ccauccacucgggccagccc

SEQ ID NO: 899450 - RNA, 23 nt, Mycobacterium avium subsp. paratuberculosis
ccauccagugcaguucgaugccg

SEQ ID NO: 899451 - RNA, 15 nt, Mycobacterium avium subsp. paratuberculosis
ccaucagugcggccc

SEQ ID NO: 899452 - RNA, 16 nt, Mycobacterium avium subsp. paratuberculosis
ccaucagugcggcccg

SEQ ID NO: 899453 - RNA, 17 nt, Mycobacterium avium subsp. paratuberculosis
ccaguuguuggccgggc

SEQ ID NO: 899454 - RNA, 22 nt, Mycobacterium avium subsp. paratuberculosis
ccaucaggccggccugccaccg

SEQ ID NO: 899455 - RNA, 15 nt, Mycobacterium avium subsp. paratuberculosis
ccauacugacgccgg

SEQ ID NO: 899456 - RNA, 19 nt, Mycobacterium avium subsp. paratuberculosis
ccaucgaggcgaucaucgc

SEQ ID NO: 899457 - RNA, 21 nt, Mycobacterium avium subsp. paratuberculosis
ccaucgaggcgaucaucgccc

SEQ ID NO: 899458 - RNA, 15 nt, Mycobacterium avium subsp. paratuberculosis
ccaucgcaccgcgag

SEQ ID NO: 899459 - RNA, 17 nt, Mycobacterium avium subsp. paratuberculosis
ccaucgacuccagcacc

SEQ ID NO: 899460 - RNA, 19 nt, Mycobacterium avium subsp. paratuberculosis
ccaucgacuccagcaccgg

SEQ ID NO: 899461 - RNA, 20 nt, Mycobacterium avium subsp. paratuberculosis
ccaucgacuccagcaccggc

SEQ ID NO: 899462 - RNA, 14 nt, Mycobacterium avium subsp. paratuberculosis
ccaucgacgcugag

SEQ ID NO: 899463 - RNA, 14 nt, Mycobacterium avium subsp. paratuberculosis
ccaucgccacgccg

SEQ ID NO: 899464 - RNA, 15 nt, Mycobacterium avium subsp. paratuberculosis
ccaucgccacgccgu

SEQ ID NO: 899465 - RNA, 21 nt, Mycobacterium avium subsp. paratuberculosis
ccaucgccacgccguggcccg

SEQ ID NO: 899466 - RNA, 17 nt, Mycobacterium avium subsp. paratuberculosis
ccaucgccucgaccagc

SEQ ID NO: 899467 - RNA, 19 nt, Mycobacterium avium subsp. paratuberculosis
ccaucgccgccaucgccgc

SEQ ID NO: 899468 - RNA, 15 nt, Mycobacterium avium subsp. paratuberculosis
ccaucgccgcgcacc

SEQ ID NO: 899469 - RNA, 15 nt, Mycobacterium avium subsp. paratuberculosis
ccauccgggcggcca

SEQ ID NO: 899470 - RNA, 16 nt, Mycobacterium avium subsp. paratuberculosis
ccauccgggcggccag

SEQ ID NO: 899471 - RNA, 14 nt, Mycobacterium avium subsp. paratuberculosis
ccauccggccggcg

SEQ ID NO: 899472 - RNA, 15 nt, Mycobacterium avium subsp. paratuberculosis
ccauccggccggcga

SEQ ID NO: 899473 - RNA, 16 nt, Mycobacterium avium subsp. paratuberculosis
ccauccggccggcgag

SEQ ID NO: 899474 - RNA, 22 nt, Mycobacterium avium subsp. paratuberculosis
ccauccgguccagaucggcgcg

SEQ ID NO: 899475 - RNA, 23 nt, Mycobacterium avium subsp. paratuberculosis
ccauccgguccagaucggcgcgc

SEQ ID NO: 899476 - RNA, 14 nt, Mycobacterium avium subsp. paratuberculosis
ccaucccgccgccg

SEQ ID NO: 899477 - RNA, 12 nt, Mycobacterium avium subsp. paratuberculosis
ccaucccgggga

SEQ ID NO: 899478 - RNA, 13 nt, Mycobacterium avium subsp. paratuberculosis
ccaucccggugga

SEQ ID NO: 899479 - RNA, 17 nt, Mycobacterium avium subsp. paratuberculosis
ccaucccgguggacgcg

SEQ ID NO: 899480 - RNA, 21 nt, Mycobacterium avium subsp. paratuberculosis
ccaucccgguggacgcgaugg

SEQ ID NO: 899481 - RNA, 21 nt, Mycobacterium avium subsp. paratuberculosis
ccauccgcgccgaacgcacca

SEQ ID NO: 899482 - RNA, 12 nt, Mycobacterium avium subsp. paratuberculosis
ccauccgcggcc

SEQ ID NO: 899483 - RNA, 15 nt, Mycobacterium avium subsp. paratuberculosis
ccauccgccacccgc

SEQ ID NO: 899484 - RNA, 22 nt, Mycobacterium avium subsp. paratuberculosis
ccauccgccacccgcugcucga

SEQ ID NO: 899485 - RNA, 13 nt, Mycobacterium avium subsp. paratuberculosis
ccauccgccgucg

SEQ ID NO: 899486 - RNA, 12 nt, Mycobacterium avium subsp. paratuberculosis
ccauccgcgacg

SEQ ID NO: 899487 - RNA, 18 nt, Mycobacterium avium subsp. paratuberculosis
ccauccgcgacgccagca

SEQ ID NO: 899488 - RNA, 19 nt, Mycobacterium avium subsp. paratuberculosis
ccauccgcgacgccagcac

SEQ ID NO: 899489 - RNA, 19 nt, Mycobacterium avium subsp. paratuberculosis
ccagguuguaggugcccga

SEQ ID NO: 899490 - RNA, 15 nt, Mycobacterium avium subsp. paratuberculosis
ccagguugucgccgc

SEQ ID NO: 899491 - RNA, 16 nt, Mycobacterium avium subsp. paratuberculosis
ccagguugucgccgcg

SEQ ID NO: 899492 - RNA, 22 nt, Mycobacterium avium subsp. paratuberculosis
ccaguccgcgugacaagccggc

SEQ ID NO: 899493 - RNA, 20 nt, Mycobacterium avium subsp. paratuberculosis
ccagucgauaguggcgucca

SEQ ID NO: 899494 - RNA, 13 nt, Mycobacterium avium subsp. paratuberculosis
ccaguccggccag

SEQ ID NO: 899495 - RNA, 13 nt, Mycobacterium avium subsp. paratuberculosis
ccaguccggccgu

SEQ ID NO: 899496 - RNA, 16 nt, Mycobacterium avium subsp. paratuberculosis
ccaguccggcgcccgg

SEQ ID NO: 899497 - RNA, 14 nt, Mycobacterium avium subsp. paratuberculosis
ccaguccggcgccg

SEQ ID NO: 899498 - RNA, 14 nt, Mycobacterium avium subsp. paratuberculosis
ccaguccugcagcu

SEQ ID NO: 899499 - RNA, 18 nt, Mycobacterium avium subsp. paratuberculosis
ccagucgaagaccacgaa

SEQ ID NO: 899500 - RNA, 20 nt, Mycobacterium avium subsp. paratuberculosis
ccagucgaagaccacgaacu

SEQ ID NO: 899501 - RNA, 22 nt, Mycobacterium avium subsp. paratuberculosis
ccagucgcgcagcgucaucgcg

SEQ ID NO: 899502 - RNA, 14 nt, Mycobacterium avium subsp. paratuberculosis
ccagucggcgccga

SEQ ID NO: 899503 - RNA, 16 nt, Mycobacterium avium subsp. paratuberculosis
ccagucggucaacgug

SEQ ID NO: 899504 - RNA, 21 nt, Mycobacterium avium subsp. paratuberculosis
ccagucguacucccaggccgc

SEQ ID NO: 899505 - RNA, 14 nt, Mycobacterium avium subsp. paratuberculosis
ccagucgccgccgc

SEQ ID NO: 899506 - RNA, 18 nt, Mycobacterium avium subsp. paratuberculosis
ccagucgccgccgcgcac

SEQ ID NO: 899507 - RNA, 23 nt, Mycobacterium avium subsp. paratuberculosis
ccagucgccgccgcgcaccgcgc

SEQ ID NO: 899508 - RNA, 17 nt, Mycobacterium avium subsp. paratuberculosis
ccagucgccgcgcagau

SEQ ID NO: 899509 - RNA, 22 nt, Mycobacterium avium subsp. paratuberculosis
ccagucgcauaugcgugggccc

SEQ ID NO: 899510 - RNA, 14 nt, Mycobacterium avium subsp. paratuberculosis
ccagguugcgccgu

SEQ ID NO: 899511 - RNA, 20 nt, Mycobacterium avium subsp. paratuberculosis
ccagguugaccaccagcgug

SEQ ID NO: 899512 - RNA, 15 nt, Mycobacterium avium subsp. paratuberculosis
ccagguugucgucgg

SEQ ID NO: 899513 - RNA, 21 nt, Mycobacterium avium subsp. paratuberculosis
ccagguugucgucgggcacca

SEQ ID NO: 899514 - RNA, 20 nt, Mycobacterium avium subsp. paratuberculosis
ccagguuguggugcacgaac

SEQ ID NO: 899515 - RNA, 21 nt, Mycobacterium avium subsp. paratuberculosis
ccagguuguggugcacgaacg

SEQ ID NO: 899516 - RNA, 23 nt, Mycobacterium avium subsp. paratuberculosis
ccagguuguggugcacgaacggc

SEQ ID NO: 899517 - RNA, 14 nt, Mycobacterium avium subsp. paratuberculosis
ccagguuggucagc

SEQ ID NO: 899518 - RNA, 16 nt, Mycobacterium avium subsp. paratuberculosis
ccagguuggucagcag

SEQ ID NO: 899519 - RNA, 15 nt, Mycobacterium avium subsp. paratuberculosis
ccagguuggcggcgg

SEQ ID NO: 899520 - RNA, 22 nt, Mycobacterium avium subsp. paratuberculosis
ccagguuggcggcggcccgcgc

SEQ ID NO: 899521 - RNA, 15 nt, Mycobacterium avium subsp. paratuberculosis
ccaggugcacgccga

SEQ ID NO: 899522 - RNA, 20 nt, Mycobacterium avium subsp. paratuberculosis
ccaggugcacgccgagcagc

SEQ ID NO: 899523 - RNA, 21 nt, Mycobacterium avium subsp. paratuberculosis
ccaggugcagaccggacagcu

SEQ ID NO: 899524 - RNA, 21 nt, Mycobacterium avium subsp. paratuberculosis
ccaggucguucauucagcacc

SEQ ID NO: 899525 - RNA, 22 nt, Mycobacterium avium subsp. paratuberculosis
ccaggucguucauucagcaccu

SEQ ID NO: 899526 - RNA, 22 nt, Mycobacterium avium subsp. paratuberculosis
ccaggucuugaggaugacgggg

SEQ ID NO: 899527 - RNA, 17 nt, Mycobacterium avium subsp. paratuberculosis
ccaggugaacagcagcc

SEQ ID NO: 899528 - RNA, 18 nt, Mycobacterium avium subsp. paratuberculosis
ccaggugaacagcagcca

SEQ ID NO: 899529 - RNA, 18 nt, Mycobacterium avium subsp. paratuberculosis
ccaggugaaugcucagcg

SEQ ID NO: 899530 - RNA, 12 nt, Mycobacterium avium subsp. paratuberculosis
ccaggugaccgg

SEQ ID NO: 899531 - RNA, 14 nt, Mycobacterium avium subsp. paratuberculosis
ccaggugacgccgc

SEQ ID NO: 899532 - RNA, 16 nt, Mycobacterium avium subsp. paratuberculosis
ccaggugacgccgcac

SEQ ID NO: 899533 - RNA, 16 nt, Mycobacterium avium subsp. paratuberculosis
ccaguugacggcgcaa

SEQ ID NO: 899534 - RNA, 19 nt, Mycobacterium avium subsp. paratuberculosis
ccaguugacguugaucgcg

SEQ ID NO: 899535 - RNA, 20 nt, Mycobacterium avium subsp. paratuberculosis
ccaguugacguugaucgcgc

SEQ ID NO: 899536 - RNA, 13 nt, Mycobacterium avium subsp. paratuberculosis
ccaguucaccgcg

SEQ ID NO: 899537 - RNA, 20 nt, Mycobacterium avium subsp. paratuberculosis
ccaguugucgaucuccucgc

SEQ ID NO: 899538 - RNA, 20 nt, Mycobacterium avium subsp. paratuberculosis
ccaguugggggccagcgccg

SEQ ID NO: 899539 - RNA, 22 nt, Mycobacterium avium subsp. paratuberculosis
ccaguugggggccagcgccgag

SEQ ID NO: 899540 - RNA, 19 nt, Mycobacterium avium subsp. paratuberculosis
ccaguugcucgggugacgc

SEQ ID NO: 899541 - RNA, 22 nt, Mycobacterium avium subsp. paratuberculosis
ccaguuggcgucgucggcggcg

SEQ ID NO: 899542 - RNA, 17 nt, Mycobacterium avium subsp. paratuberculosis
ccaguugcacgguguag

SEQ ID NO: 899543 - RNA, 16 nt, Mycobacterium avium subsp. paratuberculosis
ccaguugcgaccccgc

SEQ ID NO: 899544 - RNA, 23 nt, Mycobacterium avium subsp. paratuberculosis
ccaguugcgaccccgccgucgac

SEQ ID NO: 899545 - RNA, 22 nt, Mycobacterium avium subsp. paratuberculosis
ccaguugcggcacgccgaccac

SEQ ID NO: 899546 - RNA, 21 nt, Mycobacterium avium subsp. paratuberculosis
ccagugcaggcugacgcgacc

SEQ ID NO: 899547 - RNA, 21 nt, Mycobacterium avium subsp. paratuberculosis
ccaguggcugucgggugccgc

SEQ ID NO: 899548 - RNA, 18 nt, Mycobacterium avium subsp. paratuberculosis
ccagugucagggcagcgg

SEQ ID NO: 899549 - RNA, 13 nt, Mycobacterium avium subsp. paratuberculosis
ccaguguccgggc

SEQ ID NO: 899550 - RNA, 13 nt, Mycobacterium avium subsp. paratuberculosis
ccaguguggccgc

SEQ ID NO: 899551 - RNA, 15 nt, Mycobacterium avium subsp. paratuberculosis
ccaguguggccgcgg

SEQ ID NO: 899552 - RNA, 21 nt, Mycobacterium avium subsp. paratuberculosis
ccaguguggccgcggcggccc

SEQ ID NO: 899553 - RNA, 19 nt, Mycobacterium avium subsp. paratuberculosis
ccagucguuggugcgcacc

SEQ ID NO: 899554 - RNA, 24 nt, Mycobacterium avium subsp. paratuberculosis
ccagucguacucccaggccgcggc

SEQ ID NO: 899555 - RNA, 14 nt, Mycobacterium avium subsp. paratuberculosis
ccagugacgccugc

SEQ ID NO: 899556 - RNA, 19 nt, Mycobacterium avium subsp. paratuberculosis
ccagugacgccugcggccc

SEQ ID NO: 899557 - RNA, 16 nt, Mycobacterium avium subsp. paratuberculosis
ccagugcaccucgacg

SEQ ID NO: 899558 - RNA, 17 nt, Mycobacterium avium subsp. paratuberculosis
ccagugcaccucgacga

SEQ ID NO: 899559 - RNA, 13 nt, Mycobacterium avium subsp. paratuberculosis
ccagugcacgcuc

SEQ ID NO: 899560 - RNA, 14 nt, Mycobacterium avium subsp. paratuberculosis
ccagugcacgcucg

SEQ ID NO: 899561 - RNA, 17 nt, Mycobacterium avium subsp. paratuberculosis
ccagugcacgcucggcg

SEQ ID NO: 899562 - RNA, 17 nt, Mycobacterium avium subsp. paratuberculosis
ccaggucccaggcgugg

SEQ ID NO: 899563 - RNA, 22 nt, Mycobacterium avium subsp. paratuberculosis
ccaggucggcgugaucccgauc

SEQ ID NO: 899564 - RNA, 14 nt, Mycobacterium avium subsp. paratuberculosis
ccaggucggggccc

SEQ ID NO: 899565 - RNA, 20 nt, Mycobacterium avium subsp. paratuberculosis
ccaggucgggguccaggccg

SEQ ID NO: 899566 - RNA, 23 nt, Mycobacterium avium subsp. paratuberculosis
ccaggucgggguccaggccgcgc

SEQ ID NO: 899567 - RNA, 14 nt, Mycobacterium avium subsp. paratuberculosis
ccaggucggugaca

SEQ ID NO: 899568 - RNA, 18 nt, Mycobacterium avium subsp. paratuberculosis
ccagguccgggaacagcg

SEQ ID NO: 899569 - RNA, 20 nt, Mycobacterium avium subsp. paratuberculosis
ccagguccgguucgaccggc

SEQ ID NO: 899570 - RNA, 22 nt, Mycobacterium avium subsp. paratuberculosis
ccagguauucaucgcggccgcc

SEQ ID NO: 899571 - RNA, 20 nt, Mycobacterium avium subsp. paratuberculosis
ccaggucaugguggcggcgc

SEQ ID NO: 899572 - RNA, 23 nt, Mycobacterium avium subsp. paratuberculosis
ccaggucaugguggcggcgccgg

SEQ ID NO: 899573 - RNA, 14 nt, Mycobacterium avium subsp. paratuberculosis
ccagguccacaccg

SEQ ID NO: 899574 - RNA, 17 nt, Mycobacterium avium subsp. paratuberculosis
ccagguccacaccgugg

SEQ ID NO: 899575 - RNA, 17 nt, Mycobacterium avium subsp. paratuberculosis
ccagguccaccagguga

SEQ ID NO: 899576 - RNA, 22 nt, Mycobacterium avium subsp. paratuberculosis
ccagguccaccaggugaccggc

SEQ ID NO: 899577 - RNA, 21 nt, Mycobacterium avium subsp. paratuberculosis
ccagguaguuguucgacugca

SEQ ID NO: 899578 - RNA, 15 nt, Mycobacterium avium subsp. paratuberculosis
ccagguaggcggugg

SEQ ID NO: 899579 - RNA, 16 nt, Mycobacterium avium subsp. paratuberculosis
ccagguagguggccgu

SEQ ID NO: 899580 - RNA, 22 nt, Mycobacterium avium subsp. paratuberculosis
ccagguagacgaugcccagccc

SEQ ID NO: 899581 - RNA, 14 nt, Mycobacterium avium subsp. paratuberculosis
ccagggugccgccg

SEQ ID NO: 899582 - RNA, 23 nt, Mycobacterium avium subsp. paratuberculosis
ccagggugccgcugcccgccgcg

SEQ ID NO: 899583 - RNA, 18 nt, Mycobacterium avium subsp. paratuberculosis
ccagggugccccgcaccg

SEQ ID NO: 899584 - RNA, 17 nt, Mycobacterium avium subsp. paratuberculosis
ccagggugccgauguag

SEQ ID NO: 899585 - RNA, 18 nt, Mycobacterium avium subsp. paratuberculosis
ccaggguggccccagccc

SEQ ID NO: 899586 - RNA, 17 nt, Mycobacterium avium subsp. paratuberculosis
ccaggguggccgccacc

SEQ ID NO: 899587 - RNA, 16 nt, Mycobacterium avium subsp. paratuberculosis
ccagggucuggcccgg

SEQ ID NO: 899588 - RNA, 17 nt, Mycobacterium avium subsp. paratuberculosis
ccagggucucgcgcagc

SEQ ID NO: 899589 - RNA, 18 nt, Mycobacterium avium subsp. paratuberculosis
ccagggucucgcgcagca

SEQ ID NO: 899590 - RNA, 16 nt, Mycobacterium avium subsp. paratuberculosis
ccagggucucgggcag

SEQ ID NO: 899591 - RNA, 15 nt, Mycobacterium avium subsp. paratuberculosis
ccaggguagaggcgg

SEQ ID NO: 899592 - RNA, 19 nt, Mycobacterium avium subsp. paratuberculosis
ccagggggaguagucggcg

SEQ ID NO: 899593 - RNA, 22 nt, Mycobacterium avium subsp. paratuberculosis
ccagggggaguagucggcgauc

SEQ ID NO: 899594 - RNA, 13 nt, Mycobacterium avium subsp. paratuberculosis
ccagggcgugcgc

SEQ ID NO: 899595 - RNA, 18 nt, Mycobacterium avium subsp. paratuberculosis
ccagggcgugcgcggccg

SEQ ID NO: 899596 - RNA, 14 nt, Mycobacterium avium subsp. paratuberculosis
ccagggcgucgagc

SEQ ID NO: 899597 - RNA, 12 nt, Mycobacterium avium subsp. paratuberculosis
ccagggcggcgc

SEQ ID NO: 899598 - RNA, 13 nt, Mycobacterium avium subsp. paratuberculosis
ccagggcgcggcg

SEQ ID NO: 899599 - RNA, 18 nt, Mycobacterium avium subsp. paratuberculosis
ccagggcgcggcgcaccg

SEQ ID NO: 899600 - RNA, 14 nt, Mycobacterium avium subsp. paratuberculosis
ccagggcgcgucca

SEQ ID NO: 899601 - RNA, 16 nt, Mycobacterium avium subsp. paratuberculosis
ccagggccucgucguc

SEQ ID NO: 899602 - RNA, 18 nt, Mycobacterium avium subsp. paratuberculosis
ccagggccugcagcacca

SEQ ID NO: 899603 - RNA, 21 nt, Mycobacterium avium subsp. paratuberculosis
ccagggcgaggaacccgaccg

SEQ ID NO: 899604 - RNA, 20 nt, Mycobacterium avium subsp. paratuberculosis
ccagggcgaggacggcuugg

SEQ ID NO: 899605 - RNA, 14 nt, Mycobacterium avium subsp. paratuberculosis
ccagggcgaucacc

SEQ ID NO: 899606 - RNA, 16 nt, Mycobacterium avium subsp. paratuberculosis
ccagggcgaucaccgc

SEQ ID NO: 899607 - RNA, 21 nt, Mycobacterium avium subsp. paratuberculosis
ccagggcgaucaccgcggcca

SEQ ID NO: 899608 - RNA, 23 nt, Mycobacterium avium subsp. paratuberculosis
ccagggcgaucaccgcggccacc

SEQ ID NO: 899609 - RNA, 15 nt, Mycobacterium avium subsp. paratuberculosis
ccagggcgaccgccg

SEQ ID NO: 899610 - RNA, 16 nt, Mycobacterium avium subsp. paratuberculosis
ccagggcgaccgccgc

SEQ ID NO: 899611 - RNA, 17 nt, Mycobacterium avium subsp. paratuberculosis
ccagggcgaccgccgcg

SEQ ID NO: 899612 - RNA, 17 nt, Mycobacterium avium subsp. paratuberculosis
ccagggcgacgccgcgg

SEQ ID NO: 899613 - RNA, 19 nt, Mycobacterium avium subsp. paratuberculosis
ccagggccgggcgugcccg

SEQ ID NO: 899614 - RNA, 16 nt, Mycobacterium avium subsp. paratuberculosis
ccagggccgcgagcgc

SEQ ID NO: 899615 - RNA, 16 nt, Mycobacterium avium subsp. paratuberculosis
ccagggcccgcagccg

SEQ ID NO: 899616 - RNA, 15 nt, Mycobacterium avium subsp. paratuberculosis
ccagggccaccgcgu

SEQ ID NO: 899617 - RNA, 21 nt, Mycobacterium avium subsp. paratuberculosis
ccaggaucgggaucggcuugg

SEQ ID NO: 899618 - RNA, 13 nt, Mycobacterium avium subsp. paratuberculosis
ccaggaucugcag

SEQ ID NO: 899619 - RNA, 20 nt, Mycobacterium avium subsp. paratuberculosis
ccaggaucugcucggcgucg

SEQ ID NO: 899620 - RNA, 18 nt, Mycobacterium avium subsp. paratuberculosis
ccaggaucucgcgggccc

SEQ ID NO: 899621 - RNA, 23 nt, Mycobacterium avium subsp. paratuberculosis
ccaggaucucgcgggcccgcgcg

SEQ ID NO: 899622 - RNA, 15 nt, Mycobacterium avium subsp. paratuberculosis
ccaggaucucgucgg

SEQ ID NO: 899623 - RNA, 18 nt, Mycobacterium avium subsp. paratuberculosis
ccaggaucuugucggcgg

SEQ ID NO: 899624 - RNA, 17 nt, Mycobacterium avium subsp. paratuberculosis
ccaggaugaacacccgg

SEQ ID NO: 899625 - RNA, 17 nt, Mycobacterium avium subsp. paratuberculosis
ccaggaugaaccgggag

SEQ ID NO: 899626 - RNA, 22 nt, Mycobacterium avium subsp. paratuberculosis
ccaggaugaaccgggagaacuc

SEQ ID NO: 899627 - RNA, 22 nt, Mycobacterium avium subsp. paratuberculosis
ccagggcagcgcgaccagcccg

SEQ ID NO: 899628 - RNA, 17 nt, Mycobacterium avium subsp. paratuberculosis
ccaggaucaccgggacg

SEQ ID NO: 899629 - RNA, 19 nt, Mycobacterium avium subsp. paratuberculosis
ccaggauccgaugacgcug

SEQ ID NO: 899630 - RNA, 15 nt, Mycobacterium avium subsp. paratuberculosis
ccaggauccgcaccg

SEQ ID NO: 899631 - RNA, 16 nt, Mycobacterium avium subsp. paratuberculosis
ccaggauccgcaccgg

SEQ ID NO: 899632 - RNA, 17 nt, Mycobacterium avium subsp. paratuberculosis
ccaggauccgcccgccg

SEQ ID NO: 899633 - RNA, 22 nt, Mycobacterium avium subsp. paratuberculosis
ccaggauccgcccgccgguggc

SEQ ID NO: 899634 - RNA, 12 nt, Mycobacterium avium subsp. paratuberculosis
ccaggaucgccu

SEQ ID NO: 899635 - RNA, 20 nt, Mycobacterium avium subsp. paratuberculosis
ccccaaugucacggcggguc

SEQ ID NO: 899636 - RNA, 17 nt, Mycobacterium avium subsp. paratuberculosis
ccccaauucuucggcgu

SEQ ID NO: 899637 - RNA, 17 nt, Mycobacterium avium subsp. paratuberculosis
ccccaaaacccggcauu

SEQ ID NO: 899638 - RNA, 15 nt, Mycobacterium avium subsp. paratuberculosis
ccccaaaacgggcga

SEQ ID NO: 899639 - RNA, 13 nt, Mycobacterium avium subsp. paratuberculosis
cccaucgccacgc

SEQ ID NO: 899640 - RNA, 16 nt, Mycobacterium avium subsp. paratuberculosis
cccaucgccacgccgu

SEQ ID NO: 899641 - RNA, 16 nt, Mycobacterium avium subsp. paratuberculosis
cccauugucgccgugc

SEQ ID NO: 899642 - RNA, 15 nt, Mycobacterium avium subsp. paratuberculosis
cccauccgcggccac

SEQ ID NO: 899643 - RNA, 16 nt, Mycobacterium avium subsp. paratuberculosis
cccauccgcggccacc

SEQ ID NO: 899644 - RNA, 22 nt, Mycobacterium avium subsp. paratuberculosis
cccauccgcggccaccgggacc

SEQ ID NO: 899645 - RNA, 15 nt, Mycobacterium avium subsp. paratuberculosis
cccauccggcgccgc

SEQ ID NO: 899646 - RNA, 21 nt, Mycobacterium avium subsp. paratuberculosis
cccaucgaccggaugaugccg

SEQ ID NO: 899647 - RNA, 11 nt, Mycobacterium avium subsp. paratuberculosis
ccccacgccau

SEQ ID NO: 899648 - RNA, 13 nt, Mycobacterium avium subsp. paratuberculosis
ccccacggcgcgu

SEQ ID NO: 899649 - RNA, 13 nt, Mycobacterium avium subsp. paratuberculosis
ccccacggcccgg

SEQ ID NO: 899650 - RNA, 21 nt, Mycobacterium avium subsp. paratuberculosis
ccccacggccgcaacggcggu

SEQ ID NO: 899651 - RNA, 16 nt, Mycobacterium avium subsp. paratuberculosis
ccccacaccguccgac

SEQ ID NO: 899652 - RNA, 14 nt, Mycobacterium avium subsp. paratuberculosis
ccccacacgcucgg

SEQ ID NO: 899653 - RNA, 13 nt, Mycobacterium avium subsp. paratuberculosis
ccccacagcgcgc

SEQ ID NO: 899654 - RNA, 19 nt, Mycobacterium avium subsp. paratuberculosis
ccccaccacauucccgccg

SEQ ID NO: 899655 - RNA, 13 nt, Mycobacterium avium subsp. paratuberculosis
ccccaccaccgcc

SEQ ID NO: 899656 - RNA, 22 nt, Mycobacterium avium subsp. paratuberculosis
ccccaccgaucaggaucggcgg

SEQ ID NO: 899657 - RNA, 19 nt, Mycobacterium avium subsp. paratuberculosis
ccccagaaccgcucggcgg

SEQ ID NO: 899658 - RNA, 19 nt, Mycobacterium avium subsp. paratuberculosis
ccccagacgauuugggcgg

SEQ ID NO: 899659 - RNA, 17 nt, Mycobacterium avium subsp. paratuberculosis
ccccagccccucgccgg

SEQ ID NO: 899660 - RNA, 17 nt, Mycobacterium avium subsp. paratuberculosis
ccccagcacggugaugc

SEQ ID NO: 899661 - RNA, 14 nt, Mycobacterium avium subsp. paratuberculosis
ccccagcagcgggg

SEQ ID NO: 899662 - RNA, 16 nt, Mycobacterium avium subsp. paratuberculosis
ccccagcagcggggug

SEQ ID NO: 899663 - RNA, 13 nt, Mycobacterium avium subsp. paratuberculosis
ccccagccggccg

SEQ ID NO: 899664 - RNA, 16 nt, Mycobacterium avium subsp. paratuberculosis
ccccagccggccgagc

SEQ ID NO: 899665 - RNA, 13 nt, Mycobacterium avium subsp. paratuberculosis
ccccagcccgccg

SEQ ID NO: 899666 - RNA, 15 nt, Mycobacterium avium subsp. paratuberculosis
ccccagcccgccggg

SEQ ID NO: 899667 - RNA, 14 nt, Mycobacterium avium subsp. paratuberculosis
ccccagcccggauc

SEQ ID NO: 899668 - RNA, 14 nt, Mycobacterium avium subsp. paratuberculosis
ccccagcccggcug

SEQ ID NO: 899669 - RNA, 21 nt, Mycobacterium avium subsp. paratuberculosis
ccccagcccggggguggcggu

SEQ ID NO: 899670 - RNA, 13 nt, Mycobacterium avium subsp. paratuberculosis
ccccagccgacca

SEQ ID NO: 899671 - RNA, 16 nt, Mycobacterium avium subsp. paratuberculosis
ccccagccgccgcgac

SEQ ID NO: 899672 - RNA, 14 nt, Mycobacterium avium subsp. paratuberculosis
ccccagcggcacga

SEQ ID NO: 899673 - RNA, 23 nt, Mycobacterium avium subsp. paratuberculosis
ccccagcggcacgaucucgacca

SEQ ID NO: 899674 - RNA, 22 nt, Mycobacterium avium subsp. paratuberculosis
ccccagcggggcaagcagcggc

SEQ ID NO: 899675 - RNA, 23 nt, Mycobacterium avium subsp. paratuberculosis
ccccagcggggcaagcagcggca

SEQ ID NO: 899676 - RNA, 21 nt, Mycobacterium avium subsp. paratuberculosis
ccccagcugggccgccagccg

SEQ ID NO: 899677 - RNA, 21 nt, Mycobacterium avium subsp. paratuberculosis
ccccaggaggcacuggcgcug

SEQ ID NO: 899678 - RNA, 17 nt, Mycobacterium avium subsp. paratuberculosis
ccccaggauggccgcuu

SEQ ID NO: 899679 - RNA, 14 nt, Mycobacterium avium subsp. paratuberculosis
ccccagcgugacgu

SEQ ID NO: 899680 - RNA, 17 nt, Mycobacterium avium subsp. paratuberculosis
ccccagcgugacgucga

SEQ ID NO: 899681 - RNA, 18 nt, Mycobacterium avium subsp. paratuberculosis
ccccagcuccucggcccc

SEQ ID NO: 899682 - RNA, 21 nt, Mycobacterium avium subsp. paratuberculosis
ccccagcucgacgacuucggc

SEQ ID NO: 899683 - RNA, 20 nt, Mycobacterium avium subsp. paratuberculosis
ccccaggcgaugccgccgac

SEQ ID NO: 899684 - RNA, 21 nt, Mycobacterium avium subsp. paratuberculosis
ccccaggcgaugccgccgacg

SEQ ID NO: 899685 - RNA, 16 nt, Mycobacterium avium subsp. paratuberculosis
ccccaggucggggugg

SEQ ID NO: 899686 - RNA, 15 nt, Mycobacterium avium subsp. paratuberculosis
ccccaggugacgccg

SEQ ID NO: 899687 - RNA, 15 nt, Mycobacterium avium subsp. paratuberculosis
ccccagggugcgccg

SEQ ID NO: 899688 - RNA, 19 nt, Mycobacterium avium subsp. paratuberculosis
ccccaggcgaacauggcgg

SEQ ID NO: 899689 - RNA, 14 nt, Mycobacterium avium subsp. paratuberculosis
ccccauugccgcgc

SEQ ID NO: 899690 - RNA, 15 nt, Mycobacterium avium subsp. paratuberculosis
ccccauugccgcgcc

SEQ ID NO: 899691 - RNA, 18 nt, Mycobacterium avium subsp. paratuberculosis
ccccauugccgcgccggg

SEQ ID NO: 899692 - RNA, 21 nt, Mycobacterium avium subsp. paratuberculosis
cccccagcucgacgacuucgg

SEQ ID NO: 899693 - RNA, 13 nt, Mycobacterium avium subsp. paratuberculosis
ccccccugcucgc

SEQ ID NO: 899694 - RNA, 14 nt, Mycobacterium avium subsp. paratuberculosis
ccccauccgcggcc

SEQ ID NO: 899695 - RNA, 15 nt, Mycobacterium avium subsp. paratuberculosis
ccccauccgcggcca

SEQ ID NO: 899696 - RNA, 17 nt, Mycobacterium avium subsp. paratuberculosis
ccccauccgcggccacc

SEQ ID NO: 899697 - RNA, 16 nt, Mycobacterium avium subsp. paratuberculosis
ccccauacacgggccg

SEQ ID NO: 899698 - RNA, 12 nt, Mycobacterium avium subsp. paratuberculosis
ccccggcaucga

SEQ ID NO: 899699 - RNA, 17 nt, Mycobacterium avium subsp. paratuberculosis
ccccggccagggugccg

SEQ ID NO: 899700 - RNA, 15 nt, Mycobacterium avium subsp. paratuberculosis
ccccgcuucggcucg

SEQ ID NO: 899701 - RNA, 18 nt, Mycobacterium avium subsp. paratuberculosis
ccccggacaacggaucga

SEQ ID NO: 899702 - RNA, 16 nt, Mycobacterium avium subsp. paratuberculosis
ccccggaccugccggc

SEQ ID NO: 899703 - RNA, 18 nt, Mycobacterium avium subsp. paratuberculosis
ccccggaccugccggcga

SEQ ID NO: 899704 - RNA, 12 nt, Mycobacterium avium subsp. paratuberculosis
ccccggacggcc

SEQ ID NO: 899705 - RNA, 13 nt, Mycobacterium avium subsp. paratuberculosis
ccccggacggccg

SEQ ID NO: 899706 - RNA, 20 nt, Mycobacterium avium subsp. paratuberculosis
ccccggauccgucgccccgc

SEQ ID NO: 899707 - RNA, 23 nt, Mycobacterium avium subsp. paratuberculosis
ccccggaugaccaggguggucag

SEQ ID NO: 899708 - RNA, 19 nt, Mycobacterium avium subsp. paratuberculosis
ccccgcugccguccggcgg

SEQ ID NO: 899709 - RNA, 12 nt, Mycobacterium avium subsp. paratuberculosis
ccccgcuggcga

SEQ ID NO: 899710 - RNA, 13 nt, Mycobacterium avium subsp. paratuberculosis
ccccgcuggcgaa

SEQ ID NO: 899711 - RNA, 14 nt, Mycobacterium avium subsp. paratuberculosis
ccccgcuggcgccg

SEQ ID NO: 899712 - RNA, 15 nt, Mycobacterium avium subsp. paratuberculosis
ccccgcuggcgccgg

SEQ ID NO: 899713 - RNA, 17 nt, Mycobacterium avium subsp. paratuberculosis
ccccgcucccauccgga

SEQ ID NO: 899714 - RNA, 19 nt, Mycobacterium avium subsp. paratuberculosis
ccccgcuccuccucgcgcc

SEQ ID NO: 899715 - RNA, 15 nt, Mycobacterium avium subsp. paratuberculosis
ccccgcucggccagc

SEQ ID NO: 899716 - RNA, 18 nt, Mycobacterium avium subsp. paratuberculosis
ccccgcucggccagcgcg

SEQ ID NO: 899717 - RNA, 22 nt, Mycobacterium avium subsp. paratuberculosis
ccccgcgggucgucgacgucgg

SEQ ID NO: 899718 - RNA, 19 nt, Mycobacterium avium subsp. paratuberculosis
ccccgcggucggcggcgua

SEQ ID NO: 899719 - RNA, 15 nt, Mycobacterium avium subsp. paratuberculosis
ccccgcggugccgca

SEQ ID NO: 899720 - RNA, 17 nt, Mycobacterium avium subsp. paratuberculosis
ccccgcggugccgcagc

SEQ ID NO: 899721 - RNA, 20 nt, Mycobacterium avium subsp. paratuberculosis
ccccgcggugccgcagcucg

SEQ ID NO: 899722 - RNA, 24 nt, Mycobacterium avium subsp. paratuberculosis
ccccgcgguucgaggugcucgcgc

SEQ ID NO: 899723 - RNA, 17 nt, Mycobacterium avium subsp. paratuberculosis
ccccgcgugacggccgc

SEQ ID NO: 899724 - RNA, 23 nt, Mycobacterium avium subsp. paratuberculosis
ccccgcgugacggccgcggcgcg

SEQ ID NO: 899725 - RNA, 14 nt, Mycobacterium avium subsp. paratuberculosis
ccccgcgcgcgggc

SEQ ID NO: 899726 - RNA, 13 nt, Mycobacterium avium subsp. paratuberculosis
ccccgcgcggcuc

SEQ ID NO: 899727 - RNA, 21 nt, Mycobacterium avium subsp. paratuberculosis
ccccgcgcggcucgcgggcga

SEQ ID NO: 899728 - RNA, 14 nt, Mycobacterium avium subsp. paratuberculosis
ccccgcgcugccca

SEQ ID NO: 899729 - RNA, 17 nt, Mycobacterium avium subsp. paratuberculosis
ccccgcgcugcccagcg

SEQ ID NO: 899730 - RNA, 19 nt, Mycobacterium avium subsp. paratuberculosis
ccccgcgcugggcuggccg

SEQ ID NO: 899731 - RNA, 21 nt, Mycobacterium avium subsp. paratuberculosis
ccccgcgcugggcuggccguc

SEQ ID NO: 899732 - RNA, 11 nt, Mycobacterium avium subsp. paratuberculosis
ccccgcggcca

SEQ ID NO: 899733 - RNA, 15 nt, Mycobacterium avium subsp. paratuberculosis
ccccgccgguggcgg

SEQ ID NO: 899734 - RNA, 14 nt, Mycobacterium avium subsp. paratuberculosis
ccccgccggagaug

SEQ ID NO: 899735 - RNA, 13 nt, Mycobacterium avium subsp. paratuberculosis
ccccgccggcccg

SEQ ID NO: 899736 - RNA, 14 nt, Mycobacterium avium subsp. paratuberculosis
ccccgccggcccgg

SEQ ID NO: 899737 - RNA, 13 nt, Mycobacterium avium subsp. paratuberculosis
ccccgccucgccg

SEQ ID NO: 899738 - RNA, 14 nt, Mycobacterium avium subsp. paratuberculosis
ccccgccucgccgg

SEQ ID NO: 899739 - RNA, 15 nt, Mycobacterium avium subsp. paratuberculosis
ccccgccucgccggu

SEQ ID NO: 899740 - RNA, 16 nt, Mycobacterium avium subsp. paratuberculosis
ccccgcgacacgccgc

SEQ ID NO: 899741 - RNA, 17 nt, Mycobacterium avium subsp. paratuberculosis
ccccgcgacacgccgcg

SEQ ID NO: 899742 - RNA, 13 nt, Mycobacterium avium subsp. paratuberculosis
ccccgcgccgccc

SEQ ID NO: 899743 - RNA, 16 nt, Mycobacterium avium subsp. paratuberculosis
ccccgcgccgcccgga

SEQ ID NO: 899744 - RNA, 14 nt, Mycobacterium avium subsp. paratuberculosis
ccccgcgccgggcg

SEQ ID NO: 899745 - RNA, 13 nt, Mycobacterium avium subsp. paratuberculosis
ccccgccgccgug

SEQ ID NO: 899746 - RNA, 14 nt, Mycobacterium avium subsp. paratuberculosis
ccccgccgcgccgg

SEQ ID NO: 899747 - RNA, 15 nt, Mycobacterium avium subsp. paratuberculosis
ccccgccgcggccag

SEQ ID NO: 899748 - RNA, 15 nt, Mycobacterium avium subsp. paratuberculosis
ccccgcccacgaaga

SEQ ID NO: 899749 - RNA, 13 nt, Mycobacterium avium subsp. paratuberculosis
ccccgcccgcgac

SEQ ID NO: 899750 - RNA, 19 nt, Mycobacterium avium subsp. paratuberculosis
ccccgccaaucaccgcggu

SEQ ID NO: 899751 - RNA, 21 nt, Mycobacterium avium subsp. paratuberculosis
ccccgccagauagggcagcgu

SEQ ID NO: 899752 - RNA, 23 nt, Mycobacterium avium subsp. paratuberculosis
ccccgccagauagggcagcgucc

SEQ ID NO: 899753 - RNA, 19 nt, Mycobacterium avium subsp. paratuberculosis
ccccgccaggcggcgacga

SEQ ID NO: 899754 - RNA, 13 nt, Mycobacterium avium subsp. paratuberculosis
ccccgcccggauc

SEQ ID NO: 899755 - RNA, 12 nt, Mycobacterium avium subsp. paratuberculosis
ccccgcccggcc

SEQ ID NO: 899756 - RNA, 14 nt, Mycobacterium avium subsp. paratuberculosis
ccccgcccggccgg

SEQ ID NO: 899757 - RNA, 14 nt, Mycobacterium avium subsp. paratuberculosis
ccccgcccggcgcg

SEQ ID NO: 899758 - RNA, 13 nt, Mycobacterium avium subsp. paratuberculosis
ccccgcccggcgg

SEQ ID NO: 899759 - RNA, 14 nt, Mycobacterium avium subsp. paratuberculosis
ccccgcccggcggc

SEQ ID NO: 899760 - RNA, 15 nt, Mycobacterium avium subsp. paratuberculosis
ccccgcccggcggcc

SEQ ID NO: 899761 - RNA, 13 nt, Mycobacterium avium subsp. paratuberculosis
ccccgcccggggc

SEQ ID NO: 899762 - RNA, 14 nt, Mycobacterium avium subsp. paratuberculosis
ccccgcccggggcg

SEQ ID NO: 899763 - RNA, 19 nt, Mycobacterium avium subsp. paratuberculosis
ccccgacgaucgcgccggc

SEQ ID NO: 899764 - RNA, 14 nt, Mycobacterium avium subsp. paratuberculosis
ccccgacgccgacg

SEQ ID NO: 899765 - RNA, 14 nt, Mycobacterium avium subsp. paratuberculosis
ccccgaccgacgcg

SEQ ID NO: 899766 - RNA, 15 nt, Mycobacterium avium subsp. paratuberculosis
ccccgacggcgccgc

SEQ ID NO: 899767 - RNA, 14 nt, Mycobacterium avium subsp. paratuberculosis
ccccgagaucgcgg

SEQ ID NO: 899768 - RNA, 15 nt, Mycobacterium avium subsp. paratuberculosis
ccccgagcacgucga

SEQ ID NO: 899769 - RNA, 16 nt, Mycobacterium avium subsp. paratuberculosis
ccccgagcagcggguc

SEQ ID NO: 899770 - RNA, 21 nt, Mycobacterium avium subsp. paratuberculosis
ccccgagcagcgggucgucgg

SEQ ID NO: 899771 - RNA, 18 nt, Mycobacterium avium subsp. paratuberculosis
ccccgauagccccgccag

SEQ ID NO: 899772 - RNA, 15 nt, Mycobacterium avium subsp. paratuberculosis
ccccgaucaacaccg

SEQ ID NO: 899773 - RNA, 15 nt, Mycobacterium avium subsp. paratuberculosis
ccccgaguucggcca

SEQ ID NO: 899774 - RNA, 14 nt, Mycobacterium avium subsp. paratuberculosis
ccccgagccgacga

SEQ ID NO: 899775 - RNA, 13 nt, Mycobacterium avium subsp. paratuberculosis
ccccgagcgucac

SEQ ID NO: 899776 - RNA, 21 nt, Mycobacterium avium subsp. paratuberculosis
ccccgaggagacgucggccgg

SEQ ID NO: 899777 - RNA, 13 nt, Mycobacterium avium subsp. paratuberculosis
ccccgcagcuccc

SEQ ID NO: 899778 - RNA, 20 nt, Mycobacterium avium subsp. paratuberculosis
ccccgcagcucccccggcgu

SEQ ID NO: 899779 - RNA, 17 nt, Mycobacterium avium subsp. paratuberculosis
ccccgcacgccagcauc

SEQ ID NO: 899780 - RNA, 18 nt, Mycobacterium avium subsp. paratuberculosis
ccccgaugcgcucgccga

SEQ ID NO: 899781 - RNA, 21 nt, Mycobacterium avium subsp. paratuberculosis
ccccgaugcggugccgggcca

SEQ ID NO: 899782 - RNA, 12 nt, Mycobacterium avium subsp. paratuberculosis
ccccgcacaccg

SEQ ID NO: 899783 - RNA, 14 nt, Mycobacterium avium subsp. paratuberculosis
ccccgaucggggcc

SEQ ID NO: 899784 - RNA, 15 nt, Mycobacterium avium subsp. paratuberculosis
ccccgaucggggcca

SEQ ID NO: 899785 - RNA, 23 nt, Mycobacterium avium subsp. paratuberculosis
ccccgaucgcgaucaccgcggcc

SEQ ID NO: 899786 - RNA, 12 nt, Mycobacterium avium subsp. paratuberculosis
cccccggggugg

SEQ ID NO: 899787 - RNA, 23 nt, Mycobacterium avium subsp. paratuberculosis
cccccgggguggugugcaaggcg

SEQ ID NO: 899788 - RNA, 19 nt, Mycobacterium avium subsp. paratuberculosis
cccccggugucugaccucg

SEQ ID NO: 899789 - RNA, 20 nt, Mycobacterium avium subsp. paratuberculosis
cccccggugucugaccucgc

SEQ ID NO: 899790 - RNA, 13 nt, Mycobacterium avium subsp. paratuberculosis
cccccgcggugag

SEQ ID NO: 899791 - RNA, 21 nt, Mycobacterium avium subsp. paratuberculosis
cccccgcggugaguucaucga

SEQ ID NO: 899792 - RNA, 14 nt, Mycobacterium avium subsp. paratuberculosis
cccccgcggcgucc

SEQ ID NO: 899793 - RNA, 15 nt, Mycobacterium avium subsp. paratuberculosis
cccccggcgugagcg

SEQ ID NO: 899794 - RNA, 14 nt, Mycobacterium avium subsp. paratuberculosis
cccccgccgcgagc

SEQ ID NO: 899795 - RNA, 22 nt, Mycobacterium avium subsp. paratuberculosis
cccccgccgcgucggucagcgc

SEQ ID NO: 899796 - RNA, 14 nt, Mycobacterium avium subsp. paratuberculosis
cccccgccggggcc

SEQ ID NO: 899797 - RNA, 12 nt, Mycobacterium avium subsp. paratuberculosis
cccccgacccgc

SEQ ID NO: 899798 - RNA, 15 nt, Mycobacterium avium subsp. paratuberculosis
cccccgagcgggccu

SEQ ID NO: 899799 - RNA, 16 nt, Mycobacterium avium subsp. paratuberculosis
cccccgagcuucgggu

SEQ ID NO: 899800 - RNA, 20 nt, Mycobacterium avium subsp. paratuberculosis
cccccgaggagacgucggcc

SEQ ID NO: 899801 - RNA, 20 nt, Mycobacterium avium subsp. paratuberculosis
cccccgagucggagacccgc

SEQ ID NO: 899802 - RNA, 15 nt, Mycobacterium avium subsp. paratuberculosis
ccccgacaccgccag

SEQ ID NO: 899803 - RNA, 14 nt, Mycobacterium avium subsp. paratuberculosis
ccccgacaggccca

SEQ ID NO: 899804 - RNA, 17 nt, Mycobacterium avium subsp. paratuberculosis
ccccgacaucgccauca

SEQ ID NO: 899805 - RNA, 21 nt, Mycobacterium avium subsp. paratuberculosis
cccccuugagccgguccgacg

SEQ ID NO: 899806 - RNA, 15 nt, Mycobacterium avium subsp. paratuberculosis
ccccgaaccgcccgc

SEQ ID NO: 899807 - RNA, 12 nt, Mycobacterium avium subsp. paratuberculosis
cccccucgucga

SEQ ID NO: 899808 - RNA, 21 nt, Mycobacterium avium subsp. paratuberculosis
ccccgaaaccauugcaccgca

SEQ ID NO: 899809 - RNA, 18 nt, Mycobacterium avium subsp. paratuberculosis
cccccguuuccucgcgca

SEQ ID NO: 899810 - RNA, 14 nt, Mycobacterium avium subsp. paratuberculosis
cccccucggccggu

SEQ ID NO: 899811 - RNA, 13 nt, Mycobacterium avium subsp. paratuberculosis
cccccucggcggg

SEQ ID NO: 899812 - RNA, 12 nt, Mycobacterium avium subsp. paratuberculosis
cccagacgcggg

SEQ ID NO: 899813 - RNA, 19 nt, Mycobacterium avium subsp. paratuberculosis
cccagacgcgggcgcccag

SEQ ID NO: 899814 - RNA, 13 nt, Mycobacterium avium subsp. paratuberculosis
cccagacgucgac

SEQ ID NO: 899815 - RNA, 20 nt, Mycobacterium avium subsp. paratuberculosis
cccagacguuuccguccggc

SEQ ID NO: 899816 - RNA, 23 nt, Mycobacterium avium subsp. paratuberculosis
cccagacguuuccguccggcgac

SEQ ID NO: 899817 - RNA, 14 nt, Mycobacterium avium subsp. paratuberculosis
cccagauacgccgc

SEQ ID NO: 899818 - RNA, 16 nt, Mycobacterium avium subsp. paratuberculosis
cccagauacgccgcga

SEQ ID NO: 899819 - RNA, 17 nt, Mycobacterium avium subsp. paratuberculosis
cccagauacgccgcgac

SEQ ID NO: 899820 - RNA, 15 nt, Mycobacterium avium subsp. paratuberculosis
cccacgggaugcggc

SEQ ID NO: 899821 - RNA, 19 nt, Mycobacterium avium subsp. paratuberculosis
cccacgggaugcggcacgc

SEQ ID NO: 899822 - RNA, 18 nt, Mycobacterium avium subsp. paratuberculosis
cccacguaggcgaugucg

SEQ ID NO: 899823 - RNA, 17 nt, Mycobacterium avium subsp. paratuberculosis
cccacguaggggcccgg

SEQ ID NO: 899824 - RNA, 20 nt, Mycobacterium avium subsp. paratuberculosis
cccacggugauuccggcacc

SEQ ID NO: 899825 - RNA, 21 nt, Mycobacterium avium subsp. paratuberculosis
cccacggugauuccggcaccc

SEQ ID NO: 899826 - RNA, 18 nt, Mycobacterium avium subsp. paratuberculosis
cccagcaaaaccccgccg

SEQ ID NO: 899827 - RNA, 19 nt, Mycobacterium avium subsp. paratuberculosis
cccagcaaacccagcacca

SEQ ID NO: 899828 - RNA, 15 nt, Mycobacterium avium subsp. paratuberculosis
cccagaucgacgccg

SEQ ID NO: 899829 - RNA, 21 nt, Mycobacterium avium subsp. paratuberculosis
cccagaucgacgccgaccgcg

SEQ ID NO: 899830 - RNA, 12 nt, Mycobacterium avium subsp. paratuberculosis
cccagaucgccc

SEQ ID NO: 899831 - RNA, 21 nt, Mycobacterium avium subsp. paratuberculosis
cccagacgaugucgucgccgg

SEQ ID NO: 899832 - RNA, 23 nt, Mycobacterium avium subsp. paratuberculosis
cccagacgauuugggcgguccgc

SEQ ID NO: 899833 - RNA, 15 nt, Mycobacterium avium subsp. paratuberculosis
cccagaucggccagc

SEQ ID NO: 899834 - RNA, 20 nt, Mycobacterium avium subsp. paratuberculosis
cccagaucguagggcucggc

SEQ ID NO: 899835 - RNA, 17 nt, Mycobacterium avium subsp. paratuberculosis
cccagaugcccagcggc

SEQ ID NO: 899836 - RNA, 13 nt, Mycobacterium avium subsp. paratuberculosis
cccagaugccggc

SEQ ID NO: 899837 - RNA, 13 nt, Mycobacterium avium subsp. paratuberculosis
cccaccgggcagc

SEQ ID NO: 899838 - RNA, 16 nt, Mycobacterium avium subsp. paratuberculosis
cccaccucgagcacgc

SEQ ID NO: 899839 - RNA, 23 nt, Mycobacterium avium subsp. paratuberculosis
cccaccgucuuggucucgccgau

SEQ ID NO: 899840 - RNA, 22 nt, Mycobacterium avium subsp. paratuberculosis
cccacgacgacugggugcgcgg

SEQ ID NO: 899841 - RNA, 22 nt, Mycobacterium avium subsp. paratuberculosis
cccacgacgucugggccgccga

SEQ ID NO: 899842 - RNA, 21 nt, Mycobacterium avium subsp. paratuberculosis
cccaccuucccaaccccgggc

SEQ ID NO: 899843 - RNA, 16 nt, Mycobacterium avium subsp. paratuberculosis
cccaccuuggcgucga

SEQ ID NO: 899844 - RNA, 18 nt, Mycobacterium avium subsp. paratuberculosis
cccacgaagaugaucagc

SEQ ID NO: 899845 - RNA, 22 nt, Mycobacterium avium subsp. paratuberculosis
cccacgaagaugaucagcgcgc

SEQ ID NO: 899846 - RNA, 23 nt, Mycobacterium avium subsp. paratuberculosis
cccacgaagaugaucagcgcgcc

SEQ ID NO: 899847 - RNA, 20 nt, Mycobacterium avium subsp. paratuberculosis
cccaccugaucgcggcgagc

SEQ ID NO: 899848 - RNA, 22 nt, Mycobacterium avium subsp. paratuberculosis
cccaccugguucucccgucgcg

SEQ ID NO: 899849 - RNA, 12 nt, Mycobacterium avium subsp. paratuberculosis
cccacggccaca

SEQ ID NO: 899850 - RNA, 20 nt, Mycobacterium avium subsp. paratuberculosis
cccacgcgcucagcgcggcc

SEQ ID NO: 899851 - RNA, 13 nt, Mycobacterium avium subsp. paratuberculosis
cccacgccgucga

SEQ ID NO: 899852 - RNA, 20 nt, Mycobacterium avium subsp. paratuberculosis
cccacgccuugcgguuggcc

SEQ ID NO: 899853 - RNA, 12 nt, Mycobacterium avium subsp. paratuberculosis
cccacgccgccc

SEQ ID NO: 899854 - RNA, 19 nt, Mycobacterium avium subsp. paratuberculosis
cccacgcccuagcgggcca

SEQ ID NO: 899855 - RNA, 19 nt, Mycobacterium avium subsp. paratuberculosis
cccacgaguaaccggugcg

SEQ ID NO: 899856 - RNA, 17 nt, Mycobacterium avium subsp. paratuberculosis
ccauucgggccagcgcc

SEQ ID NO: 899857 - RNA, 22 nt, Mycobacterium avium subsp. paratuberculosis
ccauucggucucgccccggccg

SEQ ID NO: 899858 - RNA, 16 nt, Mycobacterium avium subsp. paratuberculosis
ccauucgucggcgguc

SEQ ID NO: 899859 - RNA, 21 nt, Mycobacterium avium subsp. paratuberculosis
ccauucguggcugaacagcgc

SEQ ID NO: 899860 - RNA, 15 nt, Mycobacterium avium subsp. paratuberculosis
ccauugccgcgccgg

SEQ ID NO: 899861 - RNA, 12 nt, Mycobacterium avium subsp. paratuberculosis
cccaccaggucg

SEQ ID NO: 899862 - RNA, 13 nt, Mycobacterium avium subsp. paratuberculosis
cccaccaucccgc

SEQ ID NO: 899863 - RNA, 12 nt, Mycobacterium avium subsp. paratuberculosis
cccaccagcagg

SEQ ID NO: 899864 - RNA, 14 nt, Mycobacterium avium subsp. paratuberculosis
cccaccagcagguc

SEQ ID NO: 899865 - RNA, 13 nt, Mycobacterium avium subsp. paratuberculosis
cccacccgcgcga

SEQ ID NO: 899866 - RNA, 12 nt, Mycobacterium avium subsp. paratuberculosis
cccacccggggc

SEQ ID NO: 899867 - RNA, 13 nt, Mycobacterium avium subsp. paratuberculosis
cccacccggguug

SEQ ID NO: 899868 - RNA, 13 nt, Mycobacterium avium subsp. paratuberculosis
cccaccccggcgu

SEQ ID NO: 899869 - RNA, 14 nt, Mycobacterium avium subsp. paratuberculosis
cccaccccggcguc

SEQ ID NO: 899870 - RNA, 17 nt, Mycobacterium avium subsp. paratuberculosis
cccacccgaugaccggc

SEQ ID NO: 899871 - RNA, 15 nt, Mycobacterium avium subsp. paratuberculosis
cccaccggcccagcc

SEQ ID NO: 899872 - RNA, 17 nt, Mycobacterium avium subsp. paratuberculosis
cccaccggcccggcggg

SEQ ID NO: 899873 - RNA, 13 nt, Mycobacterium avium subsp. paratuberculosis
cccaccgcgccgu

SEQ ID NO: 899874 - RNA, 15 nt, Mycobacterium avium subsp. paratuberculosis
cccaccgcgccguga

SEQ ID NO: 899875 - RNA, 16 nt, Mycobacterium avium subsp. paratuberculosis
cccaccaggcgcgggc

SEQ ID NO: 899876 - RNA, 12 nt, Mycobacterium avium subsp. paratuberculosis
cccaccgcgaca

SEQ ID NO: 899877 - RNA, 17 nt, Mycobacterium avium subsp. paratuberculosis
cccaccgcgacacgucg

SEQ ID NO: 899878 - RNA, 15 nt, Mycobacterium avium subsp. paratuberculosis
cccaccgcggcgcgc

SEQ ID NO: 899879 - RNA, 18 nt, Mycobacterium avium subsp. paratuberculosis
cccaccgcggcgcgcggc

SEQ ID NO: 899880 - RNA, 15 nt, Mycobacterium avium subsp. paratuberculosis
cccaccgcuggaacc

SEQ ID NO: 899881 - RNA, 12 nt, Mycobacterium avium subsp. paratuberculosis
cccaccgccacc

SEQ ID NO: 899882 - RNA, 18 nt, Mycobacterium avium subsp. paratuberculosis
cccaggauucccgacccc

SEQ ID NO: 899883 - RNA, 20 nt, Mycobacterium avium subsp. paratuberculosis
cccaggauucccgaccccgc

SEQ ID NO: 899884 - RNA, 17 nt, Mycobacterium avium subsp. paratuberculosis
cccaggauuccgucggc

SEQ ID NO: 899885 - RNA, 18 nt, Mycobacterium avium subsp. paratuberculosis
cccaggauuccgucggcg

SEQ ID NO: 899886 - RNA, 21 nt, Mycobacterium avium subsp. paratuberculosis
cccaggauuccgucggcggcc

SEQ ID NO: 899887 - RNA, 23 nt, Mycobacterium avium subsp. paratuberculosis
cccaggauuccgucggcggccga

SEQ ID NO: 899888 - RNA, 18 nt, Mycobacterium avium subsp. paratuberculosis
cccaggauucucagcagc

SEQ ID NO: 899889 - RNA, 15 nt, Mycobacterium avium subsp. paratuberculosis
cccaggcccagcagc

SEQ ID NO: 899890 - RNA, 21 nt, Mycobacterium avium subsp. paratuberculosis
cccagcgucaacucgucggcg

SEQ ID NO: 899891 - RNA, 21 nt, Mycobacterium avium subsp. paratuberculosis
cccaggcagacccccagcagc

SEQ ID NO: 899892 - RNA, 22 nt, Mycobacterium avium subsp. paratuberculosis
cccaggcagacccccagcagcg

SEQ ID NO: 899893 - RNA, 20 nt, Mycobacterium avium subsp. paratuberculosis
cccaggccccggccgagcgc

SEQ ID NO: 899894 - RNA, 14 nt, Mycobacterium avium subsp. paratuberculosis
cccaggccgccagc

SEQ ID NO: 899895 - RNA, 14 nt, Mycobacterium avium subsp. paratuberculosis
cccaggccgccgcc

SEQ ID NO: 899896 - RNA, 18 nt, Mycobacterium avium subsp. paratuberculosis
cccaggccgccgccaccg

SEQ ID NO: 899897 - RNA, 13 nt, Mycobacterium avium subsp. paratuberculosis
cccaggccgcggc

SEQ ID NO: 899898 - RNA, 13 nt, Mycobacterium avium subsp. paratuberculosis
cccaggccgcggu

SEQ ID NO: 899899 - RNA, 18 nt, Mycobacterium avium subsp. paratuberculosis
cccagguucuccggcccg

SEQ ID NO: 899900 - RNA, 12 nt, Mycobacterium avium subsp. paratuberculosis
cccaggccgacg

SEQ ID NO: 899901 - RNA, 15 nt, Mycobacterium avium subsp. paratuberculosis
cccaggccgacgccg

SEQ ID NO: 899902 - RNA, 16 nt, Mycobacterium avium subsp. paratuberculosis
cccaggcccggcaccg

SEQ ID NO: 899903 - RNA, 17 nt, Mycobacterium avium subsp. paratuberculosis
cccaggcccggcaccgg

SEQ ID NO: 899904 - RNA, 15 nt, Mycobacterium avium subsp. paratuberculosis
cccaggcccgggauc

SEQ ID NO: 899905 - RNA, 23 nt, Mycobacterium avium subsp. paratuberculosis
cccaguagcggaaguacaccggu

SEQ ID NO: 899906 - RNA, 19 nt, Mycobacterium avium subsp. paratuberculosis
cccaguccagucgcgccga

SEQ ID NO: 899907 - RNA, 12 nt, Mycobacterium avium subsp. paratuberculosis
cccagucgccgc

SEQ ID NO: 899908 - RNA, 17 nt, Mycobacterium avium subsp. paratuberculosis
cccagucgccgccgcgc

SEQ ID NO: 899909 - RNA, 21 nt, Mycobacterium avium subsp. paratuberculosis
cccagucguuggugcgcacca

SEQ ID NO: 899910 - RNA, 15 nt, Mycobacterium avium subsp. paratuberculosis
cccagugcaggcuga

SEQ ID NO: 899911 - RNA, 23 nt, Mycobacterium avium subsp. paratuberculosis
cccagugcaggcugacgcgaccg

SEQ ID NO: 899912 - RNA, 17 nt, Mycobacterium avium subsp. paratuberculosis
cccagugccgcaggugg

SEQ ID NO: 899913 - RNA, 15 nt, Mycobacterium avium subsp. paratuberculosis
cccagugcgcgccgu

SEQ ID NO: 899914 - RNA, 13 nt, Mycobacterium avium subsp. paratuberculosis
cccagugcucgac

SEQ ID NO: 899915 - RNA, 17 nt, Mycobacterium avium subsp. paratuberculosis
cccaguggaucggcccg

SEQ ID NO: 899916 - RNA, 18 nt, Mycobacterium avium subsp. paratuberculosis
cccaguggaucggcccga

SEQ ID NO: 899917 - RNA, 15 nt, Mycobacterium avium subsp. paratuberculosis
cccaucaccagcggc

SEQ ID NO: 899918 - RNA, 15 nt, Mycobacterium avium subsp. paratuberculosis
cccaucaccccgaag

SEQ ID NO: 899919 - RNA, 13 nt, Mycobacterium avium subsp. paratuberculosis
cccaucaccgcac

SEQ ID NO: 899920 - RNA, 21 nt, Mycobacterium avium subsp. paratuberculosis
cccaucaggaugcccgggccg

SEQ ID NO: 899921 - RNA, 14 nt, Mycobacterium avium subsp. paratuberculosis
cccaucagugcggc

SEQ ID NO: 899922 - RNA, 13 nt, Mycobacterium avium subsp. paratuberculosis
cccagcgcguuga

SEQ ID NO: 899923 - RNA, 18 nt, Mycobacterium avium subsp. paratuberculosis
cccagcgcguugcggccg

SEQ ID NO: 899924 - RNA, 12 nt, Mycobacterium avium subsp. paratuberculosis
cccagcgcggcg

SEQ ID NO: 899925 - RNA, 13 nt, Mycobacterium avium subsp. paratuberculosis
cccagcgcggucg

SEQ ID NO: 899926 - RNA, 14 nt, Mycobacterium avium subsp. paratuberculosis
cccagcgcggucgc

SEQ ID NO: 899927 - RNA, 19 nt, Mycobacterium avium subsp. paratuberculosis
cccagcgcgcgaucgccgg

SEQ ID NO: 899928 - RNA, 13 nt, Mycobacterium avium subsp. paratuberculosis
cccagcgcgcggc

SEQ ID NO: 899929 - RNA, 14 nt, Mycobacterium avium subsp. paratuberculosis
cccagcgcgcggcg

SEQ ID NO: 899930 - RNA, 16 nt, Mycobacterium avium subsp. paratuberculosis
cccagcgcgaggucga

SEQ ID NO: 899931 - RNA, 19 nt, Mycobacterium avium subsp. paratuberculosis
cccagcgccucgagcacca

SEQ ID NO: 899932 - RNA, 20 nt, Mycobacterium avium subsp. paratuberculosis
cccagcgccucgagcaccac

SEQ ID NO: 899933 - RNA, 13 nt, Mycobacterium avium subsp. paratuberculosis
cccagcagcggcc

SEQ ID NO: 899934 - RNA, 16 nt, Mycobacterium avium subsp. paratuberculosis
cccagcagcggccggc

SEQ ID NO: 899935 - RNA, 12 nt, Mycobacterium avium subsp. paratuberculosis
cccagcagcgca

SEQ ID NO: 899936 - RNA, 15 nt, Mycobacterium avium subsp. paratuberculosis
cccagcagcgcaccg

SEQ ID NO: 899937 - RNA, 14 nt, Mycobacterium avium subsp. paratuberculosis
cccagcacgacgcc

SEQ ID NO: 899938 - RNA, 17 nt, Mycobacterium avium subsp. paratuberculosis
cccagcacgacgccgcu

SEQ ID NO: 899939 - RNA, 23 nt, Mycobacterium avium subsp. paratuberculosis
cccagcacgaucccgccgcccgc

SEQ ID NO: 899940 - RNA, 16 nt, Mycobacterium avium subsp. paratuberculosis
cccagcaccgcgacga

SEQ ID NO: 899941 - RNA, 22 nt, Mycobacterium avium subsp. paratuberculosis
cccagcaccccgguccaggcga

SEQ ID NO: 899942 - RNA, 16 nt, Mycobacterium avium subsp. paratuberculosis
cccagcacccgcucgc

SEQ ID NO: 899943 - RNA, 19 nt, Mycobacterium avium subsp. paratuberculosis
cccagcaccaacagcggcc

SEQ ID NO: 899944 - RNA, 21 nt, Mycobacterium avium subsp. paratuberculosis
cccagcaccaacagcggcccg

SEQ ID NO: 899945 - RNA, 15 nt, Mycobacterium avium subsp. paratuberculosis
cccagcacagccguc

SEQ ID NO: 899946 - RNA, 15 nt, Mycobacterium avium subsp. paratuberculosis
cccagcacagcgagg

SEQ ID NO: 899947 - RNA, 12 nt, Mycobacterium avium subsp. paratuberculosis
cccagcaccacc

SEQ ID NO: 899948 - RNA, 23 nt, Mycobacterium avium subsp. paratuberculosis
cccagcucagacugccgagcauc

SEQ ID NO: 899949 - RNA, 18 nt, Mycobacterium avium subsp. paratuberculosis
cccagcuccucggccagc

SEQ ID NO: 899950 - RNA, 14 nt, Mycobacterium avium subsp. paratuberculosis
cccagcucgacgac

SEQ ID NO: 899951 - RNA, 13 nt, Mycobacterium avium subsp. paratuberculosis
cccagcucgguga

SEQ ID NO: 899952 - RNA, 21 nt, Mycobacterium avium subsp. paratuberculosis
cccagcucguugccggcggcc

SEQ ID NO: 899953 - RNA, 21 nt, Mycobacterium avium subsp. paratuberculosis
cccagcuccaaugcggccgac

SEQ ID NO: 899954 - RNA, 18 nt, Mycobacterium avium subsp. paratuberculosis
cccagcuccacgcguagc

SEQ ID NO: 899955 - RNA, 21 nt, Mycobacterium avium subsp. paratuberculosis
cccagcguggucacccgcagc

SEQ ID NO: 899956 - RNA, 14 nt, Mycobacterium avium subsp. paratuberculosis
cccagcgucucggc

SEQ ID NO: 899957 - RNA, 17 nt, Mycobacterium avium subsp. paratuberculosis
cccagcgucucggcggc

SEQ ID NO: 899958 - RNA, 18 nt, Mycobacterium avium subsp. paratuberculosis
cccagcgucucggcggcc

SEQ ID NO: 899959 - RNA, 20 nt, Mycobacterium avium subsp. paratuberculosis
cccagcgucucggcggccga

SEQ ID NO: 899960 - RNA, 16 nt, Mycobacterium avium subsp. paratuberculosis
cccagcgugacgucga

SEQ ID NO: 899961 - RNA, 13 nt, Mycobacterium avium subsp. paratuberculosis
cccagcggggcaa

SEQ ID NO: 899962 - RNA, 12 nt, Mycobacterium avium subsp. paratuberculosis
cccagcggggcg

SEQ ID NO: 899963 - RNA, 19 nt, Mycobacterium avium subsp. paratuberculosis
cccagcggcuguagcaccc

SEQ ID NO: 899964 - RNA, 13 nt, Mycobacterium avium subsp. paratuberculosis
cccagcgcggugu

SEQ ID NO: 899965 - RNA, 22 nt, Mycobacterium avium subsp. paratuberculosis
cccagcggagcguucuccaccc

SEQ ID NO: 899966 - RNA, 12 nt, Mycobacterium avium subsp. paratuberculosis
cccagcggcacg

SEQ ID NO: 899967 - RNA, 13 nt, Mycobacterium avium subsp. paratuberculosis
cccagcggcacgg

SEQ ID NO: 899968 - RNA, 20 nt, Mycobacterium avium subsp. paratuberculosis
cccagcggcacgggcaccga

SEQ ID NO: 899969 - RNA, 16 nt, Mycobacterium avium subsp. paratuberculosis
cccggcgaaucagcag

SEQ ID NO: 899970 - RNA, 22 nt, Mycobacterium avium subsp. paratuberculosis
cccggcgaauucggugaucgcg

SEQ ID NO: 899971 - RNA, 18 nt, Mycobacterium avium subsp. paratuberculosis
cccggcgaccaccagccg

SEQ ID NO: 899972 - RNA, 14 nt, Mycobacterium avium subsp. paratuberculosis
cccggcgaccagca

SEQ ID NO: 899973 - RNA, 18 nt, Mycobacterium avium subsp. paratuberculosis
cccggcgaccagcagguc

SEQ ID NO: 899974 - RNA, 12 nt, Mycobacterium avium subsp. paratuberculosis
cccggcgggcag

SEQ ID NO: 899975 - RNA, 13 nt, Mycobacterium avium subsp. paratuberculosis
cccggcgggccag

SEQ ID NO: 899976 - RNA, 13 nt, Mycobacterium avium subsp. paratuberculosis
cccggcgaugacc

SEQ ID NO: 899977 - RNA, 13 nt, Mycobacterium avium subsp. paratuberculosis
cccggcgaugauc

SEQ ID NO: 899978 - RNA, 22 nt, Mycobacterium avium subsp. paratuberculosis
cccggcgaugaucaggccggac

SEQ ID NO: 899979 - RNA, 17 nt, Mycobacterium avium subsp. paratuberculosis
cccggcgaugccgagcc

SEQ ID NO: 899980 - RNA, 13 nt, Mycobacterium avium subsp. paratuberculosis
cccggcgaugcgc

SEQ ID NO: 899981 - RNA, 12 nt, Mycobacterium avium subsp. paratuberculosis
cccggcggcccc

SEQ ID NO: 899982 - RNA, 14 nt, Mycobacterium avium subsp. paratuberculosis
cccggcggccccgg

SEQ ID NO: 899983 - RNA, 16 nt, Mycobacterium avium subsp. paratuberculosis
cccggcggccgcgucg

SEQ ID NO: 899984 - RNA, 13 nt, Mycobacterium avium subsp. paratuberculosis
cccggcggccggc

SEQ ID NO: 899985 - RNA, 19 nt, Mycobacterium avium subsp. paratuberculosis
cccggcggccggccgcgcg

SEQ ID NO: 899986 - RNA, 13 nt, Mycobacterium avium subsp. paratuberculosis
cccggcgagcagc

SEQ ID NO: 899987 - RNA, 16 nt, Mycobacterium avium subsp. paratuberculosis
cccggcgagcagcccg

SEQ ID NO: 899988 - RNA, 14 nt, Mycobacterium avium subsp. paratuberculosis
cccggcgagcgacg

SEQ ID NO: 899989 - RNA, 22 nt, Mycobacterium avium subsp. paratuberculosis
cccggcgagcgcgugcacgaac

SEQ ID NO: 899990 - RNA, 15 nt, Mycobacterium avium subsp. paratuberculosis
cccggcgagcggcac

SEQ ID NO: 899991 - RNA, 17 nt, Mycobacterium avium subsp. paratuberculosis
cccggcgagcggcaccu

SEQ ID NO: 899992 - RNA, 17 nt, Mycobacterium avium subsp. paratuberculosis
cccggcgaggccaggcg

SEQ ID NO: 899993 - RNA, 13 nt, Mycobacterium avium subsp. paratuberculosis
cccggcgacgaag

SEQ ID NO: 899994 - RNA, 15 nt, Mycobacterium avium subsp. paratuberculosis
cccggcgacgaagca

SEQ ID NO: 899995 - RNA, 19 nt, Mycobacterium avium subsp. paratuberculosis
cccggcgacgaagcagcuc

SEQ ID NO: 899996 - RNA, 19 nt, Mycobacterium avium subsp. paratuberculosis
cccggcgacgcggcgggaa

SEQ ID NO: 899997 - RNA, 15 nt, Mycobacterium avium subsp. paratuberculosis
cccggcgacggcggc

SEQ ID NO: 899998 - RNA, 12 nt, Mycobacterium avium subsp. paratuberculosis
cccggcgacguc

SEQ ID NO: 899999 - RNA, 13 nt, Mycobacterium avium subsp. paratuberculosis
cccggcgacgucg

SEQ ID NO: 900000 - RNA, 17 nt, Mycobacterium avium subsp. paratuberculosis
cccggcgacgucgccgg

SEQ ID NO: 900001 - RNA, 14 nt, Mycobacterium avium subsp. paratuberculosis
cccggcgacgucgu

SEQ ID NO: 900002 - RNA, 21 nt, Mycobacterium avium subsp. paratuberculosis
cccggcucgaaguggcagcgc

SEQ ID NO: 900003 - RNA, 15 nt, Mycobacterium avium subsp. paratuberculosis
cccggcucgaucgcg

SEQ ID NO: 900004 - RNA, 19 nt, Mycobacterium avium subsp. paratuberculosis
cccggcucgaucgcgguca

SEQ ID NO: 900005 - RNA, 15 nt, Mycobacterium avium subsp. paratuberculosis
cccggcuccccgacc

SEQ ID NO: 900006 - RNA, 21 nt, Mycobacterium avium subsp. paratuberculosis
cccggcucagcccgauucagc

SEQ ID NO: 900007 - RNA, 23 nt, Mycobacterium avium subsp. paratuberculosis
cccggcucagcgcgacgugccgg

SEQ ID NO: 900008 - RNA, 12 nt, Mycobacterium avium subsp. paratuberculosis
cccggcgugcag

SEQ ID NO: 900009 - RNA, 13 nt, Mycobacterium avium subsp. paratuberculosis
cccggcgugcagg

SEQ ID NO: 900010 - RNA, 23 nt, Mycobacterium avium subsp. paratuberculosis
cccggcgugcaggauccgcucga

SEQ ID NO: 900011 - RNA, 19 nt, Mycobacterium avium subsp. paratuberculosis
cccggcgugggccgcagcg

SEQ ID NO: 900012 - RNA, 21 nt, Mycobacterium avium subsp. paratuberculosis
cccggcgugggccgcagcgcg

SEQ ID NO: 900013 - RNA, 23 nt, Mycobacterium avium subsp. paratuberculosis
cccggcguuacccgaacccagcg

SEQ ID NO: 900014 - RNA, 17 nt, Mycobacterium avium subsp. paratuberculosis
cccggcguuccagcgca

SEQ ID NO: 900015 - RNA, 21 nt, Mycobacterium avium subsp. paratuberculosis
cccggcuaauucgggccgccg

SEQ ID NO: 900016 - RNA, 20 nt, Mycobacterium avium subsp. paratuberculosis
cccggcguaguucgucgaac

SEQ ID NO: 900017 - RNA, 12 nt, Mycobacterium avium subsp. paratuberculosis
cccggcgucgau

SEQ ID NO: 900018 - RNA, 19 nt, Mycobacterium avium subsp. paratuberculosis
cccggcgucgaugaccucg

SEQ ID NO: 900019 - RNA, 20 nt, Mycobacterium avium subsp. paratuberculosis
cccggcgucgaugaccucgc

SEQ ID NO: 900020 - RNA, 18 nt, Mycobacterium avium subsp. paratuberculosis
cccggcgucacgcuggcg

SEQ ID NO: 900021 - RNA, 21 nt, Mycobacterium avium subsp. paratuberculosis
cccggcgucacgcuggcguga

SEQ ID NO: 900022 - RNA, 18 nt, Mycobacterium avium subsp. paratuberculosis
cccggcguccacgccgug

SEQ ID NO: 900023 - RNA, 13 nt, Mycobacterium avium subsp. paratuberculosis
cccggcguccagu

SEQ ID NO: 900024 - RNA, 19 nt, Mycobacterium avium subsp. paratuberculosis
cccggcguccaguagccgc

SEQ ID NO: 900025 - RNA, 22 nt, Mycobacterium avium subsp. paratuberculosis
cccggcguccaguagccgccgg

SEQ ID NO: 900026 - RNA, 21 nt, Mycobacterium avium subsp. paratuberculosis
cccggcgggcucgccggcccg

SEQ ID NO: 900027 - RNA, 12 nt, Mycobacterium avium subsp. paratuberculosis
cccggcgagcac

SEQ ID NO: 900028 - RNA, 17 nt, Mycobacterium avium subsp. paratuberculosis
cccggcggucggaucga

SEQ ID NO: 900029 - RNA, 22 nt, Mycobacterium avium subsp. paratuberculosis
cccggcgguugauacucgggca

SEQ ID NO: 900030 - RNA, 23 nt, Mycobacterium avium subsp. paratuberculosis
cccggcgguuuuguugaccguug

SEQ ID NO: 900031 - RNA, 16 nt, Mycobacterium avium subsp. paratuberculosis
cccggcggggacccga

SEQ ID NO: 900032 - RNA, 19 nt, Mycobacterium avium subsp. paratuberculosis
cccggcgggucagcaccgc

SEQ ID NO: 900033 - RNA, 20 nt, Mycobacterium avium subsp. paratuberculosis
cccgguccccggagucgucg

SEQ ID NO: 900034 - RNA, 22 nt, Mycobacterium avium subsp. paratuberculosis
cccgguccaccuggcugugcac

SEQ ID NO: 900035 - RNA, 22 nt, Mycobacterium avium subsp. paratuberculosis
cccggucagguugacgccgaug

SEQ ID NO: 900036 - RNA, 13 nt, Mycobacterium avium subsp. paratuberculosis
cccgguccggccc

SEQ ID NO: 900037 - RNA, 14 nt, Mycobacterium avium subsp. paratuberculosis
cccgguccggcugg

SEQ ID NO: 900038 - RNA, 18 nt, Mycobacterium avium subsp. paratuberculosis
cccgguccggcuggucgg

SEQ ID NO: 900039 - RNA, 19 nt, Mycobacterium avium subsp. paratuberculosis
cccgguccggcuggucggc

SEQ ID NO: 900040 - RNA, 18 nt, Mycobacterium avium subsp. paratuberculosis
cccgguccgggucgcuga

SEQ ID NO: 900041 - RNA, 19 nt, Mycobacterium avium subsp. paratuberculosis
cccgguccgggucgcugag

SEQ ID NO: 900042 - RNA, 20 nt, Mycobacterium avium subsp. paratuberculosis
cccgguccgggucgcugagc

SEQ ID NO: 900043 - RNA, 16 nt, Mycobacterium avium subsp. paratuberculosis
cccggucagcccccac

SEQ ID NO: 900044 - RNA, 21 nt, Mycobacterium avium subsp. paratuberculosis
cccggucagcccccaccgcgc

SEQ ID NO: 900045 - RNA, 15 nt, Mycobacterium avium subsp. paratuberculosis
cccggucagcgucca

SEQ ID NO: 900046 - RNA, 17 nt, Mycobacterium avium subsp. paratuberculosis
cccggucagcguccagu

SEQ ID NO: 900047 - RNA, 14 nt, Mycobacterium avium subsp. paratuberculosis
cccggucagcucgc

SEQ ID NO: 900048 - RNA, 17 nt, Mycobacterium avium subsp. paratuberculosis
cccggucagcucgccgu

SEQ ID NO: 900049 - RNA, 19 nt, Mycobacterium avium subsp. paratuberculosis
cccggucagcucgccgucc

SEQ ID NO: 900050 - RNA, 20 nt, Mycobacterium avium subsp. paratuberculosis
cccggucagcucgccguccg

SEQ ID NO: 900051 - RNA, 21 nt, Mycobacterium avium subsp. paratuberculosis
cccggucagcucgccguccgg

SEQ ID NO: 900052 - RNA, 18 nt, Mycobacterium avium subsp. paratuberculosis
cccgguaggcggcgagau

SEQ ID NO: 900053 - RNA, 15 nt, Mycobacterium avium subsp. paratuberculosis
cccggucaccccggc

SEQ ID NO: 900054 - RNA, 15 nt, Mycobacterium avium subsp. paratuberculosis
cccgggugggcagcg

SEQ ID NO: 900055 - RNA, 17 nt, Mycobacterium avium subsp. paratuberculosis
cccgggugggcgggacg

SEQ ID NO: 900056 - RNA, 19 nt, Mycobacterium avium subsp. paratuberculosis
cccgggugugggcgccguc

SEQ ID NO: 900057 - RNA, 18 nt, Mycobacterium avium subsp. paratuberculosis
cccggguguuggagccgu

SEQ ID NO: 900058 - RNA, 21 nt, Mycobacterium avium subsp. paratuberculosis
cccggguguuggagccguccg

SEQ ID NO: 900059 - RNA, 16 nt, Mycobacterium avium subsp. paratuberculosis
cccggguugucgacgu

SEQ ID NO: 900060 - RNA, 18 nt, Mycobacterium avium subsp. paratuberculosis
cccggguugucgacgugg

SEQ ID NO: 900061 - RNA, 19 nt, Mycobacterium avium subsp. paratuberculosis
cccgguacaucgacgcgac

SEQ ID NO: 900062 - RNA, 22 nt, Mycobacterium avium subsp. paratuberculosis
cccgguacaucgacgcgaccgg

SEQ ID NO: 900063 - RNA, 19 nt, Mycobacterium avium subsp. paratuberculosis
cccgguacagcgccgcggc

SEQ ID NO: 900064 - RNA, 14 nt, Mycobacterium avium subsp. paratuberculosis
cccgguagagcggc

SEQ ID NO: 900065 - RNA, 19 nt, Mycobacterium avium subsp. paratuberculosis
cccgguagagcggcaccag

SEQ ID NO: 900066 - RNA, 17 nt, Mycobacterium avium subsp. paratuberculosis
cccgguagccagcaccg

SEQ ID NO: 900067 - RNA, 18 nt, Mycobacterium avium subsp. paratuberculosis
cccgguagccagcaccgc

SEQ ID NO: 900068 - RNA, 23 nt, Mycobacterium avium subsp. paratuberculosis
cccgguagccagcaccgccccgg

SEQ ID NO: 900069 - RNA, 15 nt, Mycobacterium avium subsp. paratuberculosis
cccgguagccgacau

SEQ ID NO: 900070 - RNA, 17 nt, Mycobacterium avium subsp. paratuberculosis
cccgguagcgcagcacc

SEQ ID NO: 900071 - RNA, 18 nt, Mycobacterium avium subsp. paratuberculosis
cccgguagcgcagcacca

SEQ ID NO: 900072 - RNA, 21 nt, Mycobacterium avium subsp. paratuberculosis
cccgguagcgcagcaccaggc

SEQ ID NO: 900073 - RNA, 17 nt, Mycobacterium avium subsp. paratuberculosis
cccgggcguucccgcgc

SEQ ID NO: 900074 - RNA, 22 nt, Mycobacterium avium subsp. paratuberculosis
cccgggcgugccggacaccggc

SEQ ID NO: 900075 - RNA, 13 nt, Mycobacterium avium subsp. paratuberculosis
cccgggcggucgc

SEQ ID NO: 900076 - RNA, 15 nt, Mycobacterium avium subsp. paratuberculosis
cccgggcggucgcgu

SEQ ID NO: 900077 - RNA, 20 nt, Mycobacterium avium subsp. paratuberculosis
cccgggucuagaucuccagg

SEQ ID NO: 900078 - RNA, 23 nt, Mycobacterium avium subsp. paratuberculosis
cccgggugaccgccuuggcgcgc

SEQ ID NO: 900079 - RNA, 15 nt, Mycobacterium avium subsp. paratuberculosis
cccgggugcccggcu

SEQ ID NO: 900080 - RNA, 22 nt, Mycobacterium avium subsp. paratuberculosis
cccgggugcgauggcaacgccg

SEQ ID NO: 900081 - RNA, 19 nt, Mycobacterium avium subsp. paratuberculosis
cccgggugcgcgucgcggu

SEQ ID NO: 900082 - RNA, 20 nt, Mycobacterium avium subsp. paratuberculosis
cccgggugcgcuugucggcg

SEQ ID NO: 900083 - RNA, 21 nt, Mycobacterium avium subsp. paratuberculosis
cccgggugcgcuugucggcgu

SEQ ID NO: 900084 - RNA, 15 nt, Mycobacterium avium subsp. paratuberculosis
cccggguggacaccg

SEQ ID NO: 900085 - RNA, 14 nt, Mycobacterium avium subsp. paratuberculosis
cccgggcgccggcg

SEQ ID NO: 900086 - RNA, 17 nt, Mycobacterium avium subsp. paratuberculosis
cccgggcgccggcgaug

SEQ ID NO: 900087 - RNA, 12 nt, Mycobacterium avium subsp. paratuberculosis
cccgggcgcgcc

SEQ ID NO: 900088 - RNA, 19 nt, Mycobacterium avium subsp. paratuberculosis
cccgggcgcgcccacccgc

SEQ ID NO: 900089 - RNA, 13 nt, Mycobacterium avium subsp. paratuberculosis
cccgggcgcugag

SEQ ID NO: 900090 - RNA, 14 nt, Mycobacterium avium subsp. paratuberculosis
cccgggcgcugagc

SEQ ID NO: 900091 - RNA, 19 nt, Mycobacterium avium subsp. paratuberculosis
cccgggcgcugagcacggu

SEQ ID NO: 900092 - RNA, 22 nt, Mycobacterium avium subsp. paratuberculosis
cccgggccuuguugcggcgcac

SEQ ID NO: 900093 - RNA, 14 nt, Mycobacterium avium subsp. paratuberculosis
cccgggcgaacguc

SEQ ID NO: 900094 - RNA, 14 nt, Mycobacterium avium subsp. paratuberculosis
cccgggcggccugc

SEQ ID NO: 900095 - RNA, 16 nt, Mycobacterium avium subsp. paratuberculosis
cccgggcggccugcug

SEQ ID NO: 900096 - RNA, 18 nt, Mycobacterium avium subsp. paratuberculosis
cccgggcgagcgucgccg

SEQ ID NO: 900097 - RNA, 21 nt, Mycobacterium avium subsp. paratuberculosis
cccgggcgagcgucgccgcgu

SEQ ID NO: 900098 - RNA, 16 nt, Mycobacterium avium subsp. paratuberculosis
cccgggcgaucagccc

SEQ ID NO: 900099 - RNA, 18 nt, Mycobacterium avium subsp. paratuberculosis
cccgggcgaucagcccgc

SEQ ID NO: 900100 - RNA, 16 nt, Mycobacterium avium subsp. paratuberculosis
cccgggccugcggcgg

SEQ ID NO: 900101 - RNA, 24 nt, Mycobacterium avium subsp. paratuberculosis
cccgggccugcggcggccgcagcg

SEQ ID NO: 900102 - RNA, 15 nt, Mycobacterium avium subsp. paratuberculosis
cccgggccggacacg

SEQ ID NO: 900103 - RNA, 21 nt, Mycobacterium avium subsp. paratuberculosis
cccgggccgucaucgccgacg

SEQ ID NO: 900104 - RNA, 22 nt, Mycobacterium avium subsp. paratuberculosis
cccgggccgucaucgccgacgg

SEQ ID NO: 900105 - RNA, 13 nt, Mycobacterium avium subsp. paratuberculosis
cccgggccguccg

SEQ ID NO: 900106 - RNA, 19 nt, Mycobacterium avium subsp. paratuberculosis
cccgggccguccgggugcg

SEQ ID NO: 900107 - RNA, 21 nt, Mycobacterium avium subsp. paratuberculosis
cccgggccguucagcgggcgg

SEQ ID NO: 900108 - RNA, 18 nt, Mycobacterium avium subsp. paratuberculosis
cccggcucgccgggcugc

SEQ ID NO: 900109 - RNA, 14 nt, Mycobacterium avium subsp. paratuberculosis
cccggcucgggcca

SEQ ID NO: 900110 - RNA, 15 nt, Mycobacterium avium subsp. paratuberculosis
cccggcucggugcgc

SEQ ID NO: 900111 - RNA, 23 nt, Mycobacterium avium subsp. paratuberculosis
cccggccggcccgcccggcggcg

SEQ ID NO: 900112 - RNA, 21 nt, Mycobacterium avium subsp. paratuberculosis
cccggccguugggccagcggc

SEQ ID NO: 900113 - RNA, 15 nt, Mycobacterium avium subsp. paratuberculosis
cccggccggcgcgac

SEQ ID NO: 900114 - RNA, 12 nt, Mycobacterium avium subsp. paratuberculosis
cccggccgggcg

SEQ ID NO: 900115 - RNA, 10 nt, Mycobacterium avium subsp. paratuberculosis
cccggccggu

SEQ ID NO: 900116 - RNA, 19 nt, Mycobacterium avium subsp. paratuberculosis
cccggccggucgccgaugg

SEQ ID NO: 900117 - RNA, 15 nt, Mycobacterium avium subsp. paratuberculosis
cccggccggucgccu

SEQ ID NO: 900118 - RNA, 16 nt, Mycobacterium avium subsp. paratuberculosis
cccggccgguggccgg

SEQ ID NO: 900119 - RNA, 17 nt, Mycobacterium avium subsp. paratuberculosis
cccggccgguggccggu

SEQ ID NO: 900120 - RNA, 13 nt, Mycobacterium avium subsp. paratuberculosis
cccggccgcggcc

SEQ ID NO: 900121 - RNA, 20 nt, Mycobacterium avium subsp. paratuberculosis
cccggccgcggugaccgcgc

SEQ ID NO: 900122 - RNA, 22 nt, Mycobacterium avium subsp. paratuberculosis
cccggccgcggugaccgcgccg

SEQ ID NO: 900123 - RNA, 16 nt, Mycobacterium avium subsp. paratuberculosis
cccggccgccgggacg

SEQ ID NO: 900124 - RNA, 13 nt, Mycobacterium avium subsp. paratuberculosis
cccggccgccgag

SEQ ID NO: 900125 - RNA, 12 nt, Mycobacterium avium subsp. paratuberculosis
cccggccgcgac

SEQ ID NO: 900126 - RNA, 15 nt, Mycobacterium avium subsp. paratuberculosis
cccggccgcgcaccg

SEQ ID NO: 900127 - RNA, 17 nt, Mycobacterium avium subsp. paratuberculosis
cccggccgcgcaccgcc

SEQ ID NO: 900128 - RNA, 20 nt, Mycobacterium avium subsp. paratuberculosis
cccggccgcgcaccgccccg

SEQ ID NO: 900129 - RNA, 13 nt, Mycobacterium avium subsp. paratuberculosis
cccggccgcgccg

SEQ ID NO: 900130 - RNA, 16 nt, Mycobacterium avium subsp. paratuberculosis
cccggccgcgccggau

SEQ ID NO: 900131 - RNA, 13 nt, Mycobacterium avium subsp. paratuberculosis
cccggcccggcgc

SEQ ID NO: 900132 - RNA, 13 nt, Mycobacterium avium subsp. paratuberculosis
cccggcccgucca

SEQ ID NO: 900133 - RNA, 15 nt, Mycobacterium avium subsp. paratuberculosis
cccggcccguccaga

SEQ ID NO: 900134 - RNA, 18 nt, Mycobacterium avium subsp. paratuberculosis
cccggcccgucgagcggc

SEQ ID NO: 900135 - RNA, 12 nt, Mycobacterium avium subsp. paratuberculosis
cccggcccgcug

SEQ ID NO: 900136 - RNA, 15 nt, Mycobacterium avium subsp. paratuberculosis
cccggcccaggcaca

SEQ ID NO: 900137 - RNA, 11 nt, Mycobacterium avium subsp. paratuberculosis
cccggccgacg

SEQ ID NO: 900138 - RNA, 17 nt, Mycobacterium avium subsp. paratuberculosis
cccggccgacgaugaac

SEQ ID NO: 900139 - RNA, 14 nt, Mycobacterium avium subsp. paratuberculosis
cccggccgacgggc

SEQ ID NO: 900140 - RNA, 16 nt, Mycobacterium avium subsp. paratuberculosis
cccggccgacgggcgu

SEQ ID NO: 900141 - RNA, 13 nt, Mycobacterium avium subsp. paratuberculosis
cccggccgagccg

SEQ ID NO: 900142 - RNA, 17 nt, Mycobacterium avium subsp. paratuberculosis
cccggccgagccggcgu

SEQ ID NO: 900143 - RNA, 13 nt, Mycobacterium avium subsp. paratuberculosis
cccggccgagcgc

SEQ ID NO: 900144 - RNA, 17 nt, Mycobacterium avium subsp. paratuberculosis
cccggccgagcgcagcg

SEQ ID NO: 900145 - RNA, 17 nt, Mycobacterium avium subsp. paratuberculosis
cccggccgagcgcgccg

SEQ ID NO: 900146 - RNA, 20 nt, Mycobacterium avium subsp. paratuberculosis
cccggccgaggucaccaccg

SEQ ID NO: 900147 - RNA, 17 nt, Mycobacterium avium subsp. paratuberculosis
cccggcccagccgcugc

SEQ ID NO: 900148 - RNA, 15 nt, Mycobacterium avium subsp. paratuberculosis
cccggcccagccggu

SEQ ID NO: 900149 - RNA, 15 nt, Mycobacterium avium subsp. paratuberculosis
cccggccccaccgcc

SEQ ID NO: 900150 - RNA, 20 nt, Mycobacterium avium subsp. paratuberculosis
cccggccccaccgccgcugc

SEQ ID NO: 900151 - RNA, 15 nt, Mycobacterium avium subsp. paratuberculosis
cccggcccaucaccg

SEQ ID NO: 900152 - RNA, 19 nt, Mycobacterium avium subsp. paratuberculosis
cccggccccggccggcggg

SEQ ID NO: 900153 - RNA, 18 nt, Mycobacterium avium subsp. paratuberculosis
cccggcccgcaugcaccg

SEQ ID NO: 900154 - RNA, 12 nt, Mycobacterium avium subsp. paratuberculosis
cccggcccgccg

SEQ ID NO: 900155 - RNA, 18 nt, Mycobacterium avium subsp. paratuberculosis
cccggccaguccggcagc

SEQ ID NO: 900156 - RNA, 19 nt, Mycobacterium avium subsp. paratuberculosis
cccggccaguccggcagca

SEQ ID NO: 900157 - RNA, 22 nt, Mycobacterium avium subsp. paratuberculosis
cccggccaguccggcagcagcg

SEQ ID NO: 900158 - RNA, 21 nt, Mycobacterium avium subsp. paratuberculosis
cccggccaucaugcccaccau

SEQ ID NO: 900159 - RNA, 21 nt, Mycobacterium avium subsp. paratuberculosis
cccggcccaagacccgcguca

SEQ ID NO: 900160 - RNA, 14 nt, Mycobacterium avium subsp. paratuberculosis
cccggcccaccggc

SEQ ID NO: 900161 - RNA, 18 nt, Mycobacterium avium subsp. paratuberculosis
cccggcccaccggcccgg

SEQ ID NO: 900162 - RNA, 21 nt, Mycobacterium avium subsp. paratuberculosis
cccggcccacgccgucgucgu

SEQ ID NO: 900163 - RNA, 13 nt, Mycobacterium avium subsp. paratuberculosis
cccggcccagccg

SEQ ID NO: 900164 - RNA, 23 nt, Mycobacterium avium subsp. paratuberculosis
cccggccagcggcagcggcgucg

SEQ ID NO: 900165 - RNA, 16 nt, Mycobacterium avium subsp. paratuberculosis
cccggccagcacccgc

SEQ ID NO: 900166 - RNA, 13 nt, Mycobacterium avium subsp. paratuberculosis
cccggccagcacg

SEQ ID NO: 900167 - RNA, 14 nt, Mycobacterium avium subsp. paratuberculosis
cccggccagcacgc

SEQ ID NO: 900168 - RNA, 18 nt, Mycobacterium avium subsp. paratuberculosis
cccggccagccggccgcu

SEQ ID NO: 900169 - RNA, 15 nt, Mycobacterium avium subsp. paratuberculosis
cccggccagccgggc

SEQ ID NO: 900170 - RNA, 16 nt, Mycobacterium avium subsp. paratuberculosis
cccggccagccgggcg

SEQ ID NO: 900171 - RNA, 16 nt, Mycobacterium avium subsp. paratuberculosis
cccggaagugccggcg

SEQ ID NO: 900172 - RNA, 20 nt, Mycobacterium avium subsp. paratuberculosis
cccggaaucgucggccacgc

SEQ ID NO: 900173 - RNA, 14 nt, Mycobacterium avium subsp. paratuberculosis
cccggaacccgcgu

SEQ ID NO: 900174 - RNA, 16 nt, Mycobacterium avium subsp. paratuberculosis
cccggaacccgcgugg

SEQ ID NO: 900175 - RNA, 23 nt, Mycobacterium avium subsp. paratuberculosis
cccggaacgcgucgcccacgccg

SEQ ID NO: 900176 - RNA, 13 nt, Mycobacterium avium subsp. paratuberculosis
cccggaccgcgga

SEQ ID NO: 900177 - RNA, 15 nt, Mycobacterium avium subsp. paratuberculosis
cccggaccggagacg

SEQ ID NO: 900178 - RNA, 17 nt, Mycobacterium avium subsp. paratuberculosis
cccggaccggccgugcg

SEQ ID NO: 900179 - RNA, 19 nt, Mycobacterium avium subsp. paratuberculosis
cccggaccgggugaccggc

SEQ ID NO: 900180 - RNA, 20 nt, Mycobacterium avium subsp. paratuberculosis
cccggaccgggugaccggcg

SEQ ID NO: 900181 - RNA, 23 nt, Mycobacterium avium subsp. paratuberculosis
cccggaccgggugaccggcgcgc

SEQ ID NO: 900182 - RNA, 23 nt, Mycobacterium avium subsp. paratuberculosis
cccggacagcgcgacgcacgccg

SEQ ID NO: 900183 - RNA, 13 nt, Mycobacterium avium subsp. paratuberculosis
cccggaccacguc

SEQ ID NO: 900184 - RNA, 13 nt, Mycobacterium avium subsp. paratuberculosis
cccggaccgccgc

SEQ ID NO: 900185 - RNA, 14 nt, Mycobacterium avium subsp. paratuberculosis
cccggaccgccgcg

SEQ ID NO: 900186 - RNA, 15 nt, Mycobacterium avium subsp. paratuberculosis
cccggaccgccgcgg

SEQ ID NO: 900187 - RNA, 16 nt, Mycobacterium avium subsp. paratuberculosis
cccggaccgccgcggc

SEQ ID NO: 900188 - RNA, 18 nt, Mycobacterium avium subsp. paratuberculosis
cccggaccgccgcggcgg

SEQ ID NO: 900189 - RNA, 19 nt, Mycobacterium avium subsp. paratuberculosis
cccggaccgccgcggcggc

SEQ ID NO: 900190 - RNA, 16 nt, Mycobacterium avium subsp. paratuberculosis
cccggacccgcucgcc

SEQ ID NO: 900191 - RNA, 18 nt, Mycobacterium avium subsp. paratuberculosis
cccggaccugccggcgau

SEQ ID NO: 900192 - RNA, 22 nt, Mycobacterium avium subsp. paratuberculosis
cccggaugauguucuccggccc

SEQ ID NO: 900193 - RNA, 16 nt, Mycobacterium avium subsp. paratuberculosis
cccggaugccggcgcc

SEQ ID NO: 900194 - RNA, 20 nt, Mycobacterium avium subsp. paratuberculosis
cccggaugcugcgggucagc

SEQ ID NO: 900195 - RNA, 16 nt, Mycobacterium avium subsp. paratuberculosis
cccggauggccgggca

SEQ ID NO: 900196 - RNA, 14 nt, Mycobacterium avium subsp. paratuberculosis
cccggauggucugc

SEQ ID NO: 900197 - RNA, 17 nt, Mycobacterium avium subsp. paratuberculosis
cccggauggucugcagc

SEQ ID NO: 900198 - RNA, 19 nt, Mycobacterium avium subsp. paratuberculosis
cccggauggucugcagcga

SEQ ID NO: 900199 - RNA, 19 nt, Mycobacterium avium subsp. paratuberculosis
cccggaugucgggcgaggu

SEQ ID NO: 900200 - RNA, 17 nt, Mycobacterium avium subsp. paratuberculosis
cccggaugucguagacg

SEQ ID NO: 900201 - RNA, 19 nt, Mycobacterium avium subsp. paratuberculosis
cccggaugucgugcggucg

SEQ ID NO: 900202 - RNA, 13 nt, Mycobacterium avium subsp. paratuberculosis
cccggcaacaccg

SEQ ID NO: 900203 - RNA, 17 nt, Mycobacterium avium subsp. paratuberculosis
cccggcaacaccggcgg

SEQ ID NO: 900204 - RNA, 18 nt, Mycobacterium avium subsp. paratuberculosis
cccggcaacaccggcggc

SEQ ID NO: 900205 - RNA, 21 nt, Mycobacterium avium subsp. paratuberculosis
cccggcaaccgaaucgagccg

SEQ ID NO: 900206 - RNA, 20 nt, Mycobacterium avium subsp. paratuberculosis
cccggcagaucgcggcccgc

SEQ ID NO: 900207 - RNA, 22 nt, Mycobacterium avium subsp. paratuberculosis
cccggcagaucgcggcccgccg

SEQ ID NO: 900208 - RNA, 16 nt, Mycobacterium avium subsp. paratuberculosis
cccggcagcggggcga

SEQ ID NO: 900209 - RNA, 12 nt, Mycobacterium avium subsp. paratuberculosis
cccggcacgaac

SEQ ID NO: 900210 - RNA, 18 nt, Mycobacterium avium subsp. paratuberculosis
cccggcacgaacgcgacg

SEQ ID NO: 900211 - RNA, 12 nt, Mycobacterium avium subsp. paratuberculosis
cccggcaccacc

SEQ ID NO: 900212 - RNA, 14 nt, Mycobacterium avium subsp. paratuberculosis
cccggcaccaccac

SEQ ID NO: 900213 - RNA, 16 nt, Mycobacterium avium subsp. paratuberculosis
cccggcaccaccaccc

SEQ ID NO: 900214 - RNA, 14 nt, Mycobacterium avium subsp. paratuberculosis
cccggccaacggga

SEQ ID NO: 900215 - RNA, 16 nt, Mycobacterium avium subsp. paratuberculosis
cccggccaacgggaag

SEQ ID NO: 900216 - RNA, 11 nt, Mycobacterium avium subsp. paratuberculosis
cccggccacca

SEQ ID NO: 900217 - RNA, 15 nt, Mycobacterium avium subsp. paratuberculosis
cccggccaccgccgc

SEQ ID NO: 900218 - RNA, 14 nt, Mycobacterium avium subsp. paratuberculosis
cccggccacgccgg

SEQ ID NO: 900219 - RNA, 15 nt, Mycobacterium avium subsp. paratuberculosis
cccggccacgccggg

SEQ ID NO: 900220 - RNA, 16 nt, Mycobacterium avium subsp. paratuberculosis
cccggccacgccgggu

SEQ ID NO: 900221 - RNA, 15 nt, Mycobacterium avium subsp. paratuberculosis
cccggccacgucgau

SEQ ID NO: 900222 - RNA, 17 nt, Mycobacterium avium subsp. paratuberculosis
cccggccacucgccgcg

SEQ ID NO: 900223 - RNA, 15 nt, Mycobacterium avium subsp. paratuberculosis
cccggcaucccaccc

SEQ ID NO: 900224 - RNA, 13 nt, Mycobacterium avium subsp. paratuberculosis
cccggcaucgaca

SEQ ID NO: 900225 - RNA, 20 nt, Mycobacterium avium subsp. paratuberculosis
cccggcaucgacaugcccgg

SEQ ID NO: 900226 - RNA, 17 nt, Mycobacterium avium subsp. paratuberculosis
cccgcagaacaccagcg

SEQ ID NO: 900227 - RNA, 19 nt, Mycobacterium avium subsp. paratuberculosis
cccgcagaacaccagcgca

SEQ ID NO: 900228 - RNA, 16 nt, Mycobacterium avium subsp. paratuberculosis
cccgcacggucgcggu

SEQ ID NO: 900229 - RNA, 20 nt, Mycobacterium avium subsp. paratuberculosis
cccgcacggccgccaggguc

SEQ ID NO: 900230 - RNA, 17 nt, Mycobacterium avium subsp. paratuberculosis
cccgcacgugcgcgccg

SEQ ID NO: 900231 - RNA, 15 nt, Mycobacterium avium subsp. paratuberculosis
cccgcaccugcgcgc

SEQ ID NO: 900232 - RNA, 19 nt, Mycobacterium avium subsp. paratuberculosis
cccgcacgaaaugcgggcg

SEQ ID NO: 900233 - RNA, 15 nt, Mycobacterium avium subsp. paratuberculosis
cccgcacgcugucgg

SEQ ID NO: 900234 - RNA, 16 nt, Mycobacterium avium subsp. paratuberculosis
cccgcagcggcgguug

SEQ ID NO: 900235 - RNA, 12 nt, Mycobacterium avium subsp. paratuberculosis
cccgcagccgcg

SEQ ID NO: 900236 - RNA, 13 nt, Mycobacterium avium subsp. paratuberculosis
cccgcagccgcga

SEQ ID NO: 900237 - RNA, 15 nt, Mycobacterium avium subsp. paratuberculosis
cccgcagcucgccga

SEQ ID NO: 900238 - RNA, 16 nt, Mycobacterium avium subsp. paratuberculosis
cccgcagcucgccggu

SEQ ID NO: 900239 - RNA, 19 nt, Mycobacterium avium subsp. paratuberculosis
cccgcagcucgccgguggc

SEQ ID NO: 900240 - RNA, 12 nt, Mycobacterium avium subsp. paratuberculosis
cccgcagccgcu

SEQ ID NO: 900241 - RNA, 17 nt, Mycobacterium avium subsp. paratuberculosis
cccgcagccgcuggccg

SEQ ID NO: 900242 - RNA, 16 nt, Mycobacterium avium subsp. paratuberculosis
cccgcagcgccagcgc

SEQ ID NO: 900243 - RNA, 12 nt, Mycobacterium avium subsp. paratuberculosis
cccgcagcgcgg

SEQ ID NO: 900244 - RNA, 15 nt, Mycobacterium avium subsp. paratuberculosis
cccgcagcgcggcgg

SEQ ID NO: 900245 - RNA, 15 nt, Mycobacterium avium subsp. paratuberculosis
cccgcagggcgccgg

SEQ ID NO: 900246 - RNA, 20 nt, Mycobacterium avium subsp. paratuberculosis
cccgcaggaucgagccggcc

SEQ ID NO: 900247 - RNA, 21 nt, Mycobacterium avium subsp. paratuberculosis
cccgcaggaucgagccggccg

SEQ ID NO: 900248 - RNA, 13 nt, Mycobacterium avium subsp. paratuberculosis
cccgccgccgaug

SEQ ID NO: 900249 - RNA, 13 nt, Mycobacterium avium subsp. paratuberculosis
cccgccgccgcgg

SEQ ID NO: 900250 - RNA, 18 nt, Mycobacterium avium subsp. paratuberculosis
cccgccgccgcggguggc

SEQ ID NO: 900251 - RNA, 16 nt, Mycobacterium avium subsp. paratuberculosis
cccgccgccggcgcug

SEQ ID NO: 900252 - RNA, 21 nt, Mycobacterium avium subsp. paratuberculosis
cccgccgccggcgcuggcgcg

SEQ ID NO: 900253 - RNA, 21 nt, Mycobacterium avium subsp. paratuberculosis
cccgccgaccgguccgccgcc

SEQ ID NO: 900254 - RNA, 20 nt, Mycobacterium avium subsp. paratuberculosis
cccgccgacgcccaggcuca

SEQ ID NO: 900255 - RNA, 19 nt, Mycobacterium avium subsp. paratuberculosis
cccgccgagauccaccgcg

SEQ ID NO: 900256 - RNA, 19 nt, Mycobacterium avium subsp. paratuberculosis
cccgccgauggacacgcug

SEQ ID NO: 900257 - RNA, 22 nt, Mycobacterium avium subsp. paratuberculosis
cccgccgauggacacgcugccg

SEQ ID NO: 900258 - RNA, 19 nt, Mycobacterium avium subsp. paratuberculosis
cccgccgcaacagccggcc

SEQ ID NO: 900259 - RNA, 16 nt, Mycobacterium avium subsp. paratuberculosis
cccgcccuuggccgcg

SEQ ID NO: 900260 - RNA, 12 nt, Mycobacterium avium subsp. paratuberculosis
cccgcccuuguc

SEQ ID NO: 900261 - RNA, 16 nt, Mycobacterium avium subsp. paratuberculosis
cccgccgaacaccggc

SEQ ID NO: 900262 - RNA, 18 nt, Mycobacterium avium subsp. paratuberculosis
cccgccgaacaccggcag

SEQ ID NO: 900263 - RNA, 23 nt, Mycobacterium avium subsp. paratuberculosis
cccgccgaacaccggcagcgcca

SEQ ID NO: 900264 - RNA, 16 nt, Mycobacterium avium subsp. paratuberculosis
cccgccgaccaggauc

SEQ ID NO: 900265 - RNA, 18 nt, Mycobacterium avium subsp. paratuberculosis
cccgcccguagacccaca

SEQ ID NO: 900266 - RNA, 14 nt, Mycobacterium avium subsp. paratuberculosis
cccgcccggacgcg

SEQ ID NO: 900267 - RNA, 15 nt, Mycobacterium avium subsp. paratuberculosis
cccgcccggacgcgc

SEQ ID NO: 900268 - RNA, 12 nt, Mycobacterium avium subsp. paratuberculosis
cccgcccggcac

SEQ ID NO: 900269 - RNA, 13 nt, Mycobacterium avium subsp. paratuberculosis
cccgcccggcacg

SEQ ID NO: 900270 - RNA, 14 nt, Mycobacterium avium subsp. paratuberculosis
cccgcccggcacga

SEQ ID NO: 900271 - RNA, 22 nt, Mycobacterium avium subsp. paratuberculosis
cccgcccggcacgaacgcgacg

SEQ ID NO: 900272 - RNA, 15 nt, Mycobacterium avium subsp. paratuberculosis
cccgcccggccgguc

SEQ ID NO: 900273 - RNA, 12 nt, Mycobacterium avium subsp. paratuberculosis
cccgcccggcgc

SEQ ID NO: 900274 - RNA, 13 nt, Mycobacterium avium subsp. paratuberculosis
cccgcccggcgcc

SEQ ID NO: 900275 - RNA, 18 nt, Mycobacterium avium subsp. paratuberculosis
cccgcccggcgccggccg

SEQ ID NO: 900276 - RNA, 14 nt, Mycobacterium avium subsp. paratuberculosis
cccgcccgggucgu

SEQ ID NO: 900277 - RNA, 20 nt, Mycobacterium avium subsp. paratuberculosis
cccgcccgggucgucggugc

SEQ ID NO: 900278 - RNA, 15 nt, Mycobacterium avium subsp. paratuberculosis
cccgaucccgggccg

SEQ ID NO: 900279 - RNA, 19 nt, Mycobacterium avium subsp. paratuberculosis
cccgauccgcgccgccgcc

SEQ ID NO: 900280 - RNA, 20 nt, Mycobacterium avium subsp. paratuberculosis
cccgaucaggguccagggcg

SEQ ID NO: 900281 - RNA, 22 nt, Mycobacterium avium subsp. paratuberculosis
cccgaucaucucaccgacgacc

SEQ ID NO: 900282 - RNA, 17 nt, Mycobacterium avium subsp. paratuberculosis
cccgauccacggcgacc

SEQ ID NO: 900283 - RNA, 21 nt, Mycobacterium avium subsp. paratuberculosis
cccgauccacggcgaccccgu

SEQ ID NO: 900284 - RNA, 13 nt, Mycobacterium avium subsp. paratuberculosis
cccgaucaccgcc

SEQ ID NO: 900285 - RNA, 14 nt, Mycobacterium avium subsp. paratuberculosis
cccgaucaccgccg

SEQ ID NO: 900286 - RNA, 15 nt, Mycobacterium avium subsp. paratuberculosis
cccgaucagccgggu

SEQ ID NO: 900287 - RNA, 24 nt, Mycobacterium avium subsp. paratuberculosis
cccgaucagccggguagcgccgcc

SEQ ID NO: 900288 - RNA, 15 nt, Mycobacterium avium subsp. paratuberculosis
cccgaucucgcgcgg

SEQ ID NO: 900289 - RNA, 19 nt, Mycobacterium avium subsp. paratuberculosis
cccgaucucgcgcgggucg

SEQ ID NO: 900290 - RNA, 16 nt, Mycobacterium avium subsp. paratuberculosis
cccgaucucgcggucg

SEQ ID NO: 900291 - RNA, 18 nt, Mycobacterium avium subsp. paratuberculosis
cccgaucucgucggugag

SEQ ID NO: 900292 - RNA, 21 nt, Mycobacterium avium subsp. paratuberculosis
cccgcaauugcgccagcagca

SEQ ID NO: 900293 - RNA, 12 nt, Mycobacterium avium subsp. paratuberculosis
cccgaucgagga

SEQ ID NO: 900294 - RNA, 18 nt, Mycobacterium avium subsp. paratuberculosis
cccgaucgaucaucgccu

SEQ ID NO: 900295 - RNA, 16 nt, Mycobacterium avium subsp. paratuberculosis
cccgaucgccagcgcc

SEQ ID NO: 900296 - RNA, 12 nt, Mycobacterium avium subsp. paratuberculosis
cccgaucgcgau

SEQ ID NO: 900297 - RNA, 19 nt, Mycobacterium avium subsp. paratuberculosis
cccgaucgcgaucaccgcg

SEQ ID NO: 900298 - RNA, 21 nt, Mycobacterium avium subsp. paratuberculosis
cccgaucgcgaucaccgcggc

SEQ ID NO: 900299 - RNA, 13 nt, Mycobacterium avium subsp. paratuberculosis
cccgaucgcggcg

SEQ ID NO: 900300 - RNA, 12 nt, Mycobacterium avium subsp. paratuberculosis
cccgaucggcac

SEQ ID NO: 900301 - RNA, 14 nt, Mycobacterium avium subsp. paratuberculosis
cccgaucggcaccc

SEQ ID NO: 900302 - RNA, 17 nt, Mycobacterium avium subsp. paratuberculosis
cccgaucggcccggcca

SEQ ID NO: 900303 - RNA, 17 nt, Mycobacterium avium subsp. paratuberculosis
cccgcaccucgcccggc

SEQ ID NO: 900304 - RNA, 14 nt, Mycobacterium avium subsp. paratuberculosis
cccgcacgccagca

SEQ ID NO: 900305 - RNA, 15 nt, Mycobacterium avium subsp. paratuberculosis
cccgcacgccagcau

SEQ ID NO: 900306 - RNA, 13 nt, Mycobacterium avium subsp. paratuberculosis
cccgcacgcccgg

SEQ ID NO: 900307 - RNA, 16 nt, Mycobacterium avium subsp. paratuberculosis
cccgcacgcccgggca

SEQ ID NO: 900308 - RNA, 14 nt, Mycobacterium avium subsp. paratuberculosis
cccgcacccgccgc

SEQ ID NO: 900309 - RNA, 22 nt, Mycobacterium avium subsp. paratuberculosis
cccgcacccuugacuaccgcgc

SEQ ID NO: 900310 - RNA, 18 nt, Mycobacterium avium subsp. paratuberculosis
cccgcaccgccaggcugg

SEQ ID NO: 900311 - RNA, 16 nt, Mycobacterium avium subsp. paratuberculosis
cccgcaccacccagcc

SEQ ID NO: 900312 - RNA, 18 nt, Mycobacterium avium subsp. paratuberculosis
cccgcaccaccgcccgga

SEQ ID NO: 900313 - RNA, 15 nt, Mycobacterium avium subsp. paratuberculosis
ccccggcgggcggcc

SEQ ID NO: 900314 - RNA, 18 nt, Mycobacterium avium subsp. paratuberculosis
ccccggcgggcucgccgg

SEQ ID NO: 900315 - RNA, 22 nt, Mycobacterium avium subsp. paratuberculosis
ccccggcgggcucgccggcccg

SEQ ID NO: 900316 - RNA, 12 nt, Mycobacterium avium subsp. paratuberculosis
ccccggcggguc

SEQ ID NO: 900317 - RNA, 14 nt, Mycobacterium avium subsp. paratuberculosis
ccccggcggccgcg

SEQ ID NO: 900318 - RNA, 16 nt, Mycobacterium avium subsp. paratuberculosis
ccccggcggccgcguc

SEQ ID NO: 900319 - RNA, 18 nt, Mycobacterium avium subsp. paratuberculosis
ccccggcggccgcgucgg

SEQ ID NO: 900320 - RNA, 13 nt, Mycobacterium avium subsp. paratuberculosis
ccccggcggccgg

SEQ ID NO: 900321 - RNA, 14 nt, Mycobacterium avium subsp. paratuberculosis
ccccggcgcgccug

SEQ ID NO: 900322 - RNA, 20 nt, Mycobacterium avium subsp. paratuberculosis
ccccggcgcggaacgcgccg

SEQ ID NO: 900323 - RNA, 17 nt, Mycobacterium avium subsp. paratuberculosis
ccccggcguccacgccg

SEQ ID NO: 900324 - RNA, 17 nt, Mycobacterium avium subsp. paratuberculosis
cccgaucaacaccgcca

SEQ ID NO: 900325 - RNA, 18 nt, Mycobacterium avium subsp. paratuberculosis
cccgaucaacaccgccag

SEQ ID NO: 900326 - RNA, 20 nt, Mycobacterium avium subsp. paratuberculosis
cccgaucaacaccgccagca

SEQ ID NO: 900327 - RNA, 22 nt, Mycobacterium avium subsp. paratuberculosis
cccgaucaacaccgccagcacc

SEQ ID NO: 900328 - RNA, 21 nt, Mycobacterium avium subsp. paratuberculosis
cccgauagcuugagccccgcc

SEQ ID NO: 900329 - RNA, 22 nt, Mycobacterium avium subsp. paratuberculosis
cccgauagcuugagccccgccg

SEQ ID NO: 900330 - RNA, 12 nt, Mycobacterium avium subsp. paratuberculosis
ccccggcgucga

SEQ ID NO: 900331 - RNA, 21 nt, Mycobacterium avium subsp. paratuberculosis
ccccggcgucgaugaccucgc

SEQ ID NO: 900332 - RNA, 20 nt, Mycobacterium avium subsp. paratuberculosis
ccccggcgugagcgagccgg

SEQ ID NO: 900333 - RNA, 17 nt, Mycobacterium avium subsp. paratuberculosis
ccccggcgugggugucg

SEQ ID NO: 900334 - RNA, 18 nt, Mycobacterium avium subsp. paratuberculosis
ccccggcgugggugucga

SEQ ID NO: 900335 - RNA, 17 nt, Mycobacterium avium subsp. paratuberculosis
ccccggcucgaucgcgg

SEQ ID NO: 900336 - RNA, 19 nt, Mycobacterium avium subsp. paratuberculosis
ccccggcgcagcgccgcgc

SEQ ID NO: 900337 - RNA, 20 nt, Mycobacterium avium subsp. paratuberculosis
ccccggcgcagcgccgcgcc

SEQ ID NO: 900338 - RNA, 13 nt, Mycobacterium avium subsp. paratuberculosis
ccccggcgacguc

SEQ ID NO: 900339 - RNA, 20 nt, Mycobacterium avium subsp. paratuberculosis
ccccggcgacgucgccggcc

SEQ ID NO: 900340 - RNA, 15 nt, Mycobacterium avium subsp. paratuberculosis
ccccggcggcaccgc

SEQ ID NO: 900341 - RNA, 15 nt, Mycobacterium avium subsp. paratuberculosis
ccccggcgacggcgg

SEQ ID NO: 900342 - RNA, 20 nt, Mycobacterium avium subsp. paratuberculosis
ccccggcgacggcggccguc

SEQ ID NO: 900343 - RNA, 13 nt, Mycobacterium avium subsp. paratuberculosis
ccccggcgccguc

SEQ ID NO: 900344 - RNA, 15 nt, Mycobacterium avium subsp. paratuberculosis
ccccggcgccgucgu

SEQ ID NO: 900345 - RNA, 14 nt, Mycobacterium avium subsp. paratuberculosis
ccccggcgcgacgg

SEQ ID NO: 900346 - RNA, 14 nt, Mycobacterium avium subsp. paratuberculosis
ccccggcccggcga

SEQ ID NO: 900347 - RNA, 15 nt, Mycobacterium avium subsp. paratuberculosis
ccccggccgagccgg

SEQ ID NO: 900348 - RNA, 22 nt, Mycobacterium avium subsp. paratuberculosis
ccccggccgcggugaccgcgcc

SEQ ID NO: 900349 - RNA, 12 nt, Mycobacterium avium subsp. paratuberculosis
ccccggccgggc

SEQ ID NO: 900350 - RNA, 16 nt, Mycobacterium avium subsp. paratuberculosis
ccccggccgggcgacu

SEQ ID NO: 900351 - RNA, 22 nt, Mycobacterium avium subsp. paratuberculosis
ccccggccguucuugcggguga

SEQ ID NO: 900352 - RNA, 14 nt, Mycobacterium avium subsp. paratuberculosis
ccccggcgacggcg

SEQ ID NO: 900353 - RNA, 13 nt, Mycobacterium avium subsp. paratuberculosis
cccgcuggcccgg

SEQ ID NO: 900354 - RNA, 14 nt, Mycobacterium avium subsp. paratuberculosis
cccgcuggcccggc

SEQ ID NO: 900355 - RNA, 15 nt, Mycobacterium avium subsp. paratuberculosis
cccgcuggccgccgc

SEQ ID NO: 900356 - RNA, 20 nt, Mycobacterium avium subsp. paratuberculosis
cccggaacagcuuggcgcag

SEQ ID NO: 900357 - RNA, 15 nt, Mycobacterium avium subsp. paratuberculosis
cccgcugcggcaaug

SEQ ID NO: 900358 - RNA, 14 nt, Mycobacterium avium subsp. paratuberculosis
cccgcugcggcgca

SEQ ID NO: 900359 - RNA, 17 nt, Mycobacterium avium subsp. paratuberculosis
cccgcugcucgaccucg

SEQ ID NO: 900360 - RNA, 18 nt, Mycobacterium avium subsp. paratuberculosis
cccgcugcucgaccucgg

SEQ ID NO: 900361 - RNA, 14 nt, Mycobacterium avium subsp. paratuberculosis
cccgcugcgccgac

SEQ ID NO: 900362 - RNA, 15 nt, Mycobacterium avium subsp. paratuberculosis
cccgcugcgccgacu

SEQ ID NO: 900363 - RNA, 16 nt, Mycobacterium avium subsp. paratuberculosis
cccgcuggaacagcgg

SEQ ID NO: 900364 - RNA, 20 nt, Mycobacterium avium subsp. paratuberculosis
cccgcugccggaccucgacc

SEQ ID NO: 900365 - RNA, 12 nt, Mycobacterium avium subsp. paratuberculosis
cccgcugccguc

SEQ ID NO: 900366 - RNA, 14 nt, Mycobacterium avium subsp. paratuberculosis
cccgcugcaccagc

SEQ ID NO: 900367 - RNA, 15 nt, Mycobacterium avium subsp. paratuberculosis
cccgcugcaccagcc

SEQ ID NO: 900368 - RNA, 17 nt, Mycobacterium avium subsp. paratuberculosis
cccgcugcaccagcccg

SEQ ID NO: 900369 - RNA, 15 nt, Mycobacterium avium subsp. paratuberculosis
cccgcugcagcgccg

SEQ ID NO: 900370 - RNA, 17 nt, Mycobacterium avium subsp. paratuberculosis
cccgcugcagcgccgag

SEQ ID NO: 900371 - RNA, 12 nt, Mycobacterium avium subsp. paratuberculosis
cccgcugcgccg

SEQ ID NO: 900372 - RNA, 13 nt, Mycobacterium avium subsp. paratuberculosis
cccgcugcgcggc

SEQ ID NO: 900373 - RNA, 15 nt, Mycobacterium avium subsp. paratuberculosis
cccgcugcgcggccg

SEQ ID NO: 900374 - RNA, 17 nt, Mycobacterium avium subsp. paratuberculosis
cccgcugcgcggccgaa

SEQ ID NO: 900375 - RNA, 22 nt, Mycobacterium avium subsp. paratuberculosis
cccgcugcgcgggucggcgccg

SEQ ID NO: 900376 - RNA, 14 nt, Mycobacterium avium subsp. paratuberculosis
cccgcuccagcggc

SEQ ID NO: 900377 - RNA, 22 nt, Mycobacterium avium subsp. paratuberculosis
cccgcuccauggcggcgaccaa

SEQ ID NO: 900378 - RNA, 15 nt, Mycobacterium avium subsp. paratuberculosis
cccgcucccgggaca

SEQ ID NO: 900379 - RNA, 20 nt, Mycobacterium avium subsp. paratuberculosis
cccgcucccgggacagcccg

SEQ ID NO: 900380 - RNA, 12 nt, Mycobacterium avium subsp. paratuberculosis
cccgcuccgacg

SEQ ID NO: 900381 - RNA, 13 nt, Mycobacterium avium subsp. paratuberculosis
cccgcucggcgug

SEQ ID NO: 900382 - RNA, 13 nt, Mycobacterium avium subsp. paratuberculosis
cccgcucgggcca

SEQ ID NO: 900383 - RNA, 13 nt, Mycobacterium avium subsp. paratuberculosis
cccgcucgggcgc

SEQ ID NO: 900384 - RNA, 24 nt, Mycobacterium avium subsp. paratuberculosis
cccgcucggucuugaucaggucgc

SEQ ID NO: 900385 - RNA, 20 nt, Mycobacterium avium subsp. paratuberculosis
cccgcugaccgccgcgcucg

SEQ ID NO: 900386 - RNA, 16 nt, Mycobacterium avium subsp. paratuberculosis
cccgcucaccugcggc

SEQ ID NO: 900387 - RNA, 19 nt, Mycobacterium avium subsp. paratuberculosis
cccgcucaggucggccgcg

SEQ ID NO: 900388 - RNA, 20 nt, Mycobacterium avium subsp. paratuberculosis
cccgcucaggucggccgcgg

SEQ ID NO: 900389 - RNA, 22 nt, Mycobacterium avium subsp. paratuberculosis
cccgcucaggucggccgcggcc

SEQ ID NO: 900390 - RNA, 15 nt, Mycobacterium avium subsp. paratuberculosis
cccgcuaaagccgac

SEQ ID NO: 900391 - RNA, 20 nt, Mycobacterium avium subsp. paratuberculosis
cccgcuaaagccgacugccc

SEQ ID NO: 900392 - RNA, 21 nt, Mycobacterium avium subsp. paratuberculosis
cccgcggggcguacgcgcugc

SEQ ID NO: 900393 - RNA, 19 nt, Mycobacterium avium subsp. paratuberculosis
cccgcguugcggcgcagcg

SEQ ID NO: 900394 - RNA, 14 nt, Mycobacterium avium subsp. paratuberculosis
cccgcggcgcgaug

SEQ ID NO: 900395 - RNA, 17 nt, Mycobacterium avium subsp. paratuberculosis
cccgcggcgcgaugauc

SEQ ID NO: 900396 - RNA, 18 nt, Mycobacterium avium subsp. paratuberculosis
cccgcggcgcgcaggucg

SEQ ID NO: 900397 - RNA, 13 nt, Mycobacterium avium subsp. paratuberculosis
cccgcggccgccg

SEQ ID NO: 900398 - RNA, 22 nt, Mycobacterium avium subsp. paratuberculosis
cccgcggccgccgccgcggccg

SEQ ID NO: 900399 - RNA, 13 nt, Mycobacterium avium subsp. paratuberculosis
cccgcggccgcug

SEQ ID NO: 900400 - RNA, 23 nt, Mycobacterium avium subsp. paratuberculosis
cccgcggccgcugcgcccagcgc

SEQ ID NO: 900401 - RNA, 17 nt, Mycobacterium avium subsp. paratuberculosis
cccgcggccuccagccg

SEQ ID NO: 900402 - RNA, 21 nt, Mycobacterium avium subsp. paratuberculosis
cccgcgggacacggcggcgcg

SEQ ID NO: 900403 - RNA, 18 nt, Mycobacterium avium subsp. paratuberculosis
cccgcgggaucagcgugu

SEQ ID NO: 900404 - RNA, 19 nt, Mycobacterium avium subsp. paratuberculosis
cccgcggcgccgcggcggc

SEQ ID NO: 900405 - RNA, 18 nt, Mycobacterium avium subsp. paratuberculosis
cccgcggguagcccgucg

SEQ ID NO: 900406 - RNA, 19 nt, Mycobacterium avium subsp. paratuberculosis
cccgcggguagcccgucga

SEQ ID NO: 900407 - RNA, 21 nt, Mycobacterium avium subsp. paratuberculosis
cccgcggguagcccgucgacg

SEQ ID NO: 900408 - RNA, 16 nt, Mycobacterium avium subsp. paratuberculosis
cccgcgggucgcggcc

SEQ ID NO: 900409 - RNA, 18 nt, Mycobacterium avium subsp. paratuberculosis
cccgcgggucgcggccca

SEQ ID NO: 900410 - RNA, 15 nt, Mycobacterium avium subsp. paratuberculosis
cccgcgggucgucga

SEQ ID NO: 900411 - RNA, 16 nt, Mycobacterium avium subsp. paratuberculosis
cccgcgggucgucgac

SEQ ID NO: 900412 - RNA, 18 nt, Mycobacterium avium subsp. paratuberculosis
cccgcgggucgucgacgu

SEQ ID NO: 900413 - RNA, 21 nt, Mycobacterium avium subsp. paratuberculosis
cccgcgggucgucgacgucgg

SEQ ID NO: 900414 - RNA, 20 nt, Mycobacterium avium subsp. paratuberculosis
cccgcguggccgccaggauc

SEQ ID NO: 900415 - RNA, 12 nt, Mycobacterium avium subsp. paratuberculosis
cccgcgccucgu

SEQ ID NO: 900416 - RNA, 21 nt, Mycobacterium avium subsp. paratuberculosis
cccgcgccucguugagcacaa

SEQ ID NO: 900417 - RNA, 14 nt, Mycobacterium avium subsp. paratuberculosis
cccgcgccggcgug

SEQ ID NO: 900418 - RNA, 16 nt, Mycobacterium avium subsp. paratuberculosis
cccgcgccgggcguug

SEQ ID NO: 900419 - RNA, 13 nt, Mycobacterium avium subsp. paratuberculosis
cccgcgccggcag

SEQ ID NO: 900420 - RNA, 18 nt, Mycobacterium avium subsp. paratuberculosis
cccgcgcgacaucaccgc

SEQ ID NO: 900421 - RNA, 19 nt, Mycobacterium avium subsp. paratuberculosis
cccgcgcugcccagcgcgg

SEQ ID NO: 900422 - RNA, 16 nt, Mycobacterium avium subsp. paratuberculosis
cccgcgcuggugcugc

SEQ ID NO: 900423 - RNA, 13 nt, Mycobacterium avium subsp. paratuberculosis
cccgcggaucgcg

SEQ ID NO: 900424 - RNA, 16 nt, Mycobacterium avium subsp. paratuberculosis
cccgcggcacgcugcg

SEQ ID NO: 900425 - RNA, 17 nt, Mycobacterium avium subsp. paratuberculosis
cccgcggcagccgggcg

SEQ ID NO: 900426 - RNA, 12 nt, Mycobacterium avium subsp. paratuberculosis
cccgcgccgacc

SEQ ID NO: 900427 - RNA, 19 nt, Mycobacterium avium subsp. paratuberculosis
cccgcgccgaccagcgcgu

SEQ ID NO: 900428 - RNA, 20 nt, Mycobacterium avium subsp. paratuberculosis
cccgcgccgcauuggcaccg

SEQ ID NO: 900429 - RNA, 20 nt, Mycobacterium avium subsp. paratuberculosis
cccgcgccagcucggcggcc

SEQ ID NO: 900430 - RNA, 15 nt, Mycobacterium avium subsp. paratuberculosis
cccgcgcccaccugg

SEQ ID NO: 900431 - RNA, 17 nt, Mycobacterium avium subsp. paratuberculosis
cccgcgccccggcggcc

SEQ ID NO: 900432 - RNA, 14 nt, Mycobacterium avium subsp. paratuberculosis
cccgcgcccgccgc

SEQ ID NO: 900433 - RNA, 13 nt, Mycobacterium avium subsp. paratuberculosis
cccgcgcccgcuc

SEQ ID NO: 900434 - RNA, 15 nt, Mycobacterium avium subsp. paratuberculosis
cccgcgcccgcucga

SEQ ID NO: 900435 - RNA, 15 nt, Mycobacterium avium subsp. paratuberculosis
cccgcgccaccccga

SEQ ID NO: 900436 - RNA, 20 nt, Mycobacterium avium subsp. paratuberculosis
cccgcgaaaucuucgccguc

SEQ ID NO: 900437 - RNA, 20 nt, Mycobacterium avium subsp. paratuberculosis
cccgcgaacacgcgaugauc

SEQ ID NO: 900438 - RNA, 23 nt, Mycobacterium avium subsp. paratuberculosis
cccgcgaacacgcgaugaucagc

SEQ ID NO: 900439 - RNA, 22 nt, Mycobacterium avium subsp. paratuberculosis
cccgccuggccaccucgacggc

SEQ ID NO: 900440 - RNA, 15 nt, Mycobacterium avium subsp. paratuberculosis
cccgccgugaccggc

SEQ ID NO: 900441 - RNA, 16 nt, Mycobacterium avium subsp. paratuberculosis
cccgccguuucagcag

SEQ ID NO: 900442 - RNA, 21 nt, Mycobacterium avium subsp. paratuberculosis
cccgccguuucagcagcgcgu

SEQ ID NO: 900443 - RNA, 17 nt, Mycobacterium avium subsp. paratuberculosis
cccgccucgcagcgaca

SEQ ID NO: 900444 - RNA, 18 nt, Mycobacterium avium subsp. paratuberculosis
cccgccucggcggccgcc

SEQ ID NO: 900445 - RNA, 16 nt, Mycobacterium avium subsp. paratuberculosis
cccgccgcugacgcgg

SEQ ID NO: 900446 - RNA, 16 nt, Mycobacterium avium subsp. paratuberculosis
cccgccgcgcccggcu

SEQ ID NO: 900447 - RNA, 13 nt, Mycobacterium avium subsp. paratuberculosis
cccgccgcggcaa

SEQ ID NO: 900448 - RNA, 11 nt, Mycobacterium avium subsp. paratuberculosis
cccgccgucga

SEQ ID NO: 900449 - RNA, 13 nt, Mycobacterium avium subsp. paratuberculosis
cccgccgucgacg

SEQ ID NO: 900450 - RNA, 18 nt, Mycobacterium avium subsp. paratuberculosis
cccgccgucgacgcgugc

SEQ ID NO: 900451 - RNA, 13 nt, Mycobacterium avium subsp. paratuberculosis
cccgccgcggcca

SEQ ID NO: 900452 - RNA, 13 nt, Mycobacterium avium subsp. paratuberculosis
cccgccgcggccg

SEQ ID NO: 900453 - RNA, 16 nt, Mycobacterium avium subsp. paratuberculosis
cccgccgcggccgcug

SEQ ID NO: 900454 - RNA, 24 nt, Mycobacterium avium subsp. paratuberculosis
cccgccgcggccgcuggcguugag

SEQ ID NO: 900455 - RNA, 18 nt, Mycobacterium avium subsp. paratuberculosis
cccgccgcguacaccggc

SEQ ID NO: 900456 - RNA, 20 nt, Mycobacterium avium subsp. paratuberculosis
cccgccgcguacaccggcug

SEQ ID NO: 900457 - RNA, 21 nt, Mycobacterium avium subsp. paratuberculosis
cccgccgcgucagcggcgggc

SEQ ID NO: 900458 - RNA, 13 nt, Mycobacterium avium subsp. paratuberculosis
cccgccgccgucg

SEQ ID NO: 900459 - RNA, 13 nt, Mycobacterium avium subsp. paratuberculosis
cccgccgccgugc

SEQ ID NO: 900460 - RNA, 15 nt, Mycobacterium avium subsp. paratuberculosis
cccgccgcgaccgcg

SEQ ID NO: 900461 - RNA, 13 nt, Mycobacterium avium subsp. paratuberculosis
cccgccgcgagca

SEQ ID NO: 900462 - RNA, 24 nt, Mycobacterium avium subsp. paratuberculosis
ccgaccagcaggacgcgcccggcg

SEQ ID NO: 900463 - RNA, 13 nt, Mycobacterium avium subsp. paratuberculosis
ccgaccagcaccc

SEQ ID NO: 900464 - RNA, 15 nt, Mycobacterium avium subsp. paratuberculosis
ccgaccagcacccgg

SEQ ID NO: 900465 - RNA, 17 nt, Mycobacterium avium subsp. paratuberculosis
ccgaccagcaccgcggc

SEQ ID NO: 900466 - RNA, 18 nt, Mycobacterium avium subsp. paratuberculosis
ccgaccagcaccgcggcg

SEQ ID NO: 900467 - RNA, 12 nt, Mycobacterium avium subsp. paratuberculosis
ccgaccagcuga

SEQ ID NO: 900468 - RNA, 13 nt, Mycobacterium avium subsp. paratuberculosis
ccgaccagcggcc

SEQ ID NO: 900469 - RNA, 18 nt, Mycobacterium avium subsp. paratuberculosis
ccgaccagcggcccaccg

SEQ ID NO: 900470 - RNA, 14 nt, Mycobacterium avium subsp. paratuberculosis
ccgaccagcgcgau

SEQ ID NO: 900471 - RNA, 12 nt, Mycobacterium avium subsp. paratuberculosis
ccgaccagccga

SEQ ID NO: 900472 - RNA, 15 nt, Mycobacterium avium subsp. paratuberculosis
ccgaccagccgaggc

SEQ ID NO: 900473 - RNA, 12 nt, Mycobacterium avium subsp. paratuberculosis
ccgaccagccgg

SEQ ID NO: 900474 - RNA, 21 nt, Mycobacterium avium subsp. paratuberculosis
ccgaccagccggucuuggaca

SEQ ID NO: 900475 - RNA, 21 nt, Mycobacterium avium subsp. paratuberculosis
ccgaccaguucggccaccgcg

SEQ ID NO: 900476 - RNA, 23 nt, Mycobacterium avium subsp. paratuberculosis
ccgaccaguucuucgaugacggc

SEQ ID NO: 900477 - RNA, 15 nt, Mycobacterium avium subsp. paratuberculosis
ccgaccagguagcgc

SEQ ID NO: 900478 - RNA, 22 nt, Mycobacterium avium subsp. paratuberculosis
ccgaccagguccgguucgaccg

SEQ ID NO: 900479 - RNA, 18 nt, Mycobacterium avium subsp. paratuberculosis
ccgaccaggaucgggauc

SEQ ID NO: 900480 - RNA, 13 nt, Mycobacterium avium subsp. paratuberculosis
ccgaccagcggga

SEQ ID NO: 900481 - RNA, 15 nt, Mycobacterium avium subsp. paratuberculosis
ccgaccagcgggccg

SEQ ID NO: 900482 - RNA, 11 nt, Mycobacterium avium subsp. paratuberculosis
ccgaccaggaa

SEQ ID NO: 900483 - RNA, 21 nt, Mycobacterium avium subsp. paratuberculosis
ccgaccaggaacacggcucgg

SEQ ID NO: 900484 - RNA, 21 nt, Mycobacterium avium subsp. paratuberculosis
ccgaccccgccagcaccgaca

SEQ ID NO: 900485 - RNA, 16 nt, Mycobacterium avium subsp. paratuberculosis
ccgaccccucggcggc

SEQ ID NO: 900486 - RNA, 23 nt, Mycobacterium avium subsp. paratuberculosis
ccgaccccugcacuaccccgucg

SEQ ID NO: 900487 - RNA, 12 nt, Mycobacterium avium subsp. paratuberculosis
ccgacccgaagc

SEQ ID NO: 900488 - RNA, 14 nt, Mycobacterium avium subsp. paratuberculosis
ccgacccgcaccac

SEQ ID NO: 900489 - RNA, 16 nt, Mycobacterium avium subsp. paratuberculosis
ccgacccgcaccaccg

SEQ ID NO: 900490 - RNA, 18 nt, Mycobacterium avium subsp. paratuberculosis
ccgacccgcccgccgggc

SEQ ID NO: 900491 - RNA, 20 nt, Mycobacterium avium subsp. paratuberculosis
ccgacccgcccgccgggcac

SEQ ID NO: 900492 - RNA, 13 nt, Mycobacterium avium subsp. paratuberculosis
ccgacccggccag

SEQ ID NO: 900493 - RNA, 13 nt, Mycobacterium avium subsp. paratuberculosis
ccgacccggccga

SEQ ID NO: 900494 - RNA, 15 nt, Mycobacterium avium subsp. paratuberculosis
ccgacccgcugcagc

SEQ ID NO: 900495 - RNA, 15 nt, Mycobacterium avium subsp. paratuberculosis
ccgacccggccgaug

SEQ ID NO: 900496 - RNA, 19 nt, Mycobacterium avium subsp. paratuberculosis
ccgacccggucagcucgcc

SEQ ID NO: 900497 - RNA, 23 nt, Mycobacterium avium subsp. paratuberculosis
ccgacccggucagcucgccgucc

SEQ ID NO: 900498 - RNA, 24 nt, Mycobacterium avium subsp. paratuberculosis
ccgacccggucagcucgccguccg

SEQ ID NO: 900499 - RNA, 22 nt, Mycobacterium avium subsp. paratuberculosis
ccgacccugcguccggcccggc

SEQ ID NO: 900500 - RNA, 14 nt, Mycobacterium avium subsp. paratuberculosis
ccgaccgacagccg

SEQ ID NO: 900501 - RNA, 21 nt, Mycobacterium avium subsp. paratuberculosis
ccgaccgacaguucggcgcgc

SEQ ID NO: 900502 - RNA, 16 nt, Mycobacterium avium subsp. paratuberculosis
ccgaccgacgcgguca

SEQ ID NO: 900503 - RNA, 21 nt, Mycobacterium avium subsp. paratuberculosis
ccgaccgacgcggucaccggc

SEQ ID NO: 900504 - RNA, 13 nt, Mycobacterium avium subsp. paratuberculosis
ccgaccgccacca

SEQ ID NO: 900505 - RNA, 16 nt, Mycobacterium avium subsp. paratuberculosis
ccgaccgccaccaccc

SEQ ID NO: 900506 - RNA, 15 nt, Mycobacterium avium subsp. paratuberculosis
ccgacgaagaucccg

SEQ ID NO: 900507 - RNA, 22 nt, Mycobacterium avium subsp. paratuberculosis
ccgacgaagaucccgcuggcca

SEQ ID NO: 900508 - RNA, 17 nt, Mycobacterium avium subsp. paratuberculosis
ccgacgaacagguucgc

SEQ ID NO: 900509 - RNA, 16 nt, Mycobacterium avium subsp. paratuberculosis
ccgacgaagccgccgc

SEQ ID NO: 900510 - RNA, 16 nt, Mycobacterium avium subsp. paratuberculosis
ccgaccuugacccagg

SEQ ID NO: 900511 - RNA, 20 nt, Mycobacterium avium subsp. paratuberculosis
ccgaccuugacccaggcccg

SEQ ID NO: 900512 - RNA, 15 nt, Mycobacterium avium subsp. paratuberculosis
ccgaccuggcggccg

SEQ ID NO: 900513 - RNA, 22 nt, Mycobacterium avium subsp. paratuberculosis
ccgaccugggcggccaccgcgc

SEQ ID NO: 900514 - RNA, 17 nt, Mycobacterium avium subsp. paratuberculosis
ccgaccuggucgccgaa

SEQ ID NO: 900515 - RNA, 20 nt, Mycobacterium avium subsp. paratuberculosis
ccgaccuccaaugcgcccug

SEQ ID NO: 900516 - RNA, 21 nt, Mycobacterium avium subsp. paratuberculosis
ccgaccucgaggccgaggucg

SEQ ID NO: 900517 - RNA, 14 nt, Mycobacterium avium subsp. paratuberculosis
ccgaccugcgcgac

SEQ ID NO: 900518 - RNA, 21 nt, Mycobacterium avium subsp. paratuberculosis
ccgaccugcgcgacggcgcug

SEQ ID NO: 900519 - RNA, 15 nt, Mycobacterium avium subsp. paratuberculosis
ccgaccucggcgacg

SEQ ID NO: 900520 - RNA, 13 nt, Mycobacterium avium subsp. paratuberculosis
ccgaccucgucga

SEQ ID NO: 900521 - RNA, 14 nt, Mycobacterium avium subsp. paratuberculosis
ccgaccucgucgac

SEQ ID NO: 900522 - RNA, 16 nt, Mycobacterium avium subsp. paratuberculosis
ccgaccucgucgacgg

SEQ ID NO: 900523 - RNA, 15 nt, Mycobacterium avium subsp. paratuberculosis
ccgaccucggccagc

SEQ ID NO: 900524 - RNA, 18 nt, Mycobacterium avium subsp. paratuberculosis
ccgaccucggccagcgug

SEQ ID NO: 900525 - RNA, 16 nt, Mycobacterium avium subsp. paratuberculosis
ccgaccgggcgcuccg

SEQ ID NO: 900526 - RNA, 13 nt, Mycobacterium avium subsp. paratuberculosis
ccgaccgguccgc

SEQ ID NO: 900527 - RNA, 14 nt, Mycobacterium avium subsp. paratuberculosis
ccgaccggcucagc

SEQ ID NO: 900528 - RNA, 16 nt, Mycobacterium avium subsp. paratuberculosis
ccgaccggcucagccc

SEQ ID NO: 900529 - RNA, 19 nt, Mycobacterium avium subsp. paratuberculosis
ccgaccggcucagcccggc

SEQ ID NO: 900530 - RNA, 17 nt, Mycobacterium avium subsp. paratuberculosis
ccgaccggucucgaccg

SEQ ID NO: 900531 - RNA, 21 nt, Mycobacterium avium subsp. paratuberculosis
ccgaccgucgucccggugaug

SEQ ID NO: 900532 - RNA, 18 nt, Mycobacterium avium subsp. paratuberculosis
ccgaccgguugcccggaa

SEQ ID NO: 900533 - RNA, 17 nt, Mycobacterium avium subsp. paratuberculosis
ccgaccgcggucgcggc

SEQ ID NO: 900534 - RNA, 21 nt, Mycobacterium avium subsp. paratuberculosis
ccgaccgcggucgcggcgccg

SEQ ID NO: 900535 - RNA, 14 nt, Mycobacterium avium subsp. paratuberculosis
ccgaccgcgccgaa

SEQ ID NO: 900536 - RNA, 18 nt, Mycobacterium avium subsp. paratuberculosis
ccgaccgcguacagggcg

SEQ ID NO: 900537 - RNA, 11 nt, Mycobacterium avium subsp. paratuberculosis
ccgaccgccgc

SEQ ID NO: 900538 - RNA, 12 nt, Mycobacterium avium subsp. paratuberculosis
ccgaccgccgcc

SEQ ID NO: 900539 - RNA, 16 nt, Mycobacterium avium subsp. paratuberculosis
ccgaccgccgcggccg

SEQ ID NO: 900540 - RNA, 12 nt, Mycobacterium avium subsp. paratuberculosis
ccgaccgcgccg

SEQ ID NO: 900541 - RNA, 20 nt, Mycobacterium avium subsp. paratuberculosis
ccgacaccgccuucgacggc

SEQ ID NO: 900542 - RNA, 14 nt, Mycobacterium avium subsp. paratuberculosis
ccgacaccggccgg

SEQ ID NO: 900543 - RNA, 16 nt, Mycobacterium avium subsp. paratuberculosis
ccgaagauggccagcg

SEQ ID NO: 900544 - RNA, 16 nt, Mycobacterium avium subsp. paratuberculosis
ccgacaccgccagcag

SEQ ID NO: 900545 - RNA, 20 nt, Mycobacterium avium subsp. paratuberculosis
ccgacaccgccagcagcgcc

SEQ ID NO: 900546 - RNA, 18 nt, Mycobacterium avium subsp. paratuberculosis
ccgacaccgccccgccgc

SEQ ID NO: 900547 - RNA, 19 nt, Mycobacterium avium subsp. paratuberculosis
ccgacaccgccccgccgcg

SEQ ID NO: 900548 - RNA, 15 nt, Mycobacterium avium subsp. paratuberculosis
ccgaaguauccgguc

SEQ ID NO: 900549 - RNA, 22 nt, Mycobacterium avium subsp. paratuberculosis
ccgaaguccgccagggugccgc

SEQ ID NO: 900550 - RNA, 13 nt, Mycobacterium avium subsp. paratuberculosis
ccgaagucgacgc

SEQ ID NO: 900551 - RNA, 16 nt, Mycobacterium avium subsp. paratuberculosis
ccgaaguuccagccga

SEQ ID NO: 900552 - RNA, 18 nt, Mycobacterium avium subsp. paratuberculosis
ccgacaccaccggccgcc

SEQ ID NO: 900553 - RNA, 22 nt, Mycobacterium avium subsp. paratuberculosis
ccgacaccaccugcacggggac

SEQ ID NO: 900554 - RNA, 16 nt, Mycobacterium avium subsp. paratuberculosis
ccgacaccccacaccg

SEQ ID NO: 900555 - RNA, 19 nt, Mycobacterium avium subsp. paratuberculosis
ccgacaccccacaccgucc

SEQ ID NO: 900556 - RNA, 17 nt, Mycobacterium avium subsp. paratuberculosis
ccgacacguaggccgcc

SEQ ID NO: 900557 - RNA, 12 nt, Mycobacterium avium subsp. paratuberculosis
ccgacaccgccu

SEQ ID NO: 900558 - RNA, 15 nt, Mycobacterium avium subsp. paratuberculosis
ccgacaccggguccc

SEQ ID NO: 900559 - RNA, 16 nt, Mycobacterium avium subsp. paratuberculosis
ccgacaccgucgccgu

SEQ ID NO: 900560 - RNA, 18 nt, Mycobacterium avium subsp. paratuberculosis
ccgacaccgucgccguga

SEQ ID NO: 900561 - RNA, 21 nt, Mycobacterium avium subsp. paratuberculosis
ccgacaccgugguggcggcga

SEQ ID NO: 900562 - RNA, 14 nt, Mycobacterium avium subsp. paratuberculosis
ccgacacgccgauc

SEQ ID NO: 900563 - RNA, 15 nt, Mycobacterium avium subsp. paratuberculosis
ccgacacgccgaucg

SEQ ID NO: 900564 - RNA, 15 nt, Mycobacterium avium subsp. paratuberculosis
ccgacacgccgaugu

SEQ ID NO: 900565 - RNA, 20 nt, Mycobacterium avium subsp. paratuberculosis
ccgaaggguauucgugucua

SEQ ID NO: 900566 - RNA, 22 nt, Mycobacterium avium subsp. paratuberculosis
ccgaaggcguuggagccgacca

SEQ ID NO: 900567 - RNA, 20 nt, Mycobacterium avium subsp. paratuberculosis
ccgaaggcuuuacgaggcgu

SEQ ID NO: 900568 - RNA, 20 nt, Mycobacterium avium subsp. paratuberculosis
ccgaagggaaaggcagcagc

SEQ ID NO: 900569 - RNA, 22 nt, Mycobacterium avium subsp. paratuberculosis
ccgaagggaaaggcagcagcca

SEQ ID NO: 900570 - RNA, 20 nt, Mycobacterium avium subsp. paratuberculosis
ccgaagcucaucaccggcgc

SEQ ID NO: 900571 - RNA, 24 nt, Mycobacterium avium subsp. paratuberculosis
ccgaagcucaucaccggcgcgccg

SEQ ID NO: 900572 - RNA, 18 nt, Mycobacterium avium subsp. paratuberculosis
ccgaagaucaccgcgacg

SEQ ID NO: 900573 - RNA, 17 nt, Mycobacterium avium subsp. paratuberculosis
ccgaagaccgccgaaag

SEQ ID NO: 900574 - RNA, 22 nt, Mycobacterium avium subsp. paratuberculosis
ccgacaucaccaaccgcucggc

SEQ ID NO: 900575 - RNA, 23 nt, Mycobacterium avium subsp. paratuberculosis
ccgacaucaccaaccgcucggcg

SEQ ID NO: 900576 - RNA, 16 nt, Mycobacterium avium subsp. paratuberculosis
ccgacaucagaucgcc

SEQ ID NO: 900577 - RNA, 19 nt, Mycobacterium avium subsp. paratuberculosis
ccgacaucagaucgccgac

SEQ ID NO: 900578 - RNA, 21 nt, Mycobacterium avium subsp. paratuberculosis
ccgacaucagaucgccgacga

SEQ ID NO: 900579 - RNA, 15 nt, Mycobacterium avium subsp. paratuberculosis
ccgacaucagugcgg

SEQ ID NO: 900580 - RNA, 19 nt, Mycobacterium avium subsp. paratuberculosis
ccgacauccaggaccgcgc

SEQ ID NO: 900581 - RNA, 21 nt, Mycobacterium avium subsp. paratuberculosis
ccgacauccaggaccgcgcgc

SEQ ID NO: 900582 - RNA, 15 nt, Mycobacterium avium subsp. paratuberculosis
ccgacauccggguag

SEQ ID NO: 900583 - RNA, 17 nt, Mycobacterium avium subsp. paratuberculosis
ccgacaucgccaucagc

SEQ ID NO: 900584 - RNA, 19 nt, Mycobacterium avium subsp. paratuberculosis
ccgacaucgccaucagcag

SEQ ID NO: 900585 - RNA, 17 nt, Mycobacterium avium subsp. paratuberculosis
ccgacaucgcggcgauc

SEQ ID NO: 900586 - RNA, 18 nt, Mycobacterium avium subsp. paratuberculosis
ccgacaucgcggcgaucu

SEQ ID NO: 900587 - RNA, 15 nt, Mycobacterium avium subsp. paratuberculosis
ccgacaucgucggcu

SEQ ID NO: 900588 - RNA, 17 nt, Mycobacterium avium subsp. paratuberculosis
ccgacaucgucggcucg

SEQ ID NO: 900589 - RNA, 14 nt, Mycobacterium avium subsp. paratuberculosis
ccgacauggacgcg

SEQ ID NO: 900590 - RNA, 16 nt, Mycobacterium avium subsp. paratuberculosis
ccgacauggacgcggc

SEQ ID NO: 900591 - RNA, 16 nt, Mycobacterium avium subsp. paratuberculosis
ccgacauggccagcac

SEQ ID NO: 900592 - RNA, 19 nt, Mycobacterium avium subsp. paratuberculosis
ccgacauggccagcaccau

SEQ ID NO: 900593 - RNA, 20 nt, Mycobacterium avium subsp. paratuberculosis
ccgacauggccagcaccauc

SEQ ID NO: 900594 - RNA, 17 nt, Mycobacterium avium subsp. paratuberculosis
ccgacaugucgccgggc

SEQ ID NO: 900595 - RNA, 19 nt, Mycobacterium avium subsp. paratuberculosis
ccgaccaacacccccgcgc

SEQ ID NO: 900596 - RNA, 20 nt, Mycobacterium avium subsp. paratuberculosis
ccgaccaacacccccgcgcu

SEQ ID NO: 900597 - RNA, 16 nt, Mycobacterium avium subsp. paratuberculosis
ccgaccaacgggcggc

SEQ ID NO: 900598 - RNA, 15 nt, Mycobacterium avium subsp. paratuberculosis
ccgaccacaccggcg

SEQ ID NO: 900599 - RNA, 16 nt, Mycobacterium avium subsp. paratuberculosis
ccgaccacaccggcgc

SEQ ID NO: 900600 - RNA, 23 nt, Mycobacterium avium subsp. paratuberculosis
ccgaccacaccggcgcugcccgc

SEQ ID NO: 900601 - RNA, 22 nt, Mycobacterium avium subsp. paratuberculosis
ccgaccacccccagcccgccgg

SEQ ID NO: 900602 - RNA, 23 nt, Mycobacterium avium subsp. paratuberculosis
ccgaccaccuugcgcagcagcag

SEQ ID NO: 900603 - RNA, 15 nt, Mycobacterium avium subsp. paratuberculosis
ccgaccacgccgcgc

SEQ ID NO: 900604 - RNA, 17 nt, Mycobacterium avium subsp. paratuberculosis
ccgaccaccuccccgcg

SEQ ID NO: 900605 - RNA, 14 nt, Mycobacterium avium subsp. paratuberculosis
ccgaccacggcccc

SEQ ID NO: 900606 - RNA, 22 nt, Mycobacterium avium subsp. paratuberculosis
ccgaccacggccccagccgccg

SEQ ID NO: 900607 - RNA, 17 nt, Mycobacterium avium subsp. paratuberculosis
ccgacagggccagcgcc

SEQ ID NO: 900608 - RNA, 18 nt, Mycobacterium avium subsp. paratuberculosis
ccgacagggccagcgcca

SEQ ID NO: 900609 - RNA, 15 nt, Mycobacterium avium subsp. paratuberculosis
ccgacaggcccaccc

SEQ ID NO: 900610 - RNA, 16 nt, Mycobacterium avium subsp. paratuberculosis
ccgacagggagccgac

SEQ ID NO: 900611 - RNA, 20 nt, Mycobacterium avium subsp. paratuberculosis
ccgacagguagcaggcgcgc

SEQ ID NO: 900612 - RNA, 22 nt, Mycobacterium avium subsp. paratuberculosis
ccgacagguagcaggcgcgcag

SEQ ID NO: 900613 - RNA, 23 nt, Mycobacterium avium subsp. paratuberculosis
ccgacagguagcaggcgcgcagc

SEQ ID NO: 900614 - RNA, 15 nt, Mycobacterium avium subsp. paratuberculosis
ccgacagucccacca

SEQ ID NO: 900615 - RNA, 15 nt, Mycobacterium avium subsp. paratuberculosis
ccgacagucgcgggc

SEQ ID NO: 900616 - RNA, 16 nt, Mycobacterium avium subsp. paratuberculosis
ccgacagucgcgggca

SEQ ID NO: 900617 - RNA, 18 nt, Mycobacterium avium subsp. paratuberculosis
ccgacagucgcgggcagc

SEQ ID NO: 900618 - RNA, 20 nt, Mycobacterium avium subsp. paratuberculosis
ccgacagucgcgggcgagcc

SEQ ID NO: 900619 - RNA, 17 nt, Mycobacterium avium subsp. paratuberculosis
ccgacaguucggcgcgc

SEQ ID NO: 900620 - RNA, 18 nt, Mycobacterium avium subsp. paratuberculosis
ccgacaguucggcgcgca

SEQ ID NO: 900621 - RNA, 17 nt, Mycobacterium avium subsp. paratuberculosis
ccgacagcgucguccau

SEQ ID NO: 900622 - RNA, 15 nt, Mycobacterium avium subsp. paratuberculosis
ccgacagcgcgucgg

SEQ ID NO: 900623 - RNA, 15 nt, Mycobacterium avium subsp. paratuberculosis
ccgacagcacgccgg

SEQ ID NO: 900624 - RNA, 19 nt, Mycobacterium avium subsp. paratuberculosis
ccgacagcacgccgggcau

SEQ ID NO: 900625 - RNA, 14 nt, Mycobacterium avium subsp. paratuberculosis
ccgacagcagcuca

SEQ ID NO: 900626 - RNA, 11 nt, Mycobacterium avium subsp. paratuberculosis
ccgacagcccc

SEQ ID NO: 900627 - RNA, 21 nt, Mycobacterium avium subsp. paratuberculosis
ccgacagcccccgcagcccgu

SEQ ID NO: 900628 - RNA, 17 nt, Mycobacterium avium subsp. paratuberculosis
ccgacagccgcaccaga

SEQ ID NO: 900629 - RNA, 14 nt, Mycobacterium avium subsp. paratuberculosis
ccgacagcaaaccg

SEQ ID NO: 900630 - RNA, 19 nt, Mycobacterium avium subsp. paratuberculosis
ccgacagcaaaccgaccgc

SEQ ID NO: 900631 - RNA, 14 nt, Mycobacterium avium subsp. paratuberculosis
ccgacagcaccucg

SEQ ID NO: 900632 - RNA, 13 nt, Mycobacterium avium subsp. paratuberculosis
ccgacagcacccg

SEQ ID NO: 900633 - RNA, 12 nt, Mycobacterium avium subsp. paratuberculosis
ccgacagcaccc

SEQ ID NO: 900634 - RNA, 19 nt, Mycobacterium avium subsp. paratuberculosis
ccgacagauacuucgucga

SEQ ID NO: 900635 - RNA, 17 nt, Mycobacterium avium subsp. paratuberculosis
ccgacagaugcggcacc

SEQ ID NO: 900636 - RNA, 20 nt, Mycobacterium avium subsp. paratuberculosis
ccgacagaugcggcaccagc

SEQ ID NO: 900637 - RNA, 23 nt, Mycobacterium avium subsp. paratuberculosis
ccgacagaugcggcaccagcccg

SEQ ID NO: 900638 - RNA, 18 nt, Mycobacterium avium subsp. paratuberculosis
cccuagcgggccaggaug

SEQ ID NO: 900639 - RNA, 19 nt, Mycobacterium avium subsp. paratuberculosis
cccguugaucucggucugc

SEQ ID NO: 900640 - RNA, 14 nt, Mycobacterium avium subsp. paratuberculosis
cccuacgccguggc

SEQ ID NO: 900641 - RNA, 19 nt, Mycobacterium avium subsp. paratuberculosis
cccuacgggcgcaccgcgc

SEQ ID NO: 900642 - RNA, 21 nt, Mycobacterium avium subsp. paratuberculosis
cccuacgggcgcaccgcgcgc

SEQ ID NO: 900643 - RNA, 16 nt, Mycobacterium avium subsp. paratuberculosis
cccguuggcaggcccg

SEQ ID NO: 900644 - RNA, 10 nt, Mycobacterium avium subsp. paratuberculosis
cccguuggcg

SEQ ID NO: 900645 - RNA, 20 nt, Mycobacterium avium subsp. paratuberculosis
cccguuggcgccggucgacg

SEQ ID NO: 900646 - RNA, 14 nt, Mycobacterium avium subsp. paratuberculosis
cccguucggcgucg

SEQ ID NO: 900647 - RNA, 19 nt, Mycobacterium avium subsp. paratuberculosis
cccguugcgccgcaacggc

SEQ ID NO: 900648 - RNA, 17 nt, Mycobacterium avium subsp. paratuberculosis
cccguugcccgaucagc

SEQ ID NO: 900649 - RNA, 14 nt, Mycobacterium avium subsp. paratuberculosis
cccguugccgccgg

SEQ ID NO: 900650 - RNA, 17 nt, Mycobacterium avium subsp. paratuberculosis
cccguugggccagaacg

SEQ ID NO: 900651 - RNA, 21 nt, Mycobacterium avium subsp. paratuberculosis
cccguugggguccucgauggc

SEQ ID NO: 900652 - RNA, 15 nt, Mycobacterium avium subsp. paratuberculosis
cccguugcggugacg

SEQ ID NO: 900653 - RNA, 20 nt, Mycobacterium avium subsp. paratuberculosis
cccguugucgagcaccgcga

SEQ ID NO: 900654 - RNA, 21 nt, Mycobacterium avium subsp. paratuberculosis
cccguucgguggccaccgcga

SEQ ID NO: 900655 - RNA, 23 nt, Mycobacterium avium subsp. paratuberculosis
cccguugaaguuggccaccgggg

SEQ ID NO: 900656 - RNA, 18 nt, Mycobacterium avium subsp. paratuberculosis
cccguucgagcgccggac

SEQ ID NO: 900657 - RNA, 17 nt, Mycobacterium avium subsp. paratuberculosis
cccguucgaugaugggc

SEQ ID NO: 900658 - RNA, 15 nt, Mycobacterium avium subsp. paratuberculosis
cccggugucgccguc

SEQ ID NO: 900659 - RNA, 16 nt, Mycobacterium avium subsp. paratuberculosis
cccggugucgccgucg

SEQ ID NO: 900660 - RNA, 20 nt, Mycobacterium avium subsp. paratuberculosis
cccggugucgccgucgccgc

SEQ ID NO: 900661 - RNA, 17 nt, Mycobacterium avium subsp. paratuberculosis
cccggugucugaccucg

SEQ ID NO: 900662 - RNA, 22 nt, Mycobacterium avium subsp. paratuberculosis
cccggugucugaccucgcgccg

SEQ ID NO: 900663 - RNA, 13 nt, Mycobacterium avium subsp. paratuberculosis
cccgguucaccag

SEQ ID NO: 900664 - RNA, 15 nt, Mycobacterium avium subsp. paratuberculosis
cccgguuccaaccac

SEQ ID NO: 900665 - RNA, 22 nt, Mycobacterium avium subsp. paratuberculosis
cccgguuccaaccaccguggcc

SEQ ID NO: 900666 - RNA, 19 nt, Mycobacterium avium subsp. paratuberculosis
cccgguuccaccgggccgc

SEQ ID NO: 900667 - RNA, 13 nt, Mycobacterium avium subsp. paratuberculosis
cccgguccuugag

SEQ ID NO: 900668 - RNA, 16 nt, Mycobacterium avium subsp. paratuberculosis
cccggucgacgauggc

SEQ ID NO: 900669 - RNA, 20 nt, Mycobacterium avium subsp. paratuberculosis
cccggucgaggucggccagc

SEQ ID NO: 900670 - RNA, 17 nt, Mycobacterium avium subsp. paratuberculosis
cccggucgaugaucugg

SEQ ID NO: 900671 - RNA, 15 nt, Mycobacterium avium subsp. paratuberculosis
cccggugccgcugga

SEQ ID NO: 900672 - RNA, 15 nt, Mycobacterium avium subsp. paratuberculosis
cccggugccggccgg

SEQ ID NO: 900673 - RNA, 17 nt, Mycobacterium avium subsp. paratuberculosis
cccggugccggccgggu

SEQ ID NO: 900674 - RNA, 14 nt, Mycobacterium avium subsp. paratuberculosis
cccggugcgacgcc

SEQ ID NO: 900675 - RNA, 15 nt, Mycobacterium avium subsp. paratuberculosis
cccggugcgacgccg

SEQ ID NO: 900676 - RNA, 16 nt, Mycobacterium avium subsp. paratuberculosis
cccggugcgacgccgc

SEQ ID NO: 900677 - RNA, 17 nt, Mycobacterium avium subsp. paratuberculosis
cccggugcgacgccgcg

SEQ ID NO: 900678 - RNA, 18 nt, Mycobacterium avium subsp. paratuberculosis
cccggugcgacgccgcgc

SEQ ID NO: 900679 - RNA, 22 nt, Mycobacterium avium subsp. paratuberculosis
cccggugcgacgccgcgcagcg

SEQ ID NO: 900680 - RNA, 16 nt, Mycobacterium avium subsp. paratuberculosis
cccgguggacgcgaug

SEQ ID NO: 900681 - RNA, 18 nt, Mycobacterium avium subsp. paratuberculosis
cccgguggacgcgauggc

SEQ ID NO: 900682 - RNA, 23 nt, Mycobacterium avium subsp. paratuberculosis
cccggugggacugggcgccgccg

SEQ ID NO: 900683 - RNA, 24 nt, Mycobacterium avium subsp. paratuberculosis
cccggugggacugggcgccgccgg

SEQ ID NO: 900684 - RNA, 14 nt, Mycobacterium avium subsp. paratuberculosis
cccucgccggcggc

SEQ ID NO: 900685 - RNA, 19 nt, Mycobacterium avium subsp. paratuberculosis
cccucggccagccaggccg

SEQ ID NO: 900686 - RNA, 22 nt, Mycobacterium avium subsp. paratuberculosis
cccucggaggugccgcgcggca

SEQ ID NO: 900687 - RNA, 19 nt, Mycobacterium avium subsp. paratuberculosis
cccucgggguacucggcgg

SEQ ID NO: 900688 - RNA, 18 nt, Mycobacterium avium subsp. paratuberculosis
cccucgggguagccggcc

SEQ ID NO: 900689 - RNA, 12 nt, Mycobacterium avium subsp. paratuberculosis
cccucggcccgc

SEQ ID NO: 900690 - RNA, 12 nt, Mycobacterium avium subsp. paratuberculosis
cccucggccggu

SEQ ID NO: 900691 - RNA, 21 nt, Mycobacterium avium subsp. paratuberculosis
cccucggccguaccggcguac

SEQ ID NO: 900692 - RNA, 14 nt, Mycobacterium avium subsp. paratuberculosis
cccucgaucgcgac

SEQ ID NO: 900693 - RNA, 22 nt, Mycobacterium avium subsp. paratuberculosis
cccucgaucgcgaccaccggcc

SEQ ID NO: 900694 - RNA, 11 nt, Mycobacterium avium subsp. paratuberculosis
cccucgccgaa

SEQ ID NO: 900695 - RNA, 15 nt, Mycobacterium avium subsp. paratuberculosis
cccucgccgaaccgg

SEQ ID NO: 900696 - RNA, 14 nt, Mycobacterium avium subsp. paratuberculosis
cccucaccacgauc

SEQ ID NO: 900697 - RNA, 16 nt, Mycobacterium avium subsp. paratuberculosis
cccucacuccagcggc

SEQ ID NO: 900698 - RNA, 19 nt, Mycobacterium avium subsp. paratuberculosis
cccucacuccagcggcggc

SEQ ID NO: 900699 - RNA, 19 nt, Mycobacterium avium subsp. paratuberculosis
cccucagaccauggcgcgg

SEQ ID NO: 900700 - RNA, 14 nt, Mycobacterium avium subsp. paratuberculosis
cccucagccggaac

SEQ ID NO: 900701 - RNA, 18 nt, Mycobacterium avium subsp. paratuberculosis
cccugcggccagugccgg

SEQ ID NO: 900702 - RNA, 23 nt, Mycobacterium avium subsp. paratuberculosis
cccugcagguagguggccagccg

SEQ ID NO: 900703 - RNA, 19 nt, Mycobacterium avium subsp. paratuberculosis
cccugcucagcggccaucg

SEQ ID NO: 900704 - RNA, 17 nt, Mycobacterium avium subsp. paratuberculosis
cccugcggcugggucgg

SEQ ID NO: 900705 - RNA, 15 nt, Mycobacterium avium subsp. paratuberculosis
cccugagggugucgg

SEQ ID NO: 900706 - RNA, 20 nt, Mycobacterium avium subsp. paratuberculosis
cccugagggugucggcgauc

SEQ ID NO: 900707 - RNA, 19 nt, Mycobacterium avium subsp. paratuberculosis
cccugcacuaccccgucga

SEQ ID NO: 900708 - RNA, 23 nt, Mycobacterium avium subsp. paratuberculosis
cccugcaccacgaagcgggcggc

SEQ ID NO: 900709 - RNA, 16 nt, Mycobacterium avium subsp. paratuberculosis
ccgaacugccgcgcac

SEQ ID NO: 900710 - RNA, 18 nt, Mycobacterium avium subsp. paratuberculosis
ccgaacugccggaccagg

SEQ ID NO: 900711 - RNA, 21 nt, Mycobacterium avium subsp. paratuberculosis
ccgaagaaccccgagaucgcg

SEQ ID NO: 900712 - RNA, 20 nt, Mycobacterium avium subsp. paratuberculosis
ccgaagaacgacuggcggcg

SEQ ID NO: 900713 - RNA, 21 nt, Mycobacterium avium subsp. paratuberculosis
ccgaagaacgacuggcggcgg

SEQ ID NO: 900714 - RNA, 23 nt, Mycobacterium avium subsp. paratuberculosis
ccgaagaacgacuggcggcggcg

SEQ ID NO: 900715 - RNA, 15 nt, Mycobacterium avium subsp. paratuberculosis
ccgaacuucagcgcg

SEQ ID NO: 900716 - RNA, 16 nt, Mycobacterium avium subsp. paratuberculosis
ccgaacuucagcgcgu

SEQ ID NO: 900717 - RNA, 19 nt, Mycobacterium avium subsp. paratuberculosis
ccgaacuucagcgcgucgu

SEQ ID NO: 900718 - RNA, 21 nt, Mycobacterium avium subsp. paratuberculosis
ccgaacuucagcgcgucgucg

SEQ ID NO: 900719 - RNA, 22 nt, Mycobacterium avium subsp. paratuberculosis
ccgaacuucagcgcgucgucga

SEQ ID NO: 900720 - RNA, 15 nt, Mycobacterium avium subsp. paratuberculosis
ccgaacucggcgccg

SEQ ID NO: 900721 - RNA, 14 nt, Mycobacterium avium subsp. paratuberculosis
ccgaacugccgcgc

SEQ ID NO: 900722 - RNA, 13 nt, Mycobacterium avium subsp. paratuberculosis
ccgaacgggucgg

SEQ ID NO: 900723 - RNA, 16 nt, Mycobacterium avium subsp. paratuberculosis
ccgaacgggucggcga

SEQ ID NO: 900724 - RNA, 19 nt, Mycobacterium avium subsp. paratuberculosis
ccgaacgggucggcgacca

SEQ ID NO: 900725 - RNA, 22 nt, Mycobacterium avium subsp. paratuberculosis
ccgaacgucgagcgcggcccgc

SEQ ID NO: 900726 - RNA, 15 nt, Mycobacterium avium subsp. paratuberculosis
ccgaacgugcgcggc

SEQ ID NO: 900727 - RNA, 20 nt, Mycobacterium avium subsp. paratuberculosis
ccgaacggaccgggcgggcu

SEQ ID NO: 900728 - RNA, 21 nt, Mycobacterium avium subsp. paratuberculosis
ccgaacgccggauuggcgucg

SEQ ID NO: 900729 - RNA, 17 nt, Mycobacterium avium subsp. paratuberculosis
ccgaacgccuccgccgc

SEQ ID NO: 900730 - RNA, 18 nt, Mycobacterium avium subsp. paratuberculosis
ccgaacgccuccgccgcc

SEQ ID NO: 900731 - RNA, 13 nt, Mycobacterium avium subsp. paratuberculosis
ccgaacgccucga

SEQ ID NO: 900732 - RNA, 15 nt, Mycobacterium avium subsp. paratuberculosis
ccgaacgccagcagc

SEQ ID NO: 900733 - RNA, 17 nt, Mycobacterium avium subsp. paratuberculosis
ccgaacagggcgacggc

SEQ ID NO: 900734 - RNA, 15 nt, Mycobacterium avium subsp. paratuberculosis
ccgaacgcaccaccg

SEQ ID NO: 900735 - RNA, 18 nt, Mycobacterium avium subsp. paratuberculosis
ccgaacgcaccaccgcgg

SEQ ID NO: 900736 - RNA, 16 nt, Mycobacterium avium subsp. paratuberculosis
ccgaacagccgggcca

SEQ ID NO: 900737 - RNA, 17 nt, Mycobacterium avium subsp. paratuberculosis
ccgaacagccgggcggc

SEQ ID NO: 900738 - RNA, 14 nt, Mycobacterium avium subsp. paratuberculosis
ccgaacagccgggu

SEQ ID NO: 900739 - RNA, 15 nt, Mycobacterium avium subsp. paratuberculosis
ccgaacagcgacguc

SEQ ID NO: 900740 - RNA, 15 nt, Mycobacterium avium subsp. paratuberculosis
ccgaacacggccgcc

SEQ ID NO: 900741 - RNA, 23 nt, Mycobacterium avium subsp. paratuberculosis
ccgaacagaugccugcccagcgg

SEQ ID NO: 900742 - RNA, 18 nt, Mycobacterium avium subsp. paratuberculosis
ccgaacaccgugaacagg

SEQ ID NO: 900743 - RNA, 15 nt, Mycobacterium avium subsp. paratuberculosis
ccgaacaccugcggc

SEQ ID NO: 900744 - RNA, 17 nt, Mycobacterium avium subsp. paratuberculosis
ccgaacaacagggccgc

SEQ ID NO: 900745 - RNA, 18 nt, Mycobacterium avium subsp. paratuberculosis
ccgaacaacggcggaccg

SEQ ID NO: 900746 - RNA, 23 nt, Mycobacterium avium subsp. paratuberculosis
ccgaacaacggcggaccggcggc

SEQ ID NO: 900747 - RNA, 18 nt, Mycobacterium avium subsp. paratuberculosis
ccgaacaccggcagcgcc

SEQ ID NO: 900748 - RNA, 15 nt, Mycobacterium avium subsp. paratuberculosis
cccuguucgcgccgg

SEQ ID NO: 900749 - RNA, 16 nt, Mycobacterium avium subsp. paratuberculosis
cccuucaucagcaccg

SEQ ID NO: 900750 - RNA, 19 nt, Mycobacterium avium subsp. paratuberculosis
cccuucaucagcaccgcga

SEQ ID NO: 900751 - RNA, 17 nt, Mycobacterium avium subsp. paratuberculosis
cccuucauuagccggac

SEQ ID NO: 900752 - RNA, 12 nt, Mycobacterium avium subsp. paratuberculosis
cccugcgucauc

SEQ ID NO: 900753 - RNA, 21 nt, Mycobacterium avium subsp. paratuberculosis
cccugcguccggcccggcguc

SEQ ID NO: 900754 - RNA, 13 nt, Mycobacterium avium subsp. paratuberculosis
cccugcucgucgu

SEQ ID NO: 900755 - RNA, 22 nt, Mycobacterium avium subsp. paratuberculosis
cccugcucgucguugaccugcu

SEQ ID NO: 900756 - RNA, 16 nt, Mycobacterium avium subsp. paratuberculosis
cccugcugggagcggc

SEQ ID NO: 900757 - RNA, 13 nt, Mycobacterium avium subsp. paratuberculosis
cccuggaaggcga

SEQ ID NO: 900758 - RNA, 22 nt, Mycobacterium avium subsp. paratuberculosis
cccuggaaggcgaucacgaaga

SEQ ID NO: 900759 - RNA, 22 nt, Mycobacterium avium subsp. paratuberculosis
cccuggacgaguggucggccgc

SEQ ID NO: 900760 - RNA, 19 nt, Mycobacterium avium subsp. paratuberculosis
cccugcuugaacagcaccc

SEQ ID NO: 900761 - RNA, 21 nt, Mycobacterium avium subsp. paratuberculosis
cccugcuugaccgcgacgggc

SEQ ID NO: 900762 - RNA, 18 nt, Mycobacterium avium subsp. paratuberculosis
cccuucggccggcagcgg

SEQ ID NO: 900763 - RNA, 19 nt, Mycobacterium avium subsp. paratuberculosis
cccuugaacggcaccagcg

SEQ ID NO: 900764 - RNA, 21 nt, Mycobacterium avium subsp. paratuberculosis
cccuugagcacggugaucagc

SEQ ID NO: 900765 - RNA, 19 nt, Mycobacterium avium subsp. paratuberculosis
cccuugagcuucccggcgg

SEQ ID NO: 900766 - RNA, 13 nt, Mycobacterium avium subsp. paratuberculosis
cccuugccgccga

SEQ ID NO: 900767 - RNA, 20 nt, Mycobacterium avium subsp. paratuberculosis
cccuuggacucccccaccac

SEQ ID NO: 900768 - RNA, 20 nt, Mycobacterium avium subsp. paratuberculosis
cccuugcccggacgaugccg

SEQ ID NO: 900769 - RNA, 15 nt, Mycobacterium avium subsp. paratuberculosis
cccuugccgaugccg

SEQ ID NO: 900770 - RNA, 23 nt, Mycobacterium avium subsp. paratuberculosis
cccuuguccaggauccccgucca

SEQ ID NO: 900771 - RNA, 20 nt, Mycobacterium avium subsp. paratuberculosis
cccuugguguaggcgaucgg

SEQ ID NO: 900772 - RNA, 22 nt, Mycobacterium avium subsp. paratuberculosis
cccuuguaggucaucagcgacg

SEQ ID NO: 900773 - RNA, 15 nt, Mycobacterium avium subsp. paratuberculosis
cccuuggcggcggcc

SEQ ID NO: 900774 - RNA, 17 nt, Mycobacterium avium subsp. paratuberculosis
caucaacugcaccagcg

SEQ ID NO: 900775 - RNA, 15 nt, Mycobacterium avium subsp. paratuberculosis
cauagcuggcgccga

SEQ ID NO: 900776 - RNA, 17 nt, Mycobacterium avium subsp. paratuberculosis
cauagcuggcgccgaac

SEQ ID NO: 900777 - RNA, 16 nt, Mycobacterium avium subsp. paratuberculosis
cauagcucaggugcga

SEQ ID NO: 900778 - RNA, 12 nt, Mycobacterium avium subsp. paratuberculosis
cauaggaccgga

SEQ ID NO: 900779 - RNA, 23 nt, Mycobacterium avium subsp. paratuberculosis
cauaggccagcaccagcguguag

SEQ ID NO: 900780 - RNA, 18 nt, Mycobacterium avium subsp. paratuberculosis
cauagcccaucagcacgc

SEQ ID NO: 900781 - RNA, 23 nt, Mycobacterium avium subsp. paratuberculosis
cauagccggccgcgucgccgacc

SEQ ID NO: 900782 - RNA, 18 nt, Mycobacterium avium subsp. paratuberculosis
caucaccggcgcgccguc

SEQ ID NO: 900783 - RNA, 21 nt, Mycobacterium avium subsp. paratuberculosis
caucaccgggauggugaccag

SEQ ID NO: 900784 - RNA, 12 nt, Mycobacterium avium subsp. paratuberculosis
caucaccgggga

SEQ ID NO: 900785 - RNA, 18 nt, Mycobacterium avium subsp. paratuberculosis
caucaccuucugcgcgcc

SEQ ID NO: 900786 - RNA, 19 nt, Mycobacterium avium subsp. paratuberculosis
caucaccuucugcgcgccg

SEQ ID NO: 900787 - RNA, 21 nt, Mycobacterium avium subsp. paratuberculosis
caucaccuucugcgcgccguc

SEQ ID NO: 900788 - RNA, 23 nt, Mycobacterium avium subsp. paratuberculosis
caucaccuugucgcugaccaccg

SEQ ID NO: 900789 - RNA, 20 nt, Mycobacterium avium subsp. paratuberculosis
caucacgcagaacucgucgc

SEQ ID NO: 900790 - RNA, 23 nt, Mycobacterium avium subsp. paratuberculosis
caucacggugccgaguucgaccu

SEQ ID NO: 900791 - RNA, 16 nt, Mycobacterium avium subsp. paratuberculosis
caucacgguggccgcc

SEQ ID NO: 900792 - RNA, 17 nt, Mycobacterium avium subsp. paratuberculosis
caucacgguggccgcca

SEQ ID NO: 900793 - RNA, 22 nt, Mycobacterium avium subsp. paratuberculosis
caucagcaccacguugcgcccg

SEQ ID NO: 900794 - RNA, 22 nt, Mycobacterium avium subsp. paratuberculosis
caucagcaccgaaucgccgagc

SEQ ID NO: 900795 - RNA, 13 nt, Mycobacterium avium subsp. paratuberculosis
caucagcaccgcg

SEQ ID NO: 900796 - RNA, 20 nt, Mycobacterium avium subsp. paratuberculosis
caucagcaccuccggcagcg

SEQ ID NO: 900797 - RNA, 14 nt, Mycobacterium avium subsp. paratuberculosis
caucagcgcccgcg

SEQ ID NO: 900798 - RNA, 20 nt, Mycobacterium avium subsp. paratuberculosis
caucagcgcccgggugggcg

SEQ ID NO: 900799 - RNA, 15 nt, Mycobacterium avium subsp. paratuberculosis
caucagcggcucgcg

SEQ ID NO: 900800 - RNA, 19 nt, Mycobacterium avium subsp. paratuberculosis
caucagcggcucgcgggug

SEQ ID NO: 900801 - RNA, 12 nt, Mycobacterium avium subsp. paratuberculosis
caucagccgccg

SEQ ID NO: 900802 - RNA, 19 nt, Mycobacterium avium subsp. paratuberculosis
caucagcgacgucaggucg

SEQ ID NO: 900803 - RNA, 17 nt, Mycobacterium avium subsp. paratuberculosis
caucagcgagacgacca

SEQ ID NO: 900804 - RNA, 13 nt, Mycobacterium avium subsp. paratuberculosis
caucagcgccacc

SEQ ID NO: 900805 - RNA, 13 nt, Mycobacterium avium subsp. paratuberculosis
cauccgcuggugc

SEQ ID NO: 900806 - RNA, 22 nt, Mycobacterium avium subsp. paratuberculosis
cauccgcuggugcgcgccggcg

SEQ ID NO: 900807 - RNA, 23 nt, Mycobacterium avium subsp. paratuberculosis
cauccgcuggugcgcgccggcgu

SEQ ID NO: 900808 - RNA, 22 nt, Mycobacterium avium subsp. paratuberculosis
cauccggaaccgggcacccggc

SEQ ID NO: 900809 - RNA, 13 nt, Mycobacterium avium subsp. paratuberculosis
cauccccgcggcc

SEQ ID NO: 900810 - RNA, 20 nt, Mycobacterium avium subsp. paratuberculosis
cauccccgcggccaccccgg

SEQ ID NO: 900811 - RNA, 17 nt, Mycobacterium avium subsp. paratuberculosis
cauccggcgcacggcgc

SEQ ID NO: 900812 - RNA, 18 nt, Mycobacterium avium subsp. paratuberculosis
cauccggcgcacggcgcc

SEQ ID NO: 900813 - RNA, 21 nt, Mycobacterium avium subsp. paratuberculosis
cauccggcgcacggcgcccag

SEQ ID NO: 900814 - RNA, 15 nt, Mycobacterium avium subsp. paratuberculosis
cauccggccggcgag

SEQ ID NO: 900815 - RNA, 18 nt, Mycobacterium avium subsp. paratuberculosis
cauccucauagccggccg

SEQ ID NO: 900816 - RNA, 16 nt, Mycobacterium avium subsp. paratuberculosis
cauccggcgccgcgca

SEQ ID NO: 900817 - RNA, 18 nt, Mycobacterium avium subsp. paratuberculosis
caucgaaugcagcggcuc

SEQ ID NO: 900818 - RNA, 19 nt, Mycobacterium avium subsp. paratuberculosis
cauccugguccggcgcccg

SEQ ID NO: 900819 - RNA, 21 nt, Mycobacterium avium subsp. paratuberculosis
cauccugguccggcgcccgau

SEQ ID NO: 900820 - RNA, 23 nt, Mycobacterium avium subsp. paratuberculosis
cauccugguccggcgcccgaucg

SEQ ID NO: 900821 - RNA, 14 nt, Mycobacterium avium subsp. paratuberculosis
cauccugggcgucg

SEQ ID NO: 900822 - RNA, 24 nt, Mycobacterium avium subsp. paratuberculosis
cauccugaagaagcggccguagcg

SEQ ID NO: 900823 - RNA, 17 nt, Mycobacterium avium subsp. paratuberculosis
cauccugcgcaucgagc

SEQ ID NO: 900824 - RNA, 16 nt, Mycobacterium avium subsp. paratuberculosis
cauccugcuggccggg

SEQ ID NO: 900825 - RNA, 15 nt, Mycobacterium avium subsp. paratuberculosis
caucccccucggcgg

SEQ ID NO: 900826 - RNA, 17 nt, Mycobacterium avium subsp. paratuberculosis
caucccccucggcggga

SEQ ID NO: 900827 - RNA, 21 nt, Mycobacterium avium subsp. paratuberculosis
cauccccgcaaacacgagcag

SEQ ID NO: 900828 - RNA, 15 nt, Mycobacterium avium subsp. paratuberculosis
cauccagucggcgcc

SEQ ID NO: 900829 - RNA, 16 nt, Mycobacterium avium subsp. paratuberculosis
cauccagucggcgccg

SEQ ID NO: 900830 - RNA, 15 nt, Mycobacterium avium subsp. paratuberculosis
cauccagguggcgcc

SEQ ID NO: 900831 - RNA, 22 nt, Mycobacterium avium subsp. paratuberculosis
cauccagguggcgccuccgccc

SEQ ID NO: 900832 - RNA, 14 nt, Mycobacterium avium subsp. paratuberculosis
cauccaggaccgcg

SEQ ID NO: 900833 - RNA, 15 nt, Mycobacterium avium subsp. paratuberculosis
cauccaggaccgcgc

SEQ ID NO: 900834 - RNA, 19 nt, Mycobacterium avium subsp. paratuberculosis
cauccaggaccgcgcgccg

SEQ ID NO: 900835 - RNA, 22 nt, Mycobacterium avium subsp. paratuberculosis
cauccaggaccgcgcgccggcc

SEQ ID NO: 900836 - RNA, 12 nt, Mycobacterium avium subsp. paratuberculosis
cauccagcgccg

SEQ ID NO: 900837 - RNA, 14 nt, Mycobacterium avium subsp. paratuberculosis
caucaggcggccgg

SEQ ID NO: 900838 - RNA, 18 nt, Mycobacterium avium subsp. paratuberculosis
caucaggcggccggcccg

SEQ ID NO: 900839 - RNA, 21 nt, Mycobacterium avium subsp. paratuberculosis
caucaggcggccggcccggcc

SEQ ID NO: 900840 - RNA, 20 nt, Mycobacterium avium subsp. paratuberculosis
cauccacucgggccagccca

SEQ ID NO: 900841 - RNA, 16 nt, Mycobacterium avium subsp. paratuberculosis
cauccacucggccacc

SEQ ID NO: 900842 - RNA, 17 nt, Mycobacterium avium subsp. paratuberculosis
cauccacucggccacca

SEQ ID NO: 900843 - RNA, 19 nt, Mycobacterium avium subsp. paratuberculosis
caucagcggagugaccgcc

SEQ ID NO: 900844 - RNA, 14 nt, Mycobacterium avium subsp. paratuberculosis
caucagcggggcgu

SEQ ID NO: 900845 - RNA, 15 nt, Mycobacterium avium subsp. paratuberculosis
caucagcucggcggc

SEQ ID NO: 900846 - RNA, 17 nt, Mycobacterium avium subsp. paratuberculosis
caucagcucggcggccu

SEQ ID NO: 900847 - RNA, 15 nt, Mycobacterium avium subsp. paratuberculosis
caucagcucgucagc

SEQ ID NO: 900848 - RNA, 23 nt, Mycobacterium avium subsp. paratuberculosis
caucaggcccuugccccaccacc

SEQ ID NO: 900849 - RNA, 22 nt, Mycobacterium avium subsp. paratuberculosis
caucgcuacaccccaccggaag

SEQ ID NO: 900850 - RNA, 19 nt, Mycobacterium avium subsp. paratuberculosis
caucgcgucggugucgccg

SEQ ID NO: 900851 - RNA, 17 nt, Mycobacterium avium subsp. paratuberculosis
caucgcugacuccaucc

SEQ ID NO: 900852 - RNA, 23 nt, Mycobacterium avium subsp. paratuberculosis
caucgcuggggugcccaccagca

SEQ ID NO: 900853 - RNA, 19 nt, Mycobacterium avium subsp. paratuberculosis
caucgcugguggccgacgu

SEQ ID NO: 900854 - RNA, 22 nt, Mycobacterium avium subsp. paratuberculosis
caucgcugguggccgacgugcc

SEQ ID NO: 900855 - RNA, 16 nt, Mycobacterium avium subsp. paratuberculosis
caucggaugccggggc

SEQ ID NO: 900856 - RNA, 17 nt, Mycobacterium avium subsp. paratuberculosis
caucggauucgucgguc

SEQ ID NO: 900857 - RNA, 16 nt, Mycobacterium avium subsp. paratuberculosis
caucgcuuuccgguca

SEQ ID NO: 900858 - RNA, 17 nt, Mycobacterium avium subsp. paratuberculosis
caucgcuuuccggucag

SEQ ID NO: 900859 - RNA, 19 nt, Mycobacterium avium subsp. paratuberculosis
caucggagagcuugccgcg

SEQ ID NO: 900860 - RNA, 22 nt, Mycobacterium avium subsp. paratuberculosis
caucggagagcuugccgcggau

SEQ ID NO: 900861 - RNA, 22 nt, Mycobacterium avium subsp. paratuberculosis
caucggcagacccagcagcggc

SEQ ID NO: 900862 - RNA, 21 nt, Mycobacterium avium subsp. paratuberculosis
caucggcacguguccgacgcc

SEQ ID NO: 900863 - RNA, 13 nt, Mycobacterium avium subsp. paratuberculosis
caucggcagcccg

SEQ ID NO: 900864 - RNA, 14 nt, Mycobacterium avium subsp. paratuberculosis
caucggccgccuug

SEQ ID NO: 900865 - RNA, 12 nt, Mycobacterium avium subsp. paratuberculosis
caucgccggcga

SEQ ID NO: 900866 - RNA, 16 nt, Mycobacterium avium subsp. paratuberculosis
caucgccggcgcgcug

SEQ ID NO: 900867 - RNA, 14 nt, Mycobacterium avium subsp. paratuberculosis
caucgccucggcgg

SEQ ID NO: 900868 - RNA, 15 nt, Mycobacterium avium subsp. paratuberculosis
caucgccucggcggc

SEQ ID NO: 900869 - RNA, 14 nt, Mycobacterium avium subsp. paratuberculosis
caucgccucggcgu

SEQ ID NO: 900870 - RNA, 16 nt, Mycobacterium avium subsp. paratuberculosis
caucgccucggcgucc

SEQ ID NO: 900871 - RNA, 16 nt, Mycobacterium avium subsp. paratuberculosis
caucgccucggucgcg

SEQ ID NO: 900872 - RNA, 19 nt, Mycobacterium avium subsp. paratuberculosis
caucgccucggucgcguga

SEQ ID NO: 900873 - RNA, 17 nt, Mycobacterium avium subsp. paratuberculosis
caucgccugagcaaccg

SEQ ID NO: 900874 - RNA, 21 nt, Mycobacterium avium subsp. paratuberculosis
caucgccugagcaaccgguuc

SEQ ID NO: 900875 - RNA, 14 nt, Mycobacterium avium subsp. paratuberculosis
caucgccucggcca

SEQ ID NO: 900876 - RNA, 15 nt, Mycobacterium avium subsp. paratuberculosis
caucgccucggccgc

SEQ ID NO: 900877 - RNA, 13 nt, Mycobacterium avium subsp. paratuberculosis
caucgccucggcg

SEQ ID NO: 900878 - RNA, 18 nt, Mycobacterium avium subsp. paratuberculosis
caucgccucgaccagcac

SEQ ID NO: 900879 - RNA, 22 nt, Mycobacterium avium subsp. paratuberculosis
caucgccucgaccagcaccgca

SEQ ID NO: 900880 - RNA, 14 nt, Mycobacterium avium subsp. paratuberculosis
caucgcgccgcaug

SEQ ID NO: 900881 - RNA, 17 nt, Mycobacterium avium subsp. paratuberculosis
caucgcgcgcggcggcc

SEQ ID NO: 900882 - RNA, 21 nt, Mycobacterium avium subsp. paratuberculosis
caucgcgcgcggcggccaccg

SEQ ID NO: 900883 - RNA, 15 nt, Mycobacterium avium subsp. paratuberculosis
caucgcgggccaccg

SEQ ID NO: 900884 - RNA, 16 nt, Mycobacterium avium subsp. paratuberculosis
caucgcgggccaccgg

SEQ ID NO: 900885 - RNA, 18 nt, Mycobacterium avium subsp. paratuberculosis
caucgcgggccaccggcg

SEQ ID NO: 900886 - RNA, 20 nt, Mycobacterium avium subsp. paratuberculosis
caucgcgggccaccggcgcc

SEQ ID NO: 900887 - RNA, 21 nt, Mycobacterium avium subsp. paratuberculosis
caucgcgggccaccggcgcca

SEQ ID NO: 900888 - RNA, 12 nt, Mycobacterium avium subsp. paratuberculosis
caucgcggccgc

SEQ ID NO: 900889 - RNA, 15 nt, Mycobacterium avium subsp. paratuberculosis
caucgcggccgcccg

SEQ ID NO: 900890 - RNA, 14 nt, Mycobacterium avium subsp. paratuberculosis
caucgcggccgccg

SEQ ID NO: 900891 - RNA, 19 nt, Mycobacterium avium subsp. paratuberculosis
caucgccgccaucgccgcc

SEQ ID NO: 900892 - RNA, 20 nt, Mycobacterium avium subsp. paratuberculosis
caucgccgccaucgccgccg

SEQ ID NO: 900893 - RNA, 15 nt, Mycobacterium avium subsp. paratuberculosis
caucgccgacgguga

SEQ ID NO: 900894 - RNA, 21 nt, Mycobacterium avium subsp. paratuberculosis
caucgccgacggugagcaccg

SEQ ID NO: 900895 - RNA, 23 nt, Mycobacterium avium subsp. paratuberculosis
caucgccgacggugagcaccgcc

SEQ ID NO: 900896 - RNA, 17 nt, Mycobacterium avium subsp. paratuberculosis
caucgccgagacgaucc

SEQ ID NO: 900897 - RNA, 21 nt, Mycobacterium avium subsp. paratuberculosis
caucgccgagggcgacgaugc

SEQ ID NO: 900898 - RNA, 14 nt, Mycobacterium avium subsp. paratuberculosis
caucgccgaaccgg

SEQ ID NO: 900899 - RNA, 20 nt, Mycobacterium avium subsp. paratuberculosis
caucgccgaaccgucccaca

SEQ ID NO: 900900 - RNA, 15 nt, Mycobacterium avium subsp. paratuberculosis
caucgccggcgaugc

SEQ ID NO: 900901 - RNA, 13 nt, Mycobacterium avium subsp. paratuberculosis
caucgccggcgcg

SEQ ID NO: 900902 - RNA, 14 nt, Mycobacterium avium subsp. paratuberculosis
caucgccggcgcgc

SEQ ID NO: 900903 - RNA, 14 nt, Mycobacterium avium subsp. paratuberculosis
caucgccgucaugg

SEQ ID NO: 900904 - RNA, 17 nt, Mycobacterium avium subsp. paratuberculosis
caucgccguccacgggu

SEQ ID NO: 900905 - RNA, 17 nt, Mycobacterium avium subsp. paratuberculosis
caucgccgucgccaccg

SEQ ID NO: 900906 - RNA, 18 nt, Mycobacterium avium subsp. paratuberculosis
caucgccgucgccaccga

SEQ ID NO: 900907 - RNA, 19 nt, Mycobacterium avium subsp. paratuberculosis
caucgccgucgccaccgag

SEQ ID NO: 900908 - RNA, 21 nt, Mycobacterium avium subsp. paratuberculosis
caucgccgucgccaccgaguc

SEQ ID NO: 900909 - RNA, 13 nt, Mycobacterium avium subsp. paratuberculosis
caucgccgucguc

SEQ ID NO: 900910 - RNA, 12 nt, Mycobacterium avium subsp. paratuberculosis
caucgccgcggu

SEQ ID NO: 900911 - RNA, 15 nt, Mycobacterium avium subsp. paratuberculosis
caucgccgcgguggc

SEQ ID NO: 900912 - RNA, 18 nt, Mycobacterium avium subsp. paratuberculosis
caucgccgcgguggcgcc

SEQ ID NO: 900913 - RNA, 13 nt, Mycobacterium avium subsp. paratuberculosis
caucgccgcgacc

SEQ ID NO: 900914 - RNA, 16 nt, Mycobacterium avium subsp. paratuberculosis
caucgccgcgacccgg

SEQ ID NO: 900915 - RNA, 18 nt, Mycobacterium avium subsp. paratuberculosis
caucgccgcgcacccggc

SEQ ID NO: 900916 - RNA, 14 nt, Mycobacterium avium subsp. paratuberculosis
caucgccgcggccg

SEQ ID NO: 900917 - RNA, 15 nt, Mycobacterium avium subsp. paratuberculosis
caucgccgcggccgg

SEQ ID NO: 900918 - RNA, 16 nt, Mycobacterium avium subsp. paratuberculosis
caucgccgcggccgga

SEQ ID NO: 900919 - RNA, 12 nt, Mycobacterium avium subsp. paratuberculosis
caucgccccgga

SEQ ID NO: 900920 - RNA, 12 nt, Mycobacterium avium subsp. paratuberculosis
caucgccccggc

SEQ ID NO: 900921 - RNA, 14 nt, Mycobacterium avium subsp. paratuberculosis
caucgccccggcga

SEQ ID NO: 900922 - RNA, 17 nt, Mycobacterium avium subsp. paratuberculosis
caucgccccggcgacgu

SEQ ID NO: 900923 - RNA, 14 nt, Mycobacterium avium subsp. paratuberculosis
caucgcccggugcg

SEQ ID NO: 900924 - RNA, 23 nt, Mycobacterium avium subsp. paratuberculosis
caucgcccggugcgccagcguga

SEQ ID NO: 900925 - RNA, 14 nt, Mycobacterium avium subsp. paratuberculosis
caucgcccagcgca

SEQ ID NO: 900926 - RNA, 15 nt, Mycobacterium avium subsp. paratuberculosis
caucgcccagcgcag

SEQ ID NO: 900927 - RNA, 13 nt, Mycobacterium avium subsp. paratuberculosis
caucgccacgccg

SEQ ID NO: 900928 - RNA, 14 nt, Mycobacterium avium subsp. paratuberculosis
caucgccacgccgu

SEQ ID NO: 900929 - RNA, 14 nt, Mycobacterium avium subsp. paratuberculosis
caucgccaccgucg

SEQ ID NO: 900930 - RNA, 21 nt, Mycobacterium avium subsp. paratuberculosis
caucgccagcaacgacccggc

SEQ ID NO: 900931 - RNA, 22 nt, Mycobacterium avium subsp. paratuberculosis
caucgccagcaacgacccggcc

SEQ ID NO: 900932 - RNA, 23 nt, Mycobacterium avium subsp. paratuberculosis
caucgccaggaaccacaccccgg

SEQ ID NO: 900933 - RNA, 16 nt, Mycobacterium avium subsp. paratuberculosis
caucgccacccgcacc

SEQ ID NO: 900934 - RNA, 13 nt, Mycobacterium avium subsp. paratuberculosis
caucgccaccugg

SEQ ID NO: 900935 - RNA, 19 nt, Mycobacterium avium subsp. paratuberculosis
caucgccaccuggaagcgc

SEQ ID NO: 900936 - RNA, 16 nt, Mycobacterium avium subsp. paratuberculosis
caucgacuugccgccg

SEQ ID NO: 900937 - RNA, 21 nt, Mycobacterium avium subsp. paratuberculosis
caucgagaugccgggaagcga

SEQ ID NO: 900938 - RNA, 16 nt, Mycobacterium avium subsp. paratuberculosis
caucgacugcgacacc

SEQ ID NO: 900939 - RNA, 16 nt, Mycobacterium avium subsp. paratuberculosis
caucgagcccaccgcg

SEQ ID NO: 900940 - RNA, 21 nt, Mycobacterium avium subsp. paratuberculosis
caucgagcccaccgcgcccag

SEQ ID NO: 900941 - RNA, 16 nt, Mycobacterium avium subsp. paratuberculosis
caucgagccgagcacc

SEQ ID NO: 900942 - RNA, 17 nt, Mycobacterium avium subsp. paratuberculosis
caucgagccgagcaccg

SEQ ID NO: 900943 - RNA, 19 nt, Mycobacterium avium subsp. paratuberculosis
caucgagccgagcaccggc

SEQ ID NO: 900944 - RNA, 20 nt, Mycobacterium avium subsp. paratuberculosis
caucgagccgagcaccggca

SEQ ID NO: 900945 - RNA, 21 nt, Mycobacterium avium subsp. paratuberculosis
caucgagccgagcaccggcag

SEQ ID NO: 900946 - RNA, 21 nt, Mycobacterium avium subsp. paratuberculosis
caucgacgacgggugggugga

SEQ ID NO: 900947 - RNA, 18 nt, Mycobacterium avium subsp. paratuberculosis
caucgacgcgaccggccc

SEQ ID NO: 900948 - RNA, 19 nt, Mycobacterium avium subsp. paratuberculosis
caucgacgugccguugacg

SEQ ID NO: 900949 - RNA, 16 nt, Mycobacterium avium subsp. paratuberculosis
caucgacaugcccggc

SEQ ID NO: 900950 - RNA, 12 nt, Mycobacterium avium subsp. paratuberculosis
caucgaccgccc

SEQ ID NO: 900951 - RNA, 14 nt, Mycobacterium avium subsp. paratuberculosis
caucgaccggcgga

SEQ ID NO: 900952 - RNA, 22 nt, Mycobacterium avium subsp. paratuberculosis
caucgauggcgggcgcgccggc

SEQ ID NO: 900953 - RNA, 22 nt, Mycobacterium avium subsp. paratuberculosis
caucgaucggguggcccaaucg

SEQ ID NO: 900954 - RNA, 14 nt, Mycobacterium avium subsp. paratuberculosis
caucgcaccgcgag

SEQ ID NO: 900955 - RNA, 16 nt, Mycobacterium avium subsp. paratuberculosis
caucgcaccgcgagca

SEQ ID NO: 900956 - RNA, 21 nt, Mycobacterium avium subsp. paratuberculosis
caucgagcugcaacgcgucgg

SEQ ID NO: 900957 - RNA, 17 nt, Mycobacterium avium subsp. paratuberculosis
caucgaggaccggcgcc

SEQ ID NO: 900958 - RNA, 19 nt, Mycobacterium avium subsp. paratuberculosis
caucgaggaccggcgccgg

SEQ ID NO: 900959 - RNA, 15 nt, Mycobacterium avium subsp. paratuberculosis
caucgagggcguccu

SEQ ID NO: 900960 - RNA, 16 nt, Mycobacterium avium subsp. paratuberculosis
caucgaggcgaucauc

SEQ ID NO: 900961 - RNA, 17 nt, Mycobacterium avium subsp. paratuberculosis
cagguugcgcagcagcc

SEQ ID NO: 900962 - RNA, 20 nt, Mycobacterium avium subsp. paratuberculosis
cagguugcgccguccggcca

SEQ ID NO: 900963 - RNA, 22 nt, Mycobacterium avium subsp. paratuberculosis
cagguugcgccguccggccacg

SEQ ID NO: 900964 - RNA, 19 nt, Mycobacterium avium subsp. paratuberculosis
cagguugcggaucaugcgc

SEQ ID NO: 900965 - RNA, 14 nt, Mycobacterium avium subsp. paratuberculosis
cagguucuuggcgg

SEQ ID NO: 900966 - RNA, 18 nt, Mycobacterium avium subsp. paratuberculosis
cagguucuuggcggccug

SEQ ID NO: 900967 - RNA, 20 nt, Mycobacterium avium subsp. paratuberculosis
cagguugaaaaacgcggugu

SEQ ID NO: 900968 - RNA, 13 nt, Mycobacterium avium subsp. paratuberculosis
cagguugacgccg

SEQ ID NO: 900969 - RNA, 15 nt, Mycobacterium avium subsp. paratuberculosis
cagguugacgccgau

SEQ ID NO: 900970 - RNA, 17 nt, Mycobacterium avium subsp. paratuberculosis
cagguugaccaccagcg

SEQ ID NO: 900971 - RNA, 16 nt, Mycobacterium avium subsp. paratuberculosis
cagguugauccgcgcg

SEQ ID NO: 900972 - RNA, 14 nt, Mycobacterium avium subsp. paratuberculosis
cagucgcuggucga

SEQ ID NO: 900973 - RNA, 20 nt, Mycobacterium avium subsp. paratuberculosis
cagucgcuggucgaaccgcg

SEQ ID NO: 900974 - RNA, 21 nt, Mycobacterium avium subsp. paratuberculosis
cagucgcuggucgaaccgcga

SEQ ID NO: 900975 - RNA, 21 nt, Mycobacterium avium subsp. paratuberculosis
cagucgaucagcgacggcccg

SEQ ID NO: 900976 - RNA, 21 nt, Mycobacterium avium subsp. paratuberculosis
cagucggccaucagcaccgaa

SEQ ID NO: 900977 - RNA, 21 nt, Mycobacterium avium subsp. paratuberculosis
cagucggccgugaaccggcgu

SEQ ID NO: 900978 - RNA, 17 nt, Mycobacterium avium subsp. paratuberculosis
cagucggcgccgaugca

SEQ ID NO: 900979 - RNA, 18 nt, Mycobacterium avium subsp. paratuberculosis
cagucgaccucgcgcguc

SEQ ID NO: 900980 - RNA, 19 nt, Mycobacterium avium subsp. paratuberculosis
cagucgaccucgcgcguca

SEQ ID NO: 900981 - RNA, 16 nt, Mycobacterium avium subsp. paratuberculosis
cagucgaagaccacga

SEQ ID NO: 900982 - RNA, 22 nt, Mycobacterium avium subsp. paratuberculosis
cagucgaagaugucgcggcgca

SEQ ID NO: 900983 - RNA, 15 nt, Mycobacterium avium subsp. paratuberculosis
cagucgaaguucggc

SEQ ID NO: 900984 - RNA, 22 nt, Mycobacterium avium subsp. paratuberculosis
cagucgaaguucggcaucucgg

SEQ ID NO: 900985 - RNA, 18 nt, Mycobacterium avium subsp. paratuberculosis
caguccugcagcucgccg

SEQ ID NO: 900986 - RNA, 22 nt, Mycobacterium avium subsp. paratuberculosis
caguccugcagcucgccggcgc

SEQ ID NO: 900987 - RNA, 17 nt, Mycobacterium avium subsp. paratuberculosis
caguccugggccagauc

SEQ ID NO: 900988 - RNA, 18 nt, Mycobacterium avium subsp. paratuberculosis
caguccugggccagaucg

SEQ ID NO: 900989 - RNA, 21 nt, Mycobacterium avium subsp. paratuberculosis
caguccugggccagaucgacc

SEQ ID NO: 900990 - RNA, 21 nt, Mycobacterium avium subsp. paratuberculosis
cagucguacucccaggccgcg

SEQ ID NO: 900991 - RNA, 22 nt, Mycobacterium avium subsp. paratuberculosis
cagucguacucccaggccgcgg

SEQ ID NO: 900992 - RNA, 14 nt, Mycobacterium avium subsp. paratuberculosis
cagucggcgucgcg

SEQ ID NO: 900993 - RNA, 16 nt, Mycobacterium avium subsp. paratuberculosis
cagucggcgucgcggc

SEQ ID NO: 900994 - RNA, 14 nt, Mycobacterium avium subsp. paratuberculosis
cagucggcgucuuc

SEQ ID NO: 900995 - RNA, 19 nt, Mycobacterium avium subsp. paratuberculosis
cagucggucaacgugucga

SEQ ID NO: 900996 - RNA, 21 nt, Mycobacterium avium subsp. paratuberculosis
cagucggucaacgugucgagc

SEQ ID NO: 900997 - RNA, 18 nt, Mycobacterium avium subsp. paratuberculosis
cagucguucggccagcac

SEQ ID NO: 900998 - RNA, 21 nt, Mycobacterium avium subsp. paratuberculosis
cagucguugccgcccgggaag

SEQ ID NO: 900999 - RNA, 23 nt, Mycobacterium avium subsp. paratuberculosis
cagucugagcccgggcaggcggc

SEQ ID NO: 901000 - RNA, 15 nt, Mycobacterium avium subsp. paratuberculosis
cagucugccgguggc

SEQ ID NO: 901001 - RNA, 15 nt, Mycobacterium avium subsp. paratuberculosis
cagggcucgugcagc

SEQ ID NO: 901002 - RNA, 19 nt, Mycobacterium avium subsp. paratuberculosis
cagggcucgugcagccggc

SEQ ID NO: 901003 - RNA, 22 nt, Mycobacterium avium subsp. paratuberculosis
caggucgauggcguagcggguc

SEQ ID NO: 901004 - RNA, 22 nt, Mycobacterium avium subsp. paratuberculosis
caggucgcacaccagcacggcg

SEQ ID NO: 901005 - RNA, 20 nt, Mycobacterium avium subsp. paratuberculosis
caggucgccgcgcagcaccg

SEQ ID NO: 901006 - RNA, 23 nt, Mycobacterium avium subsp. paratuberculosis
caggucgccgcgcagcaccgcgu

SEQ ID NO: 901007 - RNA, 16 nt, Mycobacterium avium subsp. paratuberculosis
caggucgcccggcucg

SEQ ID NO: 901008 - RNA, 13 nt, Mycobacterium avium subsp. paratuberculosis
caggucgccggcg

SEQ ID NO: 901009 - RNA, 14 nt, Mycobacterium avium subsp. paratuberculosis
caggucgccggcgg

SEQ ID NO: 901010 - RNA, 15 nt, Mycobacterium avium subsp. paratuberculosis
caggucgccggcggc

SEQ ID NO: 901011 - RNA, 18 nt, Mycobacterium avium subsp. paratuberculosis
caggucgccggcggccga

SEQ ID NO: 901012 - RNA, 20 nt, Mycobacterium avium subsp. paratuberculosis
caggucgccggcggccgaca

SEQ ID NO: 901013 - RNA, 15 nt, Mycobacterium avium subsp. paratuberculosis
caggucgcgccggag

SEQ ID NO: 901014 - RNA, 16 nt, Mycobacterium avium subsp. paratuberculosis
caggucgcgccggagc

SEQ ID NO: 901015 - RNA, 16 nt, Mycobacterium avium subsp. paratuberculosis
caggucgcggcgcugc

SEQ ID NO: 901016 - RNA, 17 nt, Mycobacterium avium subsp. paratuberculosis
caggucgcggcgcugcg

SEQ ID NO: 901017 - RNA, 19 nt, Mycobacterium avium subsp. paratuberculosis
caggucgcggcgcugcgcc

SEQ ID NO: 901018 - RNA, 16 nt, Mycobacterium avium subsp. paratuberculosis
caggucgcgguagcgc

SEQ ID NO: 901019 - RNA, 19 nt, Mycobacterium avium subsp. paratuberculosis
caggucgcgguagcgcucg

SEQ ID NO: 901020 - RNA, 23 nt, Mycobacterium avium subsp. paratuberculosis
caggucgcgguagcgcucgucgu

SEQ ID NO: 901021 - RNA, 15 nt, Mycobacterium avium subsp. paratuberculosis
caggucgcggugggc

SEQ ID NO: 901022 - RNA, 14 nt, Mycobacterium avium subsp. paratuberculosis
caggugaacagcag

SEQ ID NO: 901023 - RNA, 16 nt, Mycobacterium avium subsp. paratuberculosis
caggugaacagcagcc

SEQ ID NO: 901024 - RNA, 17 nt, Mycobacterium avium subsp. paratuberculosis
caggugaacagcagcca

SEQ ID NO: 901025 - RNA, 20 nt, Mycobacterium avium subsp. paratuberculosis
caggugaacagcagccacga

SEQ ID NO: 901026 - RNA, 16 nt, Mycobacterium avium subsp. paratuberculosis
caggucuucggucgcg

SEQ ID NO: 901027 - RNA, 17 nt, Mycobacterium avium subsp. paratuberculosis
caggucuucggucgcga

SEQ ID NO: 901028 - RNA, 18 nt, Mycobacterium avium subsp. paratuberculosis
caggucuucggucgcgac

SEQ ID NO: 901029 - RNA, 13 nt, Mycobacterium avium subsp. paratuberculosis
caggucggcggga

SEQ ID NO: 901030 - RNA, 14 nt, Mycobacterium avium subsp. paratuberculosis
caggucggcgaugg

SEQ ID NO: 901031 - RNA, 16 nt, Mycobacterium avium subsp. paratuberculosis
caggucggcggucgcg

SEQ ID NO: 901032 - RNA, 17 nt, Mycobacterium avium subsp. paratuberculosis
caggucggcggucgcgg

SEQ ID NO: 901033 - RNA, 17 nt, Mycobacterium avium subsp. paratuberculosis
caggucuccguugucga

SEQ ID NO: 901034 - RNA, 19 nt, Mycobacterium avium subsp. paratuberculosis
caggucuccguugucgagg

SEQ ID NO: 901035 - RNA, 11 nt, Mycobacterium avium subsp. paratuberculosis
caggucggccu

SEQ ID NO: 901036 - RNA, 12 nt, Mycobacterium avium subsp. paratuberculosis
caggucggcgau

SEQ ID NO: 901037 - RNA, 14 nt, Mycobacterium avium subsp. paratuberculosis
caggucggccagcu

SEQ ID NO: 901038 - RNA, 15 nt, Mycobacterium avium subsp. paratuberculosis
caggucggccagcgc

SEQ ID NO: 901039 - RNA, 20 nt, Mycobacterium avium subsp. paratuberculosis
caggucggccagcgccgccc

SEQ ID NO: 901040 - RNA, 21 nt, Mycobacterium avium subsp. paratuberculosis
caggucggccagcgccgcccg

SEQ ID NO: 901041 - RNA, 17 nt, Mycobacterium avium subsp. paratuberculosis
caggucgcugcccggcg

SEQ ID NO: 901042 - RNA, 18 nt, Mycobacterium avium subsp. paratuberculosis
caggucgcugcccggcgu

SEQ ID NO: 901043 - RNA, 19 nt, Mycobacterium avium subsp. paratuberculosis
caggucgcugcccggcgug

SEQ ID NO: 901044 - RNA, 21 nt, Mycobacterium avium subsp. paratuberculosis
caggucgcugcgcucgccguc

SEQ ID NO: 901045 - RNA, 22 nt, Mycobacterium avium subsp. paratuberculosis
caggucgcugcgcucgccgucg

SEQ ID NO: 901046 - RNA, 22 nt, Mycobacterium avium subsp. paratuberculosis
cagguguaggcguggcaggcca

SEQ ID NO: 901047 - RNA, 21 nt, Mycobacterium avium subsp. paratuberculosis
cagguggacagaugccagacg

SEQ ID NO: 901048 - RNA, 15 nt, Mycobacterium avium subsp. paratuberculosis
caggugugcggcacg

SEQ ID NO: 901049 - RNA, 23 nt, Mycobacterium avium subsp. paratuberculosis
cagguucuccggcccgcucggcg

SEQ ID NO: 901050 - RNA, 14 nt, Mycobacterium avium subsp. paratuberculosis
cagguucgacagcg

SEQ ID NO: 901051 - RNA, 13 nt, Mycobacterium avium subsp. paratuberculosis
cagguucgccgcc

SEQ ID NO: 901052 - RNA, 14 nt, Mycobacterium avium subsp. paratuberculosis
cagguucgccgccc

SEQ ID NO: 901053 - RNA, 16 nt, Mycobacterium avium subsp. paratuberculosis
cagguuccggugucga

SEQ ID NO: 901054 - RNA, 14 nt, Mycobacterium avium subsp. paratuberculosis
cagguucaccagca

SEQ ID NO: 901055 - RNA, 14 nt, Mycobacterium avium subsp. paratuberculosis
cagguucagcccgg

SEQ ID NO: 901056 - RNA, 16 nt, Mycobacterium avium subsp. paratuberculosis
cagguucagcccggcg

SEQ ID NO: 901057 - RNA, 18 nt, Mycobacterium avium subsp. paratuberculosis
cagguucaggcccgcgcc

SEQ ID NO: 901058 - RNA, 20 nt, Mycobacterium avium subsp. paratuberculosis
cagguucaggcccgcgccga

SEQ ID NO: 901059 - RNA, 17 nt, Mycobacterium avium subsp. paratuberculosis
cagguucaucaccacga

SEQ ID NO: 901060 - RNA, 20 nt, Mycobacterium avium subsp. paratuberculosis
cagguucauccccgcggcca

SEQ ID NO: 901061 - RNA, 13 nt, Mycobacterium avium subsp. paratuberculosis
caggugaccggcc

SEQ ID NO: 901062 - RNA, 20 nt, Mycobacterium avium subsp. paratuberculosis
caggugaucaaagccggugg

SEQ ID NO: 901063 - RNA, 14 nt, Mycobacterium avium subsp. paratuberculosis
caggugcgcgguca

SEQ ID NO: 901064 - RNA, 17 nt, Mycobacterium avium subsp. paratuberculosis
caggugcgcggucagcg

SEQ ID NO: 901065 - RNA, 18 nt, Mycobacterium avium subsp. paratuberculosis
caggugcgcggucagcgc

SEQ ID NO: 901066 - RNA, 23 nt, Mycobacterium avium subsp. paratuberculosis
caggugcacccgaugcucgaugc

SEQ ID NO: 901067 - RNA, 17 nt, Mycobacterium avium subsp. paratuberculosis
caggugcgccgccgcgu

SEQ ID NO: 901068 - RNA, 20 nt, Mycobacterium avium subsp. paratuberculosis
caggugcgccgccgcgucgc

SEQ ID NO: 901069 - RNA, 20 nt, Mycobacterium avium subsp. paratuberculosis
caggugcgccgcucgucggc

SEQ ID NO: 901070 - RNA, 18 nt, Mycobacterium avium subsp. paratuberculosis
caggugcucgccggcgcg

SEQ ID NO: 901071 - RNA, 19 nt, Mycobacterium avium subsp. paratuberculosis
caggugcucgccggcgcgg

SEQ ID NO: 901072 - RNA, 20 nt, Mycobacterium avium subsp. paratuberculosis
caggugcucgccggcgcgga

SEQ ID NO: 901073 - RNA, 17 nt, Mycobacterium avium subsp. paratuberculosis
caggugcggcaacccga

SEQ ID NO: 901074 - RNA, 23 nt, Mycobacterium avium subsp. paratuberculosis
caggugcggcaacccgaucgccg

SEQ ID NO: 901075 - RNA, 20 nt, Mycobacterium avium subsp. paratuberculosis
caggugacggauguggucgg

SEQ ID NO: 901076 - RNA, 17 nt, Mycobacterium avium subsp. paratuberculosis
caggugcuuggucagcg

SEQ ID NO: 901077 - RNA, 21 nt, Mycobacterium avium subsp. paratuberculosis
cauacaccgggaucggcggcg

SEQ ID NO: 901078 - RNA, 14 nt, Mycobacterium avium subsp. paratuberculosis
cauacacgggccgu

SEQ ID NO: 901079 - RNA, 18 nt, Mycobacterium avium subsp. paratuberculosis
caguugaaguccggcggu

SEQ ID NO: 901080 - RNA, 17 nt, Mycobacterium avium subsp. paratuberculosis
caguucgucgcgcgacu

SEQ ID NO: 901081 - RNA, 13 nt, Mycobacterium avium subsp. paratuberculosis
caguucgucggcc

SEQ ID NO: 901082 - RNA, 16 nt, Mycobacterium avium subsp. paratuberculosis
caguucgucggccguc

SEQ ID NO: 901083 - RNA, 20 nt, Mycobacterium avium subsp. paratuberculosis
caguucgucggccgucggcg

SEQ ID NO: 901084 - RNA, 22 nt, Mycobacterium avium subsp. paratuberculosis
caguucgguggggccgccgucu

SEQ ID NO: 901085 - RNA, 15 nt, Mycobacterium avium subsp. paratuberculosis
caguucggugcacgg

SEQ ID NO: 901086 - RNA, 16 nt, Mycobacterium avium subsp. paratuberculosis
caguucggccagcgcg

SEQ ID NO: 901087 - RNA, 15 nt, Mycobacterium avium subsp. paratuberculosis
caguucggccgccgu

SEQ ID NO: 901088 - RNA, 17 nt, Mycobacterium avium subsp. paratuberculosis
caguucggccgccgugc

SEQ ID NO: 901089 - RNA, 19 nt, Mycobacterium avium subsp. paratuberculosis
caguucgggaucgucgccg

SEQ ID NO: 901090 - RNA, 22 nt, Mycobacterium avium subsp. paratuberculosis
caguuccuugauccggccgcgg

SEQ ID NO: 901091 - RNA, 19 nt, Mycobacterium avium subsp. paratuberculosis
caguucgaugcgcucggcg

SEQ ID NO: 901092 - RNA, 20 nt, Mycobacterium avium subsp. paratuberculosis
caguucgaugcgcucggcga

SEQ ID NO: 901093 - RNA, 18 nt, Mycobacterium avium subsp. paratuberculosis
caguucgagcgccgcggc

SEQ ID NO: 901094 - RNA, 20 nt, Mycobacterium avium subsp. paratuberculosis
caguucgagcgccgcggcca

SEQ ID NO: 901095 - RNA, 20 nt, Mycobacterium avium subsp. paratuberculosis
caguucgcaccccaccgaca

SEQ ID NO: 901096 - RNA, 19 nt, Mycobacterium avium subsp. paratuberculosis
caguucgcguacccgcgcg

SEQ ID NO: 901097 - RNA, 23 nt, Mycobacterium avium subsp. paratuberculosis
caguucgccggugaccugcagcg

SEQ ID NO: 901098 - RNA, 16 nt, Mycobacterium avium subsp. paratuberculosis
caguucgccaccacgg

SEQ ID NO: 901099 - RNA, 15 nt, Mycobacterium avium subsp. paratuberculosis
cagugcgugaccugc

SEQ ID NO: 901100 - RNA, 14 nt, Mycobacterium avium subsp. paratuberculosis
caguguccagucgg

SEQ ID NO: 901101 - RNA, 17 nt, Mycobacterium avium subsp. paratuberculosis
caguguccagucggccg

SEQ ID NO: 901102 - RNA, 19 nt, Mycobacterium avium subsp. paratuberculosis
caguguccagucggccgug

SEQ ID NO: 901103 - RNA, 14 nt, Mycobacterium avium subsp. paratuberculosis
caguguccgggcgc

SEQ ID NO: 901104 - RNA, 18 nt, Mycobacterium avium subsp. paratuberculosis
cagugucggaaucggcgc

SEQ ID NO: 901105 - RNA, 22 nt, Mycobacterium avium subsp. paratuberculosis
cagugucggaaucggcgccgaa

SEQ ID NO: 901106 - RNA, 14 nt, Mycobacterium avium subsp. paratuberculosis
caguguggccgcgg

SEQ ID NO: 901107 - RNA, 15 nt, Mycobacterium avium subsp. paratuberculosis
cagugcacugccgac

SEQ ID NO: 901108 - RNA, 22 nt, Mycobacterium avium subsp. paratuberculosis
cagugcacugccgacccggcgu

SEQ ID NO: 901109 - RNA, 17 nt, Mycobacterium avium subsp. paratuberculosis
cagugcacgcucggcgg

SEQ ID NO: 901110 - RNA, 19 nt, Mycobacterium avium subsp. paratuberculosis
cagugcacgcucggcgggg

SEQ ID NO: 901111 - RNA, 20 nt, Mycobacterium avium subsp. paratuberculosis
cagugcagguuccggaucaa

SEQ ID NO: 901112 - RNA, 19 nt, Mycobacterium avium subsp. paratuberculosis
cagugcaguucgaugccga

SEQ ID NO: 901113 - RNA, 17 nt, Mycobacterium avium subsp. paratuberculosis
cagugcaccucgacgaa

SEQ ID NO: 901114 - RNA, 13 nt, Mycobacterium avium subsp. paratuberculosis
cagugcacgacga

SEQ ID NO: 901115 - RNA, 18 nt, Mycobacterium avium subsp. paratuberculosis
cagugcacgacgaccgcg

SEQ ID NO: 901116 - RNA, 14 nt, Mycobacterium avium subsp. paratuberculosis
cagugaggccagca

SEQ ID NO: 901117 - RNA, 15 nt, Mycobacterium avium subsp. paratuberculosis
cagugaggccagcac

SEQ ID NO: 901118 - RNA, 14 nt, Mycobacterium avium subsp. paratuberculosis
cagugaucggcgga

SEQ ID NO: 901119 - RNA, 19 nt, Mycobacterium avium subsp. paratuberculosis
cagugccaccaccacggcc

SEQ ID NO: 901120 - RNA, 22 nt, Mycobacterium avium subsp. paratuberculosis
cagugccccguccggcgccagc

SEQ ID NO: 901121 - RNA, 16 nt, Mycobacterium avium subsp. paratuberculosis
cagugccaguaccagc

SEQ ID NO: 901122 - RNA, 17 nt, Mycobacterium avium subsp. paratuberculosis
cagugccaguaccagcg

SEQ ID NO: 901123 - RNA, 23 nt, Mycobacterium avium subsp. paratuberculosis
cagugccaguaccagcggccguc

SEQ ID NO: 901124 - RNA, 18 nt, Mycobacterium avium subsp. paratuberculosis
cagugcaucgcugccguc

SEQ ID NO: 901125 - RNA, 17 nt, Mycobacterium avium subsp. paratuberculosis
cagugccaacacggcgg

SEQ ID NO: 901126 - RNA, 18 nt, Mycobacterium avium subsp. paratuberculosis
cagugccaacacggcggc

SEQ ID NO: 901127 - RNA, 20 nt, Mycobacterium avium subsp. paratuberculosis
cagugccaacacggcggcgc

SEQ ID NO: 901128 - RNA, 20 nt, Mycobacterium avium subsp. paratuberculosis
cagugcgucagaaccggggc

SEQ ID NO: 901129 - RNA, 14 nt, Mycobacterium avium subsp. paratuberculosis
cagugcgucgccca

SEQ ID NO: 901130 - RNA, 13 nt, Mycobacterium avium subsp. paratuberculosis
cagugcggcccgc

SEQ ID NO: 901131 - RNA, 21 nt, Mycobacterium avium subsp. paratuberculosis
cagugcggcccgccgggcguc

SEQ ID NO: 901132 - RNA, 13 nt, Mycobacterium avium subsp. paratuberculosis
cagugccgcgcca

SEQ ID NO: 901133 - RNA, 15 nt, Mycobacterium avium subsp. paratuberculosis
cagugcccgcccagc

SEQ ID NO: 901134 - RNA, 19 nt, Mycobacterium avium subsp. paratuberculosis
cagugcccgcccagcugca

SEQ ID NO: 901135 - RNA, 16 nt, Mycobacterium avium subsp. paratuberculosis
cagugccgcaccagca

SEQ ID NO: 901136 - RNA, 19 nt, Mycobacterium avium subsp. paratuberculosis
cagugccgcaccagcaccc

SEQ ID NO: 901137 - RNA, 21 nt, Mycobacterium avium subsp. paratuberculosis
cagugccgcaccagcaccccg

SEQ ID NO: 901138 - RNA, 21 nt, Mycobacterium avium subsp. paratuberculosis
caggauggugaaaucguccau

SEQ ID NO: 901139 - RNA, 14 nt, Mycobacterium avium subsp. paratuberculosis
caggaccgggacga

SEQ ID NO: 901140 - RNA, 21 nt, Mycobacterium avium subsp. paratuberculosis
caggaccgggacgacggcgcc

SEQ ID NO: 901141 - RNA, 21 nt, Mycobacterium avium subsp. paratuberculosis
caggaggacaagucaugccgc

SEQ ID NO: 901142 - RNA, 16 nt, Mycobacterium avium subsp. paratuberculosis
caggaggcacuggcgc

SEQ ID NO: 901143 - RNA, 14 nt, Mycobacterium avium subsp. paratuberculosis
caggagugcucggc

SEQ ID NO: 901144 - RNA, 15 nt, Mycobacterium avium subsp. paratuberculosis
caggagugcucggcg

SEQ ID NO: 901145 - RNA, 16 nt, Mycobacterium avium subsp. paratuberculosis
caggagugcucggcgu

SEQ ID NO: 901146 - RNA, 20 nt, Mycobacterium avium subsp. paratuberculosis
caggcacacgaacaccggcg

SEQ ID NO: 901147 - RNA, 21 nt, Mycobacterium avium subsp. paratuberculosis
caggcacacgaacaccggcgg

SEQ ID NO: 901148 - RNA, 22 nt, Mycobacterium avium subsp. paratuberculosis
caggcacacgaacaccggcgga

SEQ ID NO: 901149 - RNA, 17 nt, Mycobacterium avium subsp. paratuberculosis
caggauucucagcagcg

SEQ ID NO: 901150 - RNA, 20 nt, Mycobacterium avium subsp. paratuberculosis
caggauucucagcagcgggc

SEQ ID NO: 901151 - RNA, 22 nt, Mycobacterium avium subsp. paratuberculosis
caggauucucagcagcgggccg

SEQ ID NO: 901152 - RNA, 15 nt, Mycobacterium avium subsp. paratuberculosis
caggaugucgacgac

SEQ ID NO: 901153 - RNA, 20 nt, Mycobacterium avium subsp. paratuberculosis
caggaugucuccgcgcagcc

SEQ ID NO: 901154 - RNA, 21 nt, Mycobacterium avium subsp. paratuberculosis
caggaugucuccgcgcagcca

SEQ ID NO: 901155 - RNA, 17 nt, Mycobacterium avium subsp. paratuberculosis
caggauguucaccccgg

SEQ ID NO: 901156 - RNA, 19 nt, Mycobacterium avium subsp. paratuberculosis
caggauguucaccccggcg

SEQ ID NO: 901157 - RNA, 16 nt, Mycobacterium avium subsp. paratuberculosis
caggauuccgucggcg

SEQ ID NO: 901158 - RNA, 20 nt, Mycobacterium avium subsp. paratuberculosis
caggauuccgucggcggccg

SEQ ID NO: 901159 - RNA, 20 nt, Mycobacterium avium subsp. paratuberculosis
cagcuugaucgccggggcgc

SEQ ID NO: 901160 - RNA, 17 nt, Mycobacterium avium subsp. paratuberculosis
cagcuuggagccgagca

SEQ ID NO: 901161 - RNA, 20 nt, Mycobacterium avium subsp. paratuberculosis
cagcuuggagccgagcaccg

SEQ ID NO: 901162 - RNA, 13 nt, Mycobacterium avium subsp. paratuberculosis
caggaagccggcg

SEQ ID NO: 901163 - RNA, 14 nt, Mycobacterium avium subsp. paratuberculosis
caggaagccggcga

SEQ ID NO: 901164 - RNA, 23 nt, Mycobacterium avium subsp. paratuberculosis
caggaccacccacucccagccgc

SEQ ID NO: 901165 - RNA, 17 nt, Mycobacterium avium subsp. paratuberculosis
caggaccgagccgcgcg

SEQ ID NO: 901166 - RNA, 23 nt, Mycobacterium avium subsp. paratuberculosis
caggaccgagccgcgcgccgaga

SEQ ID NO: 901167 - RNA, 15 nt, Mycobacterium avium subsp. paratuberculosis
caggaccugaccgaa

SEQ ID NO: 901168 - RNA, 13 nt, Mycobacterium avium subsp. paratuberculosis
caggaauucgggc

SEQ ID NO: 901169 - RNA, 13 nt, Mycobacterium avium subsp. paratuberculosis
cagcucuucgacg

SEQ ID NO: 901170 - RNA, 16 nt, Mycobacterium avium subsp. paratuberculosis
cagcucuucgacgaug

SEQ ID NO: 901171 - RNA, 21 nt, Mycobacterium avium subsp. paratuberculosis
cagcugaacggugcccgccga

SEQ ID NO: 901172 - RNA, 22 nt, Mycobacterium avium subsp. paratuberculosis
cagcugaagguuguucugcucg

SEQ ID NO: 901173 - RNA, 21 nt, Mycobacterium avium subsp. paratuberculosis
cagcugaagugcacucggcga

SEQ ID NO: 901174 - RNA, 14 nt, Mycobacterium avium subsp. paratuberculosis
cagcucgucggcgc

SEQ ID NO: 901175 - RNA, 15 nt, Mycobacterium avium subsp. paratuberculosis
cagcucguggcgggc

SEQ ID NO: 901176 - RNA, 17 nt, Mycobacterium avium subsp. paratuberculosis
cagcucguggcgggccc

SEQ ID NO: 901177 - RNA, 17 nt, Mycobacterium avium subsp. paratuberculosis
cagcucguugccggcgg

SEQ ID NO: 901178 - RNA, 19 nt, Mycobacterium avium subsp. paratuberculosis
cagcucguugccggcggcc

SEQ ID NO: 901179 - RNA, 14 nt, Mycobacterium avium subsp. paratuberculosis
cagcugacgggccg

SEQ ID NO: 901180 - RNA, 20 nt, Mycobacterium avium subsp. paratuberculosis
cagcugcaccggggccggcg

SEQ ID NO: 901181 - RNA, 22 nt, Mycobacterium avium subsp. paratuberculosis
cagcugcaccggggccggcggg

SEQ ID NO: 901182 - RNA, 23 nt, Mycobacterium avium subsp. paratuberculosis
cagcugcaccggggccggcgggg

SEQ ID NO: 901183 - RNA, 15 nt, Mycobacterium avium subsp. paratuberculosis
cagcugauucgcggu

SEQ ID NO: 901184 - RNA, 20 nt, Mycobacterium avium subsp. paratuberculosis
cagcugauucgcgguggcga

SEQ ID NO: 901185 - RNA, 19 nt, Mycobacterium avium subsp. paratuberculosis
cagcugauuguugacggug

SEQ ID NO: 901186 - RNA, 18 nt, Mycobacterium avium subsp. paratuberculosis
cagcugauagcccgccgc

SEQ ID NO: 901187 - RNA, 20 nt, Mycobacterium avium subsp. paratuberculosis
cagcugauagcccgccgcgg

SEQ ID NO: 901188 - RNA, 22 nt, Mycobacterium avium subsp. paratuberculosis
cagcugauagcccgccgcggcg

SEQ ID NO: 901189 - RNA, 16 nt, Mycobacterium avium subsp. paratuberculosis
cagcugauagccgccc

SEQ ID NO: 901190 - RNA, 21 nt, Mycobacterium avium subsp. paratuberculosis
cagcugauagccgcccugccc

SEQ ID NO: 901191 - RNA, 16 nt, Mycobacterium avium subsp. paratuberculosis
cagcugaccggcgauc

SEQ ID NO: 901192 - RNA, 16 nt, Mycobacterium avium subsp. paratuberculosis
cagcugacgggccggc

SEQ ID NO: 901193 - RNA, 17 nt, Mycobacterium avium subsp. paratuberculosis
cagcugacgggccggcg

SEQ ID NO: 901194 - RNA, 18 nt, Mycobacterium avium subsp. paratuberculosis
cagcugacgggccggcgg

SEQ ID NO: 901195 - RNA, 15 nt, Mycobacterium avium subsp. paratuberculosis
cagcugagcagcccg

SEQ ID NO: 901196 - RNA, 13 nt, Mycobacterium avium subsp. paratuberculosis
cagcucgucgacg

SEQ ID NO: 901197 - RNA, 19 nt, Mycobacterium avium subsp. paratuberculosis
cagcucggugcgcaccccg

SEQ ID NO: 901198 - RNA, 21 nt, Mycobacterium avium subsp. paratuberculosis
cagcucgguggcgucggcggc

SEQ ID NO: 901199 - RNA, 22 nt, Mycobacterium avium subsp. paratuberculosis
cagcucgguggcgucggcggcc

SEQ ID NO: 901200 - RNA, 15 nt, Mycobacterium avium subsp. paratuberculosis
cagcucgucagcgcg

SEQ ID NO: 901201 - RNA, 17 nt, Mycobacterium avium subsp. paratuberculosis
cagcucgucagcgcggg

SEQ ID NO: 901202 - RNA, 18 nt, Mycobacterium avium subsp. paratuberculosis
cagcucgucagcgcgggc

SEQ ID NO: 901203 - RNA, 15 nt, Mycobacterium avium subsp. paratuberculosis
cagcucguccagcgu

SEQ ID NO: 901204 - RNA, 20 nt, Mycobacterium avium subsp. paratuberculosis
cagcucguccagcgugccgc

SEQ ID NO: 901205 - RNA, 13 nt, Mycobacterium avium subsp. paratuberculosis
cagcucgucgccg

SEQ ID NO: 901206 - RNA, 17 nt, Mycobacterium avium subsp. paratuberculosis
cagcucgucgagccggc

SEQ ID NO: 901207 - RNA, 22 nt, Mycobacterium avium subsp. paratuberculosis
cagcucggugcagaccccggcg

SEQ ID NO: 901208 - RNA, 18 nt, Mycobacterium avium subsp. paratuberculosis
cagcucggugaucaccau

SEQ ID NO: 901209 - RNA, 20 nt, Mycobacterium avium subsp. paratuberculosis
cagcucggugaucugcacca

SEQ ID NO: 901210 - RNA, 23 nt, Mycobacterium avium subsp. paratuberculosis
cagcucggugaugaucgccgggu

SEQ ID NO: 901211 - RNA, 12 nt, Mycobacterium avium subsp. paratuberculosis
cagcucggcggg

SEQ ID NO: 901212 - RNA, 13 nt, Mycobacterium avium subsp. paratuberculosis
cagcucggcgggc

SEQ ID NO: 901213 - RNA, 18 nt, Mycobacterium avium subsp. paratuberculosis
cagcucggucgcggucgg

SEQ ID NO: 901214 - RNA, 19 nt, Mycobacterium avium subsp. paratuberculosis
cagcucggucgcggucggc

SEQ ID NO: 901215 - RNA, 22 nt, Mycobacterium avium subsp. paratuberculosis
cagcucggcguauucgucgucg

SEQ ID NO: 901216 - RNA, 23 nt, Mycobacterium avium subsp. paratuberculosis
cagcucggcguauucgucgucgg

SEQ ID NO: 901217 - RNA, 16 nt, Mycobacterium avium subsp. paratuberculosis
cagcucgggcagcccg

SEQ ID NO: 901218 - RNA, 19 nt, Mycobacterium avium subsp. paratuberculosis
cagcucgggcagcccgccg

SEQ ID NO: 901219 - RNA, 15 nt, Mycobacterium avium subsp. paratuberculosis
cagcucgggcagcgu

SEQ ID NO: 901220 - RNA, 16 nt, Mycobacterium avium subsp. paratuberculosis
cagcucgggcagcgug

SEQ ID NO: 901221 - RNA, 23 nt, Mycobacterium avium subsp. paratuberculosis
cagcucgggguaguucagcgcgc

SEQ ID NO: 901222 - RNA, 18 nt, Mycobacterium avium subsp. paratuberculosis
cagcucggggucggcguc

SEQ ID NO: 901223 - RNA, 19 nt, Mycobacterium avium subsp. paratuberculosis
cagcucggggucggcgucg

SEQ ID NO: 901224 - RNA, 22 nt, Mycobacterium avium subsp. paratuberculosis
cagcucggggucggcgucgggc

SEQ ID NO: 901225 - RNA, 17 nt, Mycobacterium avium subsp. paratuberculosis
cagcucggucaccagcg

SEQ ID NO: 901226 - RNA, 17 nt, Mycobacterium avium subsp. paratuberculosis
cagcucggucagccggg

SEQ ID NO: 901227 - RNA, 18 nt, Mycobacterium avium subsp. paratuberculosis
cagcucggucagccgggc

SEQ ID NO: 901228 - RNA, 20 nt, Mycobacterium avium subsp. paratuberculosis
cagcucggucagccgggcgg

SEQ ID NO: 901229 - RNA, 22 nt, Mycobacterium avium subsp. paratuberculosis
cagcuugaagcccucgucgaag

SEQ ID NO: 901230 - RNA, 14 nt, Mycobacterium avium subsp. paratuberculosis
cagcuucucggcgu

SEQ ID NO: 901231 - RNA, 23 nt, Mycobacterium avium subsp. paratuberculosis
cagcuucucggcguccccggcgg

SEQ ID NO: 901232 - RNA, 16 nt, Mycobacterium avium subsp. paratuberculosis
cagcuucggcgccgag

SEQ ID NO: 901233 - RNA, 13 nt, Mycobacterium avium subsp. paratuberculosis
cagcuucgggcgc

SEQ ID NO: 901234 - RNA, 21 nt, Mycobacterium avium subsp. paratuberculosis
cagcuucgggcgcgcgcgcca

SEQ ID NO: 901235 - RNA, 18 nt, Mycobacterium avium subsp. paratuberculosis
cagcuucgugucaccgcc

SEQ ID NO: 901236 - RNA, 15 nt, Mycobacterium avium subsp. paratuberculosis
cagcuugaugcuggc

SEQ ID NO: 901237 - RNA, 20 nt, Mycobacterium avium subsp. paratuberculosis
cagcuugaccgugacggugc

SEQ ID NO: 901238 - RNA, 17 nt, Mycobacterium avium subsp. paratuberculosis
cagcuugaccacccggu

SEQ ID NO: 901239 - RNA, 22 nt, Mycobacterium avium subsp. paratuberculosis
cagcuugaccacccggucgacg

SEQ ID NO: 901240 - RNA, 23 nt, Mycobacterium avium subsp. paratuberculosis
cagcuugaccacccggucgacga

SEQ ID NO: 901241 - RNA, 17 nt, Mycobacterium avium subsp. paratuberculosis
cagcugcccaccagcag

SEQ ID NO: 901242 - RNA, 22 nt, Mycobacterium avium subsp. paratuberculosis
cagcugcccggaguccggcucg

SEQ ID NO: 901243 - RNA, 23 nt, Mycobacterium avium subsp. paratuberculosis
cagcugcccggaguccggcucgg

SEQ ID NO: 901244 - RNA, 20 nt, Mycobacterium avium subsp. paratuberculosis
cagcugcagcggaaacgacg

SEQ ID NO: 901245 - RNA, 23 nt, Mycobacterium avium subsp. paratuberculosis
cagcugcagcggaaacgacgucg

SEQ ID NO: 901246 - RNA, 12 nt, Mycobacterium avium subsp. paratuberculosis
cagcugcagcgu

SEQ ID NO: 901247 - RNA, 14 nt, Mycobacterium avium subsp. paratuberculosis
cagcugcagcgucg

SEQ ID NO: 901248 - RNA, 17 nt, Mycobacterium avium subsp. paratuberculosis
cagcugcauggacagcg

SEQ ID NO: 901249 - RNA, 20 nt, Mycobacterium avium subsp. paratuberculosis
cagcuggaaauaggccgggc

SEQ ID NO: 901250 - RNA, 22 nt, Mycobacterium avium subsp. paratuberculosis
cagcuggaaauaggccgggcag

SEQ ID NO: 901251 - RNA, 16 nt, Mycobacterium avium subsp. paratuberculosis
cagcuggaacaccacg

SEQ ID NO: 901252 - RNA, 21 nt, Mycobacterium avium subsp. paratuberculosis
cagcuggaacaccacggccgg

SEQ ID NO: 901253 - RNA, 17 nt, Mycobacterium avium subsp. paratuberculosis
cagcugcucguccuggc

SEQ ID NO: 901254 - RNA, 19 nt, Mycobacterium avium subsp. paratuberculosis
cagcugcucguccuggcgc

SEQ ID NO: 901255 - RNA, 16 nt, Mycobacterium avium subsp. paratuberculosis
cagcuggaucaucucg

SEQ ID NO: 901256 - RNA, 13 nt, Mycobacterium avium subsp. paratuberculosis
cagcuggccgugc

SEQ ID NO: 901257 - RNA, 17 nt, Mycobacterium avium subsp. paratuberculosis
cagcuggccgugcaccg

SEQ ID NO: 901258 - RNA, 21 nt, Mycobacterium avium subsp. paratuberculosis
cagcuggccgugcaccgucgc

SEQ ID NO: 901259 - RNA, 22 nt, Mycobacterium avium subsp. paratuberculosis
cagcuggauggcgcccagcccg

SEQ ID NO: 901260 - RNA, 16 nt, Mycobacterium avium subsp. paratuberculosis
cagcugcugcggccgg

SEQ ID NO: 901261 - RNA, 17 nt, Mycobacterium avium subsp. paratuberculosis
cagcugcugcggccgga

SEQ ID NO: 901262 - RNA, 21 nt, Mycobacterium avium subsp. paratuberculosis
cagcuggagaggcccggcagc

SEQ ID NO: 901263 - RNA, 14 nt, Mycobacterium avium subsp. paratuberculosis
cagcugcugcgcgg

SEQ ID NO: 901264 - RNA, 19 nt, Mycobacterium avium subsp. paratuberculosis
cagcugcugcgcggcggcg

SEQ ID NO: 901265 - RNA, 16 nt, Mycobacterium avium subsp. paratuberculosis
cagcgucgcgccgcca

SEQ ID NO: 901266 - RNA, 20 nt, Mycobacterium avium subsp. paratuberculosis
cagcgucgcgccgccacccc

SEQ ID NO: 901267 - RNA, 20 nt, Mycobacterium avium subsp. paratuberculosis
cagcgucgccagccgccggc

SEQ ID NO: 901268 - RNA, 21 nt, Mycobacterium avium subsp. paratuberculosis
cagcgucgccagccgccggcu

SEQ ID NO: 901269 - RNA, 21 nt, Mycobacterium avium subsp. paratuberculosis
cagcgucgccaugccgucgcg

SEQ ID NO: 901270 - RNA, 17 nt, Mycobacterium avium subsp. paratuberculosis
cagcgucgccgacgggc

SEQ ID NO: 901271 - RNA, 18 nt, Mycobacterium avium subsp. paratuberculosis
cagcgucgccgacgggcc

SEQ ID NO: 901272 - RNA, 19 nt, Mycobacterium avium subsp. paratuberculosis
cagcgucgccgacgggccc

SEQ ID NO: 901273 - RNA, 14 nt, Mycobacterium avium subsp. paratuberculosis
cagcgucgccgccc

SEQ ID NO: 901274 - RNA, 22 nt, Mycobacterium avium subsp. paratuberculosis
cagcgucgccgccccgaguucc

SEQ ID NO: 901275 - RNA, 20 nt, Mycobacterium avium subsp. paratuberculosis
cagcgugaacagcgcccggc

SEQ ID NO: 901276 - RNA, 22 nt, Mycobacterium avium subsp. paratuberculosis
cagcgugaacagcgcccggccg

SEQ ID NO: 901277 - RNA, 20 nt, Mycobacterium avium subsp. paratuberculosis
cagcgugaacguguggguga

SEQ ID NO: 901278 - RNA, 21 nt, Mycobacterium avium subsp. paratuberculosis
cagcgucgccaauccggcggg

SEQ ID NO: 901279 - RNA, 17 nt, Mycobacterium avium subsp. paratuberculosis
cagcgucuugacgaacu

SEQ ID NO: 901280 - RNA, 18 nt, Mycobacterium avium subsp. paratuberculosis
cagcgucuugacgaacuc

SEQ ID NO: 901281 - RNA, 18 nt, Mycobacterium avium subsp. paratuberculosis
cagcgucuuggacgcccg

SEQ ID NO: 901282 - RNA, 13 nt, Mycobacterium avium subsp. paratuberculosis
cagcgucaacggc

SEQ ID NO: 901283 - RNA, 12 nt, Mycobacterium avium subsp. paratuberculosis
cagcgucccguc

SEQ ID NO: 901284 - RNA, 19 nt, Mycobacterium avium subsp. paratuberculosis
cagcgucgacugcaccgac

SEQ ID NO: 901285 - RNA, 22 nt, Mycobacterium avium subsp. paratuberculosis
cagcgucgaguuguugggccga

SEQ ID NO: 901286 - RNA, 22 nt, Mycobacterium avium subsp. paratuberculosis
cagcgucgauggaaggugcuga

SEQ ID NO: 901287 - RNA, 18 nt, Mycobacterium avium subsp. paratuberculosis
cagcggugcagccccgca

SEQ ID NO: 901288 - RNA, 15 nt, Mycobacterium avium subsp. paratuberculosis
cagcggucggcggcu

SEQ ID NO: 901289 - RNA, 17 nt, Mycobacterium avium subsp. paratuberculosis
cagcggucacggacagg

SEQ ID NO: 901290 - RNA, 22 nt, Mycobacterium avium subsp. paratuberculosis
cagcggucauugaugccccggg

SEQ ID NO: 901291 - RNA, 15 nt, Mycobacterium avium subsp. paratuberculosis
cagcgguccacccga

SEQ ID NO: 901292 - RNA, 15 nt, Mycobacterium avium subsp. paratuberculosis
cagcggugucaccga

SEQ ID NO: 901293 - RNA, 20 nt, Mycobacterium avium subsp. paratuberculosis
cagcggugucaccgacgcca

SEQ ID NO: 901294 - RNA, 15 nt, Mycobacterium avium subsp. paratuberculosis
cagcgggcggccccg

SEQ ID NO: 901295 - RNA, 13 nt, Mycobacterium avium subsp. paratuberculosis
cagcgggcggcgg

SEQ ID NO: 901296 - RNA, 18 nt, Mycobacterium avium subsp. paratuberculosis
cagcgggauuggcgccac

SEQ ID NO: 901297 - RNA, 19 nt, Mycobacterium avium subsp. paratuberculosis
cagcgggcagagcugcuga

SEQ ID NO: 901298 - RNA, 16 nt, Mycobacterium avium subsp. paratuberculosis
cagcgggccggcgucg

SEQ ID NO: 901299 - RNA, 22 nt, Mycobacterium avium subsp. paratuberculosis
cagcgggccguugccggucccg

SEQ ID NO: 901300 - RNA, 20 nt, Mycobacterium avium subsp. paratuberculosis
cagcgggcgcagcucgucgu

SEQ ID NO: 901301 - RNA, 22 nt, Mycobacterium avium subsp. paratuberculosis
cagcgggccgaagaccgggccg

SEQ ID NO: 901302 - RNA, 21 nt, Mycobacterium avium subsp. paratuberculosis
cagcgggccgacagcacgccg

SEQ ID NO: 901303 - RNA, 17 nt, Mycobacterium avium subsp. paratuberculosis
cagcgggccgacccggc

SEQ ID NO: 901304 - RNA, 18 nt, Mycobacterium avium subsp. paratuberculosis
cagcgggccgacccggcc

SEQ ID NO: 901305 - RNA, 23 nt, Mycobacterium avium subsp. paratuberculosis
cagcgggccgagcguucggcgcg

SEQ ID NO: 901306 - RNA, 19 nt, Mycobacterium avium subsp. paratuberculosis
cagcgguaaccacccgugg

SEQ ID NO: 901307 - RNA, 18 nt, Mycobacterium avium subsp. paratuberculosis
cagcggguuuggccgcgg

SEQ ID NO: 901308 - RNA, 19 nt, Mycobacterium avium subsp. paratuberculosis
cagcggguuuggccgcggg

SEQ ID NO: 901309 - RNA, 16 nt, Mycobacterium avium subsp. paratuberculosis
cagcgggcuguccgcg

SEQ ID NO: 901310 - RNA, 16 nt, Mycobacterium avium subsp. paratuberculosis
cagcgggcugucggcg

SEQ ID NO: 901311 - RNA, 17 nt, Mycobacterium avium subsp. paratuberculosis
cagcgggcugugccggc

SEQ ID NO: 901312 - RNA, 18 nt, Mycobacterium avium subsp. paratuberculosis
cagcgggcugugccggcg

SEQ ID NO: 901313 - RNA, 14 nt, Mycobacterium avium subsp. paratuberculosis
cagcgggcuggcgu

SEQ ID NO: 901314 - RNA, 13 nt, Mycobacterium avium subsp. paratuberculosis
cagcgggcuggcg

SEQ ID NO: 901315 - RNA, 13 nt, Mycobacterium avium subsp. paratuberculosis
cagcgcgaucgcc

SEQ ID NO: 901316 - RNA, 13 nt, Mycobacterium avium subsp. paratuberculosis
cagcgcgaggucg

SEQ ID NO: 901317 - RNA, 17 nt, Mycobacterium avium subsp. paratuberculosis
cagcgcgaugccggcca

SEQ ID NO: 901318 - RNA, 23 nt, Mycobacterium avium subsp. paratuberculosis
cagcgcgaugccggccaggcaca

SEQ ID NO: 901319 - RNA, 22 nt, Mycobacterium avium subsp. paratuberculosis
cagcgcgcacaauucggucagc

SEQ ID NO: 901320 - RNA, 13 nt, Mycobacterium avium subsp. paratuberculosis
cagcgcgcacagc

SEQ ID NO: 901321 - RNA, 23 nt, Mycobacterium avium subsp. paratuberculosis
cagcgcgcacagcgccacaccga

SEQ ID NO: 901322 - RNA, 20 nt, Mycobacterium avium subsp. paratuberculosis
cagcgcgcacgcggacacga

SEQ ID NO: 901323 - RNA, 17 nt, Mycobacterium avium subsp. paratuberculosis
cagcgcgcagaacacca

SEQ ID NO: 901324 - RNA, 20 nt, Mycobacterium avium subsp. paratuberculosis
cagcgcgcagaacaccaccg

SEQ ID NO: 901325 - RNA, 23 nt, Mycobacterium avium subsp. paratuberculosis
cagcgcgcagaacaccaccgcca

SEQ ID NO: 901326 - RNA, 16 nt, Mycobacterium avium subsp. paratuberculosis
cagcgcgccgaucgcc

SEQ ID NO: 901327 - RNA, 22 nt, Mycobacterium avium subsp. paratuberculosis
cagcgcgccgaccacggcccca

SEQ ID NO: 901328 - RNA, 20 nt, Mycobacterium avium subsp. paratuberculosis
cagcgggaugaaggcaccca

SEQ ID NO: 901329 - RNA, 14 nt, Mycobacterium avium subsp. paratuberculosis
cagcgcgcccgcca

SEQ ID NO: 901330 - RNA, 21 nt, Mycobacterium avium subsp. paratuberculosis
cagcgcgcccugaggcccggu

SEQ ID NO: 901331 - RNA, 15 nt, Mycobacterium avium subsp. paratuberculosis
cagcgcgcccgacgg

SEQ ID NO: 901332 - RNA, 17 nt, Mycobacterium avium subsp. paratuberculosis
cagcgcgcccgacgguc

SEQ ID NO: 901333 - RNA, 12 nt, Mycobacterium avium subsp. paratuberculosis
cagcgcgcccag

SEQ ID NO: 901334 - RNA, 12 nt, Mycobacterium avium subsp. paratuberculosis
cagcgcgcccca

SEQ ID NO: 901335 - RNA, 20 nt, Mycobacterium avium subsp. paratuberculosis
cagcgcgccccagugcaggc

SEQ ID NO: 901336 - RNA, 18 nt, Mycobacterium avium subsp. paratuberculosis
cagcgugacccugccguc

SEQ ID NO: 901337 - RNA, 21 nt, Mycobacterium avium subsp. paratuberculosis
cagcgugacccugccgucacc

SEQ ID NO: 901338 - RNA, 17 nt, Mycobacterium avium subsp. paratuberculosis
cagcgugaccucgacgg

SEQ ID NO: 901339 - RNA, 20 nt, Mycobacterium avium subsp. paratuberculosis
cagcgugaccucgacggugc

SEQ ID NO: 901340 - RNA, 20 nt, Mycobacterium avium subsp. paratuberculosis
cagcgugacgcccggcgccg

SEQ ID NO: 901341 - RNA, 14 nt, Mycobacterium avium subsp. paratuberculosis
cagcgugacgccgg

SEQ ID NO: 901342 - RNA, 16 nt, Mycobacterium avium subsp. paratuberculosis
cagcgugacgccgggc

SEQ ID NO: 901343 - RNA, 21 nt, Mycobacterium avium subsp. paratuberculosis
cagcgugacgccgggccgccg

SEQ ID NO: 901344 - RNA, 14 nt, Mycobacterium avium subsp. paratuberculosis
cagcgugacgcucg

SEQ ID NO: 901345 - RNA, 17 nt, Mycobacterium avium subsp. paratuberculosis
cagcgugacgcucgggc

SEQ ID NO: 901346 - RNA, 20 nt, Mycobacterium avium subsp. paratuberculosis
cagcgugacgcucgggcuuc

SEQ ID NO: 901347 - RNA, 22 nt, Mycobacterium avium subsp. paratuberculosis
cagcgugacgcugaagaucgaa

SEQ ID NO: 901348 - RNA, 15 nt, Mycobacterium avium subsp. paratuberculosis
cagcgugcacacccg

SEQ ID NO: 901349 - RNA, 13 nt, Mycobacterium avium subsp. paratuberculosis
cagcguucgucgc

SEQ ID NO: 901350 - RNA, 18 nt, Mycobacterium avium subsp. paratuberculosis
cagcguucgucgccggug

SEQ ID NO: 901351 - RNA, 13 nt, Mycobacterium avium subsp. paratuberculosis
cagcgugcgcggc

SEQ ID NO: 901352 - RNA, 16 nt, Mycobacterium avium subsp. paratuberculosis
cagcuccaccugcggc

SEQ ID NO: 901353 - RNA, 20 nt, Mycobacterium avium subsp. paratuberculosis
cagcuccaccugcggcaccu

SEQ ID NO: 901354 - RNA, 22 nt, Mycobacterium avium subsp. paratuberculosis
cagcuaggaagccagccguccc

SEQ ID NO: 901355 - RNA, 14 nt, Mycobacterium avium subsp. paratuberculosis
cagcuaggccagca

SEQ ID NO: 901356 - RNA, 17 nt, Mycobacterium avium subsp. paratuberculosis
cagcuccaacagccggu

SEQ ID NO: 901357 - RNA, 18 nt, Mycobacterium avium subsp. paratuberculosis
cagcuccaacagccgguc

SEQ ID NO: 901358 - RNA, 18 nt, Mycobacterium avium subsp. paratuberculosis
cagcuccaaugcggccga

SEQ ID NO: 901359 - RNA, 17 nt, Mycobacterium avium subsp. paratuberculosis
cagcguuuggccugcgg

SEQ ID NO: 901360 - RNA, 21 nt, Mycobacterium avium subsp. paratuberculosis
cagcguuuggccugcggcaac

SEQ ID NO: 901361 - RNA, 14 nt, Mycobacterium avium subsp. paratuberculosis
cagcuccagcagcc

SEQ ID NO: 901362 - RNA, 14 nt, Mycobacterium avium subsp. paratuberculosis
cagcuccagguccu

SEQ ID NO: 901363 - RNA, 23 nt, Mycobacterium avium subsp. paratuberculosis
cagcuccagguccuugaaccgca

SEQ ID NO: 901364 - RNA, 19 nt, Mycobacterium avium subsp. paratuberculosis
cagcucccacgacgacugg

SEQ ID NO: 901365 - RNA, 16 nt, Mycobacterium avium subsp. paratuberculosis
cagcucccccgacacc

SEQ ID NO: 901366 - RNA, 19 nt, Mycobacterium avium subsp. paratuberculosis
cagcucccccgacaccgcc

SEQ ID NO: 901367 - RNA, 20 nt, Mycobacterium avium subsp. paratuberculosis
cagcucccccgacaccgcca

SEQ ID NO: 901368 - RNA, 16 nt, Mycobacterium avium subsp. paratuberculosis
cagcucccccggcgug

SEQ ID NO: 901369 - RNA, 16 nt, Mycobacterium avium subsp. paratuberculosis
cagcucccgagcaucg

SEQ ID NO: 901370 - RNA, 17 nt, Mycobacterium avium subsp. paratuberculosis
cagcucccgagcaucgc

SEQ ID NO: 901371 - RNA, 18 nt, Mycobacterium avium subsp. paratuberculosis
cagcucggcggccgggug

SEQ ID NO: 901372 - RNA, 18 nt, Mycobacterium avium subsp. paratuberculosis
cagcucggcggccucgcc

SEQ ID NO: 901373 - RNA, 19 nt, Mycobacterium avium subsp. paratuberculosis
cagcucggcggccucgccg

SEQ ID NO: 901374 - RNA, 16 nt, Mycobacterium avium subsp. paratuberculosis
cagcucggcggccugc

SEQ ID NO: 901375 - RNA, 13 nt, Mycobacterium avium subsp. paratuberculosis
cagcucggcggcc

SEQ ID NO: 901376 - RNA, 15 nt, Mycobacterium avium subsp. paratuberculosis
cagcucggcggcccg

SEQ ID NO: 901377 - RNA, 18 nt, Mycobacterium avium subsp. paratuberculosis
cagcucggcggcccgccg

SEQ ID NO: 901378 - RNA, 14 nt, Mycobacterium avium subsp. paratuberculosis
cagcucggcggccg

SEQ ID NO: 901379 - RNA, 14 nt, Mycobacterium avium subsp. paratuberculosis
cagcucggcgcugu

SEQ ID NO: 901380 - RNA, 13 nt, Mycobacterium avium subsp. paratuberculosis
cagcucggcgauc

SEQ ID NO: 901381 - RNA, 20 nt, Mycobacterium avium subsp. paratuberculosis
cagcucggccauccccgcgu

SEQ ID NO: 901382 - RNA, 12 nt, Mycobacterium avium subsp. paratuberculosis
cagcucggcccg

SEQ ID NO: 901383 - RNA, 17 nt, Mycobacterium avium subsp. paratuberculosis
cagcucggcagccccgu

SEQ ID NO: 901384 - RNA, 20 nt, Mycobacterium avium subsp. paratuberculosis
cagcucggcagccccgucgg

SEQ ID NO: 901385 - RNA, 22 nt, Mycobacterium avium subsp. paratuberculosis
cagcucggcagccccgucgguc

SEQ ID NO: 901386 - RNA, 22 nt, Mycobacterium avium subsp. paratuberculosis
cagcucgcguagcgagguguga

SEQ ID NO: 901387 - RNA, 18 nt, Mycobacterium avium subsp. paratuberculosis
cagcucgcguucgggccc

SEQ ID NO: 901388 - RNA, 22 nt, Mycobacterium avium subsp. paratuberculosis
cagcucgcguucgggcccggcc

SEQ ID NO: 901389 - RNA, 20 nt, Mycobacterium avium subsp. paratuberculosis
cagcucgcugagcgggacgc

SEQ ID NO: 901390 - RNA, 22 nt, Mycobacterium avium subsp. paratuberculosis
cagcucgcugagcgggacgcgc

SEQ ID NO: 901391 - RNA, 12 nt, Mycobacterium avium subsp. paratuberculosis
cagcucgcggau

SEQ ID NO: 901392 - RNA, 20 nt, Mycobacterium avium subsp. paratuberculosis
cagcucgcggauccgcagcu

SEQ ID NO: 901393 - RNA, 22 nt, Mycobacterium avium subsp. paratuberculosis
cagcucgcggauccgcagcuga

SEQ ID NO: 901394 - RNA, 19 nt, Mycobacterium avium subsp. paratuberculosis
cagcucgcggauccgggcc

SEQ ID NO: 901395 - RNA, 13 nt, Mycobacterium avium subsp. paratuberculosis
cagcucgcgcccg

SEQ ID NO: 901396 - RNA, 18 nt, Mycobacterium avium subsp. paratuberculosis
cagcucgcgcagccggcc

SEQ ID NO: 901397 - RNA, 20 nt, Mycobacterium avium subsp. paratuberculosis
cagcucgcgcagcuggccgu

SEQ ID NO: 901398 - RNA, 17 nt, Mycobacterium avium subsp. paratuberculosis
cagcucgccggccgcgg

SEQ ID NO: 901399 - RNA, 14 nt, Mycobacterium avium subsp. paratuberculosis
cagcucgccggcgc

SEQ ID NO: 901400 - RNA, 15 nt, Mycobacterium avium subsp. paratuberculosis
cagcucgccggcgcg

SEQ ID NO: 901401 - RNA, 21 nt, Mycobacterium avium subsp. paratuberculosis
cagcucgccggcgcgcagcca

SEQ ID NO: 901402 - RNA, 22 nt, Mycobacterium avium subsp. paratuberculosis
cagcucgaugccguucgcgccg

SEQ ID NO: 901403 - RNA, 14 nt, Mycobacterium avium subsp. paratuberculosis
cagcucgccggccg

SEQ ID NO: 901404 - RNA, 17 nt, Mycobacterium avium subsp. paratuberculosis
cagcucgauggugccgu

SEQ ID NO: 901405 - RNA, 23 nt, Mycobacterium avium subsp. paratuberculosis
cagcucgauggugccgucggcgg

SEQ ID NO: 901406 - RNA, 15 nt, Mycobacterium avium subsp. paratuberculosis
cagcucgcccagcac

SEQ ID NO: 901407 - RNA, 15 nt, Mycobacterium avium subsp. paratuberculosis
cagcucgccgagcgu

SEQ ID NO: 901408 - RNA, 20 nt, Mycobacterium avium subsp. paratuberculosis
cagcucgccgaugucggccg

SEQ ID NO: 901409 - RNA, 21 nt, Mycobacterium avium subsp. paratuberculosis
cagcucgccgaugucggccgg

SEQ ID NO: 901410 - RNA, 21 nt, Mycobacterium avium subsp. paratuberculosis
cagcucgccgauguggcgggc

SEQ ID NO: 901411 - RNA, 13 nt, Mycobacterium avium subsp. paratuberculosis
cagcucgccgccg

SEQ ID NO: 901412 - RNA, 15 nt, Mycobacterium avium subsp. paratuberculosis
cagcucgagcaucac

SEQ ID NO: 901413 - RNA, 16 nt, Mycobacterium avium subsp. paratuberculosis
cagcucgaggccgcgg

SEQ ID NO: 901414 - RNA, 18 nt, Mycobacterium avium subsp. paratuberculosis
cagcucgaggccgcgggc

SEQ ID NO: 901415 - RNA, 14 nt, Mycobacterium avium subsp. paratuberculosis
cagcuccaucgacg

SEQ ID NO: 901416 - RNA, 16 nt, Mycobacterium avium subsp. paratuberculosis
cagcucgaucgccgcg

SEQ ID NO: 901417 - RNA, 15 nt, Mycobacterium avium subsp. paratuberculosis
cagcucgacgaacuc

SEQ ID NO: 901418 - RNA, 16 nt, Mycobacterium avium subsp. paratuberculosis
cagcucgacgaccucg

SEQ ID NO: 901419 - RNA, 19 nt, Mycobacterium avium subsp. paratuberculosis
cagcucgacgaccucgccg

SEQ ID NO: 901420 - RNA, 20 nt, Mycobacterium avium subsp. paratuberculosis
cagcucgacgaccucgccga

SEQ ID NO: 901421 - RNA, 14 nt, Mycobacterium avium subsp. paratuberculosis
cagcucgaccagcc

SEQ ID NO: 901422 - RNA, 16 nt, Mycobacterium avium subsp. paratuberculosis
cagcucgaccgcggcg

SEQ ID NO: 901423 - RNA, 19 nt, Mycobacterium avium subsp. paratuberculosis
cagcucgaccgcggcgaug

SEQ ID NO: 901424 - RNA, 14 nt, Mycobacterium avium subsp. paratuberculosis
cagcucccggcaga

SEQ ID NO: 901425 - RNA, 21 nt, Mycobacterium avium subsp. paratuberculosis
cagcucccggcagaucgcggc

SEQ ID NO: 901426 - RNA, 16 nt, Mycobacterium avium subsp. paratuberculosis
cagcucgaaggugacc

SEQ ID NO: 901427 - RNA, 18 nt, Mycobacterium avium subsp. paratuberculosis
cagcucgaaggugcccgc

SEQ ID NO: 901428 - RNA, 15 nt, Mycobacterium avium subsp. paratuberculosis
cagggacuccgggga

SEQ ID NO: 901429 - RNA, 18 nt, Mycobacterium avium subsp. paratuberculosis
cagggaggacagcaccgc

SEQ ID NO: 901430 - RNA, 23 nt, Mycobacterium avium subsp. paratuberculosis
cagggaggacagcaccgccaucg

SEQ ID NO: 901431 - RNA, 16 nt, Mycobacterium avium subsp. paratuberculosis
cagggacaugccgagc

SEQ ID NO: 901432 - RNA, 20 nt, Mycobacterium avium subsp. paratuberculosis
cagggacaugccgagcagca

SEQ ID NO: 901433 - RNA, 20 nt, Mycobacterium avium subsp. paratuberculosis
cagggaccagugguggccga

SEQ ID NO: 901434 - RNA, 20 nt, Mycobacterium avium subsp. paratuberculosis
caggcuggcguugggcggga

SEQ ID NO: 901435 - RNA, 14 nt, Mycobacterium avium subsp. paratuberculosis
caggcuguccugcg

SEQ ID NO: 901436 - RNA, 16 nt, Mycobacterium avium subsp. paratuberculosis
caggcuucgcagcaga

SEQ ID NO: 901437 - RNA, 14 nt, Mycobacterium avium subsp. paratuberculosis
caggcuugccccgu

SEQ ID NO: 901438 - RNA, 17 nt, Mycobacterium avium subsp. paratuberculosis
caggcuuggcccgccgc

SEQ ID NO: 901439 - RNA, 19 nt, Mycobacterium avium subsp. paratuberculosis
cagggcaaagaucggugcc

SEQ ID NO: 901440 - RNA, 16 nt, Mycobacterium avium subsp. paratuberculosis
cagggcaccgacggcc

SEQ ID NO: 901441 - RNA, 20 nt, Mycobacterium avium subsp. paratuberculosis
cagggcaccgacggccgcac

SEQ ID NO: 901442 - RNA, 18 nt, Mycobacterium avium subsp. paratuberculosis
cagggcagcgcgaccagc

SEQ ID NO: 901443 - RNA, 21 nt, Mycobacterium avium subsp. paratuberculosis
cagggcagcggugucaccgac

SEQ ID NO: 901444 - RNA, 14 nt, Mycobacterium avium subsp. paratuberculosis
cagggcagcgccuc

SEQ ID NO: 901445 - RNA, 19 nt, Mycobacterium avium subsp. paratuberculosis
cagggcagccagcccgcgc

SEQ ID NO: 901446 - RNA, 15 nt, Mycobacterium avium subsp. paratuberculosis
cagggccucggcgac

SEQ ID NO: 901447 - RNA, 18 nt, Mycobacterium avium subsp. paratuberculosis
cagggccucggcgaccgc

SEQ ID NO: 901448 - RNA, 19 nt, Mycobacterium avium subsp. paratuberculosis
cagggccucggcgaccgcc

SEQ ID NO: 901449 - RNA, 13 nt, Mycobacterium avium subsp. paratuberculosis
cagggccucgccg

SEQ ID NO: 901450 - RNA, 14 nt, Mycobacterium avium subsp. paratuberculosis
cagggccucgccgu

SEQ ID NO: 901451 - RNA, 23 nt, Mycobacterium avium subsp. paratuberculosis
cagggccucgucgucgucgagca

SEQ ID NO: 901452 - RNA, 20 nt, Mycobacterium avium subsp. paratuberculosis
cagggccugcagcaccaggc

SEQ ID NO: 901453 - RNA, 15 nt, Mycobacterium avium subsp. paratuberculosis
cagggcucgcaaccg

SEQ ID NO: 901454 - RNA, 22 nt, Mycobacterium avium subsp. paratuberculosis
cagggcguucgacguccaccgg

SEQ ID NO: 901455 - RNA, 19 nt, Mycobacterium avium subsp. paratuberculosis
cagggcguggaacgcgucg

SEQ ID NO: 901456 - RNA, 17 nt, Mycobacterium avium subsp. paratuberculosis
cagggcgucggacaugc

SEQ ID NO: 901457 - RNA, 16 nt, Mycobacterium avium subsp. paratuberculosis
cagggcgucgagcgcg

SEQ ID NO: 901458 - RNA, 17 nt, Mycobacterium avium subsp. paratuberculosis
cagggcgacuccggcgc

SEQ ID NO: 901459 - RNA, 17 nt, Mycobacterium avium subsp. paratuberculosis
cagggcgguggcggcga

SEQ ID NO: 901460 - RNA, 19 nt, Mycobacterium avium subsp. paratuberculosis
cagggcgguggcggcgaac

SEQ ID NO: 901461 - RNA, 22 nt, Mycobacterium avium subsp. paratuberculosis
cagggcgguggcggcgaacgcg

SEQ ID NO: 901462 - RNA, 14 nt, Mycobacterium avium subsp. paratuberculosis
cagggcgaccgccg

SEQ ID NO: 901463 - RNA, 16 nt, Mycobacterium avium subsp. paratuberculosis
cagggcgaccgccgcg

SEQ ID NO: 901464 - RNA, 22 nt, Mycobacterium avium subsp. paratuberculosis
cagggcgaccgccgcguacagc

SEQ ID NO: 901465 - RNA, 21 nt, Mycobacterium avium subsp. paratuberculosis
cagggcgacgccgcggaagcc

SEQ ID NO: 901466 - RNA, 16 nt, Mycobacterium avium subsp. paratuberculosis
caggcucacgcugcca

SEQ ID NO: 901467 - RNA, 21 nt, Mycobacterium avium subsp. paratuberculosis
caggcucacguagucgaccgg

SEQ ID NO: 901468 - RNA, 22 nt, Mycobacterium avium subsp. paratuberculosis
caggcucaggaucagcagccgu

SEQ ID NO: 901469 - RNA, 17 nt, Mycobacterium avium subsp. paratuberculosis
caggcguggcccagccg

SEQ ID NO: 901470 - RNA, 14 nt, Mycobacterium avium subsp. paratuberculosis
caggcucagcagca

SEQ ID NO: 901471 - RNA, 16 nt, Mycobacterium avium subsp. paratuberculosis
caggcucagcagcacc

SEQ ID NO: 901472 - RNA, 17 nt, Mycobacterium avium subsp. paratuberculosis
caggcucagcagcaccg

SEQ ID NO: 901473 - RNA, 19 nt, Mycobacterium avium subsp. paratuberculosis
caggcucagcagcaccgca

SEQ ID NO: 901474 - RNA, 21 nt, Mycobacterium avium subsp. paratuberculosis
caggcucgcgagggcgggcca

SEQ ID NO: 901475 - RNA, 16 nt, Mycobacterium avium subsp. paratuberculosis
caggcuggcggcgauc

SEQ ID NO: 901476 - RNA, 19 nt, Mycobacterium avium subsp. paratuberculosis
caggcuggccagcucggcg

SEQ ID NO: 901477 - RNA, 17 nt, Mycobacterium avium subsp. paratuberculosis
caggcuggacaccacgu

SEQ ID NO: 901478 - RNA, 22 nt, Mycobacterium avium subsp. paratuberculosis
caggcuggcaucgucggcgccg

SEQ ID NO: 901479 - RNA, 14 nt, Mycobacterium avium subsp. paratuberculosis
caggcugcucggcg

SEQ ID NO: 901480 - RNA, 15 nt, Mycobacterium avium subsp. paratuberculosis
caggcugcucggcgg

SEQ ID NO: 901481 - RNA, 17 nt, Mycobacterium avium subsp. paratuberculosis
caggcugcucggcgggc

SEQ ID NO: 901482 - RNA, 21 nt, Mycobacterium avium subsp. paratuberculosis
caggcugccgcugcgccggcg

SEQ ID NO: 901483 - RNA, 15 nt, Mycobacterium avium subsp. paratuberculosis
caggcugaucucggc

SEQ ID NO: 901484 - RNA, 22 nt, Mycobacterium avium subsp. paratuberculosis
caggcugaucuggaugcggccc

SEQ ID NO: 901485 - RNA, 14 nt, Mycobacterium avium subsp. paratuberculosis
caggcugaccagcg

SEQ ID NO: 901486 - RNA, 20 nt, Mycobacterium avium subsp. paratuberculosis
caggcugaccagcgccucgc

SEQ ID NO: 901487 - RNA, 16 nt, Mycobacterium avium subsp. paratuberculosis
caggcugacgccacgc

SEQ ID NO: 901488 - RNA, 20 nt, Mycobacterium avium subsp. paratuberculosis
caggcugacgccacgcguca

SEQ ID NO: 901489 - RNA, 18 nt, Mycobacterium avium subsp. paratuberculosis
caggcugacgcgaccgcg

SEQ ID NO: 901490 - RNA, 20 nt, Mycobacterium avium subsp. paratuberculosis
caggcugacgcgaccgcgcg

SEQ ID NO: 901491 - RNA, 21 nt, Mycobacterium avium subsp. paratuberculosis
caggcugacgcgaccgcgcgg

SEQ ID NO: 901492 - RNA, 21 nt, Mycobacterium avium subsp. paratuberculosis
caggcgucggucagcaggcgc

SEQ ID NO: 901493 - RNA, 15 nt, Mycobacterium avium subsp. paratuberculosis
caggcgugcgcgugg

SEQ ID NO: 901494 - RNA, 12 nt, Mycobacterium avium subsp. paratuberculosis
caggcggcgacg

SEQ ID NO: 901495 - RNA, 21 nt, Mycobacterium avium subsp. paratuberculosis
caggcgucgucgucgagccgc

SEQ ID NO: 901496 - RNA, 18 nt, Mycobacterium avium subsp. paratuberculosis
caggcguggucggcgcgg

SEQ ID NO: 901497 - RNA, 19 nt, Mycobacterium avium subsp. paratuberculosis
caggcguggucggcgcggu

SEQ ID NO: 901498 - RNA, 16 nt, Mycobacterium avium subsp. paratuberculosis
caggcguugcaccgcg

SEQ ID NO: 901499 - RNA, 22 nt, Mycobacterium avium subsp. paratuberculosis
caggcguuggucaccaucagcg

SEQ ID NO: 901500 - RNA, 23 nt, Mycobacterium avium subsp. paratuberculosis
caggcguuggucaccaucagcgg

SEQ ID NO: 901501 - RNA, 17 nt, Mycobacterium avium subsp. paratuberculosis
caggcgguuucaccgag

SEQ ID NO: 901502 - RNA, 17 nt, Mycobacterium avium subsp. paratuberculosis
caggcguccagccagcg

SEQ ID NO: 901503 - RNA, 19 nt, Mycobacterium avium subsp. paratuberculosis
caggcguccagggccaccg

SEQ ID NO: 901504 - RNA, 16 nt, Mycobacterium avium subsp. paratuberculosis
caggcgguggccgaac

SEQ ID NO: 901505 - RNA, 21 nt, Mycobacterium avium subsp. paratuberculosis
caggcgguggccgaaccgcuc

SEQ ID NO: 901506 - RNA, 12 nt, Mycobacterium avium subsp. paratuberculosis
caggcgguccga

SEQ ID NO: 901507 - RNA, 16 nt, Mycobacterium avium subsp. paratuberculosis
caggcgguccgacacc

SEQ ID NO: 901508 - RNA, 14 nt, Mycobacterium avium subsp. paratuberculosis
caggcgggccacca

SEQ ID NO: 901509 - RNA, 17 nt, Mycobacterium avium subsp. paratuberculosis
caggcgaucucgccgaa

SEQ ID NO: 901510 - RNA, 14 nt, Mycobacterium avium subsp. paratuberculosis
caggcgaugccgcc

SEQ ID NO: 901511 - RNA, 15 nt, Mycobacterium avium subsp. paratuberculosis
caggcgaugccgccg

SEQ ID NO: 901512 - RNA, 23 nt, Mycobacterium avium subsp. paratuberculosis
caggcgacuguccaggccgaggc

SEQ ID NO: 901513 - RNA, 14 nt, Mycobacterium avium subsp. paratuberculosis
caggcgagccgaca

SEQ ID NO: 901514 - RNA, 13 nt, Mycobacterium avium subsp. paratuberculosis
caggcgagccggu

SEQ ID NO: 901515 - RNA, 18 nt, Mycobacterium avium subsp. paratuberculosis
caggcgaguuaugccguc

SEQ ID NO: 901516 - RNA, 20 nt, Mycobacterium avium subsp. paratuberculosis
caggcgaguuaugccgucac

SEQ ID NO: 901517 - RNA, 14 nt, Mycobacterium avium subsp. paratuberculosis
caggcgccgcagca

SEQ ID NO: 901518 - RNA, 16 nt, Mycobacterium avium subsp. paratuberculosis
caggcgcccugcacga

SEQ ID NO: 901519 - RNA, 18 nt, Mycobacterium avium subsp. paratuberculosis
caggcgcccugcacgaac

SEQ ID NO: 901520 - RNA, 23 nt, Mycobacterium avium subsp. paratuberculosis
caggcgcccugcacgaacaacug

SEQ ID NO: 901521 - RNA, 15 nt, Mycobacterium avium subsp. paratuberculosis
caggcgcccaggauc

SEQ ID NO: 901522 - RNA, 17 nt, Mycobacterium avium subsp. paratuberculosis
caggcgauggcgucggc

SEQ ID NO: 901523 - RNA, 17 nt, Mycobacterium avium subsp. paratuberculosis
caggcgccacagcagca

SEQ ID NO: 901524 - RNA, 21 nt, Mycobacterium avium subsp. paratuberculosis
caggcgccacagcagcaccag

SEQ ID NO: 901525 - RNA, 17 nt, Mycobacterium avium subsp. paratuberculosis
caggccguuguccgucg

SEQ ID NO: 901526 - RNA, 16 nt, Mycobacterium avium subsp. paratuberculosis
caggcgaaucggcgca

SEQ ID NO: 901527 - RNA, 16 nt, Mycobacterium avium subsp. paratuberculosis
caggccguuguggcca

SEQ ID NO: 901528 - RNA, 22 nt, Mycobacterium avium subsp. paratuberculosis
caggcgaaguuggucaccacca

SEQ ID NO: 901529 - RNA, 13 nt, Mycobacterium avium subsp. paratuberculosis
caggccgucucga

SEQ ID NO: 901530 - RNA, 23 nt, Mycobacterium avium subsp. paratuberculosis
caggccgugcacgaacaggguga

SEQ ID NO: 901531 - RNA, 14 nt, Mycobacterium avium subsp. paratuberculosis
caggccgucggcgc

SEQ ID NO: 901532 - RNA, 17 nt, Mycobacterium avium subsp. paratuberculosis
caggccgucggcgcggc

SEQ ID NO: 901533 - RNA, 15 nt, Mycobacterium avium subsp. paratuberculosis
caggccguagcggcu

SEQ ID NO: 901534 - RNA, 16 nt, Mycobacterium avium subsp. paratuberculosis
caggccguagcggcuc

SEQ ID NO: 901535 - RNA, 19 nt, Mycobacterium avium subsp. paratuberculosis
caggccgucgaggcgcugc

SEQ ID NO: 901536 - RNA, 17 nt, Mycobacterium avium subsp. paratuberculosis
caggccgaggcugacga

SEQ ID NO: 901537 - RNA, 16 nt, Mycobacterium avium subsp. paratuberculosis
caggccguccaccaga

SEQ ID NO: 901538 - RNA, 16 nt, Mycobacterium avium subsp. paratuberculosis
caggccguccagcagc

SEQ ID NO: 901539 - RNA, 17 nt, Mycobacterium avium subsp. paratuberculosis
caggccguccagcagca

SEQ ID NO: 901540 - RNA, 19 nt, Mycobacterium avium subsp. paratuberculosis
caggccguccagcagcagc

SEQ ID NO: 901541 - RNA, 20 nt, Mycobacterium avium subsp. paratuberculosis
caggccguccagcagcagcg

SEQ ID NO: 901542 - RNA, 14 nt, Mycobacterium avium subsp. paratuberculosis
caggcgccggccag

SEQ ID NO: 901543 - RNA, 16 nt, Mycobacterium avium subsp. paratuberculosis
caggcgccgucgaugg

SEQ ID NO: 901544 - RNA, 22 nt, Mycobacterium avium subsp. paratuberculosis
caggcgccgucgauggcgcggc

SEQ ID NO: 901545 - RNA, 16 nt, Mycobacterium avium subsp. paratuberculosis
caggcggcgcgcagcc

SEQ ID NO: 901546 - RNA, 20 nt, Mycobacterium avium subsp. paratuberculosis
caggcggcgcgcagccggcc

SEQ ID NO: 901547 - RNA, 16 nt, Mycobacterium avium subsp. paratuberculosis
caggcggccagcacca

SEQ ID NO: 901548 - RNA, 12 nt, Mycobacterium avium subsp. paratuberculosis
caggcggccagc

SEQ ID NO: 901549 - RNA, 18 nt, Mycobacterium avium subsp. paratuberculosis
caggcggaccugggugcg

SEQ ID NO: 901550 - RNA, 17 nt, Mycobacterium avium subsp. paratuberculosis
caggcggacggcgaccu

SEQ ID NO: 901551 - RNA, 16 nt, Mycobacterium avium subsp. paratuberculosis
caggccggcagccggc

SEQ ID NO: 901552 - RNA, 17 nt, Mycobacterium avium subsp. paratuberculosis
caggccggcagccggcg

SEQ ID NO: 901553 - RNA, 20 nt, Mycobacterium avium subsp. paratuberculosis
caggccggcagccggcgcgg

SEQ ID NO: 901554 - RNA, 12 nt, Mycobacterium avium subsp. paratuberculosis
caggccggccgc

SEQ ID NO: 901555 - RNA, 20 nt, Mycobacterium avium subsp. paratuberculosis
caggccgaguauccgcgcag

SEQ ID NO: 901556 - RNA, 21 nt, Mycobacterium avium subsp. paratuberculosis
caggccgaguauccgcgcagc

SEQ ID NO: 901557 - RNA, 13 nt, Mycobacterium avium subsp. paratuberculosis
caggccgaggcca

SEQ ID NO: 901558 - RNA, 16 nt, Mycobacterium avium subsp. paratuberculosis
caggccgacgccggcc

SEQ ID NO: 901559 - RNA, 14 nt, Mycobacterium avium subsp. paratuberculosis
caggccgacgcugg

SEQ ID NO: 901560 - RNA, 17 nt, Mycobacterium avium subsp. paratuberculosis
caggccggugcugucca

SEQ ID NO: 901561 - RNA, 22 nt, Mycobacterium avium subsp. paratuberculosis
caggccggugcuguccacaucg

SEQ ID NO: 901562 - RNA, 22 nt, Mycobacterium avium subsp. paratuberculosis
caggccggcgguggugccgccg

SEQ ID NO: 901563 - RNA, 16 nt, Mycobacterium avium subsp. paratuberculosis
caggccggucacccag

SEQ ID NO: 901564 - RNA, 15 nt, Mycobacterium avium subsp. paratuberculosis
caggccggucagcga

SEQ ID NO: 901565 - RNA, 16 nt, Mycobacterium avium subsp. paratuberculosis
caggccggucagcgac

SEQ ID NO: 901566 - RNA, 17 nt, Mycobacterium avium subsp. paratuberculosis
caggccggucagcgacg

SEQ ID NO: 901567 - RNA, 17 nt, Mycobacterium avium subsp. paratuberculosis
caggccggcgccgcggg

SEQ ID NO: 901568 - RNA, 22 nt, Mycobacterium avium subsp. paratuberculosis
caggccgggaaugucgcgcagc

SEQ ID NO: 901569 - RNA, 23 nt, Mycobacterium avium subsp. paratuberculosis
caggccgggaaugucgcgcagca

SEQ ID NO: 901570 - RNA, 20 nt, Mycobacterium avium subsp. paratuberculosis
caggccgggauagagcaccg

SEQ ID NO: 901571 - RNA, 21 nt, Mycobacterium avium subsp. paratuberculosis
caggccgggauagagcaccgc

SEQ ID NO: 901572 - RNA, 23 nt, Mycobacterium avium subsp. paratuberculosis
caggccgggauagagcaccgcgc

SEQ ID NO: 901573 - RNA, 14 nt, Mycobacterium avium subsp. paratuberculosis
caggccggccgcua

SEQ ID NO: 901574 - RNA, 16 nt, Mycobacterium avium subsp. paratuberculosis
caggccggcgacgccg

SEQ ID NO: 901575 - RNA, 17 nt, Mycobacterium avium subsp. paratuberculosis
caggccggcgacgccgg

SEQ ID NO: 901576 - RNA, 20 nt, Mycobacterium avium subsp. paratuberculosis
caggccggcgacgccggcga

SEQ ID NO: 901577 - RNA, 16 nt, Mycobacterium avium subsp. paratuberculosis
caggccggcgacggcg

SEQ ID NO: 901578 - RNA, 17 nt, Mycobacterium avium subsp. paratuberculosis
caggccggcgacggcga

SEQ ID NO: 901579 - RNA, 23 nt, Mycobacterium avium subsp. paratuberculosis
caggccggcgacggcgaguucga

SEQ ID NO: 901580 - RNA, 13 nt, Mycobacterium avium subsp. paratuberculosis
caggcccgcgccg

SEQ ID NO: 901581 - RNA, 14 nt, Mycobacterium avium subsp. paratuberculosis
caggcccgcgccga

SEQ ID NO: 901582 - RNA, 14 nt, Mycobacterium avium subsp. paratuberculosis
caggcccgggcggc

SEQ ID NO: 901583 - RNA, 20 nt, Mycobacterium avium subsp. paratuberculosis
caggcccgggcggcgagucc

SEQ ID NO: 901584 - RNA, 17 nt, Mycobacterium avium subsp. paratuberculosis
caggcccucggccagcc

SEQ ID NO: 901585 - RNA, 23 nt, Mycobacterium avium subsp. paratuberculosis
caggcccuccugggugaguucgu

SEQ ID NO: 901586 - RNA, 15 nt, Mycobacterium avium subsp. paratuberculosis
caggcccucgccgcg

SEQ ID NO: 901587 - RNA, 19 nt, Mycobacterium avium subsp. paratuberculosis
caggcccucgccgcgguca

SEQ ID NO: 901588 - RNA, 14 nt, Mycobacterium avium subsp. paratuberculosis
caggcccucgucgg

SEQ ID NO: 901589 - RNA, 17 nt, Mycobacterium avium subsp. paratuberculosis
caggcccugcccgaagc

SEQ ID NO: 901590 - RNA, 12 nt, Mycobacterium avium subsp. paratuberculosis
caggcccgggcg

SEQ ID NO: 901591 - RNA, 15 nt, Mycobacterium avium subsp. paratuberculosis
caggcccggcaccgg

SEQ ID NO: 901592 - RNA, 17 nt, Mycobacterium avium subsp. paratuberculosis
caggcccggcaccggug

SEQ ID NO: 901593 - RNA, 18 nt, Mycobacterium avium subsp. paratuberculosis
caggcccggcaccggugc

SEQ ID NO: 901594 - RNA, 13 nt, Mycobacterium avium subsp. paratuberculosis
caggcccggcacc

SEQ ID NO: 901595 - RNA, 18 nt, Mycobacterium avium subsp. paratuberculosis
caggcccgagcccgacgg

SEQ ID NO: 901596 - RNA, 23 nt, Mycobacterium avium subsp. paratuberculosis
caggcccgagcccgacggcagca

SEQ ID NO: 901597 - RNA, 13 nt, Mycobacterium avium subsp. paratuberculosis
caggcacagcagg

SEQ ID NO: 901598 - RNA, 19 nt, Mycobacterium avium subsp. paratuberculosis
caggcacagcagggcaccg

SEQ ID NO: 901599 - RNA, 17 nt, Mycobacterium avium subsp. paratuberculosis
caggcccagcagcaccg

SEQ ID NO: 901600 - RNA, 20 nt, Mycobacterium avium subsp. paratuberculosis
caggcccagcagcaccgcga

SEQ ID NO: 901601 - RNA, 14 nt, Mycobacterium avium subsp. paratuberculosis
caggcccagcagcg

SEQ ID NO: 901602 - RNA, 20 nt, Mycobacterium avium subsp. paratuberculosis
caggcccagcagcgcaccgg

SEQ ID NO: 901603 - RNA, 16 nt, Mycobacterium avium subsp. paratuberculosis
caggccccacccgcag

SEQ ID NO: 901604 - RNA, 15 nt, Mycobacterium avium subsp. paratuberculosis
caggcccaggcgacc

SEQ ID NO: 901605 - RNA, 13 nt, Mycobacterium avium subsp. paratuberculosis
caggcccaggccg

SEQ ID NO: 901606 - RNA, 19 nt, Mycobacterium avium subsp. paratuberculosis
caggcccaggccgacgccg

SEQ ID NO: 901607 - RNA, 15 nt, Mycobacterium avium subsp. paratuberculosis
caggcccagcccggc

SEQ ID NO: 901608 - RNA, 13 nt, Mycobacterium avium subsp. paratuberculosis
caggcccagccca

SEQ ID NO: 901609 - RNA, 13 nt, Mycobacterium avium subsp. paratuberculosis
cagcaaaccgacc

SEQ ID NO: 901610 - RNA, 15 nt, Mycobacterium avium subsp. paratuberculosis
cagcaaaccgaccgc

SEQ ID NO: 901611 - RNA, 19 nt, Mycobacterium avium subsp. paratuberculosis
cagcaaaccgaccgccgcg

SEQ ID NO: 901612 - RNA, 14 nt, Mycobacterium avium subsp. paratuberculosis
cagcaacagcagcg

SEQ ID NO: 901613 - RNA, 22 nt, Mycobacterium avium subsp. paratuberculosis
cagcaacaccuuucggccgcgg

SEQ ID NO: 901614 - RNA, 22 nt, Mycobacterium avium subsp. paratuberculosis
cagaucggcgggugcgggcgcu

SEQ ID NO: 901615 - RNA, 19 nt, Mycobacterium avium subsp. paratuberculosis
cagaucguccaucgcgucg

SEQ ID NO: 901616 - RNA, 14 nt, Mycobacterium avium subsp. paratuberculosis
cagaucgucggcac

SEQ ID NO: 901617 - RNA, 20 nt, Mycobacterium avium subsp. paratuberculosis
cagaucgucggcacugcccg

SEQ ID NO: 901618 - RNA, 21 nt, Mycobacterium avium subsp. paratuberculosis
cagaucgucggcacugcccgc

SEQ ID NO: 901619 - RNA, 15 nt, Mycobacterium avium subsp. paratuberculosis
cagaucugucuucgc

SEQ ID NO: 901620 - RNA, 24 nt, Mycobacterium avium subsp. paratuberculosis
cagaugaccggccugcagcgcggu

SEQ ID NO: 901621 - RNA, 19 nt, Mycobacterium avium subsp. paratuberculosis
cagaugcccgccccgcccg

SEQ ID NO: 901622 - RNA, 21 nt, Mycobacterium avium subsp. paratuberculosis
cagaugcccgccccgcccggc

SEQ ID NO: 901623 - RNA, 22 nt, Mycobacterium avium subsp. paratuberculosis
cagaugcccgccccgcccggcg

SEQ ID NO: 901624 - RNA, 23 nt, Mycobacterium avium subsp. paratuberculosis
cagaugcccgccccgcccggcgg

SEQ ID NO: 901625 - RNA, 15 nt, Mycobacterium avium subsp. paratuberculosis
cagaugccgccgcca

SEQ ID NO: 901626 - RNA, 18 nt, Mycobacterium avium subsp. paratuberculosis
cagaugccgccgccagcg

SEQ ID NO: 901627 - RNA, 19 nt, Mycobacterium avium subsp. paratuberculosis
cagaugccgccgccagcgc

SEQ ID NO: 901628 - RNA, 20 nt, Mycobacterium avium subsp. paratuberculosis
cagaugccgccgccagcgcg

SEQ ID NO: 901629 - RNA, 16 nt, Mycobacterium avium subsp. paratuberculosis
cagaugccgcucggcg

SEQ ID NO: 901630 - RNA, 17 nt, Mycobacterium avium subsp. paratuberculosis
cagaugccgcucggcgc

SEQ ID NO: 901631 - RNA, 21 nt, Mycobacterium avium subsp. paratuberculosis
cagaugccgcucggcgcucca

SEQ ID NO: 901632 - RNA, 13 nt, Mycobacterium avium subsp. paratuberculosis
cagaugccggcgu

SEQ ID NO: 901633 - RNA, 12 nt, Mycobacterium avium subsp. paratuberculosis
cagauugcggcc

SEQ ID NO: 901634 - RNA, 20 nt, Mycobacterium avium subsp. paratuberculosis
cagaucggccagccacgccg

SEQ ID NO: 901635 - RNA, 16 nt, Mycobacterium avium subsp. paratuberculosis
cagaucggccagcgcg

SEQ ID NO: 901636 - RNA, 18 nt, Mycobacterium avium subsp. paratuberculosis
cagaucggccagcgcggc

SEQ ID NO: 901637 - RNA, 21 nt, Mycobacterium avium subsp. paratuberculosis
cagaucggccagcgcggccgg

SEQ ID NO: 901638 - RNA, 23 nt, Mycobacterium avium subsp. paratuberculosis
cagaucggccagguugucgucgg

SEQ ID NO: 901639 - RNA, 19 nt, Mycobacterium avium subsp. paratuberculosis
cagaucguagggcucggcg

SEQ ID NO: 901640 - RNA, 21 nt, Mycobacterium avium subsp. paratuberculosis
cagaucguagggcucggcguc

SEQ ID NO: 901641 - RNA, 13 nt, Mycobacterium avium subsp. paratuberculosis
cagaucgccuggc

SEQ ID NO: 901642 - RNA, 16 nt, Mycobacterium avium subsp. paratuberculosis
cagaucgccuggcagc

SEQ ID NO: 901643 - RNA, 21 nt, Mycobacterium avium subsp. paratuberculosis
cagaucgcgcaucacccggcg

SEQ ID NO: 901644 - RNA, 14 nt, Mycobacterium avium subsp. paratuberculosis
cagaucgcggcccg

SEQ ID NO: 901645 - RNA, 21 nt, Mycobacterium avium subsp. paratuberculosis
cagaucgcggcccgccgcuca

SEQ ID NO: 901646 - RNA, 17 nt, Mycobacterium avium subsp. paratuberculosis
cagaucgcccgggcggc

SEQ ID NO: 901647 - RNA, 18 nt, Mycobacterium avium subsp. paratuberculosis
cagaucgcccgggcggcg

SEQ ID NO: 901648 - RNA, 19 nt, Mycobacterium avium subsp. paratuberculosis
cagaucgcccgggcggcgg

SEQ ID NO: 901649 - RNA, 22 nt, Mycobacterium avium subsp. paratuberculosis
cagaucgccgcccaucggcagc

SEQ ID NO: 901650 - RNA, 19 nt, Mycobacterium avium subsp. paratuberculosis
cagaucgcgguccaccaga

SEQ ID NO: 901651 - RNA, 20 nt, Mycobacterium avium subsp. paratuberculosis
cagauccucgaauccgcggg

SEQ ID NO: 901652 - RNA, 13 nt, Mycobacterium avium subsp. paratuberculosis
cagaucgccagca

SEQ ID NO: 901653 - RNA, 16 nt, Mycobacterium avium subsp. paratuberculosis
cagaucgccagcaccg

SEQ ID NO: 901654 - RNA, 17 nt, Mycobacterium avium subsp. paratuberculosis
cagaucgccagcaccgg

SEQ ID NO: 901655 - RNA, 20 nt, Mycobacterium avium subsp. paratuberculosis
cagaucgacccccaccgcga

SEQ ID NO: 901656 - RNA, 22 nt, Mycobacterium avium subsp. paratuberculosis
cagaucgacccccaccgcgaca

SEQ ID NO: 901657 - RNA, 15 nt, Mycobacterium avium subsp. paratuberculosis
cagaucgacgccgcg

SEQ ID NO: 901658 - RNA, 17 nt, Mycobacterium avium subsp. paratuberculosis
cagaucgacgccgcggu

SEQ ID NO: 901659 - RNA, 23 nt, Mycobacterium avium subsp. paratuberculosis
cagaucgacgccgcgguggccgg

SEQ ID NO: 901660 - RNA, 17 nt, Mycobacterium avium subsp. paratuberculosis
cagaucgauggggaugg

SEQ ID NO: 901661 - RNA, 15 nt, Mycobacterium avium subsp. paratuberculosis
cagaucccgccggcg

SEQ ID NO: 901662 - RNA, 18 nt, Mycobacterium avium subsp. paratuberculosis
cagaucccgccggcggcc

SEQ ID NO: 901663 - RNA, 19 nt, Mycobacterium avium subsp. paratuberculosis
cagaucccgccggcggcca

SEQ ID NO: 901664 - RNA, 21 nt, Mycobacterium avium subsp. paratuberculosis
cagagcccgaacacgggcggc

SEQ ID NO: 901665 - RNA, 13 nt, Mycobacterium avium subsp. paratuberculosis
cagagcagcgccu

SEQ ID NO: 901666 - RNA, 21 nt, Mycobacterium avium subsp. paratuberculosis
cagagcgcgaaaaccagcacc

SEQ ID NO: 901667 - RNA, 22 nt, Mycobacterium avium subsp. paratuberculosis
cagagcgcgaaaaccagcaccg

SEQ ID NO: 901668 - RNA, 23 nt, Mycobacterium avium subsp. paratuberculosis
cagagcgcgaaaaccagcaccgg

SEQ ID NO: 901669 - RNA, 23 nt, Mycobacterium avium subsp. paratuberculosis
cagagcugcugaugcggacacca

SEQ ID NO: 901670 - RNA, 20 nt, Mycobacterium avium subsp. paratuberculosis
cagagcggugacaucgccac

SEQ ID NO: 901671 - RNA, 21 nt, Mycobacterium avium subsp. paratuberculosis
cagagcggugacaucgccacc

SEQ ID NO: 901672 - RNA, 13 nt, Mycobacterium avium subsp. paratuberculosis
cagagcgggccga

SEQ ID NO: 901673 - RNA, 15 nt, Mycobacterium avium subsp. paratuberculosis
cagagcgggccgacc

SEQ ID NO: 901674 - RNA, 19 nt, Mycobacterium avium subsp. paratuberculosis
cagagcgggccgaccguca

SEQ ID NO: 901675 - RNA, 14 nt, Mycobacterium avium subsp. paratuberculosis
cagacucacggcgg

SEQ ID NO: 901676 - RNA, 16 nt, Mycobacterium avium subsp. paratuberculosis
cagacucacggcggca

SEQ ID NO: 901677 - RNA, 13 nt, Mycobacterium avium subsp. paratuberculosis
cagacucagcccg

SEQ ID NO: 901678 - RNA, 20 nt, Mycobacterium avium subsp. paratuberculosis
cagacugaugaagccgccga

SEQ ID NO: 901679 - RNA, 17 nt, Mycobacterium avium subsp. paratuberculosis
cagacugaugcccucgc

SEQ ID NO: 901680 - RNA, 12 nt, Mycobacterium avium subsp. paratuberculosis
cagacugccgag

SEQ ID NO: 901681 - RNA, 20 nt, Mycobacterium avium subsp. paratuberculosis
cagacugcgcaccgccagca

SEQ ID NO: 901682 - RNA, 21 nt, Mycobacterium avium subsp. paratuberculosis
cagacugcgcaccgccagcac

SEQ ID NO: 901683 - RNA, 21 nt, Mycobacterium avium subsp. paratuberculosis
cagacgugacgugccccucga

SEQ ID NO: 901684 - RNA, 21 nt, Mycobacterium avium subsp. paratuberculosis
cagacguguggcacccgggug

SEQ ID NO: 901685 - RNA, 15 nt, Mycobacterium avium subsp. paratuberculosis
cagacguccagcgcc

SEQ ID NO: 901686 - RNA, 13 nt, Mycobacterium avium subsp. paratuberculosis
cagacgucggcgu

SEQ ID NO: 901687 - RNA, 23 nt, Mycobacterium avium subsp. paratuberculosis
cagacgucggcguacugcgcgac

SEQ ID NO: 901688 - RNA, 22 nt, Mycobacterium avium subsp. paratuberculosis
cagacguuuccguccggcgaca

SEQ ID NO: 901689 - RNA, 20 nt, Mycobacterium avium subsp. paratuberculosis
cagacggacacccgcgcggu

SEQ ID NO: 901690 - RNA, 19 nt, Mycobacterium avium subsp. paratuberculosis
cagacgguuccaccggucg

SEQ ID NO: 901691 - RNA, 21 nt, Mycobacterium avium subsp. paratuberculosis
cagacgguuccaccggucgga

SEQ ID NO: 901692 - RNA, 18 nt, Mycobacterium avium subsp. paratuberculosis
cagacguagcaccagucg

SEQ ID NO: 901693 - RNA, 20 nt, Mycobacterium avium subsp. paratuberculosis
cagacguagcaccagucggc

SEQ ID NO: 901694 - RNA, 22 nt, Mycobacterium avium subsp. paratuberculosis
cagacguagcaccagucggcca

SEQ ID NO: 901695 - RNA, 16 nt, Mycobacterium avium subsp. paratuberculosis
cagacggucuuggcgu

SEQ ID NO: 901696 - RNA, 17 nt, Mycobacterium avium subsp. paratuberculosis
cagacgguggggcuggc

SEQ ID NO: 901697 - RNA, 18 nt, Mycobacterium avium subsp. paratuberculosis
cagacgguaugcccgccg

SEQ ID NO: 901698 - RNA, 19 nt, Mycobacterium avium subsp. paratuberculosis
cagacgguaugcccgccgc

SEQ ID NO: 901699 - RNA, 22 nt, Mycobacterium avium subsp. paratuberculosis
cagacgguaugcccgccgcguc

SEQ ID NO: 901700 - RNA, 14 nt, Mycobacterium avium subsp. paratuberculosis
cacucccgcgcgcu

SEQ ID NO: 901701 - RNA, 17 nt, Mycobacterium avium subsp. paratuberculosis
cacucccagccgccggc

SEQ ID NO: 901702 - RNA, 23 nt, Mycobacterium avium subsp. paratuberculosis
cacucccuuguugccgaguaccg

SEQ ID NO: 901703 - RNA, 14 nt, Mycobacterium avium subsp. paratuberculosis
cacuccagcggcgg

SEQ ID NO: 901704 - RNA, 17 nt, Mycobacterium avium subsp. paratuberculosis
cacuccagcggcggccc

SEQ ID NO: 901705 - RNA, 20 nt, Mycobacterium avium subsp. paratuberculosis
cacuccaggguucucgcggc

SEQ ID NO: 901706 - RNA, 22 nt, Mycobacterium avium subsp. paratuberculosis
cacuccaggguucucgcggcgg

SEQ ID NO: 901707 - RNA, 18 nt, Mycobacterium avium subsp. paratuberculosis
cacuccaccaccggccgc

SEQ ID NO: 901708 - RNA, 20 nt, Mycobacterium avium subsp. paratuberculosis
cacuccaccaccggccgcgc

SEQ ID NO: 901709 - RNA, 14 nt, Mycobacterium avium subsp. paratuberculosis
cacucgcgggacgg

SEQ ID NO: 901710 - RNA, 17 nt, Mycobacterium avium subsp. paratuberculosis
cacucgcgggacggcgg

SEQ ID NO: 901711 - RNA, 21 nt, Mycobacterium avium subsp. paratuberculosis
cacucggacagguggccgauc

SEQ ID NO: 901712 - RNA, 21 nt, Mycobacterium avium subsp. paratuberculosis
cacucggccaccaugucggcg

SEQ ID NO: 901713 - RNA, 23 nt, Mycobacterium avium subsp. paratuberculosis
cacucgggaaaugcgucggcagu

SEQ ID NO: 901714 - RNA, 12 nt, Mycobacterium avium subsp. paratuberculosis
cacucgucgauc

SEQ ID NO: 901715 - RNA, 13 nt, Mycobacterium avium subsp. paratuberculosis
cacucggcgaugc

SEQ ID NO: 901716 - RNA, 15 nt, Mycobacterium avium subsp. paratuberculosis
cacucggcgaugcgc

SEQ ID NO: 901717 - RNA, 15 nt, Mycobacterium avium subsp. paratuberculosis
cacucgggccagccc

SEQ ID NO: 901718 - RNA, 16 nt, Mycobacterium avium subsp. paratuberculosis
cacucgggccagccca

SEQ ID NO: 901719 - RNA, 16 nt, Mycobacterium avium subsp. paratuberculosis
cacucggucaccggug

SEQ ID NO: 901720 - RNA, 19 nt, Mycobacterium avium subsp. paratuberculosis
cacuucgccgggcuggccg

SEQ ID NO: 901721 - RNA, 19 nt, Mycobacterium avium subsp. paratuberculosis
cacucucgcggcaaggcgc

SEQ ID NO: 901722 - RNA, 20 nt, Mycobacterium avium subsp. paratuberculosis
cacucgcguccccgcgccgg

SEQ ID NO: 901723 - RNA, 16 nt, Mycobacterium avium subsp. paratuberculosis
cacucgucgaucgacg

SEQ ID NO: 901724 - RNA, 19 nt, Mycobacterium avium subsp. paratuberculosis
cacucgucgaucgacgccg

SEQ ID NO: 901725 - RNA, 16 nt, Mycobacterium avium subsp. paratuberculosis
cacucgucgaugucga

SEQ ID NO: 901726 - RNA, 19 nt, Mycobacterium avium subsp. paratuberculosis
cacucgucgaugucgaucu

SEQ ID NO: 901727 - RNA, 15 nt, Mycobacterium avium subsp. paratuberculosis
cacucgucggcgguu

SEQ ID NO: 901728 - RNA, 15 nt, Mycobacterium avium subsp. paratuberculosis
cacucgucguggcgg

SEQ ID NO: 901729 - RNA, 18 nt, Mycobacterium avium subsp. paratuberculosis
cacucgucguggcggugc

SEQ ID NO: 901730 - RNA, 20 nt, Mycobacterium avium subsp. paratuberculosis
cagaaaagagaucgccccgc

SEQ ID NO: 901731 - RNA, 14 nt, Mycobacterium avium subsp. paratuberculosis
cagaaaaaggccgc

SEQ ID NO: 901732 - RNA, 20 nt, Mycobacterium avium subsp. paratuberculosis
cagaacgccaucaccagcgc

SEQ ID NO: 901733 - RNA, 23 nt, Mycobacterium avium subsp. paratuberculosis
cagaacgcgcggaugcccaggcc

SEQ ID NO: 901734 - RNA, 16 nt, Mycobacterium avium subsp. paratuberculosis
cagaacugggccgccg

SEQ ID NO: 901735 - RNA, 19 nt, Mycobacterium avium subsp. paratuberculosis
cagaacugggccgccgucg

SEQ ID NO: 901736 - RNA, 14 nt, Mycobacterium avium subsp. paratuberculosis
cagacacagcacgc

SEQ ID NO: 901737 - RNA, 21 nt, Mycobacterium avium subsp. paratuberculosis
cagaagaucugccggugccgc

SEQ ID NO: 901738 - RNA, 18 nt, Mycobacterium avium subsp. paratuberculosis
cagaccaggaccagguug

SEQ ID NO: 901739 - RNA, 17 nt, Mycobacterium avium subsp. paratuberculosis
cagaccccacaccuucg

SEQ ID NO: 901740 - RNA, 19 nt, Mycobacterium avium subsp. paratuberculosis
cagacccagcaucgccgcg

SEQ ID NO: 901741 - RNA, 21 nt, Mycobacterium avium subsp. paratuberculosis
cagacccagcaucgccgcggu

SEQ ID NO: 901742 - RNA, 15 nt, Mycobacterium avium subsp. paratuberculosis
cagaccagcccgucg

SEQ ID NO: 901743 - RNA, 17 nt, Mycobacterium avium subsp. paratuberculosis
cagaccccggcguccag

SEQ ID NO: 901744 - RNA, 17 nt, Mycobacterium avium subsp. paratuberculosis
cagaccccguaccagcg

SEQ ID NO: 901745 - RNA, 19 nt, Mycobacterium avium subsp. paratuberculosis
cagaccccguaccagcgcu

SEQ ID NO: 901746 - RNA, 16 nt, Mycobacterium avium subsp. paratuberculosis
cagacccccagcagcg

SEQ ID NO: 901747 - RNA, 18 nt, Mycobacterium avium subsp. paratuberculosis
cagacccccagcagcggg

SEQ ID NO: 901748 - RNA, 16 nt, Mycobacterium avium subsp. paratuberculosis
cagacccgacaguccg

SEQ ID NO: 901749 - RNA, 14 nt, Mycobacterium avium subsp. paratuberculosis
cagacccgacggga

SEQ ID NO: 901750 - RNA, 13 nt, Mycobacterium avium subsp. paratuberculosis
cagacccgccgcg

SEQ ID NO: 901751 - RNA, 15 nt, Mycobacterium avium subsp. paratuberculosis
cagacccgccgcggc

SEQ ID NO: 901752 - RNA, 13 nt, Mycobacterium avium subsp. paratuberculosis
cagacccgcgucg

SEQ ID NO: 901753 - RNA, 16 nt, Mycobacterium avium subsp. paratuberculosis
cagaccgaacccgggc

SEQ ID NO: 901754 - RNA, 20 nt, Mycobacterium avium subsp. paratuberculosis
cagaccgaacccgggcgcgc

SEQ ID NO: 901755 - RNA, 21 nt, Mycobacterium avium subsp. paratuberculosis
cagaccgaacgucacggcgag

SEQ ID NO: 901756 - RNA, 23 nt, Mycobacterium avium subsp. paratuberculosis
cagaccgaacgucacggcgagga

SEQ ID NO: 901757 - RNA, 20 nt, Mycobacterium avium subsp. paratuberculosis
cagaccgaagaucaccgcga

SEQ ID NO: 901758 - RNA, 21 nt, Mycobacterium avium subsp. paratuberculosis
cagaccacaagggccaccggg

SEQ ID NO: 901759 - RNA, 22 nt, Mycobacterium avium subsp. paratuberculosis
cagaccacaagggccaccgggc

SEQ ID NO: 901760 - RNA, 14 nt, Mycobacterium avium subsp. paratuberculosis
cagacaggccggcc

SEQ ID NO: 901761 - RNA, 19 nt, Mycobacterium avium subsp. paratuberculosis
cagacgcgaaagcacccga

SEQ ID NO: 901762 - RNA, 20 nt, Mycobacterium avium subsp. paratuberculosis
cagacgcgaaagcacccgac

SEQ ID NO: 901763 - RNA, 22 nt, Mycobacterium avium subsp. paratuberculosis
cagacgcgaaagcacccgacac

SEQ ID NO: 901764 - RNA, 21 nt, Mycobacterium avium subsp. paratuberculosis
cagacgaugggccgcccgcug

SEQ ID NO: 901765 - RNA, 20 nt, Mycobacterium avium subsp. paratuberculosis
cagacgaugucgucgccggu

SEQ ID NO: 901766 - RNA, 22 nt, Mycobacterium avium subsp. paratuberculosis
cagacgcaaaagccccgcgaca

SEQ ID NO: 901767 - RNA, 15 nt, Mycobacterium avium subsp. paratuberculosis
cagaccuucgcgauc

SEQ ID NO: 901768 - RNA, 16 nt, Mycobacterium avium subsp. paratuberculosis
cagacgaacgcggccg

SEQ ID NO: 901769 - RNA, 19 nt, Mycobacterium avium subsp. paratuberculosis
cagacgaacgcggccgcca

SEQ ID NO: 901770 - RNA, 22 nt, Mycobacterium avium subsp. paratuberculosis
cagacgaacgcggccgccagcg

SEQ ID NO: 901771 - RNA, 21 nt, Mycobacterium avium subsp. paratuberculosis
cagaccgcggcggucgccacu

SEQ ID NO: 901772 - RNA, 18 nt, Mycobacterium avium subsp. paratuberculosis
cagaccggcggcgaucgg

SEQ ID NO: 901773 - RNA, 20 nt, Mycobacterium avium subsp. paratuberculosis
cagaccggcggcgaucggcg

SEQ ID NO: 901774 - RNA, 21 nt, Mycobacterium avium subsp. paratuberculosis
cagaccggcggcgaucggcgc

SEQ ID NO: 901775 - RNA, 12 nt, Mycobacterium avium subsp. paratuberculosis
cagacccucguu

SEQ ID NO: 901776 - RNA, 17 nt, Mycobacterium avium subsp. paratuberculosis
cagaccggugagcaccg

SEQ ID NO: 901777 - RNA, 14 nt, Mycobacterium avium subsp. paratuberculosis
cagaccgguggcga

SEQ ID NO: 901778 - RNA, 17 nt, Mycobacterium avium subsp. paratuberculosis
cagaccgguugcggcga

SEQ ID NO: 901779 - RNA, 19 nt, Mycobacterium avium subsp. paratuberculosis
cagaccgguugcggcgaac

SEQ ID NO: 901780 - RNA, 20 nt, Mycobacterium avium subsp. paratuberculosis
cagaccguccgguucggcgg

SEQ ID NO: 901781 - RNA, 19 nt, Mycobacterium avium subsp. paratuberculosis
cagaccgugugccagcccg

SEQ ID NO: 901782 - RNA, 21 nt, Mycobacterium avium subsp. paratuberculosis
cagaccguucuccgaggcguc

SEQ ID NO: 901783 - RNA, 14 nt, Mycobacterium avium subsp. paratuberculosis
cacuacccgcgaug

SEQ ID NO: 901784 - RNA, 22 nt, Mycobacterium avium subsp. paratuberculosis
cacguuucggcccuccagcacc

SEQ ID NO: 901785 - RNA, 17 nt, Mycobacterium avium subsp. paratuberculosis
cacguugaugccgccca

SEQ ID NO: 901786 - RNA, 20 nt, Mycobacterium avium subsp. paratuberculosis
cacguugagcacgcccgcga

SEQ ID NO: 901787 - RNA, 19 nt, Mycobacterium avium subsp. paratuberculosis
cacguugagcccggaccgg

SEQ ID NO: 901788 - RNA, 20 nt, Mycobacterium avium subsp. paratuberculosis
cacguugagucccucggcga

SEQ ID NO: 901789 - RNA, 22 nt, Mycobacterium avium subsp. paratuberculosis
cacguugauccgaugcagggcc

SEQ ID NO: 901790 - RNA, 13 nt, Mycobacterium avium subsp. paratuberculosis
cacguuggcggcc

SEQ ID NO: 901791 - RNA, 18 nt, Mycobacterium avium subsp. paratuberculosis
cacguuggcggccagcgc

SEQ ID NO: 901792 - RNA, 21 nt, Mycobacterium avium subsp. paratuberculosis
cacguuggcggccagcgcgcc

SEQ ID NO: 901793 - RNA, 16 nt, Mycobacterium avium subsp. paratuberculosis
cacguugucgcggccc

SEQ ID NO: 901794 - RNA, 17 nt, Mycobacterium avium subsp. paratuberculosis
cacgucauuucggucgg

SEQ ID NO: 901795 - RNA, 21 nt, Mycobacterium avium subsp. paratuberculosis
cacguccuuggugacggccuc

SEQ ID NO: 901796 - RNA, 19 nt, Mycobacterium avium subsp. paratuberculosis
cacgucgaacccgaccccg

SEQ ID NO: 901797 - RNA, 15 nt, Mycobacterium avium subsp. paratuberculosis
cacgucgacacgccg

SEQ ID NO: 901798 - RNA, 18 nt, Mycobacterium avium subsp. paratuberculosis
cacgucgacacgccggcc

SEQ ID NO: 901799 - RNA, 13 nt, Mycobacterium avium subsp. paratuberculosis
cacgucgagcacc

SEQ ID NO: 901800 - RNA, 14 nt, Mycobacterium avium subsp. paratuberculosis
cacgucgacgccgg

SEQ ID NO: 901801 - RNA, 14 nt, Mycobacterium avium subsp. paratuberculosis
cacgucgacggccg

SEQ ID NO: 901802 - RNA, 20 nt, Mycobacterium avium subsp. paratuberculosis
cacgucgacggccgccgcga

SEQ ID NO: 901803 - RNA, 23 nt, Mycobacterium avium subsp. paratuberculosis
cacgucgacggccgccgcgacgc

SEQ ID NO: 901804 - RNA, 15 nt, Mycobacterium avium subsp. paratuberculosis
cacgugcccagcccg

SEQ ID NO: 901805 - RNA, 18 nt, Mycobacterium avium subsp. paratuberculosis
cacgugcccagcccgcgc

SEQ ID NO: 901806 - RNA, 16 nt, Mycobacterium avium subsp. paratuberculosis
cacgugcagcucggug

SEQ ID NO: 901807 - RNA, 17 nt, Mycobacterium avium subsp. paratuberculosis
cacgugcagcucggugc

SEQ ID NO: 901808 - RNA, 18 nt, Mycobacterium avium subsp. paratuberculosis
cacgugcaggugcggcac

SEQ ID NO: 901809 - RNA, 19 nt, Mycobacterium avium subsp. paratuberculosis
cacgucgaucacgccgccg

SEQ ID NO: 901810 - RNA, 21 nt, Mycobacterium avium subsp. paratuberculosis
cacgucgaucacgccgccggg

SEQ ID NO: 901811 - RNA, 13 nt, Mycobacterium avium subsp. paratuberculosis
cacgucgccgccg

SEQ ID NO: 901812 - RNA, 14 nt, Mycobacterium avium subsp. paratuberculosis
cacgugcacggcgc

SEQ ID NO: 901813 - RNA, 13 nt, Mycobacterium avium subsp. paratuberculosis
cacgucgcccagc

SEQ ID NO: 901814 - RNA, 14 nt, Mycobacterium avium subsp. paratuberculosis
cacgucgcccagcg

SEQ ID NO: 901815 - RNA, 13 nt, Mycobacterium avium subsp. paratuberculosis
cacgucgagcggc

SEQ ID NO: 901816 - RNA, 20 nt, Mycobacterium avium subsp. paratuberculosis
cacgucgagcggcccgucgc

SEQ ID NO: 901817 - RNA, 17 nt, Mycobacterium avium subsp. paratuberculosis
cacgucgaggucggacg

SEQ ID NO: 901818 - RNA, 13 nt, Mycobacterium avium subsp. paratuberculosis
cacgucgaguucc

SEQ ID NO: 901819 - RNA, 15 nt, Mycobacterium avium subsp. paratuberculosis
cacguucaccaccgg

SEQ ID NO: 901820 - RNA, 16 nt, Mycobacterium avium subsp. paratuberculosis
cacguucaccaccgga

SEQ ID NO: 901821 - RNA, 14 nt, Mycobacterium avium subsp. paratuberculosis
cacguucgcggucg

SEQ ID NO: 901822 - RNA, 14 nt, Mycobacterium avium subsp. paratuberculosis
cacguggucgagca

SEQ ID NO: 901823 - RNA, 14 nt, Mycobacterium avium subsp. paratuberculosis
cacguggucgcuga

SEQ ID NO: 901824 - RNA, 13 nt, Mycobacterium avium subsp. paratuberculosis
cacguggugaccg

SEQ ID NO: 901825 - RNA, 16 nt, Mycobacterium avium subsp. paratuberculosis
cacguguccgacgccg

SEQ ID NO: 901826 - RNA, 17 nt, Mycobacterium avium subsp. paratuberculosis
cacguguccgacgccgu

SEQ ID NO: 901827 - RNA, 19 nt, Mycobacterium avium subsp. paratuberculosis
cacguguucgggaucggcg

SEQ ID NO: 901828 - RNA, 23 nt, Mycobacterium avium subsp. paratuberculosis
cacguguucgggaucggcgccca

SEQ ID NO: 901829 - RNA, 23 nt, Mycobacterium avium subsp. paratuberculosis
cacguggcugaccgacggcgacc

SEQ ID NO: 901830 - RNA, 19 nt, Mycobacterium avium subsp. paratuberculosis
cacgugcggguuggcgccg

SEQ ID NO: 901831 - RNA, 13 nt, Mycobacterium avium subsp. paratuberculosis
cacguggccgggc

SEQ ID NO: 901832 - RNA, 15 nt, Mycobacterium avium subsp. paratuberculosis
cacgugccacuggcg

SEQ ID NO: 901833 - RNA, 18 nt, Mycobacterium avium subsp. paratuberculosis
cacgugccacuggcgcca

SEQ ID NO: 901834 - RNA, 13 nt, Mycobacterium avium subsp. paratuberculosis
cacgugcuggcgc

SEQ ID NO: 901835 - RNA, 15 nt, Mycobacterium avium subsp. paratuberculosis
cacguggaccgagcg

SEQ ID NO: 901836 - RNA, 16 nt, Mycobacterium avium subsp. paratuberculosis
cacguggaccgagcgc

SEQ ID NO: 901837 - RNA, 17 nt, Mycobacterium avium subsp. paratuberculosis
cacguggaccgagcgcg

SEQ ID NO: 901838 - RNA, 18 nt, Mycobacterium avium subsp. paratuberculosis
cacguggaccgagcgcgc

SEQ ID NO: 901839 - RNA, 12 nt, Mycobacterium avium subsp. paratuberculosis
cacgugcgcgcc

SEQ ID NO: 901840 - RNA, 14 nt, Mycobacterium avium subsp. paratuberculosis
cacgugcgcgccga

SEQ ID NO: 901841 - RNA, 16 nt, Mycobacterium avium subsp. paratuberculosis
cacgugcgcgccgacc

SEQ ID NO: 901842 - RNA, 17 nt, Mycobacterium avium subsp. paratuberculosis
cacgugcgcgccgaccg

SEQ ID NO: 901843 - RNA, 22 nt, Mycobacterium avium subsp. paratuberculosis
cacgugcgcgggaacgaucggc

SEQ ID NO: 901844 - RNA, 22 nt, Mycobacterium avium subsp. paratuberculosis
cacgugcggauggccccggcga

SEQ ID NO: 901845 - RNA, 12 nt, Mycobacterium avium subsp. paratuberculosis
cacgugcggcgc

SEQ ID NO: 901846 - RNA, 13 nt, Mycobacterium avium subsp. paratuberculosis
cacgugcggcgcc

SEQ ID NO: 901847 - RNA, 13 nt, Mycobacterium avium subsp. paratuberculosis
cacguacaccggg

SEQ ID NO: 901848 - RNA, 14 nt, Mycobacterium avium subsp. paratuberculosis
cacguacaccggga

SEQ ID NO: 901849 - RNA, 14 nt, Mycobacterium avium subsp. paratuberculosis
cacguacagcggcg

SEQ ID NO: 901850 - RNA, 18 nt, Mycobacterium avium subsp. paratuberculosis
cacguacagcggcggcca

SEQ ID NO: 901851 - RNA, 15 nt, Mycobacterium avium subsp. paratuberculosis
cacgguuucgccgua

SEQ ID NO: 901852 - RNA, 12 nt, Mycobacterium avium subsp. paratuberculosis
cacggucggccc

SEQ ID NO: 901853 - RNA, 18 nt, Mycobacterium avium subsp. paratuberculosis
cacggucggcguccagcg

SEQ ID NO: 901854 - RNA, 19 nt, Mycobacterium avium subsp. paratuberculosis
cacggucgcggugucggcg

SEQ ID NO: 901855 - RNA, 14 nt, Mycobacterium avium subsp. paratuberculosis
cacggucggagccc

SEQ ID NO: 901856 - RNA, 18 nt, Mycobacterium avium subsp. paratuberculosis
cacggucggagcccagcg

SEQ ID NO: 901857 - RNA, 12 nt, Mycobacterium avium subsp. paratuberculosis
cacggucgccgc

SEQ ID NO: 901858 - RNA, 16 nt, Mycobacterium avium subsp. paratuberculosis
cacggucgccgcgccg

SEQ ID NO: 901859 - RNA, 18 nt, Mycobacterium avium subsp. paratuberculosis
cacggucgccgcgccgcc

SEQ ID NO: 901860 - RNA, 20 nt, Mycobacterium avium subsp. paratuberculosis
cacggucgccgcgccgccgg

SEQ ID NO: 901861 - RNA, 16 nt, Mycobacterium avium subsp. paratuberculosis
cacguagcccagcgcg

SEQ ID NO: 901862 - RNA, 21 nt, Mycobacterium avium subsp. paratuberculosis
cacguagaaggcgccgucggu

SEQ ID NO: 901863 - RNA, 21 nt, Mycobacterium avium subsp. paratuberculosis
cacguagacggugucgcccuc

SEQ ID NO: 901864 - RNA, 18 nt, Mycobacterium avium subsp. paratuberculosis
cacguaccgguacagcga

SEQ ID NO: 901865 - RNA, 17 nt, Mycobacterium avium subsp. paratuberculosis
cacguacgcgcugauca

SEQ ID NO: 901866 - RNA, 22 nt, Mycobacterium avium subsp. paratuberculosis
cacguaggcgaucagcgcgcac

SEQ ID NO: 901867 - RNA, 15 nt, Mycobacterium avium subsp. paratuberculosis
cacguaggcggcgag

SEQ ID NO: 901868 - RNA, 16 nt, Mycobacterium avium subsp. paratuberculosis
cacguaggcggcgagc

SEQ ID NO: 901869 - RNA, 20 nt, Mycobacterium avium subsp. paratuberculosis
cacguagcagcagaccgcga

SEQ ID NO: 901870 - RNA, 15 nt, Mycobacterium avium subsp. paratuberculosis
cacguagcgcggccg

SEQ ID NO: 901871 - RNA, 14 nt, Mycobacterium avium subsp. paratuberculosis
cacguccaccagca

SEQ ID NO: 901872 - RNA, 16 nt, Mycobacterium avium subsp. paratuberculosis
cacguccaccagcacc

SEQ ID NO: 901873 - RNA, 17 nt, Mycobacterium avium subsp. paratuberculosis
cacguccacgccgcggg

SEQ ID NO: 901874 - RNA, 19 nt, Mycobacterium avium subsp. paratuberculosis
cacguccacgccgcgggag

SEQ ID NO: 901875 - RNA, 18 nt, Mycobacterium avium subsp. paratuberculosis
cacguaguccgacgaucc

SEQ ID NO: 901876 - RNA, 19 nt, Mycobacterium avium subsp. paratuberculosis
cacguagucgaccgggauc

SEQ ID NO: 901877 - RNA, 22 nt, Mycobacterium avium subsp. paratuberculosis
cacguagugcuucuugaagaac

SEQ ID NO: 901878 - RNA, 13 nt, Mycobacterium avium subsp. paratuberculosis
cacguagcgaucg

SEQ ID NO: 901879 - RNA, 23 nt, Mycobacterium avium subsp. paratuberculosis
cacguaucgcgccugcaccggcg

SEQ ID NO: 901880 - RNA, 13 nt, Mycobacterium avium subsp. paratuberculosis
cacgucaccgcgc

SEQ ID NO: 901881 - RNA, 17 nt, Mycobacterium avium subsp. paratuberculosis
cacgucaccgcugaugc

SEQ ID NO: 901882 - RNA, 19 nt, Mycobacterium avium subsp. paratuberculosis
cacggccugguacagcacc

SEQ ID NO: 901883 - RNA, 23 nt, Mycobacterium avium subsp. paratuberculosis
cacggccugguacagcaccgccg

SEQ ID NO: 901884 - RNA, 19 nt, Mycobacterium avium subsp. paratuberculosis
cacggccaggaagccggcg

SEQ ID NO: 901885 - RNA, 20 nt, Mycobacterium avium subsp. paratuberculosis
cacggccaggaagccggcga

SEQ ID NO: 901886 - RNA, 23 nt, Mycobacterium avium subsp. paratuberculosis
cacggccaggaagccggcgacga

SEQ ID NO: 901887 - RNA, 16 nt, Mycobacterium avium subsp. paratuberculosis
cacggccaccacggca

SEQ ID NO: 901888 - RNA, 22 nt, Mycobacterium avium subsp. paratuberculosis
cacggccaccacggcaccgccg

SEQ ID NO: 901889 - RNA, 16 nt, Mycobacterium avium subsp. paratuberculosis
cacggccagccagccg

SEQ ID NO: 901890 - RNA, 12 nt, Mycobacterium avium subsp. paratuberculosis
cacggccagcgc

SEQ ID NO: 901891 - RNA, 13 nt, Mycobacterium avium subsp. paratuberculosis
cacggccagcgcc

SEQ ID NO: 901892 - RNA, 15 nt, Mycobacterium avium subsp. paratuberculosis
cacggccagcaccgc

SEQ ID NO: 901893 - RNA, 19 nt, Mycobacterium avium subsp. paratuberculosis
cacggccacugccccggcg

SEQ ID NO: 901894 - RNA, 14 nt, Mycobacterium avium subsp. paratuberculosis
cacggccuugccga

SEQ ID NO: 901895 - RNA, 15 nt, Mycobacterium avium subsp. paratuberculosis
cacggcgaacaccuc

SEQ ID NO: 901896 - RNA, 17 nt, Mycobacterium avium subsp. paratuberculosis
cacggcgaacaccucgg

SEQ ID NO: 901897 - RNA, 21 nt, Mycobacterium avium subsp. paratuberculosis
cacggcgaacaccucgggauc

SEQ ID NO: 901898 - RNA, 23 nt, Mycobacterium avium subsp. paratuberculosis
cacggcgaacaccucgggaucca

SEQ ID NO: 901899 - RNA, 18 nt, Mycobacterium avium subsp. paratuberculosis
cacggcgaacggccgcga

SEQ ID NO: 901900 - RNA, 18 nt, Mycobacterium avium subsp. paratuberculosis
cacggcgaccagcgagcc

SEQ ID NO: 901901 - RNA, 20 nt, Mycobacterium avium subsp. paratuberculosis
cacggcgaccagcgagccca

SEQ ID NO: 901902 - RNA, 13 nt, Mycobacterium avium subsp. paratuberculosis
cacggcgaccccg

SEQ ID NO: 901903 - RNA, 19 nt, Mycobacterium avium subsp. paratuberculosis
cacggcgaggauggcgauc

SEQ ID NO: 901904 - RNA, 20 nt, Mycobacterium avium subsp. paratuberculosis
cacggcgaggauggcgauca

SEQ ID NO: 901905 - RNA, 21 nt, Mycobacterium avium subsp. paratuberculosis
cacggcgaggauggcgaucau

SEQ ID NO: 901906 - RNA, 22 nt, Mycobacterium avium subsp. paratuberculosis
cacggcgaauauuucgccgauc

SEQ ID NO: 901907 - RNA, 13 nt, Mycobacterium avium subsp. paratuberculosis
cacggcgacgacc

SEQ ID NO: 901908 - RNA, 20 nt, Mycobacterium avium subsp. paratuberculosis
cacggcgacgaccaccagga

SEQ ID NO: 901909 - RNA, 15 nt, Mycobacterium avium subsp. paratuberculosis
cacggucaccccgag

SEQ ID NO: 901910 - RNA, 23 nt, Mycobacterium avium subsp. paratuberculosis
cacggucaccccgaguucggcca

SEQ ID NO: 901911 - RNA, 13 nt, Mycobacterium avium subsp. paratuberculosis
cacggucagcgcg

SEQ ID NO: 901912 - RNA, 19 nt, Mycobacterium avium subsp. paratuberculosis
cacggucagcgcgucggcg

SEQ ID NO: 901913 - RNA, 14 nt, Mycobacterium avium subsp. paratuberculosis
cacggucagcggcc

SEQ ID NO: 901914 - RNA, 13 nt, Mycobacterium avium subsp. paratuberculosis
cacggucagcucg

SEQ ID NO: 901915 - RNA, 19 nt, Mycobacterium avium subsp. paratuberculosis
cacggucagcucgcgcccg

SEQ ID NO: 901916 - RNA, 15 nt, Mycobacterium avium subsp. paratuberculosis
cacgggcccgcggga

SEQ ID NO: 901917 - RNA, 16 nt, Mycobacterium avium subsp. paratuberculosis
cacgggccaggcgcgc

SEQ ID NO: 901918 - RNA, 17 nt, Mycobacterium avium subsp. paratuberculosis
cacgggccaggcgcgcg

SEQ ID NO: 901919 - RNA, 12 nt, Mycobacterium avium subsp. paratuberculosis
cacgggccaugu

SEQ ID NO: 901920 - RNA, 12 nt, Mycobacterium avium subsp. paratuberculosis
cacgggcggcag

SEQ ID NO: 901921 - RNA, 23 nt, Mycobacterium avium subsp. paratuberculosis
cacgggcggcagggccagcacca

SEQ ID NO: 901922 - RNA, 12 nt, Mycobacterium avium subsp. paratuberculosis
cacgggccgcgc

SEQ ID NO: 901923 - RNA, 15 nt, Mycobacterium avium subsp. paratuberculosis
cacgggccgcgccga

SEQ ID NO: 901924 - RNA, 16 nt, Mycobacterium avium subsp. paratuberculosis
cacgggccgcgccgag

SEQ ID NO: 901925 - RNA, 17 nt, Mycobacterium avium subsp. paratuberculosis
cacgggccgcgccgagg

SEQ ID NO: 901926 - RNA, 13 nt, Mycobacterium avium subsp. paratuberculosis
cacgggauagcgc

SEQ ID NO: 901927 - RNA, 13 nt, Mycobacterium avium subsp. paratuberculosis
cacgggaugcggc

SEQ ID NO: 901928 - RNA, 22 nt, Mycobacterium avium subsp. paratuberculosis
cacgggcacaccgucguccacg

SEQ ID NO: 901929 - RNA, 16 nt, Mycobacterium avium subsp. paratuberculosis
cacgggcaccgacgag

SEQ ID NO: 901930 - RNA, 20 nt, Mycobacterium avium subsp. paratuberculosis
cacggaaaccgcugcggcac

SEQ ID NO: 901931 - RNA, 21 nt, Mycobacterium avium subsp. paratuberculosis
cacggaacccaaggcggacaa

SEQ ID NO: 901932 - RNA, 14 nt, Mycobacterium avium subsp. paratuberculosis
cacggacagccggc

SEQ ID NO: 901933 - RNA, 19 nt, Mycobacterium avium subsp. paratuberculosis
cacggacagcucaccgggc

SEQ ID NO: 901934 - RNA, 20 nt, Mycobacterium avium subsp. paratuberculosis
cacggccaacugcaucgcca

SEQ ID NO: 901935 - RNA, 22 nt, Mycobacterium avium subsp. paratuberculosis
cacggccaacugcaucgccagc

SEQ ID NO: 901936 - RNA, 15 nt, Mycobacterium avium subsp. paratuberculosis
cacggcaucgauggc

SEQ ID NO: 901937 - RNA, 16 nt, Mycobacterium avium subsp. paratuberculosis
cacggcaucgauggcg

SEQ ID NO: 901938 - RNA, 17 nt, Mycobacterium avium subsp. paratuberculosis
cacggcaucgauggcgg

SEQ ID NO: 901939 - RNA, 21 nt, Mycobacterium avium subsp. paratuberculosis
cacggcaucgauggcgggcgc

SEQ ID NO: 901940 - RNA, 22 nt, Mycobacterium avium subsp. paratuberculosis
cacggcaucgauggcgggcgcg

SEQ ID NO: 901941 - RNA, 23 nt, Mycobacterium avium subsp. paratuberculosis
cacggcaucgauggcgggcgcgc

SEQ ID NO: 901942 - RNA, 15 nt, Mycobacterium avium subsp. paratuberculosis
cacggcacgucgagg

SEQ ID NO: 901943 - RNA, 15 nt, Mycobacterium avium subsp. paratuberculosis
cacggcaccgccgcg

SEQ ID NO: 901944 - RNA, 16 nt, Mycobacterium avium subsp. paratuberculosis
cacggcaccgccgcgc

SEQ ID NO: 901945 - RNA, 20 nt, Mycobacterium avium subsp. paratuberculosis
cacggcagcaacugaccgau

SEQ ID NO: 901946 - RNA, 17 nt, Mycobacterium avium subsp. paratuberculosis
cacggcagcccgacguc

SEQ ID NO: 901947 - RNA, 19 nt, Mycobacterium avium subsp. paratuberculosis
cacgcuguuggaaccggcc

SEQ ID NO: 901948 - RNA, 20 nt, Mycobacterium avium subsp. paratuberculosis
cacgcuguuggaaccggcca

SEQ ID NO: 901949 - RNA, 23 nt, Mycobacterium avium subsp. paratuberculosis
cacgcuguuggaaccggccacca

SEQ ID NO: 901950 - RNA, 23 nt, Mycobacterium avium subsp. paratuberculosis
cacgcugucggggucgcggcccg

SEQ ID NO: 901951 - RNA, 16 nt, Mycobacterium avium subsp. paratuberculosis
cacgcuggugacgugc

SEQ ID NO: 901952 - RNA, 18 nt, Mycobacterium avium subsp. paratuberculosis
cacgcuguagggccacca

SEQ ID NO: 901953 - RNA, 22 nt, Mycobacterium avium subsp. paratuberculosis
cacgcuguagggccaccacgcc

SEQ ID NO: 901954 - RNA, 13 nt, Mycobacterium avium subsp. paratuberculosis
cacgcuguccgcg

SEQ ID NO: 901955 - RNA, 13 nt, Mycobacterium avium subsp. paratuberculosis
cacgcugggcucc

SEQ ID NO: 901956 - RNA, 14 nt, Mycobacterium avium subsp. paratuberculosis
cacgcugggcuccg

SEQ ID NO: 901957 - RNA, 15 nt, Mycobacterium avium subsp. paratuberculosis
cacgcugggcuccga

SEQ ID NO: 901958 - RNA, 17 nt, Mycobacterium avium subsp. paratuberculosis
cacgcugggcuccgacc

SEQ ID NO: 901959 - RNA, 14 nt, Mycobacterium avium subsp. paratuberculosis
cacgcuggcggugu

SEQ ID NO: 901960 - RNA, 17 nt, Mycobacterium avium subsp. paratuberculosis
cacgcuggcggugucga

SEQ ID NO: 901961 - RNA, 13 nt, Mycobacterium avium subsp. paratuberculosis
cacgcuggcguga

SEQ ID NO: 901962 - RNA, 16 nt, Mycobacterium avium subsp. paratuberculosis
cacgcuggcgugacgc

SEQ ID NO: 901963 - RNA, 19 nt, Mycobacterium avium subsp. paratuberculosis
cacgcuggcgugacgcucg

SEQ ID NO: 901964 - RNA, 20 nt, Mycobacterium avium subsp. paratuberculosis
cacgcuggcgugacgcucga

SEQ ID NO: 901965 - RNA, 20 nt, Mycobacterium avium subsp. paratuberculosis
cacgcuggcgugacgcucgg

SEQ ID NO: 901966 - RNA, 21 nt, Mycobacterium avium subsp. paratuberculosis
cacgcuggcgugacgcucggg

SEQ ID NO: 901967 - RNA, 18 nt, Mycobacterium avium subsp. paratuberculosis
cacgcuggcgugacgguc

SEQ ID NO: 901968 - RNA, 20 nt, Mycobacterium avium subsp. paratuberculosis
cacgcuggcgugacggucga

SEQ ID NO: 901969 - RNA, 22 nt, Mycobacterium avium subsp. paratuberculosis
cacgcuggcgugacggucgacc

SEQ ID NO: 901970 - RNA, 19 nt, Mycobacterium avium subsp. paratuberculosis
cacgcuggcguggcgccgg

SEQ ID NO: 901971 - RNA, 22 nt, Mycobacterium avium subsp. paratuberculosis
cacgcuggcguggcgccggcgc

SEQ ID NO: 901972 - RNA, 12 nt, Mycobacterium avium subsp. paratuberculosis
cacgcuggccgg

SEQ ID NO: 901973 - RNA, 15 nt, Mycobacterium avium subsp. paratuberculosis
cacgcuggccggcag

SEQ ID NO: 901974 - RNA, 17 nt, Mycobacterium avium subsp. paratuberculosis
cacgcuggccggcagcg

SEQ ID NO: 901975 - RNA, 18 nt, Mycobacterium avium subsp. paratuberculosis
cacgcuggccggcagcgu

SEQ ID NO: 901976 - RNA, 12 nt, Mycobacterium avium subsp. paratuberculosis
cacgcugaagcc

SEQ ID NO: 901977 - RNA, 17 nt, Mycobacterium avium subsp. paratuberculosis
cacgcugaagcccaccg

SEQ ID NO: 901978 - RNA, 14 nt, Mycobacterium avium subsp. paratuberculosis
cacgcucgcggugc

SEQ ID NO: 901979 - RNA, 14 nt, Mycobacterium avium subsp. paratuberculosis
cacgcugcgcaccc

SEQ ID NO: 901980 - RNA, 19 nt, Mycobacterium avium subsp. paratuberculosis
cacgcugaucgaccgguuc

SEQ ID NO: 901981 - RNA, 16 nt, Mycobacterium avium subsp. paratuberculosis
cacgcugcgccagccg

SEQ ID NO: 901982 - RNA, 17 nt, Mycobacterium avium subsp. paratuberculosis
cacgcugcgccagccgu

SEQ ID NO: 901983 - RNA, 14 nt, Mycobacterium avium subsp. paratuberculosis
cacgcugcgcgccg

SEQ ID NO: 901984 - RNA, 17 nt, Mycobacterium avium subsp. paratuberculosis
cacgcugcgcgccgauc

SEQ ID NO: 901985 - RNA, 11 nt, Mycobacterium avium subsp. paratuberculosis
cacgcucggca

SEQ ID NO: 901986 - RNA, 14 nt, Mycobacterium avium subsp. paratuberculosis
cacgcucggcaggc

SEQ ID NO: 901987 - RNA, 13 nt, Mycobacterium avium subsp. paratuberculosis
cacgcucggcggc

SEQ ID NO: 901988 - RNA, 11 nt, Mycobacterium avium subsp. paratuberculosis
cacgcucggcg

SEQ ID NO: 901989 - RNA, 14 nt, Mycobacterium avium subsp. paratuberculosis
cacgcucggcgggu

SEQ ID NO: 901990 - RNA, 15 nt, Mycobacterium avium subsp. paratuberculosis
cacgcucggcggcgc

SEQ ID NO: 901991 - RNA, 14 nt, Mycobacterium avium subsp. paratuberculosis
cacgcucggcgggg

SEQ ID NO: 901992 - RNA, 21 nt, Mycobacterium avium subsp. paratuberculosis
cacgcugaacggugccgucac

SEQ ID NO: 901993 - RNA, 20 nt, Mycobacterium avium subsp. paratuberculosis
cacgcucucgccggucagca

SEQ ID NO: 901994 - RNA, 22 nt, Mycobacterium avium subsp. paratuberculosis
cacgcucucgccggucagcacg

SEQ ID NO: 901995 - RNA, 14 nt, Mycobacterium avium subsp. paratuberculosis
cacgcucgggccgg

SEQ ID NO: 901996 - RNA, 17 nt, Mycobacterium avium subsp. paratuberculosis
cacgcucgggccggcgc

SEQ ID NO: 901997 - RNA, 18 nt, Mycobacterium avium subsp. paratuberculosis
cacgcucgggccggcgcc

SEQ ID NO: 901998 - RNA, 20 nt, Mycobacterium avium subsp. paratuberculosis
cacgcucgggccggcgccga

SEQ ID NO: 901999 - RNA, 21 nt, Mycobacterium avium subsp. paratuberculosis
cacgcguugcagcgccgcggc

SEQ ID NO: 902000 - RNA, 12 nt, Mycobacterium avium subsp. paratuberculosis
cacgcguucgga

SEQ ID NO: 902001 - RNA, 20 nt, Mycobacterium avium subsp. paratuberculosis
cacgcguucggacaccucgg

SEQ ID NO: 902002 - RNA, 14 nt, Mycobacterium avium subsp. paratuberculosis
cacgcguagccgac

SEQ ID NO: 902003 - RNA, 20 nt, Mycobacterium avium subsp. paratuberculosis
cacgcguagccgaccaacgg

SEQ ID NO: 902004 - RNA, 17 nt, Mycobacterium avium subsp. paratuberculosis
cacgcucacgcucggcc

SEQ ID NO: 902005 - RNA, 23 nt, Mycobacterium avium subsp. paratuberculosis
cacgcggugauccagagcaucag

SEQ ID NO: 902006 - RNA, 20 nt, Mycobacterium avium subsp. paratuberculosis
cacgcuagcgugacagucga

SEQ ID NO: 902007 - RNA, 14 nt, Mycobacterium avium subsp. paratuberculosis
cacgcucgccagac

SEQ ID NO: 902008 - RNA, 15 nt, Mycobacterium avium subsp. paratuberculosis
cacgcucgccagacc

SEQ ID NO: 902009 - RNA, 22 nt, Mycobacterium avium subsp. paratuberculosis
cacgcucgcaggcgagccgaca

SEQ ID NO: 902010 - RNA, 12 nt, Mycobacterium avium subsp. paratuberculosis
cacgcucggcga

SEQ ID NO: 902011 - RNA, 15 nt, Mycobacterium avium subsp. paratuberculosis
cacgcucggcgagcu

SEQ ID NO: 902012 - RNA, 12 nt, Mycobacterium avium subsp. paratuberculosis
cacgcucggcgc

SEQ ID NO: 902013 - RNA, 19 nt, Mycobacterium avium subsp. paratuberculosis
cacgcucggcgcaacggga

SEQ ID NO: 902014 - RNA, 16 nt, Mycobacterium avium subsp. paratuberculosis
cacgcucggcgccgag

SEQ ID NO: 902015 - RNA, 13 nt, Mycobacterium avium subsp. paratuberculosis
cacgcucggcgcg

SEQ ID NO: 902016 - RNA, 14 nt, Mycobacterium avium subsp. paratuberculosis
cacgcucggcgcga

SEQ ID NO: 902017 - RNA, 19 nt, Mycobacterium avium subsp. paratuberculosis
cacgcucggcgcgacguug

SEQ ID NO: 902018 - RNA, 16 nt, Mycobacterium avium subsp. paratuberculosis
cacgcccacgccgagg

SEQ ID NO: 902019 - RNA, 16 nt, Mycobacterium avium subsp. paratuberculosis
cacgcccagcgccgcg

SEQ ID NO: 902020 - RNA, 14 nt, Mycobacterium avium subsp. paratuberculosis
cacgcccagcgccg

SEQ ID NO: 902021 - RNA, 13 nt, Mycobacterium avium subsp. paratuberculosis
cacgccccaggcg

SEQ ID NO: 902022 - RNA, 16 nt, Mycobacterium avium subsp. paratuberculosis
cacgccccagguuccg

SEQ ID NO: 902023 - RNA, 23 nt, Mycobacterium avium subsp. paratuberculosis
cacgccccagguuccggugucga

SEQ ID NO: 902024 - RNA, 13 nt, Mycobacterium avium subsp. paratuberculosis
cacgcccagaccg

SEQ ID NO: 902025 - RNA, 15 nt, Mycobacterium avium subsp. paratuberculosis
cacgcccagaccgug

SEQ ID NO: 902026 - RNA, 17 nt, Mycobacterium avium subsp. paratuberculosis
cacgcccagaucgccga

SEQ ID NO: 902027 - RNA, 19 nt, Mycobacterium avium subsp. paratuberculosis
cacgcccagaucgccgacc

SEQ ID NO: 902028 - RNA, 18 nt, Mycobacterium avium subsp. paratuberculosis
cacgcccagaugcaggcu

SEQ ID NO: 902029 - RNA, 18 nt, Mycobacterium avium subsp. paratuberculosis
cacgcccagcccgcgggc

SEQ ID NO: 902030 - RNA, 18 nt, Mycobacterium avium subsp. paratuberculosis
cacgccaugugccggcgc

SEQ ID NO: 902031 - RNA, 13 nt, Mycobacterium avium subsp. paratuberculosis
caccuccagauag

SEQ ID NO: 902032 - RNA, 21 nt, Mycobacterium avium subsp. paratuberculosis
cacgccaucgccucggccacc

SEQ ID NO: 902033 - RNA, 20 nt, Mycobacterium avium subsp. paratuberculosis
cacgccgcagcgcagcgucg

SEQ ID NO: 902034 - RNA, 22 nt, Mycobacterium avium subsp. paratuberculosis
cacgccgauggccugguggccc

SEQ ID NO: 902035 - RNA, 19 nt, Mycobacterium avium subsp. paratuberculosis
cacgccggcacaccgagcg

SEQ ID NO: 902036 - RNA, 12 nt, Mycobacterium avium subsp. paratuberculosis
cacgccggccgg

SEQ ID NO: 902037 - RNA, 13 nt, Mycobacterium avium subsp. paratuberculosis
cacgccggccggc

SEQ ID NO: 902038 - RNA, 14 nt, Mycobacterium avium subsp. paratuberculosis
cacgccggccggcg

SEQ ID NO: 902039 - RNA, 16 nt, Mycobacterium avium subsp. paratuberculosis
cacgccggccggcgug

SEQ ID NO: 902040 - RNA, 12 nt, Mycobacterium avium subsp. paratuberculosis
cacgccggccgu

SEQ ID NO: 902041 - RNA, 16 nt, Mycobacterium avium subsp. paratuberculosis
cacgccgacgauccgc

SEQ ID NO: 902042 - RNA, 22 nt, Mycobacterium avium subsp. paratuberculosis
cacgccgacgauccgcgccgcg

SEQ ID NO: 902043 - RNA, 22 nt, Mycobacterium avium subsp. paratuberculosis
cacgccccauugccgcgccggg

SEQ ID NO: 902044 - RNA, 14 nt, Mycobacterium avium subsp. paratuberculosis
cacgccgaccaccc

SEQ ID NO: 902045 - RNA, 17 nt, Mycobacterium avium subsp. paratuberculosis
cacgccgaccagguccg

SEQ ID NO: 902046 - RNA, 17 nt, Mycobacterium avium subsp. paratuberculosis
cacgccgagcagcaccg

SEQ ID NO: 902047 - RNA, 18 nt, Mycobacterium avium subsp. paratuberculosis
cacgccgagcagcaccgg

SEQ ID NO: 902048 - RNA, 19 nt, Mycobacterium avium subsp. paratuberculosis
cacgccgagcagcaccggc

SEQ ID NO: 902049 - RNA, 17 nt, Mycobacterium avium subsp. paratuberculosis
cacgccgagggcggcgg

SEQ ID NO: 902050 - RNA, 18 nt, Mycobacterium avium subsp. paratuberculosis
cacgccgagggcggcggc

SEQ ID NO: 902051 - RNA, 20 nt, Mycobacterium avium subsp. paratuberculosis
cacgccgagggugccggcca

SEQ ID NO: 902052 - RNA, 22 nt, Mycobacterium avium subsp. paratuberculosis
cacgccgagggugccggccacc

SEQ ID NO: 902053 - RNA, 17 nt, Mycobacterium avium subsp. paratuberculosis
cacgccgacuagcgcgg

SEQ ID NO: 902054 - RNA, 17 nt, Mycobacterium avium subsp. paratuberculosis
cacgccggucagcacca

SEQ ID NO: 902055 - RNA, 22 nt, Mycobacterium avium subsp. paratuberculosis
cacgccggguugggcggcggcc

SEQ ID NO: 902056 - RNA, 18 nt, Mycobacterium avium subsp. paratuberculosis
cacgccgguagccgcucg

SEQ ID NO: 902057 - RNA, 14 nt, Mycobacterium avium subsp. paratuberculosis
cacgccggugacca

SEQ ID NO: 902058 - RNA, 21 nt, Mycobacterium avium subsp. paratuberculosis
cacgccggugagcacgaccgc

SEQ ID NO: 902059 - RNA, 19 nt, Mycobacterium avium subsp. paratuberculosis
cacgccgguggacaggugc

SEQ ID NO: 902060 - RNA, 21 nt, Mycobacterium avium subsp. paratuberculosis
cacgccgguggacaggugcau

SEQ ID NO: 902061 - RNA, 19 nt, Mycobacterium avium subsp. paratuberculosis
cacgccguauucgccgacg

SEQ ID NO: 902062 - RNA, 21 nt, Mycobacterium avium subsp. paratuberculosis
cacgccgggguagaggccgcg

SEQ ID NO: 902063 - RNA, 12 nt, Mycobacterium avium subsp. paratuberculosis
cacgccgggcau

SEQ ID NO: 902064 - RNA, 20 nt, Mycobacterium avium subsp. paratuberculosis
cacgccgggcauccgcccgu

SEQ ID NO: 902065 - RNA, 12 nt, Mycobacterium avium subsp. paratuberculosis
cacgccggcggc

SEQ ID NO: 902066 - RNA, 13 nt, Mycobacterium avium subsp. paratuberculosis
cacgccggcggcc

SEQ ID NO: 902067 - RNA, 15 nt, Mycobacterium avium subsp. paratuberculosis
cacgccggcgggggu

SEQ ID NO: 902068 - RNA, 14 nt, Mycobacterium avium subsp. paratuberculosis
cacgccgucgucgu

SEQ ID NO: 902069 - RNA, 17 nt, Mycobacterium avium subsp. paratuberculosis
cacgccgucgugcucgg

SEQ ID NO: 902070 - RNA, 18 nt, Mycobacterium avium subsp. paratuberculosis
cacgccgucgugcucggc

SEQ ID NO: 902071 - RNA, 20 nt, Mycobacterium avium subsp. paratuberculosis
cacgccgucgugcucggcga

SEQ ID NO: 902072 - RNA, 22 nt, Mycobacterium avium subsp. paratuberculosis
cacgccgucgugcucggcgagc

SEQ ID NO: 902073 - RNA, 23 nt, Mycobacterium avium subsp. paratuberculosis
cacgccgucguggguauccgccg

SEQ ID NO: 902074 - RNA, 17 nt, Mycobacterium avium subsp. paratuberculosis
cacgccgugcccggcgc

SEQ ID NO: 902075 - RNA, 18 nt, Mycobacterium avium subsp. paratuberculosis
cacgccgugcccggcgcc

SEQ ID NO: 902076 - RNA, 13 nt, Mycobacterium avium subsp. paratuberculosis
cacgccgucgacc

SEQ ID NO: 902077 - RNA, 14 nt, Mycobacterium avium subsp. paratuberculosis
cacgccgucgacga

SEQ ID NO: 902078 - RNA, 13 nt, Mycobacterium avium subsp. paratuberculosis
cacgccguggcgg

SEQ ID NO: 902079 - RNA, 23 nt, Mycobacterium avium subsp. paratuberculosis
cacgccguggcggcgggccagcu

SEQ ID NO: 902080 - RNA, 23 nt, Mycobacterium avium subsp. paratuberculosis
cacgccguugaccccgacggcgc

SEQ ID NO: 902081 - RNA, 14 nt, Mycobacterium avium subsp. paratuberculosis
cacgccucgucgag

SEQ ID NO: 902082 - RNA, 16 nt, Mycobacterium avium subsp. paratuberculosis
cacgccuccggcagua

SEQ ID NO: 902083 - RNA, 16 nt, Mycobacterium avium subsp. paratuberculosis
cacgcgcucagcgcgg

SEQ ID NO: 902084 - RNA, 16 nt, Mycobacterium avium subsp. paratuberculosis
cacgcggacacgaacg

SEQ ID NO: 902085 - RNA, 21 nt, Mycobacterium avium subsp. paratuberculosis
cacgcggacagggcggcgacc

SEQ ID NO: 902086 - RNA, 22 nt, Mycobacterium avium subsp. paratuberculosis
cacgcggacccguacuccacca

SEQ ID NO: 902087 - RNA, 22 nt, Mycobacterium avium subsp. paratuberculosis
cacgcggaccuuggugucggcg

SEQ ID NO: 902088 - RNA, 18 nt, Mycobacterium avium subsp. paratuberculosis
cacgcggauagcccagcg

SEQ ID NO: 902089 - RNA, 13 nt, Mycobacterium avium subsp. paratuberculosis
cacgcggccgcgc

SEQ ID NO: 902090 - RNA, 14 nt, Mycobacterium avium subsp. paratuberculosis
cacgcggccgcgcc

SEQ ID NO: 902091 - RNA, 23 nt, Mycobacterium avium subsp. paratuberculosis
cacgcgguccacuuccgcgcagg

SEQ ID NO: 902092 - RNA, 20 nt, Mycobacterium avium subsp. paratuberculosis
cacgcggcuggcccggcgcg

SEQ ID NO: 902093 - RNA, 21 nt, Mycobacterium avium subsp. paratuberculosis
cacgcggcuggcccggcgcgg

SEQ ID NO: 902094 - RNA, 19 nt, Mycobacterium avium subsp. paratuberculosis
cacgcggcgcgcaucgucg

SEQ ID NO: 902095 - RNA, 16 nt, Mycobacterium avium subsp. paratuberculosis
cacgcggcggcggugc

SEQ ID NO: 902096 - RNA, 12 nt, Mycobacterium avium subsp. paratuberculosis
cacgcggcggga

SEQ ID NO: 902097 - RNA, 22 nt, Mycobacterium avium subsp. paratuberculosis
cagcaacauccugguccggcgc

SEQ ID NO: 902098 - RNA, 17 nt, Mycobacterium avium subsp. paratuberculosis
cagcaaccccgcggugc

SEQ ID NO: 902099 - RNA, 21 nt, Mycobacterium avium subsp. paratuberculosis
cagcaaccccgcggugcacga

SEQ ID NO: 902100 - RNA, 18 nt, Mycobacterium avium subsp. paratuberculosis
cagcaacccgaaagcccc

SEQ ID NO: 902101 - RNA, 18 nt, Mycobacterium avium subsp. paratuberculosis
cagcaacccgccgagcgu

SEQ ID NO: 902102 - RNA, 22 nt, Mycobacterium avium subsp. paratuberculosis
cagcaaccgcgaaaacagcgac

SEQ ID NO: 902103 - RNA, 11 nt, Mycobacterium avium subsp. paratuberculosis
cagcacgguga

SEQ ID NO: 902104 - RNA, 18 nt, Mycobacterium avium subsp. paratuberculosis
cagcacggugcguucgcg

SEQ ID NO: 902105 - RNA, 17 nt, Mycobacterium avium subsp. paratuberculosis
cagcacguugugcucgu

SEQ ID NO: 902106 - RNA, 20 nt, Mycobacterium avium subsp. paratuberculosis
cagcacguugugcucgucga

SEQ ID NO: 902107 - RNA, 22 nt, Mycobacterium avium subsp. paratuberculosis
cagcacguugugcucgucgaug

SEQ ID NO: 902108 - RNA, 23 nt, Mycobacterium avium subsp. paratuberculosis
cagcacguugugggcgggcgcgu

SEQ ID NO: 902109 - RNA, 21 nt, Mycobacterium avium subsp. paratuberculosis
cagcacguuguucaggucgau

SEQ ID NO: 902110 - RNA, 23 nt, Mycobacterium avium subsp. paratuberculosis
cagcacguuguucaggucgaugg

SEQ ID NO: 902111 - RNA, 23 nt, Mycobacterium avium subsp. paratuberculosis
cagcacguguucgggaucggcgc

SEQ ID NO: 902112 - RNA, 14 nt, Mycobacterium avium subsp. paratuberculosis
cagcacgugcccag

SEQ ID NO: 902113 - RNA, 22 nt, Mycobacterium avium subsp. paratuberculosis
cagcacgugcccagcccgcgcg

SEQ ID NO: 902114 - RNA, 23 nt, Mycobacterium avium subsp. paratuberculosis
cagcacgugcccagcccgcgcga

SEQ ID NO: 902115 - RNA, 16 nt, Mycobacterium avium subsp. paratuberculosis
cagcacgugcccgccg

SEQ ID NO: 902116 - RNA, 12 nt, Mycobacterium avium subsp. paratuberculosis
cagcacguggcc

SEQ ID NO: 902117 - RNA, 16 nt, Mycobacterium avium subsp. paratuberculosis
cagcacguggccgggc

SEQ ID NO: 902118 - RNA, 21 nt, Mycobacterium avium subsp. paratuberculosis
cagcacgucguaggccauccu

SEQ ID NO: 902119 - RNA, 22 nt, Mycobacterium avium subsp. paratuberculosis
cagcacgucgcggcccuggaug

SEQ ID NO: 902120 - RNA, 13 nt, Mycobacterium avium subsp. paratuberculosis
cagcacgucgggg

SEQ ID NO: 902121 - RNA, 17 nt, Mycobacterium avium subsp. paratuberculosis
cagcacgucgggguggc

SEQ ID NO: 902122 - RNA, 22 nt, Mycobacterium avium subsp. paratuberculosis
cagcacgucggucagcgagcgg

SEQ ID NO: 902123 - RNA, 22 nt, Mycobacterium avium subsp. paratuberculosis
cagcacguccccgggcaccccg

SEQ ID NO: 902124 - RNA, 11 nt, Mycobacterium avium subsp. paratuberculosis
cagcagcaccc

SEQ ID NO: 902125 - RNA, 15 nt, Mycobacterium avium subsp. paratuberculosis
cagcagcaccccgau

SEQ ID NO: 902126 - RNA, 14 nt, Mycobacterium avium subsp. paratuberculosis
cagcagcaccgcga

SEQ ID NO: 902127 - RNA, 15 nt, Mycobacterium avium subsp. paratuberculosis
cagcagcaccgcgac

SEQ ID NO: 902128 - RNA, 17 nt, Mycobacterium avium subsp. paratuberculosis
cagcagcaccgcgaccg

SEQ ID NO: 902129 - RNA, 18 nt, Mycobacterium avium subsp. paratuberculosis
cagcagcaccgcgaccgg

SEQ ID NO: 902130 - RNA, 22 nt, Mycobacterium avium subsp. paratuberculosis
cagcagcaccgcgaccgguccg

SEQ ID NO: 902131 - RNA, 11 nt, Mycobacterium avium subsp. paratuberculosis
cagcagcaccu

SEQ ID NO: 902132 - RNA, 12 nt, Mycobacterium avium subsp. paratuberculosis
cagcagcaccug

SEQ ID NO: 902133 - RNA, 17 nt, Mycobacterium avium subsp. paratuberculosis
cagcagccaggacagcg

SEQ ID NO: 902134 - RNA, 14 nt, Mycobacterium avium subsp. paratuberculosis
cagcagcaccgcgu

SEQ ID NO: 902135 - RNA, 14 nt, Mycobacterium avium subsp. paratuberculosis
cagcagcaccggca

SEQ ID NO: 902136 - RNA, 15 nt, Mycobacterium avium subsp. paratuberculosis
cagcagcaccggcac

SEQ ID NO: 902137 - RNA, 21 nt, Mycobacterium avium subsp. paratuberculosis
cagcagcaccggcaccgcggc

SEQ ID NO: 902138 - RNA, 16 nt, Mycobacterium avium subsp. paratuberculosis
cagcagccaggauccg

SEQ ID NO: 902139 - RNA, 20 nt, Mycobacterium avium subsp. paratuberculosis
cagcagccccugcaccacga

SEQ ID NO: 902140 - RNA, 13 nt, Mycobacterium avium subsp. paratuberculosis
cagcagcccgaac

SEQ ID NO: 902141 - RNA, 13 nt, Mycobacterium avium subsp. paratuberculosis
cagcagcccgauc

SEQ ID NO: 902142 - RNA, 18 nt, Mycobacterium avium subsp. paratuberculosis
cagcagcgcgacgccgac

SEQ ID NO: 902143 - RNA, 22 nt, Mycobacterium avium subsp. paratuberculosis
cagcagccggucgaggucgccg

SEQ ID NO: 902144 - RNA, 19 nt, Mycobacterium avium subsp. paratuberculosis
cagcagcccggguccuggc

SEQ ID NO: 902145 - RNA, 15 nt, Mycobacterium avium subsp. paratuberculosis
cagcagccgccgggc

SEQ ID NO: 902146 - RNA, 13 nt, Mycobacterium avium subsp. paratuberculosis
cagcagcccggcc

SEQ ID NO: 902147 - RNA, 21 nt, Mycobacterium avium subsp. paratuberculosis
cagcagcccggccagccgggc

SEQ ID NO: 902148 - RNA, 17 nt, Mycobacterium avium subsp. paratuberculosis
cagcagccgcaccucgg

SEQ ID NO: 902149 - RNA, 22 nt, Mycobacterium avium subsp. paratuberculosis
cagcagccgcaccucggggcgu

SEQ ID NO: 902150 - RNA, 14 nt, Mycobacterium avium subsp. paratuberculosis
cagcagccgcgcca

SEQ ID NO: 902151 - RNA, 14 nt, Mycobacterium avium subsp. paratuberculosis
cagcagccgcgccg

SEQ ID NO: 902152 - RNA, 21 nt, Mycobacterium avium subsp. paratuberculosis
cagcagccgcgcgagcaucac

SEQ ID NO: 902153 - RNA, 23 nt, Mycobacterium avium subsp. paratuberculosis
cagcagccgcugcugggugccgc

SEQ ID NO: 902154 - RNA, 14 nt, Mycobacterium avium subsp. paratuberculosis
cagcagccggcaga

SEQ ID NO: 902155 - RNA, 14 nt, Mycobacterium avium subsp. paratuberculosis
cagcagcacccggg

SEQ ID NO: 902156 - RNA, 19 nt, Mycobacterium avium subsp. paratuberculosis
cagcagcacccgggccugc

SEQ ID NO: 902157 - RNA, 18 nt, Mycobacterium avium subsp. paratuberculosis
cagcagcacccgggugau

SEQ ID NO: 902158 - RNA, 17 nt, Mycobacterium avium subsp. paratuberculosis
cagcagcacccggucgc

SEQ ID NO: 902159 - RNA, 23 nt, Mycobacterium avium subsp. paratuberculosis
cagcagcacccggucgccggugu

SEQ ID NO: 902160 - RNA, 16 nt, Mycobacterium avium subsp. paratuberculosis
cagcagcaccagcgcc

SEQ ID NO: 902161 - RNA, 13 nt, Mycobacterium avium subsp. paratuberculosis
cagcagcaccagg

SEQ ID NO: 902162 - RNA, 22 nt, Mycobacterium avium subsp. paratuberculosis
cagcagcaccaggcugaccagc

SEQ ID NO: 902163 - RNA, 17 nt, Mycobacterium avium subsp. paratuberculosis
cagcagcaacgcggugu

SEQ ID NO: 902164 - RNA, 22 nt, Mycobacterium avium subsp. paratuberculosis
cagcacuucauggucgucgucg

SEQ ID NO: 902165 - RNA, 20 nt, Mycobacterium avium subsp. paratuberculosis
cagcagggcaccgacggccg

SEQ ID NO: 902166 - RNA, 19 nt, Mycobacterium avium subsp. paratuberculosis
cagcagggcaucucccgcg

SEQ ID NO: 902167 - RNA, 22 nt, Mycobacterium avium subsp. paratuberculosis
cagcaggcuguccugcgguucg

SEQ ID NO: 902168 - RNA, 13 nt, Mycobacterium avium subsp. paratuberculosis
cagcaggcuggcg

SEQ ID NO: 902169 - RNA, 14 nt, Mycobacterium avium subsp. paratuberculosis
cagcaggcuggcgg

SEQ ID NO: 902170 - RNA, 19 nt, Mycobacterium avium subsp. paratuberculosis
cagcagggcgccgacgauc

SEQ ID NO: 902171 - RNA, 16 nt, Mycobacterium avium subsp. paratuberculosis
cagcagggcgccgacg

SEQ ID NO: 902172 - RNA, 14 nt, Mycobacterium avium subsp. paratuberculosis
cagcaggcggacgg

SEQ ID NO: 902173 - RNA, 17 nt, Mycobacterium avium subsp. paratuberculosis
cagcaggcggacggcga

SEQ ID NO: 902174 - RNA, 14 nt, Mycobacterium avium subsp. paratuberculosis
cagcaggcgccggu

SEQ ID NO: 902175 - RNA, 14 nt, Mycobacterium avium subsp. paratuberculosis
cagcaggcgcgccg

SEQ ID NO: 902176 - RNA, 13 nt, Mycobacterium avium subsp. paratuberculosis
cagcagcggggcg

SEQ ID NO: 902177 - RNA, 13 nt, Mycobacterium avium subsp. paratuberculosis
cagcagcggggug

SEQ ID NO: 902178 - RNA, 16 nt, Mycobacterium avium subsp. paratuberculosis
cagcagcggcucggcc

SEQ ID NO: 902179 - RNA, 17 nt, Mycobacterium avium subsp. paratuberculosis
cagcagcgggaucagcu

SEQ ID NO: 902180 - RNA, 22 nt, Mycobacterium avium subsp. paratuberculosis
cagcagcgcggucaacaccggg

SEQ ID NO: 902181 - RNA, 17 nt, Mycobacterium avium subsp. paratuberculosis
cagcagcgcggugccga

SEQ ID NO: 902182 - RNA, 14 nt, Mycobacterium avium subsp. paratuberculosis
cagcagcggcaccc

SEQ ID NO: 902183 - RNA, 23 nt, Mycobacterium avium subsp. paratuberculosis
cagcagcgcgguuuccggcgauu

SEQ ID NO: 902184 - RNA, 18 nt, Mycobacterium avium subsp. paratuberculosis
cagcagcgcguaggugcg

SEQ ID NO: 902185 - RNA, 13 nt, Mycobacterium avium subsp. paratuberculosis
cagcagcgcgucg

SEQ ID NO: 902186 - RNA, 17 nt, Mycobacterium avium subsp. paratuberculosis
cagcagcggcagcgaac

SEQ ID NO: 902187 - RNA, 17 nt, Mycobacterium avium subsp. paratuberculosis
cagcagcggccggcgca

SEQ ID NO: 902188 - RNA, 13 nt, Mycobacterium avium subsp. paratuberculosis
cagcagcgcggcg

SEQ ID NO: 902189 - RNA, 16 nt, Mycobacterium avium subsp. paratuberculosis
cagcagcgcggcgauc

SEQ ID NO: 902190 - RNA, 22 nt, Mycobacterium avium subsp. paratuberculosis
cagcagcgcggcgaucucggcg

SEQ ID NO: 902191 - RNA, 12 nt, Mycobacterium avium subsp. paratuberculosis
cagcagcgcggc

SEQ ID NO: 902192 - RNA, 22 nt, Mycobacterium avium subsp. paratuberculosis
cagcagcgcggcauggcuggcg

SEQ ID NO: 902193 - RNA, 21 nt, Mycobacterium avium subsp. paratuberculosis
cagcagcgcgccgcgcuggcc

SEQ ID NO: 902194 - RNA, 16 nt, Mycobacterium avium subsp. paratuberculosis
cagcagcgcgccgacc

SEQ ID NO: 902195 - RNA, 17 nt, Mycobacterium avium subsp. paratuberculosis
cagcagcgaacccgcca

SEQ ID NO: 902196 - RNA, 19 nt, Mycobacterium avium subsp. paratuberculosis
cagcagguaaaccagcagc

SEQ ID NO: 902197 - RNA, 20 nt, Mycobacterium avium subsp. paratuberculosis
cagcagguaaaccagcagcg

SEQ ID NO: 902198 - RNA, 23 nt, Mycobacterium avium subsp. paratuberculosis
cagcagguaaaccagcagcgcca

SEQ ID NO: 902199 - RNA, 18 nt, Mycobacterium avium subsp. paratuberculosis
cagcagguagaagccgcg

SEQ ID NO: 902200 - RNA, 22 nt, Mycobacterium avium subsp. paratuberculosis
cagcagguagaagccgcgacgg

SEQ ID NO: 902201 - RNA, 16 nt, Mycobacterium avium subsp. paratuberculosis
cagcagggugccgccg

SEQ ID NO: 902202 - RNA, 18 nt, Mycobacterium avium subsp. paratuberculosis
cagcagggugccgccgcc

SEQ ID NO: 902203 - RNA, 19 nt, Mycobacterium avium subsp. paratuberculosis
cagcagggugccgccgccc

SEQ ID NO: 902204 - RNA, 20 nt, Mycobacterium avium subsp. paratuberculosis
cagcagggugccgccgcccg

SEQ ID NO: 902205 - RNA, 13 nt, Mycobacterium avium subsp. paratuberculosis
cagcagggcggca

SEQ ID NO: 902206 - RNA, 15 nt, Mycobacterium avium subsp. paratuberculosis
cagcagggcggcacc

SEQ ID NO: 902207 - RNA, 22 nt, Mycobacterium avium subsp. paratuberculosis
cagcagggcggcaccgaucggc

SEQ ID NO: 902208 - RNA, 13 nt, Mycobacterium avium subsp. paratuberculosis
cagcagggcggcg

SEQ ID NO: 902209 - RNA, 14 nt, Mycobacterium avium subsp. paratuberculosis
cagcagggcggcga

SEQ ID NO: 902210 - RNA, 16 nt, Mycobacterium avium subsp. paratuberculosis
cagcagggcggcgauc

SEQ ID NO: 902211 - RNA, 14 nt, Mycobacterium avium subsp. paratuberculosis
cagcaggucggcgu

SEQ ID NO: 902212 - RNA, 14 nt, Mycobacterium avium subsp. paratuberculosis
cagcaggucgucga

SEQ ID NO: 902213 - RNA, 19 nt, Mycobacterium avium subsp. paratuberculosis
cagcaggucgucgacgucc

SEQ ID NO: 902214 - RNA, 16 nt, Mycobacterium avium subsp. paratuberculosis
cagcaggucgucgauc

SEQ ID NO: 902215 - RNA, 17 nt, Mycobacterium avium subsp. paratuberculosis
cagcaggucgucgauca

SEQ ID NO: 902216 - RNA, 22 nt, Mycobacterium avium subsp. paratuberculosis
cagcaggucgucgaucagggcg

SEQ ID NO: 902217 - RNA, 12 nt, Mycobacterium avium subsp. paratuberculosis
cagcaggucggc

SEQ ID NO: 902218 - RNA, 20 nt, Mycobacterium avium subsp. paratuberculosis
cagcaggucgaucugcggca

SEQ ID NO: 902219 - RNA, 22 nt, Mycobacterium avium subsp. paratuberculosis
cagcaggucgaucugcggcacg

SEQ ID NO: 902220 - RNA, 15 nt, Mycobacterium avium subsp. paratuberculosis
cagcagguccgccgg

SEQ ID NO: 902221 - RNA, 16 nt, Mycobacterium avium subsp. paratuberculosis
cagcagguccgccggu

SEQ ID NO: 902222 - RNA, 17 nt, Mycobacterium avium subsp. paratuberculosis
cagcaggucgaaggcgg

SEQ ID NO: 902223 - RNA, 16 nt, Mycobacterium avium subsp. paratuberculosis
cagcaggucgagcaug

SEQ ID NO: 902224 - RNA, 20 nt, Mycobacterium avium subsp. paratuberculosis
cagcagguagaucgccagcg

SEQ ID NO: 902225 - RNA, 20 nt, Mycobacterium avium subsp. paratuberculosis
cagcaggugcgccagaucgc

SEQ ID NO: 902226 - RNA, 19 nt, Mycobacterium avium subsp. paratuberculosis
cagcagggcgcgcaucugc

SEQ ID NO: 902227 - RNA, 16 nt, Mycobacterium avium subsp. paratuberculosis
cagcaggugcaccacc

SEQ ID NO: 902228 - RNA, 15 nt, Mycobacterium avium subsp. paratuberculosis
cagcaggugcaucgc

SEQ ID NO: 902229 - RNA, 19 nt, Mycobacterium avium subsp. paratuberculosis
cagcaggugcaucgccacc

SEQ ID NO: 902230 - RNA, 13 nt, Mycobacterium avium subsp. paratuberculosis
cagcaggucggcg

SEQ ID NO: 902231 - RNA, 18 nt, Mycobacterium avium subsp. paratuberculosis
cagcagguugauccgcgc

SEQ ID NO: 902232 - RNA, 19 nt, Mycobacterium avium subsp. paratuberculosis
cagcagguugcgguguugc

SEQ ID NO: 902233 - RNA, 22 nt, Mycobacterium avium subsp. paratuberculosis
cagcagguuguagucggcgccg

SEQ ID NO: 902234 - RNA, 17 nt, Mycobacterium avium subsp. paratuberculosis
cagcaguuccggagcgc

SEQ ID NO: 902235 - RNA, 18 nt, Mycobacterium avium subsp. paratuberculosis
cagcagucgugacgcggc

SEQ ID NO: 902236 - RNA, 20 nt, Mycobacterium avium subsp. paratuberculosis
cagcagucgugacgcggcgu

SEQ ID NO: 902237 - RNA, 15 nt, Mycobacterium avium subsp. paratuberculosis
cagcaguccggcggu

SEQ ID NO: 902238 - RNA, 17 nt, Mycobacterium avium subsp. paratuberculosis
cagcaguccggcgguca

SEQ ID NO: 902239 - RNA, 23 nt, Mycobacterium avium subsp. paratuberculosis
cagcaguccggcggucagcaccg

SEQ ID NO: 902240 - RNA, 21 nt, Mycobacterium avium subsp. paratuberculosis
cagcagugccaacacggcggc

SEQ ID NO: 902241 - RNA, 22 nt, Mycobacterium avium subsp. paratuberculosis
cagcagugccaacacggcggcg

SEQ ID NO: 902242 - RNA, 14 nt, Mycobacterium avium subsp. paratuberculosis
cagcagugccacca

SEQ ID NO: 902243 - RNA, 23 nt, Mycobacterium avium subsp. paratuberculosis
cagcagugccaccaccacggcca

SEQ ID NO: 902244 - RNA, 15 nt, Mycobacterium avium subsp. paratuberculosis
cagcagugccccguc

SEQ ID NO: 902245 - RNA, 17 nt, Mycobacterium avium subsp. paratuberculosis
cagcagugccccguccg

SEQ ID NO: 902246 - RNA, 23 nt, Mycobacterium avium subsp. paratuberculosis
cagcagugccccguccggcgcca

SEQ ID NO: 902247 - RNA, 18 nt, Mycobacterium avium subsp. paratuberculosis
cagccgaaguuggcgucg

SEQ ID NO: 902248 - RNA, 23 nt, Mycobacterium avium subsp. paratuberculosis
cagccgaccagcggucgggugcg

SEQ ID NO: 902249 - RNA, 23 nt, Mycobacterium avium subsp. paratuberculosis
cagccgaccaguucuucgaugac

SEQ ID NO: 902250 - RNA, 14 nt, Mycobacterium avium subsp. paratuberculosis
cagccgaccgauca

SEQ ID NO: 902251 - RNA, 17 nt, Mycobacterium avium subsp. paratuberculosis
cagccgaccgaucagcg

SEQ ID NO: 902252 - RNA, 20 nt, Mycobacterium avium subsp. paratuberculosis
cagccgagaucgacccgcuc

SEQ ID NO: 902253 - RNA, 14 nt, Mycobacterium avium subsp. paratuberculosis
cagccgaagccggc

SEQ ID NO: 902254 - RNA, 15 nt, Mycobacterium avium subsp. paratuberculosis
cagccgaagccggcg

SEQ ID NO: 902255 - RNA, 16 nt, Mycobacterium avium subsp. paratuberculosis
cagccgaagccggcgc

SEQ ID NO: 902256 - RNA, 19 nt, Mycobacterium avium subsp. paratuberculosis
cagcccggccccaccgccg

SEQ ID NO: 902257 - RNA, 14 nt, Mycobacterium avium subsp. paratuberculosis
cagcccggcccgca

SEQ ID NO: 902258 - RNA, 18 nt, Mycobacterium avium subsp. paratuberculosis
cagcccggcccgcaucga

SEQ ID NO: 902259 - RNA, 13 nt, Mycobacterium avium subsp. paratuberculosis
cagcccggcccgu

SEQ ID NO: 902260 - RNA, 19 nt, Mycobacterium avium subsp. paratuberculosis
cagcccggcccgucgagcg

SEQ ID NO: 902261 - RNA, 16 nt, Mycobacterium avium subsp. paratuberculosis
cagcccgacccggcuc

SEQ ID NO: 902262 - RNA, 16 nt, Mycobacterium avium subsp. paratuberculosis
cagcccuuggcgaagc

SEQ ID NO: 902263 - RNA, 16 nt, Mycobacterium avium subsp. paratuberculosis
cagcccggcagcgggg

SEQ ID NO: 902264 - RNA, 19 nt, Mycobacterium avium subsp. paratuberculosis
cagcccggcagcggggcga

SEQ ID NO: 902265 - RNA, 15 nt, Mycobacterium avium subsp. paratuberculosis
cagcccggccagcgg

SEQ ID NO: 902266 - RNA, 13 nt, Mycobacterium avium subsp. paratuberculosis
cagcccggccagu

SEQ ID NO: 902267 - RNA, 17 nt, Mycobacterium avium subsp. paratuberculosis
cagcccggaggcgaugc

SEQ ID NO: 902268 - RNA, 21 nt, Mycobacterium avium subsp. paratuberculosis
cagcccggaggcgaugcgggu

SEQ ID NO: 902269 - RNA, 12 nt, Mycobacterium avium subsp. paratuberculosis
cagcccgcgucg

SEQ ID NO: 902270 - RNA, 17 nt, Mycobacterium avium subsp. paratuberculosis
cagcccggaaucgucgg

SEQ ID NO: 902271 - RNA, 15 nt, Mycobacterium avium subsp. paratuberculosis
cagcccgcugaccag

SEQ ID NO: 902272 - RNA, 16 nt, Mycobacterium avium subsp. paratuberculosis
cagcccgcugaccagg

SEQ ID NO: 902273 - RNA, 18 nt, Mycobacterium avium subsp. paratuberculosis
cagcccgcugaccaggcc

SEQ ID NO: 902274 - RNA, 19 nt, Mycobacterium avium subsp. paratuberculosis
cagcccgcugaccaggccg

SEQ ID NO: 902275 - RNA, 12 nt, Mycobacterium avium subsp. paratuberculosis
cagcccgcggca

SEQ ID NO: 902276 - RNA, 14 nt, Mycobacterium avium subsp. paratuberculosis
cagcccgcggcagc

SEQ ID NO: 902277 - RNA, 18 nt, Mycobacterium avium subsp. paratuberculosis
cagcccgcggcagccagc

SEQ ID NO: 902278 - RNA, 16 nt, Mycobacterium avium subsp. paratuberculosis
cagcccgaugccgccg

SEQ ID NO: 902279 - RNA, 17 nt, Mycobacterium avium subsp. paratuberculosis
cagcccgaugccgccga

SEQ ID NO: 902280 - RNA, 19 nt, Mycobacterium avium subsp. paratuberculosis
cagcccgaugccgccgagg

SEQ ID NO: 902281 - RNA, 14 nt, Mycobacterium avium subsp. paratuberculosis
cagcccgaucgcca

SEQ ID NO: 902282 - RNA, 17 nt, Mycobacterium avium subsp. paratuberculosis
cagcccgaucgccagcg

SEQ ID NO: 902283 - RNA, 13 nt, Mycobacterium avium subsp. paratuberculosis
cagcccgaucacc

SEQ ID NO: 902284 - RNA, 18 nt, Mycobacterium avium subsp. paratuberculosis
cagcccgaucacccccga

SEQ ID NO: 902285 - RNA, 13 nt, Mycobacterium avium subsp. paratuberculosis
cagcccgacgucc

SEQ ID NO: 902286 - RNA, 17 nt, Mycobacterium avium subsp. paratuberculosis
cagcccgagcaccagcg

SEQ ID NO: 902287 - RNA, 18 nt, Mycobacterium avium subsp. paratuberculosis
cagcccgagcaccagcgg

SEQ ID NO: 902288 - RNA, 13 nt, Mycobacterium avium subsp. paratuberculosis
cagcccccaccgc

SEQ ID NO: 902289 - RNA, 15 nt, Mycobacterium avium subsp. paratuberculosis
cagcccccaccgcgc

SEQ ID NO: 902290 - RNA, 16 nt, Mycobacterium avium subsp. paratuberculosis
cagcccccaccgcgcc

SEQ ID NO: 902291 - RNA, 19 nt, Mycobacterium avium subsp. paratuberculosis
cagcccccaccgcgccgug

SEQ ID NO: 902292 - RNA, 20 nt, Mycobacterium avium subsp. paratuberculosis
cagcccccaccgcgccguga

SEQ ID NO: 902293 - RNA, 19 nt, Mycobacterium avium subsp. paratuberculosis
cagcccccacgcucggcgc

SEQ ID NO: 902294 - RNA, 14 nt, Mycobacterium avium subsp. paratuberculosis
cagcccccgcgggu

SEQ ID NO: 902295 - RNA, 19 nt, Mycobacterium avium subsp. paratuberculosis
cagcccccggaccacgucc

SEQ ID NO: 902296 - RNA, 16 nt, Mycobacterium avium subsp. paratuberculosis
cagcccccgcagcccg

SEQ ID NO: 902297 - RNA, 18 nt, Mycobacterium avium subsp. paratuberculosis
cagccccgagccgcggau

SEQ ID NO: 902298 - RNA, 17 nt, Mycobacterium avium subsp. paratuberculosis
cagccccgggaaccagc

SEQ ID NO: 902299 - RNA, 18 nt, Mycobacterium avium subsp. paratuberculosis
cagccccgggaaccagcc

SEQ ID NO: 902300 - RNA, 19 nt, Mycobacterium avium subsp. paratuberculosis
cagccccgucggucccgac

SEQ ID NO: 902301 - RNA, 15 nt, Mycobacterium avium subsp. paratuberculosis
cagccccucggggcu

SEQ ID NO: 902302 - RNA, 17 nt, Mycobacterium avium subsp. paratuberculosis
cagccccucggggcugc

SEQ ID NO: 902303 - RNA, 13 nt, Mycobacterium avium subsp. paratuberculosis
cagccccucgucc

SEQ ID NO: 902304 - RNA, 14 nt, Mycobacterium avium subsp. paratuberculosis
cagccccucgucca

SEQ ID NO: 902305 - RNA, 15 nt, Mycobacterium avium subsp. paratuberculosis
cagccccugcaccac

SEQ ID NO: 902306 - RNA, 17 nt, Mycobacterium avium subsp. paratuberculosis
cagccccugcaccacga

SEQ ID NO: 902307 - RNA, 13 nt, Mycobacterium avium subsp. paratuberculosis
cagccccucgacg

SEQ ID NO: 902308 - RNA, 14 nt, Mycobacterium avium subsp. paratuberculosis
cagccccucgacgu

SEQ ID NO: 902309 - RNA, 15 nt, Mycobacterium avium subsp. paratuberculosis
cagccccucgccggg

SEQ ID NO: 902310 - RNA, 16 nt, Mycobacterium avium subsp. paratuberculosis
cagccccucgccgggc

SEQ ID NO: 902311 - RNA, 16 nt, Mycobacterium avium subsp. paratuberculosis
cagcccgaacagccgg

SEQ ID NO: 902312 - RNA, 18 nt, Mycobacterium avium subsp. paratuberculosis
cagcccgaacagccgggc

SEQ ID NO: 902313 - RNA, 22 nt, Mycobacterium avium subsp. paratuberculosis
cagcccgaacagccgggcggcc

SEQ ID NO: 902314 - RNA, 23 nt, Mycobacterium avium subsp. paratuberculosis
cagcccgaacagcuugccgaucu

SEQ ID NO: 902315 - RNA, 16 nt, Mycobacterium avium subsp. paratuberculosis
cagccccaggaggcac

SEQ ID NO: 902316 - RNA, 22 nt, Mycobacterium avium subsp. paratuberculosis
cagccccaggaggcacuggcgc

SEQ ID NO: 902317 - RNA, 16 nt, Mycobacterium avium subsp. paratuberculosis
cagccagucgaagacc

SEQ ID NO: 902318 - RNA, 19 nt, Mycobacterium avium subsp. paratuberculosis
cagccagucgaagaccacg

SEQ ID NO: 902319 - RNA, 15 nt, Mycobacterium avium subsp. paratuberculosis
cagccagucgccggc

SEQ ID NO: 902320 - RNA, 17 nt, Mycobacterium avium subsp. paratuberculosis
cagccagucgccggcca

SEQ ID NO: 902321 - RNA, 23 nt, Mycobacterium avium subsp. paratuberculosis
cagccagucggucaacgugucga

SEQ ID NO: 902322 - RNA, 13 nt, Mycobacterium avium subsp. paratuberculosis
cagccagguuggc

SEQ ID NO: 902323 - RNA, 20 nt, Mycobacterium avium subsp. paratuberculosis
cagccagguuggccagguug

SEQ ID NO: 902324 - RNA, 17 nt, Mycobacterium avium subsp. paratuberculosis
cagccaguccgccgccg

SEQ ID NO: 902325 - RNA, 19 nt, Mycobacterium avium subsp. paratuberculosis
cagccaguccgccgccguc

SEQ ID NO: 902326 - RNA, 20 nt, Mycobacterium avium subsp. paratuberculosis
cagccaguccgccgccgucc

SEQ ID NO: 902327 - RNA, 21 nt, Mycobacterium avium subsp. paratuberculosis
cagccaguccgccgccguccc

SEQ ID NO: 902328 - RNA, 14 nt, Mycobacterium avium subsp. paratuberculosis
cagccacaccgccg

SEQ ID NO: 902329 - RNA, 19 nt, Mycobacterium avium subsp. paratuberculosis
cagccacaccgccgcggcg

SEQ ID NO: 902330 - RNA, 20 nt, Mycobacterium avium subsp. paratuberculosis
cagccacaccgccgcggcgg

SEQ ID NO: 902331 - RNA, 13 nt, Mycobacterium avium subsp. paratuberculosis
cagccacagccgc

SEQ ID NO: 902332 - RNA, 14 nt, Mycobacterium avium subsp. paratuberculosis
cagccacagcucgg

SEQ ID NO: 902333 - RNA, 13 nt, Mycobacterium avium subsp. paratuberculosis
cagccacaucugg

SEQ ID NO: 902334 - RNA, 14 nt, Mycobacterium avium subsp. paratuberculosis
cagccacaucuggu

SEQ ID NO: 902335 - RNA, 22 nt, Mycobacterium avium subsp. paratuberculosis
cagccaccacaucgcuggggug

SEQ ID NO: 902336 - RNA, 22 nt, Mycobacterium avium subsp. paratuberculosis
cagccacgagcccagccgucgc

SEQ ID NO: 902337 - RNA, 16 nt, Mycobacterium avium subsp. paratuberculosis
cagccacgccagccag

SEQ ID NO: 902338 - RNA, 20 nt, Mycobacterium avium subsp. paratuberculosis
cagccacgccagccaggcga

SEQ ID NO: 902339 - RNA, 22 nt, Mycobacterium avium subsp. paratuberculosis
cagccacgccagccaggcgaug

SEQ ID NO: 902340 - RNA, 12 nt, Mycobacterium avium subsp. paratuberculosis
cagccacgccgg

SEQ ID NO: 902341 - RNA, 14 nt, Mycobacterium avium subsp. paratuberculosis
cagccacgccggca

SEQ ID NO: 902342 - RNA, 22 nt, Mycobacterium avium subsp. paratuberculosis
cagccaccgugccuuacgccgg

SEQ ID NO: 902343 - RNA, 23 nt, Mycobacterium avium subsp. paratuberculosis
cagccaccgugccuuacgccggg

SEQ ID NO: 902344 - RNA, 22 nt, Mycobacterium avium subsp. paratuberculosis
cagccaccguggccccacgggc

SEQ ID NO: 902345 - RNA, 13 nt, Mycobacterium avium subsp. paratuberculosis
cagccacccgucg

SEQ ID NO: 902346 - RNA, 16 nt, Mycobacterium avium subsp. paratuberculosis
cagccacccgucggug

SEQ ID NO: 902347 - RNA, 17 nt, Mycobacterium avium subsp. paratuberculosis
cagccacggcagcugca

SEQ ID NO: 902348 - RNA, 14 nt, Mycobacterium avium subsp. paratuberculosis
cagccacgggcggu

SEQ ID NO: 902349 - RNA, 17 nt, Mycobacterium avium subsp. paratuberculosis
cagccacgggcggucgg

SEQ ID NO: 902350 - RNA, 19 nt, Mycobacterium avium subsp. paratuberculosis
cagccacuccaccaccggc

SEQ ID NO: 902351 - RNA, 14 nt, Mycobacterium avium subsp. paratuberculosis
cagccacucgccgu

SEQ ID NO: 902352 - RNA, 15 nt, Mycobacterium avium subsp. paratuberculosis
cagccacucgccgug

SEQ ID NO: 902353 - RNA, 14 nt, Mycobacterium avium subsp. paratuberculosis
cagccaggccgccg

SEQ ID NO: 902354 - RNA, 13 nt, Mycobacterium avium subsp. paratuberculosis
cagccaggccguc

SEQ ID NO: 902355 - RNA, 15 nt, Mycobacterium avium subsp. paratuberculosis
cagccaggccgucgg

SEQ ID NO: 902356 - RNA, 17 nt, Mycobacterium avium subsp. paratuberculosis
cagccaggccgucggcg

SEQ ID NO: 902357 - RNA, 23 nt, Mycobacterium avium subsp. paratuberculosis
cagccaggcgaugaagccggcga

SEQ ID NO: 902358 - RNA, 13 nt, Mycobacterium avium subsp. paratuberculosis
cagccaggugugc

SEQ ID NO: 902359 - RNA, 19 nt, Mycobacterium avium subsp. paratuberculosis
cagccaggugugcggcacg

SEQ ID NO: 902360 - RNA, 20 nt, Mycobacterium avium subsp. paratuberculosis
cagccagguguaggcggcca

SEQ ID NO: 902361 - RNA, 22 nt, Mycobacterium avium subsp. paratuberculosis
cagccagguguaggcggccaca

SEQ ID NO: 902362 - RNA, 22 nt, Mycobacterium avium subsp. paratuberculosis
cagccagguccgggcacucgag

SEQ ID NO: 902363 - RNA, 17 nt, Mycobacterium avium subsp. paratuberculosis
cagcaucuccgagucgg

SEQ ID NO: 902364 - RNA, 17 nt, Mycobacterium avium subsp. paratuberculosis
cagcauguccucggggu

SEQ ID NO: 902365 - RNA, 19 nt, Mycobacterium avium subsp. paratuberculosis
cagcauguccucggggugg

SEQ ID NO: 902366 - RNA, 17 nt, Mycobacterium avium subsp. paratuberculosis
cagccaaucgccgauga

SEQ ID NO: 902367 - RNA, 19 nt, Mycobacterium avium subsp. paratuberculosis
cagccaaucgccgaugacc

SEQ ID NO: 902368 - RNA, 14 nt, Mycobacterium avium subsp. paratuberculosis
cagcaucucggcga

SEQ ID NO: 902369 - RNA, 16 nt, Mycobacterium avium subsp. paratuberculosis
cagcaucucggcgaag

SEQ ID NO: 902370 - RNA, 22 nt, Mycobacterium avium subsp. paratuberculosis
cagcaucgggacgccugccgcc

SEQ ID NO: 902371 - RNA, 15 nt, Mycobacterium avium subsp. paratuberculosis
cagcaucgccgucgu

SEQ ID NO: 902372 - RNA, 16 nt, Mycobacterium avium subsp. paratuberculosis
cagcaucgccgucguc

SEQ ID NO: 902373 - RNA, 13 nt, Mycobacterium avium subsp. paratuberculosis
cagcaucgccgcg

SEQ ID NO: 902374 - RNA, 14 nt, Mycobacterium avium subsp. paratuberculosis
cagcaucgccgcga

SEQ ID NO: 902375 - RNA, 14 nt, Mycobacterium avium subsp. paratuberculosis
cagcaucgccgcgg

SEQ ID NO: 902376 - RNA, 22 nt, Mycobacterium avium subsp. paratuberculosis
cagcaucgccgcggugcgcgag

SEQ ID NO: 902377 - RNA, 21 nt, Mycobacterium avium subsp. paratuberculosis
cagcaucggaugccggggcag

SEQ ID NO: 902378 - RNA, 22 nt, Mycobacterium avium subsp. paratuberculosis
cagcaucggcagaucguugggc

SEQ ID NO: 902379 - RNA, 20 nt, Mycobacterium avium subsp. paratuberculosis
cagcaguuuguccugcucgg

SEQ ID NO: 902380 - RNA, 23 nt, Mycobacterium avium subsp. paratuberculosis
cagcaguuuguccugcucggcga

SEQ ID NO: 902381 - RNA, 22 nt, Mycobacterium avium subsp. paratuberculosis
cagcaguucguccacgcuggcg

SEQ ID NO: 902382 - RNA, 14 nt, Mycobacterium avium subsp. paratuberculosis
cagcauccgccgac

SEQ ID NO: 902383 - RNA, 15 nt, Mycobacterium avium subsp. paratuberculosis
cagcauccgccgacg

SEQ ID NO: 902384 - RNA, 16 nt, Mycobacterium avium subsp. paratuberculosis
cagcauccgcuggugc

SEQ ID NO: 902385 - RNA, 22 nt, Mycobacterium avium subsp. paratuberculosis
cagcauccgcuggugcgcgccg

SEQ ID NO: 902386 - RNA, 14 nt, Mycobacterium avium subsp. paratuberculosis
cagcgcacacaccg

SEQ ID NO: 902387 - RNA, 17 nt, Mycobacterium avium subsp. paratuberculosis
cagcgcacacagcagca

SEQ ID NO: 902388 - RNA, 22 nt, Mycobacterium avium subsp. paratuberculosis
cagcgcacacagcagcagcacc

SEQ ID NO: 902389 - RNA, 23 nt, Mycobacterium avium subsp. paratuberculosis
cagcgcacacagcagcagcacca

SEQ ID NO: 902390 - RNA, 15 nt, Mycobacterium avium subsp. paratuberculosis
cagcgcaccgccguc

SEQ ID NO: 902391 - RNA, 12 nt, Mycobacterium avium subsp. paratuberculosis
cagcgcaccggc

SEQ ID NO: 902392 - RNA, 17 nt, Mycobacterium avium subsp. paratuberculosis
cagcgcaccggcgaugc

SEQ ID NO: 902393 - RNA, 14 nt, Mycobacterium avium subsp. paratuberculosis
cagcgcaccgggcc

SEQ ID NO: 902394 - RNA, 16 nt, Mycobacterium avium subsp. paratuberculosis
cagcgcaccgggcccg

SEQ ID NO: 902395 - RNA, 13 nt, Mycobacterium avium subsp. paratuberculosis
cagcgcaccgccg

SEQ ID NO: 902396 - RNA, 21 nt, Mycobacterium avium subsp. paratuberculosis
cagcgcagcaccauccgcgcg

SEQ ID NO: 902397 - RNA, 15 nt, Mycobacterium avium subsp. paratuberculosis
cagcgcagcaucggc

SEQ ID NO: 902398 - RNA, 16 nt, Mycobacterium avium subsp. paratuberculosis
cagcgcagcgaccugg

SEQ ID NO: 902399 - RNA, 23 nt, Mycobacterium avium subsp. paratuberculosis
cagcgcagcgaccugguccaccg

SEQ ID NO: 902400 - RNA, 22 nt, Mycobacterium avium subsp. paratuberculosis
cagcgcagcgccucggcggccc

SEQ ID NO: 902401 - RNA, 17 nt, Mycobacterium avium subsp. paratuberculosis
cagcgcagcgucggcgu

SEQ ID NO: 902402 - RNA, 13 nt, Mycobacterium avium subsp. paratuberculosis
cagcgcagcgugg

SEQ ID NO: 902403 - RNA, 15 nt, Mycobacterium avium subsp. paratuberculosis
cagcgcacgucgccg

SEQ ID NO: 902404 - RNA, 16 nt, Mycobacterium avium subsp. paratuberculosis
cagcgcacgucgccgc

SEQ ID NO: 902405 - RNA, 18 nt, Mycobacterium avium subsp. paratuberculosis
cagcgcacgucgccgccg

SEQ ID NO: 902406 - RNA, 15 nt, Mycobacterium avium subsp. paratuberculosis
cagcgaucggcggcu

SEQ ID NO: 902407 - RNA, 16 nt, Mycobacterium avium subsp. paratuberculosis
cagcgaucggcggcuc

SEQ ID NO: 902408 - RNA, 16 nt, Mycobacterium avium subsp. paratuberculosis
cagcgcaacggcgucg

SEQ ID NO: 902409 - RNA, 12 nt, Mycobacterium avium subsp. paratuberculosis
cagcgcaaccgc

SEQ ID NO: 902410 - RNA, 15 nt, Mycobacterium avium subsp. paratuberculosis
cagcgcaaccgcggc

SEQ ID NO: 902411 - RNA, 17 nt, Mycobacterium avium subsp. paratuberculosis
cagcgcaaccgcggcgg

SEQ ID NO: 902412 - RNA, 21 nt, Mycobacterium avium subsp. paratuberculosis
cagcgcaaccgcggcggcggc

SEQ ID NO: 902413 - RNA, 15 nt, Mycobacterium avium subsp. paratuberculosis
cagcgauugcggccg

SEQ ID NO: 902414 - RNA, 16 nt, Mycobacterium avium subsp. paratuberculosis
cagcgauucccgccgg

SEQ ID NO: 902415 - RNA, 15 nt, Mycobacterium avium subsp. paratuberculosis
cagcgaacccgccag

SEQ ID NO: 902416 - RNA, 20 nt, Mycobacterium avium subsp. paratuberculosis
cagcgaacccgccagggcga

SEQ ID NO: 902417 - RNA, 15 nt, Mycobacterium avium subsp. paratuberculosis
cagcgacagcagcgu

SEQ ID NO: 902418 - RNA, 17 nt, Mycobacterium avium subsp. paratuberculosis
cagcgacagcagcgugg

SEQ ID NO: 902419 - RNA, 17 nt, Mycobacterium avium subsp. paratuberculosis
cagcgacaugaccaccg

SEQ ID NO: 902420 - RNA, 18 nt, Mycobacterium avium subsp. paratuberculosis
cagcgacaugaccaccgc

SEQ ID NO: 902421 - RNA, 20 nt, Mycobacterium avium subsp. paratuberculosis
cagcgacagggugccgaaca

SEQ ID NO: 902422 - RNA, 16 nt, Mycobacterium avium subsp. paratuberculosis
cagcgacagcgcgucg

SEQ ID NO: 902423 - RNA, 14 nt, Mycobacterium avium subsp. paratuberculosis
cagcgagcacagcg

SEQ ID NO: 902424 - RNA, 17 nt, Mycobacterium avium subsp. paratuberculosis
cagcgagcacagcggcg

SEQ ID NO: 902425 - RNA, 19 nt, Mycobacterium avium subsp. paratuberculosis
cagcgagcacagcggcgga

SEQ ID NO: 902426 - RNA, 13 nt, Mycobacterium avium subsp. paratuberculosis
cagcgaccagucg

SEQ ID NO: 902427 - RNA, 17 nt, Mycobacterium avium subsp. paratuberculosis
cagcgaccagucggcgu

SEQ ID NO: 902428 - RNA, 16 nt, Mycobacterium avium subsp. paratuberculosis
cagcgacccgaaccgg

SEQ ID NO: 902429 - RNA, 17 nt, Mycobacterium avium subsp. paratuberculosis
cagcgaccgcaggucga

SEQ ID NO: 902430 - RNA, 18 nt, Mycobacterium avium subsp. paratuberculosis
cagcgaccgcggaugacg

SEQ ID NO: 902431 - RNA, 22 nt, Mycobacterium avium subsp. paratuberculosis
cagcgaggugguuucggggucg

SEQ ID NO: 902432 - RNA, 15 nt, Mycobacterium avium subsp. paratuberculosis
cagcgagucgaagcc

SEQ ID NO: 902433 - RNA, 16 nt, Mycobacterium avium subsp. paratuberculosis
cagcgagucgaagccg

SEQ ID NO: 902434 - RNA, 17 nt, Mycobacterium avium subsp. paratuberculosis
cagcgagucgaaggcgc

SEQ ID NO: 902435 - RNA, 21 nt, Mycobacterium avium subsp. paratuberculosis
cagcgagucgaaggcgcgggc

SEQ ID NO: 902436 - RNA, 16 nt, Mycobacterium avium subsp. paratuberculosis
cagcgagucggcgaag

SEQ ID NO: 902437 - RNA, 20 nt, Mycobacterium avium subsp. paratuberculosis
cagcgagugguaccgggugg

SEQ ID NO: 902438 - RNA, 22 nt, Mycobacterium avium subsp. paratuberculosis
cagcgaguccagccagccgcgc

SEQ ID NO: 902439 - RNA, 13 nt, Mycobacterium avium subsp. paratuberculosis
cagcgagggggug

SEQ ID NO: 902440 - RNA, 20 nt, Mycobacterium avium subsp. paratuberculosis
cagcgaggugaagccguugu

SEQ ID NO: 902441 - RNA, 13 nt, Mycobacterium avium subsp. paratuberculosis
cagcgaggcgcgc

SEQ ID NO: 902442 - RNA, 14 nt, Mycobacterium avium subsp. paratuberculosis
cagcgaggcgcgca

SEQ ID NO: 902443 - RNA, 19 nt, Mycobacterium avium subsp. paratuberculosis
cagcgaggcgcgcagguag

SEQ ID NO: 902444 - RNA, 15 nt, Mycobacterium avium subsp. paratuberculosis
cagcgaggcgacguc

SEQ ID NO: 902445 - RNA, 14 nt, Mycobacterium avium subsp. paratuberculosis
cagcgaggcgaugg

SEQ ID NO: 902446 - RNA, 14 nt, Mycobacterium avium subsp. paratuberculosis
cagcgaggacccgu

SEQ ID NO: 902447 - RNA, 14 nt, Mycobacterium avium subsp. paratuberculosis
cagcgagcugccgg

SEQ ID NO: 902448 - RNA, 18 nt, Mycobacterium avium subsp. paratuberculosis
cagcgagcugccggcggc

SEQ ID NO: 902449 - RNA, 21 nt, Mycobacterium avium subsp. paratuberculosis
cagcgagcugccggcggccgc

SEQ ID NO: 902450 - RNA, 16 nt, Mycobacterium avium subsp. paratuberculosis
cagcgagccgucgacc

SEQ ID NO: 902451 - RNA, 21 nt, Mycobacterium avium subsp. paratuberculosis
cagcgagccgucgaccggguc

SEQ ID NO: 902452 - RNA, 23 nt, Mycobacterium avium subsp. paratuberculosis
cagcgagccgucgaccggguccg

SEQ ID NO: 902453 - RNA, 18 nt, Mycobacterium avium subsp. paratuberculosis
cagcgagcccuucgcggu

SEQ ID NO: 902454 - RNA, 14 nt, Mycobacterium avium subsp. paratuberculosis
cagcgagcagguca

SEQ ID NO: 902455 - RNA, 14 nt, Mycobacterium avium subsp. paratuberculosis
cagcgagcccagcu

SEQ ID NO: 902456 - RNA, 17 nt, Mycobacterium avium subsp. paratuberculosis
cagcgagcccagcugcg

SEQ ID NO: 902457 - RNA, 15 nt, Mycobacterium avium subsp. paratuberculosis
cagccgaggcgcucg

SEQ ID NO: 902458 - RNA, 14 nt, Mycobacterium avium subsp. paratuberculosis
cagccgagccgggc

SEQ ID NO: 902459 - RNA, 17 nt, Mycobacterium avium subsp. paratuberculosis
cagccgagccgggccag

SEQ ID NO: 902460 - RNA, 21 nt, Mycobacterium avium subsp. paratuberculosis
cagccgagccgggccaggucc

SEQ ID NO: 902461 - RNA, 17 nt, Mycobacterium avium subsp. paratuberculosis
cagccgaugcgcccgcg

SEQ ID NO: 902462 - RNA, 18 nt, Mycobacterium avium subsp. paratuberculosis
cagccgaugcgcccgcgc

SEQ ID NO: 902463 - RNA, 19 nt, Mycobacterium avium subsp. paratuberculosis
cagccgaugcgcccgcgcc

SEQ ID NO: 902464 - RNA, 12 nt, Mycobacterium avium subsp. paratuberculosis
cagccggcggcg

SEQ ID NO: 902465 - RNA, 16 nt, Mycobacterium avium subsp. paratuberculosis
cagccggcggaucgcg

SEQ ID NO: 902466 - RNA, 11 nt, Mycobacterium avium subsp. paratuberculosis
cagccggcggc

SEQ ID NO: 902467 - RNA, 13 nt, Mycobacterium avium subsp. paratuberculosis
cagccggcggcgc

SEQ ID NO: 902468 - RNA, 14 nt, Mycobacterium avium subsp. paratuberculosis
cagccggcgggcgc

SEQ ID NO: 902469 - RNA, 17 nt, Mycobacterium avium subsp. paratuberculosis
cagccggcggugcaggg

SEQ ID NO: 902470 - RNA, 20 nt, Mycobacterium avium subsp. paratuberculosis
cagccggcgguucggcgggc

SEQ ID NO: 902471 - RNA, 18 nt, Mycobacterium avium subsp. paratuberculosis
cagccggcucagggugcg

SEQ ID NO: 902472 - RNA, 22 nt, Mycobacterium avium subsp. paratuberculosis
cagccggcucagggugcgcugg

SEQ ID NO: 902473 - RNA, 19 nt, Mycobacterium avium subsp. paratuberculosis
cagccggcucuuggcgacc

SEQ ID NO: 902474 - RNA, 17 nt, Mycobacterium avium subsp. paratuberculosis
cagccggcugagcagcc

SEQ ID NO: 902475 - RNA, 14 nt, Mycobacterium avium subsp. paratuberculosis
cagccgggccagca

SEQ ID NO: 902476 - RNA, 23 nt, Mycobacterium avium subsp. paratuberculosis
cagccgggccagcaacagcagcg

SEQ ID NO: 902477 - RNA, 17 nt, Mycobacterium avium subsp. paratuberculosis
cagccgggccagcagcu

SEQ ID NO: 902478 - RNA, 14 nt, Mycobacterium avium subsp. paratuberculosis
cagccgggccgagc

SEQ ID NO: 902479 - RNA, 15 nt, Mycobacterium avium subsp. paratuberculosis
cagccgggccgagcg

SEQ ID NO: 902480 - RNA, 17 nt, Mycobacterium avium subsp. paratuberculosis
cagccgggccgagcgcg

SEQ ID NO: 902481 - RNA, 19 nt, Mycobacterium avium subsp. paratuberculosis
cagccgggccgagcgcgcc

SEQ ID NO: 902482 - RNA, 23 nt, Mycobacterium avium subsp. paratuberculosis
cagccgggccgagcgcgccgccg

SEQ ID NO: 902483 - RNA, 12 nt, Mycobacterium avium subsp. paratuberculosis
cagccgggccgc

SEQ ID NO: 902484 - RNA, 16 nt, Mycobacterium avium subsp. paratuberculosis
cagccggggcagcugc

SEQ ID NO: 902485 - RNA, 22 nt, Mycobacterium avium subsp. paratuberculosis
cagccggggcagcugcugggac

SEQ ID NO: 902486 - RNA, 20 nt, Mycobacterium avium subsp. paratuberculosis
cagccgggaaucgagggcgc

SEQ ID NO: 902487 - RNA, 14 nt, Mycobacterium avium subsp. paratuberculosis
cagccgggccugca

SEQ ID NO: 902488 - RNA, 15 nt, Mycobacterium avium subsp. paratuberculosis
cagccgggccugcag

SEQ ID NO: 902489 - RNA, 17 nt, Mycobacterium avium subsp. paratuberculosis
cagccgggccugcagca

SEQ ID NO: 902490 - RNA, 16 nt, Mycobacterium avium subsp. paratuberculosis
cagccgggccugcggc

SEQ ID NO: 902491 - RNA, 18 nt, Mycobacterium avium subsp. paratuberculosis
cagccgggccugcggcgc

SEQ ID NO: 902492 - RNA, 19 nt, Mycobacterium avium subsp. paratuberculosis
cagccgggccugcggcgcg

SEQ ID NO: 902493 - RNA, 23 nt, Mycobacterium avium subsp. paratuberculosis
cagccgggccugcggcgcggcca

SEQ ID NO: 902494 - RNA, 14 nt, Mycobacterium avium subsp. paratuberculosis
cagccgggcgauca

SEQ ID NO: 902495 - RNA, 14 nt, Mycobacterium avium subsp. paratuberculosis
cagccgggcggccg

SEQ ID NO: 902496 - RNA, 17 nt, Mycobacterium avium subsp. paratuberculosis
cagccgggcggccgggc

SEQ ID NO: 902497 - RNA, 18 nt, Mycobacterium avium subsp. paratuberculosis
cagccgggcggccgggcc

SEQ ID NO: 902498 - RNA, 14 nt, Mycobacterium avium subsp. paratuberculosis
cagccgggcggcgc

SEQ ID NO: 902499 - RNA, 16 nt, Mycobacterium avium subsp. paratuberculosis
cagccgggcggcgccg

SEQ ID NO: 902500 - RNA, 17 nt, Mycobacterium avium subsp. paratuberculosis
cagccgggcggcgccga

SEQ ID NO: 902501 - RNA, 23 nt, Mycobacterium avium subsp. paratuberculosis
cagccgggcggcgccgaaccggg

SEQ ID NO: 902502 - RNA, 16 nt, Mycobacterium avium subsp. paratuberculosis
cagccgggcggcggcc

SEQ ID NO: 902503 - RNA, 20 nt, Mycobacterium avium subsp. paratuberculosis
cagccgggcggcggccuccg

SEQ ID NO: 902504 - RNA, 12 nt, Mycobacterium avium subsp. paratuberculosis
cagccgggcggu

SEQ ID NO: 902505 - RNA, 17 nt, Mycobacterium avium subsp. paratuberculosis
cagccgggcggugaugg

SEQ ID NO: 902506 - RNA, 19 nt, Mycobacterium avium subsp. paratuberculosis
cagccgguaugcgaucgcg

SEQ ID NO: 902507 - RNA, 20 nt, Mycobacterium avium subsp. paratuberculosis
cagccggucauaggccgcgc

SEQ ID NO: 902508 - RNA, 23 nt, Mycobacterium avium subsp. paratuberculosis
cagccgggugcgggccagcagcc

SEQ ID NO: 902509 - RNA, 16 nt, Mycobacterium avium subsp. paratuberculosis
cagccgggugcggugc

SEQ ID NO: 902510 - RNA, 17 nt, Mycobacterium avium subsp. paratuberculosis
cagccgggugcggugca

SEQ ID NO: 902511 - RNA, 21 nt, Mycobacterium avium subsp. paratuberculosis
cagccgggugcggugcagccg

SEQ ID NO: 902512 - RNA, 16 nt, Mycobacterium avium subsp. paratuberculosis
cagccggguggcccgc

SEQ ID NO: 902513 - RNA, 18 nt, Mycobacterium avium subsp. paratuberculosis
cagccggguggcccgccc

SEQ ID NO: 902514 - RNA, 21 nt, Mycobacterium avium subsp. paratuberculosis
cagccggguggcccgcccggg

SEQ ID NO: 902515 - RNA, 18 nt, Mycobacterium avium subsp. paratuberculosis
cagccggguggcccgcgc

SEQ ID NO: 902516 - RNA, 16 nt, Mycobacterium avium subsp. paratuberculosis
cagccgggugcccauc

SEQ ID NO: 902517 - RNA, 16 nt, Mycobacterium avium subsp. paratuberculosis
cagccgggggcggugc

SEQ ID NO: 902518 - RNA, 17 nt, Mycobacterium avium subsp. paratuberculosis
cagccgggggcggugca

SEQ ID NO: 902519 - RNA, 16 nt, Mycobacterium avium subsp. paratuberculosis
cagccgggggucggcu

SEQ ID NO: 902520 - RNA, 20 nt, Mycobacterium avium subsp. paratuberculosis
cagccgggguagggcggcgg

SEQ ID NO: 902521 - RNA, 21 nt, Mycobacterium avium subsp. paratuberculosis
cagccggggugcccgggccgc

SEQ ID NO: 902522 - RNA, 19 nt, Mycobacterium avium subsp. paratuberculosis
cagccggguagcgccgccg

SEQ ID NO: 902523 - RNA, 20 nt, Mycobacterium avium subsp. paratuberculosis
cagccggguagcgccgccgg

SEQ ID NO: 902524 - RNA, 21 nt, Mycobacterium avium subsp. paratuberculosis
cagccgggucaguucgcggcg

SEQ ID NO: 902525 - RNA, 20 nt, Mycobacterium avium subsp. paratuberculosis
cagccggguccgcacccggg

SEQ ID NO: 902526 - RNA, 22 nt, Mycobacterium avium subsp. paratuberculosis
cagccgguccaugugccgcauc

SEQ ID NO: 902527 - RNA, 16 nt, Mycobacterium avium subsp. paratuberculosis
cagccgguccgaccgc

SEQ ID NO: 902528 - RNA, 21 nt, Mycobacterium avium subsp. paratuberculosis
cagccgguccgaccgccacca

SEQ ID NO: 902529 - RNA, 17 nt, Mycobacterium avium subsp. paratuberculosis
cagccgguccggcggca

SEQ ID NO: 902530 - RNA, 16 nt, Mycobacterium avium subsp. paratuberculosis
cagccgguccuuggcc

SEQ ID NO: 902531 - RNA, 14 nt, Mycobacterium avium subsp. paratuberculosis
cagccggucgacga

SEQ ID NO: 902532 - RNA, 22 nt, Mycobacterium avium subsp. paratuberculosis
cagccggucgaggucgccgaca

SEQ ID NO: 902533 - RNA, 15 nt, Mycobacterium avium subsp. paratuberculosis
cagccggucgcaggu

SEQ ID NO: 902534 - RNA, 18 nt, Mycobacterium avium subsp. paratuberculosis
cagccggucgccgggccg

SEQ ID NO: 902535 - RNA, 16 nt, Mycobacterium avium subsp. paratuberculosis
cagccggucgcgcauc

SEQ ID NO: 902536 - RNA, 22 nt, Mycobacterium avium subsp. paratuberculosis
cagccggucgcgcaucgccucg

SEQ ID NO: 902537 - RNA, 19 nt, Mycobacterium avium subsp. paratuberculosis
cagccggugcggucggcgu

SEQ ID NO: 902538 - RNA, 20 nt, Mycobacterium avium subsp. paratuberculosis
cagccggugcggucggcguc

SEQ ID NO: 902539 - RNA, 21 nt, Mycobacterium avium subsp. paratuberculosis
cagccggugcggucggcgucg

SEQ ID NO: 902540 - RNA, 21 nt, Mycobacterium avium subsp. paratuberculosis
cagccgguggcggccacgauc

SEQ ID NO: 902541 - RNA, 18 nt, Mycobacterium avium subsp. paratuberculosis
cagccggucgucggggca

SEQ ID NO: 902542 - RNA, 17 nt, Mycobacterium avium subsp. paratuberculosis
cagccggugcaccacga

SEQ ID NO: 902543 - RNA, 20 nt, Mycobacterium avium subsp. paratuberculosis
cagccggugcaccacgauga

SEQ ID NO: 902544 - RNA, 17 nt, Mycobacterium avium subsp. paratuberculosis
cagccguuccaucgggc

SEQ ID NO: 902545 - RNA, 16 nt, Mycobacterium avium subsp. paratuberculosis
cagccguucccggcag

SEQ ID NO: 902546 - RNA, 17 nt, Mycobacterium avium subsp. paratuberculosis
cagccguucccggcaga

SEQ ID NO: 902547 - RNA, 16 nt, Mycobacterium avium subsp. paratuberculosis
cagccguucgcgcacg

SEQ ID NO: 902548 - RNA, 20 nt, Mycobacterium avium subsp. paratuberculosis
cagccguucgcgcacggcgc

SEQ ID NO: 902549 - RNA, 14 nt, Mycobacterium avium subsp. paratuberculosis
cagccguucgcugc

SEQ ID NO: 902550 - RNA, 12 nt, Mycobacterium avium subsp. paratuberculosis
cagccggugcga

SEQ ID NO: 902551 - RNA, 16 nt, Mycobacterium avium subsp. paratuberculosis
cagccguucucguccu

SEQ ID NO: 902552 - RNA, 19 nt, Mycobacterium avium subsp. paratuberculosis
cagccguucucguccuggg

SEQ ID NO: 902553 - RNA, 19 nt, Mycobacterium avium subsp. paratuberculosis
cagccggucuuggacagca

SEQ ID NO: 902554 - RNA, 23 nt, Mycobacterium avium subsp. paratuberculosis
cagccgguugcgguggccgauca

SEQ ID NO: 902555 - RNA, 19 nt, Mycobacterium avium subsp. paratuberculosis
cagccguaccgauccgcgg

SEQ ID NO: 902556 - RNA, 21 nt, Mycobacterium avium subsp. paratuberculosis
cagccguaccgauccgcgggc

SEQ ID NO: 902557 - RNA, 16 nt, Mycobacterium avium subsp. paratuberculosis
cagccgugggugucgg

SEQ ID NO: 902558 - RNA, 20 nt, Mycobacterium avium subsp. paratuberculosis
cagccgugggugucggcgaa

SEQ ID NO: 902559 - RNA, 21 nt, Mycobacterium avium subsp. paratuberculosis
cagccgugggugucggcgaag

SEQ ID NO: 902560 - RNA, 23 nt, Mycobacterium avium subsp. paratuberculosis
cagcgaaaccuccggagaucgcc

SEQ ID NO: 902561 - RNA, 22 nt, Mycobacterium avium subsp. paratuberculosis
cagcgaaacucguugccagccg

SEQ ID NO: 902562 - RNA, 23 nt, Mycobacterium avium subsp. paratuberculosis
cagcgaaacucguugccagccgg

SEQ ID NO: 902563 - RNA, 16 nt, Mycobacterium avium subsp. paratuberculosis
cagccuggcggcgacc

SEQ ID NO: 902564 - RNA, 19 nt, Mycobacterium avium subsp. paratuberculosis
cagccuucuucgccggggc

SEQ ID NO: 902565 - RNA, 15 nt, Mycobacterium avium subsp. paratuberculosis
cagccuucuuggcgg

SEQ ID NO: 902566 - RNA, 19 nt, Mycobacterium avium subsp. paratuberculosis
cagccuucuuggcgggcgc

SEQ ID NO: 902567 - RNA, 13 nt, Mycobacterium avium subsp. paratuberculosis
cagcgccggcacc

SEQ ID NO: 902568 - RNA, 17 nt, Mycobacterium avium subsp. paratuberculosis
cagcgccggcaccagca

SEQ ID NO: 902569 - RNA, 20 nt, Mycobacterium avium subsp. paratuberculosis
cagcgccggcaccagcagcc

SEQ ID NO: 902570 - RNA, 21 nt, Mycobacterium avium subsp. paratuberculosis
cagcgccggcaccagcagccg

SEQ ID NO: 902571 - RNA, 18 nt, Mycobacterium avium subsp. paratuberculosis
cagcgccggcagcaaccg

SEQ ID NO: 902572 - RNA, 20 nt, Mycobacterium avium subsp. paratuberculosis
cagcgccggcagcaaccggc

SEQ ID NO: 902573 - RNA, 22 nt, Mycobacterium avium subsp. paratuberculosis
cagcgccggcagcaaccggcgg

SEQ ID NO: 902574 - RNA, 14 nt, Mycobacterium avium subsp. paratuberculosis
cagcgccgcggcca

SEQ ID NO: 902575 - RNA, 22 nt, Mycobacterium avium subsp. paratuberculosis
cagcgccgcguugucggcgucc

SEQ ID NO: 902576 - RNA, 19 nt, Mycobacterium avium subsp. paratuberculosis
cagcgccgcuucgucgccg

SEQ ID NO: 902577 - RNA, 16 nt, Mycobacterium avium subsp. paratuberculosis
cagcgccguccgcacc

SEQ ID NO: 902578 - RNA, 18 nt, Mycobacterium avium subsp. paratuberculosis
cagcgccguccgcaccgc

SEQ ID NO: 902579 - RNA, 19 nt, Mycobacterium avium subsp. paratuberculosis
cagcgccguccgcaccgcg

SEQ ID NO: 902580 - RNA, 20 nt, Mycobacterium avium subsp. paratuberculosis
cagcgccguccgcaccgcga

SEQ ID NO: 902581 - RNA, 23 nt, Mycobacterium avium subsp. paratuberculosis
cagcgccgucuccucgaccagcg

SEQ ID NO: 902582 - RNA, 20 nt, Mycobacterium avium subsp. paratuberculosis
cagcgccgucucgacccggg

SEQ ID NO: 902583 - RNA, 24 nt, Mycobacterium avium subsp. paratuberculosis
cagcgccgucucgacccgggccag

SEQ ID NO: 902584 - RNA, 20 nt, Mycobacterium avium subsp. paratuberculosis
cagcgccguggcccggucgg

SEQ ID NO: 902585 - RNA, 17 nt, Mycobacterium avium subsp. paratuberculosis
cagcgccgucaucaccg

SEQ ID NO: 902586 - RNA, 12 nt, Mycobacterium avium subsp. paratuberculosis
cagcgccgcggc

SEQ ID NO: 902587 - RNA, 14 nt, Mycobacterium avium subsp. paratuberculosis
cagcgccgcgcgcg

SEQ ID NO: 902588 - RNA, 15 nt, Mycobacterium avium subsp. paratuberculosis
cagcgccgcggccag

SEQ ID NO: 902589 - RNA, 18 nt, Mycobacterium avium subsp. paratuberculosis
cagcgccgcggccagccg

SEQ ID NO: 902590 - RNA, 18 nt, Mycobacterium avium subsp. paratuberculosis
cagcgccgcggccggugc

SEQ ID NO: 902591 - RNA, 19 nt, Mycobacterium avium subsp. paratuberculosis
cagcgccgcggccggugcc

SEQ ID NO: 902592 - RNA, 15 nt, Mycobacterium avium subsp. paratuberculosis
cagcgccgcgccgac

SEQ ID NO: 902593 - RNA, 16 nt, Mycobacterium avium subsp. paratuberculosis
cagcgccgcgccgacc

SEQ ID NO: 902594 - RNA, 14 nt, Mycobacterium avium subsp. paratuberculosis
cagcgccgcgccga

SEQ ID NO: 902595 - RNA, 12 nt, Mycobacterium avium subsp. paratuberculosis
cagcgccgcccg

SEQ ID NO: 902596 - RNA, 14 nt, Mycobacterium avium subsp. paratuberculosis
cagcgccgcccgca

SEQ ID NO: 902597 - RNA, 16 nt, Mycobacterium avium subsp. paratuberculosis
cagcgccgcccgcacc

SEQ ID NO: 902598 - RNA, 18 nt, Mycobacterium avium subsp. paratuberculosis
cagcgccgcccgggcggc

SEQ ID NO: 902599 - RNA, 20 nt, Mycobacterium avium subsp. paratuberculosis
cagcgccgcccgggcggccc

SEQ ID NO: 902600 - RNA, 18 nt, Mycobacterium avium subsp. paratuberculosis
cagcgccgccaucgccuc

SEQ ID NO: 902601 - RNA, 17 nt, Mycobacterium avium subsp. paratuberculosis
cagcgccgccagccgca

SEQ ID NO: 902602 - RNA, 20 nt, Mycobacterium avium subsp. paratuberculosis
cagcgccgccagccgcagca

SEQ ID NO: 902603 - RNA, 17 nt, Mycobacterium avium subsp. paratuberculosis
cagcgccgccaccggcc

SEQ ID NO: 902604 - RNA, 21 nt, Mycobacterium avium subsp. paratuberculosis
cagcgccgccaccggccgguc

SEQ ID NO: 902605 - RNA, 14 nt, Mycobacterium avium subsp. paratuberculosis
cagcgccgccaacc

SEQ ID NO: 902606 - RNA, 15 nt, Mycobacterium avium subsp. paratuberculosis
cagcgccgccaacca

SEQ ID NO: 902607 - RNA, 13 nt, Mycobacterium avium subsp. paratuberculosis
cagcgccgccacc

SEQ ID NO: 902608 - RNA, 14 nt, Mycobacterium avium subsp. paratuberculosis
cagcgccgccaccg

SEQ ID NO: 902609 - RNA, 16 nt, Mycobacterium avium subsp. paratuberculosis
cagcgccugcccggag

SEQ ID NO: 902610 - RNA, 17 nt, Mycobacterium avium subsp. paratuberculosis
cagcgccucggccucgu

SEQ ID NO: 902611 - RNA, 21 nt, Mycobacterium avium subsp. paratuberculosis
cagcgccucggccucgucgac

SEQ ID NO: 902612 - RNA, 15 nt, Mycobacterium avium subsp. paratuberculosis
cagcgccucggccug

SEQ ID NO: 902613 - RNA, 14 nt, Mycobacterium avium subsp. paratuberculosis
cagcgccucggcga

SEQ ID NO: 902614 - RNA, 17 nt, Mycobacterium avium subsp. paratuberculosis
cagcgccucggcgaucg

SEQ ID NO: 902615 - RNA, 18 nt, Mycobacterium avium subsp. paratuberculosis
cagcgccucggcgaucgg

SEQ ID NO: 902616 - RNA, 14 nt, Mycobacterium avium subsp. paratuberculosis
cagcgccucggcgg

SEQ ID NO: 902617 - RNA, 15 nt, Mycobacterium avium subsp. paratuberculosis
cagcgccucggcggg

SEQ ID NO: 902618 - RNA, 14 nt, Mycobacterium avium subsp. paratuberculosis
cagcgccucggcgu

SEQ ID NO: 902619 - RNA, 15 nt, Mycobacterium avium subsp. paratuberculosis
cagcgccucggcguc

SEQ ID NO: 902620 - RNA, 16 nt, Mycobacterium avium subsp. paratuberculosis
cagcgccucggcguca

SEQ ID NO: 902621 - RNA, 18 nt, Mycobacterium avium subsp. paratuberculosis
cagcgccucggcgucacc

SEQ ID NO: 902622 - RNA, 19 nt, Mycobacterium avium subsp. paratuberculosis
cagcgccucggugaagccg

SEQ ID NO: 902623 - RNA, 16 nt, Mycobacterium avium subsp. paratuberculosis
cagcgccucgucgagc

SEQ ID NO: 902624 - RNA, 15 nt, Mycobacterium avium subsp. paratuberculosis
cagcgccucgccggg

SEQ ID NO: 902625 - RNA, 17 nt, Mycobacterium avium subsp. paratuberculosis
cagcgccucgcgggugc

SEQ ID NO: 902626 - RNA, 14 nt, Mycobacterium avium subsp. paratuberculosis
cagcgccucgcggu

SEQ ID NO: 902627 - RNA, 21 nt, Mycobacterium avium subsp. paratuberculosis
cagcgccucgcuaaucgccgc

SEQ ID NO: 902628 - RNA, 23 nt, Mycobacterium avium subsp. paratuberculosis
cagcgccucgcuaaucgccgcgc

SEQ ID NO: 902629 - RNA, 22 nt, Mycobacterium avium subsp. paratuberculosis
cagcgccucgagcaccacggcc

SEQ ID NO: 902630 - RNA, 15 nt, Mycobacterium avium subsp. paratuberculosis
cagcgccuccagccg

SEQ ID NO: 902631 - RNA, 21 nt, Mycobacterium avium subsp. paratuberculosis
cagcgccucccggaccaccag

SEQ ID NO: 902632 - RNA, 19 nt, Mycobacterium avium subsp. paratuberculosis
cagcgcgacgucgaccgcg

SEQ ID NO: 902633 - RNA, 13 nt, Mycobacterium avium subsp. paratuberculosis
cagcgcgacgugc

SEQ ID NO: 902634 - RNA, 16 nt, Mycobacterium avium subsp. paratuberculosis
cagcgcgacgugccgg

SEQ ID NO: 902635 - RNA, 17 nt, Mycobacterium avium subsp. paratuberculosis
cagcgcgacgugccggc

SEQ ID NO: 902636 - RNA, 21 nt, Mycobacterium avium subsp. paratuberculosis
cagcgcgacgugccggcgaug

SEQ ID NO: 902637 - RNA, 22 nt, Mycobacterium avium subsp. paratuberculosis
cagcgcgacgugccggcgaugg

SEQ ID NO: 902638 - RNA, 13 nt, Mycobacterium avium subsp. paratuberculosis
cagcgcgacgggc

SEQ ID NO: 902639 - RNA, 20 nt, Mycobacterium avium subsp. paratuberculosis
cagcgcgacgggcacccgcg

SEQ ID NO: 902640 - RNA, 23 nt, Mycobacterium avium subsp. paratuberculosis
cagcgcgaccucgguggugcuga

SEQ ID NO: 902641 - RNA, 17 nt, Mycobacterium avium subsp. paratuberculosis
cagcgcgacgaacagca

SEQ ID NO: 902642 - RNA, 21 nt, Mycobacterium avium subsp. paratuberculosis
cagcgcgacgaacagcaccgc

SEQ ID NO: 902643 - RNA, 22 nt, Mycobacterium avium subsp. paratuberculosis
cagcgcgacgaacagcaccgcc

SEQ ID NO: 902644 - RNA, 12 nt, Mycobacterium avium subsp. paratuberculosis
cagcgcgacgca

SEQ ID NO: 902645 - RNA, 21 nt, Mycobacterium avium subsp. paratuberculosis
cagcgcgacgcacgccggcgg

SEQ ID NO: 902646 - RNA, 23 nt, Mycobacterium avium subsp. paratuberculosis
cagcgcgacgcacgccggcgggg

SEQ ID NO: 902647 - RNA, 15 nt, Mycobacterium avium subsp. paratuberculosis
cagcgcgacaccgga

SEQ ID NO: 902648 - RNA, 13 nt, Mycobacterium avium subsp. paratuberculosis
cagcgcgacagcc

SEQ ID NO: 902649 - RNA, 20 nt, Mycobacterium avium subsp. paratuberculosis
cagcgcgacaucgccggcga

SEQ ID NO: 902650 - RNA, 22 nt, Mycobacterium avium subsp. paratuberculosis
cagcgcgacaucgccggcgacc

SEQ ID NO: 902651 - RNA, 11 nt, Mycobacterium avium subsp. paratuberculosis
cagcgcgacca

SEQ ID NO: 902652 - RNA, 14 nt, Mycobacterium avium subsp. paratuberculosis
cagcgcgaccagcc

SEQ ID NO: 902653 - RNA, 18 nt, Mycobacterium avium subsp. paratuberculosis
cagcgcgaccagcccggc

SEQ ID NO: 902654 - RNA, 19 nt, Mycobacterium avium subsp. paratuberculosis
cagcgcgaccagcccggcc

SEQ ID NO: 902655 - RNA, 24 nt, Mycobacterium avium subsp. paratuberculosis
cagcgcgaccagcccggccgccga

SEQ ID NO: 902656 - RNA, 15 nt, Mycobacterium avium subsp. paratuberculosis
cagcgcgaccgcccg

SEQ ID NO: 902657 - RNA, 21 nt, Mycobacterium avium subsp. paratuberculosis
cagcgcgaaauacgacgagcc

SEQ ID NO: 902658 - RNA, 17 nt, Mycobacterium avium subsp. paratuberculosis
cagcgcgaacagcgcgg

SEQ ID NO: 902659 - RNA, 18 nt, Mycobacterium avium subsp. paratuberculosis
cagcgcgaacagcgcggc

SEQ ID NO: 902660 - RNA, 20 nt, Mycobacterium avium subsp. paratuberculosis
cagcgcgaacaaucgcugcg

SEQ ID NO: 902661 - RNA, 15 nt, Mycobacterium avium subsp. paratuberculosis
cagcgccuucggcgc

SEQ ID NO: 902662 - RNA, 19 nt, Mycobacterium avium subsp. paratuberculosis
cagcgccuucggcgccagc

SEQ ID NO: 902663 - RNA, 19 nt, Mycobacterium avium subsp. paratuberculosis
cagcgccuucuccagcucc

SEQ ID NO: 902664 - RNA, 23 nt, Mycobacterium avium subsp. paratuberculosis
cagcgccuucuccagcuccucgg

SEQ ID NO: 902665 - RNA, 20 nt, Mycobacterium avium subsp. paratuberculosis
cagcgccuugggucccaucg

SEQ ID NO: 902666 - RNA, 16 nt, Mycobacterium avium subsp. paratuberculosis
cagcgccuugaccgcg

SEQ ID NO: 902667 - RNA, 18 nt, Mycobacterium avium subsp. paratuberculosis
cagcgccuugccgacgac

SEQ ID NO: 902668 - RNA, 15 nt, Mycobacterium avium subsp. paratuberculosis
cagcgccaugcugcc

SEQ ID NO: 902669 - RNA, 14 nt, Mycobacterium avium subsp. paratuberculosis
cagcgcccagccga

SEQ ID NO: 902670 - RNA, 19 nt, Mycobacterium avium subsp. paratuberculosis
cagcgcccagccgagccgg

SEQ ID NO: 902671 - RNA, 21 nt, Mycobacterium avium subsp. paratuberculosis
cagcgcccaggaugacgccga

SEQ ID NO: 902672 - RNA, 20 nt, Mycobacterium avium subsp. paratuberculosis
cagcgccccgguccggcuga

SEQ ID NO: 902673 - RNA, 15 nt, Mycobacterium avium subsp. paratuberculosis
cagcgcccccagcgg

SEQ ID NO: 902674 - RNA, 19 nt, Mycobacterium avium subsp. paratuberculosis
cagcgcccccgaggagacg

SEQ ID NO: 902675 - RNA, 16 nt, Mycobacterium avium subsp. paratuberculosis
cagcgccagcagcggc

SEQ ID NO: 902676 - RNA, 20 nt, Mycobacterium avium subsp. paratuberculosis
cagcgccagggugccccgca

SEQ ID NO: 902677 - RNA, 13 nt, Mycobacterium avium subsp. paratuberculosis
cagcgccaggugg

SEQ ID NO: 902678 - RNA, 14 nt, Mycobacterium avium subsp. paratuberculosis
cagcgccagcgcgc

SEQ ID NO: 902679 - RNA, 15 nt, Mycobacterium avium subsp. paratuberculosis
cagcgcccgggccag

SEQ ID NO: 902680 - RNA, 19 nt, Mycobacterium avium subsp. paratuberculosis
cagcgcccgggccaggacc

SEQ ID NO: 902681 - RNA, 13 nt, Mycobacterium avium subsp. paratuberculosis
cagcgcccgggcg

SEQ ID NO: 902682 - RNA, 19 nt, Mycobacterium avium subsp. paratuberculosis
cagcgcccgggcgcgugca

SEQ ID NO: 902683 - RNA, 14 nt, Mycobacterium avium subsp. paratuberculosis
cagcgcccgggugg

SEQ ID NO: 902684 - RNA, 23 nt, Mycobacterium avium subsp. paratuberculosis
cagcgcccgggugggcgggacgu

SEQ ID NO: 902685 - RNA, 22 nt, Mycobacterium avium subsp. paratuberculosis
cagcgcccguagccgcgguucg

SEQ ID NO: 902686 - RNA, 18 nt, Mycobacterium avium subsp. paratuberculosis
cagcgccgaggugcuguc

SEQ ID NO: 902687 - RNA, 19 nt, Mycobacterium avium subsp. paratuberculosis
cagcgccgacuuggugcca

SEQ ID NO: 902688 - RNA, 17 nt, Mycobacterium avium subsp. paratuberculosis
cagcgccgagaccagcc

SEQ ID NO: 902689 - RNA, 19 nt, Mycobacterium avium subsp. paratuberculosis
cagcgccgagaccagccag

SEQ ID NO: 902690 - RNA, 16 nt, Mycobacterium avium subsp. paratuberculosis
cagcgccgagacgugg

SEQ ID NO: 902691 - RNA, 17 nt, Mycobacterium avium subsp. paratuberculosis
cagcgccgagccgaggc

SEQ ID NO: 902692 - RNA, 19 nt, Mycobacterium avium subsp. paratuberculosis
cagcgccgagccgaggcag

SEQ ID NO: 902693 - RNA, 16 nt, Mycobacterium avium subsp. paratuberculosis
cagcgcccgcgggugc

SEQ ID NO: 902694 - RNA, 13 nt, Mycobacterium avium subsp. paratuberculosis
cagcgcccggcag

SEQ ID NO: 902695 - RNA, 15 nt, Mycobacterium avium subsp. paratuberculosis
cagcgcccggccgug

SEQ ID NO: 902696 - RNA, 15 nt, Mycobacterium avium subsp. paratuberculosis
cagcgcccggcgacc

SEQ ID NO: 902697 - RNA, 16 nt, Mycobacterium avium subsp. paratuberculosis
cagcgcccggcgacca

SEQ ID NO: 902698 - RNA, 22 nt, Mycobacterium avium subsp. paratuberculosis
cagcgcccggcgaccaccagcc

SEQ ID NO: 902699 - RNA, 13 nt, Mycobacterium avium subsp. paratuberculosis
cagcgcccgcgcg

SEQ ID NO: 902700 - RNA, 14 nt, Mycobacterium avium subsp. paratuberculosis
cagcgcccgcgcga

SEQ ID NO: 902701 - RNA, 17 nt, Mycobacterium avium subsp. paratuberculosis
cagcgcccgcgcgaucg

SEQ ID NO: 902702 - RNA, 18 nt, Mycobacterium avium subsp. paratuberculosis
cagcgcccgcgcgggcug

SEQ ID NO: 902703 - RNA, 14 nt, Mycobacterium avium subsp. paratuberculosis
cagcgcccgcgcgu

SEQ ID NO: 902704 - RNA, 20 nt, Mycobacterium avium subsp. paratuberculosis
cagcgcccgcgcgugggcca

SEQ ID NO: 902705 - RNA, 16 nt, Mycobacterium avium subsp. paratuberculosis
cagcgcccgauucgcg

SEQ ID NO: 902706 - RNA, 16 nt, Mycobacterium avium subsp. paratuberculosis
cagcgcccgcccggac

SEQ ID NO: 902707 - RNA, 19 nt, Mycobacterium avium subsp. paratuberculosis
cagcgcccgcccggcccgg

SEQ ID NO: 902708 - RNA, 14 nt, Mycobacterium avium subsp. paratuberculosis
cagcgcccgccgca

SEQ ID NO: 902709 - RNA, 19 nt, Mycobacterium avium subsp. paratuberculosis
cagcgcccgccgcaacgcg

SEQ ID NO: 902710 - RNA, 14 nt, Mycobacterium avium subsp. paratuberculosis
cagcgccacgcuca

SEQ ID NO: 902711 - RNA, 23 nt, Mycobacterium avium subsp. paratuberculosis
cagcgccacgcucaugcccgcca

SEQ ID NO: 902712 - RNA, 20 nt, Mycobacterium avium subsp. paratuberculosis
cagcgccacuggcuggucac

SEQ ID NO: 902713 - RNA, 12 nt, Mycobacterium avium subsp. paratuberculosis
cagcgccagcgc

SEQ ID NO: 902714 - RNA, 12 nt, Mycobacterium avium subsp. paratuberculosis
cagcgccagcgg

SEQ ID NO: 902715 - RNA, 14 nt, Mycobacterium avium subsp. paratuberculosis
cagcgccagcggcu

SEQ ID NO: 902716 - RNA, 13 nt, Mycobacterium avium subsp. paratuberculosis
cagcgccagcggg

SEQ ID NO: 902717 - RNA, 15 nt, Mycobacterium avium subsp. paratuberculosis
cagcgccagcguggc

SEQ ID NO: 902718 - RNA, 16 nt, Mycobacterium avium subsp. paratuberculosis
cagcgccagcguggcc

SEQ ID NO: 902719 - RNA, 20 nt, Mycobacterium avium subsp. paratuberculosis
cagcgccagcguggccagca

SEQ ID NO: 902720 - RNA, 24 nt, Mycobacterium avium subsp. paratuberculosis
cagcgccagcguggccagcaccgu

SEQ ID NO: 902721 - RNA, 17 nt, Mycobacterium avium subsp. paratuberculosis
cagcgccagcaccgggc

SEQ ID NO: 902722 - RNA, 17 nt, Mycobacterium avium subsp. paratuberculosis
cagcgccagcacggcca

SEQ ID NO: 902723 - RNA, 23 nt, Mycobacterium avium subsp. paratuberculosis
cagcgccagcacggccaccagca

SEQ ID NO: 902724 - RNA, 14 nt, Mycobacterium avium subsp. paratuberculosis
cagcgccagcaccg

SEQ ID NO: 902725 - RNA, 14 nt, Mycobacterium avium subsp. paratuberculosis
cagcgccagcaaca

SEQ ID NO: 902726 - RNA, 22 nt, Mycobacterium avium subsp. paratuberculosis
cagcgccagcaacacccagccg

SEQ ID NO: 902727 - RNA, 15 nt, Mycobacterium avium subsp. paratuberculosis
cagcgcaucgccggc

SEQ ID NO: 902728 - RNA, 17 nt, Mycobacterium avium subsp. paratuberculosis
cagcgcaucgccggcga

SEQ ID NO: 902729 - RNA, 20 nt, Mycobacterium avium subsp. paratuberculosis
cagcgcaucguugccggcgg

SEQ ID NO: 902730 - RNA, 21 nt, Mycobacterium avium subsp. paratuberculosis
cagcgcaucguugccggcggc

SEQ ID NO: 902731 - RNA, 19 nt, Mycobacterium avium subsp. paratuberculosis
cagcgccacaccgaagaac

SEQ ID NO: 902732 - RNA, 13 nt, Mycobacterium avium subsp. paratuberculosis
cagcgccaccagc

SEQ ID NO: 902733 - RNA, 18 nt, Mycobacterium avium subsp. paratuberculosis
cagcgccaccagcaccgg

SEQ ID NO: 902734 - RNA, 20 nt, Mycobacterium avium subsp. paratuberculosis
cagcgccaccagcaccggga

SEQ ID NO: 902735 - RNA, 22 nt, Mycobacterium avium subsp. paratuberculosis
cagcgccaccagcaccgggaag

SEQ ID NO: 902736 - RNA, 14 nt, Mycobacterium avium subsp. paratuberculosis
cagcgcauccgaca

SEQ ID NO: 902737 - RNA, 23 nt, Mycobacterium avium subsp. paratuberculosis
cagcgcauccucauagccggccg

SEQ ID NO: 902738 - RNA, 23 nt, Mycobacterium avium subsp. paratuberculosis
cagcgcauacaacucgaagcugc

SEQ ID NO: 902739 - RNA, 18 nt, Mycobacterium avium subsp. paratuberculosis
cagcgcagguacgcggcg

SEQ ID NO: 902740 - RNA, 16 nt, Mycobacterium avium subsp. paratuberculosis
cagcgcagugcggacg

SEQ ID NO: 902741 - RNA, 14 nt, Mycobacterium avium subsp. paratuberculosis
cuccagcaccggau

SEQ ID NO: 902742 - RNA, 15 nt, Mycobacterium avium subsp. paratuberculosis
cuccagcaccggcgc

SEQ ID NO: 902743 - RNA, 13 nt, Mycobacterium avium subsp. paratuberculosis
cuccagcaccguc

SEQ ID NO: 902744 - RNA, 16 nt, Mycobacterium avium subsp. paratuberculosis
cuccagcaccgucggc

SEQ ID NO: 902745 - RNA, 21 nt, Mycobacterium avium subsp. paratuberculosis
cucauguugugcaggcagccg

SEQ ID NO: 902746 - RNA, 18 nt, Mycobacterium avium subsp. paratuberculosis
cucaugucguacgggcgc

SEQ ID NO: 902747 - RNA, 19 nt, Mycobacterium avium subsp. paratuberculosis
cuccagcagcuucaugccc

SEQ ID NO: 902748 - RNA, 14 nt, Mycobacterium avium subsp. paratuberculosis
cuccagcagggaca

SEQ ID NO: 902749 - RNA, 23 nt, Mycobacterium avium subsp. paratuberculosis
cuccagcacgaaggccgccgggu

SEQ ID NO: 902750 - RNA, 17 nt, Mycobacterium avium subsp. paratuberculosis
cuccagcagcccgggcu

SEQ ID NO: 902751 - RNA, 13 nt, Mycobacterium avium subsp. paratuberculosis
cuccagcagcgcc

SEQ ID NO: 902752 - RNA, 14 nt, Mycobacterium avium subsp. paratuberculosis
cuccagcagcgcca

SEQ ID NO: 902753 - RNA, 15 nt, Mycobacterium avium subsp. paratuberculosis
cuccagcagcgccag

SEQ ID NO: 902754 - RNA, 13 nt, Mycobacterium avium subsp. paratuberculosis
cuccagcgcccgc

SEQ ID NO: 902755 - RNA, 16 nt, Mycobacterium avium subsp. paratuberculosis
cuccagcgcccgccgc

SEQ ID NO: 902756 - RNA, 16 nt, Mycobacterium avium subsp. paratuberculosis
cuccagccgcgcggcc

SEQ ID NO: 902757 - RNA, 19 nt, Mycobacterium avium subsp. paratuberculosis
cuccagccgcgcggccgcc

SEQ ID NO: 902758 - RNA, 22 nt, Mycobacterium avium subsp. paratuberculosis
cuccagcuggagaggcccggca

SEQ ID NO: 902759 - RNA, 19 nt, Mycobacterium avium subsp. paratuberculosis
cuccagcuccgcggccagc

SEQ ID NO: 902760 - RNA, 15 nt, Mycobacterium avium subsp. paratuberculosis
cuccagcuccucggu

SEQ ID NO: 902761 - RNA, 14 nt, Mycobacterium avium subsp. paratuberculosis
cuccagcgggcggc

SEQ ID NO: 902762 - RNA, 15 nt, Mycobacterium avium subsp. paratuberculosis
cuccagcgggcggcg

SEQ ID NO: 902763 - RNA, 17 nt, Mycobacterium avium subsp. paratuberculosis
cuccagcgggcggcggu

SEQ ID NO: 902764 - RNA, 19 nt, Mycobacterium avium subsp. paratuberculosis
cuccagcgggcggcggugg

SEQ ID NO: 902765 - RNA, 16 nt, Mycobacterium avium subsp. paratuberculosis
cuccagcgcggucucg

SEQ ID NO: 902766 - RNA, 17 nt, Mycobacterium avium subsp. paratuberculosis
cuccagcgcgaucaacg

SEQ ID NO: 902767 - RNA, 13 nt, Mycobacterium avium subsp. paratuberculosis
cuccagcggccac

SEQ ID NO: 902768 - RNA, 17 nt, Mycobacterium avium subsp. paratuberculosis
cuccagcggccacaccg

SEQ ID NO: 902769 - RNA, 13 nt, Mycobacterium avium subsp. paratuberculosis
cuccagcggccgc

SEQ ID NO: 902770 - RNA, 19 nt, Mycobacterium avium subsp. paratuberculosis
cuccagcggccgcagcgcg

SEQ ID NO: 902771 - RNA, 20 nt, Mycobacterium avium subsp. paratuberculosis
cuccagcggccgcagcgcga

SEQ ID NO: 902772 - RNA, 21 nt, Mycobacterium avium subsp. paratuberculosis
cuccagcggccgcagcgcgac

SEQ ID NO: 902773 - RNA, 15 nt, Mycobacterium avium subsp. paratuberculosis
cuccagcggccgggc

SEQ ID NO: 902774 - RNA, 20 nt, Mycobacterium avium subsp. paratuberculosis
cuccaggguucucgcggcgg

SEQ ID NO: 902775 - RNA, 19 nt, Mycobacterium avium subsp. paratuberculosis
cuccagguagggcacaccg

SEQ ID NO: 902776 - RNA, 12 nt, Mycobacterium avium subsp. paratuberculosis
cuccaugucguc

SEQ ID NO: 902777 - RNA, 16 nt, Mycobacterium avium subsp. paratuberculosis
cuccaugucgucggcg

SEQ ID NO: 902778 - RNA, 17 nt, Mycobacterium avium subsp. paratuberculosis
cuccaugucgucggcgg

SEQ ID NO: 902779 - RNA, 19 nt, Mycobacterium avium subsp. paratuberculosis
cuccaugucgucggcggac

SEQ ID NO: 902780 - RNA, 15 nt, Mycobacterium avium subsp. paratuberculosis
cuccauggcggcgac

SEQ ID NO: 902781 - RNA, 17 nt, Mycobacterium avium subsp. paratuberculosis
cuccaggcucgacaacu

SEQ ID NO: 902782 - RNA, 21 nt, Mycobacterium avium subsp. paratuberculosis
cuccaggaagaacccggcgug

SEQ ID NO: 902783 - RNA, 23 nt, Mycobacterium avium subsp. paratuberculosis
cuccagcuguugacgggccgcgg

SEQ ID NO: 902784 - RNA, 15 nt, Mycobacterium avium subsp. paratuberculosis
cucccgucgcgacga

SEQ ID NO: 902785 - RNA, 23 nt, Mycobacterium avium subsp. paratuberculosis
cucccgucgcgacgagcgggccg

SEQ ID NO: 902786 - RNA, 17 nt, Mycobacterium avium subsp. paratuberculosis
cucccgggugcgcgucg

SEQ ID NO: 902787 - RNA, 23 nt, Mycobacterium avium subsp. paratuberculosis
cucccgggugcgcgucgcggugg

SEQ ID NO: 902788 - RNA, 20 nt, Mycobacterium avium subsp. paratuberculosis
cucccgggugggcagcgcga

SEQ ID NO: 902789 - RNA, 18 nt, Mycobacterium avium subsp. paratuberculosis
cucccgguagaucgccgg

SEQ ID NO: 902790 - RNA, 16 nt, Mycobacterium avium subsp. paratuberculosis
cucccgguagccgaca

SEQ ID NO: 902791 - RNA, 17 nt, Mycobacterium avium subsp. paratuberculosis
cucccgguaggcggcga

SEQ ID NO: 902792 - RNA, 23 nt, Mycobacterium avium subsp. paratuberculosis
cucccggucguagucggcccgcc

SEQ ID NO: 902793 - RNA, 17 nt, Mycobacterium avium subsp. paratuberculosis
cucccggcgccacgccg

SEQ ID NO: 902794 - RNA, 17 nt, Mycobacterium avium subsp. paratuberculosis
cucccggcagaucgcgg

SEQ ID NO: 902795 - RNA, 19 nt, Mycobacterium avium subsp. paratuberculosis
cucccggcagaucgcggcc

SEQ ID NO: 902796 - RNA, 14 nt, Mycobacterium avium subsp. paratuberculosis
cucccggccgacga

SEQ ID NO: 902797 - RNA, 12 nt, Mycobacterium avium subsp. paratuberculosis
cucccgggcggc

SEQ ID NO: 902798 - RNA, 15 nt, Mycobacterium avium subsp. paratuberculosis
cucccgggcggcgcc

SEQ ID NO: 902799 - RNA, 12 nt, Mycobacterium avium subsp. paratuberculosis
cucccgggcggu

SEQ ID NO: 902800 - RNA, 20 nt, Mycobacterium avium subsp. paratuberculosis
cucccggaacagcuuggcgc

SEQ ID NO: 902801 - RNA, 14 nt, Mycobacterium avium subsp. paratuberculosis
cucccgcuccaugg

SEQ ID NO: 902802 - RNA, 16 nt, Mycobacterium avium subsp. paratuberculosis
cucccgcuccauggcg

SEQ ID NO: 902803 - RNA, 18 nt, Mycobacterium avium subsp. paratuberculosis
cucccgcuccauggcggc

SEQ ID NO: 902804 - RNA, 21 nt, Mycobacterium avium subsp. paratuberculosis
cucccgcuccauggcggcgac

SEQ ID NO: 902805 - RNA, 19 nt, Mycobacterium avium subsp. paratuberculosis
cucccagacgucgaccuug

SEQ ID NO: 902806 - RNA, 20 nt, Mycobacterium avium subsp. paratuberculosis
cucccagacgucgaccuugc

SEQ ID NO: 902807 - RNA, 12 nt, Mycobacterium avium subsp. paratuberculosis
cucccagccgcc

SEQ ID NO: 902808 - RNA, 22 nt, Mycobacterium avium subsp. paratuberculosis
cucccagcgcccgggcgcgugc

SEQ ID NO: 902809 - RNA, 18 nt, Mycobacterium avium subsp. paratuberculosis
cucccaggacagcugacg

SEQ ID NO: 902810 - RNA, 20 nt, Mycobacterium avium subsp. paratuberculosis
cucccaggacggcgcggugg

SEQ ID NO: 902811 - RNA, 21 nt, Mycobacterium avium subsp. paratuberculosis
cucccaggauuccgucggcgg

SEQ ID NO: 902812 - RNA, 22 nt, Mycobacterium avium subsp. paratuberculosis
cucccaggauuccgucggcggc

SEQ ID NO: 902813 - RNA, 22 nt, Mycobacterium avium subsp. paratuberculosis
cucccacucguagucguuggug

SEQ ID NO: 902814 - RNA, 19 nt, Mycobacterium avium subsp. paratuberculosis
cucccaccacggccgaugc

SEQ ID NO: 902815 - RNA, 13 nt, Mycobacterium avium subsp. paratuberculosis
cucccacagcgga

SEQ ID NO: 902816 - RNA, 13 nt, Mycobacterium avium subsp. paratuberculosis
cucccacaggucg

SEQ ID NO: 902817 - RNA, 16 nt, Mycobacterium avium subsp. paratuberculosis
cucacaccucgcuacg

SEQ ID NO: 902818 - RNA, 21 nt, Mycobacterium avium subsp. paratuberculosis
cucacaccucgcuacgcgagc

SEQ ID NO: 902819 - RNA, 13 nt, Mycobacterium avium subsp. paratuberculosis
cucacacagccgc

SEQ ID NO: 902820 - RNA, 21 nt, Mycobacterium avium subsp. paratuberculosis
cucacagcgacaacgggccgc

SEQ ID NO: 902821 - RNA, 16 nt, Mycobacterium avium subsp. paratuberculosis
cucacagcgcggcggu

SEQ ID NO: 902822 - RNA, 18 nt, Mycobacterium avium subsp. paratuberculosis
cucacagcgcggcgguga

SEQ ID NO: 902823 - RNA, 23 nt, Mycobacterium avium subsp. paratuberculosis
cucacaugggcgcguuggccggc

SEQ ID NO: 902824 - RNA, 15 nt, Mycobacterium avium subsp. paratuberculosis
cucacgccucgucga

SEQ ID NO: 902825 - RNA, 19 nt, Mycobacterium avium subsp. paratuberculosis
cucacggucggcguccagc

SEQ ID NO: 902826 - RNA, 23 nt, Mycobacterium avium subsp. paratuberculosis
cucacggucggcguccagcgcgg

SEQ ID NO: 902827 - RNA, 16 nt, Mycobacterium avium subsp. paratuberculosis
cucacguagucgaccg

SEQ ID NO: 902828 - RNA, 22 nt, Mycobacterium avium subsp. paratuberculosis
cucacggcgaauauuucgccga

SEQ ID NO: 902829 - RNA, 18 nt, Mycobacterium avium subsp. paratuberculosis
cucacggcggcagcgcgg

SEQ ID NO: 902830 - RNA, 21 nt, Mycobacterium avium subsp. paratuberculosis
cucacggcggcagcgcggcgu

SEQ ID NO: 902831 - RNA, 17 nt, Mycobacterium avium subsp. paratuberculosis
cucagcgauugcggccg

SEQ ID NO: 902832 - RNA, 19 nt, Mycobacterium avium subsp. paratuberculosis
cucagcgauugcggccgcc

SEQ ID NO: 902833 - RNA, 22 nt, Mycobacterium avium subsp. paratuberculosis
cucagcgauugcggccgccggc

SEQ ID NO: 902834 - RNA, 14 nt, Mycobacterium avium subsp. paratuberculosis
cucagcgcaccgcc

SEQ ID NO: 902835 - RNA, 23 nt, Mycobacterium avium subsp. paratuberculosis
cucagcgcccaggaugacgccga

SEQ ID NO: 902836 - RNA, 20 nt, Mycobacterium avium subsp. paratuberculosis
cucagcgcccgcccggcccg

SEQ ID NO: 902837 - RNA, 21 nt, Mycobacterium avium subsp. paratuberculosis
cucagcgcccgcccggcccgg

SEQ ID NO: 902838 - RNA, 22 nt, Mycobacterium avium subsp. paratuberculosis
cucagcgcccgcccggcccggc

SEQ ID NO: 902839 - RNA, 23 nt, Mycobacterium avium subsp. paratuberculosis
cucagcgcccgcccggcccggcg

SEQ ID NO: 902840 - RNA, 13 nt, Mycobacterium avium subsp. paratuberculosis
cucagcgcggcgg

SEQ ID NO: 902841 - RNA, 15 nt, Mycobacterium avium subsp. paratuberculosis
cucagcgcggcgggc

SEQ ID NO: 902842 - RNA, 22 nt, Mycobacterium avium subsp. paratuberculosis
cucagcgcugucgcgggcccgc

SEQ ID NO: 902843 - RNA, 20 nt, Mycobacterium avium subsp. paratuberculosis
cucagcgcgacgugccggcg

SEQ ID NO: 902844 - RNA, 17 nt, Mycobacterium avium subsp. paratuberculosis
cucagcgcgcaacgacg

SEQ ID NO: 902845 - RNA, 18 nt, Mycobacterium avium subsp. paratuberculosis
cucagugcacgcucggcg

SEQ ID NO: 902846 - RNA, 22 nt, Mycobacterium avium subsp. paratuberculosis
cucagugcacgcucggcgcgac

SEQ ID NO: 902847 - RNA, 15 nt, Mycobacterium avium subsp. paratuberculosis
cucaucaggcggccg

SEQ ID NO: 902848 - RNA, 21 nt, Mycobacterium avium subsp. paratuberculosis
cucagguggacagaugccaga

SEQ ID NO: 902849 - RNA, 15 nt, Mycobacterium avium subsp. paratuberculosis
cucaguccgacgcga

SEQ ID NO: 902850 - RNA, 19 nt, Mycobacterium avium subsp. paratuberculosis
cucaguccgccccgaugcg

SEQ ID NO: 902851 - RNA, 14 nt, Mycobacterium avium subsp. paratuberculosis
cucaguccucgccg

SEQ ID NO: 902852 - RNA, 15 nt, Mycobacterium avium subsp. paratuberculosis
cucaguccucgccga

SEQ ID NO: 902853 - RNA, 18 nt, Mycobacterium avium subsp. paratuberculosis
cucaggcgucggucagca

SEQ ID NO: 902854 - RNA, 14 nt, Mycobacterium avium subsp. paratuberculosis
cucaggcguccagc

SEQ ID NO: 902855 - RNA, 19 nt, Mycobacterium avium subsp. paratuberculosis
cucaggcguccagcaccug

SEQ ID NO: 902856 - RNA, 12 nt, Mycobacterium avium subsp. paratuberculosis
cucagcggcgcu

SEQ ID NO: 902857 - RNA, 16 nt, Mycobacterium avium subsp. paratuberculosis
cucagcggcagcgucg

SEQ ID NO: 902858 - RNA, 17 nt, Mycobacterium avium subsp. paratuberculosis
cucagcggcagcgucgc

SEQ ID NO: 902859 - RNA, 13 nt, Mycobacterium avium subsp. paratuberculosis
cucagcggccauc

SEQ ID NO: 902860 - RNA, 19 nt, Mycobacterium avium subsp. paratuberculosis
cucagcggccaucgccgcc

SEQ ID NO: 902861 - RNA, 17 nt, Mycobacterium avium subsp. paratuberculosis
cucagcgcggccacacc

SEQ ID NO: 902862 - RNA, 22 nt, Mycobacterium avium subsp. paratuberculosis
cucaugcccgccacggccagca

SEQ ID NO: 902863 - RNA, 15 nt, Mycobacterium avium subsp. paratuberculosis
cucaugagcccucca

SEQ ID NO: 902864 - RNA, 17 nt, Mycobacterium avium subsp. paratuberculosis
cucaucgucgacccggc

SEQ ID NO: 902865 - RNA, 17 nt, Mycobacterium avium subsp. paratuberculosis
cucaucuacgucgucgc

SEQ ID NO: 902866 - RNA, 20 nt, Mycobacterium avium subsp. paratuberculosis
cucaucuacgucgucgccgg

SEQ ID NO: 902867 - RNA, 22 nt, Mycobacterium avium subsp. paratuberculosis
cucaucccuagcgugccgucca

SEQ ID NO: 902868 - RNA, 23 nt, Mycobacterium avium subsp. paratuberculosis
cucaucgaggucgaaccacgcgg

SEQ ID NO: 902869 - RNA, 16 nt, Mycobacterium avium subsp. paratuberculosis
cuacuugcggccgcga

SEQ ID NO: 902870 - RNA, 20 nt, Mycobacterium avium subsp. paratuberculosis
cuacuugcguugcgcggcgg

SEQ ID NO: 902871 - RNA, 22 nt, Mycobacterium avium subsp. paratuberculosis
cuacugcgccaauacacuucgg

SEQ ID NO: 902872 - RNA, 14 nt, Mycobacterium avium subsp. paratuberculosis
cuacugccgacgca

SEQ ID NO: 902873 - RNA, 15 nt, Mycobacterium avium subsp. paratuberculosis
cuacucggacgccgg

SEQ ID NO: 902874 - RNA, 20 nt, Mycobacterium avium subsp. paratuberculosis
cuacucggacgccggcagcc

SEQ ID NO: 902875 - RNA, 20 nt, Mycobacterium avium subsp. paratuberculosis
cuagacgcgcagcacggaac

SEQ ID NO: 902876 - RNA, 19 nt, Mycobacterium avium subsp. paratuberculosis
cuagaccgauggcggcggc

SEQ ID NO: 902877 - RNA, 23 nt, Mycobacterium avium subsp. paratuberculosis
cuagaccgauggcggcggcccgc

SEQ ID NO: 902878 - RNA, 22 nt, Mycobacterium avium subsp. paratuberculosis
cuaccgcgcccaggggagcggc

SEQ ID NO: 902879 - RNA, 20 nt, Mycobacterium avium subsp. paratuberculosis
cuaccgcgcucaccgucgcg

SEQ ID NO: 902880 - RNA, 15 nt, Mycobacterium avium subsp. paratuberculosis
cuaccgccgggcggg

SEQ ID NO: 902881 - RNA, 18 nt, Mycobacterium avium subsp. paratuberculosis
cuaccgccgggcgggccg

SEQ ID NO: 902882 - RNA, 23 nt, Mycobacterium avium subsp. paratuberculosis
cuaccgccgggcgggccgcagca

SEQ ID NO: 902883 - RNA, 16 nt, Mycobacterium avium subsp. paratuberculosis
cuaccgccgagcguga

SEQ ID NO: 902884 - RNA, 15 nt, Mycobacterium avium subsp. paratuberculosis
cuaccgacggcaccu

SEQ ID NO: 902885 - RNA, 21 nt, Mycobacterium avium subsp. paratuberculosis
cguugaacgacaucaccaccg

SEQ ID NO: 902886 - RNA, 17 nt, Mycobacterium avium subsp. paratuberculosis
cguugagcaggcuggag

SEQ ID NO: 902887 - RNA, 17 nt, Mycobacterium avium subsp. paratuberculosis
cguugagcacgcggacc

SEQ ID NO: 902888 - RNA, 15 nt, Mycobacterium avium subsp. paratuberculosis
cguugagcaccacga

SEQ ID NO: 902889 - RNA, 16 nt, Mycobacterium avium subsp. paratuberculosis
cguugagcaccacgag

SEQ ID NO: 902890 - RNA, 13 nt, Mycobacterium avium subsp. paratuberculosis
cguugagcaccgc

SEQ ID NO: 902891 - RNA, 14 nt, Mycobacterium avium subsp. paratuberculosis
cguugagcaccgcg

SEQ ID NO: 902892 - RNA, 15 nt, Mycobacterium avium subsp. paratuberculosis
cguugagccggcgca

SEQ ID NO: 902893 - RNA, 16 nt, Mycobacterium avium subsp. paratuberculosis
cguugagccggcgcac

SEQ ID NO: 902894 - RNA, 18 nt, Mycobacterium avium subsp. paratuberculosis
cguugagccggcgcaccg

SEQ ID NO: 902895 - RNA, 20 nt, Mycobacterium avium subsp. paratuberculosis
cguugagccggcgcaccgcg

SEQ ID NO: 902896 - RNA, 17 nt, Mycobacterium avium subsp. paratuberculosis
cguugagcgucgccacc

SEQ ID NO: 902897 - RNA, 18 nt, Mycobacterium avium subsp. paratuberculosis
cguugagcgucgccacca

SEQ ID NO: 902898 - RNA, 21 nt, Mycobacterium avium subsp. paratuberculosis
cguugagcgucgccaccaccu

SEQ ID NO: 902899 - RNA, 16 nt, Mycobacterium avium subsp. paratuberculosis
cguugagcuucucggu

SEQ ID NO: 902900 - RNA, 11 nt, Mycobacterium avium subsp. paratuberculosis
cguugaggcga

SEQ ID NO: 902901 - RNA, 14 nt, Mycobacterium avium subsp. paratuberculosis
cguugaggcgagcc

SEQ ID NO: 902902 - RNA, 15 nt, Mycobacterium avium subsp. paratuberculosis
cguugaggcgagccg

SEQ ID NO: 902903 - RNA, 12 nt, Mycobacterium avium subsp. paratuberculosis
cguugaggcggc

SEQ ID NO: 902904 - RNA, 19 nt, Mycobacterium avium subsp. paratuberculosis
cguugaggcggcggcgggc

SEQ ID NO: 902905 - RNA, 14 nt, Mycobacterium avium subsp. paratuberculosis
cuacaggugccggc

SEQ ID NO: 902906 - RNA, 18 nt, Mycobacterium avium subsp. paratuberculosis
cguugagucccucggcga

SEQ ID NO: 902907 - RNA, 23 nt, Mycobacterium avium subsp. paratuberculosis
cguugagugcgcuguggugacgg

SEQ ID NO: 902908 - RNA, 17 nt, Mycobacterium avium subsp. paratuberculosis
cucaacggccggcgccg

SEQ ID NO: 902909 - RNA, 19 nt, Mycobacterium avium subsp. paratuberculosis
cucaacggccggcgccgcc

SEQ ID NO: 902910 - RNA, 21 nt, Mycobacterium avium subsp. paratuberculosis
cucaagaugauugcgugcccg

SEQ ID NO: 902911 - RNA, 20 nt, Mycobacterium avium subsp. paratuberculosis
cucaaucuucuccgcggccg

SEQ ID NO: 902912 - RNA, 12 nt, Mycobacterium avium subsp. paratuberculosis
cuauggcaucgc

SEQ ID NO: 902913 - RNA, 18 nt, Mycobacterium avium subsp. paratuberculosis
cuauggcaucgccaaggc

SEQ ID NO: 902914 - RNA, 18 nt, Mycobacterium avium subsp. paratuberculosis
cucaaaccgggccugcgc

SEQ ID NO: 902915 - RNA, 20 nt, Mycobacterium avium subsp. paratuberculosis
cucaacacguccuggcgcca

SEQ ID NO: 902916 - RNA, 15 nt, Mycobacterium avium subsp. paratuberculosis
cucaacccgggccgg

SEQ ID NO: 902917 - RNA, 13 nt, Mycobacterium avium subsp. paratuberculosis
cuagcgcggcggc

SEQ ID NO: 902918 - RNA, 20 nt, Mycobacterium avium subsp. paratuberculosis
cuagcggccuaggacgccgc

SEQ ID NO: 902919 - RNA, 15 nt, Mycobacterium avium subsp. paratuberculosis
cuagccuuggccgca

SEQ ID NO: 902920 - RNA, 21 nt, Mycobacterium avium subsp. paratuberculosis
cuagcgagcgggcacgccgcc

SEQ ID NO: 902921 - RNA, 23 nt, Mycobacterium avium subsp. paratuberculosis
cuagcgagcgggcacgccgccgc

SEQ ID NO: 902922 - RNA, 15 nt, Mycobacterium avium subsp. paratuberculosis
cuagcgacggccguu

SEQ ID NO: 902923 - RNA, 13 nt, Mycobacterium avium subsp. paratuberculosis
cuagccgccgagc

SEQ ID NO: 902924 - RNA, 19 nt, Mycobacterium avium subsp. paratuberculosis
cuagccgccgagcgucacg

SEQ ID NO: 902925 - RNA, 21 nt, Mycobacterium avium subsp. paratuberculosis
cuagccgccgagcgucacgcu

SEQ ID NO: 902926 - RNA, 13 nt, Mycobacterium avium subsp. paratuberculosis
cucgaaagccgcu

SEQ ID NO: 902927 - RNA, 17 nt, Mycobacterium avium subsp. paratuberculosis
cucgaacaggcuggcca

SEQ ID NO: 902928 - RNA, 19 nt, Mycobacterium avium subsp. paratuberculosis
cucgaacaggcuggccagc

SEQ ID NO: 902929 - RNA, 20 nt, Mycobacterium avium subsp. paratuberculosis
cucgaacaggcuggccagcu

SEQ ID NO: 902930 - RNA, 19 nt, Mycobacterium avium subsp. paratuberculosis
cucgaacaccgcaccgguc

SEQ ID NO: 902931 - RNA, 21 nt, Mycobacterium avium subsp. paratuberculosis
cuccuuggccaggcgggccac

SEQ ID NO: 902932 - RNA, 15 nt, Mycobacterium avium subsp. paratuberculosis
cuccuugagccgccg

SEQ ID NO: 902933 - RNA, 13 nt, Mycobacterium avium subsp. paratuberculosis
cuccggcgucgaa

SEQ ID NO: 902934 - RNA, 18 nt, Mycobacterium avium subsp. paratuberculosis
cuccgggcggcaccgcug

SEQ ID NO: 902935 - RNA, 17 nt, Mycobacterium avium subsp. paratuberculosis
cuccgggcccaccaggu

SEQ ID NO: 902936 - RNA, 17 nt, Mycobacterium avium subsp. paratuberculosis
cuccgggaacgcggcga

SEQ ID NO: 902937 - RNA, 19 nt, Mycobacterium avium subsp. paratuberculosis
cuccucgcgcggcaccacc

SEQ ID NO: 902938 - RNA, 17 nt, Mycobacterium avium subsp. paratuberculosis
cuccuccugcggugggc

SEQ ID NO: 902939 - RNA, 15 nt, Mycobacterium avium subsp. paratuberculosis
cuccucggccagcac

SEQ ID NO: 902940 - RNA, 20 nt, Mycobacterium avium subsp. paratuberculosis
cuccucggccagcaccagca

SEQ ID NO: 902941 - RNA, 23 nt, Mycobacterium avium subsp. paratuberculosis
cuccucggccagcaccagcagcc

SEQ ID NO: 902942 - RNA, 16 nt, Mycobacterium avium subsp. paratuberculosis
cuccucggccagcccc

SEQ ID NO: 902943 - RNA, 21 nt, Mycobacterium avium subsp. paratuberculosis
cuccucggccagccccaccac

SEQ ID NO: 902944 - RNA, 16 nt, Mycobacterium avium subsp. paratuberculosis
cuccucgaaccucgcg

SEQ ID NO: 902945 - RNA, 23 nt, Mycobacterium avium subsp. paratuberculosis
cuccucgaccagcgcgccgccca

SEQ ID NO: 902946 - RNA, 19 nt, Mycobacterium avium subsp. paratuberculosis
cuccuccaggaaacggccc

SEQ ID NO: 902947 - RNA, 19 nt, Mycobacterium avium subsp. paratuberculosis
cuccucccagcccucgucg

SEQ ID NO: 902948 - RNA, 20 nt, Mycobacterium avium subsp. paratuberculosis
cuccucccagcccucgucga

SEQ ID NO: 902949 - RNA, 22 nt, Mycobacterium avium subsp. paratuberculosis
cuccuccggguccccgccgccg

SEQ ID NO: 902950 - RNA, 15 nt, Mycobacterium avium subsp. paratuberculosis
cuccuccucgcgccg

SEQ ID NO: 902951 - RNA, 23 nt, Mycobacterium avium subsp. paratuberculosis
cucgaacucaccgguggccgcgu

SEQ ID NO: 902952 - RNA, 16 nt, Mycobacterium avium subsp. paratuberculosis
cucgaagccgaucgcg

SEQ ID NO: 902953 - RNA, 19 nt, Mycobacterium avium subsp. paratuberculosis
cucgaagccgaucgcggcg

SEQ ID NO: 902954 - RNA, 20 nt, Mycobacterium avium subsp. paratuberculosis
cucgaagcgcagcagcucgu

SEQ ID NO: 902955 - RNA, 23 nt, Mycobacterium avium subsp. paratuberculosis
cucgaagcgcagcagcucgucgu

SEQ ID NO: 902956 - RNA, 12 nt, Mycobacterium avium subsp. paratuberculosis
cucgaacgccgg

SEQ ID NO: 902957 - RNA, 14 nt, Mycobacterium avium subsp. paratuberculosis
cucgaacggcccgg

SEQ ID NO: 902958 - RNA, 17 nt, Mycobacterium avium subsp. paratuberculosis
cucgaaccgggcgguga

SEQ ID NO: 902959 - RNA, 19 nt, Mycobacterium avium subsp. paratuberculosis
cucgaaccgggcggugacc

SEQ ID NO: 902960 - RNA, 18 nt, Mycobacterium avium subsp. paratuberculosis
cucgaagaucuccgggaa

SEQ ID NO: 902961 - RNA, 19 nt, Mycobacterium avium subsp. paratuberculosis
cucgaagauggucgcgccg

SEQ ID NO: 902962 - RNA, 23 nt, Mycobacterium avium subsp. paratuberculosis
cucgaagauggucgcgccgcggc

SEQ ID NO: 902963 - RNA, 19 nt, Mycobacterium avium subsp. paratuberculosis
cucgacgaccucgccgacg

SEQ ID NO: 902964 - RNA, 19 nt, Mycobacterium avium subsp. paratuberculosis
cucgacgaacgcggcggag

SEQ ID NO: 902965 - RNA, 20 nt, Mycobacterium avium subsp. paratuberculosis
cucgacgaacuccgcgcgcg

SEQ ID NO: 902966 - RNA, 17 nt, Mycobacterium avium subsp. paratuberculosis
cucgaccugcccgggcc

SEQ ID NO: 902967 - RNA, 19 nt, Mycobacterium avium subsp. paratuberculosis
cucgaccugggucaucacc

SEQ ID NO: 902968 - RNA, 17 nt, Mycobacterium avium subsp. paratuberculosis
cucgaccuucgagccgc

SEQ ID NO: 902969 - RNA, 21 nt, Mycobacterium avium subsp. paratuberculosis
cucgaccuucgagccgccgcc

SEQ ID NO: 902970 - RNA, 14 nt, Mycobacterium avium subsp. paratuberculosis
cucgaagcugcgcc

SEQ ID NO: 902971 - RNA, 21 nt, Mycobacterium avium subsp. paratuberculosis
cucgaccgcgguggcggugcg

SEQ ID NO: 902972 - RNA, 19 nt, Mycobacterium avium subsp. paratuberculosis
cucgaccgugaggcccggc

SEQ ID NO: 902973 - RNA, 16 nt, Mycobacterium avium subsp. paratuberculosis
cucgaccucggcgacc

SEQ ID NO: 902974 - RNA, 17 nt, Mycobacterium avium subsp. paratuberculosis
cucgaccucggcgacca

SEQ ID NO: 902975 - RNA, 18 nt, Mycobacterium avium subsp. paratuberculosis
cucgaccucggcggccag

SEQ ID NO: 902976 - RNA, 19 nt, Mycobacterium avium subsp. paratuberculosis
cucgaccucggcggccagc

SEQ ID NO: 902977 - RNA, 14 nt, Mycobacterium avium subsp. paratuberculosis
cucgaccucgucgg

SEQ ID NO: 902978 - RNA, 21 nt, Mycobacterium avium subsp. paratuberculosis
cucgaccucgucggcggcgac

SEQ ID NO: 902979 - RNA, 23 nt, Mycobacterium avium subsp. paratuberculosis
cucgaccucgucggcggcgacgg

SEQ ID NO: 902980 - RNA, 20 nt, Mycobacterium avium subsp. paratuberculosis
cucgaccucuucggcgccgg

SEQ ID NO: 902981 - RNA, 21 nt, Mycobacterium avium subsp. paratuberculosis
cucgaccucuucggcgccggc

SEQ ID NO: 902982 - RNA, 22 nt, Mycobacterium avium subsp. paratuberculosis
cucgaccucuucggcgccggca

SEQ ID NO: 902983 - RNA, 14 nt, Mycobacterium avium subsp. paratuberculosis
cucgacguaggcca

SEQ ID NO: 902984 - RNA, 21 nt, Mycobacterium avium subsp. paratuberculosis
cucgagccauaaaccggccgg

SEQ ID NO: 902985 - RNA, 22 nt, Mycobacterium avium subsp. paratuberculosis
cucgagccauaaaccggccggc

SEQ ID NO: 902986 - RNA, 21 nt, Mycobacterium avium subsp. paratuberculosis
cucgacgguggagcggcccag

SEQ ID NO: 902987 - RNA, 17 nt, Mycobacterium avium subsp. paratuberculosis
cucgacgguggccucgg

SEQ ID NO: 902988 - RNA, 18 nt, Mycobacterium avium subsp. paratuberculosis
cucgacgguggccucggc

SEQ ID NO: 902989 - RNA, 20 nt, Mycobacterium avium subsp. paratuberculosis
cucgacgguggccucggcgc

SEQ ID NO: 902990 - RNA, 22 nt, Mycobacterium avium subsp. paratuberculosis
cucgacgguggccucggcgcug

SEQ ID NO: 902991 - RNA, 19 nt, Mycobacterium avium subsp. paratuberculosis
cucgacguaguccggccag

SEQ ID NO: 902992 - RNA, 14 nt, Mycobacterium avium subsp. paratuberculosis
cucgacguagucgc

SEQ ID NO: 902993 - RNA, 17 nt, Mycobacterium avium subsp. paratuberculosis
cucgagcaucucgaacc

SEQ ID NO: 902994 - RNA, 19 nt, Mycobacterium avium subsp. paratuberculosis
cucgagcaucucggugccg

SEQ ID NO: 902995 - RNA, 13 nt, Mycobacterium avium subsp. paratuberculosis
cucgacggcgaag

SEQ ID NO: 902996 - RNA, 22 nt, Mycobacterium avium subsp. paratuberculosis
cucgacggcgaagccggcguca

SEQ ID NO: 902997 - RNA, 16 nt, Mycobacterium avium subsp. paratuberculosis
cucgacggcgccgacg

SEQ ID NO: 902998 - RNA, 22 nt, Mycobacterium avium subsp. paratuberculosis
cucgacggcguggucggcgaag

SEQ ID NO: 902999 - RNA, 18 nt, Mycobacterium avium subsp. paratuberculosis
cucgacggugaccggcuc

SEQ ID NO: 903000 - RNA, 19 nt, Mycobacterium avium subsp. paratuberculosis
cucgacggugaccggcucg

SEQ ID NO: 903001 - RNA, 14 nt, Mycobacterium avium subsp. paratuberculosis
cucgacggugaccu

SEQ ID NO: 903002 - RNA, 22 nt, Mycobacterium avium subsp. paratuberculosis
cucgacggugaccucgucgggc

SEQ ID NO: 903003 - RNA, 16 nt, Mycobacterium avium subsp. paratuberculosis
cucgacgaugucgacg

SEQ ID NO: 903004 - RNA, 13 nt, Mycobacterium avium subsp. paratuberculosis
cucgacgccgcgc

SEQ ID NO: 903005 - RNA, 18 nt, Mycobacterium avium subsp. paratuberculosis
cucgacgccgggcagcgc

SEQ ID NO: 903006 - RNA, 24 nt, Mycobacterium avium subsp. paratuberculosis
cucgacgaagauggcgugccacag

SEQ ID NO: 903007 - RNA, 23 nt, Mycobacterium avium subsp. paratuberculosis
cucgacgaguuccucgugcgugc

SEQ ID NO: 903008 - RNA, 13 nt, Mycobacterium avium subsp. paratuberculosis
cucgacgaucagc

SEQ ID NO: 903009 - RNA, 13 nt, Mycobacterium avium subsp. paratuberculosis
cucgacgcgucga

SEQ ID NO: 903010 - RNA, 15 nt, Mycobacterium avium subsp. paratuberculosis
cucgacgcucggcga

SEQ ID NO: 903011 - RNA, 13 nt, Mycobacterium avium subsp. paratuberculosis
cucgacggccggc

SEQ ID NO: 903012 - RNA, 15 nt, Mycobacterium avium subsp. paratuberculosis
cucgacggccggcgu

SEQ ID NO: 903013 - RNA, 15 nt, Mycobacterium avium subsp. paratuberculosis
cucgacggccgguga

SEQ ID NO: 903014 - RNA, 14 nt, Mycobacterium avium subsp. paratuberculosis
cuccgccacccugc

SEQ ID NO: 903015 - RNA, 17 nt, Mycobacterium avium subsp. paratuberculosis
cuccgccaccuccuccg

SEQ ID NO: 903016 - RNA, 23 nt, Mycobacterium avium subsp. paratuberculosis
cuccgccgaaccgaucaccggca

SEQ ID NO: 903017 - RNA, 16 nt, Mycobacterium avium subsp. paratuberculosis
cuccgccgacaccagg

SEQ ID NO: 903018 - RNA, 15 nt, Mycobacterium avium subsp. paratuberculosis
cuccgccgccccguc

SEQ ID NO: 903019 - RNA, 14 nt, Mycobacterium avium subsp. paratuberculosis
cuccgcccgggugc

SEQ ID NO: 903020 - RNA, 21 nt, Mycobacterium avium subsp. paratuberculosis
cuccgcccgggugcaggccca

SEQ ID NO: 903021 - RNA, 12 nt, Mycobacterium avium subsp. paratuberculosis
cuccgccggcag

SEQ ID NO: 903022 - RNA, 13 nt, Mycobacterium avium subsp. paratuberculosis
cuccgccggcagu

SEQ ID NO: 903023 - RNA, 23 nt, Mycobacterium avium subsp. paratuberculosis
cuccgccgggcugagcugugccg

SEQ ID NO: 903024 - RNA, 19 nt, Mycobacterium avium subsp. paratuberculosis
cucccuguuagggcgacca

SEQ ID NO: 903025 - RNA, 16 nt, Mycobacterium avium subsp. paratuberculosis
cuccgacccguccagc

SEQ ID NO: 903026 - RNA, 17 nt, Mycobacterium avium subsp. paratuberculosis
cuccgaccagccggucu

SEQ ID NO: 903027 - RNA, 21 nt, Mycobacterium avium subsp. paratuberculosis
cuccgacagauacuucgucga

SEQ ID NO: 903028 - RNA, 19 nt, Mycobacterium avium subsp. paratuberculosis
cuccgacagccgcaccggc

SEQ ID NO: 903029 - RNA, 24 nt, Mycobacterium avium subsp. paratuberculosis
cuccgacagccgcaccggcgccgc

SEQ ID NO: 903030 - RNA, 24 nt, Mycobacterium avium subsp. paratuberculosis
cuccgaauccagcgcgccgcugac

SEQ ID NO: 903031 - RNA, 18 nt, Mycobacterium avium subsp. paratuberculosis
cuccgaggcguccuccuc

SEQ ID NO: 903032 - RNA, 17 nt, Mycobacterium avium subsp. paratuberculosis
cuccgaggucagcgcgu

SEQ ID NO: 903033 - RNA, 18 nt, Mycobacterium avium subsp. paratuberculosis
cuccgacuuacggcguga

SEQ ID NO: 903034 - RNA, 19 nt, Mycobacterium avium subsp. paratuberculosis
cuccgagauggacagcacc

SEQ ID NO: 903035 - RNA, 16 nt, Mycobacterium avium subsp. paratuberculosis
cuccgacgcgguggcg

SEQ ID NO: 903036 - RNA, 14 nt, Mycobacterium avium subsp. paratuberculosis
cuccgacuccagca

SEQ ID NO: 903037 - RNA, 13 nt, Mycobacterium avium subsp. paratuberculosis
cuccggcgccggu

SEQ ID NO: 903038 - RNA, 21 nt, Mycobacterium avium subsp. paratuberculosis
cuccggcgccggucagcggca

SEQ ID NO: 903039 - RNA, 12 nt, Mycobacterium avium subsp. paratuberculosis
cuccggcgccug

SEQ ID NO: 903040 - RNA, 14 nt, Mycobacterium avium subsp. paratuberculosis
cuccggcgccuggu

SEQ ID NO: 903041 - RNA, 17 nt, Mycobacterium avium subsp. paratuberculosis
cuccggcgggcuggugc

SEQ ID NO: 903042 - RNA, 12 nt, Mycobacterium avium subsp. paratuberculosis
cuccggcgcggu

SEQ ID NO: 903043 - RNA, 16 nt, Mycobacterium avium subsp. paratuberculosis
cuccggccgcgccggc

SEQ ID NO: 903044 - RNA, 19 nt, Mycobacterium avium subsp. paratuberculosis
cuccggcgacacguccagc

SEQ ID NO: 903045 - RNA, 14 nt, Mycobacterium avium subsp. paratuberculosis
cuccggccccgagc

SEQ ID NO: 903046 - RNA, 15 nt, Mycobacterium avium subsp. paratuberculosis
cuccggccccgagcc

SEQ ID NO: 903047 - RNA, 15 nt, Mycobacterium avium subsp. paratuberculosis
cuccggcaggccgcg

SEQ ID NO: 903048 - RNA, 16 nt, Mycobacterium avium subsp. paratuberculosis
cuccggcaggccgcgg

SEQ ID NO: 903049 - RNA, 17 nt, Mycobacterium avium subsp. paratuberculosis
cuccggcaggccgcggc

SEQ ID NO: 903050 - RNA, 18 nt, Mycobacterium avium subsp. paratuberculosis
cuccggcaggccgcggcc

SEQ ID NO: 903051 - RNA, 20 nt, Mycobacterium avium subsp. paratuberculosis
cuccggcaggccgcggccgu

SEQ ID NO: 903052 - RNA, 22 nt, Mycobacterium avium subsp. paratuberculosis
cuccggcaguacgcgccggccu

SEQ ID NO: 903053 - RNA, 15 nt, Mycobacterium avium subsp. paratuberculosis
cuccggcaacgaggc

SEQ ID NO: 903054 - RNA, 22 nt, Mycobacterium avium subsp. paratuberculosis
cuccggcaacgaggccagggcc

SEQ ID NO: 903055 - RNA, 13 nt, Mycobacterium avium subsp. paratuberculosis
cuccggcacguug

SEQ ID NO: 903056 - RNA, 21 nt, Mycobacterium avium subsp. paratuberculosis
cuccgcggugcugcagcgcga

SEQ ID NO: 903057 - RNA, 13 nt, Mycobacterium avium subsp. paratuberculosis
cuccgcggccgcg

SEQ ID NO: 903058 - RNA, 15 nt, Mycobacterium avium subsp. paratuberculosis
cuccgcucgggcccg

SEQ ID NO: 903059 - RNA, 16 nt, Mycobacterium avium subsp. paratuberculosis
cuccgcucgggcccgc

SEQ ID NO: 903060 - RNA, 13 nt, Mycobacterium avium subsp. paratuberculosis
cuccgcggcgggc

SEQ ID NO: 903061 - RNA, 14 nt, Mycobacterium avium subsp. paratuberculosis
cuccgcgcgcggca

SEQ ID NO: 903062 - RNA, 20 nt, Mycobacterium avium subsp. paratuberculosis
cuccgcgcugaccagcguga

SEQ ID NO: 903063 - RNA, 14 nt, Mycobacterium avium subsp. paratuberculosis
cuccgcgauggccu

SEQ ID NO: 903064 - RNA, 17 nt, Mycobacterium avium subsp. paratuberculosis
cuccggauggcggucgc

SEQ ID NO: 903065 - RNA, 19 nt, Mycobacterium avium subsp. paratuberculosis
cuccggagaucgccccggg

SEQ ID NO: 903066 - RNA, 18 nt, Mycobacterium avium subsp. paratuberculosis
cuccggagugacgucgcg

SEQ ID NO: 903067 - RNA, 19 nt, Mycobacterium avium subsp. paratuberculosis
cuccggagugacgucgcgc

SEQ ID NO: 903068 - RNA, 20 nt, Mycobacterium avium subsp. paratuberculosis
cuccggagugacgucgcgcg

SEQ ID NO: 903069 - RNA, 14 nt, Mycobacterium avium subsp. paratuberculosis
cucgcuggcgauca

SEQ ID NO: 903070 - RNA, 19 nt, Mycobacterium avium subsp. paratuberculosis
cucgcuggcgaucaccuug

SEQ ID NO: 903071 - RNA, 14 nt, Mycobacterium avium subsp. paratuberculosis
cucgcuggcggcgc

SEQ ID NO: 903072 - RNA, 19 nt, Mycobacterium avium subsp. paratuberculosis
cucggaggugccgcgcggc

SEQ ID NO: 903073 - RNA, 21 nt, Mycobacterium avium subsp. paratuberculosis
cucggaguaguccagcaccgc

SEQ ID NO: 903074 - RNA, 20 nt, Mycobacterium avium subsp. paratuberculosis
cucggaguaguuccggcggu

SEQ ID NO: 903075 - RNA, 17 nt, Mycobacterium avium subsp. paratuberculosis
cucgcugccggccgggg

SEQ ID NO: 903076 - RNA, 17 nt, Mycobacterium avium subsp. paratuberculosis
cucgcugaucucgacgg

SEQ ID NO: 903077 - RNA, 20 nt, Mycobacterium avium subsp. paratuberculosis
cucgcugaucucgacggugg

SEQ ID NO: 903078 - RNA, 19 nt, Mycobacterium avium subsp. paratuberculosis
cucggaucccggggcgcgc

SEQ ID NO: 903079 - RNA, 24 nt, Mycobacterium avium subsp. paratuberculosis
cucggaguucgcccgcagcacgcc

SEQ ID NO: 903080 - RNA, 17 nt, Mycobacterium avium subsp. paratuberculosis
cucggaguugcgcagcc

SEQ ID NO: 903081 - RNA, 18 nt, Mycobacterium avium subsp. paratuberculosis
cucggcaccgugccgcgc

SEQ ID NO: 903082 - RNA, 20 nt, Mycobacterium avium subsp. paratuberculosis
cucggcaccgugccgcgcgg

SEQ ID NO: 903083 - RNA, 12 nt, Mycobacterium avium subsp. paratuberculosis
cucggcagcccc

SEQ ID NO: 903084 - RNA, 19 nt, Mycobacterium avium subsp. paratuberculosis
cucggcccgccgggcgcca

SEQ ID NO: 903085 - RNA, 23 nt, Mycobacterium avium subsp. paratuberculosis
cucggcccgcugcgcggccgaac

SEQ ID NO: 903086 - RNA, 15 nt, Mycobacterium avium subsp. paratuberculosis
cucggccgaugagcc

SEQ ID NO: 903087 - RNA, 12 nt, Mycobacterium avium subsp. paratuberculosis
cucggccgcggu

SEQ ID NO: 903088 - RNA, 20 nt, Mycobacterium avium subsp. paratuberculosis
cucggccgcggucucgaccg

SEQ ID NO: 903089 - RNA, 13 nt, Mycobacterium avium subsp. paratuberculosis
cucggccgcggug

SEQ ID NO: 903090 - RNA, 14 nt, Mycobacterium avium subsp. paratuberculosis
cucggccggcaccu

SEQ ID NO: 903091 - RNA, 15 nt, Mycobacterium avium subsp. paratuberculosis
cucggccggcaccuc

SEQ ID NO: 903092 - RNA, 16 nt, Mycobacterium avium subsp. paratuberculosis
cucggccggcaccucg

SEQ ID NO: 903093 - RNA, 14 nt, Mycobacterium avium subsp. paratuberculosis
cucggccaggguga

SEQ ID NO: 903094 - RNA, 23 nt, Mycobacterium avium subsp. paratuberculosis
cucggccagguacugaucaccgc

SEQ ID NO: 903095 - RNA, 13 nt, Mycobacterium avium subsp. paratuberculosis
cucggccaucccg

SEQ ID NO: 903096 - RNA, 15 nt, Mycobacterium avium subsp. paratuberculosis
cucggccaucccggu

SEQ ID NO: 903097 - RNA, 17 nt, Mycobacterium avium subsp. paratuberculosis
cucggccaucccggugc

SEQ ID NO: 903098 - RNA, 19 nt, Mycobacterium avium subsp. paratuberculosis
cucggccauccgggcggca

SEQ ID NO: 903099 - RNA, 18 nt, Mycobacterium avium subsp. paratuberculosis
cucggcauaacgcaaccg

SEQ ID NO: 903100 - RNA, 16 nt, Mycobacterium avium subsp. paratuberculosis
cucgcugacgucgaug

SEQ ID NO: 903101 - RNA, 12 nt, Mycobacterium avium subsp. paratuberculosis
cucgcucugccg

SEQ ID NO: 903102 - RNA, 16 nt, Mycobacterium avium subsp. paratuberculosis
cucgcucugccgggcc

SEQ ID NO: 903103 - RNA, 20 nt, Mycobacterium avium subsp. paratuberculosis
cucgcucugccgggccgcau

SEQ ID NO: 903104 - RNA, 17 nt, Mycobacterium avium subsp. paratuberculosis
cucgcggggugucgugc

SEQ ID NO: 903105 - RNA, 19 nt, Mycobacterium avium subsp. paratuberculosis
cucgcgggugcggcgcugc

SEQ ID NO: 903106 - RNA, 23 nt, Mycobacterium avium subsp. paratuberculosis
cucgcgggugcugggcggauccg

SEQ ID NO: 903107 - RNA, 16 nt, Mycobacterium avium subsp. paratuberculosis
cucgcgggugucgagc

SEQ ID NO: 903108 - RNA, 21 nt, Mycobacterium avium subsp. paratuberculosis
cucgcgggugucgagccacca

SEQ ID NO: 903109 - RNA, 13 nt, Mycobacterium avium subsp. paratuberculosis
cucgcgggcgacc

SEQ ID NO: 903110 - RNA, 19 nt, Mycobacterium avium subsp. paratuberculosis
cucgcgggccacagcggcg

SEQ ID NO: 903111 - RNA, 21 nt, Mycobacterium avium subsp. paratuberculosis
cucgcgggccacagcggcgac

SEQ ID NO: 903112 - RNA, 13 nt, Mycobacterium avium subsp. paratuberculosis
cucgcgggcccgc

SEQ ID NO: 903113 - RNA, 21 nt, Mycobacterium avium subsp. paratuberculosis
cucgcgggcccgcgccgcguc

SEQ ID NO: 903114 - RNA, 18 nt, Mycobacterium avium subsp. paratuberculosis
cucgcgggcccgcgcggc

SEQ ID NO: 903115 - RNA, 14 nt, Mycobacterium avium subsp. paratuberculosis
cucgcgggcgaccu

SEQ ID NO: 903116 - RNA, 19 nt, Mycobacterium avium subsp. paratuberculosis
cucgcgggcgagcagcgcc

SEQ ID NO: 903117 - RNA, 16 nt, Mycobacterium avium subsp. paratuberculosis
cucgcgggacggcggc

SEQ ID NO: 903118 - RNA, 19 nt, Mycobacterium avium subsp. paratuberculosis
cucgcgggacggcggcgag

SEQ ID NO: 903119 - RNA, 18 nt, Mycobacterium avium subsp. paratuberculosis
cucgcgggaguggccggc

SEQ ID NO: 903120 - RNA, 19 nt, Mycobacterium avium subsp. paratuberculosis
cucgcgggaguggccggcg

SEQ ID NO: 903121 - RNA, 12 nt, Mycobacterium avium subsp. paratuberculosis
cucgcggcgggu

SEQ ID NO: 903122 - RNA, 14 nt, Mycobacterium avium subsp. paratuberculosis
cucgcggcggguca

SEQ ID NO: 903123 - RNA, 22 nt, Mycobacterium avium subsp. paratuberculosis
cucgcggcgggucagcacccgc

SEQ ID NO: 903124 - RNA, 14 nt, Mycobacterium avium subsp. paratuberculosis
cucgcggcggucau

SEQ ID NO: 903125 - RNA, 12 nt, Mycobacterium avium subsp. paratuberculosis
cucgcggcggcg

SEQ ID NO: 903126 - RNA, 13 nt, Mycobacterium avium subsp. paratuberculosis
cucgcggcggcgu

SEQ ID NO: 903127 - RNA, 17 nt, Mycobacterium avium subsp. paratuberculosis
cucgcggcggcgucggc

SEQ ID NO: 903128 - RNA, 19 nt, Mycobacterium avium subsp. paratuberculosis
cucgccucggaggccaccg

SEQ ID NO: 903129 - RNA, 14 nt, Mycobacterium avium subsp. paratuberculosis
cucgccugcgagcg

SEQ ID NO: 903130 - RNA, 17 nt, Mycobacterium avium subsp. paratuberculosis
cucgccugcgagcguga

SEQ ID NO: 903131 - RNA, 12 nt, Mycobacterium avium subsp. paratuberculosis
cucgccggcggc

SEQ ID NO: 903132 - RNA, 17 nt, Mycobacterium avium subsp. paratuberculosis
cucgccggcggccgcca

SEQ ID NO: 903133 - RNA, 18 nt, Mycobacterium avium subsp. paratuberculosis
cucgccggcggcgcccgc

SEQ ID NO: 903134 - RNA, 16 nt, Mycobacterium avium subsp. paratuberculosis
cucgccggcggcgccg

SEQ ID NO: 903135 - RNA, 17 nt, Mycobacterium avium subsp. paratuberculosis
cucgccggcggcgccgg

SEQ ID NO: 903136 - RNA, 20 nt, Mycobacterium avium subsp. paratuberculosis
cucgccggcuaccggcgcug

SEQ ID NO: 903137 - RNA, 12 nt, Mycobacterium avium subsp. paratuberculosis
cucgccggcgcg

SEQ ID NO: 903138 - RNA, 15 nt, Mycobacterium avium subsp. paratuberculosis
cucgccggcgcgcag

SEQ ID NO: 903139 - RNA, 13 nt, Mycobacterium avium subsp. paratuberculosis
cucgccggcgcgg

SEQ ID NO: 903140 - RNA, 14 nt, Mycobacterium avium subsp. paratuberculosis
cucgccggcgcgga

SEQ ID NO: 903141 - RNA, 14 nt, Mycobacterium avium subsp. paratuberculosis
cucgccggccgcgg

SEQ ID NO: 903142 - RNA, 16 nt, Mycobacterium avium subsp. paratuberculosis
cucgccggccgcgggc

SEQ ID NO: 903143 - RNA, 14 nt, Mycobacterium avium subsp. paratuberculosis
cucgccggccgggc

SEQ ID NO: 903144 - RNA, 16 nt, Mycobacterium avium subsp. paratuberculosis
cucgccggccgggcgg

SEQ ID NO: 903145 - RNA, 20 nt, Mycobacterium avium subsp. paratuberculosis
cucgccuuugaugacgacgu

SEQ ID NO: 903146 - RNA, 15 nt, Mycobacterium avium subsp. paratuberculosis
cucgccugucggucg

SEQ ID NO: 903147 - RNA, 19 nt, Mycobacterium avium subsp. paratuberculosis
cucgccuccagcagggaca

SEQ ID NO: 903148 - RNA, 12 nt, Mycobacterium avium subsp. paratuberculosis
cucgcgacgcgg

SEQ ID NO: 903149 - RNA, 13 nt, Mycobacterium avium subsp. paratuberculosis
cucgcgacgcggc

SEQ ID NO: 903150 - RNA, 19 nt, Mycobacterium avium subsp. paratuberculosis
cucgcgacgcggcucgcgc

SEQ ID NO: 903151 - RNA, 21 nt, Mycobacterium avium subsp. paratuberculosis
cucgcgacgcggcucgcgcgg

SEQ ID NO: 903152 - RNA, 15 nt, Mycobacterium avium subsp. paratuberculosis
cucgcgagggcgggc

SEQ ID NO: 903153 - RNA, 14 nt, Mycobacterium avium subsp. paratuberculosis
cucgcgauggcggg

SEQ ID NO: 903154 - RNA, 17 nt, Mycobacterium avium subsp. paratuberculosis
cucgcgcaacugggugg

SEQ ID NO: 903155 - RNA, 21 nt, Mycobacterium avium subsp. paratuberculosis
cucgcgcaauaacggagcggc

SEQ ID NO: 903156 - RNA, 22 nt, Mycobacterium avium subsp. paratuberculosis
cucgcgcaauaacggagcggcc

SEQ ID NO: 903157 - RNA, 16 nt, Mycobacterium avium subsp. paratuberculosis
cucgcgcaaugccgcc

SEQ ID NO: 903158 - RNA, 21 nt, Mycobacterium avium subsp. paratuberculosis
cucgcgcaaugccgccgcgac

SEQ ID NO: 903159 - RNA, 19 nt, Mycobacterium avium subsp. paratuberculosis
cucgccggagagcccgucg

SEQ ID NO: 903160 - RNA, 22 nt, Mycobacterium avium subsp. paratuberculosis
cucgccggagagcccgucgucg

SEQ ID NO: 903161 - RNA, 23 nt, Mycobacterium avium subsp. paratuberculosis
cucgccggagagcccgucgucgg

SEQ ID NO: 903162 - RNA, 13 nt, Mycobacterium avium subsp. paratuberculosis
cucgccggccgcc

SEQ ID NO: 903163 - RNA, 19 nt, Mycobacterium avium subsp. paratuberculosis
cucgccgcgaacgacgacc

SEQ ID NO: 903164 - RNA, 14 nt, Mycobacterium avium subsp. paratuberculosis
cucgccggcccgac

SEQ ID NO: 903165 - RNA, 15 nt, Mycobacterium avium subsp. paratuberculosis
cucgccgcugucguc

SEQ ID NO: 903166 - RNA, 16 nt, Mycobacterium avium subsp. paratuberculosis
cucgccgcugucgucg

SEQ ID NO: 903167 - RNA, 14 nt, Mycobacterium avium subsp. paratuberculosis
cucgccgcgcggcc

SEQ ID NO: 903168 - RNA, 20 nt, Mycobacterium avium subsp. paratuberculosis
cucgccgcgcaucaucgccc

SEQ ID NO: 903169 - RNA, 20 nt, Mycobacterium avium subsp. paratuberculosis
cucgccgcggccacgcucgg

SEQ ID NO: 903170 - RNA, 21 nt, Mycobacterium avium subsp. paratuberculosis
cucgccgcggccacgcucggg

SEQ ID NO: 903171 - RNA, 11 nt, Mycobacterium avium subsp. paratuberculosis
cucgccgcggg

SEQ ID NO: 903172 - RNA, 17 nt, Mycobacterium avium subsp. paratuberculosis
cucgccgcggucaucga

SEQ ID NO: 903173 - RNA, 16 nt, Mycobacterium avium subsp. paratuberculosis
cucgccgagcacaccg

SEQ ID NO: 903174 - RNA, 19 nt, Mycobacterium avium subsp. paratuberculosis
cucgccgagcacaccgucg

SEQ ID NO: 903175 - RNA, 13 nt, Mycobacterium avium subsp. paratuberculosis
cucgccgaucggg

SEQ ID NO: 903176 - RNA, 14 nt, Mycobacterium avium subsp. paratuberculosis
cucgccgaucggga

SEQ ID NO: 903177 - RNA, 13 nt, Mycobacterium avium subsp. paratuberculosis
cucgccgccgacg

SEQ ID NO: 903178 - RNA, 14 nt, Mycobacterium avium subsp. paratuberculosis
cucgccgccgacga

SEQ ID NO: 903179 - RNA, 11 nt, Mycobacterium avium subsp. paratuberculosis
cucgccgagcg

SEQ ID NO: 903180 - RNA, 13 nt, Mycobacterium avium subsp. paratuberculosis
cucgccgagcggg

SEQ ID NO: 903181 - RNA, 22 nt, Mycobacterium avium subsp. paratuberculosis
cucgccgacgguguccgcgggc

SEQ ID NO: 903182 - RNA, 19 nt, Mycobacterium avium subsp. paratuberculosis
cucgccgaucucgaccagc

SEQ ID NO: 903183 - RNA, 21 nt, Mycobacterium avium subsp. paratuberculosis
cucgccgaucucgaccagcgc

SEQ ID NO: 903184 - RNA, 18 nt, Mycobacterium avium subsp. paratuberculosis
cucgccgaucuggcgcag

SEQ ID NO: 903185 - RNA, 17 nt, Mycobacterium avium subsp. paratuberculosis
cucgccgaucuuggcga

SEQ ID NO: 903186 - RNA, 17 nt, Mycobacterium avium subsp. paratuberculosis
cucgccgaugacguugc

SEQ ID NO: 903187 - RNA, 18 nt, Mycobacterium avium subsp. paratuberculosis
cucgccgauguggcgggc

SEQ ID NO: 903188 - RNA, 22 nt, Mycobacterium avium subsp. paratuberculosis
cucgcccugggggucggugacc

SEQ ID NO: 903189 - RNA, 23 nt, Mycobacterium avium subsp. paratuberculosis
cucgcccugggggucggugacca

SEQ ID NO: 903190 - RNA, 14 nt, Mycobacterium avium subsp. paratuberculosis
cucgccgaaggccg

SEQ ID NO: 903191 - RNA, 17 nt, Mycobacterium avium subsp. paratuberculosis
cucgccgaccuuggcgu

SEQ ID NO: 903192 - RNA, 14 nt, Mycobacterium avium subsp. paratuberculosis
cucgcccugcagcc

SEQ ID NO: 903193 - RNA, 17 nt, Mycobacterium avium subsp. paratuberculosis
cucgcccugcagccggg

SEQ ID NO: 903194 - RNA, 23 nt, Mycobacterium avium subsp. paratuberculosis
cucgcccugcagccggguggccc

SEQ ID NO: 903195 - RNA, 20 nt, Mycobacterium avium subsp. paratuberculosis
cucgcccugcagcgcgaaca

SEQ ID NO: 903196 - RNA, 15 nt, Mycobacterium avium subsp. paratuberculosis
cucgcccgccgcgac

SEQ ID NO: 903197 - RNA, 22 nt, Mycobacterium avium subsp. paratuberculosis
cucgccccgcccgaucccgucg

SEQ ID NO: 903198 - RNA, 17 nt, Mycobacterium avium subsp. paratuberculosis
cucgcccaccuuggcgu

SEQ ID NO: 903199 - RNA, 22 nt, Mycobacterium avium subsp. paratuberculosis
cucgcccagggcgugcgcggcc

SEQ ID NO: 903200 - RNA, 15 nt, Mycobacterium avium subsp. paratuberculosis
cucgcccagcgccgc

SEQ ID NO: 903201 - RNA, 19 nt, Mycobacterium avium subsp. paratuberculosis
cucgcccagcgccgcggcg

SEQ ID NO: 903202 - RNA, 13 nt, Mycobacterium avium subsp. paratuberculosis
cucgcccagcgcg

SEQ ID NO: 903203 - RNA, 14 nt, Mycobacterium avium subsp. paratuberculosis
cucgcccagcgcgg

SEQ ID NO: 903204 - RNA, 18 nt, Mycobacterium avium subsp. paratuberculosis
cucgcccagcgcggcggc

SEQ ID NO: 903205 - RNA, 19 nt, Mycobacterium avium subsp. paratuberculosis
cucgcccagcgcggcggcc

SEQ ID NO: 903206 - RNA, 12 nt, Mycobacterium avium subsp. paratuberculosis
cucgccaccucg

SEQ ID NO: 903207 - RNA, 21 nt, Mycobacterium avium subsp. paratuberculosis
cucgccacugggcgucggcgc

SEQ ID NO: 903208 - RNA, 16 nt, Mycobacterium avium subsp. paratuberculosis
cucgccaccccgcgcc

SEQ ID NO: 903209 - RNA, 14 nt, Mycobacterium avium subsp. paratuberculosis
cucgcagucgauca

SEQ ID NO: 903210 - RNA, 21 nt, Mycobacterium avium subsp. paratuberculosis
cucgcagucgaucagcgacgg

SEQ ID NO: 903211 - RNA, 15 nt, Mycobacterium avium subsp. paratuberculosis
cucgcccagcaccgu

SEQ ID NO: 903212 - RNA, 20 nt, Mycobacterium avium subsp. paratuberculosis
cucgccaggauguacccgca

SEQ ID NO: 903213 - RNA, 19 nt, Mycobacterium avium subsp. paratuberculosis
cucgccagccccaccggcc

SEQ ID NO: 903214 - RNA, 22 nt, Mycobacterium avium subsp. paratuberculosis
cucgccaauaaagcgggcccgc

SEQ ID NO: 903215 - RNA, 21 nt, Mycobacterium avium subsp. paratuberculosis
cucgagggccuccaccaccau

SEQ ID NO: 903216 - RNA, 14 nt, Mycobacterium avium subsp. paratuberculosis
cucgaggccgcggg

SEQ ID NO: 903217 - RNA, 14 nt, Mycobacterium avium subsp. paratuberculosis
cucgagggcggcga

SEQ ID NO: 903218 - RNA, 15 nt, Mycobacterium avium subsp. paratuberculosis
cucgagggcggcgac

SEQ ID NO: 903219 - RNA, 16 nt, Mycobacterium avium subsp. paratuberculosis
cucgagggcggcgacc

SEQ ID NO: 903220 - RNA, 14 nt, Mycobacterium avium subsp. paratuberculosis
cucgcacagcacca

SEQ ID NO: 903221 - RNA, 23 nt, Mycobacterium avium subsp. paratuberculosis
cucgcagauggucgggacgucgg

SEQ ID NO: 903222 - RNA, 14 nt, Mycobacterium avium subsp. paratuberculosis
cucgcacagccggc

SEQ ID NO: 903223 - RNA, 13 nt, Mycobacterium avium subsp. paratuberculosis
cucgagcgcccgg

SEQ ID NO: 903224 - RNA, 19 nt, Mycobacterium avium subsp. paratuberculosis
cucgagcgcgucgaccagc

SEQ ID NO: 903225 - RNA, 22 nt, Mycobacterium avium subsp. paratuberculosis
cucgagcgcgucgaccagccgc

SEQ ID NO: 903226 - RNA, 23 nt, Mycobacterium avium subsp. paratuberculosis
cucgagcgugcccgcgcccaccu

SEQ ID NO: 903227 - RNA, 13 nt, Mycobacterium avium subsp. paratuberculosis
cucgagcuggccg

SEQ ID NO: 903228 - RNA, 17 nt, Mycobacterium avium subsp. paratuberculosis
cucgagcuuccgccgag

SEQ ID NO: 903229 - RNA, 19 nt, Mycobacterium avium subsp. paratuberculosis
cucgagcuuccgccgaguc

SEQ ID NO: 903230 - RNA, 17 nt, Mycobacterium avium subsp. paratuberculosis
cucgagcuugccgucgu

SEQ ID NO: 903231 - RNA, 19 nt, Mycobacterium avium subsp. paratuberculosis
cucgaggaacuugcgccgg

SEQ ID NO: 903232 - RNA, 17 nt, Mycobacterium avium subsp. paratuberculosis
cucgaggaucgcggcca

SEQ ID NO: 903233 - RNA, 19 nt, Mycobacterium avium subsp. paratuberculosis
cucgaggccccgcgugacg

SEQ ID NO: 903234 - RNA, 22 nt, Mycobacterium avium subsp. paratuberculosis
cugcaucaugccgcccaucacc

SEQ ID NO: 903235 - RNA, 14 nt, Mycobacterium avium subsp. paratuberculosis
cugcaucgccagca

SEQ ID NO: 903236 - RNA, 15 nt, Mycobacterium avium subsp. paratuberculosis
cugcaucgccagcac

SEQ ID NO: 903237 - RNA, 16 nt, Mycobacterium avium subsp. paratuberculosis
cugcaucgccagcaca

SEQ ID NO: 903238 - RNA, 16 nt, Mycobacterium avium subsp. paratuberculosis
cugcauccgcagcacc

SEQ ID NO: 903239 - RNA, 17 nt, Mycobacterium avium subsp. paratuberculosis
cugcaucuccagccgcg

SEQ ID NO: 903240 - RNA, 14 nt, Mycobacterium avium subsp. paratuberculosis
cugcaugccgggca

SEQ ID NO: 903241 - RNA, 21 nt, Mycobacterium avium subsp. paratuberculosis
cugcauagucggcccgaucgc

SEQ ID NO: 903242 - RNA, 19 nt, Mycobacterium avium subsp. paratuberculosis
cugcaucaaaaacgauccc

SEQ ID NO: 903243 - RNA, 13 nt, Mycobacterium avium subsp. paratuberculosis
cugccacgcccac

SEQ ID NO: 903244 - RNA, 17 nt, Mycobacterium avium subsp. paratuberculosis
cugccacgguuucgccg

SEQ ID NO: 903245 - RNA, 23 nt, Mycobacterium avium subsp. paratuberculosis
cugccacgguuucgccguacagc

SEQ ID NO: 903246 - RNA, 18 nt, Mycobacterium avium subsp. paratuberculosis
cugccacguacaccggga

SEQ ID NO: 903247 - RNA, 12 nt, Mycobacterium avium subsp. paratuberculosis
cugccaccgcga

SEQ ID NO: 903248 - RNA, 13 nt, Mycobacterium avium subsp. paratuberculosis
cugccaccgcgaa

SEQ ID NO: 903249 - RNA, 14 nt, Mycobacterium avium subsp. paratuberculosis
cugccacagcgaca

SEQ ID NO: 903250 - RNA, 18 nt, Mycobacterium avium subsp. paratuberculosis
cugcauuucggacggcga

SEQ ID NO: 903251 - RNA, 15 nt, Mycobacterium avium subsp. paratuberculosis
cugccaagacguccg

SEQ ID NO: 903252 - RNA, 17 nt, Mycobacterium avium subsp. paratuberculosis
cugccaagacguccgcg

SEQ ID NO: 903253 - RNA, 22 nt, Mycobacterium avium subsp. paratuberculosis
cugccaagacguccgcgucggc

SEQ ID NO: 903254 - RNA, 16 nt, Mycobacterium avium subsp. paratuberculosis
cugccaaggugcggug

SEQ ID NO: 903255 - RNA, 17 nt, Mycobacterium avium subsp. paratuberculosis
cugccaaggugcgguga

SEQ ID NO: 903256 - RNA, 22 nt, Mycobacterium avium subsp. paratuberculosis
cugcagcagucccucgaucagc

SEQ ID NO: 903257 - RNA, 13 nt, Mycobacterium avium subsp. paratuberculosis
cugcagcgacgga

SEQ ID NO: 903258 - RNA, 19 nt, Mycobacterium avium subsp. paratuberculosis
cugcagcgacggaucggcc

SEQ ID NO: 903259 - RNA, 22 nt, Mycobacterium avium subsp. paratuberculosis
cugcagcgacggaucggccgcg

SEQ ID NO: 903260 - RNA, 23 nt, Mycobacterium avium subsp. paratuberculosis
cugcagcgacggaucggccgcgu

SEQ ID NO: 903261 - RNA, 15 nt, Mycobacterium avium subsp. paratuberculosis
cugcagccgccgcgc

SEQ ID NO: 903262 - RNA, 15 nt, Mycobacterium avium subsp. paratuberculosis
cugcagccggccggc

SEQ ID NO: 903263 - RNA, 16 nt, Mycobacterium avium subsp. paratuberculosis
cugcagccggccggcg

SEQ ID NO: 903264 - RNA, 18 nt, Mycobacterium avium subsp. paratuberculosis
cugcagccggccggcgga

SEQ ID NO: 903265 - RNA, 13 nt, Mycobacterium avium subsp. paratuberculosis
cugcagccggcgc

SEQ ID NO: 903266 - RNA, 17 nt, Mycobacterium avium subsp. paratuberculosis
cugcagccggcgcggca

SEQ ID NO: 903267 - RNA, 15 nt, Mycobacterium avium subsp. paratuberculosis
cugcagccgggcggc

SEQ ID NO: 903268 - RNA, 19 nt, Mycobacterium avium subsp. paratuberculosis
cugcagccgggcggcggcc

SEQ ID NO: 903269 - RNA, 20 nt, Mycobacterium avium subsp. paratuberculosis
cugcagccgggcggcggccu

SEQ ID NO: 903270 - RNA, 23 nt, Mycobacterium avium subsp. paratuberculosis
cugcagccgggcggcggccuccg

SEQ ID NO: 903271 - RNA, 19 nt, Mycobacterium avium subsp. paratuberculosis
cugcagccggguggcccgc

SEQ ID NO: 903272 - RNA, 13 nt, Mycobacterium avium subsp. paratuberculosis
cugcagccggucc

SEQ ID NO: 903273 - RNA, 14 nt, Mycobacterium avium subsp. paratuberculosis
cugcagccgguccg

SEQ ID NO: 903274 - RNA, 15 nt, Mycobacterium avium subsp. paratuberculosis
cugcagcgcgaggcg

SEQ ID NO: 903275 - RNA, 14 nt, Mycobacterium avium subsp. paratuberculosis
cugcagcggcggcc

SEQ ID NO: 903276 - RNA, 16 nt, Mycobacterium avium subsp. paratuberculosis
cugcagcggcggccag

SEQ ID NO: 903277 - RNA, 21 nt, Mycobacterium avium subsp. paratuberculosis
cugcagcggguuuggccgcgg

SEQ ID NO: 903278 - RNA, 13 nt, Mycobacterium avium subsp. paratuberculosis
cugcagcgccgcc

SEQ ID NO: 903279 - RNA, 14 nt, Mycobacterium avium subsp. paratuberculosis
cugcagcgccgccc

SEQ ID NO: 903280 - RNA, 13 nt, Mycobacterium avium subsp. paratuberculosis
cugcagcgcccgg

SEQ ID NO: 903281 - RNA, 14 nt, Mycobacterium avium subsp. paratuberculosis
cugcagcgcccggg

SEQ ID NO: 903282 - RNA, 13 nt, Mycobacterium avium subsp. paratuberculosis
cugcagcgccgag

SEQ ID NO: 903283 - RNA, 15 nt, Mycobacterium avium subsp. paratuberculosis
cugcagcgccgaggc

SEQ ID NO: 903284 - RNA, 22 nt, Mycobacterium avium subsp. paratuberculosis
cugcagcgagaccucccggcgc

SEQ ID NO: 903285 - RNA, 19 nt, Mycobacterium avium subsp. paratuberculosis
cugcagguugauccggauc

SEQ ID NO: 903286 - RNA, 21 nt, Mycobacterium avium subsp. paratuberculosis
cugcagguugauccggauccg

SEQ ID NO: 903287 - RNA, 16 nt, Mycobacterium avium subsp. paratuberculosis
cugcagguggcccaca

SEQ ID NO: 903288 - RNA, 15 nt, Mycobacterium avium subsp. paratuberculosis
cugcaggucgcggug

SEQ ID NO: 903289 - RNA, 22 nt, Mycobacterium avium subsp. paratuberculosis
cugcaggucguaguaggcgccg

SEQ ID NO: 903290 - RNA, 17 nt, Mycobacterium avium subsp. paratuberculosis
cugcaggguuuccucga

SEQ ID NO: 903291 - RNA, 17 nt, Mycobacterium avium subsp. paratuberculosis
cugcagggauucggcca

SEQ ID NO: 903292 - RNA, 16 nt, Mycobacterium avium subsp. paratuberculosis
cugcaggcaggccggc

SEQ ID NO: 903293 - RNA, 19 nt, Mycobacterium avium subsp. paratuberculosis
cugcaggcaggccggcagc

SEQ ID NO: 903294 - RNA, 15 nt, Mycobacterium avium subsp. paratuberculosis
cugcaggccgagccg

SEQ ID NO: 903295 - RNA, 14 nt, Mycobacterium avium subsp. paratuberculosis
cugcaggccgaggc

SEQ ID NO: 903296 - RNA, 20 nt, Mycobacterium avium subsp. paratuberculosis
cugcagcuccucggcggccu

SEQ ID NO: 903297 - RNA, 22 nt, Mycobacterium avium subsp. paratuberculosis
cugcagcucgccggcgcgcagc

SEQ ID NO: 903298 - RNA, 14 nt, Mycobacterium avium subsp. paratuberculosis
cugcagcucggugc

SEQ ID NO: 903299 - RNA, 22 nt, Mycobacterium avium subsp. paratuberculosis
cugcccggagaaaccgucggcc

SEQ ID NO: 903300 - RNA, 14 nt, Mycobacterium avium subsp. paratuberculosis
cugcccggccagca

SEQ ID NO: 903301 - RNA, 15 nt, Mycobacterium avium subsp. paratuberculosis
cugcccggccagcag

SEQ ID NO: 903302 - RNA, 13 nt, Mycobacterium avium subsp. paratuberculosis
cugcccgcggccg

SEQ ID NO: 903303 - RNA, 16 nt, Mycobacterium avium subsp. paratuberculosis
cugcccgcggccgccg

SEQ ID NO: 903304 - RNA, 23 nt, Mycobacterium avium subsp. paratuberculosis
cugcccgcggccgccgccgcggc

SEQ ID NO: 903305 - RNA, 22 nt, Mycobacterium avium subsp. paratuberculosis
cugcccgggcaucccgccgaac

SEQ ID NO: 903306 - RNA, 15 nt, Mycobacterium avium subsp. paratuberculosis
cugcccgggcccgau

SEQ ID NO: 903307 - RNA, 16 nt, Mycobacterium avium subsp. paratuberculosis
cugcccgggcgccgag

SEQ ID NO: 903308 - RNA, 18 nt, Mycobacterium avium subsp. paratuberculosis
cugcccgggcgccgagaa

SEQ ID NO: 903309 - RNA, 15 nt, Mycobacterium avium subsp. paratuberculosis
cugcccggcccgccg

SEQ ID NO: 903310 - RNA, 17 nt, Mycobacterium avium subsp. paratuberculosis
cugcccggcccgccgcu

SEQ ID NO: 903311 - RNA, 19 nt, Mycobacterium avium subsp. paratuberculosis
cugcccggcccgccgcugc

SEQ ID NO: 903312 - RNA, 18 nt, Mycobacterium avium subsp. paratuberculosis
cugcccggcgccggucgu

SEQ ID NO: 903313 - RNA, 12 nt, Mycobacterium avium subsp. paratuberculosis
cugcccggcgcg

SEQ ID NO: 903314 - RNA, 13 nt, Mycobacterium avium subsp. paratuberculosis
cugcccggcgcgg

SEQ ID NO: 903315 - RNA, 14 nt, Mycobacterium avium subsp. paratuberculosis
cugcccggcgcgga

SEQ ID NO: 903316 - RNA, 23 nt, Mycobacterium avium subsp. paratuberculosis
cugcccggcgcuaaagccgaccg

SEQ ID NO: 903317 - RNA, 13 nt, Mycobacterium avium subsp. paratuberculosis
cugcccggcgugu

SEQ ID NO: 903318 - RNA, 15 nt, Mycobacterium avium subsp. paratuberculosis
cugcccgcgacggcg

SEQ ID NO: 903319 - RNA, 16 nt, Mycobacterium avium subsp. paratuberculosis
cugcccgcgacggcga

SEQ ID NO: 903320 - RNA, 18 nt, Mycobacterium avium subsp. paratuberculosis
cugcccgcgacggcgagc

SEQ ID NO: 903321 - RNA, 14 nt, Mycobacterium avium subsp. paratuberculosis
cugcccgcgacugu

SEQ ID NO: 903322 - RNA, 16 nt, Mycobacterium avium subsp. paratuberculosis
cugcccgcgaucgcca

SEQ ID NO: 903323 - RNA, 16 nt, Mycobacterium avium subsp. paratuberculosis
cugcccgcgcaggccc

SEQ ID NO: 903324 - RNA, 18 nt, Mycobacterium avium subsp. paratuberculosis
cugcccgcgcaggccccg

SEQ ID NO: 903325 - RNA, 14 nt, Mycobacterium avium subsp. paratuberculosis
cugcccgccgcggc

SEQ ID NO: 903326 - RNA, 22 nt, Mycobacterium avium subsp. paratuberculosis
cugcccgccgcggccgcuggcg

SEQ ID NO: 903327 - RNA, 14 nt, Mycobacterium avium subsp. paratuberculosis
cugcccgccgcggu

SEQ ID NO: 903328 - RNA, 15 nt, Mycobacterium avium subsp. paratuberculosis
cugcccgccgcggug

SEQ ID NO: 903329 - RNA, 13 nt, Mycobacterium avium subsp. paratuberculosis
cugcccgccgacg

SEQ ID NO: 903330 - RNA, 14 nt, Mycobacterium avium subsp. paratuberculosis
cugcccgccgacgc

SEQ ID NO: 903331 - RNA, 13 nt, Mycobacterium avium subsp. paratuberculosis
cugcccgauggug

SEQ ID NO: 903332 - RNA, 19 nt, Mycobacterium avium subsp. paratuberculosis
cugccccuucgcgacacug

SEQ ID NO: 903333 - RNA, 18 nt, Mycobacterium avium subsp. paratuberculosis
cugccccagccacagccg

SEQ ID NO: 903334 - RNA, 14 nt, Mycobacterium avium subsp. paratuberculosis
cugcccgacccgca

SEQ ID NO: 903335 - RNA, 19 nt, Mycobacterium avium subsp. paratuberculosis
cugcccgacccgcaccacc

SEQ ID NO: 903336 - RNA, 21 nt, Mycobacterium avium subsp. paratuberculosis
cugcccgacccgcaccaccgc

SEQ ID NO: 903337 - RNA, 12 nt, Mycobacterium avium subsp. paratuberculosis
cugcccgaccgc

SEQ ID NO: 903338 - RNA, 19 nt, Mycobacterium avium subsp. paratuberculosis
cugcccgaccgcgccgaac

SEQ ID NO: 903339 - RNA, 20 nt, Mycobacterium avium subsp. paratuberculosis
cugcccgaccgcgccgaaca

SEQ ID NO: 903340 - RNA, 13 nt, Mycobacterium avium subsp. paratuberculosis
cugccccggcgag

SEQ ID NO: 903341 - RNA, 23 nt, Mycobacterium avium subsp. paratuberculosis
cugccccccuugagccgguccga

SEQ ID NO: 903342 - RNA, 20 nt, Mycobacterium avium subsp. paratuberculosis
cugccccacacgcucggcgc

SEQ ID NO: 903343 - RNA, 21 nt, Mycobacterium avium subsp. paratuberculosis
cugccccacacgcucggcgcg

SEQ ID NO: 903344 - RNA, 19 nt, Mycobacterium avium subsp. paratuberculosis
cugcccagggcguuugcca

SEQ ID NO: 903345 - RNA, 13 nt, Mycobacterium avium subsp. paratuberculosis
cugcccaggucca

SEQ ID NO: 903346 - RNA, 16 nt, Mycobacterium avium subsp. paratuberculosis
cugcccagguccaccg

SEQ ID NO: 903347 - RNA, 19 nt, Mycobacterium avium subsp. paratuberculosis
cugcccauccaggccagca

SEQ ID NO: 903348 - RNA, 14 nt, Mycobacterium avium subsp. paratuberculosis
cugccagaacggcg

SEQ ID NO: 903349 - RNA, 19 nt, Mycobacterium avium subsp. paratuberculosis
cugccagaacggcggcagc

SEQ ID NO: 903350 - RNA, 12 nt, Mycobacterium avium subsp. paratuberculosis
cugccagcgccc

SEQ ID NO: 903351 - RNA, 16 nt, Mycobacterium avium subsp. paratuberculosis
cugccagcgcccgcug

SEQ ID NO: 903352 - RNA, 12 nt, Mycobacterium avium subsp. paratuberculosis
cugccagcggcg

SEQ ID NO: 903353 - RNA, 23 nt, Mycobacterium avium subsp. paratuberculosis
cugccaggacaggaugcguucgg

SEQ ID NO: 903354 - RNA, 19 nt, Mycobacterium avium subsp. paratuberculosis
cugccagggccgggcgugc

SEQ ID NO: 903355 - RNA, 19 nt, Mycobacterium avium subsp. paratuberculosis
cugccagggggaguagucg

SEQ ID NO: 903356 - RNA, 22 nt, Mycobacterium avium subsp. paratuberculosis
cugccagggggaguagucggcg

SEQ ID NO: 903357 - RNA, 20 nt, Mycobacterium avium subsp. paratuberculosis
cugccaggcgguggccgaac

SEQ ID NO: 903358 - RNA, 22 nt, Mycobacterium avium subsp. paratuberculosis
cugccaggcgguggccgaaccg

SEQ ID NO: 903359 - RNA, 23 nt, Mycobacterium avium subsp. paratuberculosis
cugcccaaugaucugggccgcca

SEQ ID NO: 903360 - RNA, 13 nt, Mycobacterium avium subsp. paratuberculosis
cugcccagcgcgg

SEQ ID NO: 903361 - RNA, 16 nt, Mycobacterium avium subsp. paratuberculosis
cugcccagcgcggucg

SEQ ID NO: 903362 - RNA, 17 nt, Mycobacterium avium subsp. paratuberculosis
cugcccagcgcggucgc

SEQ ID NO: 903363 - RNA, 19 nt, Mycobacterium avium subsp. paratuberculosis
cugcccaccagcaggucga

SEQ ID NO: 903364 - RNA, 16 nt, Mycobacterium avium subsp. paratuberculosis
cugcccagauacgccg

SEQ ID NO: 903365 - RNA, 15 nt, Mycobacterium avium subsp. paratuberculosis
cugccgaccugcgcg

SEQ ID NO: 903366 - RNA, 17 nt, Mycobacterium avium subsp. paratuberculosis
cugccgaccugcgcgac

SEQ ID NO: 903367 - RNA, 15 nt, Mycobacterium avium subsp. paratuberculosis
cugccgacgguccca

SEQ ID NO: 903368 - RNA, 19 nt, Mycobacterium avium subsp. paratuberculosis
cugccgagcaccucgucgc

SEQ ID NO: 903369 - RNA, 22 nt, Mycobacterium avium subsp. paratuberculosis
cugccgagcaccucgucgccgu

SEQ ID NO: 903370 - RNA, 18 nt, Mycobacterium avium subsp. paratuberculosis
cugccgagcaucagcugc

SEQ ID NO: 903371 - RNA, 19 nt, Mycobacterium avium subsp. paratuberculosis
cugccgagcaucagcugcc

SEQ ID NO: 903372 - RNA, 21 nt, Mycobacterium avium subsp. paratuberculosis
cugccgagcaucagcugccgu

SEQ ID NO: 903373 - RNA, 18 nt, Mycobacterium avium subsp. paratuberculosis
cugccgagguacgcgcug

SEQ ID NO: 903374 - RNA, 15 nt, Mycobacterium avium subsp. paratuberculosis
cugccgccaccgcga

SEQ ID NO: 903375 - RNA, 15 nt, Mycobacterium avium subsp. paratuberculosis
cugccgaugcugagc

SEQ ID NO: 903376 - RNA, 16 nt, Mycobacterium avium subsp. paratuberculosis
cugccgaugcugagcg

SEQ ID NO: 903377 - RNA, 23 nt, Mycobacterium avium subsp. paratuberculosis
cugccgaugcugagcgggucggc

SEQ ID NO: 903378 - RNA, 18 nt, Mycobacterium avium subsp. paratuberculosis
cugccgcaacgggccgca

SEQ ID NO: 903379 - RNA, 22 nt, Mycobacterium avium subsp. paratuberculosis
cugccgcaacgggccgcagccg

SEQ ID NO: 903380 - RNA, 12 nt, Mycobacterium avium subsp. paratuberculosis
cugccgacccgg

SEQ ID NO: 903381 - RNA, 15 nt, Mycobacterium avium subsp. paratuberculosis
cugccgacccggcgu

SEQ ID NO: 903382 - RNA, 17 nt, Mycobacterium avium subsp. paratuberculosis
cugccgacccggcguag

SEQ ID NO: 903383 - RNA, 18 nt, Mycobacterium avium subsp. paratuberculosis
cugcccugaagcugggcg

SEQ ID NO: 903384 - RNA, 18 nt, Mycobacterium avium subsp. paratuberculosis
cugcccguagucggcggc

SEQ ID NO: 903385 - RNA, 21 nt, Mycobacterium avium subsp. paratuberculosis
cugcccgucgggcgcggcggc

SEQ ID NO: 903386 - RNA, 17 nt, Mycobacterium avium subsp. paratuberculosis
cugcccggucugcggcc

SEQ ID NO: 903387 - RNA, 18 nt, Mycobacterium avium subsp. paratuberculosis
cugcccggucugcggccg

SEQ ID NO: 903388 - RNA, 16 nt, Mycobacterium avium subsp. paratuberculosis
cugccgcugcgccggc

SEQ ID NO: 903389 - RNA, 21 nt, Mycobacterium avium subsp. paratuberculosis
cugccgcuggcgucgaucgcg

SEQ ID NO: 903390 - RNA, 16 nt, Mycobacterium avium subsp. paratuberculosis
cugccggaacgagccg

SEQ ID NO: 903391 - RNA, 17 nt, Mycobacterium avium subsp. paratuberculosis
cugccggaacgagccgg

SEQ ID NO: 903392 - RNA, 20 nt, Mycobacterium avium subsp. paratuberculosis
cugccggaccucgaccagcc

SEQ ID NO: 903393 - RNA, 21 nt, Mycobacterium avium subsp. paratuberculosis
cugccggaccucgaccagccg

SEQ ID NO: 903394 - RNA, 16 nt, Mycobacterium avium subsp. paratuberculosis
cugccggaugccgcgc

SEQ ID NO: 903395 - RNA, 17 nt, Mycobacterium avium subsp. paratuberculosis
cugccggaugccgcgcg

SEQ ID NO: 903396 - RNA, 18 nt, Mycobacterium avium subsp. paratuberculosis
cugccggaugccgcgcgg

SEQ ID NO: 903397 - RNA, 19 nt, Mycobacterium avium subsp. paratuberculosis
cugccggaugccgcgcggc

SEQ ID NO: 903398 - RNA, 21 nt, Mycobacterium avium subsp. paratuberculosis
cugccggcgcuucugcgccgg

SEQ ID NO: 903399 - RNA, 22 nt, Mycobacterium avium subsp. paratuberculosis
cugccggcgcuucugcgccggu

SEQ ID NO: 903400 - RNA, 12 nt, Mycobacterium avium subsp. paratuberculosis
cugccggcggcc

SEQ ID NO: 903401 - RNA, 15 nt, Mycobacterium avium subsp. paratuberculosis
cugccggcggccgcc

SEQ ID NO: 903402 - RNA, 18 nt, Mycobacterium avium subsp. paratuberculosis
cugccggcggccgccggc

SEQ ID NO: 903403 - RNA, 19 nt, Mycobacterium avium subsp. paratuberculosis
cugccggcggccgccggca

SEQ ID NO: 903404 - RNA, 23 nt, Mycobacterium avium subsp. paratuberculosis
cugccggcggccgccggcaccgu

SEQ ID NO: 903405 - RNA, 14 nt, Mycobacterium avium subsp. paratuberculosis
cugccggccggggc

SEQ ID NO: 903406 - RNA, 17 nt, Mycobacterium avium subsp. paratuberculosis
cugccggccggggcggc

SEQ ID NO: 903407 - RNA, 21 nt, Mycobacterium avium subsp. paratuberculosis
cugccggccggggcggcggua

SEQ ID NO: 903408 - RNA, 14 nt, Mycobacterium avium subsp. paratuberculosis
cugccggccgaagg

SEQ ID NO: 903409 - RNA, 12 nt, Mycobacterium avium subsp. paratuberculosis
cugccggccgcc

SEQ ID NO: 903410 - RNA, 14 nt, Mycobacterium avium subsp. paratuberculosis
cugccggccgccgc

SEQ ID NO: 903411 - RNA, 16 nt, Mycobacterium avium subsp. paratuberculosis
cugccggccgccgcgc

SEQ ID NO: 903412 - RNA, 13 nt, Mycobacterium avium subsp. paratuberculosis
cugccggccggca

SEQ ID NO: 903413 - RNA, 19 nt, Mycobacterium avium subsp. paratuberculosis
cugccggcauaggccagca

SEQ ID NO: 903414 - RNA, 22 nt, Mycobacterium avium subsp. paratuberculosis
cugccggccaaggcaagucguc

SEQ ID NO: 903415 - RNA, 14 nt, Mycobacterium avium subsp. paratuberculosis
cugccgcgcgccga

SEQ ID NO: 903416 - RNA, 16 nt, Mycobacterium avium subsp. paratuberculosis
cugccgcgcgccgaca

SEQ ID NO: 903417 - RNA, 17 nt, Mycobacterium avium subsp. paratuberculosis
cugccgcgcgccgacag

SEQ ID NO: 903418 - RNA, 21 nt, Mycobacterium avium subsp. paratuberculosis
cugccgcgccccgagcagcgg

SEQ ID NO: 903419 - RNA, 13 nt, Mycobacterium avium subsp. paratuberculosis
cugccgccggcga

SEQ ID NO: 903420 - RNA, 14 nt, Mycobacterium avium subsp. paratuberculosis
cugccgccggcgaa

SEQ ID NO: 903421 - RNA, 18 nt, Mycobacterium avium subsp. paratuberculosis
cugccgcgacucgguguc

SEQ ID NO: 903422 - RNA, 19 nt, Mycobacterium avium subsp. paratuberculosis
cugccgcgacucggugucg

SEQ ID NO: 903423 - RNA, 17 nt, Mycobacterium avium subsp. paratuberculosis
cugccgccgcagcagcc

SEQ ID NO: 903424 - RNA, 19 nt, Mycobacterium avium subsp. paratuberculosis
cugccgccgccgcugucga

SEQ ID NO: 903425 - RNA, 13 nt, Mycobacterium avium subsp. paratuberculosis
cugccgccgccgg

SEQ ID NO: 903426 - RNA, 16 nt, Mycobacterium avium subsp. paratuberculosis
cugccgcccccgcugg

SEQ ID NO: 903427 - RNA, 17 nt, Mycobacterium avium subsp. paratuberculosis
cugccgcccccgcuggc

SEQ ID NO: 903428 - RNA, 18 nt, Mycobacterium avium subsp. paratuberculosis
cugccgcccccgcuggcg

SEQ ID NO: 903429 - RNA, 19 nt, Mycobacterium avium subsp. paratuberculosis
cugccgcccccgcuggcga

SEQ ID NO: 903430 - RNA, 15 nt, Mycobacterium avium subsp. paratuberculosis
cugccgucaccggcc

SEQ ID NO: 903431 - RNA, 16 nt, Mycobacterium avium subsp. paratuberculosis
cugccgucaccggcca

SEQ ID NO: 903432 - RNA, 17 nt, Mycobacterium avium subsp. paratuberculosis
cugccgucaccggccau

SEQ ID NO: 903433 - RNA, 20 nt, Mycobacterium avium subsp. paratuberculosis
cugccgucaccggccauccg

SEQ ID NO: 903434 - RNA, 13 nt, Mycobacterium avium subsp. paratuberculosis
cugccgucgguuu

SEQ ID NO: 903435 - RNA, 15 nt, Mycobacterium avium subsp. paratuberculosis
cugccguccggcggc

SEQ ID NO: 903436 - RNA, 16 nt, Mycobacterium avium subsp. paratuberculosis
cugccguccggcggca

SEQ ID NO: 903437 - RNA, 16 nt, Mycobacterium avium subsp. paratuberculosis
cugccguccggguccg

SEQ ID NO: 903438 - RNA, 21 nt, Mycobacterium avium subsp. paratuberculosis
cugccguccuucucgaaccgg

SEQ ID NO: 903439 - RNA, 23 nt, Mycobacterium avium subsp. paratuberculosis
cugccguccuucucgaaccgggg

SEQ ID NO: 903440 - RNA, 15 nt, Mycobacterium avium subsp. paratuberculosis
cugccgucgacgacc

SEQ ID NO: 903441 - RNA, 13 nt, Mycobacterium avium subsp. paratuberculosis
cugccguucgccg

SEQ ID NO: 903442 - RNA, 13 nt, Mycobacterium avium subsp. paratuberculosis
cugccguugggca

SEQ ID NO: 903443 - RNA, 20 nt, Mycobacterium avium subsp. paratuberculosis
cugccguugggcacggugua

SEQ ID NO: 903444 - RNA, 22 nt, Mycobacterium avium subsp. paratuberculosis
cugccguugggcacgguguagc

SEQ ID NO: 903445 - RNA, 21 nt, Mycobacterium avium subsp. paratuberculosis
cugccguugauugaccauccg

SEQ ID NO: 903446 - RNA, 17 nt, Mycobacterium avium subsp. paratuberculosis
cugccguugcgccagcg

SEQ ID NO: 903447 - RNA, 12 nt, Mycobacterium avium subsp. paratuberculosis
cugccguucggc

SEQ ID NO: 903448 - RNA, 17 nt, Mycobacterium avium subsp. paratuberculosis
cugccguucggccagcg

SEQ ID NO: 903449 - RNA, 19 nt, Mycobacterium avium subsp. paratuberculosis
cugccguucggccagcgcc

SEQ ID NO: 903450 - RNA, 12 nt, Mycobacterium avium subsp. paratuberculosis
cugccggcgacc

SEQ ID NO: 903451 - RNA, 20 nt, Mycobacterium avium subsp. paratuberculosis
cugccggcgacgguggcgcc

SEQ ID NO: 903452 - RNA, 14 nt, Mycobacterium avium subsp. paratuberculosis
cugccggggcgcag

SEQ ID NO: 903453 - RNA, 15 nt, Mycobacterium avium subsp. paratuberculosis
cugccggggcgcagc

SEQ ID NO: 903454 - RNA, 15 nt, Mycobacterium avium subsp. paratuberculosis
cugccgggccgcauc

SEQ ID NO: 903455 - RNA, 20 nt, Mycobacterium avium subsp. paratuberculosis
cugccgggccgcauccagcg

SEQ ID NO: 903456 - RNA, 22 nt, Mycobacterium avium subsp. paratuberculosis
cugccgggccgcauccagcgcc

SEQ ID NO: 903457 - RNA, 13 nt, Mycobacterium avium subsp. paratuberculosis
cugccggggugca

SEQ ID NO: 903458 - RNA, 22 nt, Mycobacterium avium subsp. paratuberculosis
cugccggggugcagcaccacga

SEQ ID NO: 903459 - RNA, 15 nt, Mycobacterium avium subsp. paratuberculosis
cugccgggcggcgac

SEQ ID NO: 903460 - RNA, 14 nt, Mycobacterium avium subsp. paratuberculosis
cugccgggcgucga

SEQ ID NO: 903461 - RNA, 19 nt, Mycobacterium avium subsp. paratuberculosis
cugccggucgaugucggcg

SEQ ID NO: 903462 - RNA, 20 nt, Mycobacterium avium subsp. paratuberculosis
cugccggucgaugucggcga

SEQ ID NO: 903463 - RNA, 18 nt, Mycobacterium avium subsp. paratuberculosis
cugccguagcgcugggug

SEQ ID NO: 903464 - RNA, 19 nt, Mycobacterium avium subsp. paratuberculosis
cugccguagcgcuggguga

SEQ ID NO: 903465 - RNA, 18 nt, Mycobacterium avium subsp. paratuberculosis
cugccggugccgccggcg

SEQ ID NO: 903466 - RNA, 21 nt, Mycobacterium avium subsp. paratuberculosis
cugccggugccgccggcgcau

SEQ ID NO: 903467 - RNA, 19 nt, Mycobacterium avium subsp. paratuberculosis
cugccggugcugcucgagg

SEQ ID NO: 903468 - RNA, 18 nt, Mycobacterium avium subsp. paratuberculosis
cugcgaauacccgcccag

SEQ ID NO: 903469 - RNA, 18 nt, Mycobacterium avium subsp. paratuberculosis
cugcgacaggucggcggu

SEQ ID NO: 903470 - RNA, 21 nt, Mycobacterium avium subsp. paratuberculosis
cugcgacaggucggcggucgc

SEQ ID NO: 903471 - RNA, 14 nt, Mycobacterium avium subsp. paratuberculosis
cugcgaccacccgg

SEQ ID NO: 903472 - RNA, 16 nt, Mycobacterium avium subsp. paratuberculosis
cugcgaccgccgccgc

SEQ ID NO: 903473 - RNA, 21 nt, Mycobacterium avium subsp. paratuberculosis
cugcgaccgccgccgcgacca

SEQ ID NO: 903474 - RNA, 21 nt, Mycobacterium avium subsp. paratuberculosis
cugcgacgcgaacgcgccccg

SEQ ID NO: 903475 - RNA, 16 nt, Mycobacterium avium subsp. paratuberculosis
cugcgacggcagcacc

SEQ ID NO: 903476 - RNA, 17 nt, Mycobacterium avium subsp. paratuberculosis
cugccugacccggccgu

SEQ ID NO: 903477 - RNA, 20 nt, Mycobacterium avium subsp. paratuberculosis
cugccuggccacguggucgc

SEQ ID NO: 903478 - RNA, 15 nt, Mycobacterium avium subsp. paratuberculosis
cugccucgacgaugg

SEQ ID NO: 903479 - RNA, 21 nt, Mycobacterium avium subsp. paratuberculosis
cugccucgacgaugggugugg

SEQ ID NO: 903480 - RNA, 21 nt, Mycobacterium avium subsp. paratuberculosis
cugccuugcugacgccgcggu

SEQ ID NO: 903481 - RNA, 22 nt, Mycobacterium avium subsp. paratuberculosis
cugccuugcugacgccgcggug

SEQ ID NO: 903482 - RNA, 23 nt, Mycobacterium avium subsp. paratuberculosis
cugccugguuggucaauccgggc

SEQ ID NO: 903483 - RNA, 17 nt, Mycobacterium avium subsp. paratuberculosis
cugaucacaugggcgac

SEQ ID NO: 903484 - RNA, 13 nt, Mycobacterium avium subsp. paratuberculosis
cugaucaccgcgc

SEQ ID NO: 903485 - RNA, 23 nt, Mycobacterium avium subsp. paratuberculosis
cugaucagccggcgagcgcgcug

SEQ ID NO: 903486 - RNA, 16 nt, Mycobacterium avium subsp. paratuberculosis
cugaucgaguccucgc

SEQ ID NO: 903487 - RNA, 17 nt, Mycobacterium avium subsp. paratuberculosis
cugaucgaguccucgcg

SEQ ID NO: 903488 - RNA, 20 nt, Mycobacterium avium subsp. paratuberculosis
cugaucgaguuccgcgucgg

SEQ ID NO: 903489 - RNA, 13 nt, Mycobacterium avium subsp. paratuberculosis
cugauccgcgguc

SEQ ID NO: 903490 - RNA, 14 nt, Mycobacterium avium subsp. paratuberculosis
cugauccagcagcg

SEQ ID NO: 903491 - RNA, 22 nt, Mycobacterium avium subsp. paratuberculosis
cugauccagcagcgccucggcg

SEQ ID NO: 903492 - RNA, 12 nt, Mycobacterium avium subsp. paratuberculosis
cugagccggccc

SEQ ID NO: 903493 - RNA, 18 nt, Mycobacterium avium subsp. paratuberculosis
cugagcccggcgacgaag

SEQ ID NO: 903494 - RNA, 13 nt, Mycobacterium avium subsp. paratuberculosis
cugagccgccgag

SEQ ID NO: 903495 - RNA, 14 nt, Mycobacterium avium subsp. paratuberculosis
cugagccgccgagc

SEQ ID NO: 903496 - RNA, 20 nt, Mycobacterium avium subsp. paratuberculosis
cugagccgccgagccggcac

SEQ ID NO: 903497 - RNA, 23 nt, Mycobacterium avium subsp. paratuberculosis
cugagccgccgagccggcacggc

SEQ ID NO: 903498 - RNA, 20 nt, Mycobacterium avium subsp. paratuberculosis
cugagccgccggggcgccgc

SEQ ID NO: 903499 - RNA, 24 nt, Mycobacterium avium subsp. paratuberculosis
cugacgucgaugccggccagcggc

SEQ ID NO: 903500 - RNA, 17 nt, Mycobacterium avium subsp. paratuberculosis
cugauaggggucggcga

SEQ ID NO: 903501 - RNA, 17 nt, Mycobacterium avium subsp. paratuberculosis
cugauaggucagcucga

SEQ ID NO: 903502 - RNA, 14 nt, Mycobacterium avium subsp. paratuberculosis
cugauagcccgccg

SEQ ID NO: 903503 - RNA, 22 nt, Mycobacterium avium subsp. paratuberculosis
cugauagcccgccgcggcgacc

SEQ ID NO: 903504 - RNA, 16 nt, Mycobacterium avium subsp. paratuberculosis
cugagcgcccggucga

SEQ ID NO: 903505 - RNA, 18 nt, Mycobacterium avium subsp. paratuberculosis
cugagcgcccggucgagg

SEQ ID NO: 903506 - RNA, 14 nt, Mycobacterium avium subsp. paratuberculosis
cugagcgcggcgag

SEQ ID NO: 903507 - RNA, 20 nt, Mycobacterium avium subsp. paratuberculosis
cugagcggguaaccgcagcc

SEQ ID NO: 903508 - RNA, 21 nt, Mycobacterium avium subsp. paratuberculosis
cugagcgggucggccggcggg

SEQ ID NO: 903509 - RNA, 14 nt, Mycobacterium avium subsp. paratuberculosis
cugacccagcgcgg

SEQ ID NO: 903510 - RNA, 12 nt, Mycobacterium avium subsp. paratuberculosis
cugaccagcgcc

SEQ ID NO: 903511 - RNA, 14 nt, Mycobacterium avium subsp. paratuberculosis
cugaccagcgccuc

SEQ ID NO: 903512 - RNA, 20 nt, Mycobacterium avium subsp. paratuberculosis
cugaccagcgccucgcgggu

SEQ ID NO: 903513 - RNA, 13 nt, Mycobacterium avium subsp. paratuberculosis
cugaccagcggcg

SEQ ID NO: 903514 - RNA, 18 nt, Mycobacterium avium subsp. paratuberculosis
cugaccagcggcgcgccg

SEQ ID NO: 903515 - RNA, 19 nt, Mycobacterium avium subsp. paratuberculosis
cugaccagcggcgcgccgg

SEQ ID NO: 903516 - RNA, 13 nt, Mycobacterium avium subsp. paratuberculosis
cugaccaggccgu

SEQ ID NO: 903517 - RNA, 14 nt, Mycobacterium avium subsp. paratuberculosis
cugaccgagcggcg

SEQ ID NO: 903518 - RNA, 17 nt, Mycobacterium avium subsp. paratuberculosis
cugaccgagcggcgcug

SEQ ID NO: 903519 - RNA, 16 nt, Mycobacterium avium subsp. paratuberculosis
cugaccgaucuggcga

SEQ ID NO: 903520 - RNA, 17 nt, Mycobacterium avium subsp. paratuberculosis
cugaccgaucuggcgau

SEQ ID NO: 903521 - RNA, 17 nt, Mycobacterium avium subsp. paratuberculosis
cugaccgauggccgccc

SEQ ID NO: 903522 - RNA, 15 nt, Mycobacterium avium subsp. paratuberculosis
cugaccgacggcgac

SEQ ID NO: 903523 - RNA, 17 nt, Mycobacterium avium subsp. paratuberculosis
cugaccgacggcgacca

SEQ ID NO: 903524 - RNA, 20 nt, Mycobacterium avium subsp. paratuberculosis
cugaccgacggcgaccagua

SEQ ID NO: 903525 - RNA, 17 nt, Mycobacterium avium subsp. paratuberculosis
cugaccccccgacgccg

SEQ ID NO: 903526 - RNA, 18 nt, Mycobacterium avium subsp. paratuberculosis
cugaccccccgacgccga

SEQ ID NO: 903527 - RNA, 21 nt, Mycobacterium avium subsp. paratuberculosis
cugacccgccgcaacagccgg

SEQ ID NO: 903528 - RNA, 16 nt, Mycobacterium avium subsp. paratuberculosis
cugacccggucgcggc

SEQ ID NO: 903529 - RNA, 18 nt, Mycobacterium avium subsp. paratuberculosis
cugacccggucgcggccg

SEQ ID NO: 903530 - RNA, 14 nt, Mycobacterium avium subsp. paratuberculosis
cugaccggccaccu

SEQ ID NO: 903531 - RNA, 22 nt, Mycobacterium avium subsp. paratuberculosis
cugaccggccaccucgucggcg

SEQ ID NO: 903532 - RNA, 17 nt, Mycobacterium avium subsp. paratuberculosis
cugaccggcgaucguca

SEQ ID NO: 903533 - RNA, 13 nt, Mycobacterium avium subsp. paratuberculosis
cugaccggcggug

SEQ ID NO: 903534 - RNA, 16 nt, Mycobacterium avium subsp. paratuberculosis
cugaccggcggugccg

SEQ ID NO: 903535 - RNA, 19 nt, Mycobacterium avium subsp. paratuberculosis
cugaccggcggugccggcc

SEQ ID NO: 903536 - RNA, 21 nt, Mycobacterium avium subsp. paratuberculosis
cugaccggcggugccggccag

SEQ ID NO: 903537 - RNA, 15 nt, Mycobacterium avium subsp. paratuberculosis
cugaccgccgcgcuc

SEQ ID NO: 903538 - RNA, 16 nt, Mycobacterium avium subsp. paratuberculosis
cugaccgcgggcccgc

SEQ ID NO: 903539 - RNA, 23 nt, Mycobacterium avium subsp. paratuberculosis
cugaccgcgggugaggggcgcgc

SEQ ID NO: 903540 - RNA, 12 nt, Mycobacterium avium subsp. paratuberculosis
cugacgggccgg

SEQ ID NO: 903541 - RNA, 13 nt, Mycobacterium avium subsp. paratuberculosis
cugacgggccggc

SEQ ID NO: 903542 - RNA, 14 nt, Mycobacterium avium subsp. paratuberculosis
cugacgggccggcg

SEQ ID NO: 903543 - RNA, 16 nt, Mycobacterium avium subsp. paratuberculosis
cugacgggccggcggg

SEQ ID NO: 903544 - RNA, 17 nt, Mycobacterium avium subsp. paratuberculosis
cugacgggccggcgggg

SEQ ID NO: 903545 - RNA, 20 nt, Mycobacterium avium subsp. paratuberculosis
cugacggcucuucggcgccg

SEQ ID NO: 903546 - RNA, 15 nt, Mycobacterium avium subsp. paratuberculosis
cugacggucgccgac

SEQ ID NO: 903547 - RNA, 13 nt, Mycobacterium avium subsp. paratuberculosis
cugcacgucggcg

SEQ ID NO: 903548 - RNA, 16 nt, Mycobacterium avium subsp. paratuberculosis
cugcacgucggcgcgc

SEQ ID NO: 903549 - RNA, 18 nt, Mycobacterium avium subsp. paratuberculosis
cugcacgucggcgcgcag

SEQ ID NO: 903550 - RNA, 16 nt, Mycobacterium avium subsp. paratuberculosis
cugcacgucggcggcc

SEQ ID NO: 903551 - RNA, 17 nt, Mycobacterium avium subsp. paratuberculosis
cugcacgucggcggccg

SEQ ID NO: 903552 - RNA, 21 nt, Mycobacterium avium subsp. paratuberculosis
cugcacgucggcggccgcgaa

SEQ ID NO: 903553 - RNA, 14 nt, Mycobacterium avium subsp. paratuberculosis
cugcagaccgaacg

SEQ ID NO: 903554 - RNA, 23 nt, Mycobacterium avium subsp. paratuberculosis
cugcagaccgaacgucacggcga

SEQ ID NO: 903555 - RNA, 14 nt, Mycobacterium avium subsp. paratuberculosis
cugcagcaccgaac

SEQ ID NO: 903556 - RNA, 18 nt, Mycobacterium avium subsp. paratuberculosis
cugcagcaacucgcgcuc

SEQ ID NO: 903557 - RNA, 16 nt, Mycobacterium avium subsp. paratuberculosis
cugcagcagccgcugc

SEQ ID NO: 903558 - RNA, 12 nt, Mycobacterium avium subsp. paratuberculosis
cugcagcagcga

SEQ ID NO: 903559 - RNA, 23 nt, Mycobacterium avium subsp. paratuberculosis
cugcagcagcgacuugaccagca

SEQ ID NO: 903560 - RNA, 14 nt, Mycobacterium avium subsp. paratuberculosis
cugcagagcgguga

SEQ ID NO: 903561 - RNA, 16 nt, Mycobacterium avium subsp. paratuberculosis
cugcagagcggugaca

SEQ ID NO: 903562 - RNA, 23 nt, Mycobacterium avium subsp. paratuberculosis
cugcagagcggugacaucgccac

SEQ ID NO: 903563 - RNA, 21 nt, Mycobacterium avium subsp. paratuberculosis
cugcagauaggacccggcgag

SEQ ID NO: 903564 - RNA, 20 nt, Mycobacterium avium subsp. paratuberculosis
cugcacggggacgucgucgu

SEQ ID NO: 903565 - RNA, 13 nt, Mycobacterium avium subsp. paratuberculosis
cugcacggggugc

SEQ ID NO: 903566 - RNA, 19 nt, Mycobacterium avium subsp. paratuberculosis
cugcacgcguugcagcgcc

SEQ ID NO: 903567 - RNA, 20 nt, Mycobacterium avium subsp. paratuberculosis
cugcacgcguugcagcgccg

SEQ ID NO: 903568 - RNA, 13 nt, Mycobacterium avium subsp. paratuberculosis
cugcacguccgcc

SEQ ID NO: 903569 - RNA, 23 nt, Mycobacterium avium subsp. paratuberculosis
cugcacguccgccuccgaccagc

SEQ ID NO: 903570 - RNA, 19 nt, Mycobacterium avium subsp. paratuberculosis
cugcacgucgccggcgacc

SEQ ID NO: 903571 - RNA, 19 nt, Mycobacterium avium subsp. paratuberculosis
cugcacggccucggucacg

SEQ ID NO: 903572 - RNA, 18 nt, Mycobacterium avium subsp. paratuberculosis
cugcacggugcgccggca

SEQ ID NO: 903573 - RNA, 23 nt, Mycobacterium avium subsp. paratuberculosis
cugcacggugcgccggcagcggc

SEQ ID NO: 903574 - RNA, 19 nt, Mycobacterium avium subsp. paratuberculosis
cugcacgcuguccgcguga

SEQ ID NO: 903575 - RNA, 19 nt, Mycobacterium avium subsp. paratuberculosis
cugcacgcgcgggucgucg

SEQ ID NO: 903576 - RNA, 12 nt, Mycobacterium avium subsp. paratuberculosis
cugcacccgcuc

SEQ ID NO: 903577 - RNA, 21 nt, Mycobacterium avium subsp. paratuberculosis
cugcacccucugccacggcgg

SEQ ID NO: 903578 - RNA, 14 nt, Mycobacterium avium subsp. paratuberculosis
cugcaccagcccgu

SEQ ID NO: 903579 - RNA, 17 nt, Mycobacterium avium subsp. paratuberculosis
cugcaccagcccgucgg

SEQ ID NO: 903580 - RNA, 13 nt, Mycobacterium avium subsp. paratuberculosis
cugcaccagcacg

SEQ ID NO: 903581 - RNA, 14 nt, Mycobacterium avium subsp. paratuberculosis
cugcaccagcacga

SEQ ID NO: 903582 - RNA, 20 nt, Mycobacterium avium subsp. paratuberculosis
cugcaccagcacgacaccga

SEQ ID NO: 903583 - RNA, 22 nt, Mycobacterium avium subsp. paratuberculosis
cugcaccagcacgacaccgacg

SEQ ID NO: 903584 - RNA, 20 nt, Mycobacterium avium subsp. paratuberculosis
cugcaccaccacacccagcg

SEQ ID NO: 903585 - RNA, 23 nt, Mycobacterium avium subsp. paratuberculosis
cugcaccacgaagcgggcggcga

SEQ ID NO: 903586 - RNA, 18 nt, Mycobacterium avium subsp. paratuberculosis
cugcacccaccggcgcag

SEQ ID NO: 903587 - RNA, 14 nt, Mycobacterium avium subsp. paratuberculosis
cugcaccagcgcgg

SEQ ID NO: 903588 - RNA, 13 nt, Mycobacterium avium subsp. paratuberculosis
cugcaccagcggc

SEQ ID NO: 903589 - RNA, 14 nt, Mycobacterium avium subsp. paratuberculosis
cugcaccagcggcg

SEQ ID NO: 903590 - RNA, 16 nt, Mycobacterium avium subsp. paratuberculosis
cugcaccagcggcgcc

SEQ ID NO: 903591 - RNA, 12 nt, Mycobacterium avium subsp. paratuberculosis
cugcaccagcgu

SEQ ID NO: 903592 - RNA, 17 nt, Mycobacterium avium subsp. paratuberculosis
cugcacccaggucaugg

SEQ ID NO: 903593 - RNA, 13 nt, Mycobacterium avium subsp. paratuberculosis
cugcacccgaacg

SEQ ID NO: 903594 - RNA, 18 nt, Mycobacterium avium subsp. paratuberculosis
cugcacagugcgucgccc

SEQ ID NO: 903595 - RNA, 19 nt, Mycobacterium avium subsp. paratuberculosis
cugcacagugcgucgccca

SEQ ID NO: 903596 - RNA, 17 nt, Mycobacterium avium subsp. paratuberculosis
cugcaacuacgcacccg

SEQ ID NO: 903597 - RNA, 15 nt, Mycobacterium avium subsp. paratuberculosis
cugcaacggcuggcg

SEQ ID NO: 903598 - RNA, 13 nt, Mycobacterium avium subsp. paratuberculosis
cugaucuucucga

SEQ ID NO: 903599 - RNA, 19 nt, Mycobacterium avium subsp. paratuberculosis
cugaucuuggcacgggccc

SEQ ID NO: 903600 - RNA, 16 nt, Mycobacterium avium subsp. paratuberculosis
cugaucuacgucggcu

SEQ ID NO: 903601 - RNA, 14 nt, Mycobacterium avium subsp. paratuberculosis
cugaucucgacggu

SEQ ID NO: 903602 - RNA, 16 nt, Mycobacterium avium subsp. paratuberculosis
cugaucgcggcgagca

SEQ ID NO: 903603 - RNA, 19 nt, Mycobacterium avium subsp. paratuberculosis
cugaucgcguagcgccggu

SEQ ID NO: 903604 - RNA, 16 nt, Mycobacterium avium subsp. paratuberculosis
cugaucgcgucgacgg

SEQ ID NO: 903605 - RNA, 14 nt, Mycobacterium avium subsp. paratuberculosis
cugaucgcccagca

SEQ ID NO: 903606 - RNA, 15 nt, Mycobacterium avium subsp. paratuberculosis
cugaucgcccagcac

SEQ ID NO: 903607 - RNA, 17 nt, Mycobacterium avium subsp. paratuberculosis
cugaucgcccagcaccg

SEQ ID NO: 903608 - RNA, 22 nt, Mycobacterium avium subsp. paratuberculosis
cugaucgcccagcaccgcgacg

SEQ ID NO: 903609 - RNA, 21 nt, Mycobacterium avium subsp. paratuberculosis
cugaucgcgauccgggcgccg

SEQ ID NO: 903610 - RNA, 18 nt, Mycobacterium avium subsp. paratuberculosis
cucguugccagccggugc

SEQ ID NO: 903611 - RNA, 16 nt, Mycobacterium avium subsp. paratuberculosis
cucguugauccagacg

SEQ ID NO: 903612 - RNA, 15 nt, Mycobacterium avium subsp. paratuberculosis
cucguugccggcggc

SEQ ID NO: 903613 - RNA, 17 nt, Mycobacterium avium subsp. paratuberculosis
cucguugccggcggcca

SEQ ID NO: 903614 - RNA, 23 nt, Mycobacterium avium subsp. paratuberculosis
cucguugccggcggccagcaucg

SEQ ID NO: 903615 - RNA, 23 nt, Mycobacterium avium subsp. paratuberculosis
cucguugugcaccggcacgucga

SEQ ID NO: 903616 - RNA, 14 nt, Mycobacterium avium subsp. paratuberculosis
cucguuggccagcu

SEQ ID NO: 903617 - RNA, 16 nt, Mycobacterium avium subsp. paratuberculosis
cucguuggggccacca

SEQ ID NO: 903618 - RNA, 20 nt, Mycobacterium avium subsp. paratuberculosis
cucguugaccgggucgccga

SEQ ID NO: 903619 - RNA, 23 nt, Mycobacterium avium subsp. paratuberculosis
cucguucgaauuguggcggccca

SEQ ID NO: 903620 - RNA, 16 nt, Mycobacterium avium subsp. paratuberculosis
cucguucucggcgaac

SEQ ID NO: 903621 - RNA, 14 nt, Mycobacterium avium subsp. paratuberculosis
cucguucuggcccg

SEQ ID NO: 903622 - RNA, 15 nt, Mycobacterium avium subsp. paratuberculosis
cucguucuggcccgc

SEQ ID NO: 903623 - RNA, 13 nt, Mycobacterium avium subsp. paratuberculosis
cucgucgucgaug

SEQ ID NO: 903624 - RNA, 15 nt, Mycobacterium avium subsp. paratuberculosis
cucgucgucggcggg

SEQ ID NO: 903625 - RNA, 14 nt, Mycobacterium avium subsp. paratuberculosis
cucgucgucgguga

SEQ ID NO: 903626 - RNA, 15 nt, Mycobacterium avium subsp. paratuberculosis
cucgucuccggcggc

SEQ ID NO: 903627 - RNA, 18 nt, Mycobacterium avium subsp. paratuberculosis
cucgucuuccgcggcggc

SEQ ID NO: 903628 - RNA, 15 nt, Mycobacterium avium subsp. paratuberculosis
cucgucgagcauccg

SEQ ID NO: 903629 - RNA, 16 nt, Mycobacterium avium subsp. paratuberculosis
cucgucgggcaccgcc

SEQ ID NO: 903630 - RNA, 17 nt, Mycobacterium avium subsp. paratuberculosis
cucgucggggcagccgu

SEQ ID NO: 903631 - RNA, 16 nt, Mycobacterium avium subsp. paratuberculosis
cucgucggggcgccua

SEQ ID NO: 903632 - RNA, 18 nt, Mycobacterium avium subsp. paratuberculosis
cucgucggggcgccuacc

SEQ ID NO: 903633 - RNA, 19 nt, Mycobacterium avium subsp. paratuberculosis
cucgucggggcgccuaccg

SEQ ID NO: 903634 - RNA, 20 nt, Mycobacterium avium subsp. paratuberculosis
cucgucggguguggcgccgu

SEQ ID NO: 903635 - RNA, 16 nt, Mycobacterium avium subsp. paratuberculosis
cucgucggcgccgucg

SEQ ID NO: 903636 - RNA, 13 nt, Mycobacterium avium subsp. paratuberculosis
cucgucggcgcgc

SEQ ID NO: 903637 - RNA, 15 nt, Mycobacterium avium subsp. paratuberculosis
cucgucggcgcgcca

SEQ ID NO: 903638 - RNA, 17 nt, Mycobacterium avium subsp. paratuberculosis
cucgucggcgcgggcca

SEQ ID NO: 903639 - RNA, 17 nt, Mycobacterium avium subsp. paratuberculosis
cucgucggcggcgacgg

SEQ ID NO: 903640 - RNA, 20 nt, Mycobacterium avium subsp. paratuberculosis
cucgucggcggcgacggcga

SEQ ID NO: 903641 - RNA, 23 nt, Mycobacterium avium subsp. paratuberculosis
cucgucggcggcgacggcgacca

SEQ ID NO: 903642 - RNA, 14 nt, Mycobacterium avium subsp. paratuberculosis
cucgucggcggcgg

SEQ ID NO: 903643 - RNA, 15 nt, Mycobacterium avium subsp. paratuberculosis
cucgucggcggcggc

SEQ ID NO: 903644 - RNA, 14 nt, Mycobacterium avium subsp. paratuberculosis
cucgucggcgggca

SEQ ID NO: 903645 - RNA, 17 nt, Mycobacterium avium subsp. paratuberculosis
cucgucggcgggcaccu

SEQ ID NO: 903646 - RNA, 22 nt, Mycobacterium avium subsp. paratuberculosis
cucgucgauccccacgucgccg

SEQ ID NO: 903647 - RNA, 17 nt, Mycobacterium avium subsp. paratuberculosis
cucgucgaucgacgccg

SEQ ID NO: 903648 - RNA, 20 nt, Mycobacterium avium subsp. paratuberculosis
cucgucgaucgacgccgaca

SEQ ID NO: 903649 - RNA, 23 nt, Mycobacterium avium subsp. paratuberculosis
cucgucgaucgacgccgacaucg

SEQ ID NO: 903650 - RNA, 13 nt, Mycobacterium avium subsp. paratuberculosis
cucgucggcgguc

SEQ ID NO: 903651 - RNA, 14 nt, Mycobacterium avium subsp. paratuberculosis
cucgucggcggugc

SEQ ID NO: 903652 - RNA, 19 nt, Mycobacterium avium subsp. paratuberculosis
cucgucgggaacgccgauc

SEQ ID NO: 903653 - RNA, 20 nt, Mycobacterium avium subsp. paratuberculosis
cucgucgggaaugucggcgu

SEQ ID NO: 903654 - RNA, 14 nt, Mycobacterium avium subsp. paratuberculosis
cucggugucgaggu

SEQ ID NO: 903655 - RNA, 14 nt, Mycobacterium avium subsp. paratuberculosis
cucggugucgaucg

SEQ ID NO: 903656 - RNA, 16 nt, Mycobacterium avium subsp. paratuberculosis
cucgguggucgacgag

SEQ ID NO: 903657 - RNA, 17 nt, Mycobacterium avium subsp. paratuberculosis
cucgguggucgacgagc

SEQ ID NO: 903658 - RNA, 22 nt, Mycobacterium avium subsp. paratuberculosis
cucguacaaggugauggcccgc

SEQ ID NO: 903659 - RNA, 15 nt, Mycobacterium avium subsp. paratuberculosis
cucgucccacggcgg

SEQ ID NO: 903660 - RNA, 14 nt, Mycobacterium avium subsp. paratuberculosis
cucgucccagcgca

SEQ ID NO: 903661 - RNA, 16 nt, Mycobacterium avium subsp. paratuberculosis
cucguccgacagcgcc

SEQ ID NO: 903662 - RNA, 13 nt, Mycobacterium avium subsp. paratuberculosis
cucguccgcggcg

SEQ ID NO: 903663 - RNA, 19 nt, Mycobacterium avium subsp. paratuberculosis
cucguccuggcgcuggugc

SEQ ID NO: 903664 - RNA, 17 nt, Mycobacterium avium subsp. paratuberculosis
cucguccugggccggga

SEQ ID NO: 903665 - RNA, 22 nt, Mycobacterium avium subsp. paratuberculosis
cucguccucccgguagccgaca

SEQ ID NO: 903666 - RNA, 16 nt, Mycobacterium avium subsp. paratuberculosis
cucgucgacgcccacc

SEQ ID NO: 903667 - RNA, 17 nt, Mycobacterium avium subsp. paratuberculosis
cucgucgacgcccaccu

SEQ ID NO: 903668 - RNA, 20 nt, Mycobacterium avium subsp. paratuberculosis
cucgucgacgcccaccuggu

SEQ ID NO: 903669 - RNA, 17 nt, Mycobacterium avium subsp. paratuberculosis
cucgucgacgcugaccg

SEQ ID NO: 903670 - RNA, 16 nt, Mycobacterium avium subsp. paratuberculosis
cucgucgagcagcgcc

SEQ ID NO: 903671 - RNA, 14 nt, Mycobacterium avium subsp. paratuberculosis
cucgucgacggcgg

SEQ ID NO: 903672 - RNA, 20 nt, Mycobacterium avium subsp. paratuberculosis
cucgucgacguccucgcccg

SEQ ID NO: 903673 - RNA, 22 nt, Mycobacterium avium subsp. paratuberculosis
cucgucgagccggccggacacc

SEQ ID NO: 903674 - RNA, 18 nt, Mycobacterium avium subsp. paratuberculosis
cucgucgagccgggcccg

SEQ ID NO: 903675 - RNA, 13 nt, Mycobacterium avium subsp. paratuberculosis
cucgguggccacc

SEQ ID NO: 903676 - RNA, 22 nt, Mycobacterium avium subsp. paratuberculosis
cucgguggccaccuuggacagg

SEQ ID NO: 903677 - RNA, 13 nt, Mycobacterium avium subsp. paratuberculosis
cucgguggccggu

SEQ ID NO: 903678 - RNA, 23 nt, Mycobacterium avium subsp. paratuberculosis
cucgguggcgguggccacggcgu

SEQ ID NO: 903679 - RNA, 16 nt, Mycobacterium avium subsp. paratuberculosis
cucgguggcgucggcg

SEQ ID NO: 903680 - RNA, 22 nt, Mycobacterium avium subsp. paratuberculosis
cucgguggugucaaccaggucg

SEQ ID NO: 903681 - RNA, 14 nt, Mycobacterium avium subsp. paratuberculosis
cucgguguacagcg

SEQ ID NO: 903682 - RNA, 17 nt, Mycobacterium avium subsp. paratuberculosis
cucgguguagagcaccu

SEQ ID NO: 903683 - RNA, 18 nt, Mycobacterium avium subsp. paratuberculosis
cucgguguagagcaccuc

SEQ ID NO: 903684 - RNA, 19 nt, Mycobacterium avium subsp. paratuberculosis
cucggcgaacagcggggug

SEQ ID NO: 903685 - RNA, 16 nt, Mycobacterium avium subsp. paratuberculosis
cucggccuuggccacc

SEQ ID NO: 903686 - RNA, 17 nt, Mycobacterium avium subsp. paratuberculosis
cucggccuuggccaccg

SEQ ID NO: 903687 - RNA, 16 nt, Mycobacterium avium subsp. paratuberculosis
cucggccucgucgacg

SEQ ID NO: 903688 - RNA, 17 nt, Mycobacterium avium subsp. paratuberculosis
cucggccucgucgacgu

SEQ ID NO: 903689 - RNA, 19 nt, Mycobacterium avium subsp. paratuberculosis
cucggccucgucgacgucg

SEQ ID NO: 903690 - RNA, 22 nt, Mycobacterium avium subsp. paratuberculosis
cucggccucgucgacgucgggg

SEQ ID NO: 903691 - RNA, 22 nt, Mycobacterium avium subsp. paratuberculosis
cucggccucccgguaggcggcg

SEQ ID NO: 903692 - RNA, 23 nt, Mycobacterium avium subsp. paratuberculosis
cucggccuccgcgcgcggcccgu

SEQ ID NO: 903693 - RNA, 14 nt, Mycobacterium avium subsp. paratuberculosis
cucggccgccgaca

SEQ ID NO: 903694 - RNA, 18 nt, Mycobacterium avium subsp. paratuberculosis
cucggccguggccgucac

SEQ ID NO: 903695 - RNA, 17 nt, Mycobacterium avium subsp. paratuberculosis
cucggccguaccggcgu

SEQ ID NO: 903696 - RNA, 17 nt, Mycobacterium avium subsp. paratuberculosis
cucuugcgugcgggucg

SEQ ID NO: 903697 - RNA, 22 nt, Mycobacterium avium subsp. paratuberculosis
cugaaccagcucgugcagcugu

SEQ ID NO: 903698 - RNA, 23 nt, Mycobacterium avium subsp. paratuberculosis
cugaaccgguagucgucgagguu

SEQ ID NO: 903699 - RNA, 22 nt, Mycobacterium avium subsp. paratuberculosis
cucugacggcucuucggcgccg

SEQ ID NO: 903700 - RNA, 23 nt, Mycobacterium avium subsp. paratuberculosis
cucugacggcucuucggcgccga

SEQ ID NO: 903701 - RNA, 15 nt, Mycobacterium avium subsp. paratuberculosis
cucugccacggcgga

SEQ ID NO: 903702 - RNA, 12 nt, Mycobacterium avium subsp. paratuberculosis
cucugcgcgcca

SEQ ID NO: 903703 - RNA, 23 nt, Mycobacterium avium subsp. paratuberculosis
cucugcacucagagcagcgccug

SEQ ID NO: 903704 - RNA, 15 nt, Mycobacterium avium subsp. paratuberculosis
cucugccgggccgca

SEQ ID NO: 903705 - RNA, 14 nt, Mycobacterium avium subsp. paratuberculosis
cugaauucggccac

SEQ ID NO: 903706 - RNA, 16 nt, Mycobacterium avium subsp. paratuberculosis
cugaauuccuggccgg

SEQ ID NO: 903707 - RNA, 18 nt, Mycobacterium avium subsp. paratuberculosis
cugaaucccuccggcagg

SEQ ID NO: 903708 - RNA, 17 nt, Mycobacterium avium subsp. paratuberculosis
cugacacagcaccggcg

SEQ ID NO: 903709 - RNA, 20 nt, Mycobacterium avium subsp. paratuberculosis
cugacacagcaccggcgucg

SEQ ID NO: 903710 - RNA, 21 nt, Mycobacterium avium subsp. paratuberculosis
cugacacagcaccggcgucga

SEQ ID NO: 903711 - RNA, 22 nt, Mycobacterium avium subsp. paratuberculosis
cugacacagcaccggcgucgac

SEQ ID NO: 903712 - RNA, 21 nt, Mycobacterium avium subsp. paratuberculosis
cugaagguuguucugcucgaa

SEQ ID NO: 903713 - RNA, 16 nt, Mycobacterium avium subsp. paratuberculosis
cugaagaagcggccgu

SEQ ID NO: 903714 - RNA, 22 nt, Mycobacterium avium subsp. paratuberculosis
cugaaguucaccaccgcgcugc

SEQ ID NO: 903715 - RNA, 20 nt, Mycobacterium avium subsp. paratuberculosis
cugaacgccugccggcgccg

SEQ ID NO: 903716 - RNA, 16 nt, Mycobacterium avium subsp. paratuberculosis
cugaacgcgauccagg

SEQ ID NO: 903717 - RNA, 22 nt, Mycobacterium avium subsp. paratuberculosis
cugaacgcggugggcaccagca

SEQ ID NO: 903718 - RNA, 16 nt, Mycobacterium avium subsp. paratuberculosis
cugaacgccagcagcc

SEQ ID NO: 903719 - RNA, 18 nt, Mycobacterium avium subsp. paratuberculosis
cugaaccugcugggcggc

SEQ ID NO: 903720 - RNA, 22 nt, Mycobacterium avium subsp. paratuberculosis
cgugacgugccccucgacccga

SEQ ID NO: 903721 - RNA, 16 nt, Mycobacterium avium subsp. paratuberculosis
cgugacguucgucagc

SEQ ID NO: 903722 - RNA, 16 nt, Mycobacterium avium subsp. paratuberculosis
cgugaccugcugggcg

SEQ ID NO: 903723 - RNA, 21 nt, Mycobacterium avium subsp. paratuberculosis
cgugaccugcugggcgggcag

SEQ ID NO: 903724 - RNA, 12 nt, Mycobacterium avium subsp. paratuberculosis
cgugacgaccug

SEQ ID NO: 903725 - RNA, 14 nt, Mycobacterium avium subsp. paratuberculosis
cgugacgaccuggu

SEQ ID NO: 903726 - RNA, 22 nt, Mycobacterium avium subsp. paratuberculosis
cgugacgaccuggucgccgccg

SEQ ID NO: 903727 - RNA, 15 nt, Mycobacterium avium subsp. paratuberculosis
cgugacgcccggcgc

SEQ ID NO: 903728 - RNA, 17 nt, Mycobacterium avium subsp. paratuberculosis
cgugacgcccggcgccg

SEQ ID NO: 903729 - RNA, 16 nt, Mycobacterium avium subsp. paratuberculosis
cgugacgccgauccgc

SEQ ID NO: 903730 - RNA, 20 nt, Mycobacterium avium subsp. paratuberculosis
cgugacgccgauccgcugcg

SEQ ID NO: 903731 - RNA, 21 nt, Mycobacterium avium subsp. paratuberculosis
cgugacgccgauccgcugcgg

SEQ ID NO: 903732 - RNA, 18 nt, Mycobacterium avium subsp. paratuberculosis
cgugacgccgcugcgugc

SEQ ID NO: 903733 - RNA, 14 nt, Mycobacterium avium subsp. paratuberculosis
cgugacgccgggcc

SEQ ID NO: 903734 - RNA, 14 nt, Mycobacterium avium subsp. paratuberculosis
cgugacgucgacgu

SEQ ID NO: 903735 - RNA, 15 nt, Mycobacterium avium subsp. paratuberculosis
cgugaccggcggugc

SEQ ID NO: 903736 - RNA, 17 nt, Mycobacterium avium subsp. paratuberculosis
cgugacccugccgucac

SEQ ID NO: 903737 - RNA, 22 nt, Mycobacterium avium subsp. paratuberculosis
cgugacccugccgucaccggcc

SEQ ID NO: 903738 - RNA, 22 nt, Mycobacterium avium subsp. paratuberculosis
cgugaccgaccuccaaugcgcc

SEQ ID NO: 903739 - RNA, 15 nt, Mycobacterium avium subsp. paratuberculosis
cgugcaacucccgcg

SEQ ID NO: 903740 - RNA, 16 nt, Mycobacterium avium subsp. paratuberculosis
cgugcaacucccgcgc

SEQ ID NO: 903741 - RNA, 19 nt, Mycobacterium avium subsp. paratuberculosis
cgugcaacucccgcgccgc

SEQ ID NO: 903742 - RNA, 20 nt, Mycobacterium avium subsp. paratuberculosis
cgugcaaaccggaccgccgc

SEQ ID NO: 903743 - RNA, 14 nt, Mycobacterium avium subsp. paratuberculosis
cgugcacaccggcc

SEQ ID NO: 903744 - RNA, 13 nt, Mycobacterium avium subsp. paratuberculosis
cgugcaaggccug

SEQ ID NO: 903745 - RNA, 17 nt, Mycobacterium avium subsp. paratuberculosis
cgugauggcgaaccagc

SEQ ID NO: 903746 - RNA, 20 nt, Mycobacterium avium subsp. paratuberculosis
cgugauggcgaaccagcgcc

SEQ ID NO: 903747 - RNA, 18 nt, Mycobacterium avium subsp. paratuberculosis
cgugaugggugggcagcu

SEQ ID NO: 903748 - RNA, 23 nt, Mycobacterium avium subsp. paratuberculosis
cgugaugguccagcaccggcgcc

SEQ ID NO: 903749 - RNA, 15 nt, Mycobacterium avium subsp. paratuberculosis
cgugauggucgucgu

SEQ ID NO: 903750 - RNA, 19 nt, Mycobacterium avium subsp. paratuberculosis
cgugauguacagcgacagc

SEQ ID NO: 903751 - RNA, 23 nt, Mycobacterium avium subsp. paratuberculosis
cgugauguacagcgacagcagcg

SEQ ID NO: 903752 - RNA, 22 nt, Mycobacterium avium subsp. paratuberculosis
cgugagcgguggccacgcccca

SEQ ID NO: 903753 - RNA, 17 nt, Mycobacterium avium subsp. paratuberculosis
cgugagauccagcagcc

SEQ ID NO: 903754 - RNA, 23 nt, Mycobacterium avium subsp. paratuberculosis
cgugccaagcguauccggccagc

SEQ ID NO: 903755 - RNA, 24 nt, Mycobacterium avium subsp. paratuberculosis
cgugccaagcguauccggccagcc

SEQ ID NO: 903756 - RNA, 23 nt, Mycobacterium avium subsp. paratuberculosis
cgugccacagcaugaagaucagc

SEQ ID NO: 903757 - RNA, 15 nt, Mycobacterium avium subsp. paratuberculosis
cgugccacaggccga

SEQ ID NO: 903758 - RNA, 17 nt, Mycobacterium avium subsp. paratuberculosis
cgugccacaggccgaac

SEQ ID NO: 903759 - RNA, 14 nt, Mycobacterium avium subsp. paratuberculosis
cgugccaccgcugg

SEQ ID NO: 903760 - RNA, 17 nt, Mycobacterium avium subsp. paratuberculosis
cgugccaccgcugggcg

SEQ ID NO: 903761 - RNA, 20 nt, Mycobacterium avium subsp. paratuberculosis
cgugccaccgcugggcggcg

SEQ ID NO: 903762 - RNA, 16 nt, Mycobacterium avium subsp. paratuberculosis
cgugccacggccgcgg

SEQ ID NO: 903763 - RNA, 21 nt, Mycobacterium avium subsp. paratuberculosis
cgugccacggccgcggcccgg

SEQ ID NO: 903764 - RNA, 22 nt, Mycobacterium avium subsp. paratuberculosis
cgugccaaccacuugaagccgg

SEQ ID NO: 903765 - RNA, 17 nt, Mycobacterium avium subsp. paratuberculosis
cgugcauguagguggcg

SEQ ID NO: 903766 - RNA, 21 nt, Mycobacterium avium subsp. paratuberculosis
cgugcauguagguggcgacca

SEQ ID NO: 903767 - RNA, 17 nt, Mycobacterium avium subsp. paratuberculosis
cgugcaugugcucggcg

SEQ ID NO: 903768 - RNA, 19 nt, Mycobacterium avium subsp. paratuberculosis
cgugcauucaggucaccgc

SEQ ID NO: 903769 - RNA, 23 nt, Mycobacterium avium subsp. paratuberculosis
cgugcauucaggucaccgcgcga

SEQ ID NO: 903770 - RNA, 19 nt, Mycobacterium avium subsp. paratuberculosis
cgugcauucagugcgagaa

SEQ ID NO: 903771 - RNA, 18 nt, Mycobacterium avium subsp. paratuberculosis
cgugcauagcuggcgccg

SEQ ID NO: 903772 - RNA, 21 nt, Mycobacterium avium subsp. paratuberculosis
cgugcauagcuggcgccgaac

SEQ ID NO: 903773 - RNA, 17 nt, Mycobacterium avium subsp. paratuberculosis
cgugccacuggcgccac

SEQ ID NO: 903774 - RNA, 18 nt, Mycobacterium avium subsp. paratuberculosis
cgugccacuggcgccacc

SEQ ID NO: 903775 - RNA, 16 nt, Mycobacterium avium subsp. paratuberculosis
cgugccaucgcuggug

SEQ ID NO: 903776 - RNA, 20 nt, Mycobacterium avium subsp. paratuberculosis
cgugccagggcagcgcgacc

SEQ ID NO: 903777 - RNA, 23 nt, Mycobacterium avium subsp. paratuberculosis
cgugccagggcagcgcgaccagc

SEQ ID NO: 903778 - RNA, 22 nt, Mycobacterium avium subsp. paratuberculosis
cgugcccaacacgccccgacag

SEQ ID NO: 903779 - RNA, 17 nt, Mycobacterium avium subsp. paratuberculosis
cgugcccaccagccggc

SEQ ID NO: 903780 - RNA, 19 nt, Mycobacterium avium subsp. paratuberculosis
cgugcccaccagccggccg

SEQ ID NO: 903781 - RNA, 20 nt, Mycobacterium avium subsp. paratuberculosis
cgugcccaccagccggccgg

SEQ ID NO: 903782 - RNA, 14 nt, Mycobacterium avium subsp. paratuberculosis
cgugcccagcccgc

SEQ ID NO: 903783 - RNA, 15 nt, Mycobacterium avium subsp. paratuberculosis
cgugcccagcccgcg

SEQ ID NO: 903784 - RNA, 18 nt, Mycobacterium avium subsp. paratuberculosis
cgugccccaggucggggu

SEQ ID NO: 903785 - RNA, 22 nt, Mycobacterium avium subsp. paratuberculosis
cgugccccaggucggggugggc

SEQ ID NO: 903786 - RNA, 23 nt, Mycobacterium avium subsp. paratuberculosis
cgugcaccaccgcguugaucagc

SEQ ID NO: 903787 - RNA, 12 nt, Mycobacterium avium subsp. paratuberculosis
cgugcaccacga

SEQ ID NO: 903788 - RNA, 16 nt, Mycobacterium avium subsp. paratuberculosis
cgugcacaggccgccg

SEQ ID NO: 903789 - RNA, 17 nt, Mycobacterium avium subsp. paratuberculosis
cgugcacaugcccgucg

SEQ ID NO: 903790 - RNA, 20 nt, Mycobacterium avium subsp. paratuberculosis
cgugcacaugcccgucgggc

SEQ ID NO: 903791 - RNA, 22 nt, Mycobacterium avium subsp. paratuberculosis
cgugcacaugcccgucgggcgg

SEQ ID NO: 903792 - RNA, 16 nt, Mycobacterium avium subsp. paratuberculosis
cgugcacccacgccag

SEQ ID NO: 903793 - RNA, 22 nt, Mycobacterium avium subsp. paratuberculosis
cgugcacccacgccagccgggu

SEQ ID NO: 903794 - RNA, 12 nt, Mycobacterium avium subsp. paratuberculosis
cgugcaccgccc

SEQ ID NO: 903795 - RNA, 15 nt, Mycobacterium avium subsp. paratuberculosis
cgugcaccgcccgcg

SEQ ID NO: 903796 - RNA, 16 nt, Mycobacterium avium subsp. paratuberculosis
cgugcaccgcccgcgc

SEQ ID NO: 903797 - RNA, 15 nt, Mycobacterium avium subsp. paratuberculosis
cgugcaccgcggcca

SEQ ID NO: 903798 - RNA, 16 nt, Mycobacterium avium subsp. paratuberculosis
cgugcaccgcggccaa

SEQ ID NO: 903799 - RNA, 17 nt, Mycobacterium avium subsp. paratuberculosis
cgugcaccggcgagucc

SEQ ID NO: 903800 - RNA, 16 nt, Mycobacterium avium subsp. paratuberculosis
cgugcaccgucgccgg

SEQ ID NO: 903801 - RNA, 20 nt, Mycobacterium avium subsp. paratuberculosis
cgugcaccugugaggcaccg

SEQ ID NO: 903802 - RNA, 22 nt, Mycobacterium avium subsp. paratuberculosis
cgugcaccugugaggcaccgaa

SEQ ID NO: 903803 - RNA, 20 nt, Mycobacterium avium subsp. paratuberculosis
cgugcaccuuggucagcucc

SEQ ID NO: 903804 - RNA, 16 nt, Mycobacterium avium subsp. paratuberculosis
cgugcaucggcgccug

SEQ ID NO: 903805 - RNA, 18 nt, Mycobacterium avium subsp. paratuberculosis
cgugcaucgggcgcucgg

SEQ ID NO: 903806 - RNA, 19 nt, Mycobacterium avium subsp. paratuberculosis
cgugcaucgggcgcucggc

SEQ ID NO: 903807 - RNA, 20 nt, Mycobacterium avium subsp. paratuberculosis
cgugcacgaucgcggugacg

SEQ ID NO: 903808 - RNA, 19 nt, Mycobacterium avium subsp. paratuberculosis
cgugcacggcgccgugccg

SEQ ID NO: 903809 - RNA, 23 nt, Mycobacterium avium subsp. paratuberculosis
cgugcacgugcaggugcggcacc

SEQ ID NO: 903810 - RNA, 16 nt, Mycobacterium avium subsp. paratuberculosis
cgugcacucagggcga

SEQ ID NO: 903811 - RNA, 17 nt, Mycobacterium avium subsp. paratuberculosis
cgugcagaacagcacga

SEQ ID NO: 903812 - RNA, 18 nt, Mycobacterium avium subsp. paratuberculosis
cgugcagaacagcacgag

SEQ ID NO: 903813 - RNA, 17 nt, Mycobacterium avium subsp. paratuberculosis
cgugcacgccgucgugc

SEQ ID NO: 903814 - RNA, 21 nt, Mycobacterium avium subsp. paratuberculosis
cgugcacgccguggcggcggg

SEQ ID NO: 903815 - RNA, 22 nt, Mycobacterium avium subsp. paratuberculosis
cgugcacgccguggcggcgggc

SEQ ID NO: 903816 - RNA, 14 nt, Mycobacterium avium subsp. paratuberculosis
cgugcacgaacgcg

SEQ ID NO: 903817 - RNA, 18 nt, Mycobacterium avium subsp. paratuberculosis
cgugcacgaacgcggcca

SEQ ID NO: 903818 - RNA, 14 nt, Mycobacterium avium subsp. paratuberculosis
cgugcacgaucgcg

SEQ ID NO: 903819 - RNA, 17 nt, Mycobacterium avium subsp. paratuberculosis
cgugcaccugcagccgg

SEQ ID NO: 903820 - RNA, 16 nt, Mycobacterium avium subsp. paratuberculosis
cgugcacgaucgcggu

SEQ ID NO: 903821 - RNA, 17 nt, Mycobacterium avium subsp. paratuberculosis
cgugcccgaucucgucg

SEQ ID NO: 903822 - RNA, 20 nt, Mycobacterium avium subsp. paratuberculosis
cgugcccgaucucgucggug

SEQ ID NO: 903823 - RNA, 13 nt, Mycobacterium avium subsp. paratuberculosis
cgugcccgccgug

SEQ ID NO: 903824 - RNA, 14 nt, Mycobacterium avium subsp. paratuberculosis
cgugcccgccgugc

SEQ ID NO: 903825 - RNA, 15 nt, Mycobacterium avium subsp. paratuberculosis
cgugcccgcgcccac

SEQ ID NO: 903826 - RNA, 23 nt, Mycobacterium avium subsp. paratuberculosis
cgugcccgcgcccaccuggaggc

SEQ ID NO: 903827 - RNA, 13 nt, Mycobacterium avium subsp. paratuberculosis
cgugcccgcggga

SEQ ID NO: 903828 - RNA, 23 nt, Mycobacterium avium subsp. paratuberculosis
cgugcccgcgggacacggcggcg

SEQ ID NO: 903829 - RNA, 15 nt, Mycobacterium avium subsp. paratuberculosis
cgugccccuccucgg

SEQ ID NO: 903830 - RNA, 20 nt, Mycobacterium avium subsp. paratuberculosis
cgugccccucgacccgaagc

SEQ ID NO: 903831 - RNA, 16 nt, Mycobacterium avium subsp. paratuberculosis
cgugcccuuccccggc

SEQ ID NO: 903832 - RNA, 20 nt, Mycobacterium avium subsp. paratuberculosis
cgugcccuuccccggcggcc

SEQ ID NO: 903833 - RNA, 21 nt, Mycobacterium avium subsp. paratuberculosis
cgugcccuuccccggcggccg

SEQ ID NO: 903834 - RNA, 22 nt, Mycobacterium avium subsp. paratuberculosis
cgugcccuuccccggcggccgg

SEQ ID NO: 903835 - RNA, 23 nt, Mycobacterium avium subsp. paratuberculosis
cgugcccuuccccggcggccggc

SEQ ID NO: 903836 - RNA, 12 nt, Mycobacterium avium subsp. paratuberculosis
cgugcccgggcc

SEQ ID NO: 903837 - RNA, 14 nt, Mycobacterium avium subsp. paratuberculosis
cgugcccgggcccg

SEQ ID NO: 903838 - RNA, 14 nt, Mycobacterium avium subsp. paratuberculosis
cgugcccggccagc

SEQ ID NO: 903839 - RNA, 13 nt, Mycobacterium avium subsp. paratuberculosis
cgugcccggcgcc

SEQ ID NO: 903840 - RNA, 17 nt, Mycobacterium avium subsp. paratuberculosis
cgugcccggcgcccugc

SEQ ID NO: 903841 - RNA, 14 nt, Mycobacterium avium subsp. paratuberculosis
cgugcccggcgccg

SEQ ID NO: 903842 - RNA, 17 nt, Mycobacterium avium subsp. paratuberculosis
cgugcccggcgccgacc

SEQ ID NO: 903843 - RNA, 13 nt, Mycobacterium avium subsp. paratuberculosis
cgugccgcacccg

SEQ ID NO: 903844 - RNA, 17 nt, Mycobacterium avium subsp. paratuberculosis
cgugccgcaccugguug

SEQ ID NO: 903845 - RNA, 16 nt, Mycobacterium avium subsp. paratuberculosis
cgugccgaugccggcc

SEQ ID NO: 903846 - RNA, 20 nt, Mycobacterium avium subsp. paratuberculosis
cgugccgauggccaccgggc

SEQ ID NO: 903847 - RNA, 15 nt, Mycobacterium avium subsp. paratuberculosis
cgugcgccagcgacc

SEQ ID NO: 903848 - RNA, 12 nt, Mycobacterium avium subsp. paratuberculosis
cgugcgccggcg

SEQ ID NO: 903849 - RNA, 17 nt, Mycobacterium avium subsp. paratuberculosis
cgugcgccggcggugcg

SEQ ID NO: 903850 - RNA, 22 nt, Mycobacterium avium subsp. paratuberculosis
cgugcgccggcggugcggcggg

SEQ ID NO: 903851 - RNA, 13 nt, Mycobacterium avium subsp. paratuberculosis
cgugcgcgccgac

SEQ ID NO: 903852 - RNA, 17 nt, Mycobacterium avium subsp. paratuberculosis
cgugcgcgccgaccgcg

SEQ ID NO: 903853 - RNA, 18 nt, Mycobacterium avium subsp. paratuberculosis
cgugcgcgccgaccgcga

SEQ ID NO: 903854 - RNA, 20 nt, Mycobacterium avium subsp. paratuberculosis
cgugcgccaguuugccgucg

SEQ ID NO: 903855 - RNA, 15 nt, Mycobacterium avium subsp. paratuberculosis
cgugcgccgcccaca

SEQ ID NO: 903856 - RNA, 11 nt, Mycobacterium avium subsp. paratuberculosis
cgugcgccgcg

SEQ ID NO: 903857 - RNA, 17 nt, Mycobacterium avium subsp. paratuberculosis
cgugcgccgcggcggcu

SEQ ID NO: 903858 - RNA, 14 nt, Mycobacterium avium subsp. paratuberculosis
cgugcgcccgacgc

SEQ ID NO: 903859 - RNA, 15 nt, Mycobacterium avium subsp. paratuberculosis
cgugcgcccgacgcc

SEQ ID NO: 903860 - RNA, 17 nt, Mycobacterium avium subsp. paratuberculosis
cgugcgcccgacgccgg

SEQ ID NO: 903861 - RNA, 21 nt, Mycobacterium avium subsp. paratuberculosis
cgugcgcccgacgccggaccc

SEQ ID NO: 903862 - RNA, 13 nt, Mycobacterium avium subsp. paratuberculosis
cgugcgcggcgac

SEQ ID NO: 903863 - RNA, 16 nt, Mycobacterium avium subsp. paratuberculosis
cgugcgcggcgcgcga

SEQ ID NO: 903864 - RNA, 13 nt, Mycobacterium avium subsp. paratuberculosis
cgugcgcggcguc

SEQ ID NO: 903865 - RNA, 18 nt, Mycobacterium avium subsp. paratuberculosis
cgugcgcggcuggccguc

SEQ ID NO: 903866 - RNA, 19 nt, Mycobacterium avium subsp. paratuberculosis
cgugcgcggcuggccgucg

SEQ ID NO: 903867 - RNA, 20 nt, Mycobacterium avium subsp. paratuberculosis
cgugcgcgggaacgaucggc

SEQ ID NO: 903868 - RNA, 14 nt, Mycobacterium avium subsp. paratuberculosis
cgugcgcguggggc

SEQ ID NO: 903869 - RNA, 21 nt, Mycobacterium avium subsp. paratuberculosis
cgugcgcguggggcgucgccg

SEQ ID NO: 903870 - RNA, 24 nt, Mycobacterium avium subsp. paratuberculosis
cgugcgcccauccggcgccgcgca

SEQ ID NO: 903871 - RNA, 17 nt, Mycobacterium avium subsp. paratuberculosis
cgugcggauggccccgg

SEQ ID NO: 903872 - RNA, 14 nt, Mycobacterium avium subsp. paratuberculosis
cgugcggcacgccg

SEQ ID NO: 903873 - RNA, 13 nt, Mycobacterium avium subsp. paratuberculosis
cgugcggccggcg

SEQ ID NO: 903874 - RNA, 15 nt, Mycobacterium avium subsp. paratuberculosis
cgugcggccggcgcc

SEQ ID NO: 903875 - RNA, 11 nt, Mycobacterium avium subsp. paratuberculosis
cgugcggccuc

SEQ ID NO: 903876 - RNA, 12 nt, Mycobacterium avium subsp. paratuberculosis
cgugcggccucg

SEQ ID NO: 903877 - RNA, 12 nt, Mycobacterium avium subsp. paratuberculosis
cgugcggccgca

SEQ ID NO: 903878 - RNA, 20 nt, Mycobacterium avium subsp. paratuberculosis
cgugcucugccuacuugcgg

SEQ ID NO: 903879 - RNA, 23 nt, Mycobacterium avium subsp. paratuberculosis
cgugcucugccuacuugcggccg

SEQ ID NO: 903880 - RNA, 22 nt, Mycobacterium avium subsp. paratuberculosis
cgugcugacgucgucgcccacc

SEQ ID NO: 903881 - RNA, 20 nt, Mycobacterium avium subsp. paratuberculosis
cgugcugauccacgcccgga

SEQ ID NO: 903882 - RNA, 18 nt, Mycobacterium avium subsp. paratuberculosis
cgugcugggcggacggga

SEQ ID NO: 903883 - RNA, 20 nt, Mycobacterium avium subsp. paratuberculosis
cguggaacgcgucgcgccag

SEQ ID NO: 903884 - RNA, 21 nt, Mycobacterium avium subsp. paratuberculosis
cgugcugggccacgauccgcg

SEQ ID NO: 903885 - RNA, 22 nt, Mycobacterium avium subsp. paratuberculosis
cgugcugggccacgauccgcgc

SEQ ID NO: 903886 - RNA, 13 nt, Mycobacterium avium subsp. paratuberculosis
cgugcugggccgg

SEQ ID NO: 903887 - RNA, 15 nt, Mycobacterium avium subsp. paratuberculosis
cgugcugggacagcg

SEQ ID NO: 903888 - RNA, 13 nt, Mycobacterium avium subsp. paratuberculosis
cgugcugggcacc

SEQ ID NO: 903889 - RNA, 17 nt, Mycobacterium avium subsp. paratuberculosis
cgugcugggcaccgucg

SEQ ID NO: 903890 - RNA, 14 nt, Mycobacterium avium subsp. paratuberculosis
cgugcuggccacca

SEQ ID NO: 903891 - RNA, 17 nt, Mycobacterium avium subsp. paratuberculosis
cgugcuggccaccacgg

SEQ ID NO: 903892 - RNA, 16 nt, Mycobacterium avium subsp. paratuberculosis
cgugcuggccaucgcg

SEQ ID NO: 903893 - RNA, 14 nt, Mycobacterium avium subsp. paratuberculosis
cgugcuggccgggu

SEQ ID NO: 903894 - RNA, 13 nt, Mycobacterium avium subsp. paratuberculosis
cgugcugccggcc

SEQ ID NO: 903895 - RNA, 23 nt, Mycobacterium avium subsp. paratuberculosis
cguggacgucguuuuccagccgg

SEQ ID NO: 903896 - RNA, 14 nt, Mycobacterium avium subsp. paratuberculosis
cguggauggccggc

SEQ ID NO: 903897 - RNA, 15 nt, Mycobacterium avium subsp. paratuberculosis
cguggauggccggcc

SEQ ID NO: 903898 - RNA, 17 nt, Mycobacterium avium subsp. paratuberculosis
cguggauguugucgugg

SEQ ID NO: 903899 - RNA, 16 nt, Mycobacterium avium subsp. paratuberculosis
cguggacgcgcgcggc

SEQ ID NO: 903900 - RNA, 19 nt, Mycobacterium avium subsp. paratuberculosis
cguggaagauguugccgcc

SEQ ID NO: 903901 - RNA, 14 nt, Mycobacterium avium subsp. paratuberculosis
cguggacaccgcac

SEQ ID NO: 903902 - RNA, 17 nt, Mycobacterium avium subsp. paratuberculosis
cguggacaccgcaccca

SEQ ID NO: 903903 - RNA, 19 nt, Mycobacterium avium subsp. paratuberculosis
cguggacaccgcacccaga

SEQ ID NO: 903904 - RNA, 18 nt, Mycobacterium avium subsp. paratuberculosis
cguggaagucgccguccg

SEQ ID NO: 903905 - RNA, 17 nt, Mycobacterium avium subsp. paratuberculosis
cguggacccgccccgac

SEQ ID NO: 903906 - RNA, 17 nt, Mycobacterium avium subsp. paratuberculosis
cguggacgaacgcggcg

SEQ ID NO: 903907 - RNA, 22 nt, Mycobacterium avium subsp. paratuberculosis
cguggacgaacgcggcgaacac

SEQ ID NO: 903908 - RNA, 17 nt, Mycobacterium avium subsp. paratuberculosis
cgucguuuuccagccgg

SEQ ID NO: 903909 - RNA, 16 nt, Mycobacterium avium subsp. paratuberculosis
cgucucgacggcgccg

SEQ ID NO: 903910 - RNA, 14 nt, Mycobacterium avium subsp. paratuberculosis
cgucuagcggcgug

SEQ ID NO: 903911 - RNA, 13 nt, Mycobacterium avium subsp. paratuberculosis
cgucucgaugagc

SEQ ID NO: 903912 - RNA, 14 nt, Mycobacterium avium subsp. paratuberculosis
cgucgugccagcgc

SEQ ID NO: 903913 - RNA, 15 nt, Mycobacterium avium subsp. paratuberculosis
cgucgugccagcgca

SEQ ID NO: 903914 - RNA, 14 nt, Mycobacterium avium subsp. paratuberculosis
cgucguugcgggcg

SEQ ID NO: 903915 - RNA, 18 nt, Mycobacterium avium subsp. paratuberculosis
cgucguugcgggcggcgc

SEQ ID NO: 903916 - RNA, 21 nt, Mycobacterium avium subsp. paratuberculosis
cgucguugcgggcggcgcggc

SEQ ID NO: 903917 - RNA, 15 nt, Mycobacterium avium subsp. paratuberculosis
cgucguuggcgcuca

SEQ ID NO: 903918 - RNA, 18 nt, Mycobacterium avium subsp. paratuberculosis
cgucguuggcgcucaacg

SEQ ID NO: 903919 - RNA, 19 nt, Mycobacterium avium subsp. paratuberculosis
cgucguuguugcgcgggaa

SEQ ID NO: 903920 - RNA, 16 nt, Mycobacterium avium subsp. paratuberculosis
cgucguugucgucgcc

SEQ ID NO: 903921 - RNA, 15 nt, Mycobacterium avium subsp. paratuberculosis
cgucguugugggcca

SEQ ID NO: 903922 - RNA, 19 nt, Mycobacterium avium subsp. paratuberculosis
cgucguugugggccagcgc

SEQ ID NO: 903923 - RNA, 20 nt, Mycobacterium avium subsp. paratuberculosis
cgucguugugggccagcgcg

SEQ ID NO: 903924 - RNA, 21 nt, Mycobacterium avium subsp. paratuberculosis
cgucguugugggccagcgcgg

SEQ ID NO: 903925 - RNA, 15 nt, Mycobacterium avium subsp. paratuberculosis
cgucgugcggccggc

SEQ ID NO: 903926 - RNA, 14 nt, Mycobacterium avium subsp. paratuberculosis
cgucgugcucgagc

SEQ ID NO: 903927 - RNA, 14 nt, Mycobacterium avium subsp. paratuberculosis
cgucgugcucggcg

SEQ ID NO: 903928 - RNA, 15 nt, Mycobacterium avium subsp. paratuberculosis
cgucgugcucggcga

SEQ ID NO: 903929 - RNA, 16 nt, Mycobacterium avium subsp. paratuberculosis
cgucgugcucggcgag

SEQ ID NO: 903930 - RNA, 15 nt, Mycobacterium avium subsp. paratuberculosis
cgucgugccgagcgu

SEQ ID NO: 903931 - RNA, 15 nt, Mycobacterium avium subsp. paratuberculosis
cgucgugcacgccgu

SEQ ID NO: 903932 - RNA, 22 nt, Mycobacterium avium subsp. paratuberculosis
cgucgugcacgccguggcggcg

SEQ ID NO: 903933 - RNA, 22 nt, Mycobacterium avium subsp. paratuberculosis
cgucgugauggcgaaccagcgc

SEQ ID NO: 903934 - RNA, 21 nt, Mycobacterium avium subsp. paratuberculosis
cgucgugcaacucccgcgccg

SEQ ID NO: 903935 - RNA, 12 nt, Mycobacterium avium subsp. paratuberculosis
cgucgugcacca

SEQ ID NO: 903936 - RNA, 22 nt, Mycobacterium avium subsp. paratuberculosis
cgucgugcaccacgacgucgag

SEQ ID NO: 903937 - RNA, 15 nt, Mycobacterium avium subsp. paratuberculosis
cgucgucgucggccg

SEQ ID NO: 903938 - RNA, 18 nt, Mycobacterium avium subsp. paratuberculosis
cgucgucgucggccgggc

SEQ ID NO: 903939 - RNA, 15 nt, Mycobacterium avium subsp. paratuberculosis
cgucgucgugcacca

SEQ ID NO: 903940 - RNA, 18 nt, Mycobacterium avium subsp. paratuberculosis
cgucgucgugcaccacga

SEQ ID NO: 903941 - RNA, 13 nt, Mycobacterium avium subsp. paratuberculosis
cgucgugaccgac

SEQ ID NO: 903942 - RNA, 12 nt, Mycobacterium avium subsp. paratuberculosis
cgucgucgucga

SEQ ID NO: 903943 - RNA, 13 nt, Mycobacterium avium subsp. paratuberculosis
cgucgucgucgac

SEQ ID NO: 903944 - RNA, 15 nt, Mycobacterium avium subsp. paratuberculosis
cgucgucgucgaccg

SEQ ID NO: 903945 - RNA, 14 nt, Mycobacterium avium subsp. paratuberculosis
cgucgucgucgaga

SEQ ID NO: 903946 - RNA, 14 nt, Mycobacterium avium subsp. paratuberculosis
cgucgucgucgagc

SEQ ID NO: 903947 - RNA, 15 nt, Mycobacterium avium subsp. paratuberculosis
cgucgucgucgagca

SEQ ID NO: 903948 - RNA, 17 nt, Mycobacterium avium subsp. paratuberculosis
cgucgucgucgagccgc

SEQ ID NO: 903949 - RNA, 14 nt, Mycobacterium avium subsp. paratuberculosis
cgucgucguuggcc

SEQ ID NO: 903950 - RNA, 18 nt, Mycobacterium avium subsp. paratuberculosis
cgucgucguuggcccgcc

SEQ ID NO: 903951 - RNA, 19 nt, Mycobacterium avium subsp. paratuberculosis
cgucgucguuggcccgccg

SEQ ID NO: 903952 - RNA, 22 nt, Mycobacterium avium subsp. paratuberculosis
cgucgucguuggcccgccgcgg

SEQ ID NO: 903953 - RNA, 20 nt, Mycobacterium avium subsp. paratuberculosis
cgucgucguuguuggcggcg

SEQ ID NO: 903954 - RNA, 21 nt, Mycobacterium avium subsp. paratuberculosis
cgucgucguuguuggcggcgg

SEQ ID NO: 903955 - RNA, 15 nt, Mycobacterium avium subsp. paratuberculosis
cgucuuccgggccac

SEQ ID NO: 903956 - RNA, 12 nt, Mycobacterium avium subsp. paratuberculosis
cgucuucgaccg

SEQ ID NO: 903957 - RNA, 14 nt, Mycobacterium avium subsp. paratuberculosis
cgugaauucggccg

SEQ ID NO: 903958 - RNA, 15 nt, Mycobacterium avium subsp. paratuberculosis
cgugacaagccggcg

SEQ ID NO: 903959 - RNA, 16 nt, Mycobacterium avium subsp. paratuberculosis
cgugacaagccggcgu

SEQ ID NO: 903960 - RNA, 18 nt, Mycobacterium avium subsp. paratuberculosis
cgugacaagccggcgucg

SEQ ID NO: 903961 - RNA, 19 nt, Mycobacterium avium subsp. paratuberculosis
cgugacaagccggcgucga

SEQ ID NO: 903962 - RNA, 21 nt, Mycobacterium avium subsp. paratuberculosis
cgugacacucggucaccggug

SEQ ID NO: 903963 - RNA, 16 nt, Mycobacterium avium subsp. paratuberculosis
cgugacaggguaaccc

SEQ ID NO: 903964 - RNA, 14 nt, Mycobacterium avium subsp. paratuberculosis
cgugacagucgacc

SEQ ID NO: 903965 - RNA, 19 nt, Mycobacterium avium subsp. paratuberculosis
cgugaccaaugcggugaac

SEQ ID NO: 903966 - RNA, 13 nt, Mycobacterium avium subsp. paratuberculosis
cgugaccaccgug

SEQ ID NO: 903967 - RNA, 14 nt, Mycobacterium avium subsp. paratuberculosis
cgugaccaccgugc

SEQ ID NO: 903968 - RNA, 15 nt, Mycobacterium avium subsp. paratuberculosis
cgugacccgccguga

SEQ ID NO: 903969 - RNA, 17 nt, Mycobacterium avium subsp. paratuberculosis
cgugacccgccgugacc

SEQ ID NO: 903970 - RNA, 18 nt, Mycobacterium avium subsp. paratuberculosis
cgugacccgccgugaccg

SEQ ID NO: 903971 - RNA, 20 nt, Mycobacterium avium subsp. paratuberculosis
cgucugguuggccggcgggu

SEQ ID NO: 903972 - RNA, 13 nt, Mycobacterium avium subsp. paratuberculosis
cgucucggccagc

SEQ ID NO: 903973 - RNA, 16 nt, Mycobacterium avium subsp. paratuberculosis
cgucucggccagccgg

SEQ ID NO: 903974 - RNA, 22 nt, Mycobacterium avium subsp. paratuberculosis
cgucucggccagccgguagugc

SEQ ID NO: 903975 - RNA, 14 nt, Mycobacterium avium subsp. paratuberculosis
cgucucggccgcgg

SEQ ID NO: 903976 - RNA, 13 nt, Mycobacterium avium subsp. paratuberculosis
cgucucggcgauc

SEQ ID NO: 903977 - RNA, 15 nt, Mycobacterium avium subsp. paratuberculosis
cgucucggcggccga

SEQ ID NO: 903978 - RNA, 19 nt, Mycobacterium avium subsp. paratuberculosis
cgucucggcggccgagcgc

SEQ ID NO: 903979 - RNA, 14 nt, Mycobacterium avium subsp. paratuberculosis
cgucucggcgucuc

SEQ ID NO: 903980 - RNA, 21 nt, Mycobacterium avium subsp. paratuberculosis
cgucucggcgugcucggccac

SEQ ID NO: 903981 - RNA, 13 nt, Mycobacterium avium subsp. paratuberculosis
cgucucgucggcc

SEQ ID NO: 903982 - RNA, 14 nt, Mycobacterium avium subsp. paratuberculosis
cgucucgucggccg

SEQ ID NO: 903983 - RNA, 17 nt, Mycobacterium avium subsp. paratuberculosis
cgucucgucggccgcga

SEQ ID NO: 903984 - RNA, 14 nt, Mycobacterium avium subsp. paratuberculosis
cgucucggugucgg

SEQ ID NO: 903985 - RNA, 18 nt, Mycobacterium avium subsp. paratuberculosis
cgucucggugucggacuu

SEQ ID NO: 903986 - RNA, 18 nt, Mycobacterium avium subsp. paratuberculosis
cgucucugucgucgacca

SEQ ID NO: 903987 - RNA, 19 nt, Mycobacterium avium subsp. paratuberculosis
cgucggcuggcgugcggcg

SEQ ID NO: 903988 - RNA, 14 nt, Mycobacterium avium subsp. paratuberculosis
cgucgggcgccggu

SEQ ID NO: 903989 - RNA, 14 nt, Mycobacterium avium subsp. paratuberculosis
cgucgggcgcggcg

SEQ ID NO: 903990 - RNA, 22 nt, Mycobacterium avium subsp. paratuberculosis
cgucgggcgcggugugggcgau

SEQ ID NO: 903991 - RNA, 14 nt, Mycobacterium avium subsp. paratuberculosis
cgucgggcggggug

SEQ ID NO: 903992 - RNA, 22 nt, Mycobacterium avium subsp. paratuberculosis
cgucgggcgggguggccaccac

SEQ ID NO: 903993 - RNA, 21 nt, Mycobacterium avium subsp. paratuberculosis
cgucgggcggggugugcggca

SEQ ID NO: 903994 - RNA, 22 nt, Mycobacterium avium subsp. paratuberculosis
cgucgggcggggugugcggcac

SEQ ID NO: 903995 - RNA, 22 nt, Mycobacterium avium subsp. paratuberculosis
cgucgggcucgucgugauggcg

SEQ ID NO: 903996 - RNA, 14 nt, Mycobacterium avium subsp. paratuberculosis
cgucgggcugggcg

SEQ ID NO: 903997 - RNA, 15 nt, Mycobacterium avium subsp. paratuberculosis
cgucgggcucgcggu

SEQ ID NO: 903998 - RNA, 15 nt, Mycobacterium avium subsp. paratuberculosis
cgucgggcucggccg

SEQ ID NO: 903999 - RNA, 18 nt, Mycobacterium avium subsp. paratuberculosis
cgucggggaugucgucgg

SEQ ID NO: 904000 - RNA, 20 nt, Mycobacterium avium subsp. paratuberculosis
cgucggggaugucgucgggc

SEQ ID NO: 904001 - RNA, 24 nt, Mycobacterium avium subsp. paratuberculosis
cgucggggaugucgucgggcgcgg

SEQ ID NO: 904002 - RNA, 16 nt, Mycobacterium avium subsp. paratuberculosis
cgucggggcagccguc

SEQ ID NO: 904003 - RNA, 18 nt, Mycobacterium avium subsp. paratuberculosis
cgucggggcagccgucga

SEQ ID NO: 904004 - RNA, 20 nt, Mycobacterium avium subsp. paratuberculosis
cgucggggcagccgucgaug

SEQ ID NO: 904005 - RNA, 21 nt, Mycobacterium avium subsp. paratuberculosis
cgucggggcagccgucgaugc

SEQ ID NO: 904006 - RNA, 22 nt, Mycobacterium avium subsp. paratuberculosis
cgucggggcaucgcagcgcgcg

SEQ ID NO: 904007 - RNA, 18 nt, Mycobacterium avium subsp. paratuberculosis
cgucggggcccggcccgg

SEQ ID NO: 904008 - RNA, 20 nt, Mycobacterium avium subsp. paratuberculosis
cgucggggcccggcccggcg

SEQ ID NO: 904009 - RNA, 23 nt, Mycobacterium avium subsp. paratuberculosis
cgucggggcccggcccggcgaug

SEQ ID NO: 904010 - RNA, 14 nt, Mycobacterium avium subsp. paratuberculosis
cgucggggcgucgg

SEQ ID NO: 904011 - RNA, 17 nt, Mycobacterium avium subsp. paratuberculosis
cgucggggcgucggcgg

SEQ ID NO: 904012 - RNA, 20 nt, Mycobacterium avium subsp. paratuberculosis
cgucggggaucagcgucgcg

SEQ ID NO: 904013 - RNA, 22 nt, Mycobacterium avium subsp. paratuberculosis
cgucggggaucagcgucgcgau

SEQ ID NO: 904014 - RNA, 14 nt, Mycobacterium avium subsp. paratuberculosis
cgucgggggugccg

SEQ ID NO: 904015 - RNA, 15 nt, Mycobacterium avium subsp. paratuberculosis
cgucgggggugccgc

SEQ ID NO: 904016 - RNA, 17 nt, Mycobacterium avium subsp. paratuberculosis
cgucggggucgcgccgg

SEQ ID NO: 904017 - RNA, 18 nt, Mycobacterium avium subsp. paratuberculosis
cgucggggugcgccaggc

SEQ ID NO: 904018 - RNA, 14 nt, Mycobacterium avium subsp. paratuberculosis
cgucggggugcggu

SEQ ID NO: 904019 - RNA, 15 nt, Mycobacterium avium subsp. paratuberculosis
cgucgggguggccgg

SEQ ID NO: 904020 - RNA, 16 nt, Mycobacterium avium subsp. paratuberculosis
cgucgggguggccggc

SEQ ID NO: 904021 - RNA, 19 nt, Mycobacterium avium subsp. paratuberculosis
cgucgggguggccggccag

SEQ ID NO: 904022 - RNA, 23 nt, Mycobacterium avium subsp. paratuberculosis
cgucgggguggggacgacgccga

SEQ ID NO: 904023 - RNA, 19 nt, Mycobacterium avium subsp. paratuberculosis
cgucggguagggcgccguc

SEQ ID NO: 904024 - RNA, 20 nt, Mycobacterium avium subsp. paratuberculosis
cgucggguagggcgccgucg

SEQ ID NO: 904025 - RNA, 16 nt, Mycobacterium avium subsp. paratuberculosis
cgucggcuagcggcug

SEQ ID NO: 904026 - RNA, 23 nt, Mycobacterium avium subsp. paratuberculosis
cgucggcuagcggcugacccgcc

SEQ ID NO: 904027 - RNA, 15 nt, Mycobacterium avium subsp. paratuberculosis
cgucggcgugauagg

SEQ ID NO: 904028 - RNA, 15 nt, Mycobacterium avium subsp. paratuberculosis
cgucggcgugcccgc

SEQ ID NO: 904029 - RNA, 16 nt, Mycobacterium avium subsp. paratuberculosis
cgucggcgugcccgcc

SEQ ID NO: 904030 - RNA, 20 nt, Mycobacterium avium subsp. paratuberculosis
cgucggcgugcccgccgacc

SEQ ID NO: 904031 - RNA, 21 nt, Mycobacterium avium subsp. paratuberculosis
cgucggcgugcccgccgacca

SEQ ID NO: 904032 - RNA, 13 nt, Mycobacterium avium subsp. paratuberculosis
cgucggcgucgga

SEQ ID NO: 904033 - RNA, 21 nt, Mycobacterium avium subsp. paratuberculosis
cgucggcgucggaggcggcgu

SEQ ID NO: 904034 - RNA, 14 nt, Mycobacterium avium subsp. paratuberculosis
cgucggcguucagc

SEQ ID NO: 904035 - RNA, 21 nt, Mycobacterium avium subsp. paratuberculosis
cgucggcguucagcggcaccg

SEQ ID NO: 904036 - RNA, 13 nt, Mycobacterium avium subsp. paratuberculosis
cgucggcguacac

SEQ ID NO: 904037 - RNA, 20 nt, Mycobacterium avium subsp. paratuberculosis
cgucggcguagggcagcccg

SEQ ID NO: 904038 - RNA, 14 nt, Mycobacterium avium subsp. paratuberculosis
cgucggcgucgaac

SEQ ID NO: 904039 - RNA, 18 nt, Mycobacterium avium subsp. paratuberculosis
cgucggcgucgaacggcg

SEQ ID NO: 904040 - RNA, 13 nt, Mycobacterium avium subsp. paratuberculosis
cgucggcgucgac

SEQ ID NO: 904041 - RNA, 20 nt, Mycobacterium avium subsp. paratuberculosis
cgucggcgucgacgacggcg

SEQ ID NO: 904042 - RNA, 13 nt, Mycobacterium avium subsp. paratuberculosis
cgucggcgucauc

SEQ ID NO: 904043 - RNA, 15 nt, Mycobacterium avium subsp. paratuberculosis
cgucggcgucaucga

SEQ ID NO: 904044 - RNA, 14 nt, Mycobacterium avium subsp. paratuberculosis
cgucgcggucggcg

SEQ ID NO: 904045 - RNA, 24 nt, Mycobacterium avium subsp. paratuberculosis
cgucgcggucagcucgaucgccgc

SEQ ID NO: 904046 - RNA, 21 nt, Mycobacterium avium subsp. paratuberculosis
cgucgcgguccacgccggcga

SEQ ID NO: 904047 - RNA, 22 nt, Mycobacterium avium subsp. paratuberculosis
cgucgcgguggagcacagcacg

SEQ ID NO: 904048 - RNA, 17 nt, Mycobacterium avium subsp. paratuberculosis
cgucgcgucccuggcga

SEQ ID NO: 904049 - RNA, 17 nt, Mycobacterium avium subsp. paratuberculosis
cgucgcguccgagcagc

SEQ ID NO: 904050 - RNA, 21 nt, Mycobacterium avium subsp. paratuberculosis
cgucgcguucgacccacaccu

SEQ ID NO: 904051 - RNA, 23 nt, Mycobacterium avium subsp. paratuberculosis
cgucgcgcgacugggcgcccacc

SEQ ID NO: 904052 - RNA, 22 nt, Mycobacterium avium subsp. paratuberculosis
cgucggcgguuucggugccggc

SEQ ID NO: 904053 - RNA, 21 nt, Mycobacterium avium subsp. paratuberculosis
cgucgcgggagagcgcgggca

SEQ ID NO: 904054 - RNA, 13 nt, Mycobacterium avium subsp. paratuberculosis
cgucgcgggcgaa

SEQ ID NO: 904055 - RNA, 21 nt, Mycobacterium avium subsp. paratuberculosis
cgucgcgggcgaaggagaaga

SEQ ID NO: 904056 - RNA, 15 nt, Mycobacterium avium subsp. paratuberculosis
cgucgcgggcgccga

SEQ ID NO: 904057 - RNA, 16 nt, Mycobacterium avium subsp. paratuberculosis
cgucgcgggcgccgag

SEQ ID NO: 904058 - RNA, 16 nt, Mycobacterium avium subsp. paratuberculosis
cgucgcgggugaccgg

SEQ ID NO: 904059 - RNA, 17 nt, Mycobacterium avium subsp. paratuberculosis
cgucgcgggugaccggc

SEQ ID NO: 904060 - RNA, 18 nt, Mycobacterium avium subsp. paratuberculosis
cgucgcggguggggauca

SEQ ID NO: 904061 - RNA, 20 nt, Mycobacterium avium subsp. paratuberculosis
cgucgcggguggggaucagg

SEQ ID NO: 904062 - RNA, 14 nt, Mycobacterium avium subsp. paratuberculosis
cgucggucacccgg

SEQ ID NO: 904063 - RNA, 19 nt, Mycobacterium avium subsp. paratuberculosis
cgucggucagcaggcgccg

SEQ ID NO: 904064 - RNA, 20 nt, Mycobacterium avium subsp. paratuberculosis
cgucggucagcaggcgccgc

SEQ ID NO: 904065 - RNA, 21 nt, Mycobacterium avium subsp. paratuberculosis
cgucggucagcaggcgccgca

SEQ ID NO: 904066 - RNA, 15 nt, Mycobacterium avium subsp. paratuberculosis
cgucggucagcaucg

SEQ ID NO: 904067 - RNA, 17 nt, Mycobacterium avium subsp. paratuberculosis
cgucgguaaucggcggu

SEQ ID NO: 904068 - RNA, 17 nt, Mycobacterium avium subsp. paratuberculosis
cgucguacucgaccgcg

SEQ ID NO: 904069 - RNA, 17 nt, Mycobacterium avium subsp. paratuberculosis
cgucggguccgaccagc

SEQ ID NO: 904070 - RNA, 20 nt, Mycobacterium avium subsp. paratuberculosis
cgucggguccgaccagcacc

SEQ ID NO: 904071 - RNA, 21 nt, Mycobacterium avium subsp. paratuberculosis
cgucggguccgaccagcaccc

SEQ ID NO: 904072 - RNA, 14 nt, Mycobacterium avium subsp. paratuberculosis
cgucgggucggcga

SEQ ID NO: 904073 - RNA, 17 nt, Mycobacterium avium subsp. paratuberculosis
cgucgggucggcgagca

SEQ ID NO: 904074 - RNA, 19 nt, Mycobacterium avium subsp. paratuberculosis
cgucgggucggcgagcagc

SEQ ID NO: 904075 - RNA, 16 nt, Mycobacterium avium subsp. paratuberculosis
cgucggguucgccggu

SEQ ID NO: 904076 - RNA, 15 nt, Mycobacterium avium subsp. paratuberculosis
cgucggguguggcgc

SEQ ID NO: 904077 - RNA, 19 nt, Mycobacterium avium subsp. paratuberculosis
cgucggguguggcgccgug

SEQ ID NO: 904078 - RNA, 15 nt, Mycobacterium avium subsp. paratuberculosis
cgucguagucgcucg

SEQ ID NO: 904079 - RNA, 17 nt, Mycobacterium avium subsp. paratuberculosis
cgucguagucgcucggc

SEQ ID NO: 904080 - RNA, 22 nt, Mycobacterium avium subsp. paratuberculosis
cgucguagucgcucggcggcga

SEQ ID NO: 904081 - RNA, 15 nt, Mycobacterium avium subsp. paratuberculosis
cgucguaguugcggc

SEQ ID NO: 904082 - RNA, 18 nt, Mycobacterium avium subsp. paratuberculosis
cgucguaguugcggccgg

SEQ ID NO: 904083 - RNA, 19 nt, Mycobacterium avium subsp. paratuberculosis
cgucguaguugcggccggc

SEQ ID NO: 904084 - RNA, 23 nt, Mycobacterium avium subsp. paratuberculosis
cgucguaguugcggccggcggug

SEQ ID NO: 904085 - RNA, 18 nt, Mycobacterium avium subsp. paratuberculosis
cgucguauucgacggcga

SEQ ID NO: 904086 - RNA, 19 nt, Mycobacterium avium subsp. paratuberculosis
cgucguauucgacggcgac

SEQ ID NO: 904087 - RNA, 15 nt, Mycobacterium avium subsp. paratuberculosis
cgucguaggcgcgga

SEQ ID NO: 904088 - RNA, 16 nt, Mycobacterium avium subsp. paratuberculosis
cgucguaggcgcggac

SEQ ID NO: 904089 - RNA, 15 nt, Mycobacterium avium subsp. paratuberculosis
cgucguagccgcggg

SEQ ID NO: 904090 - RNA, 18 nt, Mycobacterium avium subsp. paratuberculosis
cgucguagacgcugccgc

SEQ ID NO: 904091 - RNA, 23 nt, Mycobacterium avium subsp. paratuberculosis
cgucguagacgcugccgcuggcg

SEQ ID NO: 904092 - RNA, 23 nt, Mycobacterium avium subsp. paratuberculosis
cgucguagagcaggaccgagccg

SEQ ID NO: 904093 - RNA, 23 nt, Mycobacterium avium subsp. paratuberculosis
cgucgucgaugcgcagcagcggc

SEQ ID NO: 904094 - RNA, 13 nt, Mycobacterium avium subsp. paratuberculosis
cgucgucgcaccg

SEQ ID NO: 904095 - RNA, 15 nt, Mycobacterium avium subsp. paratuberculosis
cgucgucgcagugcc

SEQ ID NO: 904096 - RNA, 15 nt, Mycobacterium avium subsp. paratuberculosis
cgucgucgcccaccc

SEQ ID NO: 904097 - RNA, 14 nt, Mycobacterium avium subsp. paratuberculosis
cgucgucgaaggcc

SEQ ID NO: 904098 - RNA, 12 nt, Mycobacterium avium subsp. paratuberculosis
cgucgucgacgc

SEQ ID NO: 904099 - RNA, 13 nt, Mycobacterium avium subsp. paratuberculosis
cgucgucgacgcu

SEQ ID NO: 904100 - RNA, 14 nt, Mycobacterium avium subsp. paratuberculosis
cgucgucgccgaaa

SEQ ID NO: 904101 - RNA, 13 nt, Mycobacterium avium subsp. paratuberculosis
cgucgucgccgcc

SEQ ID NO: 904102 - RNA, 14 nt, Mycobacterium avium subsp. paratuberculosis
cgucgucgcgcagg

SEQ ID NO: 904103 - RNA, 13 nt, Mycobacterium avium subsp. paratuberculosis
cgucgucggccca

SEQ ID NO: 904104 - RNA, 17 nt, Mycobacterium avium subsp. paratuberculosis
cgucgucggccggcucg

SEQ ID NO: 904105 - RNA, 16 nt, Mycobacterium avium subsp. paratuberculosis
cgucgucggccgggcc

SEQ ID NO: 904106 - RNA, 23 nt, Mycobacterium avium subsp. paratuberculosis
cgucgucggccgggccggcggug

SEQ ID NO: 904107 - RNA, 13 nt, Mycobacterium avium subsp. paratuberculosis
cgucgucggccuc

SEQ ID NO: 904108 - RNA, 14 nt, Mycobacterium avium subsp. paratuberculosis
cgucgucggccucg

SEQ ID NO: 904109 - RNA, 15 nt, Mycobacterium avium subsp. paratuberculosis
cgucgucggccucgg

SEQ ID NO: 904110 - RNA, 16 nt, Mycobacterium avium subsp. paratuberculosis
cgucgucggccucggc

SEQ ID NO: 904111 - RNA, 17 nt, Mycobacterium avium subsp. paratuberculosis
cgucgucggccucggcg

SEQ ID NO: 904112 - RNA, 21 nt, Mycobacterium avium subsp. paratuberculosis
cgucgucggccucggcggccg

SEQ ID NO: 904113 - RNA, 19 nt, Mycobacterium avium subsp. paratuberculosis
cgucgucgcuccacaucug

SEQ ID NO: 904114 - RNA, 14 nt, Mycobacterium avium subsp. paratuberculosis
cgucgucgcugcag

SEQ ID NO: 904115 - RNA, 18 nt, Mycobacterium avium subsp. paratuberculosis
cgucgucggacaccagca

SEQ ID NO: 904116 - RNA, 21 nt, Mycobacterium avium subsp. paratuberculosis
cgucgucggacagcagcaccg

SEQ ID NO: 904117 - RNA, 12 nt, Mycobacterium avium subsp. paratuberculosis
cgucgucggcga

SEQ ID NO: 904118 - RNA, 16 nt, Mycobacterium avium subsp. paratuberculosis
cgucgucggcgaacgg

SEQ ID NO: 904119 - RNA, 15 nt, Mycobacterium avium subsp. paratuberculosis
cgucgucggcgacga

SEQ ID NO: 904120 - RNA, 18 nt, Mycobacterium avium subsp. paratuberculosis
cgucgucggcgccgcgcc

SEQ ID NO: 904121 - RNA, 13 nt, Mycobacterium avium subsp. paratuberculosis
cgucgucggcggc

SEQ ID NO: 904122 - RNA, 15 nt, Mycobacterium avium subsp. paratuberculosis
cgucgucggcggcga

SEQ ID NO: 904123 - RNA, 16 nt, Mycobacterium avium subsp. paratuberculosis
cgucgucggcggcgac

SEQ ID NO: 904124 - RNA, 17 nt, Mycobacterium avium subsp. paratuberculosis
cgucgucggcggcgacg

SEQ ID NO: 904125 - RNA, 14 nt, Mycobacterium avium subsp. paratuberculosis
cgucgucggcgggc

SEQ ID NO: 904126 - RNA, 20 nt, Mycobacterium avium subsp. paratuberculosis
cgucgucggcgggcugcagc

SEQ ID NO: 904127 - RNA, 23 nt, Mycobacterium avium subsp. paratuberculosis
cgucgucggcgggcugcagcgac

SEQ ID NO: 904128 - RNA, 15 nt, Mycobacterium avium subsp. paratuberculosis
cguucaagccgccga

SEQ ID NO: 904129 - RNA, 13 nt, Mycobacterium avium subsp. paratuberculosis
cguguugcaggcg

SEQ ID NO: 904130 - RNA, 17 nt, Mycobacterium avium subsp. paratuberculosis
cguguugcaggcggacc

SEQ ID NO: 904131 - RNA, 18 nt, Mycobacterium avium subsp. paratuberculosis
cguguuggacgcccgcuc

SEQ ID NO: 904132 - RNA, 16 nt, Mycobacterium avium subsp. paratuberculosis
cguguuccuugcggcc

SEQ ID NO: 904133 - RNA, 20 nt, Mycobacterium avium subsp. paratuberculosis
cguguucaacgcgccgaugc

SEQ ID NO: 904134 - RNA, 13 nt, Mycobacterium avium subsp. paratuberculosis
cguguucgccgag

SEQ ID NO: 904135 - RNA, 22 nt, Mycobacterium avium subsp. paratuberculosis
cguguucgccgaggaaccggca

SEQ ID NO: 904136 - RNA, 18 nt, Mycobacterium avium subsp. paratuberculosis
cguguugaucucgucgau

SEQ ID NO: 904137 - RNA, 20 nt, Mycobacterium avium subsp. paratuberculosis
cguguucgggaucggcgccc

SEQ ID NO: 904138 - RNA, 21 nt, Mycobacterium avium subsp. paratuberculosis
cguguucgggaucggcgccca

SEQ ID NO: 904139 - RNA, 14 nt, Mycobacterium avium subsp. paratuberculosis
cguguucucacggc

SEQ ID NO: 904140 - RNA, 22 nt, Mycobacterium avium subsp. paratuberculosis
cgugugcccagcacgacgccgc

SEQ ID NO: 904141 - RNA, 13 nt, Mycobacterium avium subsp. paratuberculosis
cguguggcacccg

SEQ ID NO: 904142 - RNA, 22 nt, Mycobacterium avium subsp. paratuberculosis
cgugugcgcaucggcgacgccg

SEQ ID NO: 904143 - RNA, 23 nt, Mycobacterium avium subsp. paratuberculosis
cgugugcgcaucggcgacgccgc

SEQ ID NO: 904144 - RNA, 17 nt, Mycobacterium avium subsp. paratuberculosis
cguguggcgcacgccca

SEQ ID NO: 904145 - RNA, 18 nt, Mycobacterium avium subsp. paratuberculosis
cguguggcgcacgcccau

SEQ ID NO: 904146 - RNA, 22 nt, Mycobacterium avium subsp. paratuberculosis
cgugugggcgcccgcggcgcgc

SEQ ID NO: 904147 - RNA, 19 nt, Mycobacterium avium subsp. paratuberculosis
cguguccgucgccggaggc

SEQ ID NO: 904148 - RNA, 20 nt, Mycobacterium avium subsp. paratuberculosis
cguguccgucgccggaggcg

SEQ ID NO: 904149 - RNA, 14 nt, Mycobacterium avium subsp. paratuberculosis
cgugucgccggggc

SEQ ID NO: 904150 - RNA, 15 nt, Mycobacterium avium subsp. paratuberculosis
cgugucgccggggcg

SEQ ID NO: 904151 - RNA, 19 nt, Mycobacterium avium subsp. paratuberculosis
cgugucgccggggcggauc

SEQ ID NO: 904152 - RNA, 20 nt, Mycobacterium avium subsp. paratuberculosis
cgugucgccggggcggaucc

SEQ ID NO: 904153 - RNA, 22 nt, Mycobacterium avium subsp. paratuberculosis
cgugucgcggccuccgagcggc

SEQ ID NO: 904154 - RNA, 13 nt, Mycobacterium avium subsp. paratuberculosis
cgugucgcgugcu

SEQ ID NO: 904155 - RNA, 14 nt, Mycobacterium avium subsp. paratuberculosis
cgugucggcgaucg

SEQ ID NO: 904156 - RNA, 15 nt, Mycobacterium avium subsp. paratuberculosis
cgugucggcgaucgc

SEQ ID NO: 904157 - RNA, 14 nt, Mycobacterium avium subsp. paratuberculosis
cgugucggcgccac

SEQ ID NO: 904158 - RNA, 16 nt, Mycobacterium avium subsp. paratuberculosis
cgugucggcgggcggg

SEQ ID NO: 904159 - RNA, 13 nt, Mycobacterium avium subsp. paratuberculosis
cgugucggcgucg

SEQ ID NO: 904160 - RNA, 17 nt, Mycobacterium avium subsp. paratuberculosis
cgugucgucgucgccgc

SEQ ID NO: 904161 - RNA, 19 nt, Mycobacterium avium subsp. paratuberculosis
cgugucgucgucgccgccg

SEQ ID NO: 904162 - RNA, 15 nt, Mycobacterium avium subsp. paratuberculosis
cgugucuggccccgu

SEQ ID NO: 904163 - RNA, 13 nt, Mycobacterium avium subsp. paratuberculosis
cguucugcaccag

SEQ ID NO: 904164 - RNA, 18 nt, Mycobacterium avium subsp. paratuberculosis
cguucgggauccucgccg

SEQ ID NO: 904165 - RNA, 14 nt, Mycobacterium avium subsp. paratuberculosis
cguucgggcccggc

SEQ ID NO: 904166 - RNA, 17 nt, Mycobacterium avium subsp. paratuberculosis
cguucgggcccggccgc

SEQ ID NO: 904167 - RNA, 21 nt, Mycobacterium avium subsp. paratuberculosis
cguucggcucugcagagcggu

SEQ ID NO: 904168 - RNA, 16 nt, Mycobacterium avium subsp. paratuberculosis
cguucggcgccacccc

SEQ ID NO: 904169 - RNA, 21 nt, Mycobacterium avium subsp. paratuberculosis
cguucggcgagugaggccgag

SEQ ID NO: 904170 - RNA, 14 nt, Mycobacterium avium subsp. paratuberculosis
cguucggcgauccg

SEQ ID NO: 904171 - RNA, 13 nt, Mycobacterium avium subsp. paratuberculosis
cguucggcgcgga

SEQ ID NO: 904172 - RNA, 19 nt, Mycobacterium avium subsp. paratuberculosis
cguucggccagcgccgcca

SEQ ID NO: 904173 - RNA, 12 nt, Mycobacterium avium subsp. paratuberculosis
cguucggccagu

SEQ ID NO: 904174 - RNA, 14 nt, Mycobacterium avium subsp. paratuberculosis
cguucggccagcac

SEQ ID NO: 904175 - RNA, 22 nt, Mycobacterium avium subsp. paratuberculosis
cguucgcugcccucggucgccg

SEQ ID NO: 904176 - RNA, 20 nt, Mycobacterium avium subsp. paratuberculosis
cguucgaugaugggcgaucg

SEQ ID NO: 904177 - RNA, 17 nt, Mycobacterium avium subsp. paratuberculosis
cguucgauccgccggug

SEQ ID NO: 904178 - RNA, 15 nt, Mycobacterium avium subsp. paratuberculosis
cguucgauugcacca

SEQ ID NO: 904179 - RNA, 16 nt, Mycobacterium avium subsp. paratuberculosis
cguucgauugcaccac

SEQ ID NO: 904180 - RNA, 17 nt, Mycobacterium avium subsp. paratuberculosis
cguuccagcacgcccag

SEQ ID NO: 904181 - RNA, 16 nt, Mycobacterium avium subsp. paratuberculosis
cguucgagcgccggac

SEQ ID NO: 904182 - RNA, 22 nt, Mycobacterium avium subsp. paratuberculosis
cguucgagcgccggacgcuaag

SEQ ID NO: 904183 - RNA, 17 nt, Mycobacterium avium subsp. paratuberculosis
cguucgaguucgucgac

SEQ ID NO: 904184 - RNA, 14 nt, Mycobacterium avium subsp. paratuberculosis
cguucccaccggcu

SEQ ID NO: 904185 - RNA, 19 nt, Mycobacterium avium subsp. paratuberculosis
cguucccagcccggccagu

SEQ ID NO: 904186 - RNA, 19 nt, Mycobacterium avium subsp. paratuberculosis
cguucgcguugagcgucgc

SEQ ID NO: 904187 - RNA, 14 nt, Mycobacterium avium subsp. paratuberculosis
cguucgccggccag

SEQ ID NO: 904188 - RNA, 18 nt, Mycobacterium avium subsp. paratuberculosis
cguucgccgguaccgccg

SEQ ID NO: 904189 - RNA, 23 nt, Mycobacterium avium subsp. paratuberculosis
cguucgccgguaccgccggccag

SEQ ID NO: 904190 - RNA, 15 nt, Mycobacterium avium subsp. paratuberculosis
cguucgccgacagca

SEQ ID NO: 904191 - RNA, 18 nt, Mycobacterium avium subsp. paratuberculosis
cguucgccgacagcagcu

SEQ ID NO: 904192 - RNA, 16 nt, Mycobacterium avium subsp. paratuberculosis
cguucacgucgaucac

SEQ ID NO: 904193 - RNA, 21 nt, Mycobacterium avium subsp. paratuberculosis
cguucaccaccggagcggcgg

SEQ ID NO: 904194 - RNA, 22 nt, Mycobacterium avium subsp. paratuberculosis
cguucagcgacuugccgccggc

SEQ ID NO: 904195 - RNA, 13 nt, Mycobacterium avium subsp. paratuberculosis
cguucagcagcgc

SEQ ID NO: 904196 - RNA, 15 nt, Mycobacterium avium subsp. paratuberculosis
cguucaggucgauca

SEQ ID NO: 904197 - RNA, 17 nt, Mycobacterium avium subsp. paratuberculosis
cguucaggucgaucagc

SEQ ID NO: 904198 - RNA, 16 nt, Mycobacterium avium subsp. paratuberculosis
cguucagcugcagccg

SEQ ID NO: 904199 - RNA, 17 nt, Mycobacterium avium subsp. paratuberculosis
cguucagcugcagccgg

SEQ ID NO: 904200 - RNA, 19 nt, Mycobacterium avium subsp. paratuberculosis
cguucagcgcggccaccuc

SEQ ID NO: 904201 - RNA, 18 nt, Mycobacterium avium subsp. paratuberculosis
cguucauuaucccgcacc

SEQ ID NO: 904202 - RNA, 16 nt, Mycobacterium avium subsp. paratuberculosis
cguuccagcacccggc

SEQ ID NO: 904203 - RNA, 23 nt, Mycobacterium avium subsp. paratuberculosis
cguuccagcacccggcccacgcc

SEQ ID NO: 904204 - RNA, 13 nt, Mycobacterium avium subsp. paratuberculosis
cguuccagguccg

SEQ ID NO: 904205 - RNA, 19 nt, Mycobacterium avium subsp. paratuberculosis
cguuccagguccgcggugg

SEQ ID NO: 904206 - RNA, 22 nt, Mycobacterium avium subsp. paratuberculosis
cguuccaggugugccgcuggua

SEQ ID NO: 904207 - RNA, 23 nt, Mycobacterium avium subsp. paratuberculosis
cguuccagguucagcccggcgcu

SEQ ID NO: 904208 - RNA, 21 nt, Mycobacterium avium subsp. paratuberculosis
cguuccaucagcgcccgcgcg

SEQ ID NO: 904209 - RNA, 14 nt, Mycobacterium avium subsp. paratuberculosis
cguuccagccggcc

SEQ ID NO: 904210 - RNA, 16 nt, Mycobacterium avium subsp. paratuberculosis
cguucagugaccagug

SEQ ID NO: 904211 - RNA, 22 nt, Mycobacterium avium subsp. paratuberculosis
cgugguaccggcgccaggccgg

SEQ ID NO: 904212 - RNA, 14 nt, Mycobacterium avium subsp. paratuberculosis
cgugguccagccgg

SEQ ID NO: 904213 - RNA, 22 nt, Mycobacterium avium subsp. paratuberculosis
cgugguccagccggucgcaggu

SEQ ID NO: 904214 - RNA, 14 nt, Mycobacterium avium subsp. paratuberculosis
cguggucccacacc

SEQ ID NO: 904215 - RNA, 16 nt, Mycobacterium avium subsp. paratuberculosis
cguggucgacgccgug

SEQ ID NO: 904216 - RNA, 13 nt, Mycobacterium avium subsp. paratuberculosis
cguggucgcugcu

SEQ ID NO: 904217 - RNA, 16 nt, Mycobacterium avium subsp. paratuberculosis
cguggucggcagcacc

SEQ ID NO: 904218 - RNA, 22 nt, Mycobacterium avium subsp. paratuberculosis
cguggucggcagcaccggcagc

SEQ ID NO: 904219 - RNA, 18 nt, Mycobacterium avium subsp. paratuberculosis
cguggucggcgcggucca

SEQ ID NO: 904220 - RNA, 19 nt, Mycobacterium avium subsp. paratuberculosis
cguggucggcgcgguccac

SEQ ID NO: 904221 - RNA, 18 nt, Mycobacterium avium subsp. paratuberculosis
cguggucgggcaugccgg

SEQ ID NO: 904222 - RNA, 20 nt, Mycobacterium avium subsp. paratuberculosis
cguggucgggcaugccggcc

SEQ ID NO: 904223 - RNA, 21 nt, Mycobacterium avium subsp. paratuberculosis
cguggucgggcaugccggccg

SEQ ID NO: 904224 - RNA, 23 nt, Mycobacterium avium subsp. paratuberculosis
cguggucgggcaugccggccggc

SEQ ID NO: 904225 - RNA, 13 nt, Mycobacterium avium subsp. paratuberculosis
cguggucggugcc

SEQ ID NO: 904226 - RNA, 18 nt, Mycobacterium avium subsp. paratuberculosis
cguggugacccggaccgg

SEQ ID NO: 904227 - RNA, 21 nt, Mycobacterium avium subsp. paratuberculosis
cguggugacccggaccgggug

SEQ ID NO: 904228 - RNA, 16 nt, Mycobacterium avium subsp. paratuberculosis
cguggugaucgccgcg

SEQ ID NO: 904229 - RNA, 17 nt, Mycobacterium avium subsp. paratuberculosis
cguggugaucgccgcgg

SEQ ID NO: 904230 - RNA, 18 nt, Mycobacterium avium subsp. paratuberculosis
cguggugaucgccgcgga

SEQ ID NO: 904231 - RNA, 21 nt, Mycobacterium avium subsp. paratuberculosis
cguggucggcgaacgcccggu

SEQ ID NO: 904232 - RNA, 18 nt, Mycobacterium avium subsp. paratuberculosis
cguggucuccuggccgcc

SEQ ID NO: 904233 - RNA, 20 nt, Mycobacterium avium subsp. paratuberculosis
cguggucuccuggccgccgu

SEQ ID NO: 904234 - RNA, 21 nt, Mycobacterium avium subsp. paratuberculosis
cguggucucgcaccugccguc

SEQ ID NO: 904235 - RNA, 22 nt, Mycobacterium avium subsp. paratuberculosis
cguggucucguugugcaccggc

SEQ ID NO: 904236 - RNA, 20 nt, Mycobacterium avium subsp. paratuberculosis
cguggugcggugcaccgcgg

SEQ ID NO: 904237 - RNA, 21 nt, Mycobacterium avium subsp. paratuberculosis
cguggugcggugcaccgcggc

SEQ ID NO: 904238 - RNA, 15 nt, Mycobacterium avium subsp. paratuberculosis
cguggugcgcccguc

SEQ ID NO: 904239 - RNA, 16 nt, Mycobacterium avium subsp. paratuberculosis
cguggugcgcccgucg

SEQ ID NO: 904240 - RNA, 19 nt, Mycobacterium avium subsp. paratuberculosis
cguggugcgcccgucggug

SEQ ID NO: 904241 - RNA, 20 nt, Mycobacterium avium subsp. paratuberculosis
cguggugcgcccgucggugg

SEQ ID NO: 904242 - RNA, 13 nt, Mycobacterium avium subsp. paratuberculosis
cguggugcaccgc

SEQ ID NO: 904243 - RNA, 14 nt, Mycobacterium avium subsp. paratuberculosis
cguggugcaccgcc

SEQ ID NO: 904244 - RNA, 18 nt, Mycobacterium avium subsp. paratuberculosis
cguggucacccgcagccc

SEQ ID NO: 904245 - RNA, 20 nt, Mycobacterium avium subsp. paratuberculosis
cguggucacccgcagcccga

SEQ ID NO: 904246 - RNA, 21 nt, Mycobacterium avium subsp. paratuberculosis
cguggucaggggugggcgacg

SEQ ID NO: 904247 - RNA, 18 nt, Mycobacterium avium subsp. paratuberculosis
cgugguagcggucggggu

SEQ ID NO: 904248 - RNA, 16 nt, Mycobacterium avium subsp. paratuberculosis
cgugguagacgccgga

SEQ ID NO: 904249 - RNA, 18 nt, Mycobacterium avium subsp. paratuberculosis
cgugguagacgccggacg

SEQ ID NO: 904250 - RNA, 14 nt, Mycobacterium avium subsp. paratuberculosis
cgugguagccgccg

SEQ ID NO: 904251 - RNA, 14 nt, Mycobacterium avium subsp. paratuberculosis
cgugggugucggcg

SEQ ID NO: 904252 - RNA, 16 nt, Mycobacterium avium subsp. paratuberculosis
cguggguuccgccguc

SEQ ID NO: 904253 - RNA, 20 nt, Mycobacterium avium subsp. paratuberculosis
cgugggggucgacccgccgc

SEQ ID NO: 904254 - RNA, 18 nt, Mycobacterium avium subsp. paratuberculosis
cguggggcgucgccgccc

SEQ ID NO: 904255 - RNA, 13 nt, Mycobacterium avium subsp. paratuberculosis
cguggggcucagc

SEQ ID NO: 904256 - RNA, 18 nt, Mycobacterium avium subsp. paratuberculosis
cgugggguuuucggcgcg

SEQ ID NO: 904257 - RNA, 19 nt, Mycobacterium avium subsp. paratuberculosis
cgugggugacccggccguu

SEQ ID NO: 904258 - RNA, 23 nt, Mycobacterium avium subsp. paratuberculosis
cgugggugccgacgagcucgccg

SEQ ID NO: 904259 - RNA, 20 nt, Mycobacterium avium subsp. paratuberculosis
cguggguggucugcugggcg

SEQ ID NO: 904260 - RNA, 22 nt, Mycobacterium avium subsp. paratuberculosis
cguggguguccuugcgcaccac

SEQ ID NO: 904261 - RNA, 19 nt, Mycobacterium avium subsp. paratuberculosis
cguggggacccccucgucg

SEQ ID NO: 904262 - RNA, 15 nt, Mycobacterium avium subsp. paratuberculosis
cgugggcggccacca

SEQ ID NO: 904263 - RNA, 14 nt, Mycobacterium avium subsp. paratuberculosis
cgugguggcggcga

SEQ ID NO: 904264 - RNA, 21 nt, Mycobacterium avium subsp. paratuberculosis
cgugguggggccgaugaccgc

SEQ ID NO: 904265 - RNA, 14 nt, Mycobacterium avium subsp. paratuberculosis
cgugguggugcgga

SEQ ID NO: 904266 - RNA, 17 nt, Mycobacterium avium subsp. paratuberculosis
cguggugugcaccagcg

SEQ ID NO: 904267 - RNA, 18 nt, Mycobacterium avium subsp. paratuberculosis
cguggugugcaccagcga

SEQ ID NO: 904268 - RNA, 20 nt, Mycobacterium avium subsp. paratuberculosis
cguggugugcccgcgggcca

SEQ ID NO: 904269 - RNA, 21 nt, Mycobacterium avium subsp. paratuberculosis
cguggugugcccgcgggccag

SEQ ID NO: 904270 - RNA, 21 nt, Mycobacterium avium subsp. paratuberculosis
cgugguguugaucauccggcg

SEQ ID NO: 904271 - RNA, 20 nt, Mycobacterium avium subsp. paratuberculosis
cgugguggaugaugccggcg

SEQ ID NO: 904272 - RNA, 22 nt, Mycobacterium avium subsp. paratuberculosis
cgugguggaaggugacgucgcc

SEQ ID NO: 904273 - RNA, 15 nt, Mycobacterium avium subsp. paratuberculosis
cgugguugccccagc

SEQ ID NO: 904274 - RNA, 19 nt, Mycobacterium avium subsp. paratuberculosis
cgugguugcguucgccggc

SEQ ID NO: 904275 - RNA, 21 nt, Mycobacterium avium subsp. paratuberculosis
cgugguugcguucgccggcgu

SEQ ID NO: 904276 - RNA, 20 nt, Mycobacterium avium subsp. paratuberculosis
cgugguucuccgcgacaucg

SEQ ID NO: 904277 - RNA, 16 nt, Mycobacterium avium subsp. paratuberculosis
cgugguugcaaucucg

SEQ ID NO: 904278 - RNA, 14 nt, Mycobacterium avium subsp. paratuberculosis
cguguaggccgcgc

SEQ ID NO: 904279 - RNA, 19 nt, Mycobacterium avium subsp. paratuberculosis
cguguccagaacucggcgg

SEQ ID NO: 904280 - RNA, 20 nt, Mycobacterium avium subsp. paratuberculosis
cguguccagaacucggcggc

SEQ ID NO: 904281 - RNA, 20 nt, Mycobacterium avium subsp. paratuberculosis
cguguagggcaacacgacca

SEQ ID NO: 904282 - RNA, 17 nt, Mycobacterium avium subsp. paratuberculosis
cguguaguccaggucga

SEQ ID NO: 904283 - RNA, 22 nt, Mycobacterium avium subsp. paratuberculosis
cgugucccggauggagcgcgac

SEQ ID NO: 904284 - RNA, 14 nt, Mycobacterium avium subsp. paratuberculosis
cgugucccugcggc

SEQ ID NO: 904285 - RNA, 17 nt, Mycobacterium avium subsp. paratuberculosis
cgugucccugcggcugc

SEQ ID NO: 904286 - RNA, 15 nt, Mycobacterium avium subsp. paratuberculosis
cguguccgcgccggc

SEQ ID NO: 904287 - RNA, 17 nt, Mycobacterium avium subsp. paratuberculosis
cguguccgcgccggcgc

SEQ ID NO: 904288 - RNA, 13 nt, Mycobacterium avium subsp. paratuberculosis
cguguccgggccc

SEQ ID NO: 904289 - RNA, 18 nt, Mycobacterium avium subsp. paratuberculosis
cguggcaauucgaccguc

SEQ ID NO: 904290 - RNA, 15 nt, Mycobacterium avium subsp. paratuberculosis
cguggcagcggucgg

SEQ ID NO: 904291 - RNA, 17 nt, Mycobacterium avium subsp. paratuberculosis
cguggcagcggucggcg

SEQ ID NO: 904292 - RNA, 15 nt, Mycobacterium avium subsp. paratuberculosis
cguggcaggcacgag

SEQ ID NO: 904293 - RNA, 18 nt, Mycobacterium avium subsp. paratuberculosis
cguggcaggcgauggugc

SEQ ID NO: 904294 - RNA, 15 nt, Mycobacterium avium subsp. paratuberculosis
cguggcacccgggcg

SEQ ID NO: 904295 - RNA, 14 nt, Mycobacterium avium subsp. paratuberculosis
cguggcaccgggug

SEQ ID NO: 904296 - RNA, 21 nt, Mycobacterium avium subsp. paratuberculosis
cguggcaccgggugggccgac

SEQ ID NO: 904297 - RNA, 15 nt, Mycobacterium avium subsp. paratuberculosis
cguggcccgcccagc

SEQ ID NO: 904298 - RNA, 23 nt, Mycobacterium avium subsp. paratuberculosis
cguggcccgcccagcgcagcauc

SEQ ID NO: 904299 - RNA, 22 nt, Mycobacterium avium subsp. paratuberculosis
cguggcccggauggccgggcag

SEQ ID NO: 904300 - RNA, 17 nt, Mycobacterium avium subsp. paratuberculosis
cguggcccugcucgucg

SEQ ID NO: 904301 - RNA, 17 nt, Mycobacterium avium subsp. paratuberculosis
cguggcccagccggugc

SEQ ID NO: 904302 - RNA, 14 nt, Mycobacterium avium subsp. paratuberculosis
cguggccagcgcca

SEQ ID NO: 904303 - RNA, 16 nt, Mycobacterium avium subsp. paratuberculosis
cguggcgacaucgccg

SEQ ID NO: 904304 - RNA, 17 nt, Mycobacterium avium subsp. paratuberculosis
cguggcgacaucgccgc

SEQ ID NO: 904305 - RNA, 16 nt, Mycobacterium avium subsp. paratuberculosis
cguggcgacgacgccg

SEQ ID NO: 904306 - RNA, 19 nt, Mycobacterium avium subsp. paratuberculosis
cguggcgacgacgccgauc

SEQ ID NO: 904307 - RNA, 13 nt, Mycobacterium avium subsp. paratuberculosis
cguggcgcacagc

SEQ ID NO: 904308 - RNA, 16 nt, Mycobacterium avium subsp. paratuberculosis
cguggcgaacgcgacc

SEQ ID NO: 904309 - RNA, 18 nt, Mycobacterium avium subsp. paratuberculosis
cguggcgaacgcgaccug

SEQ ID NO: 904310 - RNA, 19 nt, Mycobacterium avium subsp. paratuberculosis
cguggccgugugcgcaucg

SEQ ID NO: 904311 - RNA, 22 nt, Mycobacterium avium subsp. paratuberculosis
cguggccgugugcgcaucggcg

SEQ ID NO: 904312 - RNA, 16 nt, Mycobacterium avium subsp. paratuberculosis
cguggccucccgguag

SEQ ID NO: 904313 - RNA, 15 nt, Mycobacterium avium subsp. paratuberculosis
cguggccgcguagaa

SEQ ID NO: 904314 - RNA, 15 nt, Mycobacterium avium subsp. paratuberculosis
cguggccgucacgcu

SEQ ID NO: 904315 - RNA, 19 nt, Mycobacterium avium subsp. paratuberculosis
cguggccgucacgcuggcg

SEQ ID NO: 904316 - RNA, 18 nt, Mycobacterium avium subsp. paratuberculosis
cguggccccacgggccau

SEQ ID NO: 904317 - RNA, 12 nt, Mycobacterium avium subsp. paratuberculosis
cguggcgcgccc

SEQ ID NO: 904318 - RNA, 16 nt, Mycobacterium avium subsp. paratuberculosis
cguggcgcgccccggc

SEQ ID NO: 904319 - RNA, 21 nt, Mycobacterium avium subsp. paratuberculosis
cguggcgcgccccggcccguc

SEQ ID NO: 904320 - RNA, 22 nt, Mycobacterium avium subsp. paratuberculosis
cguggcgcgccccggcccgucc

SEQ ID NO: 904321 - RNA, 14 nt, Mycobacterium avium subsp. paratuberculosis
cguggcgcucagcg

SEQ ID NO: 904322 - RNA, 16 nt, Mycobacterium avium subsp. paratuberculosis
cguggcgcucagcggc

SEQ ID NO: 904323 - RNA, 17 nt, Mycobacterium avium subsp. paratuberculosis
cguggcgcucagcggca

SEQ ID NO: 904324 - RNA, 19 nt, Mycobacterium avium subsp. paratuberculosis
cguggcgcucagcggcagc

SEQ ID NO: 904325 - RNA, 20 nt, Mycobacterium avium subsp. paratuberculosis
cguggcgcucagcggcagcg

SEQ ID NO: 904326 - RNA, 24 nt, Mycobacterium avium subsp. paratuberculosis
cguggcgcucagcggcagcgucgc

SEQ ID NO: 904327 - RNA, 15 nt, Mycobacterium avium subsp. paratuberculosis
cguggcgccggcgcg

SEQ ID NO: 904328 - RNA, 16 nt, Mycobacterium avium subsp. paratuberculosis
cguggcgccggcgcgc

SEQ ID NO: 904329 - RNA, 20 nt, Mycobacterium avium subsp. paratuberculosis
cguggcgccggcgcgcgagc

SEQ ID NO: 904330 - RNA, 14 nt, Mycobacterium avium subsp. paratuberculosis
cguggcgcgacgcg

SEQ ID NO: 904331 - RNA, 13 nt, Mycobacterium avium subsp. paratuberculosis
cguggcgucggcg

SEQ ID NO: 904332 - RNA, 15 nt, Mycobacterium avium subsp. paratuberculosis
cguggcgucggcgcg

SEQ ID NO: 904333 - RNA, 16 nt, Mycobacterium avium subsp. paratuberculosis
cguggcgucggcgcgc

SEQ ID NO: 904334 - RNA, 19 nt, Mycobacterium avium subsp. paratuberculosis
cguggcgucggcgcgcacc

SEQ ID NO: 904335 - RNA, 13 nt, Mycobacterium avium subsp. paratuberculosis
cguggcgugccgg

SEQ ID NO: 904336 - RNA, 15 nt, Mycobacterium avium subsp. paratuberculosis
cguggcgugccgggc

SEQ ID NO: 904337 - RNA, 16 nt, Mycobacterium avium subsp. paratuberculosis
cguggcgugccgggcg

SEQ ID NO: 904338 - RNA, 14 nt, Mycobacterium avium subsp. paratuberculosis
cguggcugaccgac

SEQ ID NO: 904339 - RNA, 17 nt, Mycobacterium avium subsp. paratuberculosis
cguggcugaccgacggc

SEQ ID NO: 904340 - RNA, 20 nt, Mycobacterium avium subsp. paratuberculosis
cguggcugaccgacggcgac

SEQ ID NO: 904341 - RNA, 12 nt, Mycobacterium avium subsp. paratuberculosis
cguggcugaggc

SEQ ID NO: 904342 - RNA, 16 nt, Mycobacterium avium subsp. paratuberculosis
cguggcugaggccgcc

SEQ ID NO: 904343 - RNA, 13 nt, Mycobacterium avium subsp. paratuberculosis
cguggcgucggug

SEQ ID NO: 904344 - RNA, 14 nt, Mycobacterium avium subsp. paratuberculosis
cguggcucagcggc

SEQ ID NO: 904345 - RNA, 17 nt, Mycobacterium avium subsp. paratuberculosis
cguggcucagcggcagg

SEQ ID NO: 904346 - RNA, 13 nt, Mycobacterium avium subsp. paratuberculosis
cguggcggccguc

SEQ ID NO: 904347 - RNA, 22 nt, Mycobacterium avium subsp. paratuberculosis
cguggcggccgucgcgcaccac

SEQ ID NO: 904348 - RNA, 23 nt, Mycobacterium avium subsp. paratuberculosis
cguggcggccgucgcgcaccacc

SEQ ID NO: 904349 - RNA, 17 nt, Mycobacterium avium subsp. paratuberculosis
cguggcgggggagccgu

SEQ ID NO: 904350 - RNA, 20 nt, Mycobacterium avium subsp. paratuberculosis
cguggcgggggagccgugca

SEQ ID NO: 904351 - RNA, 17 nt, Mycobacterium avium subsp. paratuberculosis
cguggcgggcccgggcg

SEQ ID NO: 904352 - RNA, 20 nt, Mycobacterium avium subsp. paratuberculosis
cguggcgggcccgggcgcug

SEQ ID NO: 904353 - RNA, 13 nt, Mycobacterium avium subsp. paratuberculosis
cguggcggcggug

SEQ ID NO: 904354 - RNA, 17 nt, Mycobacterium avium subsp. paratuberculosis
cguggcggcgguggcga

SEQ ID NO: 904355 - RNA, 17 nt, Mycobacterium avium subsp. paratuberculosis
cguggcggcggugucgc

SEQ ID NO: 904356 - RNA, 18 nt, Mycobacterium avium subsp. paratuberculosis
cguggcucggcccgccgg

SEQ ID NO: 904357 - RNA, 17 nt, Mycobacterium avium subsp. paratuberculosis
cguggcgguggcggcga

SEQ ID NO: 904358 - RNA, 22 nt, Mycobacterium avium subsp. paratuberculosis
cguggcugaacagcgcgccgaa

SEQ ID NO: 904359 - RNA, 13 nt, Mycobacterium avium subsp. paratuberculosis
cgugggcaccggc

SEQ ID NO: 904360 - RNA, 17 nt, Mycobacterium avium subsp. paratuberculosis
cgugggcaccggcaccg

SEQ ID NO: 904361 - RNA, 18 nt, Mycobacterium avium subsp. paratuberculosis
cgugggcaccggcaccgc

SEQ ID NO: 904362 - RNA, 20 nt, Mycobacterium avium subsp. paratuberculosis
cguggcuugaucgcacccau

SEQ ID NO: 904363 - RNA, 23 nt, Mycobacterium avium subsp. paratuberculosis
cguggcuuuggucgccagcacca

SEQ ID NO: 904364 - RNA, 15 nt, Mycobacterium avium subsp. paratuberculosis
cgugggccaacgcga

SEQ ID NO: 904365 - RNA, 14 nt, Mycobacterium avium subsp. paratuberculosis
cgugggccgaccgg

SEQ ID NO: 904366 - RNA, 14 nt, Mycobacterium avium subsp. paratuberculosis
cgugggccgcagcg

SEQ ID NO: 904367 - RNA, 19 nt, Mycobacterium avium subsp. paratuberculosis
cgugggccgcagcgcggcg

SEQ ID NO: 904368 - RNA, 21 nt, Mycobacterium avium subsp. paratuberculosis
cgugggccgcagcgcggcgac

SEQ ID NO: 904369 - RNA, 18 nt, Mycobacterium avium subsp. paratuberculosis
cgugggcgauccgcaggc

SEQ ID NO: 904370 - RNA, 20 nt, Mycobacterium avium subsp. paratuberculosis
cgugggcgauccgcaggccg

SEQ ID NO: 904371 - RNA, 22 nt, Mycobacterium avium subsp. paratuberculosis
cgugggcgauccgcaggccguc

SEQ ID NO: 904372 - RNA, 13 nt, Mycobacterium avium subsp. paratuberculosis
cgugggcgccguc

SEQ ID NO: 904373 - RNA, 20 nt, Mycobacterium avium subsp. paratuberculosis
cgugggcgccgucgccgccg

SEQ ID NO: 904374 - RNA, 22 nt, Mycobacterium avium subsp. paratuberculosis
cgugggcgccgucgccgccgug

SEQ ID NO: 904375 - RNA, 13 nt, Mycobacterium avium subsp. paratuberculosis
cgguugucgcggu

SEQ ID NO: 904376 - RNA, 15 nt, Mycobacterium avium subsp. paratuberculosis
cgguugucgcggugc

SEQ ID NO: 904377 - RNA, 15 nt, Mycobacterium avium subsp. paratuberculosis
cgguugucggucagg

SEQ ID NO: 904378 - RNA, 22 nt, Mycobacterium avium subsp. paratuberculosis
cgguuggucaccaggucgcggu

SEQ ID NO: 904379 - RNA, 16 nt, Mycobacterium avium subsp. paratuberculosis
cgguugggccgccggc

SEQ ID NO: 904380 - RNA, 19 nt, Mycobacterium avium subsp. paratuberculosis
cgguugggccgccggccgc

SEQ ID NO: 904381 - RNA, 15 nt, Mycobacterium avium subsp. paratuberculosis
cgguugggccggcgc

SEQ ID NO: 904382 - RNA, 13 nt, Mycobacterium avium subsp. paratuberculosis
cgguuggcggccg

SEQ ID NO: 904383 - RNA, 14 nt, Mycobacterium avium subsp. paratuberculosis
cgguuggcggccgg

SEQ ID NO: 904384 - RNA, 18 nt, Mycobacterium avium subsp. paratuberculosis
cgguuggcccgcggcgcc

SEQ ID NO: 904385 - RNA, 15 nt, Mycobacterium avium subsp. paratuberculosis
cgguuggccggccgg

SEQ ID NO: 904386 - RNA, 17 nt, Mycobacterium avium subsp. paratuberculosis
cgguuggccggccgggc

SEQ ID NO: 904387 - RNA, 15 nt, Mycobacterium avium subsp. paratuberculosis
cgguuggcgacgcug

SEQ ID NO: 904388 - RNA, 18 nt, Mycobacterium avium subsp. paratuberculosis
cguaacgccacggcggcc

SEQ ID NO: 904389 - RNA, 23 nt, Mycobacterium avium subsp. paratuberculosis
cguaacgccacggcggccgaauc

SEQ ID NO: 904390 - RNA, 18 nt, Mycobacterium avium subsp. paratuberculosis
cguaacacccugcgccac

SEQ ID NO: 904391 - RNA, 14 nt, Mycobacterium avium subsp. paratuberculosis
cguaaccggcggcg

SEQ ID NO: 904392 - RNA, 18 nt, Mycobacterium avium subsp. paratuberculosis
cguaaccguacggcccga

SEQ ID NO: 904393 - RNA, 19 nt, Mycobacterium avium subsp. paratuberculosis
cgguuccaccgggccgcca

SEQ ID NO: 904394 - RNA, 17 nt, Mycobacterium avium subsp. paratuberculosis
cgguuccaccggucgga

SEQ ID NO: 904395 - RNA, 20 nt, Mycobacterium avium subsp. paratuberculosis
cgguucacaaaggccgaaga

SEQ ID NO: 904396 - RNA, 13 nt, Mycobacterium avium subsp. paratuberculosis
cgguucacgcggc

SEQ ID NO: 904397 - RNA, 16 nt, Mycobacterium avium subsp. paratuberculosis
cgguucacgcggcugg

SEQ ID NO: 904398 - RNA, 17 nt, Mycobacterium avium subsp. paratuberculosis
cgguucacgcggcuggc

SEQ ID NO: 904399 - RNA, 19 nt, Mycobacterium avium subsp. paratuberculosis
cgguucacgcggcuggccc

SEQ ID NO: 904400 - RNA, 23 nt, Mycobacterium avium subsp. paratuberculosis
cgguucacgcggcuggcccggcg

SEQ ID NO: 904401 - RNA, 14 nt, Mycobacterium avium subsp. paratuberculosis
cgguugagcaccag

SEQ ID NO: 904402 - RNA, 15 nt, Mycobacterium avium subsp. paratuberculosis
cgguugagcaccagc

SEQ ID NO: 904403 - RNA, 14 nt, Mycobacterium avium subsp. paratuberculosis
cgguugagcaccgc

SEQ ID NO: 904404 - RNA, 17 nt, Mycobacterium avium subsp. paratuberculosis
cgguuccagcggcaccg

SEQ ID NO: 904405 - RNA, 18 nt, Mycobacterium avium subsp. paratuberculosis
cgguuccagcggcaccgc

SEQ ID NO: 904406 - RNA, 23 nt, Mycobacterium avium subsp. paratuberculosis
cgguuccagcggcaccgccaucg

SEQ ID NO: 904407 - RNA, 13 nt, Mycobacterium avium subsp. paratuberculosis
cgguuccagaccg

SEQ ID NO: 904408 - RNA, 16 nt, Mycobacterium avium subsp. paratuberculosis
cgguuccagaccggcg

SEQ ID NO: 904409 - RNA, 18 nt, Mycobacterium avium subsp. paratuberculosis
cgguuccagaccggcggc

SEQ ID NO: 904410 - RNA, 21 nt, Mycobacterium avium subsp. paratuberculosis
cgguuccagaccggcggcgau

SEQ ID NO: 904411 - RNA, 22 nt, Mycobacterium avium subsp. paratuberculosis
cgguuccagaccggcggcgauc

SEQ ID NO: 904412 - RNA, 13 nt, Mycobacterium avium subsp. paratuberculosis
cgguuccagcggc

SEQ ID NO: 904413 - RNA, 21 nt, Mycobacterium avium subsp. paratuberculosis
cgguugagugcgccgugcagc

SEQ ID NO: 904414 - RNA, 15 nt, Mycobacterium avium subsp. paratuberculosis
cgguugaucacccgg

SEQ ID NO: 904415 - RNA, 19 nt, Mycobacterium avium subsp. paratuberculosis
cgguugcgccgaggucacc

SEQ ID NO: 904416 - RNA, 22 nt, Mycobacterium avium subsp. paratuberculosis
cgguugcgccgaggucaccgcg

SEQ ID NO: 904417 - RNA, 15 nt, Mycobacterium avium subsp. paratuberculosis
cgguugcccggaagc

SEQ ID NO: 904418 - RNA, 18 nt, Mycobacterium avium subsp. paratuberculosis
cgguugcccgguuccgcg

SEQ ID NO: 904419 - RNA, 17 nt, Mycobacterium avium subsp. paratuberculosis
cgguuggacaggccggc

SEQ ID NO: 904420 - RNA, 20 nt, Mycobacterium avium subsp. paratuberculosis
cgguuggacaggccggcgac

SEQ ID NO: 904421 - RNA, 18 nt, Mycobacterium avium subsp. paratuberculosis
cgguuggacaugaagccc

SEQ ID NO: 904422 - RNA, 21 nt, Mycobacterium avium subsp. paratuberculosis
cgguugccuuuccgcgcggcg

SEQ ID NO: 904423 - RNA, 22 nt, Mycobacterium avium subsp. paratuberculosis
cgguugccuuuccgcgcggcgg

SEQ ID NO: 904424 - RNA, 17 nt, Mycobacterium avium subsp. paratuberculosis
cgguugccucggccagc

SEQ ID NO: 904425 - RNA, 14 nt, Mycobacterium avium subsp. paratuberculosis
cgguugcccgcacc

SEQ ID NO: 904426 - RNA, 16 nt, Mycobacterium avium subsp. paratuberculosis
cgguugcggcagcaca

SEQ ID NO: 904427 - RNA, 21 nt, Mycobacterium avium subsp. paratuberculosis
cgguugcggcagcacaccuuc

SEQ ID NO: 904428 - RNA, 23 nt, Mycobacterium avium subsp. paratuberculosis
cggugacaaagaucacagcgccc

SEQ ID NO: 904429 - RNA, 13 nt, Mycobacterium avium subsp. paratuberculosis
cggugacacccag

SEQ ID NO: 904430 - RNA, 13 nt, Mycobacterium avium subsp. paratuberculosis
cggugacaucgcc

SEQ ID NO: 904431 - RNA, 15 nt, Mycobacterium avium subsp. paratuberculosis
cggugacaucgccac

SEQ ID NO: 904432 - RNA, 14 nt, Mycobacterium avium subsp. paratuberculosis
cggugaccagaauc

SEQ ID NO: 904433 - RNA, 23 nt, Mycobacterium avium subsp. paratuberculosis
cggugaccagaaucuucgccucc

SEQ ID NO: 904434 - RNA, 17 nt, Mycobacterium avium subsp. paratuberculosis
cggugaccaccugcacc

SEQ ID NO: 904435 - RNA, 20 nt, Mycobacterium avium subsp. paratuberculosis
cggugaccaccugcaccugc

SEQ ID NO: 904436 - RNA, 21 nt, Mycobacterium avium subsp. paratuberculosis
cggugaccaccugcaccugcg

SEQ ID NO: 904437 - RNA, 23 nt, Mycobacterium avium subsp. paratuberculosis
cggugaccaccugcaccugcggc

SEQ ID NO: 904438 - RNA, 23 nt, Mycobacterium avium subsp. paratuberculosis
cggugaccacgccgugcccggcg

SEQ ID NO: 904439 - RNA, 16 nt, Mycobacterium avium subsp. paratuberculosis
cggugaccacggucgg

SEQ ID NO: 904440 - RNA, 18 nt, Mycobacterium avium subsp. paratuberculosis
cggugaccacggucggcg

SEQ ID NO: 904441 - RNA, 20 nt, Mycobacterium avium subsp. paratuberculosis
cggugaccacggucggcggg

SEQ ID NO: 904442 - RNA, 17 nt, Mycobacterium avium subsp. paratuberculosis
cggugaauucaucgucc

SEQ ID NO: 904443 - RNA, 15 nt, Mycobacterium avium subsp. paratuberculosis
cggugaauugggcga

SEQ ID NO: 904444 - RNA, 19 nt, Mycobacterium avium subsp. paratuberculosis
cggugaauugggcgaguac

SEQ ID NO: 904445 - RNA, 20 nt, Mycobacterium avium subsp. paratuberculosis
cggugaaugucguagcgguc

SEQ ID NO: 904446 - RNA, 15 nt, Mycobacterium avium subsp. paratuberculosis
cggugaaguugccgc

SEQ ID NO: 904447 - RNA, 17 nt, Mycobacterium avium subsp. paratuberculosis
cggugaaguugccgccg

SEQ ID NO: 904448 - RNA, 21 nt, Mycobacterium avium subsp. paratuberculosis
cggugaaguugccgccgccgg

SEQ ID NO: 904449 - RNA, 18 nt, Mycobacterium avium subsp. paratuberculosis
cggugaaguuggcggcgg

SEQ ID NO: 904450 - RNA, 19 nt, Mycobacterium avium subsp. paratuberculosis
cggugaaguuggcggcggu

SEQ ID NO: 904451 - RNA, 16 nt, Mycobacterium avium subsp. paratuberculosis
cggugaagucaacgca

SEQ ID NO: 904452 - RNA, 21 nt, Mycobacterium avium subsp. paratuberculosis
cggugaaguccgagacgucgg

SEQ ID NO: 904453 - RNA, 18 nt, Mycobacterium avium subsp. paratuberculosis
cggugaagccgacgccgu

SEQ ID NO: 904454 - RNA, 22 nt, Mycobacterium avium subsp. paratuberculosis
cggugaagcggcgcgggucgcg

SEQ ID NO: 904455 - RNA, 18 nt, Mycobacterium avium subsp. paratuberculosis
cggugaccccgucgaacg

SEQ ID NO: 904456 - RNA, 15 nt, Mycobacterium avium subsp. paratuberculosis
cgguggucggcguca

SEQ ID NO: 904457 - RNA, 17 nt, Mycobacterium avium subsp. paratuberculosis
cgguggucggcgucacc

SEQ ID NO: 904458 - RNA, 18 nt, Mycobacterium avium subsp. paratuberculosis
cgguggugaacgcgucgg

SEQ ID NO: 904459 - RNA, 21 nt, Mycobacterium avium subsp. paratuberculosis
cgguggugaacgcgucgguca

SEQ ID NO: 904460 - RNA, 20 nt, Mycobacterium avium subsp. paratuberculosis
cggugaccgcccgcucgacg

SEQ ID NO: 904461 - RNA, 14 nt, Mycobacterium avium subsp. paratuberculosis
cggugaccgccgcc

SEQ ID NO: 904462 - RNA, 18 nt, Mycobacterium avium subsp. paratuberculosis
cgguggucgaacacggcg

SEQ ID NO: 904463 - RNA, 19 nt, Mycobacterium avium subsp. paratuberculosis
cgguggucgaacacggcgc

SEQ ID NO: 904464 - RNA, 20 nt, Mycobacterium avium subsp. paratuberculosis
cgguggucgaacacggcgcu

SEQ ID NO: 904465 - RNA, 12 nt, Mycobacterium avium subsp. paratuberculosis
cgguggucgacg

SEQ ID NO: 904466 - RNA, 13 nt, Mycobacterium avium subsp. paratuberculosis
cgguggucgacga

SEQ ID NO: 904467 - RNA, 19 nt, Mycobacterium avium subsp. paratuberculosis
cgguggucgacgagcccgc

SEQ ID NO: 904468 - RNA, 20 nt, Mycobacterium avium subsp. paratuberculosis
cgguggucgacgagcccgcg

SEQ ID NO: 904469 - RNA, 14 nt, Mycobacterium avium subsp. paratuberculosis
cgguggugauaggg

SEQ ID NO: 904470 - RNA, 18 nt, Mycobacterium avium subsp. paratuberculosis
cgguggugaucgcggcgg

SEQ ID NO: 904471 - RNA, 19 nt, Mycobacterium avium subsp. paratuberculosis
cgguggugaucgcggcggc

SEQ ID NO: 904472 - RNA, 12 nt, Mycobacterium avium subsp. paratuberculosis
cgguggugcggc

SEQ ID NO: 904473 - RNA, 17 nt, Mycobacterium avium subsp. paratuberculosis
cgguggugcggcccugu

SEQ ID NO: 904474 - RNA, 22 nt, Mycobacterium avium subsp. paratuberculosis
cgguggugcucgccccgcccga

SEQ ID NO: 904475 - RNA, 22 nt, Mycobacterium avium subsp. paratuberculosis
cgguguacucaaaccgggccug

SEQ ID NO: 904476 - RNA, 18 nt, Mycobacterium avium subsp. paratuberculosis
cgguguagacgcgggccg

SEQ ID NO: 904477 - RNA, 20 nt, Mycobacterium avium subsp. paratuberculosis
cgguguagacgcgggccggc

SEQ ID NO: 904478 - RNA, 22 nt, Mycobacterium avium subsp. paratuberculosis
cgguguagacgcgggccggcac

SEQ ID NO: 904479 - RNA, 21 nt, Mycobacterium avium subsp. paratuberculosis
cgguguaucccaucagugcgg

SEQ ID NO: 904480 - RNA, 15 nt, Mycobacterium avium subsp. paratuberculosis
cgguguagucggcga

SEQ ID NO: 904481 - RNA, 20 nt, Mycobacterium avium subsp. paratuberculosis
cgguguagucggcgaucggc

SEQ ID NO: 904482 - RNA, 15 nt, Mycobacterium avium subsp. paratuberculosis
cgguguaggacgccg

SEQ ID NO: 904483 - RNA, 22 nt, Mycobacterium avium subsp. paratuberculosis
cgguguaggacgccgugcagga

SEQ ID NO: 904484 - RNA, 17 nt, Mycobacterium avium subsp. paratuberculosis
cgguguagaucggcuca

SEQ ID NO: 904485 - RNA, 22 nt, Mycobacterium avium subsp. paratuberculosis
cgguguagaucggcucaccgaa

SEQ ID NO: 904486 - RNA, 15 nt, Mycobacterium avium subsp. paratuberculosis
cgguguagcccggug

SEQ ID NO: 904487 - RNA, 21 nt, Mycobacterium avium subsp. paratuberculosis
cgguguagcgagugccggcca

SEQ ID NO: 904488 - RNA, 15 nt, Mycobacterium avium subsp. paratuberculosis
cgguguagcggcggc

SEQ ID NO: 904489 - RNA, 18 nt, Mycobacterium avium subsp. paratuberculosis
cggugucggggucgucga

SEQ ID NO: 904490 - RNA, 17 nt, Mycobacterium avium subsp. paratuberculosis
cggugucggcgucgauc

SEQ ID NO: 904491 - RNA, 21 nt, Mycobacterium avium subsp. paratuberculosis
cggugucggcgucgaucgccg

SEQ ID NO: 904492 - RNA, 15 nt, Mycobacterium avium subsp. paratuberculosis
cggugucggugccga

SEQ ID NO: 904493 - RNA, 16 nt, Mycobacterium avium subsp. paratuberculosis
cggugucggugcgacc

SEQ ID NO: 904494 - RNA, 21 nt, Mycobacterium avium subsp. paratuberculosis
cggugucguaguugcgcgccg

SEQ ID NO: 904495 - RNA, 22 nt, Mycobacterium avium subsp. paratuberculosis
cggugucguaguugcgcgccga

SEQ ID NO: 904496 - RNA, 23 nt, Mycobacterium avium subsp. paratuberculosis
cggugucguaguugcgcgccgau

SEQ ID NO: 904497 - RNA, 23 nt, Mycobacterium avium subsp. paratuberculosis
cggugucgcuguaggccagcccg

SEQ ID NO: 904498 - RNA, 14 nt, Mycobacterium avium subsp. paratuberculosis
cggugucggcgacc

SEQ ID NO: 904499 - RNA, 14 nt, Mycobacterium avium subsp. paratuberculosis
cggugucggcgccc

SEQ ID NO: 904500 - RNA, 21 nt, Mycobacterium avium subsp. paratuberculosis
cggugucggcgccccggcgcu

SEQ ID NO: 904501 - RNA, 16 nt, Mycobacterium avium subsp. paratuberculosis
cgguguuggcggcguc

SEQ ID NO: 904502 - RNA, 18 nt, Mycobacterium avium subsp. paratuberculosis
cgguguugccgacggcgc

SEQ ID NO: 904503 - RNA, 20 nt, Mycobacterium avium subsp. paratuberculosis
cgguguugccgacggcgccg

SEQ ID NO: 904504 - RNA, 20 nt, Mycobacterium avium subsp. paratuberculosis
cgguguucgagggcgcggcg

SEQ ID NO: 904505 - RNA, 13 nt, Mycobacterium avium subsp. paratuberculosis
cgguguugagcgc

SEQ ID NO: 904506 - RNA, 14 nt, Mycobacterium avium subsp. paratuberculosis
cgguguucgggucg

SEQ ID NO: 904507 - RNA, 15 nt, Mycobacterium avium subsp. paratuberculosis
cgguguucuugaacg

SEQ ID NO: 904508 - RNA, 23 nt, Mycobacterium avium subsp. paratuberculosis
cgguguucuugaacggcgcgucg

SEQ ID NO: 904509 - RNA, 17 nt, Mycobacterium avium subsp. paratuberculosis
cggugucugaccucgcg

SEQ ID NO: 904510 - RNA, 23 nt, Mycobacterium avium subsp. paratuberculosis
cggugucugaccucgcgccgcga

SEQ ID NO: 904511 - RNA, 12 nt, Mycobacterium avium subsp. paratuberculosis
cggugugcagca

SEQ ID NO: 904512 - RNA, 13 nt, Mycobacterium avium subsp. paratuberculosis
cggugugcagcag

SEQ ID NO: 904513 - RNA, 17 nt, Mycobacterium avium subsp. paratuberculosis
cggugugggcggacugc

SEQ ID NO: 904514 - RNA, 15 nt, Mycobacterium avium subsp. paratuberculosis
cggugugggucagcg

SEQ ID NO: 904515 - RNA, 16 nt, Mycobacterium avium subsp. paratuberculosis
cggugugaucgagcac

SEQ ID NO: 904516 - RNA, 19 nt, Mycobacterium avium subsp. paratuberculosis
cggugugaucgagcaccag

SEQ ID NO: 904517 - RNA, 21 nt, Mycobacterium avium subsp. paratuberculosis
cggugugaucgagcaccagcg

SEQ ID NO: 904518 - RNA, 13 nt, Mycobacterium avium subsp. paratuberculosis
cggugucgucgac

SEQ ID NO: 904519 - RNA, 14 nt, Mycobacterium avium subsp. paratuberculosis
cggugucgucgacc

SEQ ID NO: 904520 - RNA, 17 nt, Mycobacterium avium subsp. paratuberculosis
cgguguucaagccggcg

SEQ ID NO: 904521 - RNA, 20 nt, Mycobacterium avium subsp. paratuberculosis
cgguguucaagccggcgugg

SEQ ID NO: 904522 - RNA, 21 nt, Mycobacterium avium subsp. paratuberculosis
cguaaguggcgccgcggucgc

SEQ ID NO: 904523 - RNA, 14 nt, Mycobacterium avium subsp. paratuberculosis
cguaagugucgugg

SEQ ID NO: 904524 - RNA, 16 nt, Mycobacterium avium subsp. paratuberculosis
cguaccgcaacaccga

SEQ ID NO: 904525 - RNA, 17 nt, Mycobacterium avium subsp. paratuberculosis
cguaccgcaacaccgaa

SEQ ID NO: 904526 - RNA, 12 nt, Mycobacterium avium subsp. paratuberculosis
cguaccgcggcg

SEQ ID NO: 904527 - RNA, 13 nt, Mycobacterium avium subsp. paratuberculosis
cguaccgcggcgg

SEQ ID NO: 904528 - RNA, 18 nt, Mycobacterium avium subsp. paratuberculosis
cguaccgcggcggcgucg

SEQ ID NO: 904529 - RNA, 21 nt, Mycobacterium avium subsp. paratuberculosis
cguaccgcggcggcgucgacc

SEQ ID NO: 904530 - RNA, 24 nt, Mycobacterium avium subsp. paratuberculosis
cguaccugccccacacgcucggcg

SEQ ID NO: 904531 - RNA, 18 nt, Mycobacterium avium subsp. paratuberculosis
cguaccgguacagcgacu

SEQ ID NO: 904532 - RNA, 17 nt, Mycobacterium avium subsp. paratuberculosis
cguacgggaugaucagc

SEQ ID NO: 904533 - RNA, 21 nt, Mycobacterium avium subsp. paratuberculosis
cguacgggaugaucagcaggu

SEQ ID NO: 904534 - RNA, 18 nt, Mycobacterium avium subsp. paratuberculosis
cguacgggcgcagcgccg

SEQ ID NO: 904535 - RNA, 12 nt, Mycobacterium avium subsp. paratuberculosis
cguacgcgccgg

SEQ ID NO: 904536 - RNA, 13 nt, Mycobacterium avium subsp. paratuberculosis
cguacgcgccggc

SEQ ID NO: 904537 - RNA, 16 nt, Mycobacterium avium subsp. paratuberculosis
cguacgcgccggccag

SEQ ID NO: 904538 - RNA, 16 nt, Mycobacterium avium subsp. paratuberculosis
cguacgcgcugccgac

SEQ ID NO: 904539 - RNA, 17 nt, Mycobacterium avium subsp. paratuberculosis
cguacggguugccgucg

SEQ ID NO: 904540 - RNA, 21 nt, Mycobacterium avium subsp. paratuberculosis
cguacggguugccgucgacga

SEQ ID NO: 904541 - RNA, 14 nt, Mycobacterium avium subsp. paratuberculosis
cguacugcucggcg

SEQ ID NO: 904542 - RNA, 14 nt, Mycobacterium avium subsp. paratuberculosis
cguacugcgcgagc

SEQ ID NO: 904543 - RNA, 14 nt, Mycobacterium avium subsp. paratuberculosis
cguacuggcgccgg

SEQ ID NO: 904544 - RNA, 17 nt, Mycobacterium avium subsp. paratuberculosis
cguagacgagccgguug

SEQ ID NO: 904545 - RNA, 20 nt, Mycobacterium avium subsp. paratuberculosis
cguagacggugucgcccucg

SEQ ID NO: 904546 - RNA, 21 nt, Mycobacterium avium subsp. paratuberculosis
cguagacggugucgcccucgc

SEQ ID NO: 904547 - RNA, 18 nt, Mycobacterium avium subsp. paratuberculosis
cguacucgaugccguugu

SEQ ID NO: 904548 - RNA, 17 nt, Mycobacterium avium subsp. paratuberculosis
cguacucgugggccacc

SEQ ID NO: 904549 - RNA, 18 nt, Mycobacterium avium subsp. paratuberculosis
cguacucgugggccacca

SEQ ID NO: 904550 - RNA, 23 nt, Mycobacterium avium subsp. paratuberculosis
cguacuccaccgcgccgucgucg

SEQ ID NO: 904551 - RNA, 24 nt, Mycobacterium avium subsp. paratuberculosis
cguacucccaggauuccgucggcg

SEQ ID NO: 904552 - RNA, 19 nt, Mycobacterium avium subsp. paratuberculosis
cguacucccaggccgcggc

SEQ ID NO: 904553 - RNA, 20 nt, Mycobacterium avium subsp. paratuberculosis
cguacucccaggccgcggcc

SEQ ID NO: 904554 - RNA, 14 nt, Mycobacterium avium subsp. paratuberculosis
cguacuccgacaga

SEQ ID NO: 904555 - RNA, 17 nt, Mycobacterium avium subsp. paratuberculosis
cguacucgaccgcgacu

SEQ ID NO: 904556 - RNA, 16 nt, Mycobacterium avium subsp. paratuberculosis
cguagcgccgcccguc

SEQ ID NO: 904557 - RNA, 13 nt, Mycobacterium avium subsp. paratuberculosis
cguagcgccggua

SEQ ID NO: 904558 - RNA, 20 nt, Mycobacterium avium subsp. paratuberculosis
cguagcgcugggugaacacc

SEQ ID NO: 904559 - RNA, 14 nt, Mycobacterium avium subsp. paratuberculosis
cguagcgcggccgc

SEQ ID NO: 904560 - RNA, 20 nt, Mycobacterium avium subsp. paratuberculosis
cguagcggaagcugccguug

SEQ ID NO: 904561 - RNA, 17 nt, Mycobacterium avium subsp. paratuberculosis
cguagcggcucgccacc

SEQ ID NO: 904562 - RNA, 13 nt, Mycobacterium avium subsp. paratuberculosis
cguagcgggcgaa

SEQ ID NO: 904563 - RNA, 14 nt, Mycobacterium avium subsp. paratuberculosis
cguagcggcgccac

SEQ ID NO: 904564 - RNA, 17 nt, Mycobacterium avium subsp. paratuberculosis
cguagcggcgccaccgg

SEQ ID NO: 904565 - RNA, 15 nt, Mycobacterium avium subsp. paratuberculosis
cguagcgggucagcu

SEQ ID NO: 904566 - RNA, 16 nt, Mycobacterium avium subsp. paratuberculosis
cguagcggucgcccca

SEQ ID NO: 904567 - RNA, 14 nt, Mycobacterium avium subsp. paratuberculosis
cguagcggucggga

SEQ ID NO: 904568 - RNA, 23 nt, Mycobacterium avium subsp. paratuberculosis
cguagcggugaaacgccugcacc

SEQ ID NO: 904569 - RNA, 16 nt, Mycobacterium avium subsp. paratuberculosis
cguagcucagugguag

SEQ ID NO: 904570 - RNA, 17 nt, Mycobacterium avium subsp. paratuberculosis
cguagcucgccgcggcc

SEQ ID NO: 904571 - RNA, 19 nt, Mycobacterium avium subsp. paratuberculosis
cguagcucgccgcggccac

SEQ ID NO: 904572 - RNA, 21 nt, Mycobacterium avium subsp. paratuberculosis
cguagcucgcgccgacccgcc

SEQ ID NO: 904573 - RNA, 20 nt, Mycobacterium avium subsp. paratuberculosis
cguagcuggugcgcagcccg

SEQ ID NO: 904574 - RNA, 21 nt, Mycobacterium avium subsp. paratuberculosis
cguagcuggugcgcagcccgc

SEQ ID NO: 904575 - RNA, 16 nt, Mycobacterium avium subsp. paratuberculosis
cguagcguugccggcc

SEQ ID NO: 904576 - RNA, 16 nt, Mycobacterium avium subsp. paratuberculosis
cguagcgucgggggcg

SEQ ID NO: 904577 - RNA, 17 nt, Mycobacterium avium subsp. paratuberculosis
cguagcgcaacaccgaa

SEQ ID NO: 904578 - RNA, 12 nt, Mycobacterium avium subsp. paratuberculosis
cguagccgucga

SEQ ID NO: 904579 - RNA, 13 nt, Mycobacterium avium subsp. paratuberculosis
cguagccggcggu

SEQ ID NO: 904580 - RNA, 18 nt, Mycobacterium avium subsp. paratuberculosis
cguagccggcgguggcca

SEQ ID NO: 904581 - RNA, 22 nt, Mycobacterium avium subsp. paratuberculosis
cguagccgguauccauccgcca

SEQ ID NO: 904582 - RNA, 18 nt, Mycobacterium avium subsp. paratuberculosis
cguagccgugcaucgggc

SEQ ID NO: 904583 - RNA, 22 nt, Mycobacterium avium subsp. paratuberculosis
cguagaugccgguacggccgac

SEQ ID NO: 904584 - RNA, 23 nt, Mycobacterium avium subsp. paratuberculosis
cguagaugccgguacggccgacg

SEQ ID NO: 904585 - RNA, 14 nt, Mycobacterium avium subsp. paratuberculosis
cguagaucgucgag

SEQ ID NO: 904586 - RNA, 15 nt, Mycobacterium avium subsp. paratuberculosis
cguagaucgucgagu

SEQ ID NO: 904587 - RNA, 17 nt, Mycobacterium avium subsp. paratuberculosis
cguagaucucgcgccgc

SEQ ID NO: 904588 - RNA, 20 nt, Mycobacterium avium subsp. paratuberculosis
cguagaucucgcgccgcgca

SEQ ID NO: 904589 - RNA, 22 nt, Mycobacterium avium subsp. paratuberculosis
cguagagcaggaccgagccgcg

SEQ ID NO: 904590 - RNA, 20 nt, Mycobacterium avium subsp. paratuberculosis
cguagaggggccggacggug

SEQ ID NO: 904591 - RNA, 17 nt, Mycobacterium avium subsp. paratuberculosis
cguagaucacgccggug

SEQ ID NO: 904592 - RNA, 17 nt, Mycobacterium avium subsp. paratuberculosis
cguagaucacggcguug

SEQ ID NO: 904593 - RNA, 19 nt, Mycobacterium avium subsp. paratuberculosis
cguagaucauuugaccgca

SEQ ID NO: 904594 - RNA, 17 nt, Mycobacterium avium subsp. paratuberculosis
cguagaggugcagcggg

SEQ ID NO: 904595 - RNA, 18 nt, Mycobacterium avium subsp. paratuberculosis
cguagaggugcagcgggc

SEQ ID NO: 904596 - RNA, 20 nt, Mycobacterium avium subsp. paratuberculosis
cguagaggugcagcgggcug

SEQ ID NO: 904597 - RNA, 20 nt, Mycobacterium avium subsp. paratuberculosis
cguagagccguuuggcgccg

SEQ ID NO: 904598 - RNA, 21 nt, Mycobacterium avium subsp. paratuberculosis
cguagagccguuuggcgccgc

SEQ ID NO: 904599 - RNA, 23 nt, Mycobacterium avium subsp. paratuberculosis
cguagagccguuuggcgccgccc

SEQ ID NO: 904600 - RNA, 15 nt, Mycobacterium avium subsp. paratuberculosis
cgucaacgacccgga

SEQ ID NO: 904601 - RNA, 23 nt, Mycobacterium avium subsp. paratuberculosis
cgucaacgccccggucgugucau

SEQ ID NO: 904602 - RNA, 17 nt, Mycobacterium avium subsp. paratuberculosis
cgucaaccaccggcauc

SEQ ID NO: 904603 - RNA, 13 nt, Mycobacterium avium subsp. paratuberculosis
cgucaacccguuc

SEQ ID NO: 904604 - RNA, 14 nt, Mycobacterium avium subsp. paratuberculosis
cgucacccccggcg

SEQ ID NO: 904605 - RNA, 15 nt, Mycobacterium avium subsp. paratuberculosis
cgucacccccggcgc

SEQ ID NO: 904606 - RNA, 20 nt, Mycobacterium avium subsp. paratuberculosis
cgucacccccggcgcgacgg

SEQ ID NO: 904607 - RNA, 22 nt, Mycobacterium avium subsp. paratuberculosis
cgucacccccggcgcgacggca

SEQ ID NO: 904608 - RNA, 19 nt, Mycobacterium avium subsp. paratuberculosis
cgucaccaccgggucgucg

SEQ ID NO: 904609 - RNA, 20 nt, Mycobacterium avium subsp. paratuberculosis
cgucaccaccgggucgucgc

SEQ ID NO: 904610 - RNA, 21 nt, Mycobacterium avium subsp. paratuberculosis
cgucaccgccaggaccaccca

SEQ ID NO: 904611 - RNA, 13 nt, Mycobacterium avium subsp. paratuberculosis
cgucaccgccgca

SEQ ID NO: 904612 - RNA, 15 nt, Mycobacterium avium subsp. paratuberculosis
cgucaccgccgcacc

SEQ ID NO: 904613 - RNA, 18 nt, Mycobacterium avium subsp. paratuberculosis
cgucacccagaucgcccg

SEQ ID NO: 904614 - RNA, 22 nt, Mycobacterium avium subsp. paratuberculosis
cgucacccagaucgcccgggcg

SEQ ID NO: 904615 - RNA, 18 nt, Mycobacterium avium subsp. paratuberculosis
cgucaccgaccccucggc

SEQ ID NO: 904616 - RNA, 20 nt, Mycobacterium avium subsp. paratuberculosis
cgucaccgaccccucggcgg

SEQ ID NO: 904617 - RNA, 23 nt, Mycobacterium avium subsp. paratuberculosis
cgucaccgaccccucggcggccg

SEQ ID NO: 904618 - RNA, 16 nt, Mycobacterium avium subsp. paratuberculosis
cgucagcagcgcgacg

SEQ ID NO: 904619 - RNA, 22 nt, Mycobacterium avium subsp. paratuberculosis
cgucagccaaaccgugucccgg

SEQ ID NO: 904620 - RNA, 15 nt, Mycobacterium avium subsp. paratuberculosis
cgucagcaccgcgac

SEQ ID NO: 904621 - RNA, 17 nt, Mycobacterium avium subsp. paratuberculosis
cgucagcaccgcgacgg

SEQ ID NO: 904622 - RNA, 19 nt, Mycobacterium avium subsp. paratuberculosis
cgucagcaccgcgacggug

SEQ ID NO: 904623 - RNA, 20 nt, Mycobacterium avium subsp. paratuberculosis
cgucagcaccgcgacgguga

SEQ ID NO: 904624 - RNA, 13 nt, Mycobacterium avium subsp. paratuberculosis
cgucacgcuagcg

SEQ ID NO: 904625 - RNA, 21 nt, Mycobacterium avium subsp. paratuberculosis
cgucacggaucgcccacccgc

SEQ ID NO: 904626 - RNA, 23 nt, Mycobacterium avium subsp. paratuberculosis
cgucacggaucgcccacccgcac

SEQ ID NO: 904627 - RNA, 14 nt, Mycobacterium avium subsp. paratuberculosis
cgucacggccgucc

SEQ ID NO: 904628 - RNA, 15 nt, Mycobacterium avium subsp. paratuberculosis
cgucacggccgucca

SEQ ID NO: 904629 - RNA, 14 nt, Mycobacterium avium subsp. paratuberculosis
cgucacggcgagga

SEQ ID NO: 904630 - RNA, 18 nt, Mycobacterium avium subsp. paratuberculosis
cgucacgcugcgcgccga

SEQ ID NO: 904631 - RNA, 22 nt, Mycobacterium avium subsp. paratuberculosis
cgucacgcugcgcgccgauccg

SEQ ID NO: 904632 - RNA, 24 nt, Mycobacterium avium subsp. paratuberculosis
cgucacgcugcgcgccgauccggc

SEQ ID NO: 904633 - RNA, 12 nt, Mycobacterium avium subsp. paratuberculosis
cgucacgcuggc

SEQ ID NO: 904634 - RNA, 16 nt, Mycobacterium avium subsp. paratuberculosis
cgucacgcuggcguga

SEQ ID NO: 904635 - RNA, 18 nt, Mycobacterium avium subsp. paratuberculosis
cgucacgcuggcgugaca

SEQ ID NO: 904636 - RNA, 19 nt, Mycobacterium avium subsp. paratuberculosis
cgucacgcuggcgugacag

SEQ ID NO: 904637 - RNA, 19 nt, Mycobacterium avium subsp. paratuberculosis
cgucacgcuggcgugacgc

SEQ ID NO: 904638 - RNA, 22 nt, Mycobacterium avium subsp. paratuberculosis
cgucacgcuggcgugacggucg

SEQ ID NO: 904639 - RNA, 17 nt, Mycobacterium avium subsp. paratuberculosis
cgucacgcuggcguggc

SEQ ID NO: 904640 - RNA, 19 nt, Mycobacterium avium subsp. paratuberculosis
cgucacgcuggcguggcgc

SEQ ID NO: 904641 - RNA, 23 nt, Mycobacterium avium subsp. paratuberculosis
cgucacgcuggcguggcgccggc

SEQ ID NO: 904642 - RNA, 13 nt, Mycobacterium avium subsp. paratuberculosis
cgucacgcuggug

SEQ ID NO: 904643 - RNA, 21 nt, Mycobacterium avium subsp. paratuberculosis
cgucacgcuggugacgugcac

SEQ ID NO: 904644 - RNA, 18 nt, Mycobacterium avium subsp. paratuberculosis
cgucacgccagcgugacg

SEQ ID NO: 904645 - RNA, 22 nt, Mycobacterium avium subsp. paratuberculosis
cgucacgccagcgugacgcucg

SEQ ID NO: 904646 - RNA, 17 nt, Mycobacterium avium subsp. paratuberculosis
cgucacgccaguguggc

SEQ ID NO: 904647 - RNA, 21 nt, Mycobacterium avium subsp. paratuberculosis
cgucacgccaguguggccgcg

SEQ ID NO: 904648 - RNA, 19 nt, Mycobacterium avium subsp. paratuberculosis
cgucacgcccguugacgcc

SEQ ID NO: 904649 - RNA, 22 nt, Mycobacterium avium subsp. paratuberculosis
cgucacgccgcgcccgucgagc

SEQ ID NO: 904650 - RNA, 23 nt, Mycobacterium avium subsp. paratuberculosis
cgucacgccgcgcccgucgagcg

SEQ ID NO: 904651 - RNA, 22 nt, Mycobacterium avium subsp. paratuberculosis
cguaggugagcaacgccagcgc

SEQ ID NO: 904652 - RNA, 22 nt, Mycobacterium avium subsp. paratuberculosis
cguaggugcacagcccgugcag

SEQ ID NO: 904653 - RNA, 20 nt, Mycobacterium avium subsp. paratuberculosis
cguagggcagcccgagcaac

SEQ ID NO: 904654 - RNA, 23 nt, Mycobacterium avium subsp. paratuberculosis
cguaggcggcgagcugaucggcg

SEQ ID NO: 904655 - RNA, 17 nt, Mycobacterium avium subsp. paratuberculosis
cguaggcggccagcagc

SEQ ID NO: 904656 - RNA, 22 nt, Mycobacterium avium subsp. paratuberculosis
cguaggcggccagcagcaccag

SEQ ID NO: 904657 - RNA, 14 nt, Mycobacterium avium subsp. paratuberculosis
cguaggcggccaua

SEQ ID NO: 904658 - RNA, 18 nt, Mycobacterium avium subsp. paratuberculosis
cguagguggccagcacga

SEQ ID NO: 904659 - RNA, 21 nt, Mycobacterium avium subsp. paratuberculosis
cguaggugggcagcgcggcca

SEQ ID NO: 904660 - RNA, 15 nt, Mycobacterium avium subsp. paratuberculosis
cguaguagcggauca

SEQ ID NO: 904661 - RNA, 15 nt, Mycobacterium avium subsp. paratuberculosis
cguaguaggcgccga

SEQ ID NO: 904662 - RNA, 15 nt, Mycobacterium avium subsp. paratuberculosis
cguauuggcaggcga

SEQ ID NO: 904663 - RNA, 17 nt, Mycobacterium avium subsp. paratuberculosis
cguauugccgucggcgu

SEQ ID NO: 904664 - RNA, 21 nt, Mycobacterium avium subsp. paratuberculosis
cgucaaagccguucgcgccga

SEQ ID NO: 904665 - RNA, 23 nt, Mycobacterium avium subsp. paratuberculosis
cgucaaaccguuuucggcgcgca

SEQ ID NO: 904666 - RNA, 18 nt, Mycobacterium avium subsp. paratuberculosis
cguauucgacggcgacca

SEQ ID NO: 904667 - RNA, 14 nt, Mycobacterium avium subsp. paratuberculosis
cguauucgccgacg

SEQ ID NO: 904668 - RNA, 18 nt, Mycobacterium avium subsp. paratuberculosis
cguauucgucgucggccu

SEQ ID NO: 904669 - RNA, 15 nt, Mycobacterium avium subsp. paratuberculosis
cgucgauggcgcggc

SEQ ID NO: 904670 - RNA, 20 nt, Mycobacterium avium subsp. paratuberculosis
cgucgaugucgucgucgacg

SEQ ID NO: 904671 - RNA, 21 nt, Mycobacterium avium subsp. paratuberculosis
cgucgaugucgucgucgacgc

SEQ ID NO: 904672 - RNA, 15 nt, Mycobacterium avium subsp. paratuberculosis
cgucgaugugcucgg

SEQ ID NO: 904673 - RNA, 16 nt, Mycobacterium avium subsp. paratuberculosis
cgucgaugugggccgc

SEQ ID NO: 904674 - RNA, 21 nt, Mycobacterium avium subsp. paratuberculosis
cgucgaugugggccgcagcag

SEQ ID NO: 904675 - RNA, 17 nt, Mycobacterium avium subsp. paratuberculosis
cgucgcccacccgccag

SEQ ID NO: 904676 - RNA, 18 nt, Mycobacterium avium subsp. paratuberculosis
cgucgcccacccgccagc

SEQ ID NO: 904677 - RNA, 19 nt, Mycobacterium avium subsp. paratuberculosis
cgucgcccacccggggccg

SEQ ID NO: 904678 - RNA, 14 nt, Mycobacterium avium subsp. paratuberculosis
cgucgcccaccgug

SEQ ID NO: 904679 - RNA, 14 nt, Mycobacterium avium subsp. paratuberculosis
cgucgcccacgccg

SEQ ID NO: 904680 - RNA, 14 nt, Mycobacterium avium subsp. paratuberculosis
cgucgcccagcgug

SEQ ID NO: 904681 - RNA, 18 nt, Mycobacterium avium subsp. paratuberculosis
cgucgcccagcgugucgg

SEQ ID NO: 904682 - RNA, 23 nt, Mycobacterium avium subsp. paratuberculosis
cgucgcccagcgugucggcgauc

SEQ ID NO: 904683 - RNA, 12 nt, Mycobacterium avium subsp. paratuberculosis
cgucgccaucgu

SEQ ID NO: 904684 - RNA, 14 nt, Mycobacterium avium subsp. paratuberculosis
cgucgccaucgucu

SEQ ID NO: 904685 - RNA, 23 nt, Mycobacterium avium subsp. paratuberculosis
cgucgccaugccgucgcgcaccg

SEQ ID NO: 904686 - RNA, 16 nt, Mycobacterium avium subsp. paratuberculosis
cgucgaugucgcccgg

SEQ ID NO: 904687 - RNA, 22 nt, Mycobacterium avium subsp. paratuberculosis
cgucgaugucgcccggcgcggc

SEQ ID NO: 904688 - RNA, 23 nt, Mycobacterium avium subsp. paratuberculosis
cgucgaugucgcccggcgcggca

SEQ ID NO: 904689 - RNA, 15 nt, Mycobacterium avium subsp. paratuberculosis
cgucgaugucggcgg

SEQ ID NO: 904690 - RNA, 16 nt, Mycobacterium avium subsp. paratuberculosis
cgucgaugucggcggc

SEQ ID NO: 904691 - RNA, 19 nt, Mycobacterium avium subsp. paratuberculosis
cgucgaugucggcggcccg

SEQ ID NO: 904692 - RNA, 20 nt, Mycobacterium avium subsp. paratuberculosis
cgucgaugucggcggcccgg

SEQ ID NO: 904693 - RNA, 20 nt, Mycobacterium avium subsp. paratuberculosis
cgucgauggacagggcgaca

SEQ ID NO: 904694 - RNA, 15 nt, Mycobacterium avium subsp. paratuberculosis
cgucgauggccacca

SEQ ID NO: 904695 - RNA, 14 nt, Mycobacterium avium subsp. paratuberculosis
cgucgaucgcggcg

SEQ ID NO: 904696 - RNA, 16 nt, Mycobacterium avium subsp. paratuberculosis
cgucgaucgcggcgau

SEQ ID NO: 904697 - RNA, 17 nt, Mycobacterium avium subsp. paratuberculosis
cgucgaucgcggcgaug

SEQ ID NO: 904698 - RNA, 17 nt, Mycobacterium avium subsp. paratuberculosis
cgucgaucgcgucgaug

SEQ ID NO: 904699 - RNA, 21 nt, Mycobacterium avium subsp. paratuberculosis
cgucgaucgcgucgaugccgg

SEQ ID NO: 904700 - RNA, 17 nt, Mycobacterium avium subsp. paratuberculosis
cgucgaugcgcagcagc

SEQ ID NO: 904701 - RNA, 19 nt, Mycobacterium avium subsp. paratuberculosis
cgucgaugcgcagcagcgg

SEQ ID NO: 904702 - RNA, 20 nt, Mycobacterium avium subsp. paratuberculosis
cgucgaugcgcagcagcggc

SEQ ID NO: 904703 - RNA, 14 nt, Mycobacterium avium subsp. paratuberculosis
cgucgaucgccguc

SEQ ID NO: 904704 - RNA, 13 nt, Mycobacterium avium subsp. paratuberculosis
cgucgaucagcau

SEQ ID NO: 904705 - RNA, 18 nt, Mycobacterium avium subsp. paratuberculosis
cgucgaugcgcgccacca

SEQ ID NO: 904706 - RNA, 23 nt, Mycobacterium avium subsp. paratuberculosis
cgucgaucccggacuccucggug

SEQ ID NO: 904707 - RNA, 16 nt, Mycobacterium avium subsp. paratuberculosis
cgucgauccccacguc

SEQ ID NO: 904708 - RNA, 17 nt, Mycobacterium avium subsp. paratuberculosis
cgucgauccccacgucg

SEQ ID NO: 904709 - RNA, 20 nt, Mycobacterium avium subsp. paratuberculosis
cgucgauccccacgucgccg

SEQ ID NO: 904710 - RNA, 16 nt, Mycobacterium avium subsp. paratuberculosis
cgucgaucgacgccga

SEQ ID NO: 904711 - RNA, 18 nt, Mycobacterium avium subsp. paratuberculosis
cgucgaucgacgccgaca

SEQ ID NO: 904712 - RNA, 21 nt, Mycobacterium avium subsp. paratuberculosis
cgucgaucgacgccgacaucg

SEQ ID NO: 904713 - RNA, 13 nt, Mycobacterium avium subsp. paratuberculosis
cgucgaucagggc

SEQ ID NO: 904714 - RNA, 13 nt, Mycobacterium avium subsp. paratuberculosis
cgucgaucagcgc

SEQ ID NO: 904715 - RNA, 17 nt, Mycobacterium avium subsp. paratuberculosis
cgucgaucagcgcgccg

SEQ ID NO: 904716 - RNA, 19 nt, Mycobacterium avium subsp. paratuberculosis
cgucgaucagcgcgccgcc

SEQ ID NO: 904717 - RNA, 20 nt, Mycobacterium avium subsp. paratuberculosis
cgucgaucagcgcgccgccc

SEQ ID NO: 904718 - RNA, 18 nt, Mycobacterium avium subsp. paratuberculosis
cgucgaucaccugcgggc

SEQ ID NO: 904719 - RNA, 19 nt, Mycobacterium avium subsp. paratuberculosis
cgucgaucaccugcgggcg

SEQ ID NO: 904720 - RNA, 12 nt, Mycobacterium avium subsp. paratuberculosis
cgucgaucacgc

SEQ ID NO: 904721 - RNA, 13 nt, Mycobacterium avium subsp. paratuberculosis
cgucgaucacgcc

SEQ ID NO: 904722 - RNA, 14 nt, Mycobacterium avium subsp. paratuberculosis
cgucgaucacgccg

SEQ ID NO: 904723 - RNA, 15 nt, Mycobacterium avium subsp. paratuberculosis
cgucgaucacgccgc

SEQ ID NO: 904724 - RNA, 17 nt, Mycobacterium avium subsp. paratuberculosis
cgucgaguucgccgucg

SEQ ID NO: 904725 - RNA, 20 nt, Mycobacterium avium subsp. paratuberculosis
cgucgaguucgccgucgacg

SEQ ID NO: 904726 - RNA, 17 nt, Mycobacterium avium subsp. paratuberculosis
cgucgagucggccaccg

SEQ ID NO: 904727 - RNA, 23 nt, Mycobacterium avium subsp. paratuberculosis
cgucgagucggccaccgcggucg

SEQ ID NO: 904728 - RNA, 14 nt, Mycobacterium avium subsp. paratuberculosis
cgucgagugcucga

SEQ ID NO: 904729 - RNA, 19 nt, Mycobacterium avium subsp. paratuberculosis
cgucgagugcucgauggcc

SEQ ID NO: 904730 - RNA, 21 nt, Mycobacterium avium subsp. paratuberculosis
cgucgaguuguugggccgaaa

SEQ ID NO: 904731 - RNA, 13 nt, Mycobacterium avium subsp. paratuberculosis
cgucgaggucgcg

SEQ ID NO: 904732 - RNA, 17 nt, Mycobacterium avium subsp. paratuberculosis
cgucgaggucggacgcc

SEQ ID NO: 904733 - RNA, 21 nt, Mycobacterium avium subsp. paratuberculosis
cgucgaggucggacgccuccc

SEQ ID NO: 904734 - RNA, 22 nt, Mycobacterium avium subsp. paratuberculosis
cgucgagguguugucgugccgg

SEQ ID NO: 904735 - RNA, 17 nt, Mycobacterium avium subsp. paratuberculosis
cgucgaguccguugggg

SEQ ID NO: 904736 - RNA, 19 nt, Mycobacterium avium subsp. paratuberculosis
cgucgcgggaaucccaccc

SEQ ID NO: 904737 - RNA, 21 nt, Mycobacterium avium subsp. paratuberculosis
cgucgcggcugccggugcugc

SEQ ID NO: 904738 - RNA, 16 nt, Mycobacterium avium subsp. paratuberculosis
cgucgcggcgcggacc

SEQ ID NO: 904739 - RNA, 13 nt, Mycobacterium avium subsp. paratuberculosis
cgucgcggcgcua

SEQ ID NO: 904740 - RNA, 16 nt, Mycobacterium avium subsp. paratuberculosis
cgucgcggcggcccgu

SEQ ID NO: 904741 - RNA, 18 nt, Mycobacterium avium subsp. paratuberculosis
cgucgcggcggcccgucg

SEQ ID NO: 904742 - RNA, 13 nt, Mycobacterium avium subsp. paratuberculosis
cgucgcggcggcg

SEQ ID NO: 904743 - RNA, 14 nt, Mycobacterium avium subsp. paratuberculosis
cgucgcggcggcgc

SEQ ID NO: 904744 - RNA, 17 nt, Mycobacterium avium subsp. paratuberculosis
cgucgcggcggcgcugg

SEQ ID NO: 904745 - RNA, 13 nt, Mycobacterium avium subsp. paratuberculosis
cgucgcggcgguc

SEQ ID NO: 904746 - RNA, 18 nt, Mycobacterium avium subsp. paratuberculosis
cgucgcgaugcccaagcc

SEQ ID NO: 904747 - RNA, 20 nt, Mycobacterium avium subsp. paratuberculosis
cgucgcgaugcccaagccgg

SEQ ID NO: 904748 - RNA, 14 nt, Mycobacterium avium subsp. paratuberculosis
cgucgcgccagcgg

SEQ ID NO: 904749 - RNA, 17 nt, Mycobacterium avium subsp. paratuberculosis
cgucgcgccagcggucc

SEQ ID NO: 904750 - RNA, 18 nt, Mycobacterium avium subsp. paratuberculosis
cgucgcgccagcggucca

SEQ ID NO: 904751 - RNA, 20 nt, Mycobacterium avium subsp. paratuberculosis
cgucgcgccaggaccagcgg

SEQ ID NO: 904752 - RNA, 12 nt, Mycobacterium avium subsp. paratuberculosis
cgucgcgccgau

SEQ ID NO: 904753 - RNA, 23 nt, Mycobacterium avium subsp. paratuberculosis
cgucgcgccgauguacugggccg

SEQ ID NO: 904754 - RNA, 17 nt, Mycobacterium avium subsp. paratuberculosis
cgucgcgccgccacccc

SEQ ID NO: 904755 - RNA, 16 nt, Mycobacterium avium subsp. paratuberculosis
cgucgcgccgcucggc

SEQ ID NO: 904756 - RNA, 17 nt, Mycobacterium avium subsp. paratuberculosis
cgucgcgccgcucggcc

SEQ ID NO: 904757 - RNA, 14 nt, Mycobacterium avium subsp. paratuberculosis
cgucgcgcagcccg

SEQ ID NO: 904758 - RNA, 13 nt, Mycobacterium avium subsp. paratuberculosis
cgucgcgcagcga

SEQ ID NO: 904759 - RNA, 17 nt, Mycobacterium avium subsp. paratuberculosis
cgucgcgcaggucgggc

SEQ ID NO: 904760 - RNA, 13 nt, Mycobacterium avium subsp. paratuberculosis
cgucgcgcaccgc

SEQ ID NO: 904761 - RNA, 15 nt, Mycobacterium avium subsp. paratuberculosis
cgucgcgcagcagcg

SEQ ID NO: 904762 - RNA, 18 nt, Mycobacterium avium subsp. paratuberculosis
cgucgcgcagcagcggga

SEQ ID NO: 904763 - RNA, 15 nt, Mycobacterium avium subsp. paratuberculosis
cgucgcgcaccaccu

SEQ ID NO: 904764 - RNA, 17 nt, Mycobacterium avium subsp. paratuberculosis
cgucgcgcaccaccucg

SEQ ID NO: 904765 - RNA, 20 nt, Mycobacterium avium subsp. paratuberculosis
cgucgcgcaccaccucgauc

SEQ ID NO: 904766 - RNA, 17 nt, Mycobacterium avium subsp. paratuberculosis
cgucgcgcaccagcucg

SEQ ID NO: 904767 - RNA, 13 nt, Mycobacterium avium subsp. paratuberculosis
cgucgcgcaccca

SEQ ID NO: 904768 - RNA, 14 nt, Mycobacterium avium subsp. paratuberculosis
cgucgcgcacccag

SEQ ID NO: 904769 - RNA, 19 nt, Mycobacterium avium subsp. paratuberculosis
cgucgcgaugugcucgauc

SEQ ID NO: 904770 - RNA, 21 nt, Mycobacterium avium subsp. paratuberculosis
cgucgcgauagggccggccgg

SEQ ID NO: 904771 - RNA, 12 nt, Mycobacterium avium subsp. paratuberculosis
cgucgcgaucac

SEQ ID NO: 904772 - RNA, 13 nt, Mycobacterium avium subsp. paratuberculosis
cgucgcgaucagu

SEQ ID NO: 904773 - RNA, 13 nt, Mycobacterium avium subsp. paratuberculosis
cgucgccggcggg

SEQ ID NO: 904774 - RNA, 14 nt, Mycobacterium avium subsp. paratuberculosis
cgucgccggcgggg

SEQ ID NO: 904775 - RNA, 18 nt, Mycobacterium avium subsp. paratuberculosis
cgucgccggcugacugcc

SEQ ID NO: 904776 - RNA, 15 nt, Mycobacterium avium subsp. paratuberculosis
cgucgccggcgcgca

SEQ ID NO: 904777 - RNA, 21 nt, Mycobacterium avium subsp. paratuberculosis
cgucgccggcgcgggccgcag

SEQ ID NO: 904778 - RNA, 22 nt, Mycobacterium avium subsp. paratuberculosis
cgucgccgcgugggagagcggg

SEQ ID NO: 904779 - RNA, 22 nt, Mycobacterium avium subsp. paratuberculosis
cgucgccgcucuucgacgaccc

SEQ ID NO: 904780 - RNA, 13 nt, Mycobacterium avium subsp. paratuberculosis
cgucgccggccgc

SEQ ID NO: 904781 - RNA, 14 nt, Mycobacterium avium subsp. paratuberculosis
cgucgccggccgcg

SEQ ID NO: 904782 - RNA, 15 nt, Mycobacterium avium subsp. paratuberculosis
cgucgccggccgcgg

SEQ ID NO: 904783 - RNA, 16 nt, Mycobacterium avium subsp. paratuberculosis
cgucgccggccgcggu

SEQ ID NO: 904784 - RNA, 18 nt, Mycobacterium avium subsp. paratuberculosis
cgucgccggccugcccgc

SEQ ID NO: 904785 - RNA, 19 nt, Mycobacterium avium subsp. paratuberculosis
cgucgccgcgcgcgucgac

SEQ ID NO: 904786 - RNA, 13 nt, Mycobacterium avium subsp. paratuberculosis
cgucgccgccggu

SEQ ID NO: 904787 - RNA, 15 nt, Mycobacterium avium subsp. paratuberculosis
cgucgccgcgcccgc

SEQ ID NO: 904788 - RNA, 20 nt, Mycobacterium avium subsp. paratuberculosis
cgucgccgcgcccgccggcc

SEQ ID NO: 904789 - RNA, 15 nt, Mycobacterium avium subsp. paratuberculosis
cgucgccggaggcga

SEQ ID NO: 904790 - RNA, 17 nt, Mycobacterium avium subsp. paratuberculosis
cgucgccggaggcgauc

SEQ ID NO: 904791 - RNA, 22 nt, Mycobacterium avium subsp. paratuberculosis
cgucgcccugacacagcaccgg

SEQ ID NO: 904792 - RNA, 23 nt, Mycobacterium avium subsp. paratuberculosis
cgucgcccugacacagcaccggc

SEQ ID NO: 904793 - RNA, 19 nt, Mycobacterium avium subsp. paratuberculosis
cgucgcccgucucggcgug

SEQ ID NO: 904794 - RNA, 14 nt, Mycobacterium avium subsp. paratuberculosis
cgucgcccugacac

SEQ ID NO: 904795 - RNA, 15 nt, Mycobacterium avium subsp. paratuberculosis
cgucgccgccggugc

SEQ ID NO: 904796 - RNA, 14 nt, Mycobacterium avium subsp. paratuberculosis
cgucgccccgcacc

SEQ ID NO: 904797 - RNA, 15 nt, Mycobacterium avium subsp. paratuberculosis
cgucgccccgcaccg

SEQ ID NO: 904798 - RNA, 18 nt, Mycobacterium avium subsp. paratuberculosis
cgucgccccgcaccgagc

SEQ ID NO: 904799 - RNA, 15 nt, Mycobacterium avium subsp. paratuberculosis
cgucgcccgaacuca

SEQ ID NO: 904800 - RNA, 14 nt, Mycobacterium avium subsp. paratuberculosis
cgucgcccgcccag

SEQ ID NO: 904801 - RNA, 12 nt, Mycobacterium avium subsp. paratuberculosis
cgucgcccgccg

SEQ ID NO: 904802 - RNA, 14 nt, Mycobacterium avium subsp. paratuberculosis
cgucgcccgccgac

SEQ ID NO: 904803 - RNA, 14 nt, Mycobacterium avium subsp. paratuberculosis
cgucgcccggcguc

SEQ ID NO: 904804 - RNA, 15 nt, Mycobacterium avium subsp. paratuberculosis
cgucgcccggcgucc

SEQ ID NO: 904805 - RNA, 19 nt, Mycobacterium avium subsp. paratuberculosis
cgucgcccggcguccagug

SEQ ID NO: 904806 - RNA, 20 nt, Mycobacterium avium subsp. paratuberculosis
cgucgagcagcaccacccgc

SEQ ID NO: 904807 - RNA, 22 nt, Mycobacterium avium subsp. paratuberculosis
cgucgagcagcaccacccgcac

SEQ ID NO: 904808 - RNA, 12 nt, Mycobacterium avium subsp. paratuberculosis
cgucgagcaccu

SEQ ID NO: 904809 - RNA, 13 nt, Mycobacterium avium subsp. paratuberculosis
cgucgagcaccug

SEQ ID NO: 904810 - RNA, 18 nt, Mycobacterium avium subsp. paratuberculosis
cgucgagcaccacccggg

SEQ ID NO: 904811 - RNA, 13 nt, Mycobacterium avium subsp. paratuberculosis
cgucgagcaccac

SEQ ID NO: 904812 - RNA, 16 nt, Mycobacterium avium subsp. paratuberculosis
cgucgagcaccacccg

SEQ ID NO: 904813 - RNA, 12 nt, Mycobacterium avium subsp. paratuberculosis
cgucgagcaccg

SEQ ID NO: 904814 - RNA, 17 nt, Mycobacterium avium subsp. paratuberculosis
cgucgagcaccgcgucc

SEQ ID NO: 904815 - RNA, 18 nt, Mycobacterium avium subsp. paratuberculosis
cgucgagcaccgcguccg

SEQ ID NO: 904816 - RNA, 14 nt, Mycobacterium avium subsp. paratuberculosis
cgucgagcaccggc

SEQ ID NO: 904817 - RNA, 15 nt, Mycobacterium avium subsp. paratuberculosis
cgucgagcaccggca

SEQ ID NO: 904818 - RNA, 16 nt, Mycobacterium avium subsp. paratuberculosis
cgucgagcaccggcug

SEQ ID NO: 904819 - RNA, 17 nt, Mycobacterium avium subsp. paratuberculosis
cgucgagcaccggcugg

SEQ ID NO: 904820 - RNA, 20 nt, Mycobacterium avium subsp. paratuberculosis
cgucgagcaccggcuggugc

SEQ ID NO: 904821 - RNA, 18 nt, Mycobacterium avium subsp. paratuberculosis
cgucgagcauccggcgca

SEQ ID NO: 904822 - RNA, 16 nt, Mycobacterium avium subsp. paratuberculosis
cgucgagcagcgcccg

SEQ ID NO: 904823 - RNA, 17 nt, Mycobacterium avium subsp. paratuberculosis
cgucgaggcgcugcagc

SEQ ID NO: 904824 - RNA, 15 nt, Mycobacterium avium subsp. paratuberculosis
cgucgagggccaccg

SEQ ID NO: 904825 - RNA, 16 nt, Mycobacterium avium subsp. paratuberculosis
cgucgagggccaccgg

SEQ ID NO: 904826 - RNA, 20 nt, Mycobacterium avium subsp. paratuberculosis
cgucgagggccaccggcucc

SEQ ID NO: 904827 - RNA, 14 nt, Mycobacterium avium subsp. paratuberculosis
cgucgagggcgccg

SEQ ID NO: 904828 - RNA, 17 nt, Mycobacterium avium subsp. paratuberculosis
cgucgagggcgccguug

SEQ ID NO: 904829 - RNA, 15 nt, Mycobacterium avium subsp. paratuberculosis
cgucgaccaccgccg

SEQ ID NO: 904830 - RNA, 20 nt, Mycobacterium avium subsp. paratuberculosis
cgucgaccagggcgaucacc

SEQ ID NO: 904831 - RNA, 15 nt, Mycobacterium avium subsp. paratuberculosis
cgucgaccagguagg

SEQ ID NO: 904832 - RNA, 19 nt, Mycobacterium avium subsp. paratuberculosis
cgucgaccccgccggcccg

SEQ ID NO: 904833 - RNA, 23 nt, Mycobacterium avium subsp. paratuberculosis
cgucgaccccgccggcccggucg

SEQ ID NO: 904834 - RNA, 16 nt, Mycobacterium avium subsp. paratuberculosis
cgucgacgaccaccac

SEQ ID NO: 904835 - RNA, 17 nt, Mycobacterium avium subsp. paratuberculosis
cgucgacgaccaccacc

SEQ ID NO: 904836 - RNA, 14 nt, Mycobacterium avium subsp. paratuberculosis
cgucgacgacccgu

SEQ ID NO: 904837 - RNA, 13 nt, Mycobacterium avium subsp. paratuberculosis
cgucgacgacgaa

SEQ ID NO: 904838 - RNA, 21 nt, Mycobacterium avium subsp. paratuberculosis
cgucgacgagcccgccggcgg

SEQ ID NO: 904839 - RNA, 23 nt, Mycobacterium avium subsp. paratuberculosis
cgucgacgagcccgccggcgggu

SEQ ID NO: 904840 - RNA, 23 nt, Mycobacterium avium subsp. paratuberculosis
cgucgacgaacuuggacggaucg

SEQ ID NO: 904841 - RNA, 21 nt, Mycobacterium avium subsp. paratuberculosis
cgucgacgauggcccggaccg

SEQ ID NO: 904842 - RNA, 16 nt, Mycobacterium avium subsp. paratuberculosis
cgucgacgccgcugcc

SEQ ID NO: 904843 - RNA, 17 nt, Mycobacterium avium subsp. paratuberculosis
cgucgacgccgcugccg

SEQ ID NO: 904844 - RNA, 18 nt, Mycobacterium avium subsp. paratuberculosis
cgucgacgccgcugccgg

SEQ ID NO: 904845 - RNA, 22 nt, Mycobacterium avium subsp. paratuberculosis
cgucgacgcgcugcuugacccg

SEQ ID NO: 904846 - RNA, 14 nt, Mycobacterium avium subsp. paratuberculosis
cgucgacgcgggcg

SEQ ID NO: 904847 - RNA, 16 nt, Mycobacterium avium subsp. paratuberculosis
cgucgacgcgggcgac

SEQ ID NO: 904848 - RNA, 19 nt, Mycobacterium avium subsp. paratuberculosis
cgucgacgcgggcgacguc

SEQ ID NO: 904849 - RNA, 13 nt, Mycobacterium avium subsp. paratuberculosis
cgucgacgcgguc

SEQ ID NO: 904850 - RNA, 15 nt, Mycobacterium avium subsp. paratuberculosis
cgucgacgcggucga

SEQ ID NO: 904851 - RNA, 22 nt, Mycobacterium avium subsp. paratuberculosis
cgucgacgcggugacaugcccg

SEQ ID NO: 904852 - RNA, 16 nt, Mycobacterium avium subsp. paratuberculosis
cgucgacgcgugcguc

SEQ ID NO: 904853 - RNA, 20 nt, Mycobacterium avium subsp. paratuberculosis
cgucgacgcugaccguggug

SEQ ID NO: 904854 - RNA, 15 nt, Mycobacterium avium subsp. paratuberculosis
cgucgacggcagcgc

SEQ ID NO: 904855 - RNA, 20 nt, Mycobacterium avium subsp. paratuberculosis
cgucgacggccgccgcgacg

SEQ ID NO: 904856 - RNA, 17 nt, Mycobacterium avium subsp. paratuberculosis
cgucgacggccgcgccg

SEQ ID NO: 904857 - RNA, 19 nt, Mycobacterium avium subsp. paratuberculosis
cgucgacggccgcgccgaa

SEQ ID NO: 904858 - RNA, 14 nt, Mycobacterium avium subsp. paratuberculosis
cgucgacggcgccg

SEQ ID NO: 904859 - RNA, 17 nt, Mycobacterium avium subsp. paratuberculosis
cgucgacggcgccggac

SEQ ID NO: 904860 - RNA, 13 nt, Mycobacterium avium subsp. paratuberculosis
cguccgcgucggc

SEQ ID NO: 904861 - RNA, 19 nt, Mycobacterium avium subsp. paratuberculosis
cguccgggcguagugcagc

SEQ ID NO: 904862 - RNA, 14 nt, Mycobacterium avium subsp. paratuberculosis
cguccggggccggu

SEQ ID NO: 904863 - RNA, 21 nt, Mycobacterium avium subsp. paratuberculosis
cguccggggccggugcguccg

SEQ ID NO: 904864 - RNA, 22 nt, Mycobacterium avium subsp. paratuberculosis
cguccgggucgcacagccgcag

SEQ ID NO: 904865 - RNA, 17 nt, Mycobacterium avium subsp. paratuberculosis
cguccgggugcgggcug

SEQ ID NO: 904866 - RNA, 12 nt, Mycobacterium avium subsp. paratuberculosis
cguccgcggcgg

SEQ ID NO: 904867 - RNA, 13 nt, Mycobacterium avium subsp. paratuberculosis
cguccgcggcgga

SEQ ID NO: 904868 - RNA, 13 nt, Mycobacterium avium subsp. paratuberculosis
cguccgcggcggc

SEQ ID NO: 904869 - RNA, 14 nt, Mycobacterium avium subsp. paratuberculosis
cguccgcggcggcc

SEQ ID NO: 904870 - RNA, 16 nt, Mycobacterium avium subsp. paratuberculosis
cguccgcggcggccag

SEQ ID NO: 904871 - RNA, 15 nt, Mycobacterium avium subsp. paratuberculosis
cguccgcggcggcgu

SEQ ID NO: 904872 - RNA, 21 nt, Mycobacterium avium subsp. paratuberculosis
cguccgcggcggcgugccgcc

SEQ ID NO: 904873 - RNA, 12 nt, Mycobacterium avium subsp. paratuberculosis
cguccgcgguga

SEQ ID NO: 904874 - RNA, 18 nt, Mycobacterium avium subsp. paratuberculosis
cguccgcggugagcaccg

SEQ ID NO: 904875 - RNA, 19 nt, Mycobacterium avium subsp. paratuberculosis
cguccgcggugagcaccgg

SEQ ID NO: 904876 - RNA, 20 nt, Mycobacterium avium subsp. paratuberculosis
cguccgcgguuucaccgugc

SEQ ID NO: 904877 - RNA, 22 nt, Mycobacterium avium subsp. paratuberculosis
cguccgcgguuucaccgugcgc

SEQ ID NO: 904878 - RNA, 17 nt, Mycobacterium avium subsp. paratuberculosis
cguccgguucggcggca

SEQ ID NO: 904879 - RNA, 14 nt, Mycobacterium avium subsp. paratuberculosis
cguccggucagacc

SEQ ID NO: 904880 - RNA, 19 nt, Mycobacterium avium subsp. paratuberculosis
cguccggucgcugggcucg

SEQ ID NO: 904881 - RNA, 24 nt, Mycobacterium avium subsp. paratuberculosis
cguccggucgcugggcucgagugc

SEQ ID NO: 904882 - RNA, 13 nt, Mycobacterium avium subsp. paratuberculosis
cguccgugccguc

SEQ ID NO: 904883 - RNA, 15 nt, Mycobacterium avium subsp. paratuberculosis
cguccgugccguccg

SEQ ID NO: 904884 - RNA, 19 nt, Mycobacterium avium subsp. paratuberculosis
cguccgugcugccggccgg

SEQ ID NO: 904885 - RNA, 20 nt, Mycobacterium avium subsp. paratuberculosis
cguccgugcugccggccggc

SEQ ID NO: 904886 - RNA, 18 nt, Mycobacterium avium subsp. paratuberculosis
cgucgaccagccgcauca

SEQ ID NO: 904887 - RNA, 12 nt, Mycobacterium avium subsp. paratuberculosis
cgucgaccagcg

SEQ ID NO: 904888 - RNA, 15 nt, Mycobacterium avium subsp. paratuberculosis
cgucgaccagcgggc

SEQ ID NO: 904889 - RNA, 21 nt, Mycobacterium avium subsp. paratuberculosis
cgucgaccagcgggcugucgg

SEQ ID NO: 904890 - RNA, 21 nt, Mycobacterium avium subsp. paratuberculosis
cgucgaccagcuugucgaucu

SEQ ID NO: 904891 - RNA, 19 nt, Mycobacterium avium subsp. paratuberculosis
cgucgaccaggacgucggc

SEQ ID NO: 904892 - RNA, 14 nt, Mycobacterium avium subsp. paratuberculosis
cgucgaccaacgcc

SEQ ID NO: 904893 - RNA, 18 nt, Mycobacterium avium subsp. paratuberculosis
cgucgaccaacgccaugg

SEQ ID NO: 904894 - RNA, 16 nt, Mycobacterium avium subsp. paratuberculosis
cgucgaccaccacgac

SEQ ID NO: 904895 - RNA, 20 nt, Mycobacterium avium subsp. paratuberculosis
cgucgaccaccacgaccagu

SEQ ID NO: 904896 - RNA, 17 nt, Mycobacterium avium subsp. paratuberculosis
cgucgaacucguggaug

SEQ ID NO: 904897 - RNA, 22 nt, Mycobacterium avium subsp. paratuberculosis
cgucgaacucguggauguuguc

SEQ ID NO: 904898 - RNA, 17 nt, Mycobacterium avium subsp. paratuberculosis
cgucgaagagcuggucg

SEQ ID NO: 904899 - RNA, 23 nt, Mycobacterium avium subsp. paratuberculosis
cgucgaagagcuggucgcccacc

SEQ ID NO: 904900 - RNA, 13 nt, Mycobacterium avium subsp. paratuberculosis
cgucgacacgccg

SEQ ID NO: 904901 - RNA, 16 nt, Mycobacterium avium subsp. paratuberculosis
cgucgacacgccggcc

SEQ ID NO: 904902 - RNA, 17 nt, Mycobacterium avium subsp. paratuberculosis
cgucgacacgccggccg

SEQ ID NO: 904903 - RNA, 18 nt, Mycobacterium avium subsp. paratuberculosis
cgucgacacgccggccgu

SEQ ID NO: 904904 - RNA, 16 nt, Mycobacterium avium subsp. paratuberculosis
cgucgaagccgaucac

SEQ ID NO: 904905 - RNA, 22 nt, Mycobacterium avium subsp. paratuberculosis
cgucgaacggcgucuggccgga

SEQ ID NO: 904906 - RNA, 18 nt, Mycobacterium avium subsp. paratuberculosis
cgucgaacgggccgggca

SEQ ID NO: 904907 - RNA, 21 nt, Mycobacterium avium subsp. paratuberculosis
cgucgaacgggccgggcaccg

SEQ ID NO: 904908 - RNA, 16 nt, Mycobacterium avium subsp. paratuberculosis
cgucgaacugcagccg

SEQ ID NO: 904909 - RNA, 20 nt, Mycobacterium avium subsp. paratuberculosis
cgucgaacugcagccggcca

SEQ ID NO: 904910 - RNA, 21 nt, Mycobacterium avium subsp. paratuberculosis
cgucgaacugcagccggccaa

SEQ ID NO: 904911 - RNA, 20 nt, Mycobacterium avium subsp. paratuberculosis
cgucgaagaagucguucagc

SEQ ID NO: 904912 - RNA, 21 nt, Mycobacterium avium subsp. paratuberculosis
cgucgaagaagucguucagcu

SEQ ID NO: 904913 - RNA, 12 nt, Mycobacterium avium subsp. paratuberculosis
cgucgaacagga

SEQ ID NO: 904914 - RNA, 23 nt, Mycobacterium avium subsp. paratuberculosis
cgucgaacagccgggccgcccgc

SEQ ID NO: 904915 - RNA, 16 nt, Mycobacterium avium subsp. paratuberculosis
cgucgaacagcgggca

SEQ ID NO: 904916 - RNA, 17 nt, Mycobacterium avium subsp. paratuberculosis
cgucgaacagcgggcag

SEQ ID NO: 904917 - RNA, 22 nt, Mycobacterium avium subsp. paratuberculosis
cgucgaacccgaaaagcaccag

SEQ ID NO: 904918 - RNA, 23 nt, Mycobacterium avium subsp. paratuberculosis
cgucgaacccgaaaagcaccagg

SEQ ID NO: 904919 - RNA, 18 nt, Mycobacterium avium subsp. paratuberculosis
cgucgaacccgaccccgg

SEQ ID NO: 904920 - RNA, 23 nt, Mycobacterium avium subsp. paratuberculosis
cgucgaacccgaccccggcgagc

SEQ ID NO: 904921 - RNA, 15 nt, Mycobacterium avium subsp. paratuberculosis
cgucgaacgcggcga

SEQ ID NO: 904922 - RNA, 22 nt, Mycobacterium avium subsp. paratuberculosis
cgucgaacgcguacacggcccg

SEQ ID NO: 904923 - RNA, 21 nt, Mycobacterium avium subsp. paratuberculosis
cgucaggcccagcgaggcggc

SEQ ID NO: 904924 - RNA, 22 nt, Mycobacterium avium subsp. paratuberculosis
cgucagcaucgccgucgucagc

SEQ ID NO: 904925 - RNA, 16 nt, Mycobacterium avium subsp. paratuberculosis
cgucagcccgcgucgc

SEQ ID NO: 904926 - RNA, 18 nt, Mycobacterium avium subsp. paratuberculosis
cgucagcccgcgucgcgc

SEQ ID NO: 904927 - RNA, 19 nt, Mycobacterium avium subsp. paratuberculosis
cgucagcccgcgucgcgca

SEQ ID NO: 904928 - RNA, 18 nt, Mycobacterium avium subsp. paratuberculosis
cgucagccgggccagccc

SEQ ID NO: 904929 - RNA, 22 nt, Mycobacterium avium subsp. paratuberculosis
cgucagccgggccagcccggga

SEQ ID NO: 904930 - RNA, 13 nt, Mycobacterium avium subsp. paratuberculosis
cgucagccgucgu

SEQ ID NO: 904931 - RNA, 17 nt, Mycobacterium avium subsp. paratuberculosis
cgucagggcgacuccgg

SEQ ID NO: 904932 - RNA, 14 nt, Mycobacterium avium subsp. paratuberculosis
cgucaggcgcuggg

SEQ ID NO: 904933 - RNA, 12 nt, Mycobacterium avium subsp. paratuberculosis
cgucaggccggu

SEQ ID NO: 904934 - RNA, 18 nt, Mycobacterium avium subsp. paratuberculosis
cgucaggccguagcggcu

SEQ ID NO: 904935 - RNA, 19 nt, Mycobacterium avium subsp. paratuberculosis
cgucaggccgugaucggcc

SEQ ID NO: 904936 - RNA, 22 nt, Mycobacterium avium subsp. paratuberculosis
cgucaggccugguaggccgccu

SEQ ID NO: 904937 - RNA, 19 nt, Mycobacterium avium subsp. paratuberculosis
cgucagggugacguggcgg

SEQ ID NO: 904938 - RNA, 22 nt, Mycobacterium avium subsp. paratuberculosis
cgucagggugacguggcggccg

SEQ ID NO: 904939 - RNA, 16 nt, Mycobacterium avium subsp. paratuberculosis
cgucaggguggccucg

SEQ ID NO: 904940 - RNA, 18 nt, Mycobacterium avium subsp. paratuberculosis
cgucaggguggccucguc

SEQ ID NO: 904941 - RNA, 19 nt, Mycobacterium avium subsp. paratuberculosis
cgucaggguggccucgucg

SEQ ID NO: 904942 - RNA, 21 nt, Mycobacterium avium subsp. paratuberculosis
cgucaggguggccucgucggc

SEQ ID NO: 904943 - RNA, 19 nt, Mycobacterium avium subsp. paratuberculosis
cgucaggguggugcccccg

SEQ ID NO: 904944 - RNA, 14 nt, Mycobacterium avium subsp. paratuberculosis
cgucaggucaccga

SEQ ID NO: 904945 - RNA, 16 nt, Mycobacterium avium subsp. paratuberculosis
cgucaggucaccgagc

SEQ ID NO: 904946 - RNA, 13 nt, Mycobacterium avium subsp. paratuberculosis
cgucaggucgacc

SEQ ID NO: 904947 - RNA, 17 nt, Mycobacterium avium subsp. paratuberculosis
cgucaggucgaccggcu

SEQ ID NO: 904948 - RNA, 12 nt, Mycobacterium avium subsp. paratuberculosis
cgucaggucgcg

SEQ ID NO: 904949 - RNA, 14 nt, Mycobacterium avium subsp. paratuberculosis
cgucaggucgcggu

SEQ ID NO: 904950 - RNA, 22 nt, Mycobacterium avium subsp. paratuberculosis
cgucaggucgcgguagucggga

SEQ ID NO: 904951 - RNA, 17 nt, Mycobacterium avium subsp. paratuberculosis
cgucaggucuucggucg

SEQ ID NO: 904952 - RNA, 20 nt, Mycobacterium avium subsp. paratuberculosis
cgucaucaucaccgggaugg

SEQ ID NO: 904953 - RNA, 21 nt, Mycobacterium avium subsp. paratuberculosis
cgucagggguuggcgcgcaga

SEQ ID NO: 904954 - RNA, 13 nt, Mycobacterium avium subsp. paratuberculosis
cgucagguucgag

SEQ ID NO: 904955 - RNA, 16 nt, Mycobacterium avium subsp. paratuberculosis
cgucagguucgaggug

SEQ ID NO: 904956 - RNA, 19 nt, Mycobacterium avium subsp. paratuberculosis
cgucauccccaucucgagc

SEQ ID NO: 904957 - RNA, 20 nt, Mycobacterium avium subsp. paratuberculosis
cgucauccccaucucgagca

SEQ ID NO: 904958 - RNA, 13 nt, Mycobacterium avium subsp. paratuberculosis
cgucauccggcug

SEQ ID NO: 904959 - RNA, 13 nt, Mycobacterium avium subsp. paratuberculosis
cgucaucgccgac

SEQ ID NO: 904960 - RNA, 18 nt, Mycobacterium avium subsp. paratuberculosis
cgucaucgacuugccgcc

SEQ ID NO: 904961 - RNA, 19 nt, Mycobacterium avium subsp. paratuberculosis
cgucaucgacuugccgccg

SEQ ID NO: 904962 - RNA, 13 nt, Mycobacterium avium subsp. paratuberculosis
cgucaucuugucg

SEQ ID NO: 904963 - RNA, 15 nt, Mycobacterium avium subsp. paratuberculosis
cgucaucgggcccga

SEQ ID NO: 904964 - RNA, 16 nt, Mycobacterium avium subsp. paratuberculosis
cgucaucgggcccgac

SEQ ID NO: 904965 - RNA, 22 nt, Mycobacterium avium subsp. paratuberculosis
cguccacaccguugggggucga

SEQ ID NO: 904966 - RNA, 16 nt, Mycobacterium avium subsp. paratuberculosis
cguccacagccggcgg

SEQ ID NO: 904967 - RNA, 18 nt, Mycobacterium avium subsp. paratuberculosis
cguccaaugcgccgaugg

SEQ ID NO: 904968 - RNA, 20 nt, Mycobacterium avium subsp. paratuberculosis
cguccaaugcgccgauggug

SEQ ID NO: 904969 - RNA, 15 nt, Mycobacterium avium subsp. paratuberculosis
cguccaccagcacca

SEQ ID NO: 904970 - RNA, 13 nt, Mycobacterium avium subsp. paratuberculosis
cguccaccagcuc

SEQ ID NO: 904971 - RNA, 20 nt, Mycobacterium avium subsp. paratuberculosis
cguccaccaggguggccgcc

SEQ ID NO: 904972 - RNA, 21 nt, Mycobacterium avium subsp. paratuberculosis
cguccaccaggguggccgcca

SEQ ID NO: 904973 - RNA, 22 nt, Mycobacterium avium subsp. paratuberculosis
cguccaccaggguggccgccac

SEQ ID NO: 904974 - RNA, 13 nt, Mycobacterium avium subsp. paratuberculosis
cguccacccggcc

SEQ ID NO: 904975 - RNA, 21 nt, Mycobacterium avium subsp. paratuberculosis
cguccacccggcccaccaccg

SEQ ID NO: 904976 - RNA, 21 nt, Mycobacterium avium subsp. paratuberculosis
cguccaccgacaggucgaagg

SEQ ID NO: 904977 - RNA, 20 nt, Mycobacterium avium subsp. paratuberculosis
cguccaccggauggcgcccg

SEQ ID NO: 904978 - RNA, 16 nt, Mycobacterium avium subsp. paratuberculosis
cguccaccggcacggc

SEQ ID NO: 904979 - RNA, 17 nt, Mycobacterium avium subsp. paratuberculosis
cguccaccggucgacga

SEQ ID NO: 904980 - RNA, 15 nt, Mycobacterium avium subsp. paratuberculosis
cguccacgccgcggg

SEQ ID NO: 904981 - RNA, 17 nt, Mycobacterium avium subsp. paratuberculosis
cguccacgccgcgggag

SEQ ID NO: 904982 - RNA, 16 nt, Mycobacterium avium subsp. paratuberculosis
cguccacgcuggcggu

SEQ ID NO: 904983 - RNA, 17 nt, Mycobacterium avium subsp. paratuberculosis
cguccacgcuggcggug

SEQ ID NO: 904984 - RNA, 23 nt, Mycobacterium avium subsp. paratuberculosis
cguccacguugaugccgcccagc

SEQ ID NO: 904985 - RNA, 23 nt, Mycobacterium avium subsp. paratuberculosis
cguccacuccaauacggcccggc

SEQ ID NO: 904986 - RNA, 14 nt, Mycobacterium avium subsp. paratuberculosis
cguccagaccggcc

SEQ ID NO: 904987 - RNA, 15 nt, Mycobacterium avium subsp. paratuberculosis
cguccagaccggccg

SEQ ID NO: 904988 - RNA, 17 nt, Mycobacterium avium subsp. paratuberculosis
cguccagaccggccggg

SEQ ID NO: 904989 - RNA, 20 nt, Mycobacterium avium subsp. paratuberculosis
cguccagaccggccggggcg

SEQ ID NO: 904990 - RNA, 14 nt, Mycobacterium avium subsp. paratuberculosis
cguccacgaccccg

SEQ ID NO: 904991 - RNA, 22 nt, Mycobacterium avium subsp. paratuberculosis
cgucaugccguaaguggcgccg

SEQ ID NO: 904992 - RNA, 18 nt, Mycobacterium avium subsp. paratuberculosis
cgucauuccgccgcgccc

SEQ ID NO: 904993 - RNA, 16 nt, Mycobacterium avium subsp. paratuberculosis
cgucauuucggucggc

SEQ ID NO: 904994 - RNA, 19 nt, Mycobacterium avium subsp. paratuberculosis
cgucauuucggucggcagg

SEQ ID NO: 904995 - RNA, 19 nt, Mycobacterium avium subsp. paratuberculosis
cgucauggccgucgggucg

SEQ ID NO: 904996 - RNA, 23 nt, Mycobacterium avium subsp. paratuberculosis
cgucauggacagccaccgugccu

SEQ ID NO: 904997 - RNA, 22 nt, Mycobacterium avium subsp. paratuberculosis
cguccagcggguugccgcuggc

SEQ ID NO: 904998 - RNA, 15 nt, Mycobacterium avium subsp. paratuberculosis
cguccaucauggcgc

SEQ ID NO: 904999 - RNA, 19 nt, Mycobacterium avium subsp. paratuberculosis
cguccaucauggcgcugcg

SEQ ID NO: 905000 - RNA, 19 nt, Mycobacterium avium subsp. paratuberculosis
cguccccaccaccgacagc

SEQ ID NO: 905001 - RNA, 23 nt, Mycobacterium avium subsp. paratuberculosis
cguccccaccaccgacagcaccc

SEQ ID NO: 905002 - RNA, 18 nt, Mycobacterium avium subsp. paratuberculosis
cguccauccgcuugccgc

SEQ ID NO: 905003 - RNA, 13 nt, Mycobacterium avium subsp. paratuberculosis
cguccccgcgcgg

SEQ ID NO: 905004 - RNA, 14 nt, Mycobacterium avium subsp. paratuberculosis
cguccccgcgcggc

SEQ ID NO: 905005 - RNA, 16 nt, Mycobacterium avium subsp. paratuberculosis
cguccccgggcgugcc

SEQ ID NO: 905006 - RNA, 17 nt, Mycobacterium avium subsp. paratuberculosis
cgucccgcccggcgccg

SEQ ID NO: 905007 - RNA, 19 nt, Mycobacterium avium subsp. paratuberculosis
cgucccgcccggcgccggc

SEQ ID NO: 905008 - RNA, 16 nt, Mycobacterium avium subsp. paratuberculosis
cguccccgugcagccg

SEQ ID NO: 905009 - RNA, 13 nt, Mycobacterium avium subsp. paratuberculosis
cgucccgcgccac

SEQ ID NO: 905010 - RNA, 21 nt, Mycobacterium avium subsp. paratuberculosis
cgucccgcgccacguaucgcg

SEQ ID NO: 905011 - RNA, 13 nt, Mycobacterium avium subsp. paratuberculosis
cgucccgcgccgg

SEQ ID NO: 905012 - RNA, 14 nt, Mycobacterium avium subsp. paratuberculosis
cgucccgcgccgga

SEQ ID NO: 905013 - RNA, 21 nt, Mycobacterium avium subsp. paratuberculosis
cgucccgcgcgggggccgccg

SEQ ID NO: 905014 - RNA, 13 nt, Mycobacterium avium subsp. paratuberculosis
cguccgacaccac

SEQ ID NO: 905015 - RNA, 14 nt, Mycobacterium avium subsp. paratuberculosis
cguccgacaccacc

SEQ ID NO: 905016 - RNA, 16 nt, Mycobacterium avium subsp. paratuberculosis
cguccgacaccaccug

SEQ ID NO: 905017 - RNA, 23 nt, Mycobacterium avium subsp. paratuberculosis
cgucccgcucgaucuggcggacc

SEQ ID NO: 905018 - RNA, 13 nt, Mycobacterium avium subsp. paratuberculosis
cguccgacagcgc

SEQ ID NO: 905019 - RNA, 20 nt, Mycobacterium avium subsp. paratuberculosis
cguccgacagcgccugcccg

SEQ ID NO: 905020 - RNA, 21 nt, Mycobacterium avium subsp. paratuberculosis
cguccgacggcuaccugacca

SEQ ID NO: 905021 - RNA, 18 nt, Mycobacterium avium subsp. paratuberculosis
cguccgacggcugggugg

SEQ ID NO: 905022 - RNA, 15 nt, Mycobacterium avium subsp. paratuberculosis
cguccgaggccccgc

SEQ ID NO: 905023 - RNA, 17 nt, Mycobacterium avium subsp. paratuberculosis
cguccgaggccccgcca

SEQ ID NO: 905024 - RNA, 20 nt, Mycobacterium avium subsp. paratuberculosis
cguccgaggccccgccagau

SEQ ID NO: 905025 - RNA, 17 nt, Mycobacterium avium subsp. paratuberculosis
cguccgaggcgguuccg

SEQ ID NO: 905026 - RNA, 23 nt, Mycobacterium avium subsp. paratuberculosis
cguccgaggcgguuccgguggcg

SEQ ID NO: 905027 - RNA, 22 nt, Mycobacterium avium subsp. paratuberculosis
cguccgauaccagccgcggacg

SEQ ID NO: 905028 - RNA, 23 nt, Mycobacterium avium subsp. paratuberculosis
cguccgauaccagccgcggacgg

SEQ ID NO: 905029 - RNA, 19 nt, Mycobacterium avium subsp. paratuberculosis
cguccgagaagggccgccg

SEQ ID NO: 905030 - RNA, 20 nt, Mycobacterium avium subsp. paratuberculosis
cguccgagaagggccgccgc

SEQ ID NO: 905031 - RNA, 14 nt, Mycobacterium avium subsp. paratuberculosis
cguccgagcagcag

SEQ ID NO: 905032 - RNA, 18 nt, Mycobacterium avium subsp. paratuberculosis
cguccgagcagcagccgc

SEQ ID NO: 905033 - RNA, 21 nt, Mycobacterium avium subsp. paratuberculosis
cguccgagcagcagccgcagc

SEQ ID NO: 905034 - RNA, 23 nt, Mycobacterium avium subsp. paratuberculosis
cguccgagcagcagccgcagcgg

SEQ ID NO: 905035 - RNA, 17 nt, Mycobacterium avium subsp. paratuberculosis
cguccgaccguugaccg

SEQ ID NO: 905036 - RNA, 19 nt, Mycobacterium avium subsp. paratuberculosis
cguccgaccguugaccgac

SEQ ID NO: 905037 - RNA, 16 nt, Mycobacterium avium subsp. paratuberculosis
cguccgcaaccgccgg

SEQ ID NO: 905038 - RNA, 19 nt, Mycobacterium avium subsp. paratuberculosis
cguccgcaaccgccggcag

SEQ ID NO: 905039 - RNA, 16 nt, Mycobacterium avium subsp. paratuberculosis
cguccgcaagcaccuc

SEQ ID NO: 905040 - RNA, 14 nt, Mycobacterium avium subsp. paratuberculosis
cguccgcaccgcga

SEQ ID NO: 905041 - RNA, 16 nt, Mycobacterium avium subsp. paratuberculosis
cguccgcggccgcggc

SEQ ID NO: 905042 - RNA, 18 nt, Mycobacterium avium subsp. paratuberculosis
cguccgcggccgcggcgc

SEQ ID NO: 905043 - RNA, 22 nt, Mycobacterium avium subsp. paratuberculosis
cguccgcgaacgggugcggcgc

SEQ ID NO: 905044 - RNA, 15 nt, Mycobacterium avium subsp. paratuberculosis
cguccgcgacgcuga

SEQ ID NO: 905045 - RNA, 20 nt, Mycobacterium avium subsp. paratuberculosis
cguccgcgacgcugagcgcc

SEQ ID NO: 905046 - RNA, 13 nt, Mycobacterium avium subsp. paratuberculosis
cguccgcgcccac

SEQ ID NO: 905047 - RNA, 12 nt, Mycobacterium avium subsp. paratuberculosis
cguccgcgaucg

SEQ ID NO: 905048 - RNA, 20 nt, Mycobacterium avium subsp. paratuberculosis
cguccgcgaucgucucgucg

SEQ ID NO: 905049 - RNA, 15 nt, Mycobacterium avium subsp. paratuberculosis
cguccgccccgcugc

SEQ ID NO: 905050 - RNA, 14 nt, Mycobacterium avium subsp. paratuberculosis
cguccgccggcggu

SEQ ID NO: 905051 - RNA, 18 nt, Mycobacterium avium subsp. paratuberculosis
cguccgccuccgaccagc

SEQ ID NO: 905052 - RNA, 20 nt, Mycobacterium avium subsp. paratuberculosis
cguccgccuccgaccagccg

SEQ ID NO: 905053 - RNA, 22 nt, Mycobacterium avium subsp. paratuberculosis
cguccgccuccgaccagccggu

SEQ ID NO: 905054 - RNA, 21 nt, Mycobacterium avium subsp. paratuberculosis
cguccaggugcacccgcggcg

SEQ ID NO: 905055 - RNA, 18 nt, Mycobacterium avium subsp. paratuberculosis
cguccaggugcgccgccg

SEQ ID NO: 905056 - RNA, 20 nt, Mycobacterium avium subsp. paratuberculosis
cguccaggugcgccgccgcg

SEQ ID NO: 905057 - RNA, 21 nt, Mycobacterium avium subsp. paratuberculosis
cguccaggugcgccgccgcgu

SEQ ID NO: 905058 - RNA, 22 nt, Mycobacterium avium subsp. paratuberculosis
cguccaggugcgccgccgcguc

SEQ ID NO: 905059 - RNA, 17 nt, Mycobacterium avium subsp. paratuberculosis
cguccaguccggcgugc

SEQ ID NO: 905060 - RNA, 16 nt, Mycobacterium avium subsp. paratuberculosis
cguccaguagccgccg

SEQ ID NO: 905061 - RNA, 17 nt, Mycobacterium avium subsp. paratuberculosis
cguccaguagccgccgg

SEQ ID NO: 905062 - RNA, 23 nt, Mycobacterium avium subsp. paratuberculosis
cguccaguagccgccgggcguag

SEQ ID NO: 905063 - RNA, 20 nt, Mycobacterium avium subsp. paratuberculosis
cguccagugacgccugcggc

SEQ ID NO: 905064 - RNA, 22 nt, Mycobacterium avium subsp. paratuberculosis
cguccagugacgccugcggccc

SEQ ID NO: 905065 - RNA, 17 nt, Mycobacterium avium subsp. paratuberculosis
cguccaguucggccagc

SEQ ID NO: 905066 - RNA, 20 nt, Mycobacterium avium subsp. paratuberculosis
cguccaguucggccagcgcg

SEQ ID NO: 905067 - RNA, 17 nt, Mycobacterium avium subsp. paratuberculosis
cguccaguugcggcacg

SEQ ID NO: 905068 - RNA, 19 nt, Mycobacterium avium subsp. paratuberculosis
cguccaguugcggcacgcc

SEQ ID NO: 905069 - RNA, 22 nt, Mycobacterium avium subsp. paratuberculosis
cguccaguugcggcacgccgac

SEQ ID NO: 905070 - RNA, 24 nt, Mycobacterium avium subsp. paratuberculosis
cguccaguugcggcacgccgacca

SEQ ID NO: 905071 - RNA, 24 nt, Mycobacterium avium subsp. paratuberculosis
cguccauaccccccacgcucggcg

SEQ ID NO: 905072 - RNA, 15 nt, Mycobacterium avium subsp. paratuberculosis
cguccaggcgcaccg

SEQ ID NO: 905073 - RNA, 13 nt, Mycobacterium avium subsp. paratuberculosis
cguccagggccac

SEQ ID NO: 905074 - RNA, 17 nt, Mycobacterium avium subsp. paratuberculosis
cguccagggccaccgcg

SEQ ID NO: 905075 - RNA, 13 nt, Mycobacterium avium subsp. paratuberculosis
cguccaggccgcu

SEQ ID NO: 905076 - RNA, 15 nt, Mycobacterium avium subsp. paratuberculosis
cguccaggccggcgc

SEQ ID NO: 905077 - RNA, 16 nt, Mycobacterium avium subsp. paratuberculosis
cguccaggccggcgcc

SEQ ID NO: 905078 - RNA, 18 nt, Mycobacterium avium subsp. paratuberculosis
cguccaggccggcgccgc

SEQ ID NO: 905079 - RNA, 20 nt, Mycobacterium avium subsp. paratuberculosis
cguccaggccggcgccgcgg

SEQ ID NO: 905080 - RNA, 14 nt, Mycobacterium avium subsp. paratuberculosis
cguccaggaugagc

SEQ ID NO: 905081 - RNA, 23 nt, Mycobacterium avium subsp. paratuberculosis
cguccaggaugagcugggcggcg

SEQ ID NO: 905082 - RNA, 12 nt, Mycobacterium avium subsp. paratuberculosis
cguccagcgcga

SEQ ID NO: 905083 - RNA, 16 nt, Mycobacterium avium subsp. paratuberculosis
cguccagcugggcugc

SEQ ID NO: 905084 - RNA, 17 nt, Mycobacterium avium subsp. paratuberculosis
cguccagcuucucggcg

SEQ ID NO: 905085 - RNA, 20 nt, Mycobacterium avium subsp. paratuberculosis
cguccagaucggccagcgcg

SEQ ID NO: 905086 - RNA, 24 nt, Mycobacterium avium subsp. paratuberculosis
cguccagaucggccagcgcggccg

SEQ ID NO: 905087 - RNA, 14 nt, Mycobacterium avium subsp. paratuberculosis
cguccagcaacgcc

SEQ ID NO: 905088 - RNA, 15 nt, Mycobacterium avium subsp. paratuberculosis
cguccagcaacgccg

SEQ ID NO: 905089 - RNA, 17 nt, Mycobacterium avium subsp. paratuberculosis
cguccagcaacgccgac

SEQ ID NO: 905090 - RNA, 18 nt, Mycobacterium avium subsp. paratuberculosis
cguccagcaacgccgaca

SEQ ID NO: 905091 - RNA, 19 nt, Mycobacterium avium subsp. paratuberculosis
cguccagcaacgccgacau

SEQ ID NO: 905092 - RNA, 18 nt, Mycobacterium avium subsp. paratuberculosis
cguccagcaccugcucga

SEQ ID NO: 905093 - RNA, 21 nt, Mycobacterium avium subsp. paratuberculosis
cguccagcaccugcucgaugc

SEQ ID NO: 905094 - RNA, 22 nt, Mycobacterium avium subsp. paratuberculosis
cguccagcaccugcucgaugcg

SEQ ID NO: 905095 - RNA, 17 nt, Mycobacterium avium subsp. paratuberculosis
cguccagcccgcgccag

SEQ ID NO: 905096 - RNA, 15 nt, Mycobacterium avium subsp. paratuberculosis
cguccagcagcagcg

SEQ ID NO: 905097 - RNA, 19 nt, Mycobacterium avium subsp. paratuberculosis
cguccagcagcagcgcgcg

SEQ ID NO: 905098 - RNA, 20 nt, Mycobacterium avium subsp. paratuberculosis
cguccagcagcagcgcgcgg

SEQ ID NO: 905099 - RNA, 21 nt, Mycobacterium avium subsp. paratuberculosis
cguccagcagcagcgcgcggu

SEQ ID NO: 905100 - RNA, 15 nt, Mycobacterium avium subsp. paratuberculosis
cguccagcuccgccg

SEQ ID NO: 905101 - RNA, 18 nt, Mycobacterium avium subsp. paratuberculosis
cguccagcuccgccgaca

SEQ ID NO: 905102 - RNA, 18 nt, Mycobacterium avium subsp. paratuberculosis
cguccagcucgcguucgg

SEQ ID NO: 905103 - RNA, 15 nt, Mycobacterium avium subsp. paratuberculosis
cguccagcugcgcgc

SEQ ID NO: 905104 - RNA, 17 nt, Mycobacterium avium subsp. paratuberculosis
cguccagcugcgcgccg

SEQ ID NO: 905105 - RNA, 19 nt, Mycobacterium avium subsp. paratuberculosis
cguccagcugcgcgccggc

SEQ ID NO: 905106 - RNA, 15 nt, Mycobacterium avium subsp. paratuberculosis
cguccagcgucgacu

SEQ ID NO: 905107 - RNA, 14 nt, Mycobacterium avium subsp. paratuberculosis
cguccagcgucgcg

SEQ ID NO: 905108 - RNA, 18 nt, Mycobacterium avium subsp. paratuberculosis
cguccagcgucuggcagc

SEQ ID NO: 905109 - RNA, 14 nt, Mycobacterium avium subsp. paratuberculosis
cguccagcgugccg

SEQ ID NO: 905110 - RNA, 17 nt, Mycobacterium avium subsp. paratuberculosis
cguccagcgugccgcgc

SEQ ID NO: 905111 - RNA, 14 nt, Mycobacterium avium subsp. paratuberculosis
cguccagcgcgucg

SEQ ID NO: 905112 - RNA, 22 nt, Mycobacterium avium subsp. paratuberculosis
cguccagccgugcggcacgccg

SEQ ID NO: 905113 - RNA, 13 nt, Mycobacterium avium subsp. paratuberculosis
cguccagcgccgc

SEQ ID NO: 905114 - RNA, 23 nt, Mycobacterium avium subsp. paratuberculosis
cguccagcgccgccacggccacc

SEQ ID NO: 905115 - RNA, 22 nt, Mycobacterium avium subsp. paratuberculosis
gagaacaggccgagcgcgcugg

SEQ ID NO: 905116 - RNA, 20 nt, Mycobacterium avium subsp. paratuberculosis
gagaacagguaggacaccga

SEQ ID NO: 905117 - RNA, 18 nt, Mycobacterium avium subsp. paratuberculosis
gagaacauuucgucgaag

SEQ ID NO: 905118 - RNA, 17 nt, Mycobacterium avium subsp. paratuberculosis
gagaaaaucgcccgcga

SEQ ID NO: 905119 - RNA, 23 nt, Mycobacterium avium subsp. paratuberculosis
gacuugguggccagcaccacguc

SEQ ID NO: 905120 - RNA, 14 nt, Mycobacterium avium subsp. paratuberculosis
gacuugucgggccg

SEQ ID NO: 905121 - RNA, 22 nt, Mycobacterium avium subsp. paratuberculosis
gacuucuacggcgggccggcgc

SEQ ID NO: 905122 - RNA, 16 nt, Mycobacterium avium subsp. paratuberculosis
gacuucuucgccggcg

SEQ ID NO: 905123 - RNA, 15 nt, Mycobacterium avium subsp. paratuberculosis
gacuucgcgugccgc

SEQ ID NO: 905124 - RNA, 17 nt, Mycobacterium avium subsp. paratuberculosis
gacuucggaggucagca

SEQ ID NO: 905125 - RNA, 16 nt, Mycobacterium avium subsp. paratuberculosis
gacuucggcucggcga

SEQ ID NO: 905126 - RNA, 17 nt, Mycobacterium avium subsp. paratuberculosis
gacuucggcucggcgac

SEQ ID NO: 905127 - RNA, 23 nt, Mycobacterium avium subsp. paratuberculosis
gacugucggcgccccgcccgcga

SEQ ID NO: 905128 - RNA, 17 nt, Mycobacterium avium subsp. paratuberculosis
gacugucggcucgcccg

SEQ ID NO: 905129 - RNA, 21 nt, Mycobacterium avium subsp. paratuberculosis
gacugggcgccgccggcgucg

SEQ ID NO: 905130 - RNA, 22 nt, Mycobacterium avium subsp. paratuberculosis
gacugggucaccgucacgucgu

SEQ ID NO: 905131 - RNA, 13 nt, Mycobacterium avium subsp. paratuberculosis
gacugggugcgcg

SEQ ID NO: 905132 - RNA, 21 nt, Mycobacterium avium subsp. paratuberculosis
gacugggugggacggaaaucg

SEQ ID NO: 905133 - RNA, 23 nt, Mycobacterium avium subsp. paratuberculosis
gacuggcccucggaggugccgcg

SEQ ID NO: 905134 - RNA, 14 nt, Mycobacterium avium subsp. paratuberculosis
gacuggccaccgcg

SEQ ID NO: 905135 - RNA, 21 nt, Mycobacterium avium subsp. paratuberculosis
gacuggcccacgcagccgucg

SEQ ID NO: 905136 - RNA, 21 nt, Mycobacterium avium subsp. paratuberculosis
gacugcuugggcgccucgccg

SEQ ID NO: 905137 - RNA, 13 nt, Mycobacterium avium subsp. paratuberculosis
gacugcgacaccc

SEQ ID NO: 905138 - RNA, 11 nt, Mycobacterium avium subsp. paratuberculosis
gacugcgccgg

SEQ ID NO: 905139 - RNA, 14 nt, Mycobacterium avium subsp. paratuberculosis
gacugcgccggggc

SEQ ID NO: 905140 - RNA, 15 nt, Mycobacterium avium subsp. paratuberculosis
gacugcgcggccggc

SEQ ID NO: 905141 - RNA, 15 nt, Mycobacterium avium subsp. paratuberculosis
gacugcccgaccgcg

SEQ ID NO: 905142 - RNA, 16 nt, Mycobacterium avium subsp. paratuberculosis
gacugcccgaccgcgc

SEQ ID NO: 905143 - RNA, 17 nt, Mycobacterium avium subsp. paratuberculosis
gacugccgagcaucagc

SEQ ID NO: 905144 - RNA, 22 nt, Mycobacterium avium subsp. paratuberculosis
gacugccgagcaucagcugccg

SEQ ID NO: 905145 - RNA, 12 nt, Mycobacterium avium subsp. paratuberculosis
gacugccggcga

SEQ ID NO: 905146 - RNA, 22 nt, Mycobacterium avium subsp. paratuberculosis
gacugccggcgacgguggcgcc

SEQ ID NO: 905147 - RNA, 16 nt, Mycobacterium avium subsp. paratuberculosis
gacugcgaucgccgac

SEQ ID NO: 905148 - RNA, 17 nt, Mycobacterium avium subsp. paratuberculosis
gacugcgaucgccgacg

SEQ ID NO: 905149 - RNA, 15 nt, Mycobacterium avium subsp. paratuberculosis
gacugcgcaccgcca

SEQ ID NO: 905150 - RNA, 21 nt, Mycobacterium avium subsp. paratuberculosis
gacugcgcaccgccagcaccg

SEQ ID NO: 905151 - RNA, 12 nt, Mycobacterium avium subsp. paratuberculosis
gacugcagcgcg

SEQ ID NO: 905152 - RNA, 21 nt, Mycobacterium avium subsp. paratuberculosis
gacucuucuuccugcuugacg

SEQ ID NO: 905153 - RNA, 21 nt, Mycobacterium avium subsp. paratuberculosis
gacugaaguaguacgaccgcg

SEQ ID NO: 905154 - RNA, 22 nt, Mycobacterium avium subsp. paratuberculosis
gacugaaguaguacgaccgcga

SEQ ID NO: 905155 - RNA, 15 nt, Mycobacterium avium subsp. paratuberculosis
gacugacccgcacga

SEQ ID NO: 905156 - RNA, 18 nt, Mycobacterium avium subsp. paratuberculosis
gacugaugaagccgccga

SEQ ID NO: 905157 - RNA, 17 nt, Mycobacterium avium subsp. paratuberculosis
gacugaugcccucgccg

SEQ ID NO: 905158 - RNA, 18 nt, Mycobacterium avium subsp. paratuberculosis
gacugaugcccucgccgg

SEQ ID NO: 905159 - RNA, 14 nt, Mycobacterium avium subsp. paratuberculosis
gacugaugguggcg

SEQ ID NO: 905160 - RNA, 18 nt, Mycobacterium avium subsp. paratuberculosis
gacugcacagugcgucgc

SEQ ID NO: 905161 - RNA, 22 nt, Mycobacterium avium subsp. paratuberculosis
gacugcacagugcgucgcccau

SEQ ID NO: 905162 - RNA, 13 nt, Mycobacterium avium subsp. paratuberculosis
gacugcaccgacu

SEQ ID NO: 905163 - RNA, 18 nt, Mycobacterium avium subsp. paratuberculosis
gacucgauguagccgggc

SEQ ID NO: 905164 - RNA, 20 nt, Mycobacterium avium subsp. paratuberculosis
gacuccuugggagacugcga

SEQ ID NO: 905165 - RNA, 23 nt, Mycobacterium avium subsp. paratuberculosis
gacucgggguugacccggccggu

SEQ ID NO: 905166 - RNA, 15 nt, Mycobacterium avium subsp. paratuberculosis
gacucguucgacgcc

SEQ ID NO: 905167 - RNA, 17 nt, Mycobacterium avium subsp. paratuberculosis
gacucguucgacgccgg

SEQ ID NO: 905168 - RNA, 18 nt, Mycobacterium avium subsp. paratuberculosis
gacucguucgacgccggu

SEQ ID NO: 905169 - RNA, 19 nt, Mycobacterium avium subsp. paratuberculosis
gacucgucgcugaucgcga

SEQ ID NO: 905170 - RNA, 18 nt, Mycobacterium avium subsp. paratuberculosis
gacucggcgaagucauca

SEQ ID NO: 905171 - RNA, 15 nt, Mycobacterium avium subsp. paratuberculosis
gacucggcggugccg

SEQ ID NO: 905172 - RNA, 14 nt, Mycobacterium avium subsp. paratuberculosis
gacucgcgccggau

SEQ ID NO: 905173 - RNA, 16 nt, Mycobacterium avium subsp. paratuberculosis
gacucggccuccgcgc

SEQ ID NO: 905174 - RNA, 13 nt, Mycobacterium avium subsp. paratuberculosis
gacucagcccggc

SEQ ID NO: 905175 - RNA, 14 nt, Mycobacterium avium subsp. paratuberculosis
gacucagcccggcc

SEQ ID NO: 905176 - RNA, 21 nt, Mycobacterium avium subsp. paratuberculosis
gacucagcccggcccagccgg

SEQ ID NO: 905177 - RNA, 15 nt, Mycobacterium avium subsp. paratuberculosis
gacuagcgcggcggc

SEQ ID NO: 905178 - RNA, 14 nt, Mycobacterium avium subsp. paratuberculosis
gacuccggcgacac

SEQ ID NO: 905179 - RNA, 16 nt, Mycobacterium avium subsp. paratuberculosis
gacuccggcgacacgu

SEQ ID NO: 905180 - RNA, 15 nt, Mycobacterium avium subsp. paratuberculosis
gacucccccaccacg

SEQ ID NO: 905181 - RNA, 16 nt, Mycobacterium avium subsp. paratuberculosis
gacucccccaccacgu

SEQ ID NO: 905182 - RNA, 21 nt, Mycobacterium avium subsp. paratuberculosis
gacuccccgcccggcaacacg

SEQ ID NO: 905183 - RNA, 19 nt, Mycobacterium avium subsp. paratuberculosis
gacucccgagcgugggggc

SEQ ID NO: 905184 - RNA, 19 nt, Mycobacterium avium subsp. paratuberculosis
gacuccuccucggccagcc

SEQ ID NO: 905185 - RNA, 20 nt, Mycobacterium avium subsp. paratuberculosis
gacuccuccucggccagccc

SEQ ID NO: 905186 - RNA, 15 nt, Mycobacterium avium subsp. paratuberculosis
gacuccuccugcgac

SEQ ID NO: 905187 - RNA, 18 nt, Mycobacterium avium subsp. paratuberculosis
gacuccuccugcgacggc

SEQ ID NO: 905188 - RNA, 21 nt, Mycobacterium avium subsp. paratuberculosis
gacucauucgacuccggcgac

SEQ ID NO: 905189 - RNA, 17 nt, Mycobacterium avium subsp. paratuberculosis
gacuccaccaccuggcc

SEQ ID NO: 905190 - RNA, 19 nt, Mycobacterium avium subsp. paratuberculosis
gacuccaccaccuggccgg

SEQ ID NO: 905191 - RNA, 18 nt, Mycobacterium avium subsp. paratuberculosis
gacuccagcaccggcgcc

SEQ ID NO: 905192 - RNA, 13 nt, Mycobacterium avium subsp. paratuberculosis
gacuccagcagcg

SEQ ID NO: 905193 - RNA, 14 nt, Mycobacterium avium subsp. paratuberculosis
gacuccagcagcgc

SEQ ID NO: 905194 - RNA, 16 nt, Mycobacterium avium subsp. paratuberculosis
gacuccagcagcgcca

SEQ ID NO: 905195 - RNA, 17 nt, Mycobacterium avium subsp. paratuberculosis
gacuccagcagcgccag

SEQ ID NO: 905196 - RNA, 18 nt, Mycobacterium avium subsp. paratuberculosis
gacuccagcagcgccagc

SEQ ID NO: 905197 - RNA, 19 nt, Mycobacterium avium subsp. paratuberculosis
gacuccagcagcgccagca

SEQ ID NO: 905198 - RNA, 20 nt, Mycobacterium avium subsp. paratuberculosis
gacuccagcagcgccagcac

SEQ ID NO: 905199 - RNA, 16 nt, Mycobacterium avium subsp. paratuberculosis
gacuccaccgccaccg

SEQ ID NO: 905200 - RNA, 11 nt, Mycobacterium avium subsp. paratuberculosis
gacuccagcac

SEQ ID NO: 905201 - RNA, 15 nt, Mycobacterium avium subsp. paratuberculosis
gacuccagcaccagc

SEQ ID NO: 905202 - RNA, 19 nt, Mycobacterium avium subsp. paratuberculosis
gacuccaguugacggcgca

SEQ ID NO: 905203 - RNA, 12 nt, Mycobacterium avium subsp. paratuberculosis
gagaucaccggc

SEQ ID NO: 905204 - RNA, 14 nt, Mycobacterium avium subsp. paratuberculosis
gagaucaccggcuu

SEQ ID NO: 905205 - RNA, 19 nt, Mycobacterium avium subsp. paratuberculosis
gagagcgguuugcgggucg

SEQ ID NO: 905206 - RNA, 19 nt, Mycobacterium avium subsp. paratuberculosis
gagagcgcgggcaccgucg

SEQ ID NO: 905207 - RNA, 17 nt, Mycobacterium avium subsp. paratuberculosis
gagagcggaucggcggc

SEQ ID NO: 905208 - RNA, 14 nt, Mycobacterium avium subsp. paratuberculosis
gagagcuucaugcc

SEQ ID NO: 905209 - RNA, 13 nt, Mycobacterium avium subsp. paratuberculosis
gagaggcgcggcg

SEQ ID NO: 905210 - RNA, 16 nt, Mycobacterium avium subsp. paratuberculosis
gagaggcgcggcgcga

SEQ ID NO: 905211 - RNA, 12 nt, Mycobacterium avium subsp. paratuberculosis
gagagcaacacc

SEQ ID NO: 905212 - RNA, 20 nt, Mycobacterium avium subsp. paratuberculosis
gagagccgguagaucagcgc

SEQ ID NO: 905213 - RNA, 17 nt, Mycobacterium avium subsp. paratuberculosis
gagacugcgacccaccg

SEQ ID NO: 905214 - RNA, 19 nt, Mycobacterium avium subsp. paratuberculosis
gagacggccagcagcaccg

SEQ ID NO: 905215 - RNA, 22 nt, Mycobacterium avium subsp. paratuberculosis
gagacguaccagcugcccacca

SEQ ID NO: 905216 - RNA, 15 nt, Mycobacterium avium subsp. paratuberculosis
gagacgucggccggg

SEQ ID NO: 905217 - RNA, 14 nt, Mycobacterium avium subsp. paratuberculosis
gagacgucggcgua

SEQ ID NO: 905218 - RNA, 16 nt, Mycobacterium avium subsp. paratuberculosis
gagacgugguggugcg

SEQ ID NO: 905219 - RNA, 18 nt, Mycobacterium avium subsp. paratuberculosis
gagacguugccgcacacc

SEQ ID NO: 905220 - RNA, 19 nt, Mycobacterium avium subsp. paratuberculosis
gagacguugccgcacaccg

SEQ ID NO: 905221 - RNA, 22 nt, Mycobacterium avium subsp. paratuberculosis
gagaacucgaucugcagccggc

SEQ ID NO: 905222 - RNA, 22 nt, Mycobacterium avium subsp. paratuberculosis
gagaaccucaacgugaccaccg

SEQ ID NO: 905223 - RNA, 17 nt, Mycobacterium avium subsp. paratuberculosis
gagaagcccgugcgacg

SEQ ID NO: 905224 - RNA, 14 nt, Mycobacterium avium subsp. paratuberculosis
gagaccaugccgcc

SEQ ID NO: 905225 - RNA, 20 nt, Mycobacterium avium subsp. paratuberculosis
gagacccgcccggagaacuc

SEQ ID NO: 905226 - RNA, 19 nt, Mycobacterium avium subsp. paratuberculosis
gagaccaggucggccuuca

SEQ ID NO: 905227 - RNA, 12 nt, Mycobacterium avium subsp. paratuberculosis
gagaccgccgug

SEQ ID NO: 905228 - RNA, 13 nt, Mycobacterium avium subsp. paratuberculosis
gagacgacgccac

SEQ ID NO: 905229 - RNA, 15 nt, Mycobacterium avium subsp. paratuberculosis
gagacgacgccacca

SEQ ID NO: 905230 - RNA, 17 nt, Mycobacterium avium subsp. paratuberculosis
gagacgagccgccgcgg

SEQ ID NO: 905231 - RNA, 21 nt, Mycobacterium avium subsp. paratuberculosis
gagacgagccgccgcgggucg

SEQ ID NO: 905232 - RNA, 17 nt, Mycobacterium avium subsp. paratuberculosis
gagaccucccggcgcca

SEQ ID NO: 905233 - RNA, 15 nt, Mycobacterium avium subsp. paratuberculosis
gagcaaauccggcag

SEQ ID NO: 905234 - RNA, 21 nt, Mycobacterium avium subsp. paratuberculosis
gagcaaauccggcagcgcucg

SEQ ID NO: 905235 - RNA, 14 nt, Mycobacterium avium subsp. paratuberculosis
gagcaacaccaccu

SEQ ID NO: 905236 - RNA, 17 nt, Mycobacterium avium subsp. paratuberculosis
gagcaacaccggcacga

SEQ ID NO: 905237 - RNA, 20 nt, Mycobacterium avium subsp. paratuberculosis
gagcaacaccggcacgaucg

SEQ ID NO: 905238 - RNA, 16 nt, Mycobacterium avium subsp. paratuberculosis
gagcaacaccucgggc

SEQ ID NO: 905239 - RNA, 17 nt, Mycobacterium avium subsp. paratuberculosis
gagcaacaccucgggca

SEQ ID NO: 905240 - RNA, 22 nt, Mycobacterium avium subsp. paratuberculosis
gagcaaccgccgaaacaccggc

SEQ ID NO: 905241 - RNA, 15 nt, Mycobacterium avium subsp. paratuberculosis
gagcaacagcccgac

SEQ ID NO: 905242 - RNA, 16 nt, Mycobacterium avium subsp. paratuberculosis
gagcaacagcccgacc

SEQ ID NO: 905243 - RNA, 22 nt, Mycobacterium avium subsp. paratuberculosis
gagcaaccgguucggacacggc

SEQ ID NO: 905244 - RNA, 20 nt, Mycobacterium avium subsp. paratuberculosis
gagcaaggucgucgcggcca

SEQ ID NO: 905245 - RNA, 14 nt, Mycobacterium avium subsp. paratuberculosis
gagcaagucggcgg

SEQ ID NO: 905246 - RNA, 21 nt, Mycobacterium avium subsp. paratuberculosis
gagcaauuaaccggcaggccg

SEQ ID NO: 905247 - RNA, 17 nt, Mycobacterium avium subsp. paratuberculosis
gagcacacacaggucgc

SEQ ID NO: 905248 - RNA, 17 nt, Mycobacterium avium subsp. paratuberculosis
gagcacacccagcgagc

SEQ ID NO: 905249 - RNA, 18 nt, Mycobacterium avium subsp. paratuberculosis
gagcacacccagcgagcc

SEQ ID NO: 905250 - RNA, 23 nt, Mycobacterium avium subsp. paratuberculosis
gagcacacccagcgagccgauga

SEQ ID NO: 905251 - RNA, 23 nt, Mycobacterium avium subsp. paratuberculosis
gagcacaccgucgcccgcccagg

SEQ ID NO: 905252 - RNA, 21 nt, Mycobacterium avium subsp. paratuberculosis
gagaucagcaccgggugauac

SEQ ID NO: 905253 - RNA, 19 nt, Mycobacterium avium subsp. paratuberculosis
gagaucagggcgcgcaccg

SEQ ID NO: 905254 - RNA, 20 nt, Mycobacterium avium subsp. paratuberculosis
gagaucagggugcucagccg

SEQ ID NO: 905255 - RNA, 14 nt, Mycobacterium avium subsp. paratuberculosis
gagauccaccgcgc

SEQ ID NO: 905256 - RNA, 16 nt, Mycobacterium avium subsp. paratuberculosis
gagauccaccgcgcgg

SEQ ID NO: 905257 - RNA, 18 nt, Mycobacterium avium subsp. paratuberculosis
gagauccaccgcgcggcc

SEQ ID NO: 905258 - RNA, 20 nt, Mycobacterium avium subsp. paratuberculosis
gagauccaccgcgcggccag

SEQ ID NO: 905259 - RNA, 23 nt, Mycobacterium avium subsp. paratuberculosis
gagauccagcagccaggauccga

SEQ ID NO: 905260 - RNA, 18 nt, Mycobacterium avium subsp. paratuberculosis
gagaucgcgggcugcggc

SEQ ID NO: 905261 - RNA, 22 nt, Mycobacterium avium subsp. paratuberculosis
gagaucgcgggcugcggcgagu

SEQ ID NO: 905262 - RNA, 22 nt, Mycobacterium avium subsp. paratuberculosis
gagaucgcgguggcgcccgcgg

SEQ ID NO: 905263 - RNA, 16 nt, Mycobacterium avium subsp. paratuberculosis
gagaucggcgcggagc

SEQ ID NO: 905264 - RNA, 17 nt, Mycobacterium avium subsp. paratuberculosis
gagaucaacaccgcgca

SEQ ID NO: 905265 - RNA, 16 nt, Mycobacterium avium subsp. paratuberculosis
gagaugaauucggcga

SEQ ID NO: 905266 - RNA, 16 nt, Mycobacterium avium subsp. paratuberculosis
gagaugaucagccgcc

SEQ ID NO: 905267 - RNA, 19 nt, Mycobacterium avium subsp. paratuberculosis
gagaugaucagccgcccga

SEQ ID NO: 905268 - RNA, 16 nt, Mycobacterium avium subsp. paratuberculosis
gagaugauggccgcgc

SEQ ID NO: 905269 - RNA, 19 nt, Mycobacterium avium subsp. paratuberculosis
gagaugguggucaccacca

SEQ ID NO: 905270 - RNA, 20 nt, Mycobacterium avium subsp. paratuberculosis
gagaugcguucggccgcagc

SEQ ID NO: 905271 - RNA, 21 nt, Mycobacterium avium subsp. paratuberculosis
gagauggccagcaccaccgcg

SEQ ID NO: 905272 - RNA, 22 nt, Mycobacterium avium subsp. paratuberculosis
gagauggccagcaccaccgcga

SEQ ID NO: 905273 - RNA, 15 nt, Mycobacterium avium subsp. paratuberculosis
gagauggggugaugc

SEQ ID NO: 905274 - RNA, 20 nt, Mycobacterium avium subsp. paratuberculosis
gagaucucgucgaugggcuc

SEQ ID NO: 905275 - RNA, 18 nt, Mycobacterium avium subsp. paratuberculosis
gagaucgccccgccguug

SEQ ID NO: 905276 - RNA, 21 nt, Mycobacterium avium subsp. paratuberculosis
gagcacaggaacgcgacggug

SEQ ID NO: 905277 - RNA, 15 nt, Mycobacterium avium subsp. paratuberculosis
gagcaauucggugac

SEQ ID NO: 905278 - RNA, 23 nt, Mycobacterium avium subsp. paratuberculosis
gagcaccaccaggcccaccacca

SEQ ID NO: 905279 - RNA, 12 nt, Mycobacterium avium subsp. paratuberculosis
gagcaccacgag

SEQ ID NO: 905280 - RNA, 13 nt, Mycobacterium avium subsp. paratuberculosis
gagcaccacggcc

SEQ ID NO: 905281 - RNA, 18 nt, Mycobacterium avium subsp. paratuberculosis
gagcaccacggcccgcgc

SEQ ID NO: 905282 - RNA, 18 nt, Mycobacterium avium subsp. paratuberculosis
gagcacccgcccggacgc

SEQ ID NO: 905283 - RNA, 20 nt, Mycobacterium avium subsp. paratuberculosis
gagcacccagaaacaccauc

SEQ ID NO: 905284 - RNA, 14 nt, Mycobacterium avium subsp. paratuberculosis
gagcaccagcccgg

SEQ ID NO: 905285 - RNA, 15 nt, Mycobacterium avium subsp. paratuberculosis
gagcaccagcccggc

SEQ ID NO: 905286 - RNA, 12 nt, Mycobacterium avium subsp. paratuberculosis
gagcaccagcgu

SEQ ID NO: 905287 - RNA, 17 nt, Mycobacterium avium subsp. paratuberculosis
gagcaccagcgucgacg

SEQ ID NO: 905288 - RNA, 18 nt, Mycobacterium avium subsp. paratuberculosis
gagcaccagcgucgacgc

SEQ ID NO: 905289 - RNA, 23 nt, Mycobacterium avium subsp. paratuberculosis
gagcaccgcgaccacgccgcggu

SEQ ID NO: 905290 - RNA, 22 nt, Mycobacterium avium subsp. paratuberculosis
gagcaccgcgaccagcucgggc

SEQ ID NO: 905291 - RNA, 15 nt, Mycobacterium avium subsp. paratuberculosis
gagcaccgcgaucgc

SEQ ID NO: 905292 - RNA, 14 nt, Mycobacterium avium subsp. paratuberculosis
gagcaccgccgucc

SEQ ID NO: 905293 - RNA, 21 nt, Mycobacterium avium subsp. paratuberculosis
gagcaccgcgcucaccgcggg

SEQ ID NO: 905294 - RNA, 15 nt, Mycobacterium avium subsp. paratuberculosis
gagcaccccggcggc

SEQ ID NO: 905295 - RNA, 18 nt, Mycobacterium avium subsp. paratuberculosis
gagcaccggaucgaccaa

SEQ ID NO: 905296 - RNA, 23 nt, Mycobacterium avium subsp. paratuberculosis
gagcaccggcagcaccgccgagc

SEQ ID NO: 905297 - RNA, 14 nt, Mycobacterium avium subsp. paratuberculosis
gagcaccggcagcc

SEQ ID NO: 905298 - RNA, 17 nt, Mycobacterium avium subsp. paratuberculosis
gagcaccggcagccgca

SEQ ID NO: 905299 - RNA, 18 nt, Mycobacterium avium subsp. paratuberculosis
gagcaccggcagccgcag

SEQ ID NO: 905300 - RNA, 13 nt, Mycobacterium avium subsp. paratuberculosis
gagcaccggcggc

SEQ ID NO: 905301 - RNA, 20 nt, Mycobacterium avium subsp. paratuberculosis
gagcaccggcggcagcgacu

SEQ ID NO: 905302 - RNA, 13 nt, Mycobacterium avium subsp. paratuberculosis
gagcaccgggccg

SEQ ID NO: 905303 - RNA, 13 nt, Mycobacterium avium subsp. paratuberculosis
gagcaccgggcgu

SEQ ID NO: 905304 - RNA, 13 nt, Mycobacterium avium subsp. paratuberculosis
gagcaccgugccg

SEQ ID NO: 905305 - RNA, 20 nt, Mycobacterium avium subsp. paratuberculosis
gagcaccgggaacagccagg

SEQ ID NO: 905306 - RNA, 17 nt, Mycobacterium avium subsp. paratuberculosis
gagcacucgauggcggc

SEQ ID NO: 905307 - RNA, 21 nt, Mycobacterium avium subsp. paratuberculosis
gagcacucgcgggacggcggc

SEQ ID NO: 905308 - RNA, 22 nt, Mycobacterium avium subsp. paratuberculosis
gagcacucgcgggacggcggcg

SEQ ID NO: 905309 - RNA, 11 nt, Mycobacterium avium subsp. paratuberculosis
gagcacgucga

SEQ ID NO: 905310 - RNA, 13 nt, Mycobacterium avium subsp. paratuberculosis
gagcacgucgacg

SEQ ID NO: 905311 - RNA, 19 nt, Mycobacterium avium subsp. paratuberculosis
gagcacgucgagcaccgcg

SEQ ID NO: 905312 - RNA, 20 nt, Mycobacterium avium subsp. paratuberculosis
gagcacgucgagcaccgcgu

SEQ ID NO: 905313 - RNA, 20 nt, Mycobacterium avium subsp. paratuberculosis
gagcagacacaaaagcaccc

SEQ ID NO: 905314 - RNA, 22 nt, Mycobacterium avium subsp. paratuberculosis
gagcacggugggcgccggguca

SEQ ID NO: 905315 - RNA, 19 nt, Mycobacterium avium subsp. paratuberculosis
gagcagacgcaaaagcccc

SEQ ID NO: 905316 - RNA, 20 nt, Mycobacterium avium subsp. paratuberculosis
gagcagacgcaaaagccccg

SEQ ID NO: 905317 - RNA, 21 nt, Mycobacterium avium subsp. paratuberculosis
gagcagacgcaaaagccccgc

SEQ ID NO: 905318 - RNA, 22 nt, Mycobacterium avium subsp. paratuberculosis
gagcacgggaugaucggcgccu

SEQ ID NO: 905319 - RNA, 14 nt, Mycobacterium avium subsp. paratuberculosis
gagcacgcggccgc

SEQ ID NO: 905320 - RNA, 15 nt, Mycobacterium avium subsp. paratuberculosis
gagcacgcggccgcg

SEQ ID NO: 905321 - RNA, 18 nt, Mycobacterium avium subsp. paratuberculosis
gagcaccugaacggccgc

SEQ ID NO: 905322 - RNA, 13 nt, Mycobacterium avium subsp. paratuberculosis
gagcaccugcgcg

SEQ ID NO: 905323 - RNA, 14 nt, Mycobacterium avium subsp. paratuberculosis
gagcaccugcgcga

SEQ ID NO: 905324 - RNA, 14 nt, Mycobacterium avium subsp. paratuberculosis
gagcaccuggccgu

SEQ ID NO: 905325 - RNA, 23 nt, Mycobacterium avium subsp. paratuberculosis
gagcaccuggccguucaggucga

SEQ ID NO: 905326 - RNA, 18 nt, Mycobacterium avium subsp. paratuberculosis
gagcacgaacgcggccgc

SEQ ID NO: 905327 - RNA, 13 nt, Mycobacterium avium subsp. paratuberculosis
gagcacgacgucg

SEQ ID NO: 905328 - RNA, 16 nt, Mycobacterium avium subsp. paratuberculosis
gagcacgcagccgcgc

SEQ ID NO: 905329 - RNA, 14 nt, Mycobacterium avium subsp. paratuberculosis
gagcacgcccgcga

SEQ ID NO: 905330 - RNA, 23 nt, Mycobacterium avium subsp. paratuberculosis
gagcacgcccgcgaucggcgcca

SEQ ID NO: 905331 - RNA, 12 nt, Mycobacterium avium subsp. paratuberculosis
gagcacgccgcc

SEQ ID NO: 905332 - RNA, 14 nt, Mycobacterium avium subsp. paratuberculosis
gacgucugggccgc

SEQ ID NO: 905333 - RNA, 19 nt, Mycobacterium avium subsp. paratuberculosis
gacgucugggccgccgagc

SEQ ID NO: 905334 - RNA, 16 nt, Mycobacterium avium subsp. paratuberculosis
gacgugacgaccuggu

SEQ ID NO: 905335 - RNA, 19 nt, Mycobacterium avium subsp. paratuberculosis
gacgugaaaucccccgacc

SEQ ID NO: 905336 - RNA, 21 nt, Mycobacterium avium subsp. paratuberculosis
gacgugauaucccuugccgcc

SEQ ID NO: 905337 - RNA, 22 nt, Mycobacterium avium subsp. paratuberculosis
gacgugauaucccuugccgccg

SEQ ID NO: 905338 - RNA, 17 nt, Mycobacterium avium subsp. paratuberculosis
gacgugaucgcgguggc

SEQ ID NO: 905339 - RNA, 19 nt, Mycobacterium avium subsp. paratuberculosis
gacgugaucgcgguggccg

SEQ ID NO: 905340 - RNA, 21 nt, Mycobacterium avium subsp. paratuberculosis
gacgugaucuggucggccagc

SEQ ID NO: 905341 - RNA, 22 nt, Mycobacterium avium subsp. paratuberculosis
gacgugaucuggucggccagcg

SEQ ID NO: 905342 - RNA, 16 nt, Mycobacterium avium subsp. paratuberculosis
gacgugaugcacccgg

SEQ ID NO: 905343 - RNA, 17 nt, Mycobacterium avium subsp. paratuberculosis
gacgugcaccugcagcc

SEQ ID NO: 905344 - RNA, 15 nt, Mycobacterium avium subsp. paratuberculosis
gacgugcaccaccgc

SEQ ID NO: 905345 - RNA, 17 nt, Mycobacterium avium subsp. paratuberculosis
gacgugcaccaccgcgu

SEQ ID NO: 905346 - RNA, 13 nt, Mycobacterium avium subsp. paratuberculosis
gacgugcaccggc

SEQ ID NO: 905347 - RNA, 19 nt, Mycobacterium avium subsp. paratuberculosis
gacgugcccuuccccggcg

SEQ ID NO: 905348 - RNA, 20 nt, Mycobacterium avium subsp. paratuberculosis
gacgugcccuuccccggcgg

SEQ ID NO: 905349 - RNA, 21 nt, Mycobacterium avium subsp. paratuberculosis
gacgugcccuuccccggcggc

SEQ ID NO: 905350 - RNA, 23 nt, Mycobacterium avium subsp. paratuberculosis
gacgugcccuuccccggcggccg

SEQ ID NO: 905351 - RNA, 13 nt, Mycobacterium avium subsp. paratuberculosis
gacgugccggcga

SEQ ID NO: 905352 - RNA, 14 nt, Mycobacterium avium subsp. paratuberculosis
gacgugccggcggc

SEQ ID NO: 905353 - RNA, 16 nt, Mycobacterium avium subsp. paratuberculosis
gacgugccgguggacg

SEQ ID NO: 905354 - RNA, 17 nt, Mycobacterium avium subsp. paratuberculosis
gacgugccgguggacga

SEQ ID NO: 905355 - RNA, 12 nt, Mycobacterium avium subsp. paratuberculosis
gacgucggcgcg

SEQ ID NO: 905356 - RNA, 17 nt, Mycobacterium avium subsp. paratuberculosis
gacgucggcgcgcucgg

SEQ ID NO: 905357 - RNA, 15 nt, Mycobacterium avium subsp. paratuberculosis
gacgucggccggcug

SEQ ID NO: 905358 - RNA, 22 nt, Mycobacterium avium subsp. paratuberculosis
gacgucggccggcugcagccgg

SEQ ID NO: 905359 - RNA, 13 nt, Mycobacterium avium subsp. paratuberculosis
gacgucggccggg

SEQ ID NO: 905360 - RNA, 18 nt, Mycobacterium avium subsp. paratuberculosis
gacgucggcguacugcgc

SEQ ID NO: 905361 - RNA, 22 nt, Mycobacterium avium subsp. paratuberculosis
gacgucggcguacugcgcgacc

SEQ ID NO: 905362 - RNA, 15 nt, Mycobacterium avium subsp. paratuberculosis
gacgucgccggccug

SEQ ID NO: 905363 - RNA, 16 nt, Mycobacterium avium subsp. paratuberculosis
gacgucgccggccugc

SEQ ID NO: 905364 - RNA, 13 nt, Mycobacterium avium subsp. paratuberculosis
gacgucgcgccgc

SEQ ID NO: 905365 - RNA, 20 nt, Mycobacterium avium subsp. paratuberculosis
gacgucgcgccgcucggcca

SEQ ID NO: 905366 - RNA, 13 nt, Mycobacterium avium subsp. paratuberculosis
gacgucgcgcugc

SEQ ID NO: 905367 - RNA, 16 nt, Mycobacterium avium subsp. paratuberculosis
gacgucggacgcggcc

SEQ ID NO: 905368 - RNA, 15 nt, Mycobacterium avium subsp. paratuberculosis
gacgguuucugccgg

SEQ ID NO: 905369 - RNA, 19 nt, Mycobacterium avium subsp. paratuberculosis
gacgguuucugccggccgc

SEQ ID NO: 905370 - RNA, 23 nt, Mycobacterium avium subsp. paratuberculosis
gacgguuuuggucugcgccggcg

SEQ ID NO: 905371 - RNA, 22 nt, Mycobacterium avium subsp. paratuberculosis
gacguaagccauggcggcccgc

SEQ ID NO: 905372 - RNA, 23 nt, Mycobacterium avium subsp. paratuberculosis
gacguaagccauggcggcccgcg

SEQ ID NO: 905373 - RNA, 18 nt, Mycobacterium avium subsp. paratuberculosis
gacguaagugucguggcg

SEQ ID NO: 905374 - RNA, 23 nt, Mycobacterium avium subsp. paratuberculosis
gacguaagugucguggcgugccg

SEQ ID NO: 905375 - RNA, 20 nt, Mycobacterium avium subsp. paratuberculosis
gacguacagcgagccgucga

SEQ ID NO: 905376 - RNA, 19 nt, Mycobacterium avium subsp. paratuberculosis
gacgguugccucggccagc

SEQ ID NO: 905377 - RNA, 17 nt, Mycobacterium avium subsp. paratuberculosis
gacgguuucaccgccgu

SEQ ID NO: 905378 - RNA, 12 nt, Mycobacterium avium subsp. paratuberculosis
gacgucgccgau

SEQ ID NO: 905379 - RNA, 20 nt, Mycobacterium avium subsp. paratuberculosis
gacgucgccgauggcguuca

SEQ ID NO: 905380 - RNA, 16 nt, Mycobacterium avium subsp. paratuberculosis
gacgucgcccacccgg

SEQ ID NO: 905381 - RNA, 12 nt, Mycobacterium avium subsp. paratuberculosis
gacgucgccacc

SEQ ID NO: 905382 - RNA, 21 nt, Mycobacterium avium subsp. paratuberculosis
gacgucgccaccagaccggcg

SEQ ID NO: 905383 - RNA, 15 nt, Mycobacterium avium subsp. paratuberculosis
gacguacccccgcac

SEQ ID NO: 905384 - RNA, 17 nt, Mycobacterium avium subsp. paratuberculosis
gacguacccccgcacgc

SEQ ID NO: 905385 - RNA, 21 nt, Mycobacterium avium subsp. paratuberculosis
gacguacccccgcacgccagc

SEQ ID NO: 905386 - RNA, 17 nt, Mycobacterium avium subsp. paratuberculosis
gacguacuggcgccggu

SEQ ID NO: 905387 - RNA, 21 nt, Mycobacterium avium subsp. paratuberculosis
gacguagaucauuugaccgca

SEQ ID NO: 905388 - RNA, 20 nt, Mycobacterium avium subsp. paratuberculosis
gacguagcaccagucggcca

SEQ ID NO: 905389 - RNA, 21 nt, Mycobacterium avium subsp. paratuberculosis
gacgugguugcguucgccggc

SEQ ID NO: 905390 - RNA, 16 nt, Mycobacterium avium subsp. paratuberculosis
gacguucgagucggcc

SEQ ID NO: 905391 - RNA, 20 nt, Mycobacterium avium subsp. paratuberculosis
gacguucgagucggccacgu

SEQ ID NO: 905392 - RNA, 16 nt, Mycobacterium avium subsp. paratuberculosis
gacguucgccgccagc

SEQ ID NO: 905393 - RNA, 23 nt, Mycobacterium avium subsp. paratuberculosis
gacguucgcguugagcgucgcca

SEQ ID NO: 905394 - RNA, 13 nt, Mycobacterium avium subsp. paratuberculosis
gacguucggccaa

SEQ ID NO: 905395 - RNA, 15 nt, Mycobacterium avium subsp. paratuberculosis
gacguugaccgcgaa

SEQ ID NO: 905396 - RNA, 16 nt, Mycobacterium avium subsp. paratuberculosis
gacguugagcacccgg

SEQ ID NO: 905397 - RNA, 19 nt, Mycobacterium avium subsp. paratuberculosis
gacguugaucgcgccgauc

SEQ ID NO: 905398 - RNA, 13 nt, Mycobacterium avium subsp. paratuberculosis
gacguugccgauc

SEQ ID NO: 905399 - RNA, 22 nt, Mycobacterium avium subsp. paratuberculosis
gacguugccgaucccggccagc

SEQ ID NO: 905400 - RNA, 23 nt, Mycobacterium avium subsp. paratuberculosis
gacguugccgaucccggccagca

SEQ ID NO: 905401 - RNA, 14 nt, Mycobacterium avium subsp. paratuberculosis
gacguugccgcaca

SEQ ID NO: 905402 - RNA, 15 nt, Mycobacterium avium subsp. paratuberculosis
gacguugccgcacac

SEQ ID NO: 905403 - RNA, 20 nt, Mycobacterium avium subsp. paratuberculosis
gacguugccgcacaccgcgc

SEQ ID NO: 905404 - RNA, 15 nt, Mycobacterium avium subsp. paratuberculosis
gacguuggugaucgc

SEQ ID NO: 905405 - RNA, 19 nt, Mycobacterium avium subsp. paratuberculosis
gacguuggugaucgccgac

SEQ ID NO: 905406 - RNA, 12 nt, Mycobacterium avium subsp. paratuberculosis
gacgugcagcgc

SEQ ID NO: 905407 - RNA, 17 nt, Mycobacterium avium subsp. paratuberculosis
gacgugcgacaccggcg

SEQ ID NO: 905408 - RNA, 20 nt, Mycobacterium avium subsp. paratuberculosis
gacgugcgacaccggcguga

SEQ ID NO: 905409 - RNA, 13 nt, Mycobacterium avium subsp. paratuberculosis
gacgugcgcggcg

SEQ ID NO: 905410 - RNA, 15 nt, Mycobacterium avium subsp. paratuberculosis
gacgugcucggcggc

SEQ ID NO: 905411 - RNA, 16 nt, Mycobacterium avium subsp. paratuberculosis
gacgugcucggcggcc

SEQ ID NO: 905412 - RNA, 18 nt, Mycobacterium avium subsp. paratuberculosis
gacgugcucggcggccgc

SEQ ID NO: 905413 - RNA, 19 nt, Mycobacterium avium subsp. paratuberculosis
gacgugcucggcggccgcc

SEQ ID NO: 905414 - RNA, 17 nt, Mycobacterium avium subsp. paratuberculosis
gacgugcuuggccagcu

SEQ ID NO: 905415 - RNA, 19 nt, Mycobacterium avium subsp. paratuberculosis
gacgugcuuggccagcucg

SEQ ID NO: 905416 - RNA, 21 nt, Mycobacterium avium subsp. paratuberculosis
gacgugcuuggccagcucggc

SEQ ID NO: 905417 - RNA, 16 nt, Mycobacterium avium subsp. paratuberculosis
gacguggcggccgucg

SEQ ID NO: 905418 - RNA, 21 nt, Mycobacterium avium subsp. paratuberculosis
gacguggcggccgucgcgcac

SEQ ID NO: 905419 - RNA, 13 nt, Mycobacterium avium subsp. paratuberculosis
gacguggcggcgg

SEQ ID NO: 905420 - RNA, 15 nt, Mycobacterium avium subsp. paratuberculosis
gacguggcggcggug

SEQ ID NO: 905421 - RNA, 16 nt, Mycobacterium avium subsp. paratuberculosis
gacguguggcacccgg

SEQ ID NO: 905422 - RNA, 18 nt, Mycobacterium avium subsp. paratuberculosis
gacguguggcacccgggu

SEQ ID NO: 905423 - RNA, 19 nt, Mycobacterium avium subsp. paratuberculosis
gacguguucaacgcgccga

SEQ ID NO: 905424 - RNA, 20 nt, Mycobacterium avium subsp. paratuberculosis
gacguguucaacgcgccgau

SEQ ID NO: 905425 - RNA, 21 nt, Mycobacterium avium subsp. paratuberculosis
gacguguucaacgcgccgaug

SEQ ID NO: 905426 - RNA, 19 nt, Mycobacterium avium subsp. paratuberculosis
gacguggugcaccgccagc

SEQ ID NO: 905427 - RNA, 21 nt, Mycobacterium avium subsp. paratuberculosis
gacguggugcaccgccagcgc

SEQ ID NO: 905428 - RNA, 22 nt, Mycobacterium avium subsp. paratuberculosis
gacguggugcaccgccagcgcg

SEQ ID NO: 905429 - RNA, 24 nt, Mycobacterium avium subsp. paratuberculosis
gacguggugcaccgccagcgcggc

SEQ ID NO: 905430 - RNA, 21 nt, Mycobacterium avium subsp. paratuberculosis
gacgugguggaugaugccggc

SEQ ID NO: 905431 - RNA, 22 nt, Mycobacterium avium subsp. paratuberculosis
gacgugguggaugaugccggcg

SEQ ID NO: 905432 - RNA, 22 nt, Mycobacterium avium subsp. paratuberculosis
gacguggaucucgaacggcccg

SEQ ID NO: 905433 - RNA, 21 nt, Mycobacterium avium subsp. paratuberculosis
gacgugggugguggugccguc

SEQ ID NO: 905434 - RNA, 18 nt, Mycobacterium avium subsp. paratuberculosis
gacggcucuucgcggcgg

SEQ ID NO: 905435 - RNA, 22 nt, Mycobacterium avium subsp. paratuberculosis
gacggcugcgguuggccggccg

SEQ ID NO: 905436 - RNA, 23 nt, Mycobacterium avium subsp. paratuberculosis
gacggcugcgguuggccggccgg

SEQ ID NO: 905437 - RNA, 21 nt, Mycobacterium avium subsp. paratuberculosis
gacggcguggcugaggccgcc

SEQ ID NO: 905438 - RNA, 19 nt, Mycobacterium avium subsp. paratuberculosis
gacggcguugcuggcgcga

SEQ ID NO: 905439 - RNA, 20 nt, Mycobacterium avium subsp. paratuberculosis
gacggcuccuaugucggugc

SEQ ID NO: 905440 - RNA, 14 nt, Mycobacterium avium subsp. paratuberculosis
gacggcgucggcga

SEQ ID NO: 905441 - RNA, 16 nt, Mycobacterium avium subsp. paratuberculosis
gacggcgucggcggcc

SEQ ID NO: 905442 - RNA, 10 nt, Mycobacterium avium subsp. paratuberculosis
gacggcgucc

SEQ ID NO: 905443 - RNA, 15 nt, Mycobacterium avium subsp. paratuberculosis
gacggcguccagcug

SEQ ID NO: 905444 - RNA, 17 nt, Mycobacterium avium subsp. paratuberculosis
gacggcguccagcugcg

SEQ ID NO: 905445 - RNA, 16 nt, Mycobacterium avium subsp. paratuberculosis
gacggcguccgggcgc

SEQ ID NO: 905446 - RNA, 21 nt, Mycobacterium avium subsp. paratuberculosis
gacggcggggaugcccggggg

SEQ ID NO: 905447 - RNA, 19 nt, Mycobacterium avium subsp. paratuberculosis
gacggcggggcggaugcgc

SEQ ID NO: 905448 - RNA, 19 nt, Mycobacterium avium subsp. paratuberculosis
gacggcggggugcgcggcg

SEQ ID NO: 905449 - RNA, 13 nt, Mycobacterium avium subsp. paratuberculosis
gacggcggguggg

SEQ ID NO: 905450 - RNA, 19 nt, Mycobacterium avium subsp. paratuberculosis
gacggcggugggcucggcc

SEQ ID NO: 905451 - RNA, 17 nt, Mycobacterium avium subsp. paratuberculosis
gacggcgguucgaagcg

SEQ ID NO: 905452 - RNA, 15 nt, Mycobacterium avium subsp. paratuberculosis
gacggauccgggcgc

SEQ ID NO: 905453 - RNA, 23 nt, Mycobacterium avium subsp. paratuberculosis
gacggaucgagucccgcgcggcg

SEQ ID NO: 905454 - RNA, 16 nt, Mycobacterium avium subsp. paratuberculosis
gacggaugugacgcgg

SEQ ID NO: 905455 - RNA, 19 nt, Mycobacterium avium subsp. paratuberculosis
gacggaugugacgcgggac

SEQ ID NO: 905456 - RNA, 22 nt, Mycobacterium avium subsp. paratuberculosis
gacggaugugacgcgggaccgg

SEQ ID NO: 905457 - RNA, 21 nt, Mycobacterium avium subsp. paratuberculosis
gacggauguggucggccacga

SEQ ID NO: 905458 - RNA, 13 nt, Mycobacterium avium subsp. paratuberculosis
gacggaucggccg

SEQ ID NO: 905459 - RNA, 15 nt, Mycobacterium avium subsp. paratuberculosis
gacggaucggccgcg

SEQ ID NO: 905460 - RNA, 15 nt, Mycobacterium avium subsp. paratuberculosis
gacggauucccgaac

SEQ ID NO: 905461 - RNA, 23 nt, Mycobacterium avium subsp. paratuberculosis
gacggcaagcaguaugcccgccg

SEQ ID NO: 905462 - RNA, 15 nt, Mycobacterium avium subsp. paratuberculosis
gacggcggcggugcc

SEQ ID NO: 905463 - RNA, 16 nt, Mycobacterium avium subsp. paratuberculosis
gacggcggcggugccg

SEQ ID NO: 905464 - RNA, 24 nt, Mycobacterium avium subsp. paratuberculosis
gacggcggcggugccgcaggcgaa

SEQ ID NO: 905465 - RNA, 23 nt, Mycobacterium avium subsp. paratuberculosis
gacggcggcgucccagugcucga

SEQ ID NO: 905466 - RNA, 13 nt, Mycobacterium avium subsp. paratuberculosis
gacggcggcgccc

SEQ ID NO: 905467 - RNA, 14 nt, Mycobacterium avium subsp. paratuberculosis
gacggcggcgcccu

SEQ ID NO: 905468 - RNA, 15 nt, Mycobacterium avium subsp. paratuberculosis
gacggcggcgcccug

SEQ ID NO: 905469 - RNA, 16 nt, Mycobacterium avium subsp. paratuberculosis
gacggcggcgcccugc

SEQ ID NO: 905470 - RNA, 23 nt, Mycobacterium avium subsp. paratuberculosis
gacggcggccgucuugcccggcg

SEQ ID NO: 905471 - RNA, 13 nt, Mycobacterium avium subsp. paratuberculosis
gacggcggcgagu

SEQ ID NO: 905472 - RNA, 17 nt, Mycobacterium avium subsp. paratuberculosis
gacggcggcgaguucgg

SEQ ID NO: 905473 - RNA, 15 nt, Mycobacterium avium subsp. paratuberculosis
gacggcacccggccc

SEQ ID NO: 905474 - RNA, 13 nt, Mycobacterium avium subsp. paratuberculosis
gacggcaccgacg

SEQ ID NO: 905475 - RNA, 23 nt, Mycobacterium avium subsp. paratuberculosis
gacggcaccgacggagccgagca

SEQ ID NO: 905476 - RNA, 19 nt, Mycobacterium avium subsp. paratuberculosis
gacggcgcuguaccgcgag

SEQ ID NO: 905477 - RNA, 22 nt, Mycobacterium avium subsp. paratuberculosis
gacggcgcuguaccgcgagauc

SEQ ID NO: 905478 - RNA, 13 nt, Mycobacterium avium subsp. paratuberculosis
gacggcugcccgg

SEQ ID NO: 905479 - RNA, 17 nt, Mycobacterium avium subsp. paratuberculosis
gacggcugcccggcccg

SEQ ID NO: 905480 - RNA, 19 nt, Mycobacterium avium subsp. paratuberculosis
gacggcugcccggcccgcc

SEQ ID NO: 905481 - RNA, 16 nt, Mycobacterium avium subsp. paratuberculosis
gacgggucggcggcga

SEQ ID NO: 905482 - RNA, 16 nt, Mycobacterium avium subsp. paratuberculosis
gacggguucgcgcagc

SEQ ID NO: 905483 - RNA, 17 nt, Mycobacterium avium subsp. paratuberculosis
gacggguucgcgcagcc

SEQ ID NO: 905484 - RNA, 16 nt, Mycobacterium avium subsp. paratuberculosis
gacggguugcggucca

SEQ ID NO: 905485 - RNA, 19 nt, Mycobacterium avium subsp. paratuberculosis
gacggguugggcgccagca

SEQ ID NO: 905486 - RNA, 21 nt, Mycobacterium avium subsp. paratuberculosis
gacggguugggcgccagcagc

SEQ ID NO: 905487 - RNA, 22 nt, Mycobacterium avium subsp. paratuberculosis
gacggguugggcgccagcagca

SEQ ID NO: 905488 - RNA, 18 nt, Mycobacterium avium subsp. paratuberculosis
gacggguuggucggcgcg

SEQ ID NO: 905489 - RNA, 21 nt, Mycobacterium avium subsp. paratuberculosis
gacggguuggucggcgcggcg

SEQ ID NO: 905490 - RNA, 13 nt, Mycobacterium avium subsp. paratuberculosis
gacggucaccggc

SEQ ID NO: 905491 - RNA, 20 nt, Mycobacterium avium subsp. paratuberculosis
gacggucacgcuggcgugac

SEQ ID NO: 905492 - RNA, 14 nt, Mycobacterium avium subsp. paratuberculosis
gacggucacggccg

SEQ ID NO: 905493 - RNA, 16 nt, Mycobacterium avium subsp. paratuberculosis
gacggucacggccgcc

SEQ ID NO: 905494 - RNA, 17 nt, Mycobacterium avium subsp. paratuberculosis
gacggucacggccgcca

SEQ ID NO: 905495 - RNA, 20 nt, Mycobacterium avium subsp. paratuberculosis
gacggucacggccgccagca

SEQ ID NO: 905496 - RNA, 13 nt, Mycobacterium avium subsp. paratuberculosis
gacggucagcgcg

SEQ ID NO: 905497 - RNA, 14 nt, Mycobacterium avium subsp. paratuberculosis
gacggucagcgcgc

SEQ ID NO: 905498 - RNA, 15 nt, Mycobacterium avium subsp. paratuberculosis
gacggucagcgcgcc

SEQ ID NO: 905499 - RNA, 16 nt, Mycobacterium avium subsp. paratuberculosis
gacggucagcgcgccg

SEQ ID NO: 905500 - RNA, 16 nt, Mycobacterium avium subsp. paratuberculosis
gacgguaugcccgccg

SEQ ID NO: 905501 - RNA, 19 nt, Mycobacterium avium subsp. paratuberculosis
gacgguaugcccgccgcgu

SEQ ID NO: 905502 - RNA, 18 nt, Mycobacterium avium subsp. paratuberculosis
gacggucgaccucgagcg

SEQ ID NO: 905503 - RNA, 13 nt, Mycobacterium avium subsp. paratuberculosis
gacggucgggccc

SEQ ID NO: 905504 - RNA, 23 nt, Mycobacterium avium subsp. paratuberculosis
gacgguggccgucucgucggccg

SEQ ID NO: 905505 - RNA, 16 nt, Mycobacterium avium subsp. paratuberculosis
gacgguggccucggcg

SEQ ID NO: 905506 - RNA, 17 nt, Mycobacterium avium subsp. paratuberculosis
gacgguggccucggcgc

SEQ ID NO: 905507 - RNA, 18 nt, Mycobacterium avium subsp. paratuberculosis
gacgguggccucggcgcu

SEQ ID NO: 905508 - RNA, 17 nt, Mycobacterium avium subsp. paratuberculosis
gacgguccgcucaucgu

SEQ ID NO: 905509 - RNA, 23 nt, Mycobacterium avium subsp. paratuberculosis
gacggucagguucuucugcgcga

SEQ ID NO: 905510 - RNA, 15 nt, Mycobacterium avium subsp. paratuberculosis
gacggucaugccgag

SEQ ID NO: 905511 - RNA, 22 nt, Mycobacterium avium subsp. paratuberculosis
gacgguggcccccaccacgaag

SEQ ID NO: 905512 - RNA, 16 nt, Mycobacterium avium subsp. paratuberculosis
gacgguguaggacgcc

SEQ ID NO: 905513 - RNA, 19 nt, Mycobacterium avium subsp. paratuberculosis
gacgguguccgcggcgucg

SEQ ID NO: 905514 - RNA, 20 nt, Mycobacterium avium subsp. paratuberculosis
gacgguguccgcggcgucgg

SEQ ID NO: 905515 - RNA, 13 nt, Mycobacterium avium subsp. paratuberculosis
gacggugucgccc

SEQ ID NO: 905516 - RNA, 14 nt, Mycobacterium avium subsp. paratuberculosis
gacggugucgcccu

SEQ ID NO: 905517 - RNA, 19 nt, Mycobacterium avium subsp. paratuberculosis
gacggugucgcccucgcgc

SEQ ID NO: 905518 - RNA, 16 nt, Mycobacterium avium subsp. paratuberculosis
gacgguggggcuggcc

SEQ ID NO: 905519 - RNA, 17 nt, Mycobacterium avium subsp. paratuberculosis
gacgguggggcuggccg

SEQ ID NO: 905520 - RNA, 21 nt, Mycobacterium avium subsp. paratuberculosis
gacgguggggcuggccgcacg

SEQ ID NO: 905521 - RNA, 22 nt, Mycobacterium avium subsp. paratuberculosis
gacgguggggcuggccgcacgg

SEQ ID NO: 905522 - RNA, 14 nt, Mycobacterium avium subsp. paratuberculosis
gacggugggcccgc

SEQ ID NO: 905523 - RNA, 15 nt, Mycobacterium avium subsp. paratuberculosis
gacggugggcccgcc

SEQ ID NO: 905524 - RNA, 20 nt, Mycobacterium avium subsp. paratuberculosis
gacggugggcccgccgucga

SEQ ID NO: 905525 - RNA, 14 nt, Mycobacterium avium subsp. paratuberculosis
gacgguggcgggcc

SEQ ID NO: 905526 - RNA, 17 nt, Mycobacterium avium subsp. paratuberculosis
gacgguggcgggccgcc

SEQ ID NO: 905527 - RNA, 21 nt, Mycobacterium avium subsp. paratuberculosis
gacgguggcgggccgccgggu

SEQ ID NO: 905528 - RNA, 19 nt, Mycobacterium avium subsp. paratuberculosis
gacgguggcguccucgacg

SEQ ID NO: 905529 - RNA, 19 nt, Mycobacterium avium subsp. paratuberculosis
gacgccgaagaucagcgcg

SEQ ID NO: 905530 - RNA, 22 nt, Mycobacterium avium subsp. paratuberculosis
gacgcccuuggcgcccagcgug

SEQ ID NO: 905531 - RNA, 21 nt, Mycobacterium avium subsp. paratuberculosis
gacgcccuuguccucgagccg

SEQ ID NO: 905532 - RNA, 13 nt, Mycobacterium avium subsp. paratuberculosis
gacgccgacggca

SEQ ID NO: 905533 - RNA, 15 nt, Mycobacterium avium subsp. paratuberculosis
gacgccgacggcaau

SEQ ID NO: 905534 - RNA, 19 nt, Mycobacterium avium subsp. paratuberculosis
gacgccgacguaggacagc

SEQ ID NO: 905535 - RNA, 20 nt, Mycobacterium avium subsp. paratuberculosis
gacgccgaauccgggcaugc

SEQ ID NO: 905536 - RNA, 21 nt, Mycobacterium avium subsp. paratuberculosis
gacgccgaauccgggcaugcu

SEQ ID NO: 905537 - RNA, 22 nt, Mycobacterium avium subsp. paratuberculosis
gacgccgaauccgggcaugcuc

SEQ ID NO: 905538 - RNA, 14 nt, Mycobacterium avium subsp. paratuberculosis
gacgccgacaccag

SEQ ID NO: 905539 - RNA, 17 nt, Mycobacterium avium subsp. paratuberculosis
gacgccgacaccagcgc

SEQ ID NO: 905540 - RNA, 18 nt, Mycobacterium avium subsp. paratuberculosis
gacgccgacaccagcgcg

SEQ ID NO: 905541 - RNA, 19 nt, Mycobacterium avium subsp. paratuberculosis
gacgccgacaccagcgcgc

SEQ ID NO: 905542 - RNA, 16 nt, Mycobacterium avium subsp. paratuberculosis
gacgccgacagcgaca

SEQ ID NO: 905543 - RNA, 16 nt, Mycobacterium avium subsp. paratuberculosis
gacgcccggucgacca

SEQ ID NO: 905544 - RNA, 14 nt, Mycobacterium avium subsp. paratuberculosis
gacgcccgucgcgc

SEQ ID NO: 905545 - RNA, 22 nt, Mycobacterium avium subsp. paratuberculosis
gacgcccuccuggcggguggcg

SEQ ID NO: 905546 - RNA, 11 nt, Mycobacterium avium subsp. paratuberculosis
gacgcccggcg

SEQ ID NO: 905547 - RNA, 14 nt, Mycobacterium avium subsp. paratuberculosis
gacgcccggcgagu

SEQ ID NO: 905548 - RNA, 14 nt, Mycobacterium avium subsp. paratuberculosis
gacgcccccgguga

SEQ ID NO: 905549 - RNA, 11 nt, Mycobacterium avium subsp. paratuberculosis
gacgcccgcga

SEQ ID NO: 905550 - RNA, 13 nt, Mycobacterium avium subsp. paratuberculosis
gacgcccgcgacc

SEQ ID NO: 905551 - RNA, 16 nt, Mycobacterium avium subsp. paratuberculosis
gacgcccgcgacccga

SEQ ID NO: 905552 - RNA, 12 nt, Mycobacterium avium subsp. paratuberculosis
gacgcccgcgag

SEQ ID NO: 905553 - RNA, 23 nt, Mycobacterium avium subsp. paratuberculosis
gacgccgaccgcggucgcggcgc

SEQ ID NO: 905554 - RNA, 15 nt, Mycobacterium avium subsp. paratuberculosis
gacgccgagcagcuc

SEQ ID NO: 905555 - RNA, 17 nt, Mycobacterium avium subsp. paratuberculosis
gacgccgagcagcucag

SEQ ID NO: 905556 - RNA, 20 nt, Mycobacterium avium subsp. paratuberculosis
gacgccgagcagcucagccg

SEQ ID NO: 905557 - RNA, 20 nt, Mycobacterium avium subsp. paratuberculosis
gacgccgaguaacucggccu

SEQ ID NO: 905558 - RNA, 16 nt, Mycobacterium avium subsp. paratuberculosis
gacgccgauccgcagc

SEQ ID NO: 905559 - RNA, 17 nt, Mycobacterium avium subsp. paratuberculosis
gacgccgauccgcagcc

SEQ ID NO: 905560 - RNA, 23 nt, Mycobacterium avium subsp. paratuberculosis
gacgccgauccgcugcggauccg

SEQ ID NO: 905561 - RNA, 13 nt, Mycobacterium avium subsp. paratuberculosis
gacgccgaugauc

SEQ ID NO: 905562 - RNA, 18 nt, Mycobacterium avium subsp. paratuberculosis
gacgccgaugaucugguu

SEQ ID NO: 905563 - RNA, 17 nt, Mycobacterium avium subsp. paratuberculosis
gacgccgauggugaccu

SEQ ID NO: 905564 - RNA, 20 nt, Mycobacterium avium subsp. paratuberculosis
gacgccgauggugaccucgg

SEQ ID NO: 905565 - RNA, 24 nt, Mycobacterium avium subsp. paratuberculosis
gacgccgauggugaccucggucga

SEQ ID NO: 905566 - RNA, 20 nt, Mycobacterium avium subsp. paratuberculosis
gacgccgaugugcucgguca

SEQ ID NO: 905567 - RNA, 21 nt, Mycobacterium avium subsp. paratuberculosis
gacgccgcacgaauugccggu

SEQ ID NO: 905568 - RNA, 23 nt, Mycobacterium avium subsp. paratuberculosis
gacgccgcacgaauugccggugg

SEQ ID NO: 905569 - RNA, 13 nt, Mycobacterium avium subsp. paratuberculosis
gacgccgcacgcg

SEQ ID NO: 905570 - RNA, 15 nt, Mycobacterium avium subsp. paratuberculosis
gacgccggaccccac

SEQ ID NO: 905571 - RNA, 21 nt, Mycobacterium avium subsp. paratuberculosis
gacgccggaccccacagcgcg

SEQ ID NO: 905572 - RNA, 22 nt, Mycobacterium avium subsp. paratuberculosis
gacgccggaccccacagcgcgc

SEQ ID NO: 905573 - RNA, 15 nt, Mycobacterium avium subsp. paratuberculosis
gacgccgggcagcgc

SEQ ID NO: 905574 - RNA, 21 nt, Mycobacterium avium subsp. paratuberculosis
gacgccgggcagcgcgcgaga

SEQ ID NO: 905575 - RNA, 14 nt, Mycobacterium avium subsp. paratuberculosis
gacgccgggccgcc

SEQ ID NO: 905576 - RNA, 15 nt, Mycobacterium avium subsp. paratuberculosis
gacgccgggccgccg

SEQ ID NO: 905577 - RNA, 18 nt, Mycobacterium avium subsp. paratuberculosis
gacgccgggccgccgcgg

SEQ ID NO: 905578 - RNA, 16 nt, Mycobacterium avium subsp. paratuberculosis
gacgccggucgcugcg

SEQ ID NO: 905579 - RNA, 20 nt, Mycobacterium avium subsp. paratuberculosis
gacgccggugaaaccggcgc

SEQ ID NO: 905580 - RNA, 23 nt, Mycobacterium avium subsp. paratuberculosis
gacgccggugaaaccggcgccga

SEQ ID NO: 905581 - RNA, 21 nt, Mycobacterium avium subsp. paratuberculosis
gacgccggcgaggcggucggc

SEQ ID NO: 905582 - RNA, 23 nt, Mycobacterium avium subsp. paratuberculosis
gacgccggcgaggcggucggcgg

SEQ ID NO: 905583 - RNA, 17 nt, Mycobacterium avium subsp. paratuberculosis
gacgccggccaccaaca

SEQ ID NO: 905584 - RNA, 16 nt, Mycobacterium avium subsp. paratuberculosis
gacgccggauaccccg

SEQ ID NO: 905585 - RNA, 18 nt, Mycobacterium avium subsp. paratuberculosis
gacgccggauaccccgga

SEQ ID NO: 905586 - RNA, 12 nt, Mycobacterium avium subsp. paratuberculosis
gacgccggcagc

SEQ ID NO: 905587 - RNA, 16 nt, Mycobacterium avium subsp. paratuberculosis
gacgccggcagccgcu

SEQ ID NO: 905588 - RNA, 17 nt, Mycobacterium avium subsp. paratuberculosis
gacgccggcagccgcuc

SEQ ID NO: 905589 - RNA, 19 nt, Mycobacterium avium subsp. paratuberculosis
gacgccggcagccgcucgg

SEQ ID NO: 905590 - RNA, 17 nt, Mycobacterium avium subsp. paratuberculosis
gacgccaguucgucggc

SEQ ID NO: 905591 - RNA, 21 nt, Mycobacterium avium subsp. paratuberculosis
gacgccaguucgucggccguc

SEQ ID NO: 905592 - RNA, 19 nt, Mycobacterium avium subsp. paratuberculosis
gacgccaguggcugcacgu

SEQ ID NO: 905593 - RNA, 15 nt, Mycobacterium avium subsp. paratuberculosis
gacgccagcggcagc

SEQ ID NO: 905594 - RNA, 13 nt, Mycobacterium avium subsp. paratuberculosis
gacgccagcgggc

SEQ ID NO: 905595 - RNA, 17 nt, Mycobacterium avium subsp. paratuberculosis
gacgccagcugccgcga

SEQ ID NO: 905596 - RNA, 18 nt, Mycobacterium avium subsp. paratuberculosis
gacgcauccacggccggu

SEQ ID NO: 905597 - RNA, 17 nt, Mycobacterium avium subsp. paratuberculosis
gacgcccaacuacccgc

SEQ ID NO: 905598 - RNA, 14 nt, Mycobacterium avium subsp. paratuberculosis
gacgcccacagcgc

SEQ ID NO: 905599 - RNA, 16 nt, Mycobacterium avium subsp. paratuberculosis
gacgcccacagcgcca

SEQ ID NO: 905600 - RNA, 17 nt, Mycobacterium avium subsp. paratuberculosis
gacgccaugggcccagc

SEQ ID NO: 905601 - RNA, 13 nt, Mycobacterium avium subsp. paratuberculosis
gacgcccagcgcg

SEQ ID NO: 905602 - RNA, 22 nt, Mycobacterium avium subsp. paratuberculosis
gacgcccacugguaaccgcccg

SEQ ID NO: 905603 - RNA, 19 nt, Mycobacterium avium subsp. paratuberculosis
gacgcccagaacgacgcgc

SEQ ID NO: 905604 - RNA, 24 nt, Mycobacterium avium subsp. paratuberculosis
gacgcccagaacgacgcgcucagc

SEQ ID NO: 905605 - RNA, 16 nt, Mycobacterium avium subsp. paratuberculosis
gacgcccagaacuggg

SEQ ID NO: 905606 - RNA, 21 nt, Mycobacterium avium subsp. paratuberculosis
gacgcccagaacugggccgcc

SEQ ID NO: 905607 - RNA, 22 nt, Mycobacterium avium subsp. paratuberculosis
gacgcccagaacugggccgccg

SEQ ID NO: 905608 - RNA, 13 nt, Mycobacterium avium subsp. paratuberculosis
gacgcccagcacc

SEQ ID NO: 905609 - RNA, 14 nt, Mycobacterium avium subsp. paratuberculosis
gacgcccagcaccg

SEQ ID NO: 905610 - RNA, 16 nt, Mycobacterium avium subsp. paratuberculosis
gacgaauuccgcaccg

SEQ ID NO: 905611 - RNA, 15 nt, Mycobacterium avium subsp. paratuberculosis
gacgacaccaccgug

SEQ ID NO: 905612 - RNA, 18 nt, Mycobacterium avium subsp. paratuberculosis
gacgacaccaccgugcug

SEQ ID NO: 905613 - RNA, 19 nt, Mycobacterium avium subsp. paratuberculosis
gacgacacccuucaucagc

SEQ ID NO: 905614 - RNA, 21 nt, Mycobacterium avium subsp. paratuberculosis
gacgaauccggugaccgccuc

SEQ ID NO: 905615 - RNA, 14 nt, Mycobacterium avium subsp. paratuberculosis
gacgaagcggucgc

SEQ ID NO: 905616 - RNA, 20 nt, Mycobacterium avium subsp. paratuberculosis
gacgaagucggucagcgucg

SEQ ID NO: 905617 - RNA, 15 nt, Mycobacterium avium subsp. paratuberculosis
gacgcagccgauguc

SEQ ID NO: 905618 - RNA, 18 nt, Mycobacterium avium subsp. paratuberculosis
gacgcggcucgcgcggug

SEQ ID NO: 905619 - RNA, 20 nt, Mycobacterium avium subsp. paratuberculosis
gacgcggcucgcgcgguguu

SEQ ID NO: 905620 - RNA, 21 nt, Mycobacterium avium subsp. paratuberculosis
gacgcgggaccgggcccggcg

SEQ ID NO: 905621 - RNA, 22 nt, Mycobacterium avium subsp. paratuberculosis
gacgcgccacgccccggcgccg

SEQ ID NO: 905622 - RNA, 14 nt, Mycobacterium avium subsp. paratuberculosis
gacgcgggccggca

SEQ ID NO: 905623 - RNA, 18 nt, Mycobacterium avium subsp. paratuberculosis
gacgcgggccggcacccg

SEQ ID NO: 905624 - RNA, 22 nt, Mycobacterium avium subsp. paratuberculosis
gacgcgggccggcacccgggcc

SEQ ID NO: 905625 - RNA, 14 nt, Mycobacterium avium subsp. paratuberculosis
gacgcgggcgccca

SEQ ID NO: 905626 - RNA, 16 nt, Mycobacterium avium subsp. paratuberculosis
gacgcgggcgcccagc

SEQ ID NO: 905627 - RNA, 19 nt, Mycobacterium avium subsp. paratuberculosis
gacgcgcacacggccucgc

SEQ ID NO: 905628 - RNA, 16 nt, Mycobacterium avium subsp. paratuberculosis
gacgcgcaccagggcc

SEQ ID NO: 905629 - RNA, 19 nt, Mycobacterium avium subsp. paratuberculosis
gacgcgcaccagggccgcg

SEQ ID NO: 905630 - RNA, 21 nt, Mycobacterium avium subsp. paratuberculosis
gacgccguagaucacgccggu

SEQ ID NO: 905631 - RNA, 21 nt, Mycobacterium avium subsp. paratuberculosis
gacgccgucacggaucgccca

SEQ ID NO: 905632 - RNA, 18 nt, Mycobacterium avium subsp. paratuberculosis
gacgcgcacccgggaccg

SEQ ID NO: 905633 - RNA, 12 nt, Mycobacterium avium subsp. paratuberculosis
gacgcgcaccgc

SEQ ID NO: 905634 - RNA, 13 nt, Mycobacterium avium subsp. paratuberculosis
gacgcgcaccgcc

SEQ ID NO: 905635 - RNA, 18 nt, Mycobacterium avium subsp. paratuberculosis
gacgcgcaccgccaccgc

SEQ ID NO: 905636 - RNA, 20 nt, Mycobacterium avium subsp. paratuberculosis
gacgcgcagaucgucgaacu

SEQ ID NO: 905637 - RNA, 17 nt, Mycobacterium avium subsp. paratuberculosis
gacgcucgacggccggc

SEQ ID NO: 905638 - RNA, 19 nt, Mycobacterium avium subsp. paratuberculosis
gacgcucgaggccccgcgu

SEQ ID NO: 905639 - RNA, 19 nt, Mycobacterium avium subsp. paratuberculosis
gacgcucgccaccccgcgc

SEQ ID NO: 905640 - RNA, 13 nt, Mycobacterium avium subsp. paratuberculosis
gacgcucgccggc

SEQ ID NO: 905641 - RNA, 19 nt, Mycobacterium avium subsp. paratuberculosis
gacgcucgccggcggccgc

SEQ ID NO: 905642 - RNA, 21 nt, Mycobacterium avium subsp. paratuberculosis
gacgcucgcgguugggccgcc

SEQ ID NO: 905643 - RNA, 13 nt, Mycobacterium avium subsp. paratuberculosis
gacgcucggcgau

SEQ ID NO: 905644 - RNA, 16 nt, Mycobacterium avium subsp. paratuberculosis
gacgcucggcgccggc

SEQ ID NO: 905645 - RNA, 13 nt, Mycobacterium avium subsp. paratuberculosis
gacgcucggcgcg

SEQ ID NO: 905646 - RNA, 13 nt, Mycobacterium avium subsp. paratuberculosis
gacgcucggcggc

SEQ ID NO: 905647 - RNA, 14 nt, Mycobacterium avium subsp. paratuberculosis
gacgcucggcggcc

SEQ ID NO: 905648 - RNA, 14 nt, Mycobacterium avium subsp. paratuberculosis
gacgcggucaccgg

SEQ ID NO: 905649 - RNA, 19 nt, Mycobacterium avium subsp. paratuberculosis
gacgcggucaccggcucgg

SEQ ID NO: 905650 - RNA, 17 nt, Mycobacterium avium subsp. paratuberculosis
gacgcggggcggcggcg

SEQ ID NO: 905651 - RNA, 14 nt, Mycobacterium avium subsp. paratuberculosis
gacgcggucgaaca

SEQ ID NO: 905652 - RNA, 15 nt, Mycobacterium avium subsp. paratuberculosis
gacgcggucgccgcc

SEQ ID NO: 905653 - RNA, 22 nt, Mycobacterium avium subsp. paratuberculosis
gacgcggucgucgucgucggug

SEQ ID NO: 905654 - RNA, 16 nt, Mycobacterium avium subsp. paratuberculosis
gacgcggucugcggug

SEQ ID NO: 905655 - RNA, 21 nt, Mycobacterium avium subsp. paratuberculosis
gacgcggugacaugcccgggc

SEQ ID NO: 905656 - RNA, 12 nt, Mycobacterium avium subsp. paratuberculosis
gacgcggugacg

SEQ ID NO: 905657 - RNA, 16 nt, Mycobacterium avium subsp. paratuberculosis
gacgcggugagcgcgc

SEQ ID NO: 905658 - RNA, 19 nt, Mycobacterium avium subsp. paratuberculosis
gacgcggugagcgcgccgg

SEQ ID NO: 905659 - RNA, 20 nt, Mycobacterium avium subsp. paratuberculosis
gacgcggugagcgcgccggc

SEQ ID NO: 905660 - RNA, 16 nt, Mycobacterium avium subsp. paratuberculosis
gacgcugaacagcagc

SEQ ID NO: 905661 - RNA, 17 nt, Mycobacterium avium subsp. paratuberculosis
gacgcugaacagcagca

SEQ ID NO: 905662 - RNA, 17 nt, Mycobacterium avium subsp. paratuberculosis
gacgcugaacagcccga

SEQ ID NO: 905663 - RNA, 18 nt, Mycobacterium avium subsp. paratuberculosis
gacgcugaccgugguguc

SEQ ID NO: 905664 - RNA, 16 nt, Mycobacterium avium subsp. paratuberculosis
gacgcugacgaugcgg

SEQ ID NO: 905665 - RNA, 19 nt, Mycobacterium avium subsp. paratuberculosis
gacgcugacgaugcggccg

SEQ ID NO: 905666 - RNA, 16 nt, Mycobacterium avium subsp. paratuberculosis
gacgcugagcacccgc

SEQ ID NO: 905667 - RNA, 21 nt, Mycobacterium avium subsp. paratuberculosis
gacgcugagcacccgcccgga

SEQ ID NO: 905668 - RNA, 15 nt, Mycobacterium avium subsp. paratuberculosis
gacgcugagccgcuc

SEQ ID NO: 905669 - RNA, 12 nt, Mycobacterium avium subsp. paratuberculosis
gacgcugagcgc

SEQ ID NO: 905670 - RNA, 14 nt, Mycobacterium avium subsp. paratuberculosis
gacgcugcaggugg

SEQ ID NO: 905671 - RNA, 18 nt, Mycobacterium avium subsp. paratuberculosis
gacgcugcagguggccca

SEQ ID NO: 905672 - RNA, 21 nt, Mycobacterium avium subsp. paratuberculosis
gacgcugcagguggcccacac

SEQ ID NO: 905673 - RNA, 13 nt, Mycobacterium avium subsp. paratuberculosis
gacgcugccgcgc

SEQ ID NO: 905674 - RNA, 14 nt, Mycobacterium avium subsp. paratuberculosis
gacgcugccgcugg

SEQ ID NO: 905675 - RNA, 15 nt, Mycobacterium avium subsp. paratuberculosis
gacgcugccggggcg

SEQ ID NO: 905676 - RNA, 19 nt, Mycobacterium avium subsp. paratuberculosis
gacgcugccggggcgcagc

SEQ ID NO: 905677 - RNA, 15 nt, Mycobacterium avium subsp. paratuberculosis
gacgcugccgguggu

SEQ ID NO: 905678 - RNA, 14 nt, Mycobacterium avium subsp. paratuberculosis
gacgcuggccacga

SEQ ID NO: 905679 - RNA, 15 nt, Mycobacterium avium subsp. paratuberculosis
gacgcuggccacgau

SEQ ID NO: 905680 - RNA, 14 nt, Mycobacterium avium subsp. paratuberculosis
gacgcugggcggcg

SEQ ID NO: 905681 - RNA, 20 nt, Mycobacterium avium subsp. paratuberculosis
gacggacuugggcgucucga

SEQ ID NO: 905682 - RNA, 13 nt, Mycobacterium avium subsp. paratuberculosis
gacggagacgacc

SEQ ID NO: 905683 - RNA, 23 nt, Mycobacterium avium subsp. paratuberculosis
gacggagacgacgacgaacgcgg

SEQ ID NO: 905684 - RNA, 14 nt, Mycobacterium avium subsp. paratuberculosis
gacggacacccgcg

SEQ ID NO: 905685 - RNA, 18 nt, Mycobacterium avium subsp. paratuberculosis
gacggacacccgcgcggu

SEQ ID NO: 905686 - RNA, 17 nt, Mycobacterium avium subsp. paratuberculosis
gacggagccgagcacca

SEQ ID NO: 905687 - RNA, 17 nt, Mycobacterium avium subsp. paratuberculosis
gacggagccgugcccga

SEQ ID NO: 905688 - RNA, 15 nt, Mycobacterium avium subsp. paratuberculosis
gacggagucgucggc

SEQ ID NO: 905689 - RNA, 16 nt, Mycobacterium avium subsp. paratuberculosis
gacggaguuggaucgc

SEQ ID NO: 905690 - RNA, 18 nt, Mycobacterium avium subsp. paratuberculosis
gacggaguuggaucgccg

SEQ ID NO: 905691 - RNA, 12 nt, Mycobacterium avium subsp. paratuberculosis
gacgcugguggc

SEQ ID NO: 905692 - RNA, 17 nt, Mycobacterium avium subsp. paratuberculosis
gacgcugguggccugca

SEQ ID NO: 905693 - RNA, 17 nt, Mycobacterium avium subsp. paratuberculosis
gaccuugucgcgcaccc

SEQ ID NO: 905694 - RNA, 18 nt, Mycobacterium avium subsp. paratuberculosis
gaccuuggcgcugaucga

SEQ ID NO: 905695 - RNA, 22 nt, Mycobacterium avium subsp. paratuberculosis
gaccuugggcauccgcucgccg

SEQ ID NO: 905696 - RNA, 16 nt, Mycobacterium avium subsp. paratuberculosis
gacgaaaccgccaugc

SEQ ID NO: 905697 - RNA, 14 nt, Mycobacterium avium subsp. paratuberculosis
gacgaacaucgacg

SEQ ID NO: 905698 - RNA, 23 nt, Mycobacterium avium subsp. paratuberculosis
gacgaacaucgagcccaccgcgc

SEQ ID NO: 905699 - RNA, 17 nt, Mycobacterium avium subsp. paratuberculosis
gacgaacaagggcgggu

SEQ ID NO: 905700 - RNA, 15 nt, Mycobacterium avium subsp. paratuberculosis
gacgaacaccaccgg

SEQ ID NO: 905701 - RNA, 16 nt, Mycobacterium avium subsp. paratuberculosis
gacgaacaccaccggc

SEQ ID NO: 905702 - RNA, 18 nt, Mycobacterium avium subsp. paratuberculosis
gacgaaaucgucgggccg

SEQ ID NO: 905703 - RNA, 15 nt, Mycobacterium avium subsp. paratuberculosis
gacgaacagcaccgc

SEQ ID NO: 905704 - RNA, 22 nt, Mycobacterium avium subsp. paratuberculosis
gacgaacagcaccgccacggcg

SEQ ID NO: 905705 - RNA, 20 nt, Mycobacterium avium subsp. paratuberculosis
gacgaacaugcugccgccgg

SEQ ID NO: 905706 - RNA, 23 nt, Mycobacterium avium subsp. paratuberculosis
gacgaaguagaagaucagcgcca

SEQ ID NO: 905707 - RNA, 13 nt, Mycobacterium avium subsp. paratuberculosis
gaccuucugcugc

SEQ ID NO: 905708 - RNA, 22 nt, Mycobacterium avium subsp. paratuberculosis
gaccuucugcugcacguccgcc

SEQ ID NO: 905709 - RNA, 22 nt, Mycobacterium avium subsp. paratuberculosis
gaccuucgagccgccgccggcg

SEQ ID NO: 905710 - RNA, 14 nt, Mycobacterium avium subsp. paratuberculosis
gaccuugcgcagcc

SEQ ID NO: 905711 - RNA, 16 nt, Mycobacterium avium subsp. paratuberculosis
gaccuugcgcagccgg

SEQ ID NO: 905712 - RNA, 17 nt, Mycobacterium avium subsp. paratuberculosis
gaccuugcgcagccggc

SEQ ID NO: 905713 - RNA, 14 nt, Mycobacterium avium subsp. paratuberculosis
gaccuugcagcccg

SEQ ID NO: 905714 - RNA, 14 nt, Mycobacterium avium subsp. paratuberculosis
gaccugggcggcca

SEQ ID NO: 905715 - RNA, 16 nt, Mycobacterium avium subsp. paratuberculosis
gaccugggucaucacc

SEQ ID NO: 905716 - RNA, 16 nt, Mycobacterium avium subsp. paratuberculosis
gaccugggugcgccac

SEQ ID NO: 905717 - RNA, 15 nt, Mycobacterium avium subsp. paratuberculosis
gaccuucucccgcgg

SEQ ID NO: 905718 - RNA, 18 nt, Mycobacterium avium subsp. paratuberculosis
gaccuucucgaccaggcu

SEQ ID NO: 905719 - RNA, 23 nt, Mycobacterium avium subsp. paratuberculosis
gaccuggcugacggcgucguuga

SEQ ID NO: 905720 - RNA, 15 nt, Mycobacterium avium subsp. paratuberculosis
gaccuggcggccgga

SEQ ID NO: 905721 - RNA, 17 nt, Mycobacterium avium subsp. paratuberculosis
gaccuggcgggccagcu

SEQ ID NO: 905722 - RNA, 13 nt, Mycobacterium avium subsp. paratuberculosis
gaccuggccggcc

SEQ ID NO: 905723 - RNA, 20 nt, Mycobacterium avium subsp. paratuberculosis
gaccgucacccccggcgcga

SEQ ID NO: 905724 - RNA, 14 nt, Mycobacterium avium subsp. paratuberculosis
gaccgucaccgugg

SEQ ID NO: 905725 - RNA, 17 nt, Mycobacterium avium subsp. paratuberculosis
gaccgucaccguggcgg

SEQ ID NO: 905726 - RNA, 12 nt, Mycobacterium avium subsp. paratuberculosis
gaccgucacgcu

SEQ ID NO: 905727 - RNA, 18 nt, Mycobacterium avium subsp. paratuberculosis
gaccguagccggucggcc

SEQ ID NO: 905728 - RNA, 20 nt, Mycobacterium avium subsp. paratuberculosis
gaccgguugcggcgaacgcg

SEQ ID NO: 905729 - RNA, 23 nt, Mycobacterium avium subsp. paratuberculosis
gaccgguuuuccgucuucgaccg

SEQ ID NO: 905730 - RNA, 23 nt, Mycobacterium avium subsp. paratuberculosis
gaccgugaggcccggcgugggcc

SEQ ID NO: 905731 - RNA, 17 nt, Mycobacterium avium subsp. paratuberculosis
gaccgugcccaccagcc

SEQ ID NO: 905732 - RNA, 19 nt, Mycobacterium avium subsp. paratuberculosis
gaccgugcccaccagccgg

SEQ ID NO: 905733 - RNA, 20 nt, Mycobacterium avium subsp. paratuberculosis
gaccgucuucuucagccgca

SEQ ID NO: 905734 - RNA, 14 nt, Mycobacterium avium subsp. paratuberculosis
gaccucggccagcg

SEQ ID NO: 905735 - RNA, 15 nt, Mycobacterium avium subsp. paratuberculosis
gaccucggccagcgu

SEQ ID NO: 905736 - RNA, 13 nt, Mycobacterium avium subsp. paratuberculosis
gaccguugaccga

SEQ ID NO: 905737 - RNA, 17 nt, Mycobacterium avium subsp. paratuberculosis
gaccguugaccgacgcc

SEQ ID NO: 905738 - RNA, 18 nt, Mycobacterium avium subsp. paratuberculosis
gaccguugaccgacgccu

SEQ ID NO: 905739 - RNA, 15 nt, Mycobacterium avium subsp. paratuberculosis
gaccguugacgaccu

SEQ ID NO: 905740 - RNA, 17 nt, Mycobacterium avium subsp. paratuberculosis
gaccguugacgaccuug

SEQ ID NO: 905741 - RNA, 17 nt, Mycobacterium avium subsp. paratuberculosis
gaccucggccaccaccu

SEQ ID NO: 905742 - RNA, 14 nt, Mycobacterium avium subsp. paratuberculosis
gaccgugcgacuug

SEQ ID NO: 905743 - RNA, 20 nt, Mycobacterium avium subsp. paratuberculosis
gaccuggacgccgcacgcga

SEQ ID NO: 905744 - RNA, 20 nt, Mycobacterium avium subsp. paratuberculosis
gaccugcuuggcggccugcg

SEQ ID NO: 905745 - RNA, 21 nt, Mycobacterium avium subsp. paratuberculosis
gaccugcuuggcggccugcgc

SEQ ID NO: 905746 - RNA, 21 nt, Mycobacterium avium subsp. paratuberculosis
gaccugcucgucggugacggu

SEQ ID NO: 905747 - RNA, 18 nt, Mycobacterium avium subsp. paratuberculosis
gaccucuucggcgccggc

SEQ ID NO: 905748 - RNA, 19 nt, Mycobacterium avium subsp. paratuberculosis
gaccucuucggcgccggca

SEQ ID NO: 905749 - RNA, 19 nt, Mycobacterium avium subsp. paratuberculosis
gaccucgucgacggcggcg

SEQ ID NO: 905750 - RNA, 11 nt, Mycobacterium avium subsp. paratuberculosis
gaccucgucgg

SEQ ID NO: 905751 - RNA, 23 nt, Mycobacterium avium subsp. paratuberculosis
gaccucgucggcggcgacggcga

SEQ ID NO: 905752 - RNA, 20 nt, Mycobacterium avium subsp. paratuberculosis
gaccucgucgggcgccagcc

SEQ ID NO: 905753 - RNA, 21 nt, Mycobacterium avium subsp. paratuberculosis
gaccucgucgggcgccagccc

SEQ ID NO: 905754 - RNA, 23 nt, Mycobacterium avium subsp. paratuberculosis
gaccucgucgggcgccagcccgc

SEQ ID NO: 905755 - RNA, 17 nt, Mycobacterium avium subsp. paratuberculosis
gaccucggggaugucga

SEQ ID NO: 905756 - RNA, 16 nt, Mycobacterium avium subsp. paratuberculosis
gaccucggggucggcc

SEQ ID NO: 905757 - RNA, 19 nt, Mycobacterium avium subsp. paratuberculosis
gaccucggggucggccgga

SEQ ID NO: 905758 - RNA, 16 nt, Mycobacterium avium subsp. paratuberculosis
gaccucggcgaccagc

SEQ ID NO: 905759 - RNA, 17 nt, Mycobacterium avium subsp. paratuberculosis
gaccucggcgaccagcg

SEQ ID NO: 905760 - RNA, 22 nt, Mycobacterium avium subsp. paratuberculosis
gaccucggcgaccagcgacggc

SEQ ID NO: 905761 - RNA, 15 nt, Mycobacterium avium subsp. paratuberculosis
gaccgcggaaccgua

SEQ ID NO: 905762 - RNA, 13 nt, Mycobacterium avium subsp. paratuberculosis
gaccgcggccgcg

SEQ ID NO: 905763 - RNA, 16 nt, Mycobacterium avium subsp. paratuberculosis
gaccgcggccgcgacg

SEQ ID NO: 905764 - RNA, 17 nt, Mycobacterium avium subsp. paratuberculosis
gaccgcggcggucgcca

SEQ ID NO: 905765 - RNA, 19 nt, Mycobacterium avium subsp. paratuberculosis
gaccgcggcggucgccacu

SEQ ID NO: 905766 - RNA, 17 nt, Mycobacterium avium subsp. paratuberculosis
gaccgcggcgccgaugg

SEQ ID NO: 905767 - RNA, 18 nt, Mycobacterium avium subsp. paratuberculosis
gaccgcggcgccgauggc

SEQ ID NO: 905768 - RNA, 12 nt, Mycobacterium avium subsp. paratuberculosis
gaccgcggguga

SEQ ID NO: 905769 - RNA, 19 nt, Mycobacterium avium subsp. paratuberculosis
gaccgcgggugaggggcgc

SEQ ID NO: 905770 - RNA, 22 nt, Mycobacterium avium subsp. paratuberculosis
gaccgcgggugaggggcgcgcg

SEQ ID NO: 905771 - RNA, 14 nt, Mycobacterium avium subsp. paratuberculosis
gaccgcggucaccg

SEQ ID NO: 905772 - RNA, 17 nt, Mycobacterium avium subsp. paratuberculosis
gaccgcggcuccggccg

SEQ ID NO: 905773 - RNA, 19 nt, Mycobacterium avium subsp. paratuberculosis
gaccgcggcuccggccgcg

SEQ ID NO: 905774 - RNA, 21 nt, Mycobacterium avium subsp. paratuberculosis
gaccgcggcuccggccgcgcc

SEQ ID NO: 905775 - RNA, 22 nt, Mycobacterium avium subsp. paratuberculosis
gaccgcggcuccggccgcgccg

SEQ ID NO: 905776 - RNA, 12 nt, Mycobacterium avium subsp. paratuberculosis
gaccgcgggccc

SEQ ID NO: 905777 - RNA, 14 nt, Mycobacterium avium subsp. paratuberculosis
gaccgcgggcccgc

SEQ ID NO: 905778 - RNA, 13 nt, Mycobacterium avium subsp. paratuberculosis
gaccggcgcgcag

SEQ ID NO: 905779 - RNA, 17 nt, Mycobacterium avium subsp. paratuberculosis
gaccggcgcgcagcauc

SEQ ID NO: 905780 - RNA, 19 nt, Mycobacterium avium subsp. paratuberculosis
gaccggcgcgcagcaucuc

SEQ ID NO: 905781 - RNA, 13 nt, Mycobacterium avium subsp. paratuberculosis
gaccggcgccggc

SEQ ID NO: 905782 - RNA, 14 nt, Mycobacterium avium subsp. paratuberculosis
gaccggcgccggcc

SEQ ID NO: 905783 - RNA, 23 nt, Mycobacterium avium subsp. paratuberculosis
gaccggcgccggccgccggaucg

SEQ ID NO: 905784 - RNA, 13 nt, Mycobacterium avium subsp. paratuberculosis
gaccggcgaggug

SEQ ID NO: 905785 - RNA, 13 nt, Mycobacterium avium subsp. paratuberculosis
gaccggcgaucgu

SEQ ID NO: 905786 - RNA, 18 nt, Mycobacterium avium subsp. paratuberculosis
gaccggcgaucgucaggu

SEQ ID NO: 905787 - RNA, 17 nt, Mycobacterium avium subsp. paratuberculosis
gaccggcgauuucggcc

SEQ ID NO: 905788 - RNA, 18 nt, Mycobacterium avium subsp. paratuberculosis
gaccggcgauuucggccg

SEQ ID NO: 905789 - RNA, 15 nt, Mycobacterium avium subsp. paratuberculosis
gaccggccggggcgg

SEQ ID NO: 905790 - RNA, 16 nt, Mycobacterium avium subsp. paratuberculosis
gaccggccgugcgcgu

SEQ ID NO: 905791 - RNA, 21 nt, Mycobacterium avium subsp. paratuberculosis
gaccggccugagacgacgcca

SEQ ID NO: 905792 - RNA, 18 nt, Mycobacterium avium subsp. paratuberculosis
gaccggccugcagcgcgg

SEQ ID NO: 905793 - RNA, 21 nt, Mycobacterium avium subsp. paratuberculosis
gaccgcggucgcggcgccggu

SEQ ID NO: 905794 - RNA, 21 nt, Mycobacterium avium subsp. paratuberculosis
gaccggccaucuccugcacgc

SEQ ID NO: 905795 - RNA, 20 nt, Mycobacterium avium subsp. paratuberculosis
gaccggccccaacggcgugc

SEQ ID NO: 905796 - RNA, 13 nt, Mycobacterium avium subsp. paratuberculosis
gaccggcccggcg

SEQ ID NO: 905797 - RNA, 14 nt, Mycobacterium avium subsp. paratuberculosis
gaccggcccggcgg

SEQ ID NO: 905798 - RNA, 15 nt, Mycobacterium avium subsp. paratuberculosis
gaccggcccggcggc

SEQ ID NO: 905799 - RNA, 16 nt, Mycobacterium avium subsp. paratuberculosis
gaccggcccggcggcc

SEQ ID NO: 905800 - RNA, 16 nt, Mycobacterium avium subsp. paratuberculosis
gaccgcggaugacggg

SEQ ID NO: 905801 - RNA, 13 nt, Mycobacterium avium subsp. paratuberculosis
gaccgccaccacc

SEQ ID NO: 905802 - RNA, 14 nt, Mycobacterium avium subsp. paratuberculosis
gaccgccaccaccc

SEQ ID NO: 905803 - RNA, 15 nt, Mycobacterium avium subsp. paratuberculosis
gaccgccaccacccg

SEQ ID NO: 905804 - RNA, 20 nt, Mycobacterium avium subsp. paratuberculosis
gaccgccaccacccggcgau

SEQ ID NO: 905805 - RNA, 18 nt, Mycobacterium avium subsp. paratuberculosis
gaccgccaccagaucgug

SEQ ID NO: 905806 - RNA, 20 nt, Mycobacterium avium subsp. paratuberculosis
gaccgccaccagaucguguc

SEQ ID NO: 905807 - RNA, 18 nt, Mycobacterium avium subsp. paratuberculosis
gaccgcaggucgauggcg

SEQ ID NO: 905808 - RNA, 21 nt, Mycobacterium avium subsp. paratuberculosis
gaccgcagcaggcggacggcg

SEQ ID NO: 905809 - RNA, 14 nt, Mycobacterium avium subsp. paratuberculosis
gaccgcacgccggg

SEQ ID NO: 905810 - RNA, 16 nt, Mycobacterium avium subsp. paratuberculosis
gaccgcaccgaccagc

SEQ ID NO: 905811 - RNA, 21 nt, Mycobacterium avium subsp. paratuberculosis
gaccgcacccccagcucgacg

SEQ ID NO: 905812 - RNA, 23 nt, Mycobacterium avium subsp. paratuberculosis
gaccgcacccccagcucgacgac

SEQ ID NO: 905813 - RNA, 13 nt, Mycobacterium avium subsp. paratuberculosis
gaccgcaccgacc

SEQ ID NO: 905814 - RNA, 12 nt, Mycobacterium avium subsp. paratuberculosis
gaccgaucagcg

SEQ ID NO: 905815 - RNA, 15 nt, Mycobacterium avium subsp. paratuberculosis
gaccgaucuggcgau

SEQ ID NO: 905816 - RNA, 17 nt, Mycobacterium avium subsp. paratuberculosis
gaccgaucuggcgaucg

SEQ ID NO: 905817 - RNA, 19 nt, Mycobacterium avium subsp. paratuberculosis
gaccgcaagugcggucagc

SEQ ID NO: 905818 - RNA, 20 nt, Mycobacterium avium subsp. paratuberculosis
gaccgcaagugcggucagcu

SEQ ID NO: 905819 - RNA, 21 nt, Mycobacterium avium subsp. paratuberculosis
gaccgcaagugcggucagcuc

SEQ ID NO: 905820 - RNA, 17 nt, Mycobacterium avium subsp. paratuberculosis
gaccgcacaauccgguc

SEQ ID NO: 905821 - RNA, 18 nt, Mycobacterium avium subsp. paratuberculosis
gaccgcacaauccgguca

SEQ ID NO: 905822 - RNA, 21 nt, Mycobacterium avium subsp. paratuberculosis
gaccgcacaauccggucagcg

SEQ ID NO: 905823 - RNA, 23 nt, Mycobacterium avium subsp. paratuberculosis
gaccgcacaauccggucagcgug

SEQ ID NO: 905824 - RNA, 14 nt, Mycobacterium avium subsp. paratuberculosis
gaccgggaagccga

SEQ ID NO: 905825 - RNA, 20 nt, Mycobacterium avium subsp. paratuberculosis
gaccgggaagccgagcuugg

SEQ ID NO: 905826 - RNA, 22 nt, Mycobacterium avium subsp. paratuberculosis
gaccgggaaguagggcagcccg

SEQ ID NO: 905827 - RNA, 16 nt, Mycobacterium avium subsp. paratuberculosis
gaccgggacgacggcg

SEQ ID NO: 905828 - RNA, 18 nt, Mycobacterium avium subsp. paratuberculosis
gaccgggacgacggcgcc

SEQ ID NO: 905829 - RNA, 22 nt, Mycobacterium avium subsp. paratuberculosis
gaccgggacgacggcgccgccc

SEQ ID NO: 905830 - RNA, 16 nt, Mycobacterium avium subsp. paratuberculosis
gaccggcucucagccg

SEQ ID NO: 905831 - RNA, 21 nt, Mycobacterium avium subsp. paratuberculosis
gaccggcugcucgcgcugccg

SEQ ID NO: 905832 - RNA, 17 nt, Mycobacterium avium subsp. paratuberculosis
gaccgggcccggcgcca

SEQ ID NO: 905833 - RNA, 15 nt, Mycobacterium avium subsp. paratuberculosis
gaccgggcuccagcg

SEQ ID NO: 905834 - RNA, 16 nt, Mycobacterium avium subsp. paratuberculosis
gaccgggcuccagcgg

SEQ ID NO: 905835 - RNA, 16 nt, Mycobacterium avium subsp. paratuberculosis
gaccggcucgccggcg

SEQ ID NO: 905836 - RNA, 17 nt, Mycobacterium avium subsp. paratuberculosis
gaccggcucagcccggc

SEQ ID NO: 905837 - RNA, 20 nt, Mycobacterium avium subsp. paratuberculosis
gaccggcgccgggcagcccg

SEQ ID NO: 905838 - RNA, 14 nt, Mycobacterium avium subsp. paratuberculosis
gaccggcggugccg

SEQ ID NO: 905839 - RNA, 15 nt, Mycobacterium avium subsp. paratuberculosis
gaccggcggugccgg

SEQ ID NO: 905840 - RNA, 16 nt, Mycobacterium avium subsp. paratuberculosis
gaccggcggugccggc

SEQ ID NO: 905841 - RNA, 17 nt, Mycobacterium avium subsp. paratuberculosis
gaccggcggugccggcc

SEQ ID NO: 905842 - RNA, 12 nt, Mycobacterium avium subsp. paratuberculosis
gaccggcggugu

SEQ ID NO: 905843 - RNA, 14 nt, Mycobacterium avium subsp. paratuberculosis
gaccggcggccagc

SEQ ID NO: 905844 - RNA, 15 nt, Mycobacterium avium subsp. paratuberculosis
gaccggcggccagcg

SEQ ID NO: 905845 - RNA, 16 nt, Mycobacterium avium subsp. paratuberculosis
gaccggcggccagcga

SEQ ID NO: 905846 - RNA, 15 nt, Mycobacterium avium subsp. paratuberculosis
gaccggcggcgaucg

SEQ ID NO: 905847 - RNA, 17 nt, Mycobacterium avium subsp. paratuberculosis
gaccggcggcgaucggc

SEQ ID NO: 905848 - RNA, 22 nt, Mycobacterium avium subsp. paratuberculosis
gaccggcggcgaucggcgcggc

SEQ ID NO: 905849 - RNA, 19 nt, Mycobacterium avium subsp. paratuberculosis
gaccgguccgccgccggcg

SEQ ID NO: 905850 - RNA, 13 nt, Mycobacterium avium subsp. paratuberculosis
gaccgguccgcgg

SEQ ID NO: 905851 - RNA, 23 nt, Mycobacterium avium subsp. paratuberculosis
gaccgguccgugccacggccgcg

SEQ ID NO: 905852 - RNA, 16 nt, Mycobacterium avium subsp. paratuberculosis
gaccgguccuccccgc

SEQ ID NO: 905853 - RNA, 18 nt, Mycobacterium avium subsp. paratuberculosis
gaccgguaggcgcaccgc

SEQ ID NO: 905854 - RNA, 23 nt, Mycobacterium avium subsp. paratuberculosis
gaccgguaggcgcaccgccgggc

SEQ ID NO: 905855 - RNA, 15 nt, Mycobacterium avium subsp. paratuberculosis
gaccggugagcaccg

SEQ ID NO: 905856 - RNA, 18 nt, Mycobacterium avium subsp. paratuberculosis
gaccggugagcaccggga

SEQ ID NO: 905857 - RNA, 20 nt, Mycobacterium avium subsp. paratuberculosis
gaccggugagcaccgggaac

SEQ ID NO: 905858 - RNA, 15 nt, Mycobacterium avium subsp. paratuberculosis
gaccggugcgcccgc

SEQ ID NO: 905859 - RNA, 16 nt, Mycobacterium avium subsp. paratuberculosis
gaccggugcgcccgcg

SEQ ID NO: 905860 - RNA, 17 nt, Mycobacterium avium subsp. paratuberculosis
gaccggugcgcgcacca

SEQ ID NO: 905861 - RNA, 20 nt, Mycobacterium avium subsp. paratuberculosis
gaccggugcgcgcaccaggc

SEQ ID NO: 905862 - RNA, 20 nt, Mycobacterium avium subsp. paratuberculosis
gaccggugcggucccggucg

SEQ ID NO: 905863 - RNA, 23 nt, Mycobacterium avium subsp. paratuberculosis
gaccgggucugccacgcccaccg

SEQ ID NO: 905864 - RNA, 21 nt, Mycobacterium avium subsp. paratuberculosis
gaccgggugaacgaggccgcg

SEQ ID NO: 905865 - RNA, 23 nt, Mycobacterium avium subsp. paratuberculosis
gaccgggugaacgaggccgcgcc

SEQ ID NO: 905866 - RNA, 24 nt, Mycobacterium avium subsp. paratuberculosis
gaccgggugaacgaggccgcgccg

SEQ ID NO: 905867 - RNA, 16 nt, Mycobacterium avium subsp. paratuberculosis
gaccgggugaccggcg

SEQ ID NO: 905868 - RNA, 19 nt, Mycobacterium avium subsp. paratuberculosis
gaccgggugaccggcgcgc

SEQ ID NO: 905869 - RNA, 20 nt, Mycobacterium avium subsp. paratuberculosis
gaccgggugaccggcgcgca

SEQ ID NO: 905870 - RNA, 15 nt, Mycobacterium avium subsp. paratuberculosis
gaccgggucgccgau

SEQ ID NO: 905871 - RNA, 16 nt, Mycobacterium avium subsp. paratuberculosis
gaccggguuggcgcgc

SEQ ID NO: 905872 - RNA, 21 nt, Mycobacterium avium subsp. paratuberculosis
gaccggguuugaggcccacgu

SEQ ID NO: 905873 - RNA, 14 nt, Mycobacterium avium subsp. paratuberculosis
gaccggggacuuga

SEQ ID NO: 905874 - RNA, 17 nt, Mycobacterium avium subsp. paratuberculosis
gaccggggacuugacga

SEQ ID NO: 905875 - RNA, 16 nt, Mycobacterium avium subsp. paratuberculosis
gaccggggucggcgcc

SEQ ID NO: 905876 - RNA, 14 nt, Mycobacterium avium subsp. paratuberculosis
gaccggggcgguga

SEQ ID NO: 905877 - RNA, 14 nt, Mycobacterium avium subsp. paratuberculosis
gaccgggucgccga

SEQ ID NO: 905878 - RNA, 12 nt, Mycobacterium avium subsp. paratuberculosis
gaccagcgugac

SEQ ID NO: 905879 - RNA, 15 nt, Mycobacterium avium subsp. paratuberculosis
gaccagcgugucgcc

SEQ ID NO: 905880 - RNA, 19 nt, Mycobacterium avium subsp. paratuberculosis
gaccagcgugucgccgggg

SEQ ID NO: 905881 - RNA, 21 nt, Mycobacterium avium subsp. paratuberculosis
gaccagcgugucgccggggcg

SEQ ID NO: 905882 - RNA, 22 nt, Mycobacterium avium subsp. paratuberculosis
gaccagcgugucgccggggcgg

SEQ ID NO: 905883 - RNA, 17 nt, Mycobacterium avium subsp. paratuberculosis
gaccagcgugaccucga

SEQ ID NO: 905884 - RNA, 20 nt, Mycobacterium avium subsp. paratuberculosis
gaccagcgugaccucgacgg

SEQ ID NO: 905885 - RNA, 23 nt, Mycobacterium avium subsp. paratuberculosis
gaccagcgugaccucgacggugc

SEQ ID NO: 905886 - RNA, 13 nt, Mycobacterium avium subsp. paratuberculosis
gaccagcgugacg

SEQ ID NO: 905887 - RNA, 13 nt, Mycobacterium avium subsp. paratuberculosis
gaccagcgggccg

SEQ ID NO: 905888 - RNA, 17 nt, Mycobacterium avium subsp. paratuberculosis
gaccagcgggcugucgg

SEQ ID NO: 905889 - RNA, 20 nt, Mycobacterium avium subsp. paratuberculosis
gaccagcgggcugucggcgc

SEQ ID NO: 905890 - RNA, 23 nt, Mycobacterium avium subsp. paratuberculosis
gaccagcgggcugucggcgccca

SEQ ID NO: 905891 - RNA, 14 nt, Mycobacterium avium subsp. paratuberculosis
gaccagcggcagca

SEQ ID NO: 905892 - RNA, 17 nt, Mycobacterium avium subsp. paratuberculosis
gaccagcggcagcagca

SEQ ID NO: 905893 - RNA, 22 nt, Mycobacterium avium subsp. paratuberculosis
gaccagcggcagcagcaccagc

SEQ ID NO: 905894 - RNA, 17 nt, Mycobacterium avium subsp. paratuberculosis
gaccagcggcccaccgc

SEQ ID NO: 905895 - RNA, 18 nt, Mycobacterium avium subsp. paratuberculosis
gaccagcggcccaccgcg

SEQ ID NO: 905896 - RNA, 19 nt, Mycobacterium avium subsp. paratuberculosis
gaccagcggcccaccgcga

SEQ ID NO: 905897 - RNA, 13 nt, Mycobacterium avium subsp. paratuberculosis
gaccagcggcgcg

SEQ ID NO: 905898 - RNA, 15 nt, Mycobacterium avium subsp. paratuberculosis
gaccagcggcgcgcc

SEQ ID NO: 905899 - RNA, 16 nt, Mycobacterium avium subsp. paratuberculosis
gaccagcggcgcgccg

SEQ ID NO: 905900 - RNA, 17 nt, Mycobacterium avium subsp. paratuberculosis
gaccagcggcgcgccgg

SEQ ID NO: 905901 - RNA, 19 nt, Mycobacterium avium subsp. paratuberculosis
gaccagcggcgcgccgggc

SEQ ID NO: 905902 - RNA, 20 nt, Mycobacterium avium subsp. paratuberculosis
gaccagcggcgcgccgggca

SEQ ID NO: 905903 - RNA, 21 nt, Mycobacterium avium subsp. paratuberculosis
gaccagcggcgcgccgggcag

SEQ ID NO: 905904 - RNA, 23 nt, Mycobacterium avium subsp. paratuberculosis
gaccagccgcaucaccuucugcg

SEQ ID NO: 905905 - RNA, 19 nt, Mycobacterium avium subsp. paratuberculosis
gaccagcgccucggccugc

SEQ ID NO: 905906 - RNA, 19 nt, Mycobacterium avium subsp. paratuberculosis
gaccagcgcgaacagcgcg

SEQ ID NO: 905907 - RNA, 13 nt, Mycobacterium avium subsp. paratuberculosis
gaccagcgcgccg

SEQ ID NO: 905908 - RNA, 19 nt, Mycobacterium avium subsp. paratuberculosis
gaccagcgcgccgcccagc

SEQ ID NO: 905909 - RNA, 17 nt, Mycobacterium avium subsp. paratuberculosis
gaccagcgcgccggcca

SEQ ID NO: 905910 - RNA, 20 nt, Mycobacterium avium subsp. paratuberculosis
gaccagcgcgccggccagca

SEQ ID NO: 905911 - RNA, 21 nt, Mycobacterium avium subsp. paratuberculosis
gaccagcgcgccggccagcag

SEQ ID NO: 905912 - RNA, 16 nt, Mycobacterium avium subsp. paratuberculosis
gaccagcgcggugccg

SEQ ID NO: 905913 - RNA, 20 nt, Mycobacterium avium subsp. paratuberculosis
gaccagcaggacgcgcccgg

SEQ ID NO: 905914 - RNA, 15 nt, Mycobacterium avium subsp. paratuberculosis
gaccagcccggccgc

SEQ ID NO: 905915 - RNA, 16 nt, Mycobacterium avium subsp. paratuberculosis
gaccagcccggccgcc

SEQ ID NO: 905916 - RNA, 23 nt, Mycobacterium avium subsp. paratuberculosis
gaccagcacguugugcucgucga

SEQ ID NO: 905917 - RNA, 21 nt, Mycobacterium avium subsp. paratuberculosis
gaccagccgaaguuggcgucg

SEQ ID NO: 905918 - RNA, 20 nt, Mycobacterium avium subsp. paratuberculosis
gaccagccgaggcgcucgca

SEQ ID NO: 905919 - RNA, 13 nt, Mycobacterium avium subsp. paratuberculosis
gaccagcgacggc

SEQ ID NO: 905920 - RNA, 20 nt, Mycobacterium avium subsp. paratuberculosis
gaccagcgagcccagcugcg

SEQ ID NO: 905921 - RNA, 16 nt, Mycobacterium avium subsp. paratuberculosis
gaccagcgcaaccgcg

SEQ ID NO: 905922 - RNA, 20 nt, Mycobacterium avium subsp. paratuberculosis
gaccagcgcaaccgcggcgg

SEQ ID NO: 905923 - RNA, 21 nt, Mycobacterium avium subsp. paratuberculosis
gaccagcgcaaccgcggcggc

SEQ ID NO: 905924 - RNA, 22 nt, Mycobacterium avium subsp. paratuberculosis
gaccagcgcaaccgcggcggcg

SEQ ID NO: 905925 - RNA, 14 nt, Mycobacterium avium subsp. paratuberculosis
gaccagcgcccccg

SEQ ID NO: 905926 - RNA, 18 nt, Mycobacterium avium subsp. paratuberculosis
gaccagcgcccccgacag

SEQ ID NO: 905927 - RNA, 20 nt, Mycobacterium avium subsp. paratuberculosis
gaccagcgcccccgacaggc

SEQ ID NO: 905928 - RNA, 19 nt, Mycobacterium avium subsp. paratuberculosis
gaccagcgccgagaccagc

SEQ ID NO: 905929 - RNA, 22 nt, Mycobacterium avium subsp. paratuberculosis
gaccagcugcgaaucgucggcg

SEQ ID NO: 905930 - RNA, 23 nt, Mycobacterium avium subsp. paratuberculosis
gaccagcugcgaaucgucggcga

SEQ ID NO: 905931 - RNA, 23 nt, Mycobacterium avium subsp. paratuberculosis
gaccagcuugaagcccucgucga

SEQ ID NO: 905932 - RNA, 18 nt, Mycobacterium avium subsp. paratuberculosis
gaccaggaacacggcucg

SEQ ID NO: 905933 - RNA, 17 nt, Mycobacterium avium subsp. paratuberculosis
gaccaggaagaugccga

SEQ ID NO: 905934 - RNA, 18 nt, Mycobacterium avium subsp. paratuberculosis
gaccaggaccagguugga

SEQ ID NO: 905935 - RNA, 19 nt, Mycobacterium avium subsp. paratuberculosis
gaccaggaugucuccgcgc

SEQ ID NO: 905936 - RNA, 20 nt, Mycobacterium avium subsp. paratuberculosis
gaccaggaugucuccgcgca

SEQ ID NO: 905937 - RNA, 23 nt, Mycobacterium avium subsp. paratuberculosis
gaccaggaugucuccgcgcagcc

SEQ ID NO: 905938 - RNA, 20 nt, Mycobacterium avium subsp. paratuberculosis
gaccaggaaguacaccaccg

SEQ ID NO: 905939 - RNA, 17 nt, Mycobacterium avium subsp. paratuberculosis
gaccagggcgaucaccg

SEQ ID NO: 905940 - RNA, 18 nt, Mycobacterium avium subsp. paratuberculosis
gaccagggcgaucaccgc

SEQ ID NO: 905941 - RNA, 19 nt, Mycobacterium avium subsp. paratuberculosis
gaccagggcgaucaccgcg

SEQ ID NO: 905942 - RNA, 20 nt, Mycobacterium avium subsp. paratuberculosis
gaccagggcgaucaccgcgg

SEQ ID NO: 905943 - RNA, 23 nt, Mycobacterium avium subsp. paratuberculosis
gaccaggcuugccccguacgggu

SEQ ID NO: 905944 - RNA, 19 nt, Mycobacterium avium subsp. paratuberculosis
gaccaggcuuggcccgccg

SEQ ID NO: 905945 - RNA, 14 nt, Mycobacterium avium subsp. paratuberculosis
gaccaggcucgcga

SEQ ID NO: 905946 - RNA, 22 nt, Mycobacterium avium subsp. paratuberculosis
gaccaggcucgcgagggcgggc

SEQ ID NO: 905947 - RNA, 16 nt, Mycobacterium avium subsp. paratuberculosis
gaccaggccguccacc

SEQ ID NO: 905948 - RNA, 16 nt, Mycobacterium avium subsp. paratuberculosis
gaccaggucgccggcg

SEQ ID NO: 905949 - RNA, 17 nt, Mycobacterium avium subsp. paratuberculosis
gaccaggucgccggcgg

SEQ ID NO: 905950 - RNA, 20 nt, Mycobacterium avium subsp. paratuberculosis
gaccaggucgccggcggccg

SEQ ID NO: 905951 - RNA, 13 nt, Mycobacterium avium subsp. paratuberculosis
gaccaggucggcc

SEQ ID NO: 905952 - RNA, 20 nt, Mycobacterium avium subsp. paratuberculosis
gaccaggucggccuucagcg

SEQ ID NO: 905953 - RNA, 20 nt, Mycobacterium avium subsp. paratuberculosis
gaccagggcgguggcggcga

SEQ ID NO: 905954 - RNA, 14 nt, Mycobacterium avium subsp. paratuberculosis
gaccagggugguca

SEQ ID NO: 905955 - RNA, 16 nt, Mycobacterium avium subsp. paratuberculosis
gaccaggguggucagc

SEQ ID NO: 905956 - RNA, 17 nt, Mycobacterium avium subsp. paratuberculosis
gaccaggguggucagcg

SEQ ID NO: 905957 - RNA, 15 nt, Mycobacterium avium subsp. paratuberculosis
gaccaggguuccggu

SEQ ID NO: 905958 - RNA, 23 nt, Mycobacterium avium subsp. paratuberculosis
gaccaggguuucaugcacggcgc

SEQ ID NO: 905959 - RNA, 19 nt, Mycobacterium avium subsp. paratuberculosis
gaccaggguuugggcgugc

SEQ ID NO: 905960 - RNA, 17 nt, Mycobacterium avium subsp. paratuberculosis
gaccagguagcgcugca

SEQ ID NO: 905961 - RNA, 22 nt, Mycobacterium avium subsp. paratuberculosis
gaccagguauucaucgcggccg

SEQ ID NO: 905962 - RNA, 21 nt, Mycobacterium avium subsp. paratuberculosis
gaccagucggcgucuucgggg

SEQ ID NO: 905963 - RNA, 16 nt, Mycobacterium avium subsp. paratuberculosis
gaccagugcagagcga

SEQ ID NO: 905964 - RNA, 17 nt, Mycobacterium avium subsp. paratuberculosis
gaccagugcagagcgau

SEQ ID NO: 905965 - RNA, 13 nt, Mycobacterium avium subsp. paratuberculosis
gaccagugguggc

SEQ ID NO: 905966 - RNA, 19 nt, Mycobacterium avium subsp. paratuberculosis
gaccagugguggccgaacg

SEQ ID NO: 905967 - RNA, 16 nt, Mycobacterium avium subsp. paratuberculosis
gaccaguaccgggccu

SEQ ID NO: 905968 - RNA, 16 nt, Mycobacterium avium subsp. paratuberculosis
gaccaguaggccagca

SEQ ID NO: 905969 - RNA, 18 nt, Mycobacterium avium subsp. paratuberculosis
gaccaguaggccagcauc

SEQ ID NO: 905970 - RNA, 21 nt, Mycobacterium avium subsp. paratuberculosis
gaccaguucuucgaugacggc

SEQ ID NO: 905971 - RNA, 20 nt, Mycobacterium avium subsp. paratuberculosis
gaccaguucgcccuggccgc

SEQ ID NO: 905972 - RNA, 16 nt, Mycobacterium avium subsp. paratuberculosis
gaccaguucggccacc

SEQ ID NO: 905973 - RNA, 18 nt, Mycobacterium avium subsp. paratuberculosis
gaccaguucggccaccgc

SEQ ID NO: 905974 - RNA, 20 nt, Mycobacterium avium subsp. paratuberculosis
gaccaguucggccaccgcgu

SEQ ID NO: 905975 - RNA, 14 nt, Mycobacterium avium subsp. paratuberculosis
gaccgacgcccggc

SEQ ID NO: 905976 - RNA, 14 nt, Mycobacterium avium subsp. paratuberculosis
gaccgacgacguga

SEQ ID NO: 905977 - RNA, 15 nt, Mycobacterium avium subsp. paratuberculosis
gaccgacgacgugac

SEQ ID NO: 905978 - RNA, 13 nt, Mycobacterium avium subsp. paratuberculosis
gaccgacccggcc

SEQ ID NO: 905979 - RNA, 16 nt, Mycobacterium avium subsp. paratuberculosis
gaccgacccggccagc

SEQ ID NO: 905980 - RNA, 17 nt, Mycobacterium avium subsp. paratuberculosis
gaccgacccggccagcg

SEQ ID NO: 905981 - RNA, 22 nt, Mycobacterium avium subsp. paratuberculosis
gaccgaccuccaaugcgcccug

SEQ ID NO: 905982 - RNA, 15 nt, Mycobacterium avium subsp. paratuberculosis
gaccgacaguucggc

SEQ ID NO: 905983 - RNA, 16 nt, Mycobacterium avium subsp. paratuberculosis
gaccgacauggccagc

SEQ ID NO: 905984 - RNA, 17 nt, Mycobacterium avium subsp. paratuberculosis
gaccgacauggccagca

SEQ ID NO: 905985 - RNA, 18 nt, Mycobacterium avium subsp. paratuberculosis
gaccgaagaucaccgcga

SEQ ID NO: 905986 - RNA, 16 nt, Mycobacterium avium subsp. paratuberculosis
gaccgacagcaaaccg

SEQ ID NO: 905987 - RNA, 12 nt, Mycobacterium avium subsp. paratuberculosis
gaccgacagccg

SEQ ID NO: 905988 - RNA, 14 nt, Mycobacterium avium subsp. paratuberculosis
gaccgacagccgca

SEQ ID NO: 905989 - RNA, 17 nt, Mycobacterium avium subsp. paratuberculosis
gaccgacagccgcacca

SEQ ID NO: 905990 - RNA, 13 nt, Mycobacterium avium subsp. paratuberculosis
gaccgaggccgcc

SEQ ID NO: 905991 - RNA, 17 nt, Mycobacterium avium subsp. paratuberculosis
gaccgaggcgaucgcgg

SEQ ID NO: 905992 - RNA, 22 nt, Mycobacterium avium subsp. paratuberculosis
gaccgaggcgaucgcggccacc

SEQ ID NO: 905993 - RNA, 16 nt, Mycobacterium avium subsp. paratuberculosis
gaccgauccgccggcg

SEQ ID NO: 905994 - RNA, 17 nt, Mycobacterium avium subsp. paratuberculosis
gaccgauccgccggcga

SEQ ID NO: 905995 - RNA, 19 nt, Mycobacterium avium subsp. paratuberculosis
gaccgauccgccggcgaag

SEQ ID NO: 905996 - RNA, 21 nt, Mycobacterium avium subsp. paratuberculosis
gaccgauccgccggcgaagcu

SEQ ID NO: 905997 - RNA, 15 nt, Mycobacterium avium subsp. paratuberculosis
gaccgauccggcgcc

SEQ ID NO: 905998 - RNA, 21 nt, Mycobacterium avium subsp. paratuberculosis
gaccgagcggcgcugcagcag

SEQ ID NO: 905999 - RNA, 13 nt, Mycobacterium avium subsp. paratuberculosis
gaccgacgcgguc

SEQ ID NO: 906000 - RNA, 22 nt, Mycobacterium avium subsp. paratuberculosis
gaccgagaugaagacccggccg

SEQ ID NO: 906001 - RNA, 11 nt, Mycobacterium avium subsp. paratuberculosis
gacccgggcga

SEQ ID NO: 906002 - RNA, 16 nt, Mycobacterium avium subsp. paratuberculosis
gacccgggcggccugc

SEQ ID NO: 906003 - RNA, 19 nt, Mycobacterium avium subsp. paratuberculosis
gacccgggcuagacgcgca

SEQ ID NO: 906004 - RNA, 14 nt, Mycobacterium avium subsp. paratuberculosis
gacccggccagcgg

SEQ ID NO: 906005 - RNA, 14 nt, Mycobacterium avium subsp. paratuberculosis
gacccgggccagca

SEQ ID NO: 906006 - RNA, 17 nt, Mycobacterium avium subsp. paratuberculosis
gacccgccccgacagca

SEQ ID NO: 906007 - RNA, 16 nt, Mycobacterium avium subsp. paratuberculosis
gacccgcccgccgggc

SEQ ID NO: 906008 - RNA, 17 nt, Mycobacterium avium subsp. paratuberculosis
gacccgcccgccgggca

SEQ ID NO: 906009 - RNA, 18 nt, Mycobacterium avium subsp. paratuberculosis
gacccggaccgggugacc

SEQ ID NO: 906010 - RNA, 14 nt, Mycobacterium avium subsp. paratuberculosis
gacccggaggcggc

SEQ ID NO: 906011 - RNA, 20 nt, Mycobacterium avium subsp. paratuberculosis
gacccggaggcggcgggggc

SEQ ID NO: 906012 - RNA, 22 nt, Mycobacterium avium subsp. paratuberculosis
gacccggauacacgguggugac

SEQ ID NO: 906013 - RNA, 22 nt, Mycobacterium avium subsp. paratuberculosis
gacccggaugaucaacacgucg

SEQ ID NO: 906014 - RNA, 18 nt, Mycobacterium avium subsp. paratuberculosis
gacccggccagcggcagc

SEQ ID NO: 906015 - RNA, 22 nt, Mycobacterium avium subsp. paratuberculosis
gacccggcccaucaccggaccg

SEQ ID NO: 906016 - RNA, 22 nt, Mycobacterium avium subsp. paratuberculosis
gacccggccgagcgcgccgagc

SEQ ID NO: 906017 - RNA, 15 nt, Mycobacterium avium subsp. paratuberculosis
gacccggccgauggu

SEQ ID NO: 906018 - RNA, 14 nt, Mycobacterium avium subsp. paratuberculosis
gacccggccgcaca

SEQ ID NO: 906019 - RNA, 20 nt, Mycobacterium avium subsp. paratuberculosis
gacccggccgcacaccacca

SEQ ID NO: 906020 - RNA, 21 nt, Mycobacterium avium subsp. paratuberculosis
gacccggccgcgccggauggu

SEQ ID NO: 906021 - RNA, 13 nt, Mycobacterium avium subsp. paratuberculosis
gacccggccaccg

SEQ ID NO: 906022 - RNA, 15 nt, Mycobacterium avium subsp. paratuberculosis
gacccggccaccgcc

SEQ ID NO: 906023 - RNA, 12 nt, Mycobacterium avium subsp. paratuberculosis
gacccggccggu

SEQ ID NO: 906024 - RNA, 19 nt, Mycobacterium avium subsp. paratuberculosis
gacccggccgugcgcagca

SEQ ID NO: 906025 - RNA, 18 nt, Mycobacterium avium subsp. paratuberculosis
gacccggccguggacccg

SEQ ID NO: 906026 - RNA, 20 nt, Mycobacterium avium subsp. paratuberculosis
gacccggccguugggccagc

SEQ ID NO: 906027 - RNA, 22 nt, Mycobacterium avium subsp. paratuberculosis
gacccggccguugggccagcgg

SEQ ID NO: 906028 - RNA, 20 nt, Mycobacterium avium subsp. paratuberculosis
gacccggcguaguucgucga

SEQ ID NO: 906029 - RNA, 15 nt, Mycobacterium avium subsp. paratuberculosis
gaccaucauggccuc

SEQ ID NO: 906030 - RNA, 15 nt, Mycobacterium avium subsp. paratuberculosis
gaccaucagccugcg

SEQ ID NO: 906031 - RNA, 20 nt, Mycobacterium avium subsp. paratuberculosis
gaccaucagcgcccgggugg

SEQ ID NO: 906032 - RNA, 19 nt, Mycobacterium avium subsp. paratuberculosis
gaccaucgggucgucggcg

SEQ ID NO: 906033 - RNA, 17 nt, Mycobacterium avium subsp. paratuberculosis
gaccaucuacgaccucg

SEQ ID NO: 906034 - RNA, 15 nt, Mycobacterium avium subsp. paratuberculosis
gaccaucugccggcg

SEQ ID NO: 906035 - RNA, 23 nt, Mycobacterium avium subsp. paratuberculosis
gaccaugccguagcggucgcccc

SEQ ID NO: 906036 - RNA, 17 nt, Mycobacterium avium subsp. paratuberculosis
gaccaugaguugcgggu

SEQ ID NO: 906037 - RNA, 17 nt, Mycobacterium avium subsp. paratuberculosis
gaccaugcccagcaguc

SEQ ID NO: 906038 - RNA, 14 nt, Mycobacterium avium subsp. paratuberculosis
gaccaugcccggcg

SEQ ID NO: 906039 - RNA, 17 nt, Mycobacterium avium subsp. paratuberculosis
gaccaugccgcgggcca

SEQ ID NO: 906040 - RNA, 20 nt, Mycobacterium avium subsp. paratuberculosis
gaccccgcucggcguggcgc

SEQ ID NO: 906041 - RNA, 14 nt, Mycobacterium avium subsp. paratuberculosis
gaccccggccagga

SEQ ID NO: 906042 - RNA, 17 nt, Mycobacterium avium subsp. paratuberculosis
gaccccggcgaccagca

SEQ ID NO: 906043 - RNA, 20 nt, Mycobacterium avium subsp. paratuberculosis
gaccccggcgaccagcaggu

SEQ ID NO: 906044 - RNA, 23 nt, Mycobacterium avium subsp. paratuberculosis
gacccgcaacucgggcucgucgu

SEQ ID NO: 906045 - RNA, 16 nt, Mycobacterium avium subsp. paratuberculosis
gacccgcaaggccgcc

SEQ ID NO: 906046 - RNA, 21 nt, Mycobacterium avium subsp. paratuberculosis
gacccgcaaggccgccagccg

SEQ ID NO: 906047 - RNA, 15 nt, Mycobacterium avium subsp. paratuberculosis
gacccgcaccaccgc

SEQ ID NO: 906048 - RNA, 18 nt, Mycobacterium avium subsp. paratuberculosis
gacccgcaccaccgcccg

SEQ ID NO: 906049 - RNA, 23 nt, Mycobacterium avium subsp. paratuberculosis
gacccgcaccaccgcccggaccg

SEQ ID NO: 906050 - RNA, 12 nt, Mycobacterium avium subsp. paratuberculosis
gacccgcaccga

SEQ ID NO: 906051 - RNA, 12 nt, Mycobacterium avium subsp. paratuberculosis
gacccgcaccgg

SEQ ID NO: 906052 - RNA, 23 nt, Mycobacterium avium subsp. paratuberculosis
gacccgcacgaaaugcgggcgau

SEQ ID NO: 906053 - RNA, 18 nt, Mycobacterium avium subsp. paratuberculosis
gacccgcacgaugccgcg

SEQ ID NO: 906054 - RNA, 20 nt, Mycobacterium avium subsp. paratuberculosis
gacccgauccagggcccgcu

SEQ ID NO: 906055 - RNA, 20 nt, Mycobacterium avium subsp. paratuberculosis
gacccgaucgaucaucgccu

SEQ ID NO: 906056 - RNA, 20 nt, Mycobacterium avium subsp. paratuberculosis
gacccgaccuuuugcccggc

SEQ ID NO: 906057 - RNA, 22 nt, Mycobacterium avium subsp. paratuberculosis
gacccgaccuuuugcccggcga

SEQ ID NO: 906058 - RNA, 20 nt, Mycobacterium avium subsp. paratuberculosis
gacccgacgggaacucggcc

SEQ ID NO: 906059 - RNA, 16 nt, Mycobacterium avium subsp. paratuberculosis
gacccgaagucgacgc

SEQ ID NO: 906060 - RNA, 22 nt, Mycobacterium avium subsp. paratuberculosis
gacccgaagucgacgcaccacg

SEQ ID NO: 906061 - RNA, 15 nt, Mycobacterium avium subsp. paratuberculosis
gaccccgucgaacga

SEQ ID NO: 906062 - RNA, 18 nt, Mycobacterium avium subsp. paratuberculosis
gacccgaacuucagcgcg

SEQ ID NO: 906063 - RNA, 15 nt, Mycobacterium avium subsp. paratuberculosis
gacccgaagccaggu

SEQ ID NO: 906064 - RNA, 14 nt, Mycobacterium avium subsp. paratuberculosis
gacccgaagcccau

SEQ ID NO: 906065 - RNA, 19 nt, Mycobacterium avium subsp. paratuberculosis
gaccccguucgccgacagc

SEQ ID NO: 906066 - RNA, 13 nt, Mycobacterium avium subsp. paratuberculosis
gaccccuacgggc

SEQ ID NO: 906067 - RNA, 20 nt, Mycobacterium avium subsp. paratuberculosis
gaccccuacgggcgcaccgc

SEQ ID NO: 906068 - RNA, 22 nt, Mycobacterium avium subsp. paratuberculosis
gaccccuacgggcgcaccgcgc

SEQ ID NO: 906069 - RNA, 14 nt, Mycobacterium avium subsp. paratuberculosis
gaccccucggcggc

SEQ ID NO: 906070 - RNA, 17 nt, Mycobacterium avium subsp. paratuberculosis
gaccccucggcggccgu

SEQ ID NO: 906071 - RNA, 23 nt, Mycobacterium avium subsp. paratuberculosis
gaccccggcguccaguagccgcc

SEQ ID NO: 906072 - RNA, 16 nt, Mycobacterium avium subsp. paratuberculosis
gaccccggcugcugca

SEQ ID NO: 906073 - RNA, 19 nt, Mycobacterium avium subsp. paratuberculosis
gaccccggcugcugcacga

SEQ ID NO: 906074 - RNA, 16 nt, Mycobacterium avium subsp. paratuberculosis
gacacaaaagcgcccg

SEQ ID NO: 906075 - RNA, 14 nt, Mycobacterium avium subsp. paratuberculosis
gacacagcaccggc

SEQ ID NO: 906076 - RNA, 18 nt, Mycobacterium avium subsp. paratuberculosis
gacacagcaccggcgucg

SEQ ID NO: 906077 - RNA, 16 nt, Mycobacterium avium subsp. paratuberculosis
gacaaucucgggcacc

SEQ ID NO: 906078 - RNA, 13 nt, Mycobacterium avium subsp. paratuberculosis
gacaagccggcgu

SEQ ID NO: 906079 - RNA, 18 nt, Mycobacterium avium subsp. paratuberculosis
gacaagccggcgucgaug

SEQ ID NO: 906080 - RNA, 16 nt, Mycobacterium avium subsp. paratuberculosis
gacaagggccgggcgc

SEQ ID NO: 906081 - RNA, 15 nt, Mycobacterium avium subsp. paratuberculosis
gacaaggucgaccgc

SEQ ID NO: 906082 - RNA, 15 nt, Mycobacterium avium subsp. paratuberculosis
gacaacgacagcacc

SEQ ID NO: 906083 - RNA, 17 nt, Mycobacterium avium subsp. paratuberculosis
gacaacggcccccacga

SEQ ID NO: 906084 - RNA, 24 nt, Mycobacterium avium subsp. paratuberculosis
gacaacgggauaugcgccugcacg

SEQ ID NO: 906085 - RNA, 18 nt, Mycobacterium avium subsp. paratuberculosis
gacaacgggccgccucac

SEQ ID NO: 906086 - RNA, 22 nt, Mycobacterium avium subsp. paratuberculosis
gacaacgggccgccucacgcag

SEQ ID NO: 906087 - RNA, 23 nt, Mycobacterium avium subsp. paratuberculosis
gacaacgggccgccucacgcagg

SEQ ID NO: 906088 - RNA, 15 nt, Mycobacterium avium subsp. paratuberculosis
gacaacggugguggc

SEQ ID NO: 906089 - RNA, 16 nt, Mycobacterium avium subsp. paratuberculosis
gacaacggugguggcg

SEQ ID NO: 906090 - RNA, 22 nt, Mycobacterium avium subsp. paratuberculosis
gacaacguggugugcaccagcg

SEQ ID NO: 906091 - RNA, 20 nt, Mycobacterium avium subsp. paratuberculosis
gaaugucguagaacucgccg

SEQ ID NO: 906092 - RNA, 16 nt, Mycobacterium avium subsp. paratuberculosis
gaaugucguagcgguc

SEQ ID NO: 906093 - RNA, 17 nt, Mycobacterium avium subsp. paratuberculosis
gaaugucguagcggucg

SEQ ID NO: 906094 - RNA, 15 nt, Mycobacterium avium subsp. paratuberculosis
gaauuguggcggccc

SEQ ID NO: 906095 - RNA, 15 nt, Mycobacterium avium subsp. paratuberculosis
gaaugcucagcggga

SEQ ID NO: 906096 - RNA, 15 nt, Mycobacterium avium subsp. paratuberculosis
gaaugcggugcugcc

SEQ ID NO: 906097 - RNA, 15 nt, Mycobacterium avium subsp. paratuberculosis
gaauuuucgccguca

SEQ ID NO: 906098 - RNA, 20 nt, Mycobacterium avium subsp. paratuberculosis
gaacucuucgcagcgcucag

SEQ ID NO: 906099 - RNA, 20 nt, Mycobacterium avium subsp. paratuberculosis
gaacugcagcccgaucucgc

SEQ ID NO: 906100 - RNA, 23 nt, Mycobacterium avium subsp. paratuberculosis
gaacugcagcgacuggcccucgg

SEQ ID NO: 906101 - RNA, 20 nt, Mycobacterium avium subsp. paratuberculosis
gaacugcaccagcacgacac

SEQ ID NO: 906102 - RNA, 19 nt, Mycobacterium avium subsp. paratuberculosis
gaacugccgaugcugagcg

SEQ ID NO: 906103 - RNA, 19 nt, Mycobacterium avium subsp. paratuberculosis
gaacugcucgaccagcgcc

SEQ ID NO: 906104 - RNA, 12 nt, Mycobacterium avium subsp. paratuberculosis
gaacucggccag

SEQ ID NO: 906105 - RNA, 13 nt, Mycobacterium avium subsp. paratuberculosis
gaacucggccagg

SEQ ID NO: 906106 - RNA, 21 nt, Mycobacterium avium subsp. paratuberculosis
gaacucggccagggcucgugc

SEQ ID NO: 906107 - RNA, 14 nt, Mycobacterium avium subsp. paratuberculosis
gaacucggccggca

SEQ ID NO: 906108 - RNA, 20 nt, Mycobacterium avium subsp. paratuberculosis
gaacucggcgccgccggucg

SEQ ID NO: 906109 - RNA, 14 nt, Mycobacterium avium subsp. paratuberculosis
gaacucgccgaucg

SEQ ID NO: 906110 - RNA, 19 nt, Mycobacterium avium subsp. paratuberculosis
gaacucgaucugcagccgg

SEQ ID NO: 906111 - RNA, 20 nt, Mycobacterium avium subsp. paratuberculosis
gaacucgaucugcagccggc

SEQ ID NO: 906112 - RNA, 19 nt, Mycobacterium avium subsp. paratuberculosis
gaacucgcggcgggucagc

SEQ ID NO: 906113 - RNA, 12 nt, Mycobacterium avium subsp. paratuberculosis
gaacucgcgggc

SEQ ID NO: 906114 - RNA, 23 nt, Mycobacterium avium subsp. paratuberculosis
gaacucgcgggcgagcagcgccc

SEQ ID NO: 906115 - RNA, 17 nt, Mycobacterium avium subsp. paratuberculosis
gaacucguuggcguggc

SEQ ID NO: 906116 - RNA, 22 nt, Mycobacterium avium subsp. paratuberculosis
gaacucgucgaugcacgccgga

SEQ ID NO: 906117 - RNA, 15 nt, Mycobacterium avium subsp. paratuberculosis
gaacucgucgccacc

SEQ ID NO: 906118 - RNA, 16 nt, Mycobacterium avium subsp. paratuberculosis
gaauacccgcccagca

SEQ ID NO: 906119 - RNA, 22 nt, Mycobacterium avium subsp. paratuberculosis
gaaucaccuugcccugcgugca

SEQ ID NO: 906120 - RNA, 14 nt, Mycobacterium avium subsp. paratuberculosis
gaaucaccaagcgc

SEQ ID NO: 906121 - RNA, 13 nt, Mycobacterium avium subsp. paratuberculosis
gaaucacccacgg

SEQ ID NO: 906122 - RNA, 22 nt, Mycobacterium avium subsp. paratuberculosis
gaauaccagggcgaggaacccg

SEQ ID NO: 906123 - RNA, 15 nt, Mycobacterium avium subsp. paratuberculosis
gaacuggacgccgug

SEQ ID NO: 906124 - RNA, 23 nt, Mycobacterium avium subsp. paratuberculosis
gaauaacgccggccccggcgacg

SEQ ID NO: 906125 - RNA, 21 nt, Mycobacterium avium subsp. paratuberculosis
gaaucucgugguaccggcgcc

SEQ ID NO: 906126 - RNA, 18 nt, Mycobacterium avium subsp. paratuberculosis
gaaucuuggccagcagcg

SEQ ID NO: 906127 - RNA, 16 nt, Mycobacterium avium subsp. paratuberculosis
gaauccucagcacggc

SEQ ID NO: 906128 - RNA, 23 nt, Mycobacterium avium subsp. paratuberculosis
gaauccgggugucgacgccgggc

SEQ ID NO: 906129 - RNA, 16 nt, Mycobacterium avium subsp. paratuberculosis
gaauccggugaccgcc

SEQ ID NO: 906130 - RNA, 13 nt, Mycobacterium avium subsp. paratuberculosis
gaauccuggccga

SEQ ID NO: 906131 - RNA, 17 nt, Mycobacterium avium subsp. paratuberculosis
gaaucgucggcgaugga

SEQ ID NO: 906132 - RNA, 17 nt, Mycobacterium avium subsp. paratuberculosis
gaaucacuuccgcggca

SEQ ID NO: 906133 - RNA, 13 nt, Mycobacterium avium subsp. paratuberculosis
gaauccagccgug

SEQ ID NO: 906134 - RNA, 20 nt, Mycobacterium avium subsp. paratuberculosis
gaauccagccgugcggcuug

SEQ ID NO: 906135 - RNA, 14 nt, Mycobacterium avium subsp. paratuberculosis
gaaucccacccgca

SEQ ID NO: 906136 - RNA, 14 nt, Mycobacterium avium subsp. paratuberculosis
gaauccgcgcagca

SEQ ID NO: 906137 - RNA, 14 nt, Mycobacterium avium subsp. paratuberculosis
gaauccgagcaucg

SEQ ID NO: 906138 - RNA, 20 nt, Mycobacterium avium subsp. paratuberculosis
gaauccgagcaucggguugc

SEQ ID NO: 906139 - RNA, 22 nt, Mycobacterium avium subsp. paratuberculosis
gaauccgcgggcguggcggucg

SEQ ID NO: 906140 - RNA, 20 nt, Mycobacterium avium subsp. paratuberculosis
gaauccggcggggacguguc

SEQ ID NO: 906141 - RNA, 21 nt, Mycobacterium avium subsp. paratuberculosis
gacaccacgucgucggccugc

SEQ ID NO: 906142 - RNA, 16 nt, Mycobacterium avium subsp. paratuberculosis
gacaccaccugcacgg

SEQ ID NO: 906143 - RNA, 19 nt, Mycobacterium avium subsp. paratuberculosis
gacaccacgaucagcgcgu

SEQ ID NO: 906144 - RNA, 21 nt, Mycobacterium avium subsp. paratuberculosis
gacaccacgaucagcgcgucg

SEQ ID NO: 906145 - RNA, 14 nt, Mycobacterium avium subsp. paratuberculosis
gacaccaccgcgcg

SEQ ID NO: 906146 - RNA, 20 nt, Mycobacterium avium subsp. paratuberculosis
gacaccaccggccgcccggc

SEQ ID NO: 906147 - RNA, 19 nt, Mycobacterium avium subsp. paratuberculosis
gacaccagcauggcgauca

SEQ ID NO: 906148 - RNA, 14 nt, Mycobacterium avium subsp. paratuberculosis
gacaccagcgucgc

SEQ ID NO: 906149 - RNA, 17 nt, Mycobacterium avium subsp. paratuberculosis
gacaccagggugcgcac

SEQ ID NO: 906150 - RNA, 20 nt, Mycobacterium avium subsp. paratuberculosis
gacaccagucgcacaaccgu

SEQ ID NO: 906151 - RNA, 20 nt, Mycobacterium avium subsp. paratuberculosis
gacacccccgauccgccguu

SEQ ID NO: 906152 - RNA, 21 nt, Mycobacterium avium subsp. paratuberculosis
gacacccccgauccgccguug

SEQ ID NO: 906153 - RNA, 19 nt, Mycobacterium avium subsp. paratuberculosis
gacacccagcggcgcggcc

SEQ ID NO: 906154 - RNA, 21 nt, Mycobacterium avium subsp. paratuberculosis
gacaccccgcgagucaccggc

SEQ ID NO: 906155 - RNA, 19 nt, Mycobacterium avium subsp. paratuberculosis
gacaccccgcucggccagc

SEQ ID NO: 906156 - RNA, 23 nt, Mycobacterium avium subsp. paratuberculosis
gacaccccgcucggccagcgcgc

SEQ ID NO: 906157 - RNA, 20 nt, Mycobacterium avium subsp. paratuberculosis
gacaccccggccaguccgcg

SEQ ID NO: 906158 - RNA, 16 nt, Mycobacterium avium subsp. paratuberculosis
gacaccccggcgauga

SEQ ID NO: 906159 - RNA, 22 nt, Mycobacterium avium subsp. paratuberculosis
gacaccccggcgaugaccggga

SEQ ID NO: 906160 - RNA, 17 nt, Mycobacterium avium subsp. paratuberculosis
gacacccuucaucagca

SEQ ID NO: 906161 - RNA, 22 nt, Mycobacterium avium subsp. paratuberculosis
gacacccuucaucagcaccgcg

SEQ ID NO: 906162 - RNA, 21 nt, Mycobacterium avium subsp. paratuberculosis
gacaccgaaccgccccgcgcg

SEQ ID NO: 906163 - RNA, 13 nt, Mycobacterium avium subsp. paratuberculosis
gacacccucgcgc

SEQ ID NO: 906164 - RNA, 20 nt, Mycobacterium avium subsp. paratuberculosis
gacagcaggaucuccggccg

SEQ ID NO: 906165 - RNA, 21 nt, Mycobacterium avium subsp. paratuberculosis
gacagcaggaucuccggccgg

SEQ ID NO: 906166 - RNA, 23 nt, Mycobacterium avium subsp. paratuberculosis
gacagcaggaucuccggccggug

SEQ ID NO: 906167 - RNA, 22 nt, Mycobacterium avium subsp. paratuberculosis
gacagcaccucgcccugcagcg

SEQ ID NO: 906168 - RNA, 22 nt, Mycobacterium avium subsp. paratuberculosis
gacagcagccagguccgggcac

SEQ ID NO: 906169 - RNA, 15 nt, Mycobacterium avium subsp. paratuberculosis
gacagcagcaccggc

SEQ ID NO: 906170 - RNA, 17 nt, Mycobacterium avium subsp. paratuberculosis
gacaccgcggaccaccg

SEQ ID NO: 906171 - RNA, 13 nt, Mycobacterium avium subsp. paratuberculosis
gacagcaccgcca

SEQ ID NO: 906172 - RNA, 14 nt, Mycobacterium avium subsp. paratuberculosis
gacagcaccgccau

SEQ ID NO: 906173 - RNA, 12 nt, Mycobacterium avium subsp. paratuberculosis
gacagcaccaca

SEQ ID NO: 906174 - RNA, 13 nt, Mycobacterium avium subsp. paratuberculosis
gacagcacccagg

SEQ ID NO: 906175 - RNA, 14 nt, Mycobacterium avium subsp. paratuberculosis
gacagcacccgcug

SEQ ID NO: 906176 - RNA, 21 nt, Mycobacterium avium subsp. paratuberculosis
gacagcacccgcugcagccgg

SEQ ID NO: 906177 - RNA, 19 nt, Mycobacterium avium subsp. paratuberculosis
gacaccgccagcagcgccg

SEQ ID NO: 906178 - RNA, 17 nt, Mycobacterium avium subsp. paratuberculosis
gacaccgccccgccgcg

SEQ ID NO: 906179 - RNA, 19 nt, Mycobacterium avium subsp. paratuberculosis
gacaccgcgaucaccaccc

SEQ ID NO: 906180 - RNA, 22 nt, Mycobacterium avium subsp. paratuberculosis
gacaccgcggcgacgucgugca

SEQ ID NO: 906181 - RNA, 21 nt, Mycobacterium avium subsp. paratuberculosis
gacaccgacgaccaucagcgc

SEQ ID NO: 906182 - RNA, 13 nt, Mycobacterium avium subsp. paratuberculosis
gacaccgcaccca

SEQ ID NO: 906183 - RNA, 19 nt, Mycobacterium avium subsp. paratuberculosis
gacaccgcacggcccauca

SEQ ID NO: 906184 - RNA, 11 nt, Mycobacterium avium subsp. paratuberculosis
gacaccgccag

SEQ ID NO: 906185 - RNA, 18 nt, Mycobacterium avium subsp. paratuberculosis
gacaccgccccgccgcgc

SEQ ID NO: 906186 - RNA, 16 nt, Mycobacterium avium subsp. paratuberculosis
gacagcgaaccgacau

SEQ ID NO: 906187 - RNA, 14 nt, Mycobacterium avium subsp. paratuberculosis
gacagccacagcuc

SEQ ID NO: 906188 - RNA, 13 nt, Mycobacterium avium subsp. paratuberculosis
gacagcgacgggc

SEQ ID NO: 906189 - RNA, 15 nt, Mycobacterium avium subsp. paratuberculosis
gacagcgacgggccg

SEQ ID NO: 906190 - RNA, 17 nt, Mycobacterium avium subsp. paratuberculosis
gacagcgacgggccggg

SEQ ID NO: 906191 - RNA, 13 nt, Mycobacterium avium subsp. paratuberculosis
gacagccugaccg

SEQ ID NO: 906192 - RNA, 16 nt, Mycobacterium avium subsp. paratuberculosis
gacagccugaccgcgg

SEQ ID NO: 906193 - RNA, 19 nt, Mycobacterium avium subsp. paratuberculosis
gacagcgagaagucgccga

SEQ ID NO: 906194 - RNA, 18 nt, Mycobacterium avium subsp. paratuberculosis
gacagcgauugcacaccg

SEQ ID NO: 906195 - RNA, 11 nt, Mycobacterium avium subsp. paratuberculosis
gacagcgcgac

SEQ ID NO: 906196 - RNA, 15 nt, Mycobacterium avium subsp. paratuberculosis
gacagcgcgacgcac

SEQ ID NO: 906197 - RNA, 21 nt, Mycobacterium avium subsp. paratuberculosis
gacagcgcgacgggcacccgc

SEQ ID NO: 906198 - RNA, 17 nt, Mycobacterium avium subsp. paratuberculosis
gacaggcccagcggcug

SEQ ID NO: 906199 - RNA, 22 nt, Mycobacterium avium subsp. paratuberculosis
gacagcgacaaucucgggcacc

SEQ ID NO: 906200 - RNA, 22 nt, Mycobacterium avium subsp. paratuberculosis
gacagcgcgguggucagcggcg

SEQ ID NO: 906201 - RNA, 22 nt, Mycobacterium avium subsp. paratuberculosis
gacagcgcguacaggucgcaca

SEQ ID NO: 906202 - RNA, 16 nt, Mycobacterium avium subsp. paratuberculosis
gacagcgcgucggcca

SEQ ID NO: 906203 - RNA, 18 nt, Mycobacterium avium subsp. paratuberculosis
gacagcgcgucggccagc

SEQ ID NO: 906204 - RNA, 20 nt, Mycobacterium avium subsp. paratuberculosis
gacagcgcgucggccagcgc

SEQ ID NO: 906205 - RNA, 21 nt, Mycobacterium avium subsp. paratuberculosis
gacagcgcgucggccagcgcg

SEQ ID NO: 906206 - RNA, 13 nt, Mycobacterium avium subsp. paratuberculosis
gacaggcagcccg

SEQ ID NO: 906207 - RNA, 14 nt, Mycobacterium avium subsp. paratuberculosis
gacaggcagcccgg

SEQ ID NO: 906208 - RNA, 20 nt, Mycobacterium avium subsp. paratuberculosis
gacaggcagcccggcugcgc

SEQ ID NO: 906209 - RNA, 12 nt, Mycobacterium avium subsp. paratuberculosis
gacagggccagc

SEQ ID NO: 906210 - RNA, 14 nt, Mycobacterium avium subsp. paratuberculosis
gacagggccagcgc

SEQ ID NO: 906211 - RNA, 15 nt, Mycobacterium avium subsp. paratuberculosis
gacagggcgacaucg

SEQ ID NO: 906212 - RNA, 23 nt, Mycobacterium avium subsp. paratuberculosis
gacaggguaacccgggacccgga

SEQ ID NO: 906213 - RNA, 12 nt, Mycobacterium avium subsp. paratuberculosis
gacagggugcca

SEQ ID NO: 906214 - RNA, 15 nt, Mycobacterium avium subsp. paratuberculosis
gacaggggcagcagc

SEQ ID NO: 906215 - RNA, 20 nt, Mycobacterium avium subsp. paratuberculosis
gacaggggcagcagcagauc

SEQ ID NO: 906216 - RNA, 16 nt, Mycobacterium avium subsp. paratuberculosis
gacaggucggcggucg

SEQ ID NO: 906217 - RNA, 20 nt, Mycobacterium avium subsp. paratuberculosis
gacaggugcauccagucggc

SEQ ID NO: 906218 - RNA, 16 nt, Mycobacterium avium subsp. paratuberculosis
gacagguggccgauca

SEQ ID NO: 906219 - RNA, 15 nt, Mycobacterium avium subsp. paratuberculosis
gacagguggggcacc

SEQ ID NO: 906220 - RNA, 23 nt, Mycobacterium avium subsp. paratuberculosis
gacaggucgagggugacccgggc

SEQ ID NO: 906221 - RNA, 13 nt, Mycobacterium avium subsp. paratuberculosis
gacaggucgauga

SEQ ID NO: 906222 - RNA, 16 nt, Mycobacterium avium subsp. paratuberculosis
gacagguagcaggcgc

SEQ ID NO: 906223 - RNA, 18 nt, Mycobacterium avium subsp. paratuberculosis
gacagguagcaggcgcgc

SEQ ID NO: 906224 - RNA, 16 nt, Mycobacterium avium subsp. paratuberculosis
gacagguagcgcagcc

SEQ ID NO: 906225 - RNA, 18 nt, Mycobacterium avium subsp. paratuberculosis
gacagguagcgcagcccg

SEQ ID NO: 906226 - RNA, 20 nt, Mycobacterium avium subsp. paratuberculosis
gacagguagcgcaucagcuc

SEQ ID NO: 906227 - RNA, 22 nt, Mycobacterium avium subsp. paratuberculosis
gacagcggccccccgcacaccg

SEQ ID NO: 906228 - RNA, 21 nt, Mycobacterium avium subsp. paratuberculosis
gacagcggccuaugcgcccgg

SEQ ID NO: 906229 - RNA, 13 nt, Mycobacterium avium subsp. paratuberculosis
gacaggccggccg

SEQ ID NO: 906230 - RNA, 18 nt, Mycobacterium avium subsp. paratuberculosis
gacaggccggccgcuacc

SEQ ID NO: 906231 - RNA, 18 nt, Mycobacterium avium subsp. paratuberculosis
gacaggccggcgacggcg

SEQ ID NO: 906232 - RNA, 16 nt, Mycobacterium avium subsp. paratuberculosis
gaccagauaggccagc

SEQ ID NO: 906233 - RNA, 20 nt, Mycobacterium avium subsp. paratuberculosis
gaccagauaggccagcgcgu

SEQ ID NO: 906234 - RNA, 22 nt, Mycobacterium avium subsp. paratuberculosis
gaccagauccucgaauccgcgg

SEQ ID NO: 906235 - RNA, 17 nt, Mycobacterium avium subsp. paratuberculosis
gaccagcacccgggccu

SEQ ID NO: 906236 - RNA, 18 nt, Mycobacterium avium subsp. paratuberculosis
gaccagcacccgggccuu

SEQ ID NO: 906237 - RNA, 13 nt, Mycobacterium avium subsp. paratuberculosis
gaccagcaccgca

SEQ ID NO: 906238 - RNA, 22 nt, Mycobacterium avium subsp. paratuberculosis
gaccacuccuggguuccggugg

SEQ ID NO: 906239 - RNA, 17 nt, Mycobacterium avium subsp. paratuberculosis
gaccacguccccgggcg

SEQ ID NO: 906240 - RNA, 14 nt, Mycobacterium avium subsp. paratuberculosis
gaccacggcgcgga

SEQ ID NO: 906241 - RNA, 19 nt, Mycobacterium avium subsp. paratuberculosis
gaccacggucacagccgcg

SEQ ID NO: 906242 - RNA, 20 nt, Mycobacterium avium subsp. paratuberculosis
gaccacggucacagccgcga

SEQ ID NO: 906243 - RNA, 14 nt, Mycobacterium avium subsp. paratuberculosis
gaccacggucggcg

SEQ ID NO: 906244 - RNA, 15 nt, Mycobacterium avium subsp. paratuberculosis
gaccacggugcgcuc

SEQ ID NO: 906245 - RNA, 16 nt, Mycobacterium avium subsp. paratuberculosis
gaccacggugcgcucg

SEQ ID NO: 906246 - RNA, 16 nt, Mycobacterium avium subsp. paratuberculosis
gaccacggccccagcc

SEQ ID NO: 906247 - RNA, 13 nt, Mycobacterium avium subsp. paratuberculosis
gaccacggccggu

SEQ ID NO: 906248 - RNA, 16 nt, Mycobacterium avium subsp. paratuberculosis
gaccacggccgguccg

SEQ ID NO: 906249 - RNA, 23 nt, Mycobacterium avium subsp. paratuberculosis
gaccacggccugguacagcaccg

SEQ ID NO: 906250 - RNA, 24 nt, Mycobacterium avium subsp. paratuberculosis
gaccacgcuccagaugcgguggug

SEQ ID NO: 906251 - RNA, 19 nt, Mycobacterium avium subsp. paratuberculosis
gaccacgcugagcaaccgc

SEQ ID NO: 906252 - RNA, 13 nt, Mycobacterium avium subsp. paratuberculosis
gaccacgccgcgc

SEQ ID NO: 906253 - RNA, 20 nt, Mycobacterium avium subsp. paratuberculosis
gaccacgccgcggucgcuga

SEQ ID NO: 906254 - RNA, 22 nt, Mycobacterium avium subsp. paratuberculosis
gaccacgccgcggucgcugacc

SEQ ID NO: 906255 - RNA, 14 nt, Mycobacterium avium subsp. paratuberculosis
gaccacgccgugcc

SEQ ID NO: 906256 - RNA, 19 nt, Mycobacterium avium subsp. paratuberculosis
gaccacgccgugcccggcg

SEQ ID NO: 906257 - RNA, 12 nt, Mycobacterium avium subsp. paratuberculosis
gaccacgcacac

SEQ ID NO: 906258 - RNA, 17 nt, Mycobacterium avium subsp. paratuberculosis
gaccacgcacaccaccg

SEQ ID NO: 906259 - RNA, 23 nt, Mycobacterium avium subsp. paratuberculosis
gaccaccucgguggacgccgcgc

SEQ ID NO: 906260 - RNA, 18 nt, Mycobacterium avium subsp. paratuberculosis
gaccaccucuucgcgguc

SEQ ID NO: 906261 - RNA, 17 nt, Mycobacterium avium subsp. paratuberculosis
gaccacgaagggcgcca

SEQ ID NO: 906262 - RNA, 19 nt, Mycobacterium avium subsp. paratuberculosis
gaccacgaagggcgccagc

SEQ ID NO: 906263 - RNA, 20 nt, Mycobacterium avium subsp. paratuberculosis
gaccacgaagggcgccagca

SEQ ID NO: 906264 - RNA, 16 nt, Mycobacterium avium subsp. paratuberculosis
gaccaccuugcgcagc

SEQ ID NO: 906265 - RNA, 17 nt, Mycobacterium avium subsp. paratuberculosis
gaccaccuugcgcagca

SEQ ID NO: 906266 - RNA, 19 nt, Mycobacterium avium subsp. paratuberculosis
gaccaccuugcgcagcagc

SEQ ID NO: 906267 - RNA, 19 nt, Mycobacterium avium subsp. paratuberculosis
gaccaccuuggccggugcg

SEQ ID NO: 906268 - RNA, 23 nt, Mycobacterium avium subsp. paratuberculosis
gaccaccuuggccggugcgccga

SEQ ID NO: 906269 - RNA, 20 nt, Mycobacterium avium subsp. paratuberculosis
gaccacgaacaccggcgcga

SEQ ID NO: 906270 - RNA, 20 nt, Mycobacterium avium subsp. paratuberculosis
gaccaccucggcgacgaugg

SEQ ID NO: 906271 - RNA, 19 nt, Mycobacterium avium subsp. paratuberculosis
gaccaccggguagcccgcg

SEQ ID NO: 906272 - RNA, 24 nt, Mycobacterium avium subsp. paratuberculosis
gaccaccgcuguggacaggucgau

SEQ ID NO: 906273 - RNA, 11 nt, Mycobacterium avium subsp. paratuberculosis
gaccaccggca

SEQ ID NO: 906274 - RNA, 13 nt, Mycobacterium avium subsp. paratuberculosis
gaccacagcgccu

SEQ ID NO: 906275 - RNA, 19 nt, Mycobacterium avium subsp. paratuberculosis
gaccacagcgccucgucga

SEQ ID NO: 906276 - RNA, 20 nt, Mycobacterium avium subsp. paratuberculosis
gaccacagcgccucgucgag

SEQ ID NO: 906277 - RNA, 16 nt, Mycobacterium avium subsp. paratuberculosis
gaccacaagggccacc

SEQ ID NO: 906278 - RNA, 17 nt, Mycobacterium avium subsp. paratuberculosis
gaccacaagggccaccg

SEQ ID NO: 906279 - RNA, 20 nt, Mycobacterium avium subsp. paratuberculosis
gaccacaagggccaccgggc

SEQ ID NO: 906280 - RNA, 22 nt, Mycobacterium avium subsp. paratuberculosis
gaccacaagggccaccgggccg

SEQ ID NO: 906281 - RNA, 12 nt, Mycobacterium avium subsp. paratuberculosis
gaccacaccgcc

SEQ ID NO: 906282 - RNA, 16 nt, Mycobacterium avium subsp. paratuberculosis
gaccacaccgccggcc

SEQ ID NO: 906283 - RNA, 13 nt, Mycobacterium avium subsp. paratuberculosis
gaccacaccggcg

SEQ ID NO: 906284 - RNA, 21 nt, Mycobacterium avium subsp. paratuberculosis
gaccacaccggcgcugcccgc

SEQ ID NO: 906285 - RNA, 16 nt, Mycobacterium avium subsp. paratuberculosis
gaccacaccgucgacg

SEQ ID NO: 906286 - RNA, 22 nt, Mycobacterium avium subsp. paratuberculosis
gacaucgaaugcagcggcuccg

SEQ ID NO: 906287 - RNA, 17 nt, Mycobacterium avium subsp. paratuberculosis
gacaucgccaucagcag

SEQ ID NO: 906288 - RNA, 20 nt, Mycobacterium avium subsp. paratuberculosis
gacaucgccaucagcagcgc

SEQ ID NO: 906289 - RNA, 22 nt, Mycobacterium avium subsp. paratuberculosis
gacaucgccaucagcagcgccu

SEQ ID NO: 906290 - RNA, 14 nt, Mycobacterium avium subsp. paratuberculosis
gacaucgccggcga

SEQ ID NO: 906291 - RNA, 21 nt, Mycobacterium avium subsp. paratuberculosis
gacaucgccggcgaccgugcc

SEQ ID NO: 906292 - RNA, 15 nt, Mycobacterium avium subsp. paratuberculosis
gacaucgccucggcg

SEQ ID NO: 906293 - RNA, 12 nt, Mycobacterium avium subsp. paratuberculosis
gacaucgccgcg

SEQ ID NO: 906294 - RNA, 16 nt, Mycobacterium avium subsp. paratuberculosis
gacaucgccgcggccg

SEQ ID NO: 906295 - RNA, 13 nt, Mycobacterium avium subsp. paratuberculosis
gacaucggcagca

SEQ ID NO: 906296 - RNA, 23 nt, Mycobacterium avium subsp. paratuberculosis
gacaucggcagcagggugccgcc

SEQ ID NO: 906297 - RNA, 20 nt, Mycobacterium avium subsp. paratuberculosis
gaccaauugcgagcaggccg

SEQ ID NO: 906298 - RNA, 23 nt, Mycobacterium avium subsp. paratuberculosis
gacaucaggcccuugccccacca

SEQ ID NO: 906299 - RNA, 19 nt, Mycobacterium avium subsp. paratuberculosis
gacagucgcgggcagccgg

SEQ ID NO: 906300 - RNA, 17 nt, Mycobacterium avium subsp. paratuberculosis
gacauccaggaccgcgc

SEQ ID NO: 906301 - RNA, 19 nt, Mycobacterium avium subsp. paratuberculosis
gacauccaggaccgcgcgc

SEQ ID NO: 906302 - RNA, 16 nt, Mycobacterium avium subsp. paratuberculosis
gacauccauugggccg

SEQ ID NO: 906303 - RNA, 18 nt, Mycobacterium avium subsp. paratuberculosis
gacagguucuuggcggcc

SEQ ID NO: 906304 - RNA, 21 nt, Mycobacterium avium subsp. paratuberculosis
gacagguucuuggcggccugc

SEQ ID NO: 906305 - RNA, 13 nt, Mycobacterium avium subsp. paratuberculosis
gacagucccgcgu

SEQ ID NO: 906306 - RNA, 14 nt, Mycobacterium avium subsp. paratuberculosis
gaaaugggccaugc

SEQ ID NO: 906307 - RNA, 20 nt, Mycobacterium avium subsp. paratuberculosis
gaaaugggccaugccggccu

SEQ ID NO: 906308 - RNA, 15 nt, Mycobacterium avium subsp. paratuberculosis
gaaaugcgucgccag

SEQ ID NO: 906309 - RNA, 23 nt, Mycobacterium avium subsp. paratuberculosis
gaaaugcgggcgauggcgggccg

SEQ ID NO: 906310 - RNA, 13 nt, Mycobacterium avium subsp. paratuberculosis
gaaaucucucgac

SEQ ID NO: 906311 - RNA, 22 nt, Mycobacterium avium subsp. paratuberculosis
gaaaucggguccagcgccgagc

SEQ ID NO: 906312 - RNA, 14 nt, Mycobacterium avium subsp. paratuberculosis
gaaaugccgggccg

SEQ ID NO: 906313 - RNA, 20 nt, Mycobacterium avium subsp. paratuberculosis
gaaaucgccuguccgaccag

SEQ ID NO: 906314 - RNA, 14 nt, Mycobacterium avium subsp. paratuberculosis
gaaaucgagcgcgc

SEQ ID NO: 906315 - RNA, 15 nt, Mycobacterium avium subsp. paratuberculosis
gaaaucgagcgcgcu

SEQ ID NO: 906316 - RNA, 22 nt, Mycobacterium avium subsp. paratuberculosis
gaaaucgagcgcgcugugcgcc

SEQ ID NO: 906317 - RNA, 14 nt, Mycobacterium avium subsp. paratuberculosis
gaacaacagggccg

SEQ ID NO: 906318 - RNA, 17 nt, Mycobacterium avium subsp. paratuberculosis
gaacaacccggccgcga

SEQ ID NO: 906319 - RNA, 22 nt, Mycobacterium avium subsp. paratuberculosis
gaacaacggcggaccggcggcc

SEQ ID NO: 906320 - RNA, 13 nt, Mycobacterium avium subsp. paratuberculosis
gaacaacgcggug

SEQ ID NO: 906321 - RNA, 22 nt, Mycobacterium avium subsp. paratuberculosis
gaacaacgcggugaccgcggcc

SEQ ID NO: 906322 - RNA, 19 nt, Mycobacterium avium subsp. paratuberculosis
gaacaacugaccgauggcc

SEQ ID NO: 906323 - RNA, 13 nt, Mycobacterium avium subsp. paratuberculosis
gaacaccaccggc

SEQ ID NO: 906324 - RNA, 13 nt, Mycobacterium avium subsp. paratuberculosis
gaacaccacggcc

SEQ ID NO: 906325 - RNA, 16 nt, Mycobacterium avium subsp. paratuberculosis
gaacaccacggccggc

SEQ ID NO: 906326 - RNA, 20 nt, Mycobacterium avium subsp. paratuberculosis
gaacaccagaugccgcucgg

SEQ ID NO: 906327 - RNA, 22 nt, Mycobacterium avium subsp. paratuberculosis
gaacaccagaugccgcucggcg

SEQ ID NO: 906328 - RNA, 22 nt, Mycobacterium avium subsp. paratuberculosis
gaacaauuccucugcgcgccaa

SEQ ID NO: 906329 - RNA, 14 nt, Mycobacterium avium subsp. paratuberculosis
gaacaccagcgcau

SEQ ID NO: 906330 - RNA, 13 nt, Mycobacterium avium subsp. paratuberculosis
gaacaccagcacc

SEQ ID NO: 906331 - RNA, 18 nt, Mycobacterium avium subsp. paratuberculosis
gaacaccagcacccagca

SEQ ID NO: 906332 - RNA, 21 nt, Mycobacterium avium subsp. paratuberculosis
gaacaccgaauuguccagcag

SEQ ID NO: 906333 - RNA, 16 nt, Mycobacterium avium subsp. paratuberculosis
gaacaccggcagcgcc

SEQ ID NO: 906334 - RNA, 20 nt, Mycobacterium avium subsp. paratuberculosis
gaacaccggcagcgccacca

SEQ ID NO: 906335 - RNA, 14 nt, Mycobacterium avium subsp. paratuberculosis
gaacaccuccucgg

SEQ ID NO: 906336 - RNA, 12 nt, Mycobacterium avium subsp. paratuberculosis
gaacaccucgaa

SEQ ID NO: 906337 - RNA, 22 nt, Mycobacterium avium subsp. paratuberculosis
gaacaccgucaucgugugggcg

SEQ ID NO: 906338 - RNA, 18 nt, Mycobacterium avium subsp. paratuberculosis
gaacaccgugccgucacg

SEQ ID NO: 906339 - RNA, 16 nt, Mycobacterium avium subsp. paratuberculosis
gaacacgaacccggcg

SEQ ID NO: 906340 - RNA, 18 nt, Mycobacterium avium subsp. paratuberculosis
gaacacgaacccggcggc

SEQ ID NO: 906341 - RNA, 17 nt, Mycobacterium avium subsp. paratuberculosis
gaacacgcaggugcgcc

SEQ ID NO: 906342 - RNA, 20 nt, Mycobacterium avium subsp. paratuberculosis
gaacacgcaggugcgccgcu

SEQ ID NO: 906343 - RNA, 17 nt, Mycobacterium avium subsp. paratuberculosis
gaacacgcccagcgccg

SEQ ID NO: 906344 - RNA, 19 nt, Mycobacterium avium subsp. paratuberculosis
gaacacgcccagcgccgcg

SEQ ID NO: 906345 - RNA, 15 nt, Mycobacterium avium subsp. paratuberculosis
gaacacgccccggcg

SEQ ID NO: 906346 - RNA, 16 nt, Mycobacterium avium subsp. paratuberculosis
gaacacgccccggcgg

SEQ ID NO: 906347 - RNA, 17 nt, Mycobacterium avium subsp. paratuberculosis
gaacacgccccggcggg

SEQ ID NO: 906348 - RNA, 24 nt, Mycobacterium avium subsp. paratuberculosis
gaacacggccgccuccagcacguc

SEQ ID NO: 906349 - RNA, 21 nt, Mycobacterium avium subsp. paratuberculosis
gaacacgcgaugaucagcucg

SEQ ID NO: 906350 - RNA, 23 nt, Mycobacterium avium subsp. paratuberculosis
gaacacgcgaugaucagcucgcg

SEQ ID NO: 906351 - RNA, 22 nt, Mycobacterium avium subsp. paratuberculosis
gaacacggcucgggggccgcuc

SEQ ID NO: 906352 - RNA, 13 nt, Mycobacterium avium subsp. paratuberculosis
gaacacgggcggc

SEQ ID NO: 906353 - RNA, 20 nt, Mycobacterium avium subsp. paratuberculosis
gaacacgggcggcagggcca

SEQ ID NO: 906354 - RNA, 15 nt, Mycobacterium avium subsp. paratuberculosis
gaacacggucgccgg

SEQ ID NO: 906355 - RNA, 17 nt, Mycobacterium avium subsp. paratuberculosis
gaacacggucgccggcu

SEQ ID NO: 906356 - RNA, 17 nt, Mycobacterium avium subsp. paratuberculosis
gaacacguacagcggcg

SEQ ID NO: 906357 - RNA, 15 nt, Mycobacterium avium subsp. paratuberculosis
gaacagcgggccggc

SEQ ID NO: 906358 - RNA, 19 nt, Mycobacterium avium subsp. paratuberculosis
gaacagcgggccggcgucg

SEQ ID NO: 906359 - RNA, 15 nt, Mycobacterium avium subsp. paratuberculosis
gaacagcgucgccga

SEQ ID NO: 906360 - RNA, 18 nt, Mycobacterium avium subsp. paratuberculosis
gaacagcgucgccgacgg

SEQ ID NO: 906361 - RNA, 20 nt, Mycobacterium avium subsp. paratuberculosis
gaacagcgucgccgacgggc

SEQ ID NO: 906362 - RNA, 17 nt, Mycobacterium avium subsp. paratuberculosis
gaacagcggggugccca

SEQ ID NO: 906363 - RNA, 23 nt, Mycobacterium avium subsp. paratuberculosis
gaacagcggguucuucagggcgg

SEQ ID NO: 906364 - RNA, 22 nt, Mycobacterium avium subsp. paratuberculosis
gaacagcgacgucugcggcucg

SEQ ID NO: 906365 - RNA, 24 nt, Mycobacterium avium subsp. paratuberculosis
gaacagcgacgucugcggcucggc

SEQ ID NO: 906366 - RNA, 15 nt, Mycobacterium avium subsp. paratuberculosis
gaacagcgcgcccga

SEQ ID NO: 906367 - RNA, 17 nt, Mycobacterium avium subsp. paratuberculosis
gaacagcgcgcccgacg

SEQ ID NO: 906368 - RNA, 20 nt, Mycobacterium avium subsp. paratuberculosis
gaacagcgcgcccgacgguc

SEQ ID NO: 906369 - RNA, 15 nt, Mycobacterium avium subsp. paratuberculosis
gaacagcgcgccgaa

SEQ ID NO: 906370 - RNA, 13 nt, Mycobacterium avium subsp. paratuberculosis
gaacagcgcggcc

SEQ ID NO: 906371 - RNA, 15 nt, Mycobacterium avium subsp. paratuberculosis
gaacagcgcggccac

SEQ ID NO: 906372 - RNA, 19 nt, Mycobacterium avium subsp. paratuberculosis
gaacagcgcggccaccacg

SEQ ID NO: 906373 - RNA, 22 nt, Mycobacterium avium subsp. paratuberculosis
gaacaggcccugcugcagcgcg

SEQ ID NO: 906374 - RNA, 16 nt, Mycobacterium avium subsp. paratuberculosis
gaacagcucgaccagc

SEQ ID NO: 906375 - RNA, 15 nt, Mycobacterium avium subsp. paratuberculosis
gaacagcuuggcgca

SEQ ID NO: 906376 - RNA, 13 nt, Mycobacterium avium subsp. paratuberculosis
gaacagccgaccg

SEQ ID NO: 906377 - RNA, 17 nt, Mycobacterium avium subsp. paratuberculosis
gaacagccggaucagcg

SEQ ID NO: 906378 - RNA, 24 nt, Mycobacterium avium subsp. paratuberculosis
gaacagccggaucagcguuccggc

SEQ ID NO: 906379 - RNA, 16 nt, Mycobacterium avium subsp. paratuberculosis
gaacagccgggccagc

SEQ ID NO: 906380 - RNA, 20 nt, Mycobacterium avium subsp. paratuberculosis
gaacagccgggccagcagcu

SEQ ID NO: 906381 - RNA, 14 nt, Mycobacterium avium subsp. paratuberculosis
gaacagccgggccg

SEQ ID NO: 906382 - RNA, 16 nt, Mycobacterium avium subsp. paratuberculosis
gaacagccgggccgcc

SEQ ID NO: 906383 - RNA, 21 nt, Mycobacterium avium subsp. paratuberculosis
gaacagccgggccgcccgcgc

SEQ ID NO: 906384 - RNA, 22 nt, Mycobacterium avium subsp. paratuberculosis
gaacagccgggccgcccgcgcg

SEQ ID NO: 906385 - RNA, 15 nt, Mycobacterium avium subsp. paratuberculosis
gaacagccgggcggc

SEQ ID NO: 906386 - RNA, 17 nt, Mycobacterium avium subsp. paratuberculosis
gaacagccgggcggccg

SEQ ID NO: 906387 - RNA, 20 nt, Mycobacterium avium subsp. paratuberculosis
gaacagccgguccgaccgcc

SEQ ID NO: 906388 - RNA, 15 nt, Mycobacterium avium subsp. paratuberculosis
gaacagcccgagcac

SEQ ID NO: 906389 - RNA, 23 nt, Mycobacterium avium subsp. paratuberculosis
gaacagccacgguccuuggcgua

SEQ ID NO: 906390 - RNA, 14 nt, Mycobacterium avium subsp. paratuberculosis
gaacagcagcaccc

SEQ ID NO: 906391 - RNA, 17 nt, Mycobacterium avium subsp. paratuberculosis
gaacagcagcagcagcg

SEQ ID NO: 906392 - RNA, 18 nt, Mycobacterium avium subsp. paratuberculosis
gaacagcagcagcagcgg

SEQ ID NO: 906393 - RNA, 20 nt, Mycobacterium avium subsp. paratuberculosis
gaacagcagccacgacacca

SEQ ID NO: 906394 - RNA, 14 nt, Mycobacterium avium subsp. paratuberculosis
gaacagcagcgcgc

SEQ ID NO: 906395 - RNA, 13 nt, Mycobacterium avium subsp. paratuberculosis
gaacagcaccgcc

SEQ ID NO: 906396 - RNA, 15 nt, Mycobacterium avium subsp. paratuberculosis
gaacagcaccgccac

SEQ ID NO: 906397 - RNA, 13 nt, Mycobacterium avium subsp. paratuberculosis
gaacagcacgccg

SEQ ID NO: 906398 - RNA, 14 nt, Mycobacterium avium subsp. paratuberculosis
gaacagcacgccgg

SEQ ID NO: 906399 - RNA, 17 nt, Mycobacterium avium subsp. paratuberculosis
gaacagcacgccggccg

SEQ ID NO: 906400 - RNA, 17 nt, Mycobacterium avium subsp. paratuberculosis
gaacacgucggccagcg

SEQ ID NO: 906401 - RNA, 14 nt, Mycobacterium avium subsp. paratuberculosis
gaacacgucggcga

SEQ ID NO: 906402 - RNA, 19 nt, Mycobacterium avium subsp. paratuberculosis
gaacacguugcgcaucagc

SEQ ID NO: 906403 - RNA, 21 nt, Mycobacterium avium subsp. paratuberculosis
gaacacguugcgcaucagcgc

SEQ ID NO: 906404 - RNA, 18 nt, Mycobacterium avium subsp. paratuberculosis
gaacagacucagcccggc

SEQ ID NO: 906405 - RNA, 19 nt, Mycobacterium avium subsp. paratuberculosis
gaacagacucagcccggcc

SEQ ID NO: 906406 - RNA, 16 nt, Mycobacterium avium subsp. paratuberculosis
gaacagucggccggcg

SEQ ID NO: 906407 - RNA, 16 nt, Mycobacterium avium subsp. paratuberculosis
gaacaguuccucggcg

SEQ ID NO: 906408 - RNA, 15 nt, Mycobacterium avium subsp. paratuberculosis
gaacaguucgacgua

SEQ ID NO: 906409 - RNA, 18 nt, Mycobacterium avium subsp. paratuberculosis
gaacaguucgacguagcc

SEQ ID NO: 906410 - RNA, 21 nt, Mycobacterium avium subsp. paratuberculosis
gaacaguucggugcacggcgc

SEQ ID NO: 906411 - RNA, 16 nt, Mycobacterium avium subsp. paratuberculosis
gaacaggaugcgggug

SEQ ID NO: 906412 - RNA, 19 nt, Mycobacterium avium subsp. paratuberculosis
gaacaggcgcaacagcacc

SEQ ID NO: 906413 - RNA, 22 nt, Mycobacterium avium subsp. paratuberculosis
gaacaggcuggccagcucggcg

SEQ ID NO: 906414 - RNA, 13 nt, Mycobacterium avium subsp. paratuberculosis
gaacagggcggcg

SEQ ID NO: 906415 - RNA, 16 nt, Mycobacterium avium subsp. paratuberculosis
gaacagggcggcgggc

SEQ ID NO: 906416 - RNA, 20 nt, Mycobacterium avium subsp. paratuberculosis
gaacagggcggcgggcccgg

SEQ ID NO: 906417 - RNA, 16 nt, Mycobacterium avium subsp. paratuberculosis
gaacagguaggcggcg

SEQ ID NO: 906418 - RNA, 17 nt, Mycobacterium avium subsp. paratuberculosis
gaacagguaggcggcgc

SEQ ID NO: 906419 - RNA, 20 nt, Mycobacterium avium subsp. paratuberculosis
gaacagguaggcggcgccgu

SEQ ID NO: 906420 - RNA, 23 nt, Mycobacterium avium subsp. paratuberculosis
gaacagguaggcggcgccgucga

SEQ ID NO: 906421 - RNA, 13 nt, Mycobacterium avium subsp. paratuberculosis
gaacagguccgcg

SEQ ID NO: 906422 - RNA, 14 nt, Mycobacterium avium subsp. paratuberculosis
gaaccaacgcggcg

SEQ ID NO: 906423 - RNA, 18 nt, Mycobacterium avium subsp. paratuberculosis
gaacaugcugccgccggc

SEQ ID NO: 906424 - RNA, 20 nt, Mycobacterium avium subsp. paratuberculosis
gaacaugcugccgccggcga

SEQ ID NO: 906425 - RNA, 16 nt, Mycobacterium avium subsp. paratuberculosis
gaacauggcggccagc

SEQ ID NO: 906426 - RNA, 19 nt, Mycobacterium avium subsp. paratuberculosis
gaacauggcggccagccgg

SEQ ID NO: 906427 - RNA, 22 nt, Mycobacterium avium subsp. paratuberculosis
gaacauggucgcccacaccgga

SEQ ID NO: 906428 - RNA, 20 nt, Mycobacterium avium subsp. paratuberculosis
gaacaucuuggucagccgcg

SEQ ID NO: 906429 - RNA, 21 nt, Mycobacterium avium subsp. paratuberculosis
gaacaucuuggucagccgcgg

SEQ ID NO: 906430 - RNA, 20 nt, Mycobacterium avium subsp. paratuberculosis
gaacaucccggagccgucgg

SEQ ID NO: 906431 - RNA, 19 nt, Mycobacterium avium subsp. paratuberculosis
gaacaucgagcccaccgcg

SEQ ID NO: 906432 - RNA, 20 nt, Mycobacterium avium subsp. paratuberculosis
gaacaucgccucggccgcgg

SEQ ID NO: 906433 - RNA, 18 nt, Mycobacterium avium subsp. paratuberculosis
gaacaucggcacgugucc

SEQ ID NO: 906434 - RNA, 13 nt, Mycobacterium avium subsp. paratuberculosis
gaacggcccggac

SEQ ID NO: 906435 - RNA, 19 nt, Mycobacterium avium subsp. paratuberculosis
gaacucaccgguggccgcg

SEQ ID NO: 906436 - RNA, 22 nt, Mycobacterium avium subsp. paratuberculosis
gaacucaccgguggccgcgucg

SEQ ID NO: 906437 - RNA, 16 nt, Mycobacterium avium subsp. paratuberculosis
gaacucaggcgcgcac

SEQ ID NO: 906438 - RNA, 14 nt, Mycobacterium avium subsp. paratuberculosis
gaacuccagcagcu

SEQ ID NO: 906439 - RNA, 21 nt, Mycobacterium avium subsp. paratuberculosis
gaacuccauccgccgucgacc

SEQ ID NO: 906440 - RNA, 20 nt, Mycobacterium avium subsp. paratuberculosis
gaacuccugcucgcgggcca

SEQ ID NO: 906441 - RNA, 16 nt, Mycobacterium avium subsp. paratuberculosis
gaacuccgucucgccg

SEQ ID NO: 906442 - RNA, 14 nt, Mycobacterium avium subsp. paratuberculosis
gaacucgacgucga

SEQ ID NO: 906443 - RNA, 14 nt, Mycobacterium avium subsp. paratuberculosis
gaacucccgcgccg

SEQ ID NO: 906444 - RNA, 15 nt, Mycobacterium avium subsp. paratuberculosis
gaacucccgcgccgc

SEQ ID NO: 906445 - RNA, 14 nt, Mycobacterium avium subsp. paratuberculosis
gaacuccgacucca

SEQ ID NO: 906446 - RNA, 17 nt, Mycobacterium avium subsp. paratuberculosis
gaacuccgacuccagca

SEQ ID NO: 906447 - RNA, 18 nt, Mycobacterium avium subsp. paratuberculosis
gaacuccgacuccagcag

SEQ ID NO: 906448 - RNA, 13 nt, Mycobacterium avium subsp. paratuberculosis
gaacuccgccgaa

SEQ ID NO: 906449 - RNA, 14 nt, Mycobacterium avium subsp. paratuberculosis
gaacuccgccgaac

SEQ ID NO: 906450 - RNA, 16 nt, Mycobacterium avium subsp. paratuberculosis
gaacuccgcgauggcc

SEQ ID NO: 906451 - RNA, 17 nt, Mycobacterium avium subsp. paratuberculosis
gaacuccgcgauggccu

SEQ ID NO: 906452 - RNA, 23 nt, Mycobacterium avium subsp. paratuberculosis
gaacuccgcgauggccuccgacc

SEQ ID NO: 906453 - RNA, 17 nt, Mycobacterium avium subsp. paratuberculosis
gaacuccgcgcgcggca

SEQ ID NO: 906454 - RNA, 21 nt, Mycobacterium avium subsp. paratuberculosis
gaacggccggauggccagcag

SEQ ID NO: 906455 - RNA, 22 nt, Mycobacterium avium subsp. paratuberculosis
gaacgcggcgaaggccagcgau

SEQ ID NO: 906456 - RNA, 18 nt, Mycobacterium avium subsp. paratuberculosis
gaacggcccgccgccggc

SEQ ID NO: 906457 - RNA, 19 nt, Mycobacterium avium subsp. paratuberculosis
gaacggcagcucgucgacg

SEQ ID NO: 906458 - RNA, 20 nt, Mycobacterium avium subsp. paratuberculosis
gaacggcaccccgcggucgg

SEQ ID NO: 906459 - RNA, 21 nt, Mycobacterium avium subsp. paratuberculosis
gaacggcaccccgcggucggc

SEQ ID NO: 906460 - RNA, 13 nt, Mycobacterium avium subsp. paratuberculosis
gaacggcacccgc

SEQ ID NO: 906461 - RNA, 15 nt, Mycobacterium avium subsp. paratuberculosis
gaacggcaccucgau

SEQ ID NO: 906462 - RNA, 18 nt, Mycobacterium avium subsp. paratuberculosis
gaacggcaccucgaucac

SEQ ID NO: 906463 - RNA, 21 nt, Mycobacterium avium subsp. paratuberculosis
gaacggcacguugcccaggaa

SEQ ID NO: 906464 - RNA, 15 nt, Mycobacterium avium subsp. paratuberculosis
gaacggcaccagcgg

SEQ ID NO: 906465 - RNA, 16 nt, Mycobacterium avium subsp. paratuberculosis
gaacggcaaccugggc

SEQ ID NO: 906466 - RNA, 17 nt, Mycobacterium avium subsp. paratuberculosis
gaacggcaaccugggcg

SEQ ID NO: 906467 - RNA, 22 nt, Mycobacterium avium subsp. paratuberculosis
gaacggcaaccugggcggcggc

SEQ ID NO: 906468 - RNA, 12 nt, Mycobacterium avium subsp. paratuberculosis
gaacggcaacgg

SEQ ID NO: 906469 - RNA, 22 nt, Mycobacterium avium subsp. paratuberculosis
gaacgcgcggaugcccaggccg

SEQ ID NO: 906470 - RNA, 23 nt, Mycobacterium avium subsp. paratuberculosis
gaacgcgcggucgucgcccgucu

SEQ ID NO: 906471 - RNA, 23 nt, Mycobacterium avium subsp. paratuberculosis
gaacgcgcugucgcccucgaucg

SEQ ID NO: 906472 - RNA, 15 nt, Mycobacterium avium subsp. paratuberculosis
gaacgcggacagcuc

SEQ ID NO: 906473 - RNA, 22 nt, Mycobacterium avium subsp. paratuberculosis
gaacgcggacagcucgccggcc

SEQ ID NO: 906474 - RNA, 15 nt, Mycobacterium avium subsp. paratuberculosis
gaacgcggccagcgg

SEQ ID NO: 906475 - RNA, 13 nt, Mycobacterium avium subsp. paratuberculosis
gaacgcggccagg

SEQ ID NO: 906476 - RNA, 16 nt, Mycobacterium avium subsp. paratuberculosis
gaacgcggccgccagc

SEQ ID NO: 906477 - RNA, 20 nt, Mycobacterium avium subsp. paratuberculosis
gaacgcggccgccagcgcac

SEQ ID NO: 906478 - RNA, 18 nt, Mycobacterium avium subsp. paratuberculosis
gaacgaaucgucgccguc

SEQ ID NO: 906479 - RNA, 13 nt, Mycobacterium avium subsp. paratuberculosis
gaacgacacgugg

SEQ ID NO: 906480 - RNA, 18 nt, Mycobacterium avium subsp. paratuberculosis
gaacgacgccguucaggu

SEQ ID NO: 906481 - RNA, 18 nt, Mycobacterium avium subsp. paratuberculosis
gaacgacgcggcacgccg

SEQ ID NO: 906482 - RNA, 18 nt, Mycobacterium avium subsp. paratuberculosis
gaacgccgaucaccgcgu

SEQ ID NO: 906483 - RNA, 18 nt, Mycobacterium avium subsp. paratuberculosis
gaacgccgaucaccggca

SEQ ID NO: 906484 - RNA, 23 nt, Mycobacterium avium subsp. paratuberculosis
gaacgcccgaucugggaucggug

SEQ ID NO: 906485 - RNA, 17 nt, Mycobacterium avium subsp. paratuberculosis
gaacgcccgcaccacga

SEQ ID NO: 906486 - RNA, 16 nt, Mycobacterium avium subsp. paratuberculosis
gaacgacccuuccgga

SEQ ID NO: 906487 - RNA, 20 nt, Mycobacterium avium subsp. paratuberculosis
gaaccugcugggcggcacca

SEQ ID NO: 906488 - RNA, 15 nt, Mycobacterium avium subsp. paratuberculosis
gaaccuggccaccag

SEQ ID NO: 906489 - RNA, 12 nt, Mycobacterium avium subsp. paratuberculosis
gaaccuggccgu

SEQ ID NO: 906490 - RNA, 15 nt, Mycobacterium avium subsp. paratuberculosis
gaaccucgcggcggc

SEQ ID NO: 906491 - RNA, 19 nt, Mycobacterium avium subsp. paratuberculosis
gaaccucgcggcggcgucg

SEQ ID NO: 906492 - RNA, 16 nt, Mycobacterium avium subsp. paratuberculosis
gaaccgggcacccggc

SEQ ID NO: 906493 - RNA, 20 nt, Mycobacterium avium subsp. paratuberculosis
gaacgcgaccugcaucucga

SEQ ID NO: 906494 - RNA, 22 nt, Mycobacterium avium subsp. paratuberculosis
gaacgcgacgaucagcagccgg

SEQ ID NO: 906495 - RNA, 14 nt, Mycobacterium avium subsp. paratuberculosis
gaacgcgaacccac

SEQ ID NO: 906496 - RNA, 13 nt, Mycobacterium avium subsp. paratuberculosis
gaacgcgccggcg

SEQ ID NO: 906497 - RNA, 22 nt, Mycobacterium avium subsp. paratuberculosis
gaacgcgccgggcaacagcgcg

SEQ ID NO: 906498 - RNA, 23 nt, Mycobacterium avium subsp. paratuberculosis
gaacgcgccgggcaacagcgcgc

SEQ ID NO: 906499 - RNA, 22 nt, Mycobacterium avium subsp. paratuberculosis
gaacgcgccggugaccccgucg

SEQ ID NO: 906500 - RNA, 14 nt, Mycobacterium avium subsp. paratuberculosis
gaacgcgcccggcg

SEQ ID NO: 906501 - RNA, 14 nt, Mycobacterium avium subsp. paratuberculosis
gaacgcgccgccca

SEQ ID NO: 906502 - RNA, 15 nt, Mycobacterium avium subsp. paratuberculosis
gaacgcgccgcccac

SEQ ID NO: 906503 - RNA, 16 nt, Mycobacterium avium subsp. paratuberculosis
gaacgcgccgcccacc

SEQ ID NO: 906504 - RNA, 22 nt, Mycobacterium avium subsp. paratuberculosis
gaacgccuccgccgccccgucg

SEQ ID NO: 906505 - RNA, 19 nt, Mycobacterium avium subsp. paratuberculosis
gaacgccucgagcgcccgg

SEQ ID NO: 906506 - RNA, 14 nt, Mycobacterium avium subsp. paratuberculosis
gaacgccucguugg

SEQ ID NO: 906507 - RNA, 15 nt, Mycobacterium avium subsp. paratuberculosis
gaacgccucguuggc

SEQ ID NO: 906508 - RNA, 14 nt, Mycobacterium avium subsp. paratuberculosis
gaacgccugccggc

SEQ ID NO: 906509 - RNA, 19 nt, Mycobacterium avium subsp. paratuberculosis
gaacgccugccggcgccgg

SEQ ID NO: 906510 - RNA, 13 nt, Mycobacterium avium subsp. paratuberculosis
gaacgccgggucc

SEQ ID NO: 906511 - RNA, 21 nt, Mycobacterium avium subsp. paratuberculosis
gaacgccggugagguggcgua

SEQ ID NO: 906512 - RNA, 23 nt, Mycobacterium avium subsp. paratuberculosis
gaacgccgcauacaccuugucgg

SEQ ID NO: 906513 - RNA, 14 nt, Mycobacterium avium subsp. paratuberculosis
gaacgccgccaaca

SEQ ID NO: 906514 - RNA, 19 nt, Mycobacterium avium subsp. paratuberculosis
gaaccgcaacaccagcacg

SEQ ID NO: 906515 - RNA, 14 nt, Mycobacterium avium subsp. paratuberculosis
gaaccgcgccuucg

SEQ ID NO: 906516 - RNA, 23 nt, Mycobacterium avium subsp. paratuberculosis
gaaccgcucgauggcgccgaucg

SEQ ID NO: 906517 - RNA, 15 nt, Mycobacterium avium subsp. paratuberculosis
gaaccgcucggcggc

SEQ ID NO: 906518 - RNA, 22 nt, Mycobacterium avium subsp. paratuberculosis
gaaccgcucggcggcgccgucg

SEQ ID NO: 906519 - RNA, 18 nt, Mycobacterium avium subsp. paratuberculosis
gaaccgcgagcagacgcg

SEQ ID NO: 906520 - RNA, 17 nt, Mycobacterium avium subsp. paratuberculosis
gaaccgcgagcgcgcgg

SEQ ID NO: 906521 - RNA, 14 nt, Mycobacterium avium subsp. paratuberculosis
gaaccgcucgucgg

SEQ ID NO: 906522 - RNA, 16 nt, Mycobacterium avium subsp. paratuberculosis
gaaccgcugaccagga

SEQ ID NO: 906523 - RNA, 19 nt, Mycobacterium avium subsp. paratuberculosis
gaaccgcugcaugccgucg

SEQ ID NO: 906524 - RNA, 21 nt, Mycobacterium avium subsp. paratuberculosis
gaaccgcugcaugccgucgau

SEQ ID NO: 906525 - RNA, 19 nt, Mycobacterium avium subsp. paratuberculosis
gaaccgcugcuccgggucc

SEQ ID NO: 906526 - RNA, 16 nt, Mycobacterium avium subsp. paratuberculosis
gaaccgcugcugcucg

SEQ ID NO: 906527 - RNA, 22 nt, Mycobacterium avium subsp. paratuberculosis
gaaccgcugcugcucggccgca

SEQ ID NO: 906528 - RNA, 20 nt, Mycobacterium avium subsp. paratuberculosis
gaaccgcuugcccagccccu

SEQ ID NO: 906529 - RNA, 18 nt, Mycobacterium avium subsp. paratuberculosis
gaaccgaaucggucgacc

SEQ ID NO: 906530 - RNA, 17 nt, Mycobacterium avium subsp. paratuberculosis
gaaccgacaccucgccg

SEQ ID NO: 906531 - RNA, 21 nt, Mycobacterium avium subsp. paratuberculosis
gaacccugccccacggcccgg

SEQ ID NO: 906532 - RNA, 21 nt, Mycobacterium avium subsp. paratuberculosis
gaacccugggcggcgacacgc

SEQ ID NO: 906533 - RNA, 13 nt, Mycobacterium avium subsp. paratuberculosis
gaaccgcaccccg

SEQ ID NO: 906534 - RNA, 16 nt, Mycobacterium avium subsp. paratuberculosis
gaaccgcaccccgucg

SEQ ID NO: 906535 - RNA, 13 nt, Mycobacterium avium subsp. paratuberculosis
gaaccgcagccgg

SEQ ID NO: 906536 - RNA, 13 nt, Mycobacterium avium subsp. paratuberculosis
gaaccgccccgcg

SEQ ID NO: 906537 - RNA, 16 nt, Mycobacterium avium subsp. paratuberculosis
gaaccgccccgcgcga

SEQ ID NO: 906538 - RNA, 16 nt, Mycobacterium avium subsp. paratuberculosis
gaaccgcccgcccggc

SEQ ID NO: 906539 - RNA, 17 nt, Mycobacterium avium subsp. paratuberculosis
gaaccgcccuuccagca

SEQ ID NO: 906540 - RNA, 18 nt, Mycobacterium avium subsp. paratuberculosis
gaaccgcccuuccagcac

SEQ ID NO: 906541 - RNA, 19 nt, Mycobacterium avium subsp. paratuberculosis
gaaccgcccuuccagcacc

SEQ ID NO: 906542 - RNA, 17 nt, Mycobacterium avium subsp. paratuberculosis
gaaccgguacaggcccc

SEQ ID NO: 906543 - RNA, 18 nt, Mycobacterium avium subsp. paratuberculosis
gaaccgguagucgucgag

SEQ ID NO: 906544 - RNA, 14 nt, Mycobacterium avium subsp. paratuberculosis
gaaccgggcgcgca

SEQ ID NO: 906545 - RNA, 16 nt, Mycobacterium avium subsp. paratuberculosis
gaaccgggcgcgcaga

SEQ ID NO: 906546 - RNA, 22 nt, Mycobacterium avium subsp. paratuberculosis
gaaccgggcggugaccacgccg

SEQ ID NO: 906547 - RNA, 16 nt, Mycobacterium avium subsp. paratuberculosis
gaaccggggccgcacc

SEQ ID NO: 906548 - RNA, 18 nt, Mycobacterium avium subsp. paratuberculosis
gaaccgggucagcaccac

SEQ ID NO: 906549 - RNA, 17 nt, Mycobacterium avium subsp. paratuberculosis
gaaccggaagaucagca

SEQ ID NO: 906550 - RNA, 14 nt, Mycobacterium avium subsp. paratuberculosis
gaaccggcagccgg

SEQ ID NO: 906551 - RNA, 18 nt, Mycobacterium avium subsp. paratuberculosis
gaaccggcagccggcgua

SEQ ID NO: 906552 - RNA, 19 nt, Mycobacterium avium subsp. paratuberculosis
gaaccggcaggacgggggc

SEQ ID NO: 906553 - RNA, 15 nt, Mycobacterium avium subsp. paratuberculosis
gaaccggccaccacg

SEQ ID NO: 906554 - RNA, 17 nt, Mycobacterium avium subsp. paratuberculosis
gaaccggcccagcagcg

SEQ ID NO: 906555 - RNA, 15 nt, Mycobacterium avium subsp. paratuberculosis
gaaccgggacagccg

SEQ ID NO: 906556 - RNA, 18 nt, Mycobacterium avium subsp. paratuberculosis
gaaccgggacagccgcgc

SEQ ID NO: 906557 - RNA, 23 nt, Mycobacterium avium subsp. paratuberculosis
gaaccgggacagccgcgccgaca

SEQ ID NO: 906558 - RNA, 23 nt, Mycobacterium avium subsp. paratuberculosis
gaaccggucguuggccuccucgg

SEQ ID NO: 906559 - RNA, 17 nt, Mycobacterium avium subsp. paratuberculosis
gaaccguaaaucgcuca

SEQ ID NO: 906560 - RNA, 18 nt, Mycobacterium avium subsp. paratuberculosis
gaaccgucuagcggcgug

SEQ ID NO: 906561 - RNA, 19 nt, Mycobacterium avium subsp. paratuberculosis
gaaccaguucgccaccacg

SEQ ID NO: 906562 - RNA, 15 nt, Mycobacterium avium subsp. paratuberculosis
gaaccauucguggcu

SEQ ID NO: 906563 - RNA, 16 nt, Mycobacterium avium subsp. paratuberculosis
gaaccagugcccggcc

SEQ ID NO: 906564 - RNA, 15 nt, Mycobacterium avium subsp. paratuberculosis
gaaccagugcgccuu

SEQ ID NO: 906565 - RNA, 17 nt, Mycobacterium avium subsp. paratuberculosis
gaacccaccagcgccug

SEQ ID NO: 906566 - RNA, 15 nt, Mycobacterium avium subsp. paratuberculosis
gaacccagcaccccg

SEQ ID NO: 906567 - RNA, 20 nt, Mycobacterium avium subsp. paratuberculosis
gaaccccgagaucgcgggcu

SEQ ID NO: 906568 - RNA, 16 nt, Mycobacterium avium subsp. paratuberculosis
gaacccgaacgcgucg

SEQ ID NO: 906569 - RNA, 21 nt, Mycobacterium avium subsp. paratuberculosis
gaacccgagcaccccggcggc

SEQ ID NO: 906570 - RNA, 14 nt, Mycobacterium avium subsp. paratuberculosis
gaacccccucgcgc

SEQ ID NO: 906571 - RNA, 15 nt, Mycobacterium avium subsp. paratuberculosis
gaacccggcgcccgg

SEQ ID NO: 906572 - RNA, 21 nt, Mycobacterium avium subsp. paratuberculosis
gaacccguggauggacgccca

SEQ ID NO: 906573 - RNA, 23 nt, Mycobacterium avium subsp. paratuberculosis
gaacccguggauggacgcccaga

SEQ ID NO: 906574 - RNA, 17 nt, Mycobacterium avium subsp. paratuberculosis
gaacccgccagggcgac

SEQ ID NO: 906575 - RNA, 14 nt, Mycobacterium avium subsp. paratuberculosis
gaacccggccagcg

SEQ ID NO: 906576 - RNA, 20 nt, Mycobacterium avium subsp. paratuberculosis
gaaccagcaccgccgcggcc

SEQ ID NO: 906577 - RNA, 16 nt, Mycobacterium avium subsp. paratuberculosis
gaaccacuucuggcgc

SEQ ID NO: 906578 - RNA, 19 nt, Mycobacterium avium subsp. paratuberculosis
gaaccacuucuggcgcugc

SEQ ID NO: 906579 - RNA, 19 nt, Mycobacterium avium subsp. paratuberculosis
gaaccacaccccggccacc

SEQ ID NO: 906580 - RNA, 13 nt, Mycobacterium avium subsp. paratuberculosis
gaaccacgcggcg

SEQ ID NO: 906581 - RNA, 18 nt, Mycobacterium avium subsp. paratuberculosis
gaaccacgcggcggcggu

SEQ ID NO: 906582 - RNA, 14 nt, Mycobacterium avium subsp. paratuberculosis
gaaccacgggucgc

SEQ ID NO: 906583 - RNA, 20 nt, Mycobacterium avium subsp. paratuberculosis
gaaccaccugggcgucgucg

SEQ ID NO: 906584 - RNA, 20 nt, Mycobacterium avium subsp. paratuberculosis
gaaccagggcagccagcccg

SEQ ID NO: 906585 - RNA, 14 nt, Mycobacterium avium subsp. paratuberculosis
gaaccaggccgcgc

SEQ ID NO: 906586 - RNA, 19 nt, Mycobacterium avium subsp. paratuberculosis
gaaccaggccgcgcuggcg

SEQ ID NO: 906587 - RNA, 14 nt, Mycobacterium avium subsp. paratuberculosis
gaaccaggcgccgg

SEQ ID NO: 906588 - RNA, 15 nt, Mycobacterium avium subsp. paratuberculosis
gaaccaggcgccggc

SEQ ID NO: 906589 - RNA, 12 nt, Mycobacterium avium subsp. paratuberculosis
gaaccagcgccc

SEQ ID NO: 906590 - RNA, 14 nt, Mycobacterium avium subsp. paratuberculosis
gaaccagcgcccgc

SEQ ID NO: 906591 - RNA, 23 nt, Mycobacterium avium subsp. paratuberculosis
gaaccagcaugcgccagagcgcg

SEQ ID NO: 906592 - RNA, 16 nt, Mycobacterium avium subsp. paratuberculosis
gaaccagcccggcccg

SEQ ID NO: 906593 - RNA, 17 nt, Mycobacterium avium subsp. paratuberculosis
gaaaacgccugcgccgc

SEQ ID NO: 906594 - RNA, 18 nt, Mycobacterium avium subsp. paratuberculosis
gaaaagcgaccagcgcgc

SEQ ID NO: 906595 - RNA, 12 nt, Mycobacterium avium subsp. paratuberculosis
gaaagccgcgaa

SEQ ID NO: 906596 - RNA, 20 nt, Mycobacterium avium subsp. paratuberculosis
gaaagcgcuuucgcuggucg

SEQ ID NO: 906597 - RNA, 14 nt, Mycobacterium avium subsp. paratuberculosis
gaaagcacccgaca

SEQ ID NO: 906598 - RNA, 14 nt, Mycobacterium avium subsp. paratuberculosis
gaaagccacccgcg

SEQ ID NO: 906599 - RNA, 20 nt, Mycobacterium avium subsp. paratuberculosis
gaaagccacccgcgccucca

SEQ ID NO: 906600 - RNA, 17 nt, Mycobacterium avium subsp. paratuberculosis
gaaacuuccgcccggcg

SEQ ID NO: 906601 - RNA, 22 nt, Mycobacterium avium subsp. paratuberculosis
gaaacuuguggaaggcgccggc

SEQ ID NO: 906602 - RNA, 20 nt, Mycobacterium avium subsp. paratuberculosis
gaaacuagcuucacgcucgg

SEQ ID NO: 906603 - RNA, 20 nt, Mycobacterium avium subsp. paratuberculosis
gaaacuagcuucacggucgg

SEQ ID NO: 906604 - RNA, 21 nt, Mycobacterium avium subsp. paratuberculosis
gaaacuagcuucacguucggc

SEQ ID NO: 906605 - RNA, 21 nt, Mycobacterium avium subsp. paratuberculosis
gaaauagccgcgccgcgguag

SEQ ID NO: 906606 - RNA, 20 nt, Mycobacterium avium subsp. paratuberculosis
gaaagugcaacugccgacgg

SEQ ID NO: 906607 - RNA, 20 nt, Mycobacterium avium subsp. paratuberculosis
gaaagugcuacugccgacgc

SEQ ID NO: 906608 - RNA, 21 nt, Mycobacterium avium subsp. paratuberculosis
gaaaguccgccgacagcggga

SEQ ID NO: 906609 - RNA, 17 nt, Mycobacterium avium subsp. paratuberculosis
gaaagcucgcgucgacg

SEQ ID NO: 906610 - RNA, 17 nt, Mycobacterium avium subsp. paratuberculosis
cuuguuguuggugccgc

SEQ ID NO: 906611 - RNA, 13 nt, Mycobacterium avium subsp. paratuberculosis
cuuguggucgaug

SEQ ID NO: 906612 - RNA, 20 nt, Mycobacterium avium subsp. paratuberculosis
cuuguggucgaugcccgcgc

SEQ ID NO: 906613 - RNA, 17 nt, Mycobacterium avium subsp. paratuberculosis
cuugucgggccgcgggc

SEQ ID NO: 906614 - RNA, 16 nt, Mycobacterium avium subsp. paratuberculosis
cuuguggaaggcgccg

SEQ ID NO: 906615 - RNA, 18 nt, Mycobacterium avium subsp. paratuberculosis
cuuguggcccaggccggc

SEQ ID NO: 906616 - RNA, 14 nt, Mycobacterium avium subsp. paratuberculosis
cuugucggcgccca

SEQ ID NO: 906617 - RNA, 17 nt, Mycobacterium avium subsp. paratuberculosis
cuuggugcgagccaccu

SEQ ID NO: 906618 - RNA, 13 nt, Mycobacterium avium subsp. paratuberculosis
cuugguggccgcg

SEQ ID NO: 906619 - RNA, 14 nt, Mycobacterium avium subsp. paratuberculosis
cuugguggccgcgg

SEQ ID NO: 906620 - RNA, 15 nt, Mycobacterium avium subsp. paratuberculosis
cuugguggccgcggc

SEQ ID NO: 906621 - RNA, 17 nt, Mycobacterium avium subsp. paratuberculosis
cuugguggcgacgaagu

SEQ ID NO: 906622 - RNA, 14 nt, Mycobacterium avium subsp. paratuberculosis
cuugguggcgccgg

SEQ ID NO: 906623 - RNA, 22 nt, Mycobacterium avium subsp. paratuberculosis
cuugguccgcaacgcggcggug

SEQ ID NO: 906624 - RNA, 17 nt, Mycobacterium avium subsp. paratuberculosis
cuuggugaagaucgacg

SEQ ID NO: 906625 - RNA, 17 nt, Mycobacterium avium subsp. paratuberculosis
cuuggugagcaccgcga

SEQ ID NO: 906626 - RNA, 19 nt, Mycobacterium avium subsp. paratuberculosis
cuuggccgcaggcggccag

SEQ ID NO: 906627 - RNA, 14 nt, Mycobacterium avium subsp. paratuberculosis
cuuggccgcgccgc

SEQ ID NO: 906628 - RNA, 17 nt, Mycobacterium avium subsp. paratuberculosis
cuuggccgcgccgccga

SEQ ID NO: 906629 - RNA, 18 nt, Mycobacterium avium subsp. paratuberculosis
cuuggccgcgccgccgac

SEQ ID NO: 906630 - RNA, 14 nt, Mycobacterium avium subsp. paratuberculosis
cuuggccgggcgga

SEQ ID NO: 906631 - RNA, 17 nt, Mycobacterium avium subsp. paratuberculosis
cuuggccggugcgccga

SEQ ID NO: 906632 - RNA, 19 nt, Mycobacterium avium subsp. paratuberculosis
cuuggccggugcgccgacc

SEQ ID NO: 906633 - RNA, 22 nt, Mycobacterium avium subsp. paratuberculosis
cuuggccgugcagggggcgcag

SEQ ID NO: 906634 - RNA, 22 nt, Mycobacterium avium subsp. paratuberculosis
cuuggccuccaccggcaaucgg

SEQ ID NO: 906635 - RNA, 16 nt, Mycobacterium avium subsp. paratuberculosis
cuuggucagccgcggc

SEQ ID NO: 906636 - RNA, 23 nt, Mycobacterium avium subsp. paratuberculosis
cuuggucagcgcggcccgcggcg

SEQ ID NO: 906637 - RNA, 20 nt, Mycobacterium avium subsp. paratuberculosis
cuuggucagcucccggcaga

SEQ ID NO: 906638 - RNA, 16 nt, Mycobacterium avium subsp. paratuberculosis
cuuggcccgccgccgg

SEQ ID NO: 906639 - RNA, 15 nt, Mycobacterium avium subsp. paratuberculosis
cuuggcccgcgcggc

SEQ ID NO: 906640 - RNA, 19 nt, Mycobacterium avium subsp. paratuberculosis
cuuggcccgcgcggccgcc

SEQ ID NO: 906641 - RNA, 20 nt, Mycobacterium avium subsp. paratuberculosis
cuuggcccgcgcggccgcca

SEQ ID NO: 906642 - RNA, 14 nt, Mycobacterium avium subsp. paratuberculosis
cuuggccaggcggg

SEQ ID NO: 906643 - RNA, 22 nt, Mycobacterium avium subsp. paratuberculosis
cuugcuggcggccuucuuggcc

SEQ ID NO: 906644 - RNA, 13 nt, Mycobacterium avium subsp. paratuberculosis
cuuggccacgucg

SEQ ID NO: 906645 - RNA, 16 nt, Mycobacterium avium subsp. paratuberculosis
cuuggccagcucggcg

SEQ ID NO: 906646 - RNA, 19 nt, Mycobacterium avium subsp. paratuberculosis
cuuggccagcucggcggcc

SEQ ID NO: 906647 - RNA, 22 nt, Mycobacterium avium subsp. paratuberculosis
cuuggccagcucggcggccaug

SEQ ID NO: 906648 - RNA, 13 nt, Mycobacterium avium subsp. paratuberculosis
cuugcgaucgccg

SEQ ID NO: 906649 - RNA, 14 nt, Mycobacterium avium subsp. paratuberculosis
cuugcgaucgccgc

SEQ ID NO: 906650 - RNA, 17 nt, Mycobacterium avium subsp. paratuberculosis
cuugccgucggccgccg

SEQ ID NO: 906651 - RNA, 18 nt, Mycobacterium avium subsp. paratuberculosis
cuugccgucggccgccga

SEQ ID NO: 906652 - RNA, 19 nt, Mycobacterium avium subsp. paratuberculosis
cuugccgucggccgccgac

SEQ ID NO: 906653 - RNA, 15 nt, Mycobacterium avium subsp. paratuberculosis
cuugccgucgacgcg

SEQ ID NO: 906654 - RNA, 17 nt, Mycobacterium avium subsp. paratuberculosis
cuugccgucgagcaggg

SEQ ID NO: 906655 - RNA, 18 nt, Mycobacterium avium subsp. paratuberculosis
cuugccgaucgccgcggc

SEQ ID NO: 906656 - RNA, 23 nt, Mycobacterium avium subsp. paratuberculosis
cuugcccgaggucauaucgacgg

SEQ ID NO: 906657 - RNA, 22 nt, Mycobacterium avium subsp. paratuberculosis
cuugcccugguacgcgccgucg

SEQ ID NO: 906658 - RNA, 23 nt, Mycobacterium avium subsp. paratuberculosis
cuugccgaacaggcgcaacagca

SEQ ID NO: 906659 - RNA, 14 nt, Mycobacterium avium subsp. paratuberculosis
cuugcccgucgcgu

SEQ ID NO: 906660 - RNA, 18 nt, Mycobacterium avium subsp. paratuberculosis
cuugcccggacgaugccg

SEQ ID NO: 906661 - RNA, 21 nt, Mycobacterium avium subsp. paratuberculosis
cuugcccggcgagcgacgcca

SEQ ID NO: 906662 - RNA, 16 nt, Mycobacterium avium subsp. paratuberculosis
cuugccaugucgaagg

SEQ ID NO: 906663 - RNA, 18 nt, Mycobacterium avium subsp. paratuberculosis
cuugccccaccaccgccg

SEQ ID NO: 906664 - RNA, 16 nt, Mycobacterium avium subsp. paratuberculosis
cuucgugucaccgccc

SEQ ID NO: 906665 - RNA, 14 nt, Mycobacterium avium subsp. paratuberculosis
cuucgucgccgggc

SEQ ID NO: 906666 - RNA, 16 nt, Mycobacterium avium subsp. paratuberculosis
cuucggcgugucgggu

SEQ ID NO: 906667 - RNA, 23 nt, Mycobacterium avium subsp. paratuberculosis
cuucguaacacccucggucgggc

SEQ ID NO: 906668 - RNA, 15 nt, Mycobacterium avium subsp. paratuberculosis
cuucguacggcccgg

SEQ ID NO: 906669 - RNA, 19 nt, Mycobacterium avium subsp. paratuberculosis
cuucguacggcccgggaag

SEQ ID NO: 906670 - RNA, 13 nt, Mycobacterium avium subsp. paratuberculosis
cuucgucagcagc

SEQ ID NO: 906671 - RNA, 17 nt, Mycobacterium avium subsp. paratuberculosis
cuucgucagcagcgaca

SEQ ID NO: 906672 - RNA, 15 nt, Mycobacterium avium subsp. paratuberculosis
cuugcuccacacugg

SEQ ID NO: 906673 - RNA, 22 nt, Mycobacterium avium subsp. paratuberculosis
cuugcugagccggcccugcggc

SEQ ID NO: 906674 - RNA, 19 nt, Mycobacterium avium subsp. paratuberculosis
cuugcugagcugcgcccac

SEQ ID NO: 906675 - RNA, 17 nt, Mycobacterium avium subsp. paratuberculosis
cuugcugcccgcggccg

SEQ ID NO: 906676 - RNA, 20 nt, Mycobacterium avium subsp. paratuberculosis
cuugcugauccccagcggca

SEQ ID NO: 906677 - RNA, 13 nt, Mycobacterium avium subsp. paratuberculosis
cuugcgcagccgg

SEQ ID NO: 906678 - RNA, 14 nt, Mycobacterium avium subsp. paratuberculosis
cuugcgcaccacgu

SEQ ID NO: 906679 - RNA, 17 nt, Mycobacterium avium subsp. paratuberculosis
cuugcgcaccacgucgg

SEQ ID NO: 906680 - RNA, 18 nt, Mycobacterium avium subsp. paratuberculosis
cuugcgcagcgucgugua

SEQ ID NO: 906681 - RNA, 17 nt, Mycobacterium avium subsp. paratuberculosis
cuugcgcucggucgcgg

SEQ ID NO: 906682 - RNA, 18 nt, Mycobacterium avium subsp. paratuberculosis
cuugcgcucggucgcggc

SEQ ID NO: 906683 - RNA, 19 nt, Mycobacterium avium subsp. paratuberculosis
cuugcgcgggucgccgggc

SEQ ID NO: 906684 - RNA, 15 nt, Mycobacterium avium subsp. paratuberculosis
cuuccagcgcggcga

SEQ ID NO: 906685 - RNA, 17 nt, Mycobacterium avium subsp. paratuberculosis
cuucaucagcaccgcga

SEQ ID NO: 906686 - RNA, 19 nt, Mycobacterium avium subsp. paratuberculosis
cuucagcucgcugaucagc

SEQ ID NO: 906687 - RNA, 14 nt, Mycobacterium avium subsp. paratuberculosis
cuucaggcagcgca

SEQ ID NO: 906688 - RNA, 21 nt, Mycobacterium avium subsp. paratuberculosis
cuucaggcagcgcacgaugug

SEQ ID NO: 906689 - RNA, 19 nt, Mycobacterium avium subsp. paratuberculosis
cuucagugaaccccgggcu

SEQ ID NO: 906690 - RNA, 19 nt, Mycobacterium avium subsp. paratuberculosis
cuucacggucggagcccag

SEQ ID NO: 906691 - RNA, 15 nt, Mycobacterium avium subsp. paratuberculosis
cuucacgugcgcggc

SEQ ID NO: 906692 - RNA, 18 nt, Mycobacterium avium subsp. paratuberculosis
cuucacgugcgcggcguc

SEQ ID NO: 906693 - RNA, 19 nt, Mycobacterium avium subsp. paratuberculosis
cuucacguucggcgaguga

SEQ ID NO: 906694 - RNA, 15 nt, Mycobacterium avium subsp. paratuberculosis
cuucagcccucgagc

SEQ ID NO: 906695 - RNA, 14 nt, Mycobacterium avium subsp. paratuberculosis
cuucaccucggccu

SEQ ID NO: 906696 - RNA, 20 nt, Mycobacterium avium subsp. paratuberculosis
cuucacgaagugcccggcgc

SEQ ID NO: 906697 - RNA, 22 nt, Mycobacterium avium subsp. paratuberculosis
cuucacgaagugcccggcgccg

SEQ ID NO: 906698 - RNA, 12 nt, Mycobacterium avium subsp. paratuberculosis
cuucaccgcgcc

SEQ ID NO: 906699 - RNA, 17 nt, Mycobacterium avium subsp. paratuberculosis
cuucaccgcgccggucc

SEQ ID NO: 906700 - RNA, 21 nt, Mycobacterium avium subsp. paratuberculosis
cuucacgcucgcaggcgagcc

SEQ ID NO: 906701 - RNA, 14 nt, Mycobacterium avium subsp. paratuberculosis
cuucacgcucgcgu

SEQ ID NO: 906702 - RNA, 13 nt, Mycobacterium avium subsp. paratuberculosis
cuucacgcucggc

SEQ ID NO: 906703 - RNA, 14 nt, Mycobacterium avium subsp. paratuberculosis
cuucacgcucggcg

SEQ ID NO: 906704 - RNA, 18 nt, Mycobacterium avium subsp. paratuberculosis
cuucacgcucggcgagca

SEQ ID NO: 906705 - RNA, 20 nt, Mycobacterium avium subsp. paratuberculosis
cuucacgcucggcgccgagc

SEQ ID NO: 906706 - RNA, 24 nt, Mycobacterium avium subsp. paratuberculosis
cuucacgcucggcgccgagcguga

SEQ ID NO: 906707 - RNA, 14 nt, Mycobacterium avium subsp. paratuberculosis
cuucacgcuggccu

SEQ ID NO: 906708 - RNA, 22 nt, Mycobacterium avium subsp. paratuberculosis
cuucacgaccggcagcaccggc

SEQ ID NO: 906709 - RNA, 14 nt, Mycobacterium avium subsp. paratuberculosis
cuucaccgaccagc

SEQ ID NO: 906710 - RNA, 18 nt, Mycobacterium avium subsp. paratuberculosis
cuucgauggccaucgucg

SEQ ID NO: 906711 - RNA, 20 nt, Mycobacterium avium subsp. paratuberculosis
cuucgaugggaaccgcucgg

SEQ ID NO: 906712 - RNA, 19 nt, Mycobacterium avium subsp. paratuberculosis
cuucgauguagaagccgug

SEQ ID NO: 906713 - RNA, 20 nt, Mycobacterium avium subsp. paratuberculosis
cuucgaugucgccggcgacc

SEQ ID NO: 906714 - RNA, 15 nt, Mycobacterium avium subsp. paratuberculosis
cuucgaugccggugg

SEQ ID NO: 906715 - RNA, 18 nt, Mycobacterium avium subsp. paratuberculosis
cuucgaucaggcgcagcc

SEQ ID NO: 906716 - RNA, 20 nt, Mycobacterium avium subsp. paratuberculosis
cuucgccuccgggaaggcgg

SEQ ID NO: 906717 - RNA, 18 nt, Mycobacterium avium subsp. paratuberculosis
cuuccugggacagccggu

SEQ ID NO: 906718 - RNA, 22 nt, Mycobacterium avium subsp. paratuberculosis
cuuccugggacagccggucgac

SEQ ID NO: 906719 - RNA, 13 nt, Mycobacterium avium subsp. paratuberculosis
cuuccucgcggaa

SEQ ID NO: 906720 - RNA, 15 nt, Mycobacterium avium subsp. paratuberculosis
cuuccaucgacgcug

SEQ ID NO: 906721 - RNA, 16 nt, Mycobacterium avium subsp. paratuberculosis
cuuccaucgacgcuga

SEQ ID NO: 906722 - RNA, 21 nt, Mycobacterium avium subsp. paratuberculosis
cuuccaucacgccccggcguc

SEQ ID NO: 906723 - RNA, 13 nt, Mycobacterium avium subsp. paratuberculosis
cuucggccaucga

SEQ ID NO: 906724 - RNA, 22 nt, Mycobacterium avium subsp. paratuberculosis
cuucggccucgguuucgaacug

SEQ ID NO: 906725 - RNA, 19 nt, Mycobacterium avium subsp. paratuberculosis
cuucggagacguggcggcg

SEQ ID NO: 906726 - RNA, 20 nt, Mycobacterium avium subsp. paratuberculosis
cuucggagacguggcggcgg

SEQ ID NO: 906727 - RNA, 17 nt, Mycobacterium avium subsp. paratuberculosis
cuucggcacgaagccga

SEQ ID NO: 906728 - RNA, 13 nt, Mycobacterium avium subsp. paratuberculosis
cuucggcgcgccg

SEQ ID NO: 906729 - RNA, 16 nt, Mycobacterium avium subsp. paratuberculosis
cuucggcgccagcccg

SEQ ID NO: 906730 - RNA, 17 nt, Mycobacterium avium subsp. paratuberculosis
cuucggcgccagcccgc

SEQ ID NO: 906731 - RNA, 19 nt, Mycobacterium avium subsp. paratuberculosis
cuucggcgccagcccgccg

SEQ ID NO: 906732 - RNA, 19 nt, Mycobacterium avium subsp. paratuberculosis
cuucggcgcccgcuccggc

SEQ ID NO: 906733 - RNA, 13 nt, Mycobacterium avium subsp. paratuberculosis
cuucggcgccgag

SEQ ID NO: 906734 - RNA, 14 nt, Mycobacterium avium subsp. paratuberculosis
cuucggcgccgagc

SEQ ID NO: 906735 - RNA, 15 nt, Mycobacterium avium subsp. paratuberculosis
cuucggcgccgagcg

SEQ ID NO: 906736 - RNA, 22 nt, Mycobacterium avium subsp. paratuberculosis
cuucggcgccgagcgucacgcu

SEQ ID NO: 906737 - RNA, 14 nt, Mycobacterium avium subsp. paratuberculosis
cuucggcgcgccgg

SEQ ID NO: 906738 - RNA, 15 nt, Mycobacterium avium subsp. paratuberculosis
cuucgcugcgccggc

SEQ ID NO: 906739 - RNA, 17 nt, Mycobacterium avium subsp. paratuberculosis
cuucgcggucggcaacc

SEQ ID NO: 906740 - RNA, 15 nt, Mycobacterium avium subsp. paratuberculosis
cuucgcgggcggcgc

SEQ ID NO: 906741 - RNA, 23 nt, Mycobacterium avium subsp. paratuberculosis
cuucgcgggcggcgcagucggcc

SEQ ID NO: 906742 - RNA, 16 nt, Mycobacterium avium subsp. paratuberculosis
cuucgcgggugccuuc

SEQ ID NO: 906743 - RNA, 20 nt, Mycobacterium avium subsp. paratuberculosis
cuucgcggauccgggccgcc

SEQ ID NO: 906744 - RNA, 16 nt, Mycobacterium avium subsp. paratuberculosis
cuucgcgcgcggcgug

SEQ ID NO: 906745 - RNA, 18 nt, Mycobacterium avium subsp. paratuberculosis
cuucgcgaagaacgacgc

SEQ ID NO: 906746 - RNA, 17 nt, Mycobacterium avium subsp. paratuberculosis
cugguuguagucgucga

SEQ ID NO: 906747 - RNA, 20 nt, Mycobacterium avium subsp. paratuberculosis
cugguuccacagcugcaggc

SEQ ID NO: 906748 - RNA, 17 nt, Mycobacterium avium subsp. paratuberculosis
cugguugagcaccgcga

SEQ ID NO: 906749 - RNA, 14 nt, Mycobacterium avium subsp. paratuberculosis
cugguucgacguga

SEQ ID NO: 906750 - RNA, 16 nt, Mycobacterium avium subsp. paratuberculosis
cugguucaccgccacc

SEQ ID NO: 906751 - RNA, 20 nt, Mycobacterium avium subsp. paratuberculosis
cugguucaccgccaccagca

SEQ ID NO: 906752 - RNA, 13 nt, Mycobacterium avium subsp. paratuberculosis
cuggugugacgcu

SEQ ID NO: 906753 - RNA, 16 nt, Mycobacterium avium subsp. paratuberculosis
cuggugugacgcucgc

SEQ ID NO: 906754 - RNA, 17 nt, Mycobacterium avium subsp. paratuberculosis
cugguugucgacgcugc

SEQ ID NO: 906755 - RNA, 16 nt, Mycobacterium avium subsp. paratuberculosis
cugguuggccggcggg

SEQ ID NO: 906756 - RNA, 18 nt, Mycobacterium avium subsp. paratuberculosis
cuguccaggccgaggcug

SEQ ID NO: 906757 - RNA, 14 nt, Mycobacterium avium subsp. paratuberculosis
cuguccagcagcga

SEQ ID NO: 906758 - RNA, 18 nt, Mycobacterium avium subsp. paratuberculosis
cugucgcccucgaucgcg

SEQ ID NO: 906759 - RNA, 14 nt, Mycobacterium avium subsp. paratuberculosis
cugucccggccgcg

SEQ ID NO: 906760 - RNA, 16 nt, Mycobacterium avium subsp. paratuberculosis
cugucccggccgcgac

SEQ ID NO: 906761 - RNA, 19 nt, Mycobacterium avium subsp. paratuberculosis
cugucccggccgcgacagc

SEQ ID NO: 906762 - RNA, 13 nt, Mycobacterium avium subsp. paratuberculosis
cuguccgaccagc

SEQ ID NO: 906763 - RNA, 22 nt, Mycobacterium avium subsp. paratuberculosis
cuguacuggggugucagcgcga

SEQ ID NO: 906764 - RNA, 23 nt, Mycobacterium avium subsp. paratuberculosis
cuguacuggggugucagcgcgac

SEQ ID NO: 906765 - RNA, 23 nt, Mycobacterium avium subsp. paratuberculosis
cuguagggccaccacgccagccu

SEQ ID NO: 906766 - RNA, 22 nt, Mycobacterium avium subsp. paratuberculosis
cuguagcucacggugucggcgg

SEQ ID NO: 906767 - RNA, 15 nt, Mycobacterium avium subsp. paratuberculosis
cuguaggccagcccg

SEQ ID NO: 906768 - RNA, 14 nt, Mycobacterium avium subsp. paratuberculosis
cuguaggccagccg

SEQ ID NO: 906769 - RNA, 17 nt, Mycobacterium avium subsp. paratuberculosis
cuguuugaugccgucgg

SEQ ID NO: 906770 - RNA, 21 nt, Mycobacterium avium subsp. paratuberculosis
cuguugccggacaccuggagu

SEQ ID NO: 906771 - RNA, 14 nt, Mycobacterium avium subsp. paratuberculosis
cuguugcacguagg

SEQ ID NO: 906772 - RNA, 23 nt, Mycobacterium avium subsp. paratuberculosis
cuguugcacguaggcggcgagcu

SEQ ID NO: 906773 - RNA, 14 nt, Mycobacterium avium subsp. paratuberculosis
cuguuuggccagcc

SEQ ID NO: 906774 - RNA, 17 nt, Mycobacterium avium subsp. paratuberculosis
cuguugacgggccgcgg

SEQ ID NO: 906775 - RNA, 18 nt, Mycobacterium avium subsp. paratuberculosis
cuguugacgggccgcggc

SEQ ID NO: 906776 - RNA, 20 nt, Mycobacterium avium subsp. paratuberculosis
cuguucgggcagauggucgc

SEQ ID NO: 906777 - RNA, 23 nt, Mycobacterium avium subsp. paratuberculosis
cuguucggcggcgauccggccgg

SEQ ID NO: 906778 - RNA, 12 nt, Mycobacterium avium subsp. paratuberculosis
cuguucgucgag

SEQ ID NO: 906779 - RNA, 15 nt, Mycobacterium avium subsp. paratuberculosis
cugugcgacggcguc

SEQ ID NO: 906780 - RNA, 18 nt, Mycobacterium avium subsp. paratuberculosis
cugugcgacggcgucggc

SEQ ID NO: 906781 - RNA, 20 nt, Mycobacterium avium subsp. paratuberculosis
cugugccgcggugcggcccg

SEQ ID NO: 906782 - RNA, 18 nt, Mycobacterium avium subsp. paratuberculosis
cugucggcgaaacaccaa

SEQ ID NO: 906783 - RNA, 13 nt, Mycobacterium avium subsp. paratuberculosis
cugucggcgccca

SEQ ID NO: 906784 - RNA, 13 nt, Mycobacterium avium subsp. paratuberculosis
cugucggcgcgga

SEQ ID NO: 906785 - RNA, 20 nt, Mycobacterium avium subsp. paratuberculosis
cugucgcgggucuggcucgg

SEQ ID NO: 906786 - RNA, 21 nt, Mycobacterium avium subsp. paratuberculosis
cugucgcgggucuggcucggc

SEQ ID NO: 906787 - RNA, 15 nt, Mycobacterium avium subsp. paratuberculosis
cugucggggucgcgg

SEQ ID NO: 906788 - RNA, 14 nt, Mycobacterium avium subsp. paratuberculosis
cugucgggugccgc

SEQ ID NO: 906789 - RNA, 15 nt, Mycobacterium avium subsp. paratuberculosis
cugucggcucgcccg

SEQ ID NO: 906790 - RNA, 22 nt, Mycobacterium avium subsp. paratuberculosis
cugucggcucgcccgcgacugu

SEQ ID NO: 906791 - RNA, 16 nt, Mycobacterium avium subsp. paratuberculosis
cugucggcucgccugc

SEQ ID NO: 906792 - RNA, 14 nt, Mycobacterium avium subsp. paratuberculosis
cugugcggcccggc

SEQ ID NO: 906793 - RNA, 21 nt, Mycobacterium avium subsp. paratuberculosis
cugugcgccauguccggcagg

SEQ ID NO: 906794 - RNA, 18 nt, Mycobacterium avium subsp. paratuberculosis
cugugcgccccacggcgc

SEQ ID NO: 906795 - RNA, 23 nt, Mycobacterium avium subsp. paratuberculosis
cugugcgccccacggcgcgugcu

SEQ ID NO: 906796 - RNA, 21 nt, Mycobacterium avium subsp. paratuberculosis
cugugcgccuugccgucgagc

SEQ ID NO: 906797 - RNA, 18 nt, Mycobacterium avium subsp. paratuberculosis
cuguuccaacaacuucga

SEQ ID NO: 906798 - RNA, 16 nt, Mycobacterium avium subsp. paratuberculosis
cuguuccccggcgggc

SEQ ID NO: 906799 - RNA, 20 nt, Mycobacterium avium subsp. paratuberculosis
cuguuccugguagucgucgu

SEQ ID NO: 906800 - RNA, 21 nt, Mycobacterium avium subsp. paratuberculosis
cuguucgcggcuggccgcggc

SEQ ID NO: 906801 - RNA, 22 nt, Mycobacterium avium subsp. paratuberculosis
cuguucgcggcuggccgcggcg

SEQ ID NO: 906802 - RNA, 17 nt, Mycobacterium avium subsp. paratuberculosis
cuguucgccgucgcggg

SEQ ID NO: 906803 - RNA, 18 nt, Mycobacterium avium subsp. paratuberculosis
cuggaugaaggucgcgga

SEQ ID NO: 906804 - RNA, 19 nt, Mycobacterium avium subsp. paratuberculosis
cuggaucgcgcaggugaug

SEQ ID NO: 906805 - RNA, 18 nt, Mycobacterium avium subsp. paratuberculosis
cuggaugcggucgucgcc

SEQ ID NO: 906806 - RNA, 22 nt, Mycobacterium avium subsp. paratuberculosis
cuggaugcccagggcgcgucca

SEQ ID NO: 906807 - RNA, 24 nt, Mycobacterium avium subsp. paratuberculosis
cuggaugccgcccuugcucgcggc

SEQ ID NO: 906808 - RNA, 20 nt, Mycobacterium avium subsp. paratuberculosis
cuggauguccaggccgucga

SEQ ID NO: 906809 - RNA, 14 nt, Mycobacterium avium subsp. paratuberculosis
cuggauggucucgc

SEQ ID NO: 906810 - RNA, 19 nt, Mycobacterium avium subsp. paratuberculosis
cuggauggucucgcgcacc

SEQ ID NO: 906811 - RNA, 17 nt, Mycobacterium avium subsp. paratuberculosis
cuggcacgacgccgccg

SEQ ID NO: 906812 - RNA, 16 nt, Mycobacterium avium subsp. paratuberculosis
cuggcacggcugcucc

SEQ ID NO: 906813 - RNA, 20 nt, Mycobacterium avium subsp. paratuberculosis
cuggcagcauccgccgacga

SEQ ID NO: 906814 - RNA, 16 nt, Mycobacterium avium subsp. paratuberculosis
cuggcagccggccggc

SEQ ID NO: 906815 - RNA, 18 nt, Mycobacterium avium subsp. paratuberculosis
cuggcagccggccggcag

SEQ ID NO: 906816 - RNA, 22 nt, Mycobacterium avium subsp. paratuberculosis
cuggcaggacgggcaccaguag

SEQ ID NO: 906817 - RNA, 14 nt, Mycobacterium avium subsp. paratuberculosis
cuggcaggucgcgc

SEQ ID NO: 906818 - RNA, 17 nt, Mycobacterium avium subsp. paratuberculosis
cuggcaggucgcgccgg

SEQ ID NO: 906819 - RNA, 18 nt, Mycobacterium avium subsp. paratuberculosis
cuggcaggucgcgccgga

SEQ ID NO: 906820 - RNA, 18 nt, Mycobacterium avium subsp. paratuberculosis
cuggccaccucgacggcg

SEQ ID NO: 906821 - RNA, 20 nt, Mycobacterium avium subsp. paratuberculosis
cuggccacgauccggggcag

SEQ ID NO: 906822 - RNA, 19 nt, Mycobacterium avium subsp. paratuberculosis
cuggccaccgcaucgccga

SEQ ID NO: 906823 - RNA, 14 nt, Mycobacterium avium subsp. paratuberculosis
cuggcaggugagcc

SEQ ID NO: 906824 - RNA, 16 nt, Mycobacterium avium subsp. paratuberculosis
cuggccaccagcagca

SEQ ID NO: 906825 - RNA, 16 nt, Mycobacterium avium subsp. paratuberculosis
cuggcagcugccgaac

SEQ ID NO: 906826 - RNA, 18 nt, Mycobacterium avium subsp. paratuberculosis
cugcgagcccggccaguc

SEQ ID NO: 906827 - RNA, 20 nt, Mycobacterium avium subsp. paratuberculosis
cugcgacuucuacggcgggc

SEQ ID NO: 906828 - RNA, 22 nt, Mycobacterium avium subsp. paratuberculosis
cugcgacuucuacggcgggccg

SEQ ID NO: 906829 - RNA, 23 nt, Mycobacterium avium subsp. paratuberculosis
cugcgacuucuacggcgggccgg

SEQ ID NO: 906830 - RNA, 15 nt, Mycobacterium avium subsp. paratuberculosis
cugcgagaucggcag

SEQ ID NO: 906831 - RNA, 16 nt, Mycobacterium avium subsp. paratuberculosis
cugcgagaugcccacc

SEQ ID NO: 906832 - RNA, 21 nt, Mycobacterium avium subsp. paratuberculosis
cuggacgaguggucggccgcc

SEQ ID NO: 906833 - RNA, 13 nt, Mycobacterium avium subsp. paratuberculosis
cugcgaggcgggc

SEQ ID NO: 906834 - RNA, 16 nt, Mycobacterium avium subsp. paratuberculosis
cugcgaggcgggcaca

SEQ ID NO: 906835 - RNA, 22 nt, Mycobacterium avium subsp. paratuberculosis
cugcgaggcgggcacacgcggu

SEQ ID NO: 906836 - RNA, 21 nt, Mycobacterium avium subsp. paratuberculosis
cuggacgccgcacgcgaccgc

SEQ ID NO: 906837 - RNA, 19 nt, Mycobacterium avium subsp. paratuberculosis
cuggacggcccgacgacgc

SEQ ID NO: 906838 - RNA, 18 nt, Mycobacterium avium subsp. paratuberculosis
cuggacgguuucaccgcc

SEQ ID NO: 906839 - RNA, 22 nt, Mycobacterium avium subsp. paratuberculosis
cuggacgguuucaccgccgucc

SEQ ID NO: 906840 - RNA, 16 nt, Mycobacterium avium subsp. paratuberculosis
cuggacgucgucgcug

SEQ ID NO: 906841 - RNA, 23 nt, Mycobacterium avium subsp. paratuberculosis
cuggacgucgucgcuguccucga

SEQ ID NO: 906842 - RNA, 19 nt, Mycobacterium avium subsp. paratuberculosis
cuggagugcugcagaccga

SEQ ID NO: 906843 - RNA, 17 nt, Mycobacterium avium subsp. paratuberculosis
cuggaucccgaacugcc

SEQ ID NO: 906844 - RNA, 19 nt, Mycobacterium avium subsp. paratuberculosis
cuggaguaggugcccgagc

SEQ ID NO: 906845 - RNA, 22 nt, Mycobacterium avium subsp. paratuberculosis
cuggaggccaacgagcgcgccg

SEQ ID NO: 906846 - RNA, 12 nt, Mycobacterium avium subsp. paratuberculosis
cuggcgaccggu

SEQ ID NO: 906847 - RNA, 20 nt, Mycobacterium avium subsp. paratuberculosis
cuggcgaucaucgucgucac

SEQ ID NO: 906848 - RNA, 16 nt, Mycobacterium avium subsp. paratuberculosis
cuggcgaugaucaaca

SEQ ID NO: 906849 - RNA, 21 nt, Mycobacterium avium subsp. paratuberculosis
cuggcgaugugaucgcggccc

SEQ ID NO: 906850 - RNA, 16 nt, Mycobacterium avium subsp. paratuberculosis
cuggcgauggugccga

SEQ ID NO: 906851 - RNA, 19 nt, Mycobacterium avium subsp. paratuberculosis
cuggcgauggugccgaagc

SEQ ID NO: 906852 - RNA, 14 nt, Mycobacterium avium subsp. paratuberculosis
cuggcgcaccgccg

SEQ ID NO: 906853 - RNA, 19 nt, Mycobacterium avium subsp. paratuberculosis
cuggcgcaccgccgcggga

SEQ ID NO: 906854 - RNA, 16 nt, Mycobacterium avium subsp. paratuberculosis
cuggcgcagcaccgac

SEQ ID NO: 906855 - RNA, 23 nt, Mycobacterium avium subsp. paratuberculosis
cuggcgcagcaccgacuccuccg

SEQ ID NO: 906856 - RNA, 14 nt, Mycobacterium avium subsp. paratuberculosis
cuggcgcagggcgu

SEQ ID NO: 906857 - RNA, 17 nt, Mycobacterium avium subsp. paratuberculosis
cuggcgcagggcguucg

SEQ ID NO: 906858 - RNA, 23 nt, Mycobacterium avium subsp. paratuberculosis
cuggcgcaucagcggggcgucca

SEQ ID NO: 906859 - RNA, 22 nt, Mycobacterium avium subsp. paratuberculosis
cuggcgccggcguccagcgccg

SEQ ID NO: 906860 - RNA, 13 nt, Mycobacterium avium subsp. paratuberculosis
cuggcgcaggcgc

SEQ ID NO: 906861 - RNA, 12 nt, Mycobacterium avium subsp. paratuberculosis
cuggcgccgaac

SEQ ID NO: 906862 - RNA, 17 nt, Mycobacterium avium subsp. paratuberculosis
cuggccuugaucgggua

SEQ ID NO: 906863 - RNA, 14 nt, Mycobacterium avium subsp. paratuberculosis
cuggccgaccgccg

SEQ ID NO: 906864 - RNA, 22 nt, Mycobacterium avium subsp. paratuberculosis
cuggccgaccccgaugcgcucg

SEQ ID NO: 906865 - RNA, 15 nt, Mycobacterium avium subsp. paratuberculosis
cuggcgaaccgcggc

SEQ ID NO: 906866 - RNA, 15 nt, Mycobacterium avium subsp. paratuberculosis
cuggcgaacauggug

SEQ ID NO: 906867 - RNA, 18 nt, Mycobacterium avium subsp. paratuberculosis
cuggcccuugaccgccug

SEQ ID NO: 906868 - RNA, 22 nt, Mycobacterium avium subsp. paratuberculosis
cuggccacguggucgcugaccu

SEQ ID NO: 906869 - RNA, 18 nt, Mycobacterium avium subsp. paratuberculosis
cuggcccggugcgacgcc

SEQ ID NO: 906870 - RNA, 21 nt, Mycobacterium avium subsp. paratuberculosis
cuggcccggcguuccagcgca

SEQ ID NO: 906871 - RNA, 19 nt, Mycobacterium avium subsp. paratuberculosis
cuggcccgccaucgcccgg

SEQ ID NO: 906872 - RNA, 20 nt, Mycobacterium avium subsp. paratuberculosis
cuggcccgccaucgcccggu

SEQ ID NO: 906873 - RNA, 15 nt, Mycobacterium avium subsp. paratuberculosis
cuggccagcaccagc

SEQ ID NO: 906874 - RNA, 19 nt, Mycobacterium avium subsp. paratuberculosis
cuggccagcaccagcgcgc

SEQ ID NO: 906875 - RNA, 20 nt, Mycobacterium avium subsp. paratuberculosis
cuggccagcaccagcgcgcg

SEQ ID NO: 906876 - RNA, 15 nt, Mycobacterium avium subsp. paratuberculosis
cuggccagcaccgcg

SEQ ID NO: 906877 - RNA, 17 nt, Mycobacterium avium subsp. paratuberculosis
cuggguuccgcgagacg

SEQ ID NO: 906878 - RNA, 15 nt, Mycobacterium avium subsp. paratuberculosis
cuggguugcucgccg

SEQ ID NO: 906879 - RNA, 15 nt, Mycobacterium avium subsp. paratuberculosis
cugggugggugcggu

SEQ ID NO: 906880 - RNA, 14 nt, Mycobacterium avium subsp. paratuberculosis
cugggugcgcggcg

SEQ ID NO: 906881 - RNA, 19 nt, Mycobacterium avium subsp. paratuberculosis
cugggugcgcgggcgcccg

SEQ ID NO: 906882 - RNA, 15 nt, Mycobacterium avium subsp. paratuberculosis
cugggugagcgacac

SEQ ID NO: 906883 - RNA, 17 nt, Mycobacterium avium subsp. paratuberculosis
cugggugagcgacacca

SEQ ID NO: 906884 - RNA, 19 nt, Mycobacterium avium subsp. paratuberculosis
cugggugccccgccguuuc

SEQ ID NO: 906885 - RNA, 14 nt, Mycobacterium avium subsp. paratuberculosis
cugggugccgcggu

SEQ ID NO: 906886 - RNA, 17 nt, Mycobacterium avium subsp. paratuberculosis
cuggggcagaucgucgg

SEQ ID NO: 906887 - RNA, 15 nt, Mycobacterium avium subsp. paratuberculosis
cugggucggucccga

SEQ ID NO: 906888 - RNA, 20 nt, Mycobacterium avium subsp. paratuberculosis
cugggucucgggaucgccga

SEQ ID NO: 906889 - RNA, 15 nt, Mycobacterium avium subsp. paratuberculosis
cugggucugcggccg

SEQ ID NO: 906890 - RNA, 19 nt, Mycobacterium avium subsp. paratuberculosis
cugggucugcggccggggc

SEQ ID NO: 906891 - RNA, 14 nt, Mycobacterium avium subsp. paratuberculosis
cugggcgucgucgg

SEQ ID NO: 906892 - RNA, 21 nt, Mycobacterium avium subsp. paratuberculosis
cugggcgucgucggccggcuc

SEQ ID NO: 906893 - RNA, 16 nt, Mycobacterium avium subsp. paratuberculosis
cugggcgggcagccgc

SEQ ID NO: 906894 - RNA, 21 nt, Mycobacterium avium subsp. paratuberculosis
cugggccaggaucucgucggg

SEQ ID NO: 906895 - RNA, 23 nt, Mycobacterium avium subsp. paratuberculosis
cugggcuaccagccccaggaggc

SEQ ID NO: 906896 - RNA, 20 nt, Mycobacterium avium subsp. paratuberculosis
cugggcucgagugccggcag

SEQ ID NO: 906897 - RNA, 15 nt, Mycobacterium avium subsp. paratuberculosis
cugggcuggccgucc

SEQ ID NO: 906898 - RNA, 15 nt, Mycobacterium avium subsp. paratuberculosis
cugggccgccaacgg

SEQ ID NO: 906899 - RNA, 14 nt, Mycobacterium avium subsp. paratuberculosis
cugggccagaucga

SEQ ID NO: 906900 - RNA, 20 nt, Mycobacterium avium subsp. paratuberculosis
cugggccccuccagccgccg

SEQ ID NO: 906901 - RNA, 14 nt, Mycobacterium avium subsp. paratuberculosis
cugggccaggucgc

SEQ ID NO: 906902 - RNA, 21 nt, Mycobacterium avium subsp. paratuberculosis
cugggccacgauccgcgcggc

SEQ ID NO: 906903 - RNA, 18 nt, Mycobacterium avium subsp. paratuberculosis
cuggcgggcggcccgcac

SEQ ID NO: 906904 - RNA, 16 nt, Mycobacterium avium subsp. paratuberculosis
cuggcgguggcccggu

SEQ ID NO: 906905 - RNA, 20 nt, Mycobacterium avium subsp. paratuberculosis
cuggcgguggcccgguacag

SEQ ID NO: 906906 - RNA, 18 nt, Mycobacterium avium subsp. paratuberculosis
cuggcggugucgaagacc

SEQ ID NO: 906907 - RNA, 20 nt, Mycobacterium avium subsp. paratuberculosis
cuggcggucgcugaccccgc

SEQ ID NO: 906908 - RNA, 19 nt, Mycobacterium avium subsp. paratuberculosis
cuggcggguguucagcccc

SEQ ID NO: 906909 - RNA, 22 nt, Mycobacterium avium subsp. paratuberculosis
cuggcggguguucagccccucg

SEQ ID NO: 906910 - RNA, 20 nt, Mycobacterium avium subsp. paratuberculosis
cuggcguagaucugcacgcu

SEQ ID NO: 906911 - RNA, 18 nt, Mycobacterium avium subsp. paratuberculosis
cugggaugucuagccgcc

SEQ ID NO: 906912 - RNA, 20 nt, Mycobacterium avium subsp. paratuberculosis
cugggaugucuagccgccga

SEQ ID NO: 906913 - RNA, 22 nt, Mycobacterium avium subsp. paratuberculosis
cugggaugucuagccgccgagc

SEQ ID NO: 906914 - RNA, 20 nt, Mycobacterium avium subsp. paratuberculosis
cugggacgggucggcggcga

SEQ ID NO: 906915 - RNA, 16 nt, Mycobacterium avium subsp. paratuberculosis
cugggauugccgggca

SEQ ID NO: 906916 - RNA, 14 nt, Mycobacterium avium subsp. paratuberculosis
cugggcaauggccg

SEQ ID NO: 906917 - RNA, 13 nt, Mycobacterium avium subsp. paratuberculosis
cugggcagccaga

SEQ ID NO: 906918 - RNA, 14 nt, Mycobacterium avium subsp. paratuberculosis
cugggcagccgucc

SEQ ID NO: 906919 - RNA, 18 nt, Mycobacterium avium subsp. paratuberculosis
cuggguuugggucaucga

SEQ ID NO: 906920 - RNA, 13 nt, Mycobacterium avium subsp. paratuberculosis
cugguacgcgccg

SEQ ID NO: 906921 - RNA, 19 nt, Mycobacterium avium subsp. paratuberculosis
cugguacgcgccgucgucg

SEQ ID NO: 906922 - RNA, 20 nt, Mycobacterium avium subsp. paratuberculosis
cugguacgcgccgucgucgu

SEQ ID NO: 906923 - RNA, 14 nt, Mycobacterium avium subsp. paratuberculosis
cugguagaugccga

SEQ ID NO: 906924 - RNA, 18 nt, Mycobacterium avium subsp. paratuberculosis
cugguagaugguggccgu

SEQ ID NO: 906925 - RNA, 23 nt, Mycobacterium avium subsp. paratuberculosis
cuggucgccgaacgugcgcggcg

SEQ ID NO: 906926 - RNA, 22 nt, Mycobacterium avium subsp. paratuberculosis
cuggucgacgucauccggcugc

SEQ ID NO: 906927 - RNA, 19 nt, Mycobacterium avium subsp. paratuberculosis
cugguagcugagcagcagg

SEQ ID NO: 906928 - RNA, 14 nt, Mycobacterium avium subsp. paratuberculosis
cuggucgccgccgu

SEQ ID NO: 906929 - RNA, 23 nt, Mycobacterium avium subsp. paratuberculosis
cuggucgcuuucggugaccauca

SEQ ID NO: 906930 - RNA, 16 nt, Mycobacterium avium subsp. paratuberculosis
cuggucggccagcgcg

SEQ ID NO: 906931 - RNA, 13 nt, Mycobacterium avium subsp. paratuberculosis
cuggucggccagg

SEQ ID NO: 906932 - RNA, 16 nt, Mycobacterium avium subsp. paratuberculosis
cuggucggccagggcg

SEQ ID NO: 906933 - RNA, 19 nt, Mycobacterium avium subsp. paratuberculosis
cuggucggccagggcgugg

SEQ ID NO: 906934 - RNA, 17 nt, Mycobacterium avium subsp. paratuberculosis
cuggucgugcagcaccg

SEQ ID NO: 906935 - RNA, 19 nt, Mycobacterium avium subsp. paratuberculosis
cuggucgugcagcaccgcc

SEQ ID NO: 906936 - RNA, 14 nt, Mycobacterium avium subsp. paratuberculosis
cuggucgucgagcu

SEQ ID NO: 906937 - RNA, 18 nt, Mycobacterium avium subsp. paratuberculosis
cuggucgucgagcugaca

SEQ ID NO: 906938 - RNA, 19 nt, Mycobacterium avium subsp. paratuberculosis
cuggucguugcacacccgg

SEQ ID NO: 906939 - RNA, 17 nt, Mycobacterium avium subsp. paratuberculosis
cuggucgggguggaucg

SEQ ID NO: 906940 - RNA, 23 nt, Mycobacterium avium subsp. paratuberculosis
cuggucggcgaaccguucgucgu

SEQ ID NO: 906941 - RNA, 17 nt, Mycobacterium avium subsp. paratuberculosis
cuggucggccggcaggc

SEQ ID NO: 906942 - RNA, 21 nt, Mycobacterium avium subsp. paratuberculosis
cuggucggccggcaggccgcc

SEQ ID NO: 906943 - RNA, 13 nt, Mycobacterium avium subsp. paratuberculosis
cuggucggcgggc

SEQ ID NO: 906944 - RNA, 14 nt, Mycobacterium avium subsp. paratuberculosis
cuggugcgcgccgg

SEQ ID NO: 906945 - RNA, 15 nt, Mycobacterium avium subsp. paratuberculosis
cuggugcgcgccggc

SEQ ID NO: 906946 - RNA, 17 nt, Mycobacterium avium subsp. paratuberculosis
cuggugccgccgaugac

SEQ ID NO: 906947 - RNA, 14 nt, Mycobacterium avium subsp. paratuberculosis
cuggugcagcagcu

SEQ ID NO: 906948 - RNA, 17 nt, Mycobacterium avium subsp. paratuberculosis
cuggugcagcagcugga

SEQ ID NO: 906949 - RNA, 19 nt, Mycobacterium avium subsp. paratuberculosis
cuggugcagcagggcgcgc

SEQ ID NO: 906950 - RNA, 23 nt, Mycobacterium avium subsp. paratuberculosis
cuggugcagcagggcgcgcaucu

SEQ ID NO: 906951 - RNA, 19 nt, Mycobacterium avium subsp. paratuberculosis
cuggugaagcugccgacca

SEQ ID NO: 906952 - RNA, 21 nt, Mycobacterium avium subsp. paratuberculosis
cuggugaaguucuccagcacg

SEQ ID NO: 906953 - RNA, 16 nt, Mycobacterium avium subsp. paratuberculosis
cuggugaccgacgacg

SEQ ID NO: 906954 - RNA, 17 nt, Mycobacterium avium subsp. paratuberculosis
cuggugcaacaccgaaa

SEQ ID NO: 906955 - RNA, 20 nt, Mycobacterium avium subsp. paratuberculosis
cuggugauagaucaucccgg

SEQ ID NO: 906956 - RNA, 21 nt, Mycobacterium avium subsp. paratuberculosis
cuggugauagaucaucccggc

SEQ ID NO: 906957 - RNA, 22 nt, Mycobacterium avium subsp. paratuberculosis
cuggugauccucgucuccggcg

SEQ ID NO: 906958 - RNA, 15 nt, Mycobacterium avium subsp. paratuberculosis
cuggugggccaucgc

SEQ ID NO: 906959 - RNA, 13 nt, Mycobacterium avium subsp. paratuberculosis
cuggugggcgucg

SEQ ID NO: 906960 - RNA, 17 nt, Mycobacterium avium subsp. paratuberculosis
cugguggccgacgugcc

SEQ ID NO: 906961 - RNA, 13 nt, Mycobacterium avium subsp. paratuberculosis
cuggugcucgcgc

SEQ ID NO: 906962 - RNA, 16 nt, Mycobacterium avium subsp. paratuberculosis
cuggugcucgcgcucg

SEQ ID NO: 906963 - RNA, 13 nt, Mycobacterium avium subsp. paratuberculosis
cugguggcagcgg

SEQ ID NO: 906964 - RNA, 18 nt, Mycobacterium avium subsp. paratuberculosis
cuggugcgggccagcacg

SEQ ID NO: 906965 - RNA, 19 nt, Mycobacterium avium subsp. paratuberculosis
cuggugcgggccagcacga

SEQ ID NO: 906966 - RNA, 14 nt, Mycobacterium avium subsp. paratuberculosis
cuggugcgcagccg

SEQ ID NO: 906967 - RNA, 15 nt, Mycobacterium avium subsp. paratuberculosis
gccccaacggcgugc

SEQ ID NO: 906968 - RNA, 17 nt, Mycobacterium avium subsp. paratuberculosis
gccccaacggugaucga

SEQ ID NO: 906969 - RNA, 16 nt, Mycobacterium avium subsp. paratuberculosis
gccccacacgcucggc

SEQ ID NO: 906970 - RNA, 18 nt, Mycobacterium avium subsp. paratuberculosis
gccccacacgcucggcgc

SEQ ID NO: 906971 - RNA, 20 nt, Mycobacterium avium subsp. paratuberculosis
gccccacacgaugcgcggua

SEQ ID NO: 906972 - RNA, 13 nt, Mycobacterium avium subsp. paratuberculosis
gccccaccaccgc

SEQ ID NO: 906973 - RNA, 14 nt, Mycobacterium avium subsp. paratuberculosis
gccccaccaccgcc

SEQ ID NO: 906974 - RNA, 15 nt, Mycobacterium avium subsp. paratuberculosis
gccccaccaccgcca

SEQ ID NO: 906975 - RNA, 21 nt, Mycobacterium avium subsp. paratuberculosis
gccccaccaccgccaccagcg

SEQ ID NO: 906976 - RNA, 15 nt, Mycobacterium avium subsp. paratuberculosis
gccccaccaccgccg

SEQ ID NO: 906977 - RNA, 16 nt, Mycobacterium avium subsp. paratuberculosis
gccccaccaccgccgg

SEQ ID NO: 906978 - RNA, 17 nt, Mycobacterium avium subsp. paratuberculosis
gccccaccaccgccggc

SEQ ID NO: 906979 - RNA, 19 nt, Mycobacterium avium subsp. paratuberculosis
gccccaccaccgccggccc

SEQ ID NO: 906980 - RNA, 21 nt, Mycobacterium avium subsp. paratuberculosis
gccccaccaccgccggcccag

SEQ ID NO: 906981 - RNA, 14 nt, Mycobacterium avium subsp. paratuberculosis
gcccagucgccgcc

SEQ ID NO: 906982 - RNA, 17 nt, Mycobacterium avium subsp. paratuberculosis
gcccagucgccgccgcg

SEQ ID NO: 906983 - RNA, 13 nt, Mycobacterium avium subsp. paratuberculosis
gcccaguggaucg

SEQ ID NO: 906984 - RNA, 18 nt, Mycobacterium avium subsp. paratuberculosis
gcccaguggaucggcccg

SEQ ID NO: 906985 - RNA, 21 nt, Mycobacterium avium subsp. paratuberculosis
gcccaguggaucggcccgacg

SEQ ID NO: 906986 - RNA, 12 nt, Mycobacterium avium subsp. paratuberculosis
gcccagucccgu

SEQ ID NO: 906987 - RNA, 16 nt, Mycobacterium avium subsp. paratuberculosis
gcccaguccagucgcg

SEQ ID NO: 906988 - RNA, 21 nt, Mycobacterium avium subsp. paratuberculosis
gcccaguccagucgcgccgag

SEQ ID NO: 906989 - RNA, 22 nt, Mycobacterium avium subsp. paratuberculosis
gcccaguccagucgcgccgagg

SEQ ID NO: 906990 - RNA, 17 nt, Mycobacterium avium subsp. paratuberculosis
gcccaugucgaucggcu

SEQ ID NO: 906991 - RNA, 20 nt, Mycobacterium avium subsp. paratuberculosis
gcccaugucgaucggcucgg

SEQ ID NO: 906992 - RNA, 14 nt, Mycobacterium avium subsp. paratuberculosis
gcccaugucgccgg

SEQ ID NO: 906993 - RNA, 15 nt, Mycobacterium avium subsp. paratuberculosis
gcccaugucgccggu

SEQ ID NO: 906994 - RNA, 16 nt, Mycobacterium avium subsp. paratuberculosis
gcccaugucgccggug

SEQ ID NO: 906995 - RNA, 12 nt, Mycobacterium avium subsp. paratuberculosis
gccccaccccgg

SEQ ID NO: 906996 - RNA, 13 nt, Mycobacterium avium subsp. paratuberculosis
gccccaccccgga

SEQ ID NO: 906997 - RNA, 16 nt, Mycobacterium avium subsp. paratuberculosis
gccccagccacagccg

SEQ ID NO: 906998 - RNA, 14 nt, Mycobacterium avium subsp. paratuberculosis
gccccagccaccgu

SEQ ID NO: 906999 - RNA, 13 nt, Mycobacterium avium subsp. paratuberculosis
gccccaccgccgc

SEQ ID NO: 907000 - RNA, 17 nt, Mycobacterium avium subsp. paratuberculosis
gccccagccccucgccg

SEQ ID NO: 907001 - RNA, 18 nt, Mycobacterium avium subsp. paratuberculosis
gccccagccccucgccgg

SEQ ID NO: 907002 - RNA, 20 nt, Mycobacterium avium subsp. paratuberculosis
gccccagccccucgccgggc

SEQ ID NO: 907003 - RNA, 13 nt, Mycobacterium avium subsp. paratuberculosis
gccccagcccggc

SEQ ID NO: 907004 - RNA, 17 nt, Mycobacterium avium subsp. paratuberculosis
gccccagcccgggggug

SEQ ID NO: 907005 - RNA, 18 nt, Mycobacterium avium subsp. paratuberculosis
gccccagccgaccaguuc

SEQ ID NO: 907006 - RNA, 14 nt, Mycobacterium avium subsp. paratuberculosis
gccccagccgccgc

SEQ ID NO: 907007 - RNA, 16 nt, Mycobacterium avium subsp. paratuberculosis
gccccagccgccgcga

SEQ ID NO: 907008 - RNA, 16 nt, Mycobacterium avium subsp. paratuberculosis
gccccagcuccucggc

SEQ ID NO: 907009 - RNA, 14 nt, Mycobacterium avium subsp. paratuberculosis
gccccaggcccggu

SEQ ID NO: 907010 - RNA, 19 nt, Mycobacterium avium subsp. paratuberculosis
gccccauugccgcgccggg

SEQ ID NO: 907011 - RNA, 19 nt, Mycobacterium avium subsp. paratuberculosis
gcccccaaugucacggcgg

SEQ ID NO: 907012 - RNA, 23 nt, Mycobacterium avium subsp. paratuberculosis
gcccccaccacgaagcuggcgaa

SEQ ID NO: 907013 - RNA, 16 nt, Mycobacterium avium subsp. paratuberculosis
gcccccaccugaucgc

SEQ ID NO: 907014 - RNA, 18 nt, Mycobacterium avium subsp. paratuberculosis
gcccccaccugaucgcgg

SEQ ID NO: 907015 - RNA, 16 nt, Mycobacterium avium subsp. paratuberculosis
gcccccacgcucggcg

SEQ ID NO: 907016 - RNA, 17 nt, Mycobacterium avium subsp. paratuberculosis
gcccccacgcucggcgc

SEQ ID NO: 907017 - RNA, 15 nt, Mycobacterium avium subsp. paratuberculosis
gcccccagcggggca

SEQ ID NO: 907018 - RNA, 23 nt, Mycobacterium avium subsp. paratuberculosis
gcccccagcggggcaagcagcgg

SEQ ID NO: 907019 - RNA, 17 nt, Mycobacterium avium subsp. paratuberculosis
gccccccgcacaccggc

SEQ ID NO: 907020 - RNA, 17 nt, Mycobacterium avium subsp. paratuberculosis
gccccccgggcaccagc

SEQ ID NO: 907021 - RNA, 18 nt, Mycobacterium avium subsp. paratuberculosis
gcccccgcuggcccggcg

SEQ ID NO: 907022 - RNA, 14 nt, Mycobacterium avium subsp. paratuberculosis
gcccccggaccacg

SEQ ID NO: 907023 - RNA, 13 nt, Mycobacterium avium subsp. paratuberculosis
gcccccggcucga

SEQ ID NO: 907024 - RNA, 16 nt, Mycobacterium avium subsp. paratuberculosis
gcccccggcucgaucg

SEQ ID NO: 907025 - RNA, 18 nt, Mycobacterium avium subsp. paratuberculosis
gcccccgggcccgaagcg

SEQ ID NO: 907026 - RNA, 13 nt, Mycobacterium avium subsp. paratuberculosis
gcccccggugacg

SEQ ID NO: 907027 - RNA, 18 nt, Mycobacterium avium subsp. paratuberculosis
gcccaggaaguagccggc

SEQ ID NO: 907028 - RNA, 19 nt, Mycobacterium avium subsp. paratuberculosis
gcccaggaaguagccggcc

SEQ ID NO: 907029 - RNA, 22 nt, Mycobacterium avium subsp. paratuberculosis
gcccaggaaguagccggccagc

SEQ ID NO: 907030 - RNA, 14 nt, Mycobacterium avium subsp. paratuberculosis
gcccaggaacgcgc

SEQ ID NO: 907031 - RNA, 16 nt, Mycobacterium avium subsp. paratuberculosis
gcccaggaacgcgccg

SEQ ID NO: 907032 - RNA, 18 nt, Mycobacterium avium subsp. paratuberculosis
gcccaggaacgcgccggc

SEQ ID NO: 907033 - RNA, 21 nt, Mycobacterium avium subsp. paratuberculosis
gcccaggcagacccccagcag

SEQ ID NO: 907034 - RNA, 13 nt, Mycobacterium avium subsp. paratuberculosis
gcccaggacccgu

SEQ ID NO: 907035 - RNA, 15 nt, Mycobacterium avium subsp. paratuberculosis
gcccagcugggccag

SEQ ID NO: 907036 - RNA, 19 nt, Mycobacterium avium subsp. paratuberculosis
gcccagcugggccagcgcg

SEQ ID NO: 907037 - RNA, 20 nt, Mycobacterium avium subsp. paratuberculosis
gcccagcugggccagcgcgg

SEQ ID NO: 907038 - RNA, 14 nt, Mycobacterium avium subsp. paratuberculosis
gcccagcggccccg

SEQ ID NO: 907039 - RNA, 16 nt, Mycobacterium avium subsp. paratuberculosis
gcccagcggccccggc

SEQ ID NO: 907040 - RNA, 21 nt, Mycobacterium avium subsp. paratuberculosis
gcccagcggcauggcgaugac

SEQ ID NO: 907041 - RNA, 14 nt, Mycobacterium avium subsp. paratuberculosis
gcccagcggcgaug

SEQ ID NO: 907042 - RNA, 21 nt, Mycobacterium avium subsp. paratuberculosis
gcccagcggcacgggcaccga

SEQ ID NO: 907043 - RNA, 13 nt, Mycobacterium avium subsp. paratuberculosis
gcccagcgcguug

SEQ ID NO: 907044 - RNA, 13 nt, Mycobacterium avium subsp. paratuberculosis
gcccagcgcggua

SEQ ID NO: 907045 - RNA, 22 nt, Mycobacterium avium subsp. paratuberculosis
gcccagcgcgguaaagucuucg

SEQ ID NO: 907046 - RNA, 13 nt, Mycobacterium avium subsp. paratuberculosis
gcccagcgcgguc

SEQ ID NO: 907047 - RNA, 14 nt, Mycobacterium avium subsp. paratuberculosis
gcccagcgcggucg

SEQ ID NO: 907048 - RNA, 17 nt, Mycobacterium avium subsp. paratuberculosis
gcccagcgcggucgcca

SEQ ID NO: 907049 - RNA, 19 nt, Mycobacterium avium subsp. paratuberculosis
gcccagcgcggucgccacc

SEQ ID NO: 907050 - RNA, 23 nt, Mycobacterium avium subsp. paratuberculosis
gcccagcgcgguguacagcgcgc

SEQ ID NO: 907051 - RNA, 20 nt, Mycobacterium avium subsp. paratuberculosis
gcccagggcgugcgcggccg

SEQ ID NO: 907052 - RNA, 15 nt, Mycobacterium avium subsp. paratuberculosis
gcccaggggagcggc

SEQ ID NO: 907053 - RNA, 17 nt, Mycobacterium avium subsp. paratuberculosis
gcccaggggagcggcgg

SEQ ID NO: 907054 - RNA, 22 nt, Mycobacterium avium subsp. paratuberculosis
gcccaggggucccaggugggcg

SEQ ID NO: 907055 - RNA, 14 nt, Mycobacterium avium subsp. paratuberculosis
gcccagggcgccag

SEQ ID NO: 907056 - RNA, 16 nt, Mycobacterium avium subsp. paratuberculosis
gcccagggcgcgucca

SEQ ID NO: 907057 - RNA, 15 nt, Mycobacterium avium subsp. paratuberculosis
gcccaggcgggccag

SEQ ID NO: 907058 - RNA, 19 nt, Mycobacterium avium subsp. paratuberculosis
gcccaggcgggccagcucg

SEQ ID NO: 907059 - RNA, 20 nt, Mycobacterium avium subsp. paratuberculosis
gcccaggcgggccagcucga

SEQ ID NO: 907060 - RNA, 16 nt, Mycobacterium avium subsp. paratuberculosis
gcccaggcgugcgcgu

SEQ ID NO: 907061 - RNA, 17 nt, Mycobacterium avium subsp. paratuberculosis
gcccaggcccagcagca

SEQ ID NO: 907062 - RNA, 18 nt, Mycobacterium avium subsp. paratuberculosis
gcccaggcccagcagcac

SEQ ID NO: 907063 - RNA, 17 nt, Mycobacterium avium subsp. paratuberculosis
gcccaggaugacgccga

SEQ ID NO: 907064 - RNA, 20 nt, Mycobacterium avium subsp. paratuberculosis
gcccaggaugacgccgaauc

SEQ ID NO: 907065 - RNA, 16 nt, Mycobacterium avium subsp. paratuberculosis
gcccaggccaacagca

SEQ ID NO: 907066 - RNA, 17 nt, Mycobacterium avium subsp. paratuberculosis
gcccaggccaacagcag

SEQ ID NO: 907067 - RNA, 12 nt, Mycobacterium avium subsp. paratuberculosis
gcccaggcccag

SEQ ID NO: 907068 - RNA, 17 nt, Mycobacterium avium subsp. paratuberculosis
gcccagcgcauccacca

SEQ ID NO: 907069 - RNA, 21 nt, Mycobacterium avium subsp. paratuberculosis
gcccagcgcauccaccagggc

SEQ ID NO: 907070 - RNA, 23 nt, Mycobacterium avium subsp. paratuberculosis
gcccagcgcauccaccagggcgg

SEQ ID NO: 907071 - RNA, 17 nt, Mycobacterium avium subsp. paratuberculosis
gcccagcgaggcggcca

SEQ ID NO: 907072 - RNA, 16 nt, Mycobacterium avium subsp. paratuberculosis
gcccagcgagucgaga

SEQ ID NO: 907073 - RNA, 15 nt, Mycobacterium avium subsp. paratuberculosis
gcccagcgcagcauc

SEQ ID NO: 907074 - RNA, 16 nt, Mycobacterium avium subsp. paratuberculosis
gcccagcgcagcaucg

SEQ ID NO: 907075 - RNA, 14 nt, Mycobacterium avium subsp. paratuberculosis
gcccaccaggucga

SEQ ID NO: 907076 - RNA, 19 nt, Mycobacterium avium subsp. paratuberculosis
gcccagcgcagcgccucgg

SEQ ID NO: 907077 - RNA, 13 nt, Mycobacterium avium subsp. paratuberculosis
gcccagcgcgacg

SEQ ID NO: 907078 - RNA, 19 nt, Mycobacterium avium subsp. paratuberculosis
gcccagcgcgaggucgacg

SEQ ID NO: 907079 - RNA, 20 nt, Mycobacterium avium subsp. paratuberculosis
gcccagcgcgaggucgacgg

SEQ ID NO: 907080 - RNA, 13 nt, Mycobacterium avium subsp. paratuberculosis
gcccagcgccgcg

SEQ ID NO: 907081 - RNA, 16 nt, Mycobacterium avium subsp. paratuberculosis
gcccagcgccgcggcg

SEQ ID NO: 907082 - RNA, 12 nt, Mycobacterium avium subsp. paratuberculosis
gcccagcgcgcg

SEQ ID NO: 907083 - RNA, 15 nt, Mycobacterium avium subsp. paratuberculosis
gcccagcgcgcgauc

SEQ ID NO: 907084 - RNA, 17 nt, Mycobacterium avium subsp. paratuberculosis
gcccagcgcgcgaucgc

SEQ ID NO: 907085 - RNA, 18 nt, Mycobacterium avium subsp. paratuberculosis
gcccagcgcgcgaucgcc

SEQ ID NO: 907086 - RNA, 20 nt, Mycobacterium avium subsp. paratuberculosis
gcccagcgcgcgaucgccgg

SEQ ID NO: 907087 - RNA, 21 nt, Mycobacterium avium subsp. paratuberculosis
gcccagcgcgcgaucgccggu

SEQ ID NO: 907088 - RNA, 15 nt, Mycobacterium avium subsp. paratuberculosis
gcccagcgcgcggcg

SEQ ID NO: 907089 - RNA, 16 nt, Mycobacterium avium subsp. paratuberculosis
gcccagcgcgcggugc

SEQ ID NO: 907090 - RNA, 17 nt, Mycobacterium avium subsp. paratuberculosis
gcccaccaucccgccgc

SEQ ID NO: 907091 - RNA, 22 nt, Mycobacterium avium subsp. paratuberculosis
gcccaccaucccgccgccgaac

SEQ ID NO: 907092 - RNA, 19 nt, Mycobacterium avium subsp. paratuberculosis
gcccaccacgaacgcgccg

SEQ ID NO: 907093 - RNA, 21 nt, Mycobacterium avium subsp. paratuberculosis
gcccaccacgaacgcgccgcc

SEQ ID NO: 907094 - RNA, 23 nt, Mycobacterium avium subsp. paratuberculosis
gcccaccacgaacgcgccgccga

SEQ ID NO: 907095 - RNA, 19 nt, Mycobacterium avium subsp. paratuberculosis
gcccaccacgacgacgugg

SEQ ID NO: 907096 - RNA, 13 nt, Mycobacterium avium subsp. paratuberculosis
gcccaccagcaca

SEQ ID NO: 907097 - RNA, 18 nt, Mycobacterium avium subsp. paratuberculosis
gcccaccagcacaccgga

SEQ ID NO: 907098 - RNA, 20 nt, Mycobacterium avium subsp. paratuberculosis
gcccaccagcaggucgaucu

SEQ ID NO: 907099 - RNA, 12 nt, Mycobacterium avium subsp. paratuberculosis
gcccaccagcau

SEQ ID NO: 907100 - RNA, 13 nt, Mycobacterium avium subsp. paratuberculosis
gcccaccagcauc

SEQ ID NO: 907101 - RNA, 15 nt, Mycobacterium avium subsp. paratuberculosis
gcccaccagccggcc

SEQ ID NO: 907102 - RNA, 19 nt, Mycobacterium avium subsp. paratuberculosis
gcccaccagccggccggcg

SEQ ID NO: 907103 - RNA, 21 nt, Mycobacterium avium subsp. paratuberculosis
gcccaagacccgcgucaucgg

SEQ ID NO: 907104 - RNA, 17 nt, Mycobacterium avium subsp. paratuberculosis
gcccaauaccguuccgc

SEQ ID NO: 907105 - RNA, 20 nt, Mycobacterium avium subsp. paratuberculosis
gcccaaugaucugggccgcc

SEQ ID NO: 907106 - RNA, 21 nt, Mycobacterium avium subsp. paratuberculosis
gcccaaugaucugggccgcca

SEQ ID NO: 907107 - RNA, 14 nt, Mycobacterium avium subsp. paratuberculosis
gcccaagccggcca

SEQ ID NO: 907108 - RNA, 14 nt, Mycobacterium avium subsp. paratuberculosis
gcccaccaccgccu

SEQ ID NO: 907109 - RNA, 13 nt, Mycobacterium avium subsp. paratuberculosis
gcccaccaccggc

SEQ ID NO: 907110 - RNA, 22 nt, Mycobacterium avium subsp. paratuberculosis
gcccaccaccggcuuggccacg

SEQ ID NO: 907111 - RNA, 18 nt, Mycobacterium avium subsp. paratuberculosis
gcccgcacuggucgugcu

SEQ ID NO: 907112 - RNA, 20 nt, Mycobacterium avium subsp. paratuberculosis
gcccgcacuggucgugcugg

SEQ ID NO: 907113 - RNA, 15 nt, Mycobacterium avium subsp. paratuberculosis
gcccgcacguagacg

SEQ ID NO: 907114 - RNA, 13 nt, Mycobacterium avium subsp. paratuberculosis
gcccgcagcauca

SEQ ID NO: 907115 - RNA, 20 nt, Mycobacterium avium subsp. paratuberculosis
gcccgcaccugcgcgccguu

SEQ ID NO: 907116 - RNA, 14 nt, Mycobacterium avium subsp. paratuberculosis
gcccgcacggccgc

SEQ ID NO: 907117 - RNA, 23 nt, Mycobacterium avium subsp. paratuberculosis
gcccgcacccuugacuaccgcgc

SEQ ID NO: 907118 - RNA, 15 nt, Mycobacterium avium subsp. paratuberculosis
gcccgcacccgccgc

SEQ ID NO: 907119 - RNA, 16 nt, Mycobacterium avium subsp. paratuberculosis
gcccgcacccgccgcc

SEQ ID NO: 907120 - RNA, 12 nt, Mycobacterium avium subsp. paratuberculosis
gcccgcaccacc

SEQ ID NO: 907121 - RNA, 13 nt, Mycobacterium avium subsp. paratuberculosis
gcccgcaccacga

SEQ ID NO: 907122 - RNA, 13 nt, Mycobacterium avium subsp. paratuberculosis
gcccgcaccagca

SEQ ID NO: 907123 - RNA, 14 nt, Mycobacterium avium subsp. paratuberculosis
gcccgcaccagcag

SEQ ID NO: 907124 - RNA, 17 nt, Mycobacterium avium subsp. paratuberculosis
gcccgcaccagcagguc

SEQ ID NO: 907125 - RNA, 19 nt, Mycobacterium avium subsp. paratuberculosis
gcccgaugcuggccaucgc

SEQ ID NO: 907126 - RNA, 20 nt, Mycobacterium avium subsp. paratuberculosis
gcccgaugcuggccaucgcc

SEQ ID NO: 907127 - RNA, 16 nt, Mycobacterium avium subsp. paratuberculosis
gcccgauggaggugcc

SEQ ID NO: 907128 - RNA, 20 nt, Mycobacterium avium subsp. paratuberculosis
gcccgccccgcccggcggcc

SEQ ID NO: 907129 - RNA, 21 nt, Mycobacterium avium subsp. paratuberculosis
gcccgccccgcccggcggcca

SEQ ID NO: 907130 - RNA, 19 nt, Mycobacterium avium subsp. paratuberculosis
gcccgccccgacgugcagc

SEQ ID NO: 907131 - RNA, 23 nt, Mycobacterium avium subsp. paratuberculosis
gcccgccccgacgugcagcgcca

SEQ ID NO: 907132 - RNA, 16 nt, Mycobacterium avium subsp. paratuberculosis
gcccgccacgugcggc

SEQ ID NO: 907133 - RNA, 20 nt, Mycobacterium avium subsp. paratuberculosis
gcccgccacgugcggcugcg

SEQ ID NO: 907134 - RNA, 14 nt, Mycobacterium avium subsp. paratuberculosis
gcccgccacggcca

SEQ ID NO: 907135 - RNA, 16 nt, Mycobacterium avium subsp. paratuberculosis
gcccgcagccgcuggc

SEQ ID NO: 907136 - RNA, 22 nt, Mycobacterium avium subsp. paratuberculosis
gcccgcagccgcuggccgcgcc

SEQ ID NO: 907137 - RNA, 15 nt, Mycobacterium avium subsp. paratuberculosis
gcccgcagccagcgc

SEQ ID NO: 907138 - RNA, 17 nt, Mycobacterium avium subsp. paratuberculosis
gcccgcagccagcgcag

SEQ ID NO: 907139 - RNA, 19 nt, Mycobacterium avium subsp. paratuberculosis
gcccgcagccagcgcagca

SEQ ID NO: 907140 - RNA, 19 nt, Mycobacterium avium subsp. paratuberculosis
gcccgccaaaacggggugg

SEQ ID NO: 907141 - RNA, 19 nt, Mycobacterium avium subsp. paratuberculosis
gcccgaucucgcgcggguc

SEQ ID NO: 907142 - RNA, 24 nt, Mycobacterium avium subsp. paratuberculosis
gcccgaucucgcgcgggucgagca

SEQ ID NO: 907143 - RNA, 16 nt, Mycobacterium avium subsp. paratuberculosis
gcccgaucucgcgguc

SEQ ID NO: 907144 - RNA, 15 nt, Mycobacterium avium subsp. paratuberculosis
gcccgaucucgucgg

SEQ ID NO: 907145 - RNA, 16 nt, Mycobacterium avium subsp. paratuberculosis
gcccgaucucgucggu

SEQ ID NO: 907146 - RNA, 18 nt, Mycobacterium avium subsp. paratuberculosis
gcccgaucucgucgguga

SEQ ID NO: 907147 - RNA, 15 nt, Mycobacterium avium subsp. paratuberculosis
gcccgaugccgccga

SEQ ID NO: 907148 - RNA, 17 nt, Mycobacterium avium subsp. paratuberculosis
gcccgaugccgccgagg

SEQ ID NO: 907149 - RNA, 19 nt, Mycobacterium avium subsp. paratuberculosis
gcccgaugccgccgagggc

SEQ ID NO: 907150 - RNA, 16 nt, Mycobacterium avium subsp. paratuberculosis
gcccgagucacccggc

SEQ ID NO: 907151 - RNA, 17 nt, Mycobacterium avium subsp. paratuberculosis
gcccgagucacccggcu

SEQ ID NO: 907152 - RNA, 12 nt, Mycobacterium avium subsp. paratuberculosis
gcccgaucgcgg

SEQ ID NO: 907153 - RNA, 18 nt, Mycobacterium avium subsp. paratuberculosis
gcccgaucgcgucgacga

SEQ ID NO: 907154 - RNA, 20 nt, Mycobacterium avium subsp. paratuberculosis
gcccgaggucauaucgacgg

SEQ ID NO: 907155 - RNA, 21 nt, Mycobacterium avium subsp. paratuberculosis
gcccgaggucauaucgacggc

SEQ ID NO: 907156 - RNA, 18 nt, Mycobacterium avium subsp. paratuberculosis
gcccgagguccucgcgca

SEQ ID NO: 907157 - RNA, 16 nt, Mycobacterium avium subsp. paratuberculosis
gcccgagcugaucgcg

SEQ ID NO: 907158 - RNA, 17 nt, Mycobacterium avium subsp. paratuberculosis
gcccgagcugaucgcgg

SEQ ID NO: 907159 - RNA, 20 nt, Mycobacterium avium subsp. paratuberculosis
gcccgagcugaucgcggccg

SEQ ID NO: 907160 - RNA, 13 nt, Mycobacterium avium subsp. paratuberculosis
gcccgagcgucac

SEQ ID NO: 907161 - RNA, 14 nt, Mycobacterium avium subsp. paratuberculosis
gcccgagcgucacg

SEQ ID NO: 907162 - RNA, 17 nt, Mycobacterium avium subsp. paratuberculosis
gcccgagcgucacgcca

SEQ ID NO: 907163 - RNA, 20 nt, Mycobacterium avium subsp. paratuberculosis
gcccgagcgucacgccagcg

SEQ ID NO: 907164 - RNA, 21 nt, Mycobacterium avium subsp. paratuberculosis
gcccgagcgucacgccagcgu

SEQ ID NO: 907165 - RNA, 22 nt, Mycobacterium avium subsp. paratuberculosis
gcccgagcgucacgccagcgug

SEQ ID NO: 907166 - RNA, 22 nt, Mycobacterium avium subsp. paratuberculosis
gcccgagcgucauuccgccgcg

SEQ ID NO: 907167 - RNA, 23 nt, Mycobacterium avium subsp. paratuberculosis
gcccgagcgucauuccgccgcgc

SEQ ID NO: 907168 - RNA, 13 nt, Mycobacterium avium subsp. paratuberculosis
gcccgacccggcu

SEQ ID NO: 907169 - RNA, 23 nt, Mycobacterium avium subsp. paratuberculosis
gcccgagcccugcgccagcagca

SEQ ID NO: 907170 - RNA, 20 nt, Mycobacterium avium subsp. paratuberculosis
gcccgacauccaggaccgcg

SEQ ID NO: 907171 - RNA, 21 nt, Mycobacterium avium subsp. paratuberculosis
gcccgacauccaggaccgcgc

SEQ ID NO: 907172 - RNA, 22 nt, Mycobacterium avium subsp. paratuberculosis
gcccgacauccaggaccgcgcg

SEQ ID NO: 907173 - RNA, 19 nt, Mycobacterium avium subsp. paratuberculosis
gcccgacaucugccgggcg

SEQ ID NO: 907174 - RNA, 23 nt, Mycobacterium avium subsp. paratuberculosis
gcccgacaucugccgggcggcga

SEQ ID NO: 907175 - RNA, 15 nt, Mycobacterium avium subsp. paratuberculosis
gcccgaccagcgggc

SEQ ID NO: 907176 - RNA, 16 nt, Mycobacterium avium subsp. paratuberculosis
gcccgaccagcgggcc

SEQ ID NO: 907177 - RNA, 17 nt, Mycobacterium avium subsp. paratuberculosis
gcccgaccagcgggccg

SEQ ID NO: 907178 - RNA, 18 nt, Mycobacterium avium subsp. paratuberculosis
gcccgaccagcgggccga

SEQ ID NO: 907179 - RNA, 23 nt, Mycobacterium avium subsp. paratuberculosis
gcccgacaccgccccgccgcgcc

SEQ ID NO: 907180 - RNA, 21 nt, Mycobacterium avium subsp. paratuberculosis
gcccgaauugcgcugcaccgc

SEQ ID NO: 907181 - RNA, 13 nt, Mycobacterium avium subsp. paratuberculosis
gcccgacccgcac

SEQ ID NO: 907182 - RNA, 15 nt, Mycobacterium avium subsp. paratuberculosis
gcccgacccgcacca

SEQ ID NO: 907183 - RNA, 16 nt, Mycobacterium avium subsp. paratuberculosis
gcccgacccgcaccac

SEQ ID NO: 907184 - RNA, 17 nt, Mycobacterium avium subsp. paratuberculosis
gcccgacccgcaccacc

SEQ ID NO: 907185 - RNA, 22 nt, Mycobacterium avium subsp. paratuberculosis
gcccgacccgcaccaccgcccg

SEQ ID NO: 907186 - RNA, 14 nt, Mycobacterium avium subsp. paratuberculosis
gcccgacaccgccc

SEQ ID NO: 907187 - RNA, 18 nt, Mycobacterium avium subsp. paratuberculosis
gcccgaacgcgcgucggu

SEQ ID NO: 907188 - RNA, 19 nt, Mycobacterium avium subsp. paratuberculosis
gcccgaacucauggcgugc

SEQ ID NO: 907189 - RNA, 18 nt, Mycobacterium avium subsp. paratuberculosis
gcccccugggacagcgag

SEQ ID NO: 907190 - RNA, 16 nt, Mycobacterium avium subsp. paratuberculosis
gccccgaacagcgcca

SEQ ID NO: 907191 - RNA, 17 nt, Mycobacterium avium subsp. paratuberculosis
gcccccugcucagcggc

SEQ ID NO: 907192 - RNA, 15 nt, Mycobacterium avium subsp. paratuberculosis
gcccccucggccggu

SEQ ID NO: 907193 - RNA, 18 nt, Mycobacterium avium subsp. paratuberculosis
gcccccucggccgguccg

SEQ ID NO: 907194 - RNA, 21 nt, Mycobacterium avium subsp. paratuberculosis
gcccccguuggacauuccggu

SEQ ID NO: 907195 - RNA, 20 nt, Mycobacterium avium subsp. paratuberculosis
gccccgcgacacgccgcgca

SEQ ID NO: 907196 - RNA, 14 nt, Mycobacterium avium subsp. paratuberculosis
gccccgcgaccgca

SEQ ID NO: 907197 - RNA, 16 nt, Mycobacterium avium subsp. paratuberculosis
gccccgccgcgccggg

SEQ ID NO: 907198 - RNA, 18 nt, Mycobacterium avium subsp. paratuberculosis
gccccgccgcgccgggcg

SEQ ID NO: 907199 - RNA, 15 nt, Mycobacterium avium subsp. paratuberculosis
gccccgccgcggcca

SEQ ID NO: 907200 - RNA, 18 nt, Mycobacterium avium subsp. paratuberculosis
gccccgacagcaacgcca

SEQ ID NO: 907201 - RNA, 18 nt, Mycobacterium avium subsp. paratuberculosis
gccccgacaucgccauca

SEQ ID NO: 907202 - RNA, 20 nt, Mycobacterium avium subsp. paratuberculosis
gccccgccggugucggcgac

SEQ ID NO: 907203 - RNA, 21 nt, Mycobacterium avium subsp. paratuberculosis
gccccgccguuucagcagcgc

SEQ ID NO: 907204 - RNA, 23 nt, Mycobacterium avium subsp. paratuberculosis
gccccgccguuucagcagcgcgu

SEQ ID NO: 907205 - RNA, 15 nt, Mycobacterium avium subsp. paratuberculosis
gccccgcuccuccuc

SEQ ID NO: 907206 - RNA, 20 nt, Mycobacterium avium subsp. paratuberculosis
gccccgcuccuccucgcgcc

SEQ ID NO: 907207 - RNA, 21 nt, Mycobacterium avium subsp. paratuberculosis
gccccgcgcgaucaggccggc

SEQ ID NO: 907208 - RNA, 13 nt, Mycobacterium avium subsp. paratuberculosis
gccccgcgugacg

SEQ ID NO: 907209 - RNA, 17 nt, Mycobacterium avium subsp. paratuberculosis
gccccgcgugacggccg

SEQ ID NO: 907210 - RNA, 18 nt, Mycobacterium avium subsp. paratuberculosis
gccccgcgugacggccgc

SEQ ID NO: 907211 - RNA, 19 nt, Mycobacterium avium subsp. paratuberculosis
gccccgcgugacggccgcg

SEQ ID NO: 907212 - RNA, 22 nt, Mycobacterium avium subsp. paratuberculosis
gccccgcgugacggccgcggcg

SEQ ID NO: 907213 - RNA, 14 nt, Mycobacterium avium subsp. paratuberculosis
gccccggagauggu

SEQ ID NO: 907214 - RNA, 20 nt, Mycobacterium avium subsp. paratuberculosis
gccccggaguagaccuuguc

SEQ ID NO: 907215 - RNA, 19 nt, Mycobacterium avium subsp. paratuberculosis
gccccggauccgucgcccc

SEQ ID NO: 907216 - RNA, 23 nt, Mycobacterium avium subsp. paratuberculosis
gccccggauccgucgccccgcac

SEQ ID NO: 907217 - RNA, 15 nt, Mycobacterium avium subsp. paratuberculosis
gccccgcugccgucc

SEQ ID NO: 907218 - RNA, 16 nt, Mycobacterium avium subsp. paratuberculosis
gccccgcugccguccg

SEQ ID NO: 907219 - RNA, 19 nt, Mycobacterium avium subsp. paratuberculosis
gccccgcugccguccggcg

SEQ ID NO: 907220 - RNA, 20 nt, Mycobacterium avium subsp. paratuberculosis
gccccgcugccguccggcgg

SEQ ID NO: 907221 - RNA, 15 nt, Mycobacterium avium subsp. paratuberculosis
gccccggccgcggug

SEQ ID NO: 907222 - RNA, 17 nt, Mycobacterium avium subsp. paratuberculosis
gccccggccgcggugac

SEQ ID NO: 907223 - RNA, 18 nt, Mycobacterium avium subsp. paratuberculosis
gccccggccgcggugacc

SEQ ID NO: 907224 - RNA, 13 nt, Mycobacterium avium subsp. paratuberculosis
gccccggccggcg

SEQ ID NO: 907225 - RNA, 14 nt, Mycobacterium avium subsp. paratuberculosis
gccccggccggcgg

SEQ ID NO: 907226 - RNA, 15 nt, Mycobacterium avium subsp. paratuberculosis
gccccggccggcggg

SEQ ID NO: 907227 - RNA, 16 nt, Mycobacterium avium subsp. paratuberculosis
gccccggccggcgggu

SEQ ID NO: 907228 - RNA, 14 nt, Mycobacterium avium subsp. paratuberculosis
gccccggccgggcg

SEQ ID NO: 907229 - RNA, 19 nt, Mycobacterium avium subsp. paratuberculosis
gccccggccgggcgacugc

SEQ ID NO: 907230 - RNA, 15 nt, Mycobacterium avium subsp. paratuberculosis
gccccggcgaacgcc

SEQ ID NO: 907231 - RNA, 19 nt, Mycobacterium avium subsp. paratuberculosis
gccccggcgacggcggccg

SEQ ID NO: 907232 - RNA, 15 nt, Mycobacterium avium subsp. paratuberculosis
gccccggcgacgucg

SEQ ID NO: 907233 - RNA, 16 nt, Mycobacterium avium subsp. paratuberculosis
gccccggcgacgucgc

SEQ ID NO: 907234 - RNA, 23 nt, Mycobacterium avium subsp. paratuberculosis
gccccggcaucgacaugcccggc

SEQ ID NO: 907235 - RNA, 14 nt, Mycobacterium avium subsp. paratuberculosis
gccccggcccggcg

SEQ ID NO: 907236 - RNA, 13 nt, Mycobacterium avium subsp. paratuberculosis
gccccggcccguc

SEQ ID NO: 907237 - RNA, 12 nt, Mycobacterium avium subsp. paratuberculosis
gccccuccagcc

SEQ ID NO: 907238 - RNA, 14 nt, Mycobacterium avium subsp. paratuberculosis
gccccuccagccgc

SEQ ID NO: 907239 - RNA, 16 nt, Mycobacterium avium subsp. paratuberculosis
gccccucccaccacgg

SEQ ID NO: 907240 - RNA, 23 nt, Mycobacterium avium subsp. paratuberculosis
gccccucauugggaccggugcgg

SEQ ID NO: 907241 - RNA, 14 nt, Mycobacterium avium subsp. paratuberculosis
gccccucgacccga

SEQ ID NO: 907242 - RNA, 12 nt, Mycobacterium avium subsp. paratuberculosis
gccccucgacga

SEQ ID NO: 907243 - RNA, 16 nt, Mycobacterium avium subsp. paratuberculosis
gccccucgacgaacgc

SEQ ID NO: 907244 - RNA, 20 nt, Mycobacterium avium subsp. paratuberculosis
gccccucgacgaacgcggcg

SEQ ID NO: 907245 - RNA, 15 nt, Mycobacterium avium subsp. paratuberculosis
gccccucgacgucca

SEQ ID NO: 907246 - RNA, 14 nt, Mycobacterium avium subsp. paratuberculosis
gccccucgccgggc

SEQ ID NO: 907247 - RNA, 15 nt, Mycobacterium avium subsp. paratuberculosis
gccccucgccgggcg

SEQ ID NO: 907248 - RNA, 16 nt, Mycobacterium avium subsp. paratuberculosis
gcccgaaaguccccgg

SEQ ID NO: 907249 - RNA, 13 nt, Mycobacterium avium subsp. paratuberculosis
gcccgaacagccg

SEQ ID NO: 907250 - RNA, 21 nt, Mycobacterium avium subsp. paratuberculosis
gcccgaacagccgggccagca

SEQ ID NO: 907251 - RNA, 21 nt, Mycobacterium avium subsp. paratuberculosis
gcccgaacaucgccucggccg

SEQ ID NO: 907252 - RNA, 17 nt, Mycobacterium avium subsp. paratuberculosis
gcccgaaaacgcccggg

SEQ ID NO: 907253 - RNA, 18 nt, Mycobacterium avium subsp. paratuberculosis
gcccgaaaacgcccgggu

SEQ ID NO: 907254 - RNA, 20 nt, Mycobacterium avium subsp. paratuberculosis
gcccgaaaacgcccggguga

SEQ ID NO: 907255 - RNA, 21 nt, Mycobacterium avium subsp. paratuberculosis
gccccuucgaugucgccggcg

SEQ ID NO: 907256 - RNA, 23 nt, Mycobacterium avium subsp. paratuberculosis
gccccguuggugcggugcaucgu

SEQ ID NO: 907257 - RNA, 19 nt, Mycobacterium avium subsp. paratuberculosis
gccccgguagccagcaccg

SEQ ID NO: 907258 - RNA, 17 nt, Mycobacterium avium subsp. paratuberculosis
gccccgggggaccagcg

SEQ ID NO: 907259 - RNA, 16 nt, Mycobacterium avium subsp. paratuberculosis
gccccgggaaccagcc

SEQ ID NO: 907260 - RNA, 21 nt, Mycobacterium avium subsp. paratuberculosis
gccccgggaaccagcccaggu

SEQ ID NO: 907261 - RNA, 22 nt, Mycobacterium avium subsp. paratuberculosis
gccccgggauccgaggcgucag

SEQ ID NO: 907262 - RNA, 17 nt, Mycobacterium avium subsp. paratuberculosis
gccccgggccgcagggu

SEQ ID NO: 907263 - RNA, 16 nt, Mycobacterium avium subsp. paratuberculosis
gccccggcgucgauga

SEQ ID NO: 907264 - RNA, 20 nt, Mycobacterium avium subsp. paratuberculosis
gccccggcgucgaugaccuc

SEQ ID NO: 907265 - RNA, 15 nt, Mycobacterium avium subsp. paratuberculosis
gccccggcgucggag

SEQ ID NO: 907266 - RNA, 14 nt, Mycobacterium avium subsp. paratuberculosis
gccccggcgggcgg

SEQ ID NO: 907267 - RNA, 17 nt, Mycobacterium avium subsp. paratuberculosis
gccccggcgggcggccg

SEQ ID NO: 907268 - RNA, 18 nt, Mycobacterium avium subsp. paratuberculosis
gccccggcgggcggccga

SEQ ID NO: 907269 - RNA, 17 nt, Mycobacterium avium subsp. paratuberculosis
gccccggcgcgccugcg

SEQ ID NO: 907270 - RNA, 13 nt, Mycobacterium avium subsp. paratuberculosis
gccccggcgcagc

SEQ ID NO: 907271 - RNA, 18 nt, Mycobacterium avium subsp. paratuberculosis
gccccggcgcagcgccgc

SEQ ID NO: 907272 - RNA, 21 nt, Mycobacterium avium subsp. paratuberculosis
gccccggcgcagcgccgcgcc

SEQ ID NO: 907273 - RNA, 15 nt, Mycobacterium avium subsp. paratuberculosis
gcccggguagcgcag

SEQ ID NO: 907274 - RNA, 20 nt, Mycobacterium avium subsp. paratuberculosis
gcccgggugcaggcccagcu

SEQ ID NO: 907275 - RNA, 13 nt, Mycobacterium avium subsp. paratuberculosis
gcccgggugcgcu

SEQ ID NO: 907276 - RNA, 21 nt, Mycobacterium avium subsp. paratuberculosis
gcccggguggacgcccgcgag

SEQ ID NO: 907277 - RNA, 19 nt, Mycobacterium avium subsp. paratuberculosis
gcccgggucgucggugccg

SEQ ID NO: 907278 - RNA, 16 nt, Mycobacterium avium subsp. paratuberculosis
gcccgggucgugcggc

SEQ ID NO: 907279 - RNA, 19 nt, Mycobacterium avium subsp. paratuberculosis
gcccgggucgugcggcggc

SEQ ID NO: 907280 - RNA, 15 nt, Mycobacterium avium subsp. paratuberculosis
gcccgggcugcagca

SEQ ID NO: 907281 - RNA, 18 nt, Mycobacterium avium subsp. paratuberculosis
gcccgggcugcagcagcg

SEQ ID NO: 907282 - RNA, 14 nt, Mycobacterium avium subsp. paratuberculosis
gcccggggcggcga

SEQ ID NO: 907283 - RNA, 16 nt, Mycobacterium avium subsp. paratuberculosis
gcccggggcggcgaug

SEQ ID NO: 907284 - RNA, 20 nt, Mycobacterium avium subsp. paratuberculosis
gcccggggguggcggucccg

SEQ ID NO: 907285 - RNA, 19 nt, Mycobacterium avium subsp. paratuberculosis
gcccgggguccaccggccg

SEQ ID NO: 907286 - RNA, 20 nt, Mycobacterium avium subsp. paratuberculosis
gcccgggguccaccggccga

SEQ ID NO: 907287 - RNA, 18 nt, Mycobacterium avium subsp. paratuberculosis
gcccggggugaugccggc

SEQ ID NO: 907288 - RNA, 14 nt, Mycobacterium avium subsp. paratuberculosis
gcccggggcgcgga

SEQ ID NO: 907289 - RNA, 17 nt, Mycobacterium avium subsp. paratuberculosis
gcccggggcgcggaccg

SEQ ID NO: 907290 - RNA, 23 nt, Mycobacterium avium subsp. paratuberculosis
gcccgggcuguugaccacggccu

SEQ ID NO: 907291 - RNA, 21 nt, Mycobacterium avium subsp. paratuberculosis
gcccgggcgacuucguuggug

SEQ ID NO: 907292 - RNA, 13 nt, Mycobacterium avium subsp. paratuberculosis
gcccgggcgccga

SEQ ID NO: 907293 - RNA, 17 nt, Mycobacterium avium subsp. paratuberculosis
gcccgggcggcccgcau

SEQ ID NO: 907294 - RNA, 20 nt, Mycobacterium avium subsp. paratuberculosis
gcccgggcggcccgcaucga

SEQ ID NO: 907295 - RNA, 17 nt, Mycobacterium avium subsp. paratuberculosis
gcccgggcggcccgggu

SEQ ID NO: 907296 - RNA, 13 nt, Mycobacterium avium subsp. paratuberculosis
gcccgggcggcga

SEQ ID NO: 907297 - RNA, 23 nt, Mycobacterium avium subsp. paratuberculosis
gcccgggcggcgaguccggccag

SEQ ID NO: 907298 - RNA, 14 nt, Mycobacterium avium subsp. paratuberculosis
gcccgggcggcggg

SEQ ID NO: 907299 - RNA, 16 nt, Mycobacterium avium subsp. paratuberculosis
gcccgggcggcggggc

SEQ ID NO: 907300 - RNA, 21 nt, Mycobacterium avium subsp. paratuberculosis
gcccgggcggcggggcugccc

SEQ ID NO: 907301 - RNA, 19 nt, Mycobacterium avium subsp. paratuberculosis
gcccgggcgcugagcacgg

SEQ ID NO: 907302 - RNA, 20 nt, Mycobacterium avium subsp. paratuberculosis
gcccgggcgcugagcacggu

SEQ ID NO: 907303 - RNA, 21 nt, Mycobacterium avium subsp. paratuberculosis
gcccgggccguaucggccccg

SEQ ID NO: 907304 - RNA, 19 nt, Mycobacterium avium subsp. paratuberculosis
gcccgggccgucaucgccg

SEQ ID NO: 907305 - RNA, 20 nt, Mycobacterium avium subsp. paratuberculosis
gcccgggccgucaucgccga

SEQ ID NO: 907306 - RNA, 14 nt, Mycobacterium avium subsp. paratuberculosis
gcccgggccguccg

SEQ ID NO: 907307 - RNA, 15 nt, Mycobacterium avium subsp. paratuberculosis
gcccgggcaucccgc

SEQ ID NO: 907308 - RNA, 16 nt, Mycobacterium avium subsp. paratuberculosis
gcccgggcaucccgcc

SEQ ID NO: 907309 - RNA, 17 nt, Mycobacterium avium subsp. paratuberculosis
gcccgggcaucccgccg

SEQ ID NO: 907310 - RNA, 18 nt, Mycobacterium avium subsp. paratuberculosis
gcccgggcaucccgccga

SEQ ID NO: 907311 - RNA, 17 nt, Mycobacterium avium subsp. paratuberculosis
gcccgggcacgacgguc

SEQ ID NO: 907312 - RNA, 18 nt, Mycobacterium avium subsp. paratuberculosis
gcccgggcacgacgguca

SEQ ID NO: 907313 - RNA, 17 nt, Mycobacterium avium subsp. paratuberculosis
gcccgggcaggcggcgc

SEQ ID NO: 907314 - RNA, 20 nt, Mycobacterium avium subsp. paratuberculosis
gcccgggccacacccgucga

SEQ ID NO: 907315 - RNA, 22 nt, Mycobacterium avium subsp. paratuberculosis
gcccgggccacacccgucgacu

SEQ ID NO: 907316 - RNA, 13 nt, Mycobacterium avium subsp. paratuberculosis
gcccgggccagga

SEQ ID NO: 907317 - RNA, 16 nt, Mycobacterium avium subsp. paratuberculosis
gcccgggccaggcgcg

SEQ ID NO: 907318 - RNA, 14 nt, Mycobacterium avium subsp. paratuberculosis
gcccgggccagguc

SEQ ID NO: 907319 - RNA, 19 nt, Mycobacterium avium subsp. paratuberculosis
gcccgggccaggucgguga

SEQ ID NO: 907320 - RNA, 12 nt, Mycobacterium avium subsp. paratuberculosis
gcccgggcccgu

SEQ ID NO: 907321 - RNA, 12 nt, Mycobacterium avium subsp. paratuberculosis
gcccgggccgca

SEQ ID NO: 907322 - RNA, 20 nt, Mycobacterium avium subsp. paratuberculosis
gcccgggccgcgcccagugu

SEQ ID NO: 907323 - RNA, 22 nt, Mycobacterium avium subsp. paratuberculosis
gcccgggccggaggugcggguc

SEQ ID NO: 907324 - RNA, 16 nt, Mycobacterium avium subsp. paratuberculosis
gcccggcucgccgggc

SEQ ID NO: 907325 - RNA, 18 nt, Mycobacterium avium subsp. paratuberculosis
gcccggcuggcaggucgc

SEQ ID NO: 907326 - RNA, 19 nt, Mycobacterium avium subsp. paratuberculosis
gcccggcugggcgcgcaac

SEQ ID NO: 907327 - RNA, 18 nt, Mycobacterium avium subsp. paratuberculosis
gcccggcuucgccgccgc

SEQ ID NO: 907328 - RNA, 19 nt, Mycobacterium avium subsp. paratuberculosis
gcccggcuucgccgccgca

SEQ ID NO: 907329 - RNA, 16 nt, Mycobacterium avium subsp. paratuberculosis
gcccggcuucgccgcg

SEQ ID NO: 907330 - RNA, 18 nt, Mycobacterium avium subsp. paratuberculosis
gcccggcuucgccgcgcu

SEQ ID NO: 907331 - RNA, 17 nt, Mycobacterium avium subsp. paratuberculosis
gcccgggaagccgcagc

SEQ ID NO: 907332 - RNA, 20 nt, Mycobacterium avium subsp. paratuberculosis
gcccgggaagcuggugguga

SEQ ID NO: 907333 - RNA, 23 nt, Mycobacterium avium subsp. paratuberculosis
gcccgucccggcccauggcgaac

SEQ ID NO: 907334 - RNA, 16 nt, Mycobacterium avium subsp. paratuberculosis
gcccgucccugcgcgg

SEQ ID NO: 907335 - RNA, 17 nt, Mycobacterium avium subsp. paratuberculosis
gcccgucccugcgcgga

SEQ ID NO: 907336 - RNA, 15 nt, Mycobacterium avium subsp. paratuberculosis
gcccguccgccccgc

SEQ ID NO: 907337 - RNA, 16 nt, Mycobacterium avium subsp. paratuberculosis
gcccguccgccccgcu

SEQ ID NO: 907338 - RNA, 23 nt, Mycobacterium avium subsp. paratuberculosis
gcccgucgaccuccucgaccccg

SEQ ID NO: 907339 - RNA, 13 nt, Mycobacterium avium subsp. paratuberculosis
gcccgucgacguc

SEQ ID NO: 907340 - RNA, 15 nt, Mycobacterium avium subsp. paratuberculosis
gcccgucgacgucga

SEQ ID NO: 907341 - RNA, 13 nt, Mycobacterium avium subsp. paratuberculosis
gcccgucgagcgu

SEQ ID NO: 907342 - RNA, 14 nt, Mycobacterium avium subsp. paratuberculosis
gcccgucgagcguc

SEQ ID NO: 907343 - RNA, 16 nt, Mycobacterium avium subsp. paratuberculosis
gcccgucgagcgucac

SEQ ID NO: 907344 - RNA, 16 nt, Mycobacterium avium subsp. paratuberculosis
gcccgucgaucccgga

SEQ ID NO: 907345 - RNA, 13 nt, Mycobacterium avium subsp. paratuberculosis
gcccgucgccacc

SEQ ID NO: 907346 - RNA, 14 nt, Mycobacterium avium subsp. paratuberculosis
gcccgucgccacca

SEQ ID NO: 907347 - RNA, 17 nt, Mycobacterium avium subsp. paratuberculosis
gcccgucgccaccacgg

SEQ ID NO: 907348 - RNA, 13 nt, Mycobacterium avium subsp. paratuberculosis
gcccgucgccgau

SEQ ID NO: 907349 - RNA, 14 nt, Mycobacterium avium subsp. paratuberculosis
gcccgucgccgauc

SEQ ID NO: 907350 - RNA, 22 nt, Mycobacterium avium subsp. paratuberculosis
gcccgucgccgaucagcaccag

SEQ ID NO: 907351 - RNA, 20 nt, Mycobacterium avium subsp. paratuberculosis
gcccgucgccggcgcgcagc

SEQ ID NO: 907352 - RNA, 15 nt, Mycobacterium avium subsp. paratuberculosis
gcccgucgccuccga

SEQ ID NO: 907353 - RNA, 22 nt, Mycobacterium avium subsp. paratuberculosis
gcccgucgccuccugcuggcgc

SEQ ID NO: 907354 - RNA, 13 nt, Mycobacterium avium subsp. paratuberculosis
gcccgucgcgcaa

SEQ ID NO: 907355 - RNA, 21 nt, Mycobacterium avium subsp. paratuberculosis
gcccgucgcgucccuggcgau

SEQ ID NO: 907356 - RNA, 22 nt, Mycobacterium avium subsp. paratuberculosis
gcccgucggaggacaacgcguc

SEQ ID NO: 907357 - RNA, 17 nt, Mycobacterium avium subsp. paratuberculosis
gcccgucggcaacgccg

SEQ ID NO: 907358 - RNA, 12 nt, Mycobacterium avium subsp. paratuberculosis
gcccgucggccu

SEQ ID NO: 907359 - RNA, 17 nt, Mycobacterium avium subsp. paratuberculosis
gcccgucggccucggcg

SEQ ID NO: 907360 - RNA, 12 nt, Mycobacterium avium subsp. paratuberculosis
gcccgucggcgu

SEQ ID NO: 907361 - RNA, 14 nt, Mycobacterium avium subsp. paratuberculosis
gcccgucggcguga

SEQ ID NO: 907362 - RNA, 13 nt, Mycobacterium avium subsp. paratuberculosis
gcccgucgggcgc

SEQ ID NO: 907363 - RNA, 14 nt, Mycobacterium avium subsp. paratuberculosis
gcccgucgggcgcg

SEQ ID NO: 907364 - RNA, 18 nt, Mycobacterium avium subsp. paratuberculosis
gcccgucggggcccggcc

SEQ ID NO: 907365 - RNA, 20 nt, Mycobacterium avium subsp. paratuberculosis
gcccgucggggcccggcccg

SEQ ID NO: 907366 - RNA, 15 nt, Mycobacterium avium subsp. paratuberculosis
gcccgucgucgccga

SEQ ID NO: 907367 - RNA, 13 nt, Mycobacterium avium subsp. paratuberculosis
gcccgucccgccg

SEQ ID NO: 907368 - RNA, 14 nt, Mycobacterium avium subsp. paratuberculosis
gcccgucccgccga

SEQ ID NO: 907369 - RNA, 16 nt, Mycobacterium avium subsp. paratuberculosis
gcccgucccgccgacg

SEQ ID NO: 907370 - RNA, 16 nt, Mycobacterium avium subsp. paratuberculosis
gcccgucaggccucga

SEQ ID NO: 907371 - RNA, 21 nt, Mycobacterium avium subsp. paratuberculosis
gcccgucaggccucgaggauc

SEQ ID NO: 907372 - RNA, 20 nt, Mycobacterium avium subsp. paratuberculosis
gcccguccagaucggccagc

SEQ ID NO: 907373 - RNA, 21 nt, Mycobacterium avium subsp. paratuberculosis
gcccguccagaucggccagcg

SEQ ID NO: 907374 - RNA, 22 nt, Mycobacterium avium subsp. paratuberculosis
gcccguccagaucggccagcgc

SEQ ID NO: 907375 - RNA, 23 nt, Mycobacterium avium subsp. paratuberculosis
gcccguccagaucggccagcgcg

SEQ ID NO: 907376 - RNA, 13 nt, Mycobacterium avium subsp. paratuberculosis
gcccguccagcgc

SEQ ID NO: 907377 - RNA, 17 nt, Mycobacterium avium subsp. paratuberculosis
gcccguccccaccaccg

SEQ ID NO: 907378 - RNA, 13 nt, Mycobacterium avium subsp. paratuberculosis
gcccggucacccg

SEQ ID NO: 907379 - RNA, 19 nt, Mycobacterium avium subsp. paratuberculosis
gcccggucaggaacccggc

SEQ ID NO: 907380 - RNA, 23 nt, Mycobacterium avium subsp. paratuberculosis
gcccggucaggaacccggcccgg

SEQ ID NO: 907381 - RNA, 13 nt, Mycobacterium avium subsp. paratuberculosis
gcccgggcucgca

SEQ ID NO: 907382 - RNA, 12 nt, Mycobacterium avium subsp. paratuberculosis
gcccgucacgcu

SEQ ID NO: 907383 - RNA, 19 nt, Mycobacterium avium subsp. paratuberculosis
gcccgucacgcuggcguga

SEQ ID NO: 907384 - RNA, 20 nt, Mycobacterium avium subsp. paratuberculosis
gcccgucacgcuggcgugac

SEQ ID NO: 907385 - RNA, 17 nt, Mycobacterium avium subsp. paratuberculosis
gcccgucacggccgucc

SEQ ID NO: 907386 - RNA, 12 nt, Mycobacterium avium subsp. paratuberculosis
gcccggguggcg

SEQ ID NO: 907387 - RNA, 16 nt, Mycobacterium avium subsp. paratuberculosis
gcccgguacagcgccg

SEQ ID NO: 907388 - RNA, 16 nt, Mycobacterium avium subsp. paratuberculosis
gcccgguacaucgacg

SEQ ID NO: 907389 - RNA, 14 nt, Mycobacterium avium subsp. paratuberculosis
gcccgguaggccgc

SEQ ID NO: 907390 - RNA, 16 nt, Mycobacterium avium subsp. paratuberculosis
gcccgguaggccgccg

SEQ ID NO: 907391 - RNA, 17 nt, Mycobacterium avium subsp. paratuberculosis
gcccgguaggccgccgc

SEQ ID NO: 907392 - RNA, 19 nt, Mycobacterium avium subsp. paratuberculosis
gcccgguaggccgccgcga

SEQ ID NO: 907393 - RNA, 22 nt, Mycobacterium avium subsp. paratuberculosis
gcccgguaggccgccgcgaccg

SEQ ID NO: 907394 - RNA, 16 nt, Mycobacterium avium subsp. paratuberculosis
gcccggguugucgacg

SEQ ID NO: 907395 - RNA, 17 nt, Mycobacterium avium subsp. paratuberculosis
gcccggguugucgacgu

SEQ ID NO: 907396 - RNA, 16 nt, Mycobacterium avium subsp. paratuberculosis
gcccgggugugggcgc

SEQ ID NO: 907397 - RNA, 18 nt, Mycobacterium avium subsp. paratuberculosis
gcccgggugugggcgccg

SEQ ID NO: 907398 - RNA, 21 nt, Mycobacterium avium subsp. paratuberculosis
gcccgggugugggcgccguca

SEQ ID NO: 907399 - RNA, 21 nt, Mycobacterium avium subsp. paratuberculosis
gcccggguugcacaggucgau

SEQ ID NO: 907400 - RNA, 14 nt, Mycobacterium avium subsp. paratuberculosis
gcccggcgagcgac

SEQ ID NO: 907401 - RNA, 18 nt, Mycobacterium avium subsp. paratuberculosis
gcccggcgagcgacgcca

SEQ ID NO: 907402 - RNA, 20 nt, Mycobacterium avium subsp. paratuberculosis
gcccggcgagcgacgccacg

SEQ ID NO: 907403 - RNA, 15 nt, Mycobacterium avium subsp. paratuberculosis
gcccggcgacgcggc

SEQ ID NO: 907404 - RNA, 18 nt, Mycobacterium avium subsp. paratuberculosis
gcccggcgacgcggcggg

SEQ ID NO: 907405 - RNA, 21 nt, Mycobacterium avium subsp. paratuberculosis
gcccggcgacgcggcgggaaa

SEQ ID NO: 907406 - RNA, 15 nt, Mycobacterium avium subsp. paratuberculosis
gcccggcgacggcgc

SEQ ID NO: 907407 - RNA, 13 nt, Mycobacterium avium subsp. paratuberculosis
gcccggcgacguc

SEQ ID NO: 907408 - RNA, 17 nt, Mycobacterium avium subsp. paratuberculosis
gcccggcgacgucgucg

SEQ ID NO: 907409 - RNA, 18 nt, Mycobacterium avium subsp. paratuberculosis
gcccggcgacgucgucga

SEQ ID NO: 907410 - RNA, 23 nt, Mycobacterium avium subsp. paratuberculosis
gcccggcgacgucgucgaugccg

SEQ ID NO: 907411 - RNA, 15 nt, Mycobacterium avium subsp. paratuberculosis
gcccggcgagcagcc

SEQ ID NO: 907412 - RNA, 17 nt, Mycobacterium avium subsp. paratuberculosis
gcccggcgagcagcccg

SEQ ID NO: 907413 - RNA, 15 nt, Mycobacterium avium subsp. paratuberculosis
gcccggcgaugauca

SEQ ID NO: 907414 - RNA, 15 nt, Mycobacterium avium subsp. paratuberculosis
gcccggcgaugccga

SEQ ID NO: 907415 - RNA, 13 nt, Mycobacterium avium subsp. paratuberculosis
gcccggcgauggc

SEQ ID NO: 907416 - RNA, 12 nt, Mycobacterium avium subsp. paratuberculosis
gcccggcgaugu

SEQ ID NO: 907417 - RNA, 14 nt, Mycobacterium avium subsp. paratuberculosis
gcccggcgaugucg

SEQ ID NO: 907418 - RNA, 15 nt, Mycobacterium avium subsp. paratuberculosis
gcccggcgaugucgg

SEQ ID NO: 907419 - RNA, 17 nt, Mycobacterium avium subsp. paratuberculosis
gcccggcgaugucgggc

SEQ ID NO: 907420 - RNA, 17 nt, Mycobacterium avium subsp. paratuberculosis
gcccggccggucgccga

SEQ ID NO: 907421 - RNA, 23 nt, Mycobacterium avium subsp. paratuberculosis
gcccggccggugcuuggcguuga

SEQ ID NO: 907422 - RNA, 20 nt, Mycobacterium avium subsp. paratuberculosis
gcccggccguaucggccaaa

SEQ ID NO: 907423 - RNA, 20 nt, Mycobacterium avium subsp. paratuberculosis
gcccggcgaaucagcagcuu

SEQ ID NO: 907424 - RNA, 18 nt, Mycobacterium avium subsp. paratuberculosis
gcccggcgaccaccagcc

SEQ ID NO: 907425 - RNA, 19 nt, Mycobacterium avium subsp. paratuberculosis
gcccggcgaccaccagccg

SEQ ID NO: 907426 - RNA, 20 nt, Mycobacterium avium subsp. paratuberculosis
gcccggcgacgaagcagcuc

SEQ ID NO: 907427 - RNA, 15 nt, Mycobacterium avium subsp. paratuberculosis
gcccggccggcgcga

SEQ ID NO: 907428 - RNA, 11 nt, Mycobacterium avium subsp. paratuberculosis
gcccggccgcg

SEQ ID NO: 907429 - RNA, 13 nt, Mycobacterium avium subsp. paratuberculosis
gcccggccgccga

SEQ ID NO: 907430 - RNA, 15 nt, Mycobacterium avium subsp. paratuberculosis
gcccggcccggcgau

SEQ ID NO: 907431 - RNA, 16 nt, Mycobacterium avium subsp. paratuberculosis
gcccggcccggcgaug

SEQ ID NO: 907432 - RNA, 12 nt, Mycobacterium avium subsp. paratuberculosis
gcccggcccguc

SEQ ID NO: 907433 - RNA, 19 nt, Mycobacterium avium subsp. paratuberculosis
gcccggcccgucgagcggc

SEQ ID NO: 907434 - RNA, 23 nt, Mycobacterium avium subsp. paratuberculosis
gcccggccgaggucaccaccgag

SEQ ID NO: 907435 - RNA, 18 nt, Mycobacterium avium subsp. paratuberculosis
gcccggcccccugcucag

SEQ ID NO: 907436 - RNA, 23 nt, Mycobacterium avium subsp. paratuberculosis
gcccggcccccugcucagcggcc

SEQ ID NO: 907437 - RNA, 20 nt, Mycobacterium avium subsp. paratuberculosis
gcccggcccgccgcugcagc

SEQ ID NO: 907438 - RNA, 12 nt, Mycobacterium avium subsp. paratuberculosis
gcccggcccgcu

SEQ ID NO: 907439 - RNA, 14 nt, Mycobacterium avium subsp. paratuberculosis
gcccggccccaccg

SEQ ID NO: 907440 - RNA, 15 nt, Mycobacterium avium subsp. paratuberculosis
gcccggccccaccgc

SEQ ID NO: 907441 - RNA, 17 nt, Mycobacterium avium subsp. paratuberculosis
gcccggccccaccgccg

SEQ ID NO: 907442 - RNA, 13 nt, Mycobacterium avium subsp. paratuberculosis
gcccggcccaaga

SEQ ID NO: 907443 - RNA, 13 nt, Mycobacterium avium subsp. paratuberculosis
gcccggcccagcc

SEQ ID NO: 907444 - RNA, 16 nt, Mycobacterium avium subsp. paratuberculosis
gcccggcccagccgcu

SEQ ID NO: 907445 - RNA, 15 nt, Mycobacterium avium subsp. paratuberculosis
gcccggcccagccgg

SEQ ID NO: 907446 - RNA, 22 nt, Mycobacterium avium subsp. paratuberculosis
gcccggcccaggcacagcgaaa

SEQ ID NO: 907447 - RNA, 11 nt, Mycobacterium avium subsp. paratuberculosis
gcccggccacc

SEQ ID NO: 907448 - RNA, 12 nt, Mycobacterium avium subsp. paratuberculosis
gcccggccaccu

SEQ ID NO: 907449 - RNA, 17 nt, Mycobacterium avium subsp. paratuberculosis
gcccggccaccuggccg

SEQ ID NO: 907450 - RNA, 17 nt, Mycobacterium avium subsp. paratuberculosis
gcccggccacucgccgc

SEQ ID NO: 907451 - RNA, 13 nt, Mycobacterium avium subsp. paratuberculosis
gcccggccagcag

SEQ ID NO: 907452 - RNA, 22 nt, Mycobacterium avium subsp. paratuberculosis
gcccggccaguccggcagcagc

SEQ ID NO: 907453 - RNA, 21 nt, Mycobacterium avium subsp. paratuberculosis
gcccggccauaaagccgucgu

SEQ ID NO: 907454 - RNA, 16 nt, Mycobacterium avium subsp. paratuberculosis
gcccggccagcaggua

SEQ ID NO: 907455 - RNA, 17 nt, Mycobacterium avium subsp. paratuberculosis
gcccggccagccggccg

SEQ ID NO: 907456 - RNA, 18 nt, Mycobacterium avium subsp. paratuberculosis
gcccggccagccgggcgg

SEQ ID NO: 907457 - RNA, 19 nt, Mycobacterium avium subsp. paratuberculosis
gcccggccagccgggcggc

SEQ ID NO: 907458 - RNA, 15 nt, Mycobacterium avium subsp. paratuberculosis
gcccggccagccggu

SEQ ID NO: 907459 - RNA, 20 nt, Mycobacterium avium subsp. paratuberculosis
gcccggccagccgguaugcg

SEQ ID NO: 907460 - RNA, 17 nt, Mycobacterium avium subsp. paratuberculosis
gcccggccagcggcauc

SEQ ID NO: 907461 - RNA, 15 nt, Mycobacterium avium subsp. paratuberculosis
gcccggcuccacgau

SEQ ID NO: 907462 - RNA, 15 nt, Mycobacterium avium subsp. paratuberculosis
gcccggcucggugcg

SEQ ID NO: 907463 - RNA, 18 nt, Mycobacterium avium subsp. paratuberculosis
gcccggcucggugcgcca

SEQ ID NO: 907464 - RNA, 14 nt, Mycobacterium avium subsp. paratuberculosis
gcccggcugcgcag

SEQ ID NO: 907465 - RNA, 15 nt, Mycobacterium avium subsp. paratuberculosis
gcccggcugcgcagc

SEQ ID NO: 907466 - RNA, 13 nt, Mycobacterium avium subsp. paratuberculosis
gcccggcugcgcc

SEQ ID NO: 907467 - RNA, 16 nt, Mycobacterium avium subsp. paratuberculosis
gcccggcugcgccgcg

SEQ ID NO: 907468 - RNA, 17 nt, Mycobacterium avium subsp. paratuberculosis
gcccggcugcgccgcgc

SEQ ID NO: 907469 - RNA, 18 nt, Mycobacterium avium subsp. paratuberculosis
gcccggcguuccagcgca

SEQ ID NO: 907470 - RNA, 22 nt, Mycobacterium avium subsp. paratuberculosis
gcccggcguuggacagcucgac

SEQ ID NO: 907471 - RNA, 21 nt, Mycobacterium avium subsp. paratuberculosis
gcccggcuaauucgggccgcc

SEQ ID NO: 907472 - RNA, 14 nt, Mycobacterium avium subsp. paratuberculosis
gcccggcucaaacc

SEQ ID NO: 907473 - RNA, 22 nt, Mycobacterium avium subsp. paratuberculosis
gcccggcuacucggacgccggc

SEQ ID NO: 907474 - RNA, 21 nt, Mycobacterium avium subsp. paratuberculosis
gcccggcucagcgcgacgugc

SEQ ID NO: 907475 - RNA, 22 nt, Mycobacterium avium subsp. paratuberculosis
gcccggcguguaguacaggccg

SEQ ID NO: 907476 - RNA, 20 nt, Mycobacterium avium subsp. paratuberculosis
gcccggcggugccgaaccgg

SEQ ID NO: 907477 - RNA, 23 nt, Mycobacterium avium subsp. paratuberculosis
gcccggcguacagcaauccgcug

SEQ ID NO: 907478 - RNA, 13 nt, Mycobacterium avium subsp. paratuberculosis
gcccggcgucggu

SEQ ID NO: 907479 - RNA, 15 nt, Mycobacterium avium subsp. paratuberculosis
gcccggcgucggugg

SEQ ID NO: 907480 - RNA, 17 nt, Mycobacterium avium subsp. paratuberculosis
gcccggcgucacgcugg

SEQ ID NO: 907481 - RNA, 11 nt, Mycobacterium avium subsp. paratuberculosis
gcccggcgucc

SEQ ID NO: 907482 - RNA, 15 nt, Mycobacterium avium subsp. paratuberculosis
gcccggcguccugca

SEQ ID NO: 907483 - RNA, 18 nt, Mycobacterium avium subsp. paratuberculosis
gcccggcgggucagcacc

SEQ ID NO: 907484 - RNA, 19 nt, Mycobacterium avium subsp. paratuberculosis
gcccggcgggucagcaccg

SEQ ID NO: 907485 - RNA, 21 nt, Mycobacterium avium subsp. paratuberculosis
gcccggcgggucagcaccgcg

SEQ ID NO: 907486 - RNA, 15 nt, Mycobacterium avium subsp. paratuberculosis
gcccggcgggccacg

SEQ ID NO: 907487 - RNA, 13 nt, Mycobacterium avium subsp. paratuberculosis
gcccggcggccac

SEQ ID NO: 907488 - RNA, 17 nt, Mycobacterium avium subsp. paratuberculosis
gcccggcgcggcggcgc

SEQ ID NO: 907489 - RNA, 21 nt, Mycobacterium avium subsp. paratuberculosis
gcccggcgcggcggcgccgcg

SEQ ID NO: 907490 - RNA, 16 nt, Mycobacterium avium subsp. paratuberculosis
gcccggcgcuaaagcc

SEQ ID NO: 907491 - RNA, 21 nt, Mycobacterium avium subsp. paratuberculosis
gcccggcgcuaaagccgaccg

SEQ ID NO: 907492 - RNA, 16 nt, Mycobacterium avium subsp. paratuberculosis
gcccggcgcucaccgc

SEQ ID NO: 907493 - RNA, 18 nt, Mycobacterium avium subsp. paratuberculosis
gcccggcgcucaccgcga

SEQ ID NO: 907494 - RNA, 19 nt, Mycobacterium avium subsp. paratuberculosis
gcccggcgcugcgcccggu

SEQ ID NO: 907495 - RNA, 17 nt, Mycobacterium avium subsp. paratuberculosis
gcccggcgcggacagcg

SEQ ID NO: 907496 - RNA, 19 nt, Mycobacterium avium subsp. paratuberculosis
gcccggcgcggacagcgcg

SEQ ID NO: 907497 - RNA, 20 nt, Mycobacterium avium subsp. paratuberculosis
gcccggcgcggacagcgcgg

SEQ ID NO: 907498 - RNA, 12 nt, Mycobacterium avium subsp. paratuberculosis
gcccggcgcggc

SEQ ID NO: 907499 - RNA, 22 nt, Mycobacterium avium subsp. paratuberculosis
gcccggcgcggcaucggcgacg

SEQ ID NO: 907500 - RNA, 13 nt, Mycobacterium avium subsp. paratuberculosis
gcccggcgcggcc

SEQ ID NO: 907501 - RNA, 14 nt, Mycobacterium avium subsp. paratuberculosis
gcccggcgcggccg

SEQ ID NO: 907502 - RNA, 17 nt, Mycobacterium avium subsp. paratuberculosis
gcccggcgcggccggug

SEQ ID NO: 907503 - RNA, 19 nt, Mycobacterium avium subsp. paratuberculosis
gcccggcgcggccggugcg

SEQ ID NO: 907504 - RNA, 22 nt, Mycobacterium avium subsp. paratuberculosis
gcccggcgcggccggugcgcgu

SEQ ID NO: 907505 - RNA, 15 nt, Mycobacterium avium subsp. paratuberculosis
gcccggcgcggcggc

SEQ ID NO: 907506 - RNA, 15 nt, Mycobacterium avium subsp. paratuberculosis
gcccggcgcgccgca

SEQ ID NO: 907507 - RNA, 23 nt, Mycobacterium avium subsp. paratuberculosis
gcccggcgcgcagcccagccagc

SEQ ID NO: 907508 - RNA, 24 nt, Mycobacterium avium subsp. paratuberculosis
gcccggcgcgcagcccagccagcg

SEQ ID NO: 907509 - RNA, 19 nt, Mycobacterium avium subsp. paratuberculosis
gcccggcgcccggccggcc

SEQ ID NO: 907510 - RNA, 17 nt, Mycobacterium avium subsp. paratuberculosis
gcccggcgcccugcacc

SEQ ID NO: 907511 - RNA, 16 nt, Mycobacterium avium subsp. paratuberculosis
gcccggcgccccgcca

SEQ ID NO: 907512 - RNA, 13 nt, Mycobacterium avium subsp. paratuberculosis
gcccggcgcccgg

SEQ ID NO: 907513 - RNA, 15 nt, Mycobacterium avium subsp. paratuberculosis
gcccggcgccggacg

SEQ ID NO: 907514 - RNA, 13 nt, Mycobacterium avium subsp. paratuberculosis
gcccggcgccggc

SEQ ID NO: 907515 - RNA, 14 nt, Mycobacterium avium subsp. paratuberculosis
gcccggcgccggcc

SEQ ID NO: 907516 - RNA, 17 nt, Mycobacterium avium subsp. paratuberculosis
gcccggcgccggcccgc

SEQ ID NO: 907517 - RNA, 15 nt, Mycobacterium avium subsp. paratuberculosis
gcccggcgccggccg

SEQ ID NO: 907518 - RNA, 21 nt, Mycobacterium avium subsp. paratuberculosis
gcccggcgccggccgacaugg

SEQ ID NO: 907519 - RNA, 15 nt, Mycobacterium avium subsp. paratuberculosis
gcccggcgccggucg

SEQ ID NO: 907520 - RNA, 12 nt, Mycobacterium avium subsp. paratuberculosis
gcccggcgccac

SEQ ID NO: 907521 - RNA, 21 nt, Mycobacterium avium subsp. paratuberculosis
gcccggcgcacaggaacgcgu

SEQ ID NO: 907522 - RNA, 19 nt, Mycobacterium avium subsp. paratuberculosis
gcccggcaacacguagucg

SEQ ID NO: 907523 - RNA, 18 nt, Mycobacterium avium subsp. paratuberculosis
gcccggaucgccgaacgc

SEQ ID NO: 907524 - RNA, 22 nt, Mycobacterium avium subsp. paratuberculosis
gcccggaucgucuugcggccca

SEQ ID NO: 907525 - RNA, 14 nt, Mycobacterium avium subsp. paratuberculosis
gcccggaucagcug

SEQ ID NO: 907526 - RNA, 17 nt, Mycobacterium avium subsp. paratuberculosis
gcccggaucagcugacc

SEQ ID NO: 907527 - RNA, 23 nt, Mycobacterium avium subsp. paratuberculosis
gcccggaucagcugaccggcgau

SEQ ID NO: 907528 - RNA, 16 nt, Mycobacterium avium subsp. paratuberculosis
gcccggauggccgggc

SEQ ID NO: 907529 - RNA, 17 nt, Mycobacterium avium subsp. paratuberculosis
gcccggauggccgggca

SEQ ID NO: 907530 - RNA, 18 nt, Mycobacterium avium subsp. paratuberculosis
gcccggauggccgggcag

SEQ ID NO: 907531 - RNA, 13 nt, Mycobacterium avium subsp. paratuberculosis
gcccggaugucgg

SEQ ID NO: 907532 - RNA, 19 nt, Mycobacterium avium subsp. paratuberculosis
gcccggauucgcggcggcg

SEQ ID NO: 907533 - RNA, 20 nt, Mycobacterium avium subsp. paratuberculosis
gcccggauucgcggcggcgc

SEQ ID NO: 907534 - RNA, 21 nt, Mycobacterium avium subsp. paratuberculosis
gcccggauucgcggcggcgcc

SEQ ID NO: 907535 - RNA, 22 nt, Mycobacterium avium subsp. paratuberculosis
gcccggaccaggguggccccag

SEQ ID NO: 907536 - RNA, 12 nt, Mycobacterium avium subsp. paratuberculosis
gcccggacccgc

SEQ ID NO: 907537 - RNA, 17 nt, Mycobacterium avium subsp. paratuberculosis
gcccggacccgcucgcc

SEQ ID NO: 907538 - RNA, 18 nt, Mycobacterium avium subsp. paratuberculosis
gcccggacccgcucgccg

SEQ ID NO: 907539 - RNA, 13 nt, Mycobacterium avium subsp. paratuberculosis
gcccggaccgccg

SEQ ID NO: 907540 - RNA, 15 nt, Mycobacterium avium subsp. paratuberculosis
gcccggaccgccgcg

SEQ ID NO: 907541 - RNA, 14 nt, Mycobacterium avium subsp. paratuberculosis
gcccggaccgcggu

SEQ ID NO: 907542 - RNA, 16 nt, Mycobacterium avium subsp. paratuberculosis
gcccggaccggccgug

SEQ ID NO: 907543 - RNA, 17 nt, Mycobacterium avium subsp. paratuberculosis
gcccggaccggccgugc

SEQ ID NO: 907544 - RNA, 21 nt, Mycobacterium avium subsp. paratuberculosis
gcccggaccggccgugcgcgu

SEQ ID NO: 907545 - RNA, 18 nt, Mycobacterium avium subsp. paratuberculosis
gcccggacgaugccgcgg

SEQ ID NO: 907546 - RNA, 15 nt, Mycobacterium avium subsp. paratuberculosis
gcccggacgcgcaca

SEQ ID NO: 907547 - RNA, 23 nt, Mycobacterium avium subsp. paratuberculosis
gcccggacgcgcacacggccucg

SEQ ID NO: 907548 - RNA, 23 nt, Mycobacterium avium subsp. paratuberculosis
gcccggacggagccgugcccgag

SEQ ID NO: 907549 - RNA, 16 nt, Mycobacterium avium subsp. paratuberculosis
gcccggacggccaccu

SEQ ID NO: 907550 - RNA, 20 nt, Mycobacterium avium subsp. paratuberculosis
gcccggacggccaccuuguc

SEQ ID NO: 907551 - RNA, 19 nt, Mycobacterium avium subsp. paratuberculosis
gcccggacaccccguaggu

SEQ ID NO: 907552 - RNA, 15 nt, Mycobacterium avium subsp. paratuberculosis
gcccggagcugucgg

SEQ ID NO: 907553 - RNA, 17 nt, Mycobacterium avium subsp. paratuberculosis
gcccggagcugucggug

SEQ ID NO: 907554 - RNA, 15 nt, Mycobacterium avium subsp. paratuberculosis
gcccggaggcgaugc

SEQ ID NO: 907555 - RNA, 21 nt, Mycobacterium avium subsp. paratuberculosis
gcccggaggcgaugcggguca

SEQ ID NO: 907556 - RNA, 16 nt, Mycobacterium avium subsp. paratuberculosis
gcccggaguagccggu

SEQ ID NO: 907557 - RNA, 15 nt, Mycobacterium avium subsp. paratuberculosis
gcccggaguccggcu

SEQ ID NO: 907558 - RNA, 18 nt, Mycobacterium avium subsp. paratuberculosis
gcccggaguccggcucgg

SEQ ID NO: 907559 - RNA, 14 nt, Mycobacterium avium subsp. paratuberculosis
gcccggcagcgggg

SEQ ID NO: 907560 - RNA, 15 nt, Mycobacterium avium subsp. paratuberculosis
gcccggcagcggggc

SEQ ID NO: 907561 - RNA, 14 nt, Mycobacterium avium subsp. paratuberculosis
gcccggcagcgguc

SEQ ID NO: 907562 - RNA, 19 nt, Mycobacterium avium subsp. paratuberculosis
gcccggcacgaacgcgacg

SEQ ID NO: 907563 - RNA, 20 nt, Mycobacterium avium subsp. paratuberculosis
gcccggcacgaacgcgacga

SEQ ID NO: 907564 - RNA, 21 nt, Mycobacterium avium subsp. paratuberculosis
gcccggcacgaacgcgacgau

SEQ ID NO: 907565 - RNA, 13 nt, Mycobacterium avium subsp. paratuberculosis
gcccggcagccgg

SEQ ID NO: 907566 - RNA, 15 nt, Mycobacterium avium subsp. paratuberculosis
gcccggcagccgggg

SEQ ID NO: 907567 - RNA, 13 nt, Mycobacterium avium subsp. paratuberculosis
gcccggcaccgcg

SEQ ID NO: 907568 - RNA, 14 nt, Mycobacterium avium subsp. paratuberculosis
gcccggcaccgcgg

SEQ ID NO: 907569 - RNA, 21 nt, Mycobacterium avium subsp. paratuberculosis
gcccggcaccgcggcgguguc

SEQ ID NO: 907570 - RNA, 13 nt, Mycobacterium avium subsp. paratuberculosis
gcccgcgucgcgc

SEQ ID NO: 907571 - RNA, 13 nt, Mycobacterium avium subsp. paratuberculosis
gcccgcgugcaca

SEQ ID NO: 907572 - RNA, 15 nt, Mycobacterium avium subsp. paratuberculosis
gcccgcucaccugcg

SEQ ID NO: 907573 - RNA, 20 nt, Mycobacterium avium subsp. paratuberculosis
gcccgcucaccugcggcccg

SEQ ID NO: 907574 - RNA, 21 nt, Mycobacterium avium subsp. paratuberculosis
gcccgcucaccugcggcccgu

SEQ ID NO: 907575 - RNA, 19 nt, Mycobacterium avium subsp. paratuberculosis
gcccgcucagagcugcacc

SEQ ID NO: 907576 - RNA, 13 nt, Mycobacterium avium subsp. paratuberculosis
gcccgcuccgcgg

SEQ ID NO: 907577 - RNA, 15 nt, Mycobacterium avium subsp. paratuberculosis
gcccgcuccgcggug

SEQ ID NO: 907578 - RNA, 14 nt, Mycobacterium avium subsp. paratuberculosis
gcccgcuccggcgg

SEQ ID NO: 907579 - RNA, 16 nt, Mycobacterium avium subsp. paratuberculosis
gcccgcuccggcggac

SEQ ID NO: 907580 - RNA, 11 nt, Mycobacterium avium subsp. paratuberculosis
gcccgcugacc

SEQ ID NO: 907581 - RNA, 12 nt, Mycobacterium avium subsp. paratuberculosis
gcccgcugacca

SEQ ID NO: 907582 - RNA, 18 nt, Mycobacterium avium subsp. paratuberculosis
gcccgcugaccaggccga

SEQ ID NO: 907583 - RNA, 12 nt, Mycobacterium avium subsp. paratuberculosis
gcccgcucggcg

SEQ ID NO: 907584 - RNA, 14 nt, Mycobacterium avium subsp. paratuberculosis
gcccgcucggcggg

SEQ ID NO: 907585 - RNA, 16 nt, Mycobacterium avium subsp. paratuberculosis
gcccgcucgacggccg

SEQ ID NO: 907586 - RNA, 17 nt, Mycobacterium avium subsp. paratuberculosis
gcccgcucgacggccgg

SEQ ID NO: 907587 - RNA, 19 nt, Mycobacterium avium subsp. paratuberculosis
gcccggaacgcgucgccca

SEQ ID NO: 907588 - RNA, 16 nt, Mycobacterium avium subsp. paratuberculosis
gcccggaacggcgggc

SEQ ID NO: 907589 - RNA, 20 nt, Mycobacterium avium subsp. paratuberculosis
gcccggaaucgucggccacg

SEQ ID NO: 907590 - RNA, 19 nt, Mycobacterium avium subsp. paratuberculosis
gcccggaaaaccccacccc

SEQ ID NO: 907591 - RNA, 21 nt, Mycobacterium avium subsp. paratuberculosis
gcccggaaaaccccaccccga

SEQ ID NO: 907592 - RNA, 15 nt, Mycobacterium avium subsp. paratuberculosis
gcccggaaagcgcgg

SEQ ID NO: 907593 - RNA, 18 nt, Mycobacterium avium subsp. paratuberculosis
gcccgcuugauggcggcg

SEQ ID NO: 907594 - RNA, 19 nt, Mycobacterium avium subsp. paratuberculosis
gcccgcuugauggcggcgc

SEQ ID NO: 907595 - RNA, 16 nt, Mycobacterium avium subsp. paratuberculosis
gcccgcuugccgacgu

SEQ ID NO: 907596 - RNA, 13 nt, Mycobacterium avium subsp. paratuberculosis
gcccgcugcgcgg

SEQ ID NO: 907597 - RNA, 15 nt, Mycobacterium avium subsp. paratuberculosis
gcccgcugcgcggcc

SEQ ID NO: 907598 - RNA, 14 nt, Mycobacterium avium subsp. paratuberculosis
gcccgcugcggcaa

SEQ ID NO: 907599 - RNA, 13 nt, Mycobacterium avium subsp. paratuberculosis
gcccgcugcggcg

SEQ ID NO: 907600 - RNA, 14 nt, Mycobacterium avium subsp. paratuberculosis
gcccgcugcggcgc

SEQ ID NO: 907601 - RNA, 21 nt, Mycobacterium avium subsp. paratuberculosis
gcccgcugugguccucgucac

SEQ ID NO: 907602 - RNA, 12 nt, Mycobacterium avium subsp. paratuberculosis
gcccgcugcgcc

SEQ ID NO: 907603 - RNA, 15 nt, Mycobacterium avium subsp. paratuberculosis
gcccgcugcgccgac

SEQ ID NO: 907604 - RNA, 19 nt, Mycobacterium avium subsp. paratuberculosis
gcccgcugcgcggccgaac

SEQ ID NO: 907605 - RNA, 22 nt, Mycobacterium avium subsp. paratuberculosis
gcccgcugcgcgggucggcgcc

SEQ ID NO: 907606 - RNA, 14 nt, Mycobacterium avium subsp. paratuberculosis
gcccgcugaccgcc

SEQ ID NO: 907607 - RNA, 15 nt, Mycobacterium avium subsp. paratuberculosis
gcccgcugaccgccg

SEQ ID NO: 907608 - RNA, 19 nt, Mycobacterium avium subsp. paratuberculosis
gcccgcugaccgccgcgcu

SEQ ID NO: 907609 - RNA, 15 nt, Mycobacterium avium subsp. paratuberculosis
gcccgcugcagcgcc

SEQ ID NO: 907610 - RNA, 16 nt, Mycobacterium avium subsp. paratuberculosis
gcccgcugcagcgccg

SEQ ID NO: 907611 - RNA, 15 nt, Mycobacterium avium subsp. paratuberculosis
gcccgcgcgaucggc

SEQ ID NO: 907612 - RNA, 16 nt, Mycobacterium avium subsp. paratuberculosis
gcccgcgcgaucggcg

SEQ ID NO: 907613 - RNA, 19 nt, Mycobacterium avium subsp. paratuberculosis
gcccgcgcgaugcgggcgc

SEQ ID NO: 907614 - RNA, 21 nt, Mycobacterium avium subsp. paratuberculosis
gcccgcgcgaugcgggcgccg

SEQ ID NO: 907615 - RNA, 22 nt, Mycobacterium avium subsp. paratuberculosis
gcccgcgcgaugcgggcgccga

SEQ ID NO: 907616 - RNA, 17 nt, Mycobacterium avium subsp. paratuberculosis
gcccgcgcgagcgcagc

SEQ ID NO: 907617 - RNA, 15 nt, Mycobacterium avium subsp. paratuberculosis
gcccgcgcgcugacc

SEQ ID NO: 907618 - RNA, 17 nt, Mycobacterium avium subsp. paratuberculosis
gcccgcgcggccgccag

SEQ ID NO: 907619 - RNA, 15 nt, Mycobacterium avium subsp. paratuberculosis
gcccgcgcggcggcc

SEQ ID NO: 907620 - RNA, 19 nt, Mycobacterium avium subsp. paratuberculosis
gcccgcgcggcggccaacg

SEQ ID NO: 907621 - RNA, 12 nt, Mycobacterium avium subsp. paratuberculosis
gcccgcgcgugg

SEQ ID NO: 907622 - RNA, 22 nt, Mycobacterium avium subsp. paratuberculosis
gcccgcgcgugggccaacgcga

SEQ ID NO: 907623 - RNA, 15 nt, Mycobacterium avium subsp. paratuberculosis
gcccgcgcguggucc

SEQ ID NO: 907624 - RNA, 17 nt, Mycobacterium avium subsp. paratuberculosis
gcccgcgcgugguccca

SEQ ID NO: 907625 - RNA, 14 nt, Mycobacterium avium subsp. paratuberculosis
gcccgcggcgcgca

SEQ ID NO: 907626 - RNA, 21 nt, Mycobacterium avium subsp. paratuberculosis
gcccgcggcggauccagcacc

SEQ ID NO: 907627 - RNA, 14 nt, Mycobacterium avium subsp. paratuberculosis
gcccgcggccaucg

SEQ ID NO: 907628 - RNA, 13 nt, Mycobacterium avium subsp. paratuberculosis
gcccgcggccgcc

SEQ ID NO: 907629 - RNA, 12 nt, Mycobacterium avium subsp. paratuberculosis
gcccgcggcacg

SEQ ID NO: 907630 - RNA, 17 nt, Mycobacterium avium subsp. paratuberculosis
gcccgcggcacgcugcg

SEQ ID NO: 907631 - RNA, 22 nt, Mycobacterium avium subsp. paratuberculosis
gcccgcggcacgcugcgccagc

SEQ ID NO: 907632 - RNA, 21 nt, Mycobacterium avium subsp. paratuberculosis
gcccgcgcuggugcugcugcc

SEQ ID NO: 907633 - RNA, 15 nt, Mycobacterium avium subsp. paratuberculosis
gcccgcgcgggcugc

SEQ ID NO: 907634 - RNA, 17 nt, Mycobacterium avium subsp. paratuberculosis
gcccgcgcgggcugcag

SEQ ID NO: 907635 - RNA, 17 nt, Mycobacterium avium subsp. paratuberculosis
gcccgcgcgggguccca

SEQ ID NO: 907636 - RNA, 17 nt, Mycobacterium avium subsp. paratuberculosis
gcccgcguccugcagcg

SEQ ID NO: 907637 - RNA, 19 nt, Mycobacterium avium subsp. paratuberculosis
gcccgcguccugcagcgcc

SEQ ID NO: 907638 - RNA, 22 nt, Mycobacterium avium subsp. paratuberculosis
gcccgcguccugcagcgccguc

SEQ ID NO: 907639 - RNA, 17 nt, Mycobacterium avium subsp. paratuberculosis
gcccgcgucguggcccu

SEQ ID NO: 907640 - RNA, 22 nt, Mycobacterium avium subsp. paratuberculosis
gcccgcgucguggcccugcucg

SEQ ID NO: 907641 - RNA, 20 nt, Mycobacterium avium subsp. paratuberculosis
gcccgcgucguguccgggcc

SEQ ID NO: 907642 - RNA, 22 nt, Mycobacterium avium subsp. paratuberculosis
gcccgcgucguguccgggcccg

SEQ ID NO: 907643 - RNA, 14 nt, Mycobacterium avium subsp. paratuberculosis
gcccgcgucgcgca

SEQ ID NO: 907644 - RNA, 15 nt, Mycobacterium avium subsp. paratuberculosis
gcccgcgucgcgcag

SEQ ID NO: 907645 - RNA, 16 nt, Mycobacterium avium subsp. paratuberculosis
gcccgcgucgcgcagc

SEQ ID NO: 907646 - RNA, 14 nt, Mycobacterium avium subsp. paratuberculosis
gcccgcguacagcg

SEQ ID NO: 907647 - RNA, 18 nt, Mycobacterium avium subsp. paratuberculosis
gcccgcguacagcggguc

SEQ ID NO: 907648 - RNA, 20 nt, Mycobacterium avium subsp. paratuberculosis
gcccgcguacagcgggucgu

SEQ ID NO: 907649 - RNA, 23 nt, Mycobacterium avium subsp. paratuberculosis
gcccgcguacagcgggucguugg

SEQ ID NO: 907650 - RNA, 18 nt, Mycobacterium avium subsp. paratuberculosis
gcccgcggugcagucggu

SEQ ID NO: 907651 - RNA, 21 nt, Mycobacterium avium subsp. paratuberculosis
gcccgcggugcagucggucgg

SEQ ID NO: 907652 - RNA, 22 nt, Mycobacterium avium subsp. paratuberculosis
gcccgcggugugcuggccagca

SEQ ID NO: 907653 - RNA, 17 nt, Mycobacterium avium subsp. paratuberculosis
gcccgcguaaccggcgg

SEQ ID NO: 907654 - RNA, 20 nt, Mycobacterium avium subsp. paratuberculosis
gcccgcguaaccggcggcgg

SEQ ID NO: 907655 - RNA, 23 nt, Mycobacterium avium subsp. paratuberculosis
gcccgcguaaccggcggcgguga

SEQ ID NO: 907656 - RNA, 22 nt, Mycobacterium avium subsp. paratuberculosis
gcccgcggggcguacgcgcugc

SEQ ID NO: 907657 - RNA, 22 nt, Mycobacterium avium subsp. paratuberculosis
gcccgcggguagcccgucgacg

SEQ ID NO: 907658 - RNA, 19 nt, Mycobacterium avium subsp. paratuberculosis
gcccgcggucaugcgcggg

SEQ ID NO: 907659 - RNA, 20 nt, Mycobacterium avium subsp. paratuberculosis
gcccgcgggugcagccggau

SEQ ID NO: 907660 - RNA, 23 nt, Mycobacterium avium subsp. paratuberculosis
gcccgcggguguuucggucggcg

SEQ ID NO: 907661 - RNA, 16 nt, Mycobacterium avium subsp. paratuberculosis
gcccgcgggaucagcg

SEQ ID NO: 907662 - RNA, 22 nt, Mycobacterium avium subsp. paratuberculosis
gcccgcgggaucagcguguugg

SEQ ID NO: 907663 - RNA, 16 nt, Mycobacterium avium subsp. paratuberculosis
gcccgcgggccagacu

SEQ ID NO: 907664 - RNA, 21 nt, Mycobacterium avium subsp. paratuberculosis
gcccgcgggccagacugcgca

SEQ ID NO: 907665 - RNA, 17 nt, Mycobacterium avium subsp. paratuberculosis
gcccgcgggacacggcg

SEQ ID NO: 907666 - RNA, 21 nt, Mycobacterium avium subsp. paratuberculosis
gcccgcgggacacggcggcgc

SEQ ID NO: 907667 - RNA, 14 nt, Mycobacterium avium subsp. paratuberculosis
gcccgcggccgccg

SEQ ID NO: 907668 - RNA, 14 nt, Mycobacterium avium subsp. paratuberculosis
gcccgcggccucca

SEQ ID NO: 907669 - RNA, 17 nt, Mycobacterium avium subsp. paratuberculosis
gcccgcggccuccagcc

SEQ ID NO: 907670 - RNA, 21 nt, Mycobacterium avium subsp. paratuberculosis
gcccgcggccuccagccgcuc

SEQ ID NO: 907671 - RNA, 12 nt, Mycobacterium avium subsp. paratuberculosis
gcccgcggcguc

SEQ ID NO: 907672 - RNA, 13 nt, Mycobacterium avium subsp. paratuberculosis
gcccgcggcguca

SEQ ID NO: 907673 - RNA, 14 nt, Mycobacterium avium subsp. paratuberculosis
gcccgcccuggcug

SEQ ID NO: 907674 - RNA, 22 nt, Mycobacterium avium subsp. paratuberculosis
gcccgcgcaauacccgaccagc

SEQ ID NO: 907675 - RNA, 14 nt, Mycobacterium avium subsp. paratuberculosis
gcccgcgcaccguc

SEQ ID NO: 907676 - RNA, 16 nt, Mycobacterium avium subsp. paratuberculosis
gcccgcgcaccgucau

SEQ ID NO: 907677 - RNA, 22 nt, Mycobacterium avium subsp. paratuberculosis
gcccgcgaucaacaccgguccg

SEQ ID NO: 907678 - RNA, 17 nt, Mycobacterium avium subsp. paratuberculosis
gcccgcgaucgccagcg

SEQ ID NO: 907679 - RNA, 15 nt, Mycobacterium avium subsp. paratuberculosis
gcccgcgaucggcgc

SEQ ID NO: 907680 - RNA, 17 nt, Mycobacterium avium subsp. paratuberculosis
gcccgcgaucggcgcca

SEQ ID NO: 907681 - RNA, 12 nt, Mycobacterium avium subsp. paratuberculosis
gcccgcgacggc

SEQ ID NO: 907682 - RNA, 14 nt, Mycobacterium avium subsp. paratuberculosis
gcccgcgacggcga

SEQ ID NO: 907683 - RNA, 22 nt, Mycobacterium avium subsp. paratuberculosis
gcccgcgacggcgagccgggcc

SEQ ID NO: 907684 - RNA, 23 nt, Mycobacterium avium subsp. paratuberculosis
gcccgcgacugucggcgccccgc

SEQ ID NO: 907685 - RNA, 21 nt, Mycobacterium avium subsp. paratuberculosis
gcccgcgacugucggcucgcc

SEQ ID NO: 907686 - RNA, 23 nt, Mycobacterium avium subsp. paratuberculosis
gcccgcgacugucggcucgcccg

SEQ ID NO: 907687 - RNA, 22 nt, Mycobacterium avium subsp. paratuberculosis
gcccgcgccgcgucgucgucga

SEQ ID NO: 907688 - RNA, 14 nt, Mycobacterium avium subsp. paratuberculosis
gcccgcgccggcgu

SEQ ID NO: 907689 - RNA, 14 nt, Mycobacterium avium subsp. paratuberculosis
gcccgcgccgcguc

SEQ ID NO: 907690 - RNA, 22 nt, Mycobacterium avium subsp. paratuberculosis
gcccgcgccgacggccgcgccg

SEQ ID NO: 907691 - RNA, 16 nt, Mycobacterium avium subsp. paratuberculosis
gcccgcgccgaccagc

SEQ ID NO: 907692 - RNA, 19 nt, Mycobacterium avium subsp. paratuberculosis
gcccgcgccgaccagcgcg

SEQ ID NO: 907693 - RNA, 22 nt, Mycobacterium avium subsp. paratuberculosis
gcccgcgccccggcggccacgc

SEQ ID NO: 907694 - RNA, 16 nt, Mycobacterium avium subsp. paratuberculosis
gcccgcgcccgcucga

SEQ ID NO: 907695 - RNA, 12 nt, Mycobacterium avium subsp. paratuberculosis
gcccgcgcccau

SEQ ID NO: 907696 - RNA, 23 nt, Mycobacterium avium subsp. paratuberculosis
gcccgcgcccaugaacgcgucgc

SEQ ID NO: 907697 - RNA, 13 nt, Mycobacterium avium subsp. paratuberculosis
gcccgcgccagcu

SEQ ID NO: 907698 - RNA, 18 nt, Mycobacterium avium subsp. paratuberculosis
gcccgcgccagcucggcg

SEQ ID NO: 907699 - RNA, 19 nt, Mycobacterium avium subsp. paratuberculosis
gcccgcgccagcucggcgg

SEQ ID NO: 907700 - RNA, 16 nt, Mycobacterium avium subsp. paratuberculosis
gcccgcgcaggccccg

SEQ ID NO: 907701 - RNA, 19 nt, Mycobacterium avium subsp. paratuberculosis
gcccgcgcaucccgucgac

SEQ ID NO: 907702 - RNA, 20 nt, Mycobacterium avium subsp. paratuberculosis
gcccgcgcaucccgucgacc

SEQ ID NO: 907703 - RNA, 19 nt, Mycobacterium avium subsp. paratuberculosis
gcccgcccgcagcggcggu

SEQ ID NO: 907704 - RNA, 11 nt, Mycobacterium avium subsp. paratuberculosis
gcccgcccggc

SEQ ID NO: 907705 - RNA, 13 nt, Mycobacterium avium subsp. paratuberculosis
gcccgcccggcac

SEQ ID NO: 907706 - RNA, 17 nt, Mycobacterium avium subsp. paratuberculosis
gcccgccccugagggug

SEQ ID NO: 907707 - RNA, 23 nt, Mycobacterium avium subsp. paratuberculosis
gcccgcccgagaguccgccgccg

SEQ ID NO: 907708 - RNA, 16 nt, Mycobacterium avium subsp. paratuberculosis
gcccgcccuuggccgc

SEQ ID NO: 907709 - RNA, 17 nt, Mycobacterium avium subsp. paratuberculosis
gcccgccgaacaccggc

SEQ ID NO: 907710 - RNA, 13 nt, Mycobacterium avium subsp. paratuberculosis
gcccgccgaacgc

SEQ ID NO: 907711 - RNA, 14 nt, Mycobacterium avium subsp. paratuberculosis
gcccgccgaccacc

SEQ ID NO: 907712 - RNA, 22 nt, Mycobacterium avium subsp. paratuberculosis
gcccgccgaccaccuugcgcag

SEQ ID NO: 907713 - RNA, 13 nt, Mycobacterium avium subsp. paratuberculosis
gcccgccgaccag

SEQ ID NO: 907714 - RNA, 15 nt, Mycobacterium avium subsp. paratuberculosis
gcccgcccggcacga

SEQ ID NO: 907715 - RNA, 12 nt, Mycobacterium avium subsp. paratuberculosis
gcccgcccggcc

SEQ ID NO: 907716 - RNA, 18 nt, Mycobacterium avium subsp. paratuberculosis
gcccgcccggcccggcgc

SEQ ID NO: 907717 - RNA, 22 nt, Mycobacterium avium subsp. paratuberculosis
gcccgcccggcccggcgcggcc

SEQ ID NO: 907718 - RNA, 13 nt, Mycobacterium avium subsp. paratuberculosis
gcccgcccggcgg

SEQ ID NO: 907719 - RNA, 14 nt, Mycobacterium avium subsp. paratuberculosis
gcccgcccggcggc

SEQ ID NO: 907720 - RNA, 16 nt, Mycobacterium avium subsp. paratuberculosis
gcccgcccggcggcgc

SEQ ID NO: 907721 - RNA, 17 nt, Mycobacterium avium subsp. paratuberculosis
gcccgcccggcggcgcu

SEQ ID NO: 907722 - RNA, 15 nt, Mycobacterium avium subsp. paratuberculosis
gcccgcccgggcacg

SEQ ID NO: 907723 - RNA, 22 nt, Mycobacterium avium subsp. paratuberculosis
gcccgcgaaaucuucgccguca

SEQ ID NO: 907724 - RNA, 15 nt, Mycobacterium avium subsp. paratuberculosis
gcccgccgacgccca

SEQ ID NO: 907725 - RNA, 21 nt, Mycobacterium avium subsp. paratuberculosis
gcccgccgacggcugcccggc

SEQ ID NO: 907726 - RNA, 22 nt, Mycobacterium avium subsp. paratuberculosis
gccagacgguggggcuggccgc

SEQ ID NO: 907727 - RNA, 21 nt, Mycobacterium avium subsp. paratuberculosis
gccagaucagcguggucagcg

SEQ ID NO: 907728 - RNA, 23 nt, Mycobacterium avium subsp. paratuberculosis
gccagaucgccuggcagcugccg

SEQ ID NO: 907729 - RNA, 21 nt, Mycobacterium avium subsp. paratuberculosis
gccagaucgacccccaccgcg

SEQ ID NO: 907730 - RNA, 15 nt, Mycobacterium avium subsp. paratuberculosis
gccagaugcgccgcg

SEQ ID NO: 907731 - RNA, 22 nt, Mycobacterium avium subsp. paratuberculosis
gccagaucuccgccuucgacga

SEQ ID NO: 907732 - RNA, 23 nt, Mycobacterium avium subsp. paratuberculosis
gccagaucuccgccuucgacgau

SEQ ID NO: 907733 - RNA, 23 nt, Mycobacterium avium subsp. paratuberculosis
gccagaccguucuccgaggcguc

SEQ ID NO: 907734 - RNA, 14 nt, Mycobacterium avium subsp. paratuberculosis
gccagaccucgccg

SEQ ID NO: 907735 - RNA, 16 nt, Mycobacterium avium subsp. paratuberculosis
gccagaccucgccgac

SEQ ID NO: 907736 - RNA, 24 nt, Mycobacterium avium subsp. paratuberculosis
gccagaccucgccgacgguguccg

SEQ ID NO: 907737 - RNA, 18 nt, Mycobacterium avium subsp. paratuberculosis
gccagaccgguugcggcg

SEQ ID NO: 907738 - RNA, 15 nt, Mycobacterium avium subsp. paratuberculosis
gccagacugcgcacc

SEQ ID NO: 907739 - RNA, 16 nt, Mycobacterium avium subsp. paratuberculosis
gccagacugcgcaccg

SEQ ID NO: 907740 - RNA, 17 nt, Mycobacterium avium subsp. paratuberculosis
gccagacugcgcaccgc

SEQ ID NO: 907741 - RNA, 19 nt, Mycobacterium avium subsp. paratuberculosis
gccagacugcgcaccgcca

SEQ ID NO: 907742 - RNA, 17 nt, Mycobacterium avium subsp. paratuberculosis
gccagacucacggcggc

SEQ ID NO: 907743 - RNA, 19 nt, Mycobacterium avium subsp. paratuberculosis
gccagacucacggcggcag

SEQ ID NO: 907744 - RNA, 15 nt, Mycobacterium avium subsp. paratuberculosis
gccagacguccagcg

SEQ ID NO: 907745 - RNA, 17 nt, Mycobacterium avium subsp. paratuberculosis
gccagacguccagcgcc

SEQ ID NO: 907746 - RNA, 18 nt, Mycobacterium avium subsp. paratuberculosis
gccagacguccagcgccg

SEQ ID NO: 907747 - RNA, 20 nt, Mycobacterium avium subsp. paratuberculosis
gccagacguccagcgccgcc

SEQ ID NO: 907748 - RNA, 21 nt, Mycobacterium avium subsp. paratuberculosis
gccagacguccagcgccgcca

SEQ ID NO: 907749 - RNA, 17 nt, Mycobacterium avium subsp. paratuberculosis
gccagacgaacgcggcc

SEQ ID NO: 907750 - RNA, 18 nt, Mycobacterium avium subsp. paratuberculosis
gccagacgaacgcggccg

SEQ ID NO: 907751 - RNA, 21 nt, Mycobacterium avium subsp. paratuberculosis
gccagacgaacgcggccgcca

SEQ ID NO: 907752 - RNA, 14 nt, Mycobacterium avium subsp. paratuberculosis
gccagacgcgcacc

SEQ ID NO: 907753 - RNA, 15 nt, Mycobacterium avium subsp. paratuberculosis
gccagacgcgcaccg

SEQ ID NO: 907754 - RNA, 18 nt, Mycobacterium avium subsp. paratuberculosis
gccagacgcgcaccgcca

SEQ ID NO: 907755 - RNA, 22 nt, Mycobacterium avium subsp. paratuberculosis
gccagaagaucugccggugccg

SEQ ID NO: 907756 - RNA, 15 nt, Mycobacterium avium subsp. paratuberculosis
gccacuugcgcacgu

SEQ ID NO: 907757 - RNA, 19 nt, Mycobacterium avium subsp. paratuberculosis
gccacuugcgcacguaccg

SEQ ID NO: 907758 - RNA, 21 nt, Mycobacterium avium subsp. paratuberculosis
gccagaacgaguuucccgucg

SEQ ID NO: 907759 - RNA, 21 nt, Mycobacterium avium subsp. paratuberculosis
gccagaaccggcaacacagcc

SEQ ID NO: 907760 - RNA, 13 nt, Mycobacterium avium subsp. paratuberculosis
gccagaacggcgg

SEQ ID NO: 907761 - RNA, 14 nt, Mycobacterium avium subsp. paratuberculosis
gccagaacggcggc

SEQ ID NO: 907762 - RNA, 15 nt, Mycobacterium avium subsp. paratuberculosis
gccagaacggcggca

SEQ ID NO: 907763 - RNA, 21 nt, Mycobacterium avium subsp. paratuberculosis
gccagaacggcggcagcgagg

SEQ ID NO: 907764 - RNA, 16 nt, Mycobacterium avium subsp. paratuberculosis
gccacuccaccaccgg

SEQ ID NO: 907765 - RNA, 17 nt, Mycobacterium avium subsp. paratuberculosis
gccacuccaccaccggc

SEQ ID NO: 907766 - RNA, 23 nt, Mycobacterium avium subsp. paratuberculosis
gccacuccaggguucucgcggcg

SEQ ID NO: 907767 - RNA, 17 nt, Mycobacterium avium subsp. paratuberculosis
gccacuccauccggaac

SEQ ID NO: 907768 - RNA, 23 nt, Mycobacterium avium subsp. paratuberculosis
gccacguugccggguaucgacag

SEQ ID NO: 907769 - RNA, 13 nt, Mycobacterium avium subsp. paratuberculosis
gccacguggucga

SEQ ID NO: 907770 - RNA, 22 nt, Mycobacterium avium subsp. paratuberculosis
gccacguggucgagcaugcggg

SEQ ID NO: 907771 - RNA, 13 nt, Mycobacterium avium subsp. paratuberculosis
gccacgugcggcu

SEQ ID NO: 907772 - RNA, 22 nt, Mycobacterium avium subsp. paratuberculosis
gccacgugcggcugcgcguucg

SEQ ID NO: 907773 - RNA, 23 nt, Mycobacterium avium subsp. paratuberculosis
gccacgugcggcugcgcguucgg

SEQ ID NO: 907774 - RNA, 21 nt, Mycobacterium avium subsp. paratuberculosis
gccacgucguucaugaucggc

SEQ ID NO: 907775 - RNA, 13 nt, Mycobacterium avium subsp. paratuberculosis
gccacgccguugg

SEQ ID NO: 907776 - RNA, 13 nt, Mycobacterium avium subsp. paratuberculosis
gccacgccgcgau

SEQ ID NO: 907777 - RNA, 12 nt, Mycobacterium avium subsp. paratuberculosis
gccacgccggca

SEQ ID NO: 907778 - RNA, 20 nt, Mycobacterium avium subsp. paratuberculosis
gccacgccggcacaccgagc

SEQ ID NO: 907779 - RNA, 16 nt, Mycobacterium avium subsp. paratuberculosis
gccacgccgcccccgc

SEQ ID NO: 907780 - RNA, 22 nt, Mycobacterium avium subsp. paratuberculosis
gccacgccgcccccgccgcgag

SEQ ID NO: 907781 - RNA, 17 nt, Mycobacterium avium subsp. paratuberculosis
gccacggccgcggcccg

SEQ ID NO: 907782 - RNA, 19 nt, Mycobacterium avium subsp. paratuberculosis
gccacggccgcggcccggc

SEQ ID NO: 907783 - RNA, 22 nt, Mycobacterium avium subsp. paratuberculosis
gccacggccgcggcccggccac

SEQ ID NO: 907784 - RNA, 19 nt, Mycobacterium avium subsp. paratuberculosis
gccacgcgucaggcgucgu

SEQ ID NO: 907785 - RNA, 20 nt, Mycobacterium avium subsp. paratuberculosis
gccacgcuagcgugacgcuc

SEQ ID NO: 907786 - RNA, 10 nt, Mycobacterium avium subsp. paratuberculosis
gccacgcuca

SEQ ID NO: 907787 - RNA, 20 nt, Mycobacterium avium subsp. paratuberculosis
gccacgcucggcggcgcgca

SEQ ID NO: 907788 - RNA, 17 nt, Mycobacterium avium subsp. paratuberculosis
gccacggccagcaccgc

SEQ ID NO: 907789 - RNA, 19 nt, Mycobacterium avium subsp. paratuberculosis
gccacggccagcaccgcca

SEQ ID NO: 907790 - RNA, 22 nt, Mycobacterium avium subsp. paratuberculosis
gccacgcggcuucauaugacgc

SEQ ID NO: 907791 - RNA, 13 nt, Mycobacterium avium subsp. paratuberculosis
gccacggcgacga

SEQ ID NO: 907792 - RNA, 17 nt, Mycobacterium avium subsp. paratuberculosis
gccacggcgccaugcgc

SEQ ID NO: 907793 - RNA, 19 nt, Mycobacterium avium subsp. paratuberculosis
gccacggcgccaugcgccg

SEQ ID NO: 907794 - RNA, 20 nt, Mycobacterium avium subsp. paratuberculosis
gccacggcgccaugcgccgc

SEQ ID NO: 907795 - RNA, 22 nt, Mycobacterium avium subsp. paratuberculosis
gccacggcgccaugcgccgcgc

SEQ ID NO: 907796 - RNA, 14 nt, Mycobacterium avium subsp. paratuberculosis
gccacggccggcag

SEQ ID NO: 907797 - RNA, 15 nt, Mycobacterium avium subsp. paratuberculosis
gccacggccggcagc

SEQ ID NO: 907798 - RNA, 16 nt, Mycobacterium avium subsp. paratuberculosis
gccacggccggcagca

SEQ ID NO: 907799 - RNA, 18 nt, Mycobacterium avium subsp. paratuberculosis
gccacggcguugaccaac

SEQ ID NO: 907800 - RNA, 22 nt, Mycobacterium avium subsp. paratuberculosis
gccacggcguugaccaacgccg

SEQ ID NO: 907801 - RNA, 14 nt, Mycobacterium avium subsp. paratuberculosis
gccacggcgguguc

SEQ ID NO: 907802 - RNA, 17 nt, Mycobacterium avium subsp. paratuberculosis
gccacgcucgccagacc

SEQ ID NO: 907803 - RNA, 20 nt, Mycobacterium avium subsp. paratuberculosis
gccacggcggaucaguaccg

SEQ ID NO: 907804 - RNA, 13 nt, Mycobacterium avium subsp. paratuberculosis
gccacggcggccg

SEQ ID NO: 907805 - RNA, 21 nt, Mycobacterium avium subsp. paratuberculosis
gccacggcggccgaauccggc

SEQ ID NO: 907806 - RNA, 17 nt, Mycobacterium avium subsp. paratuberculosis
gccacguaguccgacga

SEQ ID NO: 907807 - RNA, 16 nt, Mycobacterium avium subsp. paratuberculosis
gccacguaucgcgccu

SEQ ID NO: 907808 - RNA, 14 nt, Mycobacterium avium subsp. paratuberculosis
gccacguagcagca

SEQ ID NO: 907809 - RNA, 17 nt, Mycobacterium avium subsp. paratuberculosis
gccacguagcagcagac

SEQ ID NO: 907810 - RNA, 20 nt, Mycobacterium avium subsp. paratuberculosis
gccacguccggaugcggcgc

SEQ ID NO: 907811 - RNA, 21 nt, Mycobacterium avium subsp. paratuberculosis
gccacguccggaugcggcgcc

SEQ ID NO: 907812 - RNA, 23 nt, Mycobacterium avium subsp. paratuberculosis
gccacguccggaugcggcgccca

SEQ ID NO: 907813 - RNA, 21 nt, Mycobacterium avium subsp. paratuberculosis
gccacgucgaacccgaccccg

SEQ ID NO: 907814 - RNA, 22 nt, Mycobacterium avium subsp. paratuberculosis
gccacgucgaacccgaccccgg

SEQ ID NO: 907815 - RNA, 23 nt, Mycobacterium avium subsp. paratuberculosis
gccacgucgaacccgaccccggc

SEQ ID NO: 907816 - RNA, 19 nt, Mycobacterium avium subsp. paratuberculosis
gccacgucgaagcccgggu

SEQ ID NO: 907817 - RNA, 20 nt, Mycobacterium avium subsp. paratuberculosis
gccacgucgaagcccgggua

SEQ ID NO: 907818 - RNA, 20 nt, Mycobacterium avium subsp. paratuberculosis
gccacgccaacugguccugc

SEQ ID NO: 907819 - RNA, 23 nt, Mycobacterium avium subsp. paratuberculosis
gccacgcaggcguccagggccac

SEQ ID NO: 907820 - RNA, 19 nt, Mycobacterium avium subsp. paratuberculosis
gccacgaugaugcccccga

SEQ ID NO: 907821 - RNA, 14 nt, Mycobacterium avium subsp. paratuberculosis
gccacgccagccag

SEQ ID NO: 907822 - RNA, 15 nt, Mycobacterium avium subsp. paratuberculosis
gccacgcacaccgcg

SEQ ID NO: 907823 - RNA, 19 nt, Mycobacterium avium subsp. paratuberculosis
gccacgcacaccgcgcgca

SEQ ID NO: 907824 - RNA, 20 nt, Mycobacterium avium subsp. paratuberculosis
gccacgcacaccgcgcgcag

SEQ ID NO: 907825 - RNA, 21 nt, Mycobacterium avium subsp. paratuberculosis
gccacgaucaccaccaccgcc

SEQ ID NO: 907826 - RNA, 23 nt, Mycobacterium avium subsp. paratuberculosis
gccacgaugcugauacccgcgcg

SEQ ID NO: 907827 - RNA, 18 nt, Mycobacterium avium subsp. paratuberculosis
gccacgauggggacgucg

SEQ ID NO: 907828 - RNA, 21 nt, Mycobacterium avium subsp. paratuberculosis
gccacgauggggacgucgacg

SEQ ID NO: 907829 - RNA, 16 nt, Mycobacterium avium subsp. paratuberculosis
gccacgagcccagccg

SEQ ID NO: 907830 - RNA, 15 nt, Mycobacterium avium subsp. paratuberculosis
gccacgauccgcgcg

SEQ ID NO: 907831 - RNA, 16 nt, Mycobacterium avium subsp. paratuberculosis
gccacgauccgcgcgg

SEQ ID NO: 907832 - RNA, 18 nt, Mycobacterium avium subsp. paratuberculosis
gccacgauccgcgcggcc

SEQ ID NO: 907833 - RNA, 19 nt, Mycobacterium avium subsp. paratuberculosis
gccacgauccgcgcggcca

SEQ ID NO: 907834 - RNA, 16 nt, Mycobacterium avium subsp. paratuberculosis
gccacgaucgcggcca

SEQ ID NO: 907835 - RNA, 18 nt, Mycobacterium avium subsp. paratuberculosis
gccacgaucgcggccagc

SEQ ID NO: 907836 - RNA, 20 nt, Mycobacterium avium subsp. paratuberculosis
gccacgaucgcggccagcgu

SEQ ID NO: 907837 - RNA, 21 nt, Mycobacterium avium subsp. paratuberculosis
gccacgaucgcggccagcgug

SEQ ID NO: 907838 - RNA, 13 nt, Mycobacterium avium subsp. paratuberculosis
gccacgaccucgg

SEQ ID NO: 907839 - RNA, 17 nt, Mycobacterium avium subsp. paratuberculosis
gccacgacugcgcggcc

SEQ ID NO: 907840 - RNA, 18 nt, Mycobacterium avium subsp. paratuberculosis
gccacgacugcgcggccg

SEQ ID NO: 907841 - RNA, 21 nt, Mycobacterium avium subsp. paratuberculosis
gccacgacugcgcggccggcg

SEQ ID NO: 907842 - RNA, 23 nt, Mycobacterium avium subsp. paratuberculosis
gccacgacugcgcggccggcgug

SEQ ID NO: 907843 - RNA, 14 nt, Mycobacterium avium subsp. paratuberculosis
gccacgacgcgcca

SEQ ID NO: 907844 - RNA, 12 nt, Mycobacterium avium subsp. paratuberculosis
gccacgacgcgg

SEQ ID NO: 907845 - RNA, 14 nt, Mycobacterium avium subsp. paratuberculosis
gccacgacgcggcg

SEQ ID NO: 907846 - RNA, 19 nt, Mycobacterium avium subsp. paratuberculosis
gccacgacgcggcgcgcga

SEQ ID NO: 907847 - RNA, 12 nt, Mycobacterium avium subsp. paratuberculosis
gccacgacggcg

SEQ ID NO: 907848 - RNA, 19 nt, Mycobacterium avium subsp. paratuberculosis
gccacgacggcgcuggccg

SEQ ID NO: 907849 - RNA, 20 nt, Mycobacterium avium subsp. paratuberculosis
gccacgacguacccccgcac

SEQ ID NO: 907850 - RNA, 21 nt, Mycobacterium avium subsp. paratuberculosis
gccaacggauagcguccgccc

SEQ ID NO: 907851 - RNA, 18 nt, Mycobacterium avium subsp. paratuberculosis
gccaacggauucagcguc

SEQ ID NO: 907852 - RNA, 16 nt, Mycobacterium avium subsp. paratuberculosis
gccaacgccucgucga

SEQ ID NO: 907853 - RNA, 18 nt, Mycobacterium avium subsp. paratuberculosis
gccaacgccucgucgacc

SEQ ID NO: 907854 - RNA, 20 nt, Mycobacterium avium subsp. paratuberculosis
gccaacgccucgucgaccgc

SEQ ID NO: 907855 - RNA, 21 nt, Mycobacterium avium subsp. paratuberculosis
gccaacgcgauucucgcugcg

SEQ ID NO: 907856 - RNA, 18 nt, Mycobacterium avium subsp. paratuberculosis
gccaacgguucggccgcu

SEQ ID NO: 907857 - RNA, 22 nt, Mycobacterium avium subsp. paratuberculosis
gccaacgggaagagcggcguga

SEQ ID NO: 907858 - RNA, 21 nt, Mycobacterium avium subsp. paratuberculosis
gccagccuggcggcgacccgg

SEQ ID NO: 907859 - RNA, 20 nt, Mycobacterium avium subsp. paratuberculosis
gccagccgcucccggcgcag

SEQ ID NO: 907860 - RNA, 22 nt, Mycobacterium avium subsp. paratuberculosis
gccagccgcucccggcgcagca

SEQ ID NO: 907861 - RNA, 18 nt, Mycobacterium avium subsp. paratuberculosis
gccagccaguugggggcc

SEQ ID NO: 907862 - RNA, 16 nt, Mycobacterium avium subsp. paratuberculosis
gccagccggcccucca

SEQ ID NO: 907863 - RNA, 13 nt, Mycobacterium avium subsp. paratuberculosis
gccagccggccgc

SEQ ID NO: 907864 - RNA, 18 nt, Mycobacterium avium subsp. paratuberculosis
gccagcgaguccagccag

SEQ ID NO: 907865 - RNA, 22 nt, Mycobacterium avium subsp. paratuberculosis
gccagcgaguccagccagccgc

SEQ ID NO: 907866 - RNA, 23 nt, Mycobacterium avium subsp. paratuberculosis
gccagcgaguccagccagccgcg

SEQ ID NO: 907867 - RNA, 16 nt, Mycobacterium avium subsp. paratuberculosis
gccagcgagucgauga

SEQ ID NO: 907868 - RNA, 23 nt, Mycobacterium avium subsp. paratuberculosis
gccagcgagucgaugaccucgcg

SEQ ID NO: 907869 - RNA, 19 nt, Mycobacterium avium subsp. paratuberculosis
gccagcgagugggugaagg

SEQ ID NO: 907870 - RNA, 15 nt, Mycobacterium avium subsp. paratuberculosis
gccagcgacggccgg

SEQ ID NO: 907871 - RNA, 16 nt, Mycobacterium avium subsp. paratuberculosis
gccagcgacggccggg

SEQ ID NO: 907872 - RNA, 17 nt, Mycobacterium avium subsp. paratuberculosis
gccagcgacggccgggu

SEQ ID NO: 907873 - RNA, 20 nt, Mycobacterium avium subsp. paratuberculosis
gccagcgagaagucgcucag

SEQ ID NO: 907874 - RNA, 22 nt, Mycobacterium avium subsp. paratuberculosis
gccagcgaauuguucugcuugg

SEQ ID NO: 907875 - RNA, 13 nt, Mycobacterium avium subsp. paratuberculosis
gccagcgacaacg

SEQ ID NO: 907876 - RNA, 22 nt, Mycobacterium avium subsp. paratuberculosis
gccagcgacaacguggugugca

SEQ ID NO: 907877 - RNA, 15 nt, Mycobacterium avium subsp. paratuberculosis
gccagcgaccgcagg

SEQ ID NO: 907878 - RNA, 12 nt, Mycobacterium avium subsp. paratuberculosis
gccagcgcgacg

SEQ ID NO: 907879 - RNA, 14 nt, Mycobacterium avium subsp. paratuberculosis
gccagcgcggcguc

SEQ ID NO: 907880 - RNA, 12 nt, Mycobacterium avium subsp. paratuberculosis
gccagcgcgggg

SEQ ID NO: 907881 - RNA, 19 nt, Mycobacterium avium subsp. paratuberculosis
gccagcgcggugaagucgg

SEQ ID NO: 907882 - RNA, 13 nt, Mycobacterium avium subsp. paratuberculosis
gccagcgcggugc

SEQ ID NO: 907883 - RNA, 17 nt, Mycobacterium avium subsp. paratuberculosis
gccagcgcggugcccag

SEQ ID NO: 907884 - RNA, 19 nt, Mycobacterium avium subsp. paratuberculosis
gccagcgcggugcccagcc

SEQ ID NO: 907885 - RNA, 20 nt, Mycobacterium avium subsp. paratuberculosis
gccagcgcggugcccagcca

SEQ ID NO: 907886 - RNA, 21 nt, Mycobacterium avium subsp. paratuberculosis
gccagcgauacccguugcgcc

SEQ ID NO: 907887 - RNA, 14 nt, Mycobacterium avium subsp. paratuberculosis
gccagcgcggcggc

SEQ ID NO: 907888 - RNA, 16 nt, Mycobacterium avium subsp. paratuberculosis
gccagcgcgguggcca

SEQ ID NO: 907889 - RNA, 18 nt, Mycobacterium avium subsp. paratuberculosis
gccagcgcggcggccagc

SEQ ID NO: 907890 - RNA, 16 nt, Mycobacterium avium subsp. paratuberculosis
gccagcgcggcggcgc

SEQ ID NO: 907891 - RNA, 19 nt, Mycobacterium avium subsp. paratuberculosis
gccagcgcggcggcgccgu

SEQ ID NO: 907892 - RNA, 20 nt, Mycobacterium avium subsp. paratuberculosis
gccagcgcggcggcgccguc

SEQ ID NO: 907893 - RNA, 21 nt, Mycobacterium avium subsp. paratuberculosis
gccagcgcggcggcgccgucg

SEQ ID NO: 907894 - RNA, 15 nt, Mycobacterium avium subsp. paratuberculosis
gccagcgcggcgguc

SEQ ID NO: 907895 - RNA, 13 nt, Mycobacterium avium subsp. paratuberculosis
gccagcgcgacgg

SEQ ID NO: 907896 - RNA, 22 nt, Mycobacterium avium subsp. paratuberculosis
gccagcgcggccgggcgccccg

SEQ ID NO: 907897 - RNA, 14 nt, Mycobacterium avium subsp. paratuberculosis
gccagcgcggcgau

SEQ ID NO: 907898 - RNA, 19 nt, Mycobacterium avium subsp. paratuberculosis
gccagcgcggcgaucagca

SEQ ID NO: 907899 - RNA, 21 nt, Mycobacterium avium subsp. paratuberculosis
gccagcgcggcgaucagcagc

SEQ ID NO: 907900 - RNA, 21 nt, Mycobacterium avium subsp. paratuberculosis
gccagcgcgaaagcagcaacg

SEQ ID NO: 907901 - RNA, 22 nt, Mycobacterium avium subsp. paratuberculosis
gccagcgcgaaagcagcaacgg

SEQ ID NO: 907902 - RNA, 15 nt, Mycobacterium avium subsp. paratuberculosis
gccagcgccuucggc

SEQ ID NO: 907903 - RNA, 18 nt, Mycobacterium avium subsp. paratuberculosis
gccagcgccuucggcgcc

SEQ ID NO: 907904 - RNA, 15 nt, Mycobacterium avium subsp. paratuberculosis
gccagcgccucggcg

SEQ ID NO: 907905 - RNA, 23 nt, Mycobacterium avium subsp. paratuberculosis
gccagcgccucggcgucaccgcg

SEQ ID NO: 907906 - RNA, 14 nt, Mycobacterium avium subsp. paratuberculosis
gccagcgccucggc

SEQ ID NO: 907907 - RNA, 12 nt, Mycobacterium avium subsp. paratuberculosis
gccagcgccggg

SEQ ID NO: 907908 - RNA, 13 nt, Mycobacterium avium subsp. paratuberculosis
gccagcgccucca

SEQ ID NO: 907909 - RNA, 16 nt, Mycobacterium avium subsp. paratuberculosis
gccagcgccuccagcc

SEQ ID NO: 907910 - RNA, 17 nt, Mycobacterium avium subsp. paratuberculosis
gccagcgccuccagccg

SEQ ID NO: 907911 - RNA, 19 nt, Mycobacterium avium subsp. paratuberculosis
gccagcgccuccagccgcu

SEQ ID NO: 907912 - RNA, 20 nt, Mycobacterium avium subsp. paratuberculosis
gccagcgccuccagccgcuc

SEQ ID NO: 907913 - RNA, 18 nt, Mycobacterium avium subsp. paratuberculosis
gccagcgccgucaucacc

SEQ ID NO: 907914 - RNA, 19 nt, Mycobacterium avium subsp. paratuberculosis
gccagcgccgucaucaccg

SEQ ID NO: 907915 - RNA, 22 nt, Mycobacterium avium subsp. paratuberculosis
gccagcgccgucaucaccgccg

SEQ ID NO: 907916 - RNA, 16 nt, Mycobacterium avium subsp. paratuberculosis
gccagcgccgcgcgcg

SEQ ID NO: 907917 - RNA, 14 nt, Mycobacterium avium subsp. paratuberculosis
gccagcgccggcag

SEQ ID NO: 907918 - RNA, 19 nt, Mycobacterium avium subsp. paratuberculosis
gccagcgucgaguuguugg

SEQ ID NO: 907919 - RNA, 13 nt, Mycobacterium avium subsp. paratuberculosis
gccagcgucgcgc

SEQ ID NO: 907920 - RNA, 15 nt, Mycobacterium avium subsp. paratuberculosis
gccagcgucgcgccg

SEQ ID NO: 907921 - RNA, 16 nt, Mycobacterium avium subsp. paratuberculosis
gccagcgucuccggcg

SEQ ID NO: 907922 - RNA, 19 nt, Mycobacterium avium subsp. paratuberculosis
gccagcgucuccggcgggc

SEQ ID NO: 907923 - RNA, 21 nt, Mycobacterium avium subsp. paratuberculosis
gccagcgucugcugcgccauc

SEQ ID NO: 907924 - RNA, 14 nt, Mycobacterium avium subsp. paratuberculosis
gccagcgugaacac

SEQ ID NO: 907925 - RNA, 18 nt, Mycobacterium avium subsp. paratuberculosis
gccagcgugaacaccgcg

SEQ ID NO: 907926 - RNA, 19 nt, Mycobacterium avium subsp. paratuberculosis
gccagcgugaacaccgcgu

SEQ ID NO: 907927 - RNA, 15 nt, Mycobacterium avium subsp. paratuberculosis
gccagcgucagggcg

SEQ ID NO: 907928 - RNA, 16 nt, Mycobacterium avium subsp. paratuberculosis
gccagcgucagggcga

SEQ ID NO: 907929 - RNA, 16 nt, Mycobacterium avium subsp. paratuberculosis
gccagcggcgcaacca

SEQ ID NO: 907930 - RNA, 12 nt, Mycobacterium avium subsp. paratuberculosis
gccagcgucgcg

SEQ ID NO: 907931 - RNA, 12 nt, Mycobacterium avium subsp. paratuberculosis
gccagcgugacg

SEQ ID NO: 907932 - RNA, 14 nt, Mycobacterium avium subsp. paratuberculosis
gccagcgugacgcc

SEQ ID NO: 907933 - RNA, 18 nt, Mycobacterium avium subsp. paratuberculosis
gccagcgugacgcccggc

SEQ ID NO: 907934 - RNA, 19 nt, Mycobacterium avium subsp. paratuberculosis
gccagcgugacgcccggcg

SEQ ID NO: 907935 - RNA, 20 nt, Mycobacterium avium subsp. paratuberculosis
gccagcgugacgcccggcgc

SEQ ID NO: 907936 - RNA, 23 nt, Mycobacterium avium subsp. paratuberculosis
gccagcgugacgccgggccgccg

SEQ ID NO: 907937 - RNA, 17 nt, Mycobacterium avium subsp. paratuberculosis
gccagcgugacgcucgg

SEQ ID NO: 907938 - RNA, 20 nt, Mycobacterium avium subsp. paratuberculosis
gccagcgugacgcucgggcu

SEQ ID NO: 907939 - RNA, 13 nt, Mycobacterium avium subsp. paratuberculosis
gccagcguggcgc

SEQ ID NO: 907940 - RNA, 16 nt, Mycobacterium avium subsp. paratuberculosis
gccagcguggcgcgcc

SEQ ID NO: 907941 - RNA, 19 nt, Mycobacterium avium subsp. paratuberculosis
gccagcguggcgcgccccg

SEQ ID NO: 907942 - RNA, 15 nt, Mycobacterium avium subsp. paratuberculosis
gccagcucgaacacc

SEQ ID NO: 907943 - RNA, 16 nt, Mycobacterium avium subsp. paratuberculosis
gccagcucgaaccugg

SEQ ID NO: 907944 - RNA, 21 nt, Mycobacterium avium subsp. paratuberculosis
gccagcucgaccgcggcgaug

SEQ ID NO: 907945 - RNA, 19 nt, Mycobacterium avium subsp. paratuberculosis
gccagcucgagcaucacga

SEQ ID NO: 907946 - RNA, 20 nt, Mycobacterium avium subsp. paratuberculosis
gccagcucgagcaucacgaa

SEQ ID NO: 907947 - RNA, 12 nt, Mycobacterium avium subsp. paratuberculosis
gccagcucgccg

SEQ ID NO: 907948 - RNA, 18 nt, Mycobacterium avium subsp. paratuberculosis
gccagcggcaacugggcg

SEQ ID NO: 907949 - RNA, 13 nt, Mycobacterium avium subsp. paratuberculosis
gccagcgcgucgg

SEQ ID NO: 907950 - RNA, 15 nt, Mycobacterium avium subsp. paratuberculosis
gccagcgcgucggcc

SEQ ID NO: 907951 - RNA, 17 nt, Mycobacterium avium subsp. paratuberculosis
gccagcgcgucggccag

SEQ ID NO: 907952 - RNA, 22 nt, Mycobacterium avium subsp. paratuberculosis
gccagcgcgucggccagcacca

SEQ ID NO: 907953 - RNA, 16 nt, Mycobacterium avium subsp. paratuberculosis
gccagcgcgugaucgg

SEQ ID NO: 907954 - RNA, 18 nt, Mycobacterium avium subsp. paratuberculosis
gccagcgcgugaucggug

SEQ ID NO: 907955 - RNA, 22 nt, Mycobacterium avium subsp. paratuberculosis
gccagcgcgugaugggugggca

SEQ ID NO: 907956 - RNA, 19 nt, Mycobacterium avium subsp. paratuberculosis
gccagcgcgugcggggugu

SEQ ID NO: 907957 - RNA, 21 nt, Mycobacterium avium subsp. paratuberculosis
gccagcgcggugucgacgucg

SEQ ID NO: 907958 - RNA, 22 nt, Mycobacterium avium subsp. paratuberculosis
gccagcgcggugucgacgucgg

SEQ ID NO: 907959 - RNA, 21 nt, Mycobacterium avium subsp. paratuberculosis
gccagcgcggugugcggcggc

SEQ ID NO: 907960 - RNA, 24 nt, Mycobacterium avium subsp. paratuberculosis
gccagcgcggugugcggcggcucg

SEQ ID NO: 907961 - RNA, 12 nt, Mycobacterium avium subsp. paratuberculosis
gccagcgcgucg

SEQ ID NO: 907962 - RNA, 21 nt, Mycobacterium avium subsp. paratuberculosis
gccagcgcgucgcacagcgcc

SEQ ID NO: 907963 - RNA, 22 nt, Mycobacterium avium subsp. paratuberculosis
gccagcgcgucgcacagcgccg

SEQ ID NO: 907964 - RNA, 16 nt, Mycobacterium avium subsp. paratuberculosis
gccagcggccagcccg

SEQ ID NO: 907965 - RNA, 15 nt, Mycobacterium avium subsp. paratuberculosis
gccagcggcagcgcc

SEQ ID NO: 907966 - RNA, 16 nt, Mycobacterium avium subsp. paratuberculosis
gccagcggcagcgcca

SEQ ID NO: 907967 - RNA, 17 nt, Mycobacterium avium subsp. paratuberculosis
gccagcggcagcgccag

SEQ ID NO: 907968 - RNA, 17 nt, Mycobacterium avium subsp. paratuberculosis
gccagcggcagcggcgu

SEQ ID NO: 907969 - RNA, 19 nt, Mycobacterium avium subsp. paratuberculosis
gccagcggcagcggcgucg

SEQ ID NO: 907970 - RNA, 22 nt, Mycobacterium avium subsp. paratuberculosis
gccagcggcagcggcgucgucg

SEQ ID NO: 907971 - RNA, 18 nt, Mycobacterium avium subsp. paratuberculosis
gccagcacacccucgacc

SEQ ID NO: 907972 - RNA, 15 nt, Mycobacterium avium subsp. paratuberculosis
gccagcaccaccgcg

SEQ ID NO: 907973 - RNA, 19 nt, Mycobacterium avium subsp. paratuberculosis
gccagcaccaccgcgagcg

SEQ ID NO: 907974 - RNA, 21 nt, Mycobacterium avium subsp. paratuberculosis
gccagcaccaccgcgagcggg

SEQ ID NO: 907975 - RNA, 22 nt, Mycobacterium avium subsp. paratuberculosis
gccagcaccaccgcgagcgggu

SEQ ID NO: 907976 - RNA, 16 nt, Mycobacterium avium subsp. paratuberculosis
gccagcaccaccguca

SEQ ID NO: 907977 - RNA, 22 nt, Mycobacterium avium subsp. paratuberculosis
gccagcaccaccgucaccgccg

SEQ ID NO: 907978 - RNA, 15 nt, Mycobacterium avium subsp. paratuberculosis
gccagcaccaccucg

SEQ ID NO: 907979 - RNA, 16 nt, Mycobacterium avium subsp. paratuberculosis
gccagcaccaccucgc

SEQ ID NO: 907980 - RNA, 17 nt, Mycobacterium avium subsp. paratuberculosis
gccagcaccaccucgcg

SEQ ID NO: 907981 - RNA, 21 nt, Mycobacterium avium subsp. paratuberculosis
gccagcaccaccucgcgcggg

SEQ ID NO: 907982 - RNA, 13 nt, Mycobacterium avium subsp. paratuberculosis
gccagcagggcgc

SEQ ID NO: 907983 - RNA, 19 nt, Mycobacterium avium subsp. paratuberculosis
gccagcagggcgccgacga

SEQ ID NO: 907984 - RNA, 16 nt, Mycobacterium avium subsp. paratuberculosis
gccagcagggucagcg

SEQ ID NO: 907985 - RNA, 12 nt, Mycobacterium avium subsp. paratuberculosis
gccagcaccacc

SEQ ID NO: 907986 - RNA, 16 nt, Mycobacterium avium subsp. paratuberculosis
gccagcaccacguccg

SEQ ID NO: 907987 - RNA, 21 nt, Mycobacterium avium subsp. paratuberculosis
gccagcaccacguccgcggug

SEQ ID NO: 907988 - RNA, 17 nt, Mycobacterium avium subsp. paratuberculosis
gccagcaggucgaaggc

SEQ ID NO: 907989 - RNA, 18 nt, Mycobacterium avium subsp. paratuberculosis
gccagcaguucguccacg

SEQ ID NO: 907990 - RNA, 13 nt, Mycobacterium avium subsp. paratuberculosis
gccagcauccgcu

SEQ ID NO: 907991 - RNA, 19 nt, Mycobacterium avium subsp. paratuberculosis
gccagcauccgcuggugcg

SEQ ID NO: 907992 - RNA, 23 nt, Mycobacterium avium subsp. paratuberculosis
gccagcauccgcuggugcgcgcc

SEQ ID NO: 907993 - RNA, 19 nt, Mycobacterium avium subsp. paratuberculosis
gccagcagguccgccggug

SEQ ID NO: 907994 - RNA, 20 nt, Mycobacterium avium subsp. paratuberculosis
gccagcagguccgccggugc

SEQ ID NO: 907995 - RNA, 19 nt, Mycobacterium avium subsp. paratuberculosis
gccagcagguagaucgcca

SEQ ID NO: 907996 - RNA, 20 nt, Mycobacterium avium subsp. paratuberculosis
gccagcagguagaucgccag

SEQ ID NO: 907997 - RNA, 22 nt, Mycobacterium avium subsp. paratuberculosis
gccagcagguagaucgccagcg

SEQ ID NO: 907998 - RNA, 23 nt, Mycobacterium avium subsp. paratuberculosis
gccagcagguagaagccgcgacg

SEQ ID NO: 907999 - RNA, 15 nt, Mycobacterium avium subsp. paratuberculosis
gccagcaggucgucg

SEQ ID NO: 908000 - RNA, 16 nt, Mycobacterium avium subsp. paratuberculosis
gccagcaggucgucga

SEQ ID NO: 908001 - RNA, 16 nt, Mycobacterium avium subsp. paratuberculosis
gccagcagucgugacg

SEQ ID NO: 908002 - RNA, 19 nt, Mycobacterium avium subsp. paratuberculosis
gccagcagucgugacgcgg

SEQ ID NO: 908003 - RNA, 20 nt, Mycobacterium avium subsp. paratuberculosis
gccagcagucgugacgcggc

SEQ ID NO: 908004 - RNA, 12 nt, Mycobacterium avium subsp. paratuberculosis
gccagcagugcc

SEQ ID NO: 908005 - RNA, 13 nt, Mycobacterium avium subsp. paratuberculosis
gccagcagugcca

SEQ ID NO: 908006 - RNA, 18 nt, Mycobacterium avium subsp. paratuberculosis
gccagcagugccaccacc

SEQ ID NO: 908007 - RNA, 19 nt, Mycobacterium avium subsp. paratuberculosis
gccagcagugccaccacca

SEQ ID NO: 908008 - RNA, 13 nt, Mycobacterium avium subsp. paratuberculosis
gccagccaccaca

SEQ ID NO: 908009 - RNA, 22 nt, Mycobacterium avium subsp. paratuberculosis
gccagccaccacaucgcugggg

SEQ ID NO: 908010 - RNA, 15 nt, Mycobacterium avium subsp. paratuberculosis
gccagcaugaucacc

SEQ ID NO: 908011 - RNA, 18 nt, Mycobacterium avium subsp. paratuberculosis
gccagcaugaucaccgcc

SEQ ID NO: 908012 - RNA, 21 nt, Mycobacterium avium subsp. paratuberculosis
gccagcaugaucaccgccagc

SEQ ID NO: 908013 - RNA, 15 nt, Mycobacterium avium subsp. paratuberculosis
gccagcaugcgauga

SEQ ID NO: 908014 - RNA, 17 nt, Mycobacterium avium subsp. paratuberculosis
gccagcaugcgaugacc

SEQ ID NO: 908015 - RNA, 20 nt, Mycobacterium avium subsp. paratuberculosis
gccagcaugcgaugaccacc

SEQ ID NO: 908016 - RNA, 14 nt, Mycobacterium avium subsp. paratuberculosis
gccagcaucucggc

SEQ ID NO: 908017 - RNA, 16 nt, Mycobacterium avium subsp. paratuberculosis
gccagcaucucggcga

SEQ ID NO: 908018 - RNA, 18 nt, Mycobacterium avium subsp. paratuberculosis
gccagccaggccgucggc

SEQ ID NO: 908019 - RNA, 19 nt, Mycobacterium avium subsp. paratuberculosis
gccagccaggccgucggcg

SEQ ID NO: 908020 - RNA, 15 nt, Mycobacterium avium subsp. paratuberculosis
gccagccacgccgac

SEQ ID NO: 908021 - RNA, 18 nt, Mycobacterium avium subsp. paratuberculosis
gccagccacgccgacacc

SEQ ID NO: 908022 - RNA, 19 nt, Mycobacterium avium subsp. paratuberculosis
gccagccacgccgacaccg

SEQ ID NO: 908023 - RNA, 23 nt, Mycobacterium avium subsp. paratuberculosis
gccagccacgccgacaccgucgc

SEQ ID NO: 908024 - RNA, 14 nt, Mycobacterium avium subsp. paratuberculosis
gccagccagccgcc

SEQ ID NO: 908025 - RNA, 15 nt, Mycobacterium avium subsp. paratuberculosis
gccagccagccgccc

SEQ ID NO: 908026 - RNA, 13 nt, Mycobacterium avium subsp. paratuberculosis
gccagccagccgg

SEQ ID NO: 908027 - RNA, 16 nt, Mycobacterium avium subsp. paratuberculosis
gccagccagccggugc

SEQ ID NO: 908028 - RNA, 17 nt, Mycobacterium avium subsp. paratuberculosis
gccagccagccggugcg

SEQ ID NO: 908029 - RNA, 14 nt, Mycobacterium avium subsp. paratuberculosis
gccagccgccggcu

SEQ ID NO: 908030 - RNA, 16 nt, Mycobacterium avium subsp. paratuberculosis
gccagccgccggcuca

SEQ ID NO: 908031 - RNA, 14 nt, Mycobacterium avium subsp. paratuberculosis
gccagcccagccgc

SEQ ID NO: 908032 - RNA, 15 nt, Mycobacterium avium subsp. paratuberculosis
gccagcccagccgcc

SEQ ID NO: 908033 - RNA, 16 nt, Mycobacterium avium subsp. paratuberculosis
gccagcccagccgcca

SEQ ID NO: 908034 - RNA, 16 nt, Mycobacterium avium subsp. paratuberculosis
gccagccccaccaccg

SEQ ID NO: 908035 - RNA, 18 nt, Mycobacterium avium subsp. paratuberculosis
gccagccccaccaccgcc

SEQ ID NO: 908036 - RNA, 19 nt, Mycobacterium avium subsp. paratuberculosis
gccagccccaccaccgcca

SEQ ID NO: 908037 - RNA, 20 nt, Mycobacterium avium subsp. paratuberculosis
gccagccccaccaccgccac

SEQ ID NO: 908038 - RNA, 17 nt, Mycobacterium avium subsp. paratuberculosis
gccagccccaccggcca

SEQ ID NO: 908039 - RNA, 21 nt, Mycobacterium avium subsp. paratuberculosis
gccaucaaccgauuucggcca

SEQ ID NO: 908040 - RNA, 23 nt, Mycobacterium avium subsp. paratuberculosis
gccauauuucgugaagccggugg

SEQ ID NO: 908041 - RNA, 22 nt, Mycobacterium avium subsp. paratuberculosis
gccaucaccuccuuggccaggc

SEQ ID NO: 908042 - RNA, 24 nt, Mycobacterium avium subsp. paratuberculosis
gccaucaccuccuuggccaggcgg

SEQ ID NO: 908043 - RNA, 18 nt, Mycobacterium avium subsp. paratuberculosis
gccaucagaacgcccgca

SEQ ID NO: 908044 - RNA, 15 nt, Mycobacterium avium subsp. paratuberculosis
gccaucagcaccacg

SEQ ID NO: 908045 - RNA, 22 nt, Mycobacterium avium subsp. paratuberculosis
gccaucagcaccacguugcgcc

SEQ ID NO: 908046 - RNA, 15 nt, Mycobacterium avium subsp. paratuberculosis
gccaguccaggccgc

SEQ ID NO: 908047 - RNA, 17 nt, Mycobacterium avium subsp. paratuberculosis
gccagucgaaguucggc

SEQ ID NO: 908048 - RNA, 19 nt, Mycobacterium avium subsp. paratuberculosis
gccagucgaaguucggcau

SEQ ID NO: 908049 - RNA, 14 nt, Mycobacterium avium subsp. paratuberculosis
gccaguccgccgcc

SEQ ID NO: 908050 - RNA, 19 nt, Mycobacterium avium subsp. paratuberculosis
gccaguccgccgccguccc

SEQ ID NO: 908051 - RNA, 16 nt, Mycobacterium avium subsp. paratuberculosis
gccaguccggcagcag

SEQ ID NO: 908052 - RNA, 17 nt, Mycobacterium avium subsp. paratuberculosis
gccaguccggcagcagc

SEQ ID NO: 908053 - RNA, 16 nt, Mycobacterium avium subsp. paratuberculosis
gccaguccggcgccga

SEQ ID NO: 908054 - RNA, 17 nt, Mycobacterium avium subsp. paratuberculosis
gccaucagcccggcguc

SEQ ID NO: 908055 - RNA, 19 nt, Mycobacterium avium subsp. paratuberculosis
gccaucagcccggcguccu

SEQ ID NO: 908056 - RNA, 13 nt, Mycobacterium avium subsp. paratuberculosis
gccaucagccgcc

SEQ ID NO: 908057 - RNA, 15 nt, Mycobacterium avium subsp. paratuberculosis
gccaucacggugccg

SEQ ID NO: 908058 - RNA, 15 nt, Mycobacterium avium subsp. paratuberculosis
gccaucaugcccacc

SEQ ID NO: 908059 - RNA, 18 nt, Mycobacterium avium subsp. paratuberculosis
gccaucaugcccaccauc

SEQ ID NO: 908060 - RNA, 21 nt, Mycobacterium avium subsp. paratuberculosis
gccauccccgcguuggccagc

SEQ ID NO: 908061 - RNA, 21 nt, Mycobacterium avium subsp. paratuberculosis
gccaucccggggacaccgggc

SEQ ID NO: 908062 - RNA, 13 nt, Mycobacterium avium subsp. paratuberculosis
gccaucgcggccc

SEQ ID NO: 908063 - RNA, 16 nt, Mycobacterium avium subsp. paratuberculosis
gccaucgcggccccca

SEQ ID NO: 908064 - RNA, 19 nt, Mycobacterium avium subsp. paratuberculosis
gccaucgcggcguuguggc

SEQ ID NO: 908065 - RNA, 15 nt, Mycobacterium avium subsp. paratuberculosis
gccaucuggccgcgg

SEQ ID NO: 908066 - RNA, 16 nt, Mycobacterium avium subsp. paratuberculosis
gccaucuggccgcggg

SEQ ID NO: 908067 - RNA, 14 nt, Mycobacterium avium subsp. paratuberculosis
gccaucgccgccgc

SEQ ID NO: 908068 - RNA, 13 nt, Mycobacterium avium subsp. paratuberculosis
gccaucgccgcgg

SEQ ID NO: 908069 - RNA, 19 nt, Mycobacterium avium subsp. paratuberculosis
gccaucgccucggccacca

SEQ ID NO: 908070 - RNA, 22 nt, Mycobacterium avium subsp. paratuberculosis
gccaucgccucggccaccagau

SEQ ID NO: 908071 - RNA, 18 nt, Mycobacterium avium subsp. paratuberculosis
gccauucaucgcgcacca

SEQ ID NO: 908072 - RNA, 19 nt, Mycobacterium avium subsp. paratuberculosis
gccaugggucucggcgagg

SEQ ID NO: 908073 - RNA, 19 nt, Mycobacterium avium subsp. paratuberculosis
gccauguccccgccggugg

SEQ ID NO: 908074 - RNA, 14 nt, Mycobacterium avium subsp. paratuberculosis
gccauguccggcag

SEQ ID NO: 908075 - RNA, 14 nt, Mycobacterium avium subsp. paratuberculosis
gccaugucgauguc

SEQ ID NO: 908076 - RNA, 22 nt, Mycobacterium avium subsp. paratuberculosis
gccauguacggauugcggacgc

SEQ ID NO: 908077 - RNA, 19 nt, Mycobacterium avium subsp. paratuberculosis
gccaugacuaauccccccg

SEQ ID NO: 908078 - RNA, 12 nt, Mycobacterium avium subsp. paratuberculosis
gccauggcggca

SEQ ID NO: 908079 - RNA, 15 nt, Mycobacterium avium subsp. paratuberculosis
gccauggcggcaucc

SEQ ID NO: 908080 - RNA, 20 nt, Mycobacterium avium subsp. paratuberculosis
gccaugggguugaccuugac

SEQ ID NO: 908081 - RNA, 18 nt, Mycobacterium avium subsp. paratuberculosis
gccaugaacggcggggcc

SEQ ID NO: 908082 - RNA, 18 nt, Mycobacterium avium subsp. paratuberculosis
gccaugaccaugucgacg

SEQ ID NO: 908083 - RNA, 20 nt, Mycobacterium avium subsp. paratuberculosis
gccaugaccaugucgacgcu

SEQ ID NO: 908084 - RNA, 21 nt, Mycobacterium avium subsp. paratuberculosis
gccaucuucacgugcgcggcg

SEQ ID NO: 908085 - RNA, 21 nt, Mycobacterium avium subsp. paratuberculosis
gccaucuucaguucggccggc

SEQ ID NO: 908086 - RNA, 15 nt, Mycobacterium avium subsp. paratuberculosis
gccauuucagcagcg

SEQ ID NO: 908087 - RNA, 22 nt, Mycobacterium avium subsp. paratuberculosis
gccauuuccguugugccaccgc

SEQ ID NO: 908088 - RNA, 22 nt, Mycobacterium avium subsp. paratuberculosis
gcccaaaaacgagaugccccag

SEQ ID NO: 908089 - RNA, 20 nt, Mycobacterium avium subsp. paratuberculosis
gcccaacagcucgcgggccu

SEQ ID NO: 908090 - RNA, 20 nt, Mycobacterium avium subsp. paratuberculosis
gcccaacaacucgacguucg

SEQ ID NO: 908091 - RNA, 21 nt, Mycobacterium avium subsp. paratuberculosis
gcccaacaacucgacguucgg

SEQ ID NO: 908092 - RNA, 22 nt, Mycobacterium avium subsp. paratuberculosis
gcccaacaacucgacguucggc

SEQ ID NO: 908093 - RNA, 14 nt, Mycobacterium avium subsp. paratuberculosis
gcccaacgucgacu

SEQ ID NO: 908094 - RNA, 16 nt, Mycobacterium avium subsp. paratuberculosis
gcccaacacgcccugc

SEQ ID NO: 908095 - RNA, 16 nt, Mycobacterium avium subsp. paratuberculosis
gcccaaccgcauucgg

SEQ ID NO: 908096 - RNA, 16 nt, Mycobacterium avium subsp. paratuberculosis
gcccaacgacgucggc

SEQ ID NO: 908097 - RNA, 18 nt, Mycobacterium avium subsp. paratuberculosis
gcccaacgacgucggcgu

SEQ ID NO: 908098 - RNA, 16 nt, Mycobacterium avium subsp. paratuberculosis
gccaggcuggcgucga

SEQ ID NO: 908099 - RNA, 19 nt, Mycobacterium avium subsp. paratuberculosis
gccaggcuggcgucgaacg

SEQ ID NO: 908100 - RNA, 17 nt, Mycobacterium avium subsp. paratuberculosis
gccaggcguugcaccgc

SEQ ID NO: 908101 - RNA, 19 nt, Mycobacterium avium subsp. paratuberculosis
gccaggcguugcaccgcgg

SEQ ID NO: 908102 - RNA, 20 nt, Mycobacterium avium subsp. paratuberculosis
gccaggcguuggucaccauc

SEQ ID NO: 908103 - RNA, 22 nt, Mycobacterium avium subsp. paratuberculosis
gccaggcguuggucaccaucag

SEQ ID NO: 908104 - RNA, 18 nt, Mycobacterium avium subsp. paratuberculosis
gccaggcucacguagucg

SEQ ID NO: 908105 - RNA, 12 nt, Mycobacterium avium subsp. paratuberculosis
gccaggcggugg

SEQ ID NO: 908106 - RNA, 19 nt, Mycobacterium avium subsp. paratuberculosis
gccaggcgguggccgaacc

SEQ ID NO: 908107 - RNA, 14 nt, Mycobacterium avium subsp. paratuberculosis
gccaggcggcgacg

SEQ ID NO: 908108 - RNA, 23 nt, Mycobacterium avium subsp. paratuberculosis
gccaggcgggugaucccgaugcc

SEQ ID NO: 908109 - RNA, 21 nt, Mycobacterium avium subsp. paratuberculosis
gccagggggaguagucggcga

SEQ ID NO: 908110 - RNA, 22 nt, Mycobacterium avium subsp. paratuberculosis
gccagggggaguagucggcgau

SEQ ID NO: 908111 - RNA, 17 nt, Mycobacterium avium subsp. paratuberculosis
gccagggcgacgccgcg

SEQ ID NO: 908112 - RNA, 20 nt, Mycobacterium avium subsp. paratuberculosis
gccagggcguggaacgcguc

SEQ ID NO: 908113 - RNA, 16 nt, Mycobacterium avium subsp. paratuberculosis
gccagggccgccgcau

SEQ ID NO: 908114 - RNA, 15 nt, Mycobacterium avium subsp. paratuberculosis
gccagggcagcgcga

SEQ ID NO: 908115 - RNA, 20 nt, Mycobacterium avium subsp. paratuberculosis
gccagggcagcgcgaccagc

SEQ ID NO: 908116 - RNA, 13 nt, Mycobacterium avium subsp. paratuberculosis
gccagggugccga

SEQ ID NO: 908117 - RNA, 16 nt, Mycobacterium avium subsp. paratuberculosis
gccagguacaccacca

SEQ ID NO: 908118 - RNA, 19 nt, Mycobacterium avium subsp. paratuberculosis
gccagguacaccaccaggu

SEQ ID NO: 908119 - RNA, 16 nt, Mycobacterium avium subsp. paratuberculosis
gccagguacugaucac

SEQ ID NO: 908120 - RNA, 18 nt, Mycobacterium avium subsp. paratuberculosis
gccagguacugaucaccg

SEQ ID NO: 908121 - RNA, 21 nt, Mycobacterium avium subsp. paratuberculosis
gccagguacugaucaccgcgc

SEQ ID NO: 908122 - RNA, 23 nt, Mycobacterium avium subsp. paratuberculosis
gccagguacugaucaccgcgcuc

SEQ ID NO: 908123 - RNA, 23 nt, Mycobacterium avium subsp. paratuberculosis
gccagggugccccgcaccgccag

SEQ ID NO: 908124 - RNA, 22 nt, Mycobacterium avium subsp. paratuberculosis
gccagggucucgggcagcagca

SEQ ID NO: 908125 - RNA, 18 nt, Mycobacterium avium subsp. paratuberculosis
gccagggucuggcccggu

SEQ ID NO: 908126 - RNA, 21 nt, Mycobacterium avium subsp. paratuberculosis
gccagggucuggcccggugcg

SEQ ID NO: 908127 - RNA, 15 nt, Mycobacterium avium subsp. paratuberculosis
gccagguaguggugg

SEQ ID NO: 908128 - RNA, 21 nt, Mycobacterium avium subsp. paratuberculosis
gccagguaguuguucgacugc

SEQ ID NO: 908129 - RNA, 16 nt, Mycobacterium avium subsp. paratuberculosis
gccagguccgggcacu

SEQ ID NO: 908130 - RNA, 22 nt, Mycobacterium avium subsp. paratuberculosis
gccagguccgggcacucgagcg

SEQ ID NO: 908131 - RNA, 17 nt, Mycobacterium avium subsp. paratuberculosis
gccagguccucgcuggc

SEQ ID NO: 908132 - RNA, 19 nt, Mycobacterium avium subsp. paratuberculosis
gccagggugucccagcgcc

SEQ ID NO: 908133 - RNA, 15 nt, Mycobacterium avium subsp. paratuberculosis
gccagguccacaccg

SEQ ID NO: 908134 - RNA, 17 nt, Mycobacterium avium subsp. paratuberculosis
gccaggugugcggcacg

SEQ ID NO: 908135 - RNA, 18 nt, Mycobacterium avium subsp. paratuberculosis
gccagguguuguccggua

SEQ ID NO: 908136 - RNA, 15 nt, Mycobacterium avium subsp. paratuberculosis
gccagguuccaccgg

SEQ ID NO: 908137 - RNA, 17 nt, Mycobacterium avium subsp. paratuberculosis
gccagguuccaccgggc

SEQ ID NO: 908138 - RNA, 18 nt, Mycobacterium avium subsp. paratuberculosis
gccagguguaggcggcca

SEQ ID NO: 908139 - RNA, 17 nt, Mycobacterium avium subsp. paratuberculosis
gccagguguagaccacg

SEQ ID NO: 908140 - RNA, 22 nt, Mycobacterium avium subsp. paratuberculosis
gccaggucgggguccaggccgc

SEQ ID NO: 908141 - RNA, 23 nt, Mycobacterium avium subsp. paratuberculosis
gccaggucgggguccaggccgcg

SEQ ID NO: 908142 - RNA, 14 nt, Mycobacterium avium subsp. paratuberculosis
gccaggucgccgcg

SEQ ID NO: 908143 - RNA, 21 nt, Mycobacterium avium subsp. paratuberculosis
gccaggucgccgcgcagcacc

SEQ ID NO: 908144 - RNA, 19 nt, Mycobacterium avium subsp. paratuberculosis
gccaggaugaccgcccagg

SEQ ID NO: 908145 - RNA, 20 nt, Mycobacterium avium subsp. paratuberculosis
gccaggaugaccgcccagga

SEQ ID NO: 908146 - RNA, 17 nt, Mycobacterium avium subsp. paratuberculosis
gccaggaugccgaacgc

SEQ ID NO: 908147 - RNA, 18 nt, Mycobacterium avium subsp. paratuberculosis
gccaggaugccgaacgcg

SEQ ID NO: 908148 - RNA, 16 nt, Mycobacterium avium subsp. paratuberculosis
gccaggcacggcccgu

SEQ ID NO: 908149 - RNA, 22 nt, Mycobacterium avium subsp. paratuberculosis
gccaggcccaccgucgccacga

SEQ ID NO: 908150 - RNA, 23 nt, Mycobacterium avium subsp. paratuberculosis
gccaggcccaccgucgccacgau

SEQ ID NO: 908151 - RNA, 22 nt, Mycobacterium avium subsp. paratuberculosis
gccaggccauggcgcaccgcgg

SEQ ID NO: 908152 - RNA, 14 nt, Mycobacterium avium subsp. paratuberculosis
gccaggccaccgca

SEQ ID NO: 908153 - RNA, 15 nt, Mycobacterium avium subsp. paratuberculosis
gccaggccaccgcac

SEQ ID NO: 908154 - RNA, 15 nt, Mycobacterium avium subsp. paratuberculosis
gccaggcccagcccg

SEQ ID NO: 908155 - RNA, 17 nt, Mycobacterium avium subsp. paratuberculosis
gccaggcccagcccggc

SEQ ID NO: 908156 - RNA, 18 nt, Mycobacterium avium subsp. paratuberculosis
gccaggcccagcccggcc

SEQ ID NO: 908157 - RNA, 23 nt, Mycobacterium avium subsp. paratuberculosis
gccaggcccagcccggccccacc

SEQ ID NO: 908158 - RNA, 17 nt, Mycobacterium avium subsp. paratuberculosis
gccaggauguacccgca

SEQ ID NO: 908159 - RNA, 13 nt, Mycobacterium avium subsp. paratuberculosis
gccaggaugucgg

SEQ ID NO: 908160 - RNA, 18 nt, Mycobacterium avium subsp. paratuberculosis
gccaggaugucggacucg

SEQ ID NO: 908161 - RNA, 23 nt, Mycobacterium avium subsp. paratuberculosis
gccaggaugucggacucgcgccg

SEQ ID NO: 908162 - RNA, 19 nt, Mycobacterium avium subsp. paratuberculosis
gccaggauguucaccccgg

SEQ ID NO: 908163 - RNA, 15 nt, Mycobacterium avium subsp. paratuberculosis
gccaggaucucgcgg

SEQ ID NO: 908164 - RNA, 22 nt, Mycobacterium avium subsp. paratuberculosis
gccaggaucucgcgggcccgcg

SEQ ID NO: 908165 - RNA, 16 nt, Mycobacterium avium subsp. paratuberculosis
gccaggaucugcucgg

SEQ ID NO: 908166 - RNA, 21 nt, Mycobacterium avium subsp. paratuberculosis
gccaggaucuugucggcggcc

SEQ ID NO: 908167 - RNA, 17 nt, Mycobacterium avium subsp. paratuberculosis
gccaggauccgcccgcc

SEQ ID NO: 908168 - RNA, 13 nt, Mycobacterium avium subsp. paratuberculosis
gccagcucggcgg

SEQ ID NO: 908169 - RNA, 15 nt, Mycobacterium avium subsp. paratuberculosis
gccagcucggcggcc

SEQ ID NO: 908170 - RNA, 17 nt, Mycobacterium avium subsp. paratuberculosis
gccagcucggcggccau

SEQ ID NO: 908171 - RNA, 14 nt, Mycobacterium avium subsp. paratuberculosis
gccagcucgucgcg

SEQ ID NO: 908172 - RNA, 18 nt, Mycobacterium avium subsp. paratuberculosis
gccagcucggcggccggg

SEQ ID NO: 908173 - RNA, 19 nt, Mycobacterium avium subsp. paratuberculosis
gccagcucggcggccgggu

SEQ ID NO: 908174 - RNA, 15 nt, Mycobacterium avium subsp. paratuberculosis
gccagcucggcgugg

SEQ ID NO: 908175 - RNA, 23 nt, Mycobacterium avium subsp. paratuberculosis
gccagcucggcguggucgaggcc

SEQ ID NO: 908176 - RNA, 18 nt, Mycobacterium avium subsp. paratuberculosis
gccagcucggucagccgg

SEQ ID NO: 908177 - RNA, 21 nt, Mycobacterium avium subsp. paratuberculosis
gccagcucggucagccgggcg

SEQ ID NO: 908178 - RNA, 21 nt, Mycobacterium avium subsp. paratuberculosis
gccagcucggucgcggucggc

SEQ ID NO: 908179 - RNA, 13 nt, Mycobacterium avium subsp. paratuberculosis
gccagcucgucga

SEQ ID NO: 908180 - RNA, 16 nt, Mycobacterium avium subsp. paratuberculosis
gccagcucgucgagcc

SEQ ID NO: 908181 - RNA, 20 nt, Mycobacterium avium subsp. paratuberculosis
gccagcucgucgagccggcc

SEQ ID NO: 908182 - RNA, 14 nt, Mycobacterium avium subsp. paratuberculosis
gccagcucggcccg

SEQ ID NO: 908183 - RNA, 18 nt, Mycobacterium avium subsp. paratuberculosis
gccagcucggcccgcugc

SEQ ID NO: 908184 - RNA, 18 nt, Mycobacterium avium subsp. paratuberculosis
gccagcguggccagcacc

SEQ ID NO: 908185 - RNA, 15 nt, Mycobacterium avium subsp. paratuberculosis
gccagcucgccgccg

SEQ ID NO: 908186 - RNA, 15 nt, Mycobacterium avium subsp. paratuberculosis
gccaggcgcgcgcug

SEQ ID NO: 908187 - RNA, 17 nt, Mycobacterium avium subsp. paratuberculosis
gccaggcgcgcgcuggu

SEQ ID NO: 908188 - RNA, 21 nt, Mycobacterium avium subsp. paratuberculosis
gccaggcgaugaagccggcga

SEQ ID NO: 908189 - RNA, 23 nt, Mycobacterium avium subsp. paratuberculosis
gccaggcgaugaagccggcgaac

SEQ ID NO: 908190 - RNA, 14 nt, Mycobacterium avium subsp. paratuberculosis
gccaggcgcccagc

SEQ ID NO: 908191 - RNA, 17 nt, Mycobacterium avium subsp. paratuberculosis
gccaggcgcccagcacc

SEQ ID NO: 908192 - RNA, 18 nt, Mycobacterium avium subsp. paratuberculosis
gccaggcgcccagcaccc

SEQ ID NO: 908193 - RNA, 13 nt, Mycobacterium avium subsp. paratuberculosis
gccaggccgucgg

SEQ ID NO: 908194 - RNA, 17 nt, Mycobacterium avium subsp. paratuberculosis
gccaggccgucggcgcg

SEQ ID NO: 908195 - RNA, 21 nt, Mycobacterium avium subsp. paratuberculosis
gccaggccgucggcgcggccg

SEQ ID NO: 908196 - RNA, 14 nt, Mycobacterium avium subsp. paratuberculosis
gccaggccgucggc

SEQ ID NO: 908197 - RNA, 12 nt, Mycobacterium avium subsp. paratuberculosis
gccaggccuccc

SEQ ID NO: 908198 - RNA, 18 nt, Mycobacterium avium subsp. paratuberculosis
gccaggccucccacagcg

SEQ ID NO: 908199 - RNA, 20 nt, Mycobacterium avium subsp. paratuberculosis
gccaggccucccacagcgga

SEQ ID NO: 908200 - RNA, 18 nt, Mycobacterium avium subsp. paratuberculosis
gccaggccggccugccgg

SEQ ID NO: 908201 - RNA, 20 nt, Mycobacterium avium subsp. paratuberculosis
gccaggccggccugccggau

SEQ ID NO: 908202 - RNA, 15 nt, Mycobacterium avium subsp. paratuberculosis
gccaggccggcgacg

SEQ ID NO: 908203 - RNA, 18 nt, Mycobacterium avium subsp. paratuberculosis
gccaggccgccgggccgc

SEQ ID NO: 908204 - RNA, 18 nt, Mycobacterium avium subsp. paratuberculosis
gccaggccgcgagcacga

SEQ ID NO: 908205 - RNA, 23 nt, Mycobacterium avium subsp. paratuberculosis
gccaggccgcgagcacgacgucg

SEQ ID NO: 908206 - RNA, 12 nt, Mycobacterium avium subsp. paratuberculosis
gccaggcccugc

SEQ ID NO: 908207 - RNA, 18 nt, Mycobacterium avium subsp. paratuberculosis
gccaggcccugccagcgc

SEQ ID NO: 908208 - RNA, 20 nt, Mycobacterium avium subsp. paratuberculosis
gccaggcccugccagcgccc

SEQ ID NO: 908209 - RNA, 23 nt, Mycobacterium avium subsp. paratuberculosis
gccgacgugcccgaucucgucgg

SEQ ID NO: 908210 - RNA, 19 nt, Mycobacterium avium subsp. paratuberculosis
gccgacuuggucagcccgc

SEQ ID NO: 908211 - RNA, 14 nt, Mycobacterium avium subsp. paratuberculosis
gccgacuuggugcc

SEQ ID NO: 908212 - RNA, 21 nt, Mycobacterium avium subsp. paratuberculosis
gccgacuuggugccaugccgg

SEQ ID NO: 908213 - RNA, 22 nt, Mycobacterium avium subsp. paratuberculosis
gccgacgugggugguggugccg

SEQ ID NO: 908214 - RNA, 15 nt, Mycobacterium avium subsp. paratuberculosis
gccgagaacaggccg

SEQ ID NO: 908215 - RNA, 16 nt, Mycobacterium avium subsp. paratuberculosis
gccgagaacaggccga

SEQ ID NO: 908216 - RNA, 21 nt, Mycobacterium avium subsp. paratuberculosis
gccgagaacaggccgagcgcg

SEQ ID NO: 908217 - RNA, 17 nt, Mycobacterium avium subsp. paratuberculosis
gccgacgucaggggugc

SEQ ID NO: 908218 - RNA, 19 nt, Mycobacterium avium subsp. paratuberculosis
gccgacgucaggggugccg

SEQ ID NO: 908219 - RNA, 18 nt, Mycobacterium avium subsp. paratuberculosis
gccgacgucaggguggcc

SEQ ID NO: 908220 - RNA, 17 nt, Mycobacterium avium subsp. paratuberculosis
gccgacguaggacagca

SEQ ID NO: 908221 - RNA, 20 nt, Mycobacterium avium subsp. paratuberculosis
gccgacguaggacagcacca

SEQ ID NO: 908222 - RNA, 18 nt, Mycobacterium avium subsp. paratuberculosis
gccgacguccuggaucgc

SEQ ID NO: 908223 - RNA, 19 nt, Mycobacterium avium subsp. paratuberculosis
gccgacguccuggaucgcg

SEQ ID NO: 908224 - RNA, 12 nt, Mycobacterium avium subsp. paratuberculosis
gccgacgucgac

SEQ ID NO: 908225 - RNA, 13 nt, Mycobacterium avium subsp. paratuberculosis
gccgacgucgacc

SEQ ID NO: 908226 - RNA, 13 nt, Mycobacterium avium subsp. paratuberculosis
gccgacgucggug

SEQ ID NO: 908227 - RNA, 16 nt, Mycobacterium avium subsp. paratuberculosis
gccgacgucugguugg

SEQ ID NO: 908228 - RNA, 22 nt, Mycobacterium avium subsp. paratuberculosis
gccgacgucugguuggccggcg

SEQ ID NO: 908229 - RNA, 23 nt, Mycobacterium avium subsp. paratuberculosis
gccgacgucugguuggccggcgg

SEQ ID NO: 908230 - RNA, 18 nt, Mycobacterium avium subsp. paratuberculosis
gccgacgguguccgcggg

SEQ ID NO: 908231 - RNA, 23 nt, Mycobacterium avium subsp. paratuberculosis
gccgacggugucguagacgacgu

SEQ ID NO: 908232 - RNA, 15 nt, Mycobacterium avium subsp. paratuberculosis
gccgacguaaccgua

SEQ ID NO: 908233 - RNA, 19 nt, Mycobacterium avium subsp. paratuberculosis
gccgacguaaccguacggc

SEQ ID NO: 908234 - RNA, 22 nt, Mycobacterium avium subsp. paratuberculosis
gccgacguaaccguacggcccg

SEQ ID NO: 908235 - RNA, 15 nt, Mycobacterium avium subsp. paratuberculosis
gccgacguagacgag

SEQ ID NO: 908236 - RNA, 22 nt, Mycobacterium avium subsp. paratuberculosis
gccgacguagacgagccgguug

SEQ ID NO: 908237 - RNA, 22 nt, Mycobacterium avium subsp. paratuberculosis
gccgacgcgcugcgcgccgccc

SEQ ID NO: 908238 - RNA, 18 nt, Mycobacterium avium subsp. paratuberculosis
gccgacggagacgaccag

SEQ ID NO: 908239 - RNA, 21 nt, Mycobacterium avium subsp. paratuberculosis
gccgacggagacgaccagguc

SEQ ID NO: 908240 - RNA, 14 nt, Mycobacterium avium subsp. paratuberculosis
gccgacgcggccuc

SEQ ID NO: 908241 - RNA, 16 nt, Mycobacterium avium subsp. paratuberculosis
gccgacgcggccucga

SEQ ID NO: 908242 - RNA, 12 nt, Mycobacterium avium subsp. paratuberculosis
gccgacgcgccg

SEQ ID NO: 908243 - RNA, 14 nt, Mycobacterium avium subsp. paratuberculosis
gccgacgccgucga

SEQ ID NO: 908244 - RNA, 17 nt, Mycobacterium avium subsp. paratuberculosis
gccgacgccgucgauga

SEQ ID NO: 908245 - RNA, 16 nt, Mycobacterium avium subsp. paratuberculosis
gccgacgccugcgcga

SEQ ID NO: 908246 - RNA, 19 nt, Mycobacterium avium subsp. paratuberculosis
gccgacgccugcgcgaaca

SEQ ID NO: 908247 - RNA, 14 nt, Mycobacterium avium subsp. paratuberculosis
gccgacgccggcca

SEQ ID NO: 908248 - RNA, 15 nt, Mycobacterium avium subsp. paratuberculosis
gccgacgccggccac

SEQ ID NO: 908249 - RNA, 17 nt, Mycobacterium avium subsp. paratuberculosis
gccgacgccggccacca

SEQ ID NO: 908250 - RNA, 20 nt, Mycobacterium avium subsp. paratuberculosis
gccgacgccggccaccaaca

SEQ ID NO: 908251 - RNA, 20 nt, Mycobacterium avium subsp. paratuberculosis
gccgaccuuggcguuguuga

SEQ ID NO: 908252 - RNA, 22 nt, Mycobacterium avium subsp. paratuberculosis
gccgacgaagaucccgcuggcc

SEQ ID NO: 908253 - RNA, 21 nt, Mycobacterium avium subsp. paratuberculosis
gccgacgaagaugcgcccggu

SEQ ID NO: 908254 - RNA, 14 nt, Mycobacterium avium subsp. paratuberculosis
gccgagcaucagcu

SEQ ID NO: 908255 - RNA, 18 nt, Mycobacterium avium subsp. paratuberculosis
gccgagcaucagcugccg

SEQ ID NO: 908256 - RNA, 22 nt, Mycobacterium avium subsp. paratuberculosis
gccgagcaucagcugccguccg

SEQ ID NO: 908257 - RNA, 17 nt, Mycobacterium avium subsp. paratuberculosis
gccgagcccgccggcgg

SEQ ID NO: 908258 - RNA, 19 nt, Mycobacterium avium subsp. paratuberculosis
gccgagcccgccggcggcg

SEQ ID NO: 908259 - RNA, 17 nt, Mycobacterium avium subsp. paratuberculosis
gccgagcgcagcgggga

SEQ ID NO: 908260 - RNA, 18 nt, Mycobacterium avium subsp. paratuberculosis
gccgagcgcaucgacugc

SEQ ID NO: 908261 - RNA, 19 nt, Mycobacterium avium subsp. paratuberculosis
gccgagcgcaucgacugcg

SEQ ID NO: 908262 - RNA, 13 nt, Mycobacterium avium subsp. paratuberculosis
gccgagcgcaccg

SEQ ID NO: 908263 - RNA, 16 nt, Mycobacterium avium subsp. paratuberculosis
gccgagcgcaccgcgg

SEQ ID NO: 908264 - RNA, 17 nt, Mycobacterium avium subsp. paratuberculosis
gccgagcgcaccgcgga

SEQ ID NO: 908265 - RNA, 23 nt, Mycobacterium avium subsp. paratuberculosis
gccgagcccuuugcgcugcccga

SEQ ID NO: 908266 - RNA, 12 nt, Mycobacterium avium subsp. paratuberculosis
gccgagccgacc

SEQ ID NO: 908267 - RNA, 14 nt, Mycobacterium avium subsp. paratuberculosis
gccgagccgacccg

SEQ ID NO: 908268 - RNA, 20 nt, Mycobacterium avium subsp. paratuberculosis
gccgagccgacccgggcuag

SEQ ID NO: 908269 - RNA, 13 nt, Mycobacterium avium subsp. paratuberculosis
gccgagccgagcc

SEQ ID NO: 908270 - RNA, 17 nt, Mycobacterium avium subsp. paratuberculosis
gccgagccgagccgacc

SEQ ID NO: 908271 - RNA, 21 nt, Mycobacterium avium subsp. paratuberculosis
gccgagccgaggccgauggcg

SEQ ID NO: 908272 - RNA, 22 nt, Mycobacterium avium subsp. paratuberculosis
gccgagccgaggccgauggcgc

SEQ ID NO: 908273 - RNA, 15 nt, Mycobacterium avium subsp. paratuberculosis
gccgagcacgcggcc

SEQ ID NO: 908274 - RNA, 20 nt, Mycobacterium avium subsp. paratuberculosis
gccgagcacgcggccgcgcc

SEQ ID NO: 908275 - RNA, 21 nt, Mycobacterium avium subsp. paratuberculosis
gccgagcacgcggccgcgccg

SEQ ID NO: 908276 - RNA, 16 nt, Mycobacterium avium subsp. paratuberculosis
gccgagauccaccgcg

SEQ ID NO: 908277 - RNA, 18 nt, Mycobacterium avium subsp. paratuberculosis
gccgagauccaccgcgcg

SEQ ID NO: 908278 - RNA, 19 nt, Mycobacterium avium subsp. paratuberculosis
gccgagauccaccgcgcgg

SEQ ID NO: 908279 - RNA, 19 nt, Mycobacterium avium subsp. paratuberculosis
gccgagcaccucgucgccg

SEQ ID NO: 908280 - RNA, 23 nt, Mycobacterium avium subsp. paratuberculosis
gccgagcaccucgucgccgucgg

SEQ ID NO: 908281 - RNA, 13 nt, Mycobacterium avium subsp. paratuberculosis
gccgagcaccugg

SEQ ID NO: 908282 - RNA, 14 nt, Mycobacterium avium subsp. paratuberculosis
gccgagcaccuggc

SEQ ID NO: 908283 - RNA, 17 nt, Mycobacterium avium subsp. paratuberculosis
gccgagcacgaacgcgg

SEQ ID NO: 908284 - RNA, 20 nt, Mycobacterium avium subsp. paratuberculosis
gccgagcacgaacgcggccg

SEQ ID NO: 908285 - RNA, 21 nt, Mycobacterium avium subsp. paratuberculosis
gccgagcacgaacgcggccgc

SEQ ID NO: 908286 - RNA, 17 nt, Mycobacterium avium subsp. paratuberculosis
gccgagaaugccguaga

SEQ ID NO: 908287 - RNA, 16 nt, Mycobacterium avium subsp. paratuberculosis
gccgagagcgcgucga

SEQ ID NO: 908288 - RNA, 18 nt, Mycobacterium avium subsp. paratuberculosis
gccgagagcgcgucgacg

SEQ ID NO: 908289 - RNA, 20 nt, Mycobacterium avium subsp. paratuberculosis
gccgagagcgcgucgacgcg

SEQ ID NO: 908290 - RNA, 22 nt, Mycobacterium avium subsp. paratuberculosis
gccgagagcgcgucgacgcggu

SEQ ID NO: 908291 - RNA, 22 nt, Mycobacterium avium subsp. paratuberculosis
gccgagagcgucuuguuggcga

SEQ ID NO: 908292 - RNA, 14 nt, Mycobacterium avium subsp. paratuberculosis
gccgagacggcgug

SEQ ID NO: 908293 - RNA, 15 nt, Mycobacterium avium subsp. paratuberculosis
gccgagacggcgugg

SEQ ID NO: 908294 - RNA, 15 nt, Mycobacterium avium subsp. paratuberculosis
gccgagacguggugg

SEQ ID NO: 908295 - RNA, 19 nt, Mycobacterium avium subsp. paratuberculosis
gccgagacugaugguggcg

SEQ ID NO: 908296 - RNA, 19 nt, Mycobacterium avium subsp. paratuberculosis
gccgagcagagcuacggac

SEQ ID NO: 908297 - RNA, 15 nt, Mycobacterium avium subsp. paratuberculosis
gccgagcagaucggg

SEQ ID NO: 908298 - RNA, 13 nt, Mycobacterium avium subsp. paratuberculosis
gccgagcagcacc

SEQ ID NO: 908299 - RNA, 14 nt, Mycobacterium avium subsp. paratuberculosis
gccgagcacgcagc

SEQ ID NO: 908300 - RNA, 16 nt, Mycobacterium avium subsp. paratuberculosis
gccgagcagccgggcc

SEQ ID NO: 908301 - RNA, 18 nt, Mycobacterium avium subsp. paratuberculosis
gccgagcagccgggccag

SEQ ID NO: 908302 - RNA, 23 nt, Mycobacterium avium subsp. paratuberculosis
gccgagcagccgggccagcaaca

SEQ ID NO: 908303 - RNA, 14 nt, Mycobacterium avium subsp. paratuberculosis
gccgagcagcaccg

SEQ ID NO: 908304 - RNA, 15 nt, Mycobacterium avium subsp. paratuberculosis
gccgagcagcaccgc

SEQ ID NO: 908305 - RNA, 17 nt, Mycobacterium avium subsp. paratuberculosis
gccgagcagcaccgcga

SEQ ID NO: 908306 - RNA, 16 nt, Mycobacterium avium subsp. paratuberculosis
gccgagcagcaccggc

SEQ ID NO: 908307 - RNA, 12 nt, Mycobacterium avium subsp. paratuberculosis
gccgagcagcuc

SEQ ID NO: 908308 - RNA, 17 nt, Mycobacterium avium subsp. paratuberculosis
gccgagcagcucagccg

SEQ ID NO: 908309 - RNA, 22 nt, Mycobacterium avium subsp. paratuberculosis
gccgagcagcucagccgccugg

SEQ ID NO: 908310 - RNA, 14 nt, Mycobacterium avium subsp. paratuberculosis
gccgagcagcucgg

SEQ ID NO: 908311 - RNA, 15 nt, Mycobacterium avium subsp. paratuberculosis
gccgagcagcucggc

SEQ ID NO: 908312 - RNA, 17 nt, Mycobacterium avium subsp. paratuberculosis
gccgagcagcucggcgg

SEQ ID NO: 908313 - RNA, 12 nt, Mycobacterium avium subsp. paratuberculosis
gccgacagucgc

SEQ ID NO: 908314 - RNA, 13 nt, Mycobacterium avium subsp. paratuberculosis
gccgacagucgcg

SEQ ID NO: 908315 - RNA, 19 nt, Mycobacterium avium subsp. paratuberculosis
gccgacagucgcgggcagc

SEQ ID NO: 908316 - RNA, 20 nt, Mycobacterium avium subsp. paratuberculosis
gccgacagucgcgggcagcc

SEQ ID NO: 908317 - RNA, 24 nt, Mycobacterium avium subsp. paratuberculosis
gccgacagucgcgggcagccggcg

SEQ ID NO: 908318 - RNA, 21 nt, Mycobacterium avium subsp. paratuberculosis
gccgacagucgcgggcgagcc

SEQ ID NO: 908319 - RNA, 19 nt, Mycobacterium avium subsp. paratuberculosis
gccgacagguagcaggcgc

SEQ ID NO: 908320 - RNA, 17 nt, Mycobacterium avium subsp. paratuberculosis
gccgacagcgucgucca

SEQ ID NO: 908321 - RNA, 18 nt, Mycobacterium avium subsp. paratuberculosis
gccgacagcugagcagcc

SEQ ID NO: 908322 - RNA, 21 nt, Mycobacterium avium subsp. paratuberculosis
gccgacagcugagcagcccga

SEQ ID NO: 908323 - RNA, 20 nt, Mycobacterium avium subsp. paratuberculosis
gccgaccagcaggacgcgcc

SEQ ID NO: 908324 - RNA, 13 nt, Mycobacterium avium subsp. paratuberculosis
gccgaccagccga

SEQ ID NO: 908325 - RNA, 14 nt, Mycobacterium avium subsp. paratuberculosis
gccgaccagcgcgu

SEQ ID NO: 908326 - RNA, 16 nt, Mycobacterium avium subsp. paratuberculosis
gccgaccagcgcguug

SEQ ID NO: 908327 - RNA, 18 nt, Mycobacterium avium subsp. paratuberculosis
gccgaccgacaguucggc

SEQ ID NO: 908328 - RNA, 14 nt, Mycobacterium avium subsp. paratuberculosis
gccgaccgacccgg

SEQ ID NO: 908329 - RNA, 17 nt, Mycobacterium avium subsp. paratuberculosis
gccgaccgacccggcca

SEQ ID NO: 908330 - RNA, 21 nt, Mycobacterium avium subsp. paratuberculosis
gccgaccgacccggccagcgg

SEQ ID NO: 908331 - RNA, 15 nt, Mycobacterium avium subsp. paratuberculosis
gccgaccaguucggc

SEQ ID NO: 908332 - RNA, 18 nt, Mycobacterium avium subsp. paratuberculosis
gccgaccaguucggccac

SEQ ID NO: 908333 - RNA, 21 nt, Mycobacterium avium subsp. paratuberculosis
gccgaccaguucggccaccgc

SEQ ID NO: 908334 - RNA, 22 nt, Mycobacterium avium subsp. paratuberculosis
gccgaccaguucggccaccgcg

SEQ ID NO: 908335 - RNA, 15 nt, Mycobacterium avium subsp. paratuberculosis
gccgaccagguagcg

SEQ ID NO: 908336 - RNA, 22 nt, Mycobacterium avium subsp. paratuberculosis
gccgaccaggcucgcgagggcg

SEQ ID NO: 908337 - RNA, 11 nt, Mycobacterium avium subsp. paratuberculosis
gccgaccagcg

SEQ ID NO: 908338 - RNA, 15 nt, Mycobacterium avium subsp. paratuberculosis
gccgaccuggcggcc

SEQ ID NO: 908339 - RNA, 16 nt, Mycobacterium avium subsp. paratuberculosis
gccgaccuggcggccg

SEQ ID NO: 908340 - RNA, 20 nt, Mycobacterium avium subsp. paratuberculosis
gccgaccuugacccaggccc

SEQ ID NO: 908341 - RNA, 14 nt, Mycobacterium avium subsp. paratuberculosis
gccgaccugggcgg

SEQ ID NO: 908342 - RNA, 18 nt, Mycobacterium avium subsp. paratuberculosis
gccgaccugggcggccac

SEQ ID NO: 908343 - RNA, 22 nt, Mycobacterium avium subsp. paratuberculosis
gccgaccugggcggccaccgcg

SEQ ID NO: 908344 - RNA, 17 nt, Mycobacterium avium subsp. paratuberculosis
gccgaccuggucgccga

SEQ ID NO: 908345 - RNA, 19 nt, Mycobacterium avium subsp. paratuberculosis
gccgaccuggucgccgaac

SEQ ID NO: 908346 - RNA, 18 nt, Mycobacterium avium subsp. paratuberculosis
gccgaccgcggucgcggc

SEQ ID NO: 908347 - RNA, 19 nt, Mycobacterium avium subsp. paratuberculosis
gccgaccgcggucgcggcg

SEQ ID NO: 908348 - RNA, 20 nt, Mycobacterium avium subsp. paratuberculosis
gccgaccgcggucgcggcgc

SEQ ID NO: 908349 - RNA, 21 nt, Mycobacterium avium subsp. paratuberculosis
gccgaccgcggucgcggcgcc

SEQ ID NO: 908350 - RNA, 22 nt, Mycobacterium avium subsp. paratuberculosis
gccgaccgcggucgcggcgccg

SEQ ID NO: 908351 - RNA, 11 nt, Mycobacterium avium subsp. paratuberculosis
gccgaccgcgu

SEQ ID NO: 908352 - RNA, 17 nt, Mycobacterium avium subsp. paratuberculosis
gccgaccgcgugucggc

SEQ ID NO: 908353 - RNA, 19 nt, Mycobacterium avium subsp. paratuberculosis
gccgaccugcacgcugaag

SEQ ID NO: 908354 - RNA, 13 nt, Mycobacterium avium subsp. paratuberculosis
gccgaccugcgcg

SEQ ID NO: 908355 - RNA, 14 nt, Mycobacterium avium subsp. paratuberculosis
gccgaccugcgcga

SEQ ID NO: 908356 - RNA, 16 nt, Mycobacterium avium subsp. paratuberculosis
gccgaccugcgcgacg

SEQ ID NO: 908357 - RNA, 18 nt, Mycobacterium avium subsp. paratuberculosis
gccgaccugcgcgacggc

SEQ ID NO: 908358 - RNA, 19 nt, Mycobacterium avium subsp. paratuberculosis
gccgaccugcgcgacggcg

SEQ ID NO: 908359 - RNA, 13 nt, Mycobacterium avium subsp. paratuberculosis
gccgaccgcgagc

SEQ ID NO: 908360 - RNA, 15 nt, Mycobacterium avium subsp. paratuberculosis
gccgaccgcgaucga

SEQ ID NO: 908361 - RNA, 14 nt, Mycobacterium avium subsp. paratuberculosis
gccgaccgccccgc

SEQ ID NO: 908362 - RNA, 14 nt, Mycobacterium avium subsp. paratuberculosis
gccgaccgcccgcu

SEQ ID NO: 908363 - RNA, 15 nt, Mycobacterium avium subsp. paratuberculosis
gccgaccgccgagcg

SEQ ID NO: 908364 - RNA, 20 nt, Mycobacterium avium subsp. paratuberculosis
gccgaccgccgagcgggcga

SEQ ID NO: 908365 - RNA, 14 nt, Mycobacterium avium subsp. paratuberculosis
gccgaccgccgcca

SEQ ID NO: 908366 - RNA, 19 nt, Mycobacterium avium subsp. paratuberculosis
gccgaccgccgccauccgu

SEQ ID NO: 908367 - RNA, 22 nt, Mycobacterium avium subsp. paratuberculosis
gccgaccgccgccauccguucg

SEQ ID NO: 908368 - RNA, 14 nt, Mycobacterium avium subsp. paratuberculosis
gccgaccgccucga

SEQ ID NO: 908369 - RNA, 20 nt, Mycobacterium avium subsp. paratuberculosis
gccgaccgccucgauggccc

SEQ ID NO: 908370 - RNA, 17 nt, Mycobacterium avium subsp. paratuberculosis
gcccuagucgacgccga

SEQ ID NO: 908371 - RNA, 15 nt, Mycobacterium avium subsp. paratuberculosis
gcccuauggcaucgc

SEQ ID NO: 908372 - RNA, 16 nt, Mycobacterium avium subsp. paratuberculosis
gcccuagcgguggcgu

SEQ ID NO: 908373 - RNA, 16 nt, Mycobacterium avium subsp. paratuberculosis
gccgaauccggccgga

SEQ ID NO: 908374 - RNA, 15 nt, Mycobacterium avium subsp. paratuberculosis
gccgaauccggcggg

SEQ ID NO: 908375 - RNA, 13 nt, Mycobacterium avium subsp. paratuberculosis
gcccucagugcgg

SEQ ID NO: 908376 - RNA, 16 nt, Mycobacterium avium subsp. paratuberculosis
gcccucagugcgggua

SEQ ID NO: 908377 - RNA, 12 nt, Mycobacterium avium subsp. paratuberculosis
gccgaauucggu

SEQ ID NO: 908378 - RNA, 19 nt, Mycobacterium avium subsp. paratuberculosis
gccgacaacauccgcgacg

SEQ ID NO: 908379 - RNA, 20 nt, Mycobacterium avium subsp. paratuberculosis
gccgacaacauccgcgacga

SEQ ID NO: 908380 - RNA, 21 nt, Mycobacterium avium subsp. paratuberculosis
gccgaauugcuuacgcaucgc

SEQ ID NO: 908381 - RNA, 15 nt, Mycobacterium avium subsp. paratuberculosis
gccgaauuguucggc

SEQ ID NO: 908382 - RNA, 17 nt, Mycobacterium avium subsp. paratuberculosis
gccgaauuguucggcca

SEQ ID NO: 908383 - RNA, 22 nt, Mycobacterium avium subsp. paratuberculosis
gccgaauuguucggccaccgcg

SEQ ID NO: 908384 - RNA, 18 nt, Mycobacterium avium subsp. paratuberculosis
gccgacacguaggccgcc

SEQ ID NO: 908385 - RNA, 16 nt, Mycobacterium avium subsp. paratuberculosis
gccgacagacccgaca

SEQ ID NO: 908386 - RNA, 20 nt, Mycobacterium avium subsp. paratuberculosis
gccgacagaugcggcaccag

SEQ ID NO: 908387 - RNA, 18 nt, Mycobacterium avium subsp. paratuberculosis
gccgacagcaccucgccc

SEQ ID NO: 908388 - RNA, 13 nt, Mycobacterium avium subsp. paratuberculosis
gccgacagcacgc

SEQ ID NO: 908389 - RNA, 16 nt, Mycobacterium avium subsp. paratuberculosis
gccgacagcacgccgg

SEQ ID NO: 908390 - RNA, 17 nt, Mycobacterium avium subsp. paratuberculosis
gccgacagcacgccggg

SEQ ID NO: 908391 - RNA, 13 nt, Mycobacterium avium subsp. paratuberculosis
gccgacagcagcu

SEQ ID NO: 908392 - RNA, 20 nt, Mycobacterium avium subsp. paratuberculosis
gccgcaccgcaaagcaccgc

SEQ ID NO: 908393 - RNA, 21 nt, Mycobacterium avium subsp. paratuberculosis
gccgcaccgcaaagcaccgcg

SEQ ID NO: 908394 - RNA, 11 nt, Mycobacterium avium subsp. paratuberculosis
gccgcacccga

SEQ ID NO: 908395 - RNA, 22 nt, Mycobacterium avium subsp. paratuberculosis
gccgcacccgauccacggcgac

SEQ ID NO: 908396 - RNA, 23 nt, Mycobacterium avium subsp. paratuberculosis
gccgcacguauccgcggucgacc

SEQ ID NO: 908397 - RNA, 21 nt, Mycobacterium avium subsp. paratuberculosis
gccgcacccagcgggcgacgu

SEQ ID NO: 908398 - RNA, 15 nt, Mycobacterium avium subsp. paratuberculosis
gccgcaccccacccg

SEQ ID NO: 908399 - RNA, 17 nt, Mycobacterium avium subsp. paratuberculosis
gccgcaccccacccgcg

SEQ ID NO: 908400 - RNA, 17 nt, Mycobacterium avium subsp. paratuberculosis
gccgcaccagaucgucg

SEQ ID NO: 908401 - RNA, 23 nt, Mycobacterium avium subsp. paratuberculosis
gccgcaccagaucgucgggcacc

SEQ ID NO: 908402 - RNA, 14 nt, Mycobacterium avium subsp. paratuberculosis
gccgcaccagcacc

SEQ ID NO: 908403 - RNA, 16 nt, Mycobacterium avium subsp. paratuberculosis
gccgcaccagcacccc

SEQ ID NO: 908404 - RNA, 22 nt, Mycobacterium avium subsp. paratuberculosis
gccgcaccaguuccugcaugcc

SEQ ID NO: 908405 - RNA, 13 nt, Mycobacterium avium subsp. paratuberculosis
gccgcaccagguu

SEQ ID NO: 908406 - RNA, 17 nt, Mycobacterium avium subsp. paratuberculosis
gccgcacagccggcggc

SEQ ID NO: 908407 - RNA, 18 nt, Mycobacterium avium subsp. paratuberculosis
gccgcaacuugcccgacg

SEQ ID NO: 908408 - RNA, 14 nt, Mycobacterium avium subsp. paratuberculosis
gccgcaacggcgca

SEQ ID NO: 908409 - RNA, 22 nt, Mycobacterium avium subsp. paratuberculosis
gccgcaacggcggucgugcggc

SEQ ID NO: 908410 - RNA, 15 nt, Mycobacterium avium subsp. paratuberculosis
gccgcaacgggccgc

SEQ ID NO: 908411 - RNA, 16 nt, Mycobacterium avium subsp. paratuberculosis
gccgcaacgggccgca

SEQ ID NO: 908412 - RNA, 23 nt, Mycobacterium avium subsp. paratuberculosis
gccgcacuuggccucgggcgacg

SEQ ID NO: 908413 - RNA, 20 nt, Mycobacterium avium subsp. paratuberculosis
gccgcacguguucucacggc

SEQ ID NO: 908414 - RNA, 18 nt, Mycobacterium avium subsp. paratuberculosis
gccgcacuccgucgcgau

SEQ ID NO: 908415 - RNA, 19 nt, Mycobacterium avium subsp. paratuberculosis
gccgcacuccgucgcgauc

SEQ ID NO: 908416 - RNA, 21 nt, Mycobacterium avium subsp. paratuberculosis
gccgcacuccgucgcgaucac

SEQ ID NO: 908417 - RNA, 18 nt, Mycobacterium avium subsp. paratuberculosis
gccgcacucuugcgugcg

SEQ ID NO: 908418 - RNA, 20 nt, Mycobacterium avium subsp. paratuberculosis
gccgcacugcacggccucgg

SEQ ID NO: 908419 - RNA, 20 nt, Mycobacterium avium subsp. paratuberculosis
gccgcacugcaucucgaccu

SEQ ID NO: 908420 - RNA, 21 nt, Mycobacterium avium subsp. paratuberculosis
gccgcacugcaucucgaccug

SEQ ID NO: 908421 - RNA, 23 nt, Mycobacterium avium subsp. paratuberculosis
gccgcacugcaucucgaccuggg

SEQ ID NO: 908422 - RNA, 13 nt, Mycobacterium avium subsp. paratuberculosis
gccgcagcgcccg

SEQ ID NO: 908423 - RNA, 14 nt, Mycobacterium avium subsp. paratuberculosis
gccgcagcgcgacg

SEQ ID NO: 908424 - RNA, 18 nt, Mycobacterium avium subsp. paratuberculosis
gccgcagcgcgcgaccgc

SEQ ID NO: 908425 - RNA, 22 nt, Mycobacterium avium subsp. paratuberculosis
gccgcagcgcgcgaccgcgaug

SEQ ID NO: 908426 - RNA, 19 nt, Mycobacterium avium subsp. paratuberculosis
gccgcagcgcgcgcucggu

SEQ ID NO: 908427 - RNA, 13 nt, Mycobacterium avium subsp. paratuberculosis
gccgcagcgcggc

SEQ ID NO: 908428 - RNA, 15 nt, Mycobacterium avium subsp. paratuberculosis
gccgcagcgcggcga

SEQ ID NO: 908429 - RNA, 16 nt, Mycobacterium avium subsp. paratuberculosis
gccgcagcgcggcgac

SEQ ID NO: 908430 - RNA, 17 nt, Mycobacterium avium subsp. paratuberculosis
gccgcagcgcggcgaca

SEQ ID NO: 908431 - RNA, 12 nt, Mycobacterium avium subsp. paratuberculosis
gccgcagcgccc

SEQ ID NO: 908432 - RNA, 14 nt, Mycobacterium avium subsp. paratuberculosis
gccgcagcgcagcg

SEQ ID NO: 908433 - RNA, 17 nt, Mycobacterium avium subsp. paratuberculosis
gccgcagcgcagcgucg

SEQ ID NO: 908434 - RNA, 22 nt, Mycobacterium avium subsp. paratuberculosis
gccgcagcgcagcgucggcgug

SEQ ID NO: 908435 - RNA, 14 nt, Mycobacterium avium subsp. paratuberculosis
gccgcagcgcaucg

SEQ ID NO: 908436 - RNA, 23 nt, Mycobacterium avium subsp. paratuberculosis
gccgcagcgcaucgccggcgaug

SEQ ID NO: 908437 - RNA, 12 nt, Mycobacterium avium subsp. paratuberculosis
gccgaugccggc

SEQ ID NO: 908438 - RNA, 23 nt, Mycobacterium avium subsp. paratuberculosis
gccgaugccgcgcugcgccgggu

SEQ ID NO: 908439 - RNA, 15 nt, Mycobacterium avium subsp. paratuberculosis
gccgaugcccagcag

SEQ ID NO: 908440 - RNA, 16 nt, Mycobacterium avium subsp. paratuberculosis
gccgaugcccagcagc

SEQ ID NO: 908441 - RNA, 14 nt, Mycobacterium avium subsp. paratuberculosis
gccgaugcagcaca

SEQ ID NO: 908442 - RNA, 21 nt, Mycobacterium avium subsp. paratuberculosis
gccgaugcagcacauccagcc

SEQ ID NO: 908443 - RNA, 18 nt, Mycobacterium avium subsp. paratuberculosis
gccgaugcccaucacgcc

SEQ ID NO: 908444 - RNA, 19 nt, Mycobacterium avium subsp. paratuberculosis
gccgaugcccaucacgccc

SEQ ID NO: 908445 - RNA, 21 nt, Mycobacterium avium subsp. paratuberculosis
gccgaugcccaucacgcccca

SEQ ID NO: 908446 - RNA, 17 nt, Mycobacterium avium subsp. paratuberculosis
gccgauguucaccccga

SEQ ID NO: 908447 - RNA, 19 nt, Mycobacterium avium subsp. paratuberculosis
gccgauguucaccccgauc

SEQ ID NO: 908448 - RNA, 14 nt, Mycobacterium avium subsp. paratuberculosis
gccgaugugcucgg

SEQ ID NO: 908449 - RNA, 19 nt, Mycobacterium avium subsp. paratuberculosis
gccgauguggccggcgaug

SEQ ID NO: 908450 - RNA, 13 nt, Mycobacterium avium subsp. paratuberculosis
gccgaugccggcg

SEQ ID NO: 908451 - RNA, 13 nt, Mycobacterium avium subsp. paratuberculosis
gccgauguggcgg

SEQ ID NO: 908452 - RNA, 22 nt, Mycobacterium avium subsp. paratuberculosis
gccgauguggcgggcguccugc

SEQ ID NO: 908453 - RNA, 14 nt, Mycobacterium avium subsp. paratuberculosis
gccgaugccggcgu

SEQ ID NO: 908454 - RNA, 21 nt, Mycobacterium avium subsp. paratuberculosis
gccgcaacacggccucgauca

SEQ ID NO: 908455 - RNA, 14 nt, Mycobacterium avium subsp. paratuberculosis
gccgcaacagccgg

SEQ ID NO: 908456 - RNA, 21 nt, Mycobacterium avium subsp. paratuberculosis
gccgauucggcgccgcgaccc

SEQ ID NO: 908457 - RNA, 18 nt, Mycobacterium avium subsp. paratuberculosis
gccgauuccggccggccg

SEQ ID NO: 908458 - RNA, 22 nt, Mycobacterium avium subsp. paratuberculosis
gccgauuccggccggccgccgg

SEQ ID NO: 908459 - RNA, 18 nt, Mycobacterium avium subsp. paratuberculosis
gccgauuccgucgguggc

SEQ ID NO: 908460 - RNA, 19 nt, Mycobacterium avium subsp. paratuberculosis
gccgauuccgucgguggcg

SEQ ID NO: 908461 - RNA, 17 nt, Mycobacterium avium subsp. paratuberculosis
gccgauucaaccccgcg

SEQ ID NO: 908462 - RNA, 19 nt, Mycobacterium avium subsp. paratuberculosis
gccgauucaaccccgcgcg

SEQ ID NO: 908463 - RNA, 22 nt, Mycobacterium avium subsp. paratuberculosis
gccgauucaaccccgcgcgcgg

SEQ ID NO: 908464 - RNA, 21 nt, Mycobacterium avium subsp. paratuberculosis
gccgauacaugugccgauguc

SEQ ID NO: 908465 - RNA, 20 nt, Mycobacterium avium subsp. paratuberculosis
gccgaucaccggcacgugcg

SEQ ID NO: 908466 - RNA, 21 nt, Mycobacterium avium subsp. paratuberculosis
gccgaucaccggcacgugcgg

SEQ ID NO: 908467 - RNA, 13 nt, Mycobacterium avium subsp. paratuberculosis
gccgaucaccucg

SEQ ID NO: 908468 - RNA, 15 nt, Mycobacterium avium subsp. paratuberculosis
gccgaucaccucgau

SEQ ID NO: 908469 - RNA, 17 nt, Mycobacterium avium subsp. paratuberculosis
gccgaucaccucgccgg

SEQ ID NO: 908470 - RNA, 18 nt, Mycobacterium avium subsp. paratuberculosis
gccgaucaccugacagac

SEQ ID NO: 908471 - RNA, 23 nt, Mycobacterium avium subsp. paratuberculosis
gccgaucaccugacagacccgau

SEQ ID NO: 908472 - RNA, 14 nt, Mycobacterium avium subsp. paratuberculosis
gccgaucagcacca

SEQ ID NO: 908473 - RNA, 23 nt, Mycobacterium avium subsp. paratuberculosis
gccgaucaccgcguugucggcga

SEQ ID NO: 908474 - RNA, 19 nt, Mycobacterium avium subsp. paratuberculosis
gccgaucacggugaucgcc

SEQ ID NO: 908475 - RNA, 12 nt, Mycobacterium avium subsp. paratuberculosis
gccgaucacgaa

SEQ ID NO: 908476 - RNA, 14 nt, Mycobacterium avium subsp. paratuberculosis
gccgaucacgccgg

SEQ ID NO: 908477 - RNA, 15 nt, Mycobacterium avium subsp. paratuberculosis
gccgaucacgccggu

SEQ ID NO: 908478 - RNA, 16 nt, Mycobacterium avium subsp. paratuberculosis
gccgaucacgccggug

SEQ ID NO: 908479 - RNA, 20 nt, Mycobacterium avium subsp. paratuberculosis
gccgaugaugguggcggcca

SEQ ID NO: 908480 - RNA, 22 nt, Mycobacterium avium subsp. paratuberculosis
gccgaugaugguggcggccacc

SEQ ID NO: 908481 - RNA, 23 nt, Mycobacterium avium subsp. paratuberculosis
gccgaugaugaaaccggccagca

SEQ ID NO: 908482 - RNA, 21 nt, Mycobacterium avium subsp. paratuberculosis
gccgaucugcucggcugcagg

SEQ ID NO: 908483 - RNA, 17 nt, Mycobacterium avium subsp. paratuberculosis
gccgaucucgaccagcg

SEQ ID NO: 908484 - RNA, 22 nt, Mycobacterium avium subsp. paratuberculosis
gccgaucucguagcccaccucg

SEQ ID NO: 908485 - RNA, 14 nt, Mycobacterium avium subsp. paratuberculosis
gccgaucuccaccg

SEQ ID NO: 908486 - RNA, 15 nt, Mycobacterium avium subsp. paratuberculosis
gccgaucuccaccga

SEQ ID NO: 908487 - RNA, 16 nt, Mycobacterium avium subsp. paratuberculosis
gccgaucuccaccgag

SEQ ID NO: 908488 - RNA, 22 nt, Mycobacterium avium subsp. paratuberculosis
gccgaucuccaccgagugcggc

SEQ ID NO: 908489 - RNA, 17 nt, Mycobacterium avium subsp. paratuberculosis
gccgaucggggcgcagc

SEQ ID NO: 908490 - RNA, 22 nt, Mycobacterium avium subsp. paratuberculosis
gccgaucggggcgcagcccggc

SEQ ID NO: 908491 - RNA, 22 nt, Mycobacterium avium subsp. paratuberculosis
gccgaucgugaauucggccggg

SEQ ID NO: 908492 - RNA, 16 nt, Mycobacterium avium subsp. paratuberculosis
gccgaucgggaccguc

SEQ ID NO: 908493 - RNA, 12 nt, Mycobacterium avium subsp. paratuberculosis
gccgaucgggau

SEQ ID NO: 908494 - RNA, 17 nt, Mycobacterium avium subsp. paratuberculosis
gccgaucgcggugcugc

SEQ ID NO: 908495 - RNA, 19 nt, Mycobacterium avium subsp. paratuberculosis
gccgaucagcgucagcacc

SEQ ID NO: 908496 - RNA, 14 nt, Mycobacterium avium subsp. paratuberculosis
gccgagggccagca

SEQ ID NO: 908497 - RNA, 16 nt, Mycobacterium avium subsp. paratuberculosis
gccgagggccagcagc

SEQ ID NO: 908498 - RNA, 13 nt, Mycobacterium avium subsp. paratuberculosis
gccgagggcgacg

SEQ ID NO: 908499 - RNA, 14 nt, Mycobacterium avium subsp. paratuberculosis
gccgagggcgacga

SEQ ID NO: 908500 - RNA, 12 nt, Mycobacterium avium subsp. paratuberculosis
gccgagggcggc

SEQ ID NO: 908501 - RNA, 14 nt, Mycobacterium avium subsp. paratuberculosis
gccgagggcggcgg

SEQ ID NO: 908502 - RNA, 14 nt, Mycobacterium avium subsp. paratuberculosis
gccgagguccucga

SEQ ID NO: 908503 - RNA, 16 nt, Mycobacterium avium subsp. paratuberculosis
gccgagguccucgacc

SEQ ID NO: 908504 - RNA, 17 nt, Mycobacterium avium subsp. paratuberculosis
gccgagguccucgaccu

SEQ ID NO: 908505 - RNA, 22 nt, Mycobacterium avium subsp. paratuberculosis
gccgagggggaagucgaccggg

SEQ ID NO: 908506 - RNA, 23 nt, Mycobacterium avium subsp. paratuberculosis
gccgagggguccggggcacggug

SEQ ID NO: 908507 - RNA, 17 nt, Mycobacterium avium subsp. paratuberculosis
gccgagggugccggcca

SEQ ID NO: 908508 - RNA, 18 nt, Mycobacterium avium subsp. paratuberculosis
gccgagggugccggccac

SEQ ID NO: 908509 - RNA, 21 nt, Mycobacterium avium subsp. paratuberculosis
gccgagggugccggccaccgg

SEQ ID NO: 908510 - RNA, 15 nt, Mycobacterium avium subsp. paratuberculosis
gccgagguacgcgcu

SEQ ID NO: 908511 - RNA, 20 nt, Mycobacterium avium subsp. paratuberculosis
gccgagguagccgcgcacca

SEQ ID NO: 908512 - RNA, 20 nt, Mycobacterium avium subsp. paratuberculosis
gccgagguagucggccuccu

SEQ ID NO: 908513 - RNA, 16 nt, Mycobacterium avium subsp. paratuberculosis
gccgaguuugcgguga

SEQ ID NO: 908514 - RNA, 16 nt, Mycobacterium avium subsp. paratuberculosis
gccgaguuuggcgucg

SEQ ID NO: 908515 - RNA, 18 nt, Mycobacterium avium subsp. paratuberculosis
gccgaguuuggcgucgau

SEQ ID NO: 908516 - RNA, 14 nt, Mycobacterium avium subsp. paratuberculosis
gccgaguucgaccu

SEQ ID NO: 908517 - RNA, 17 nt, Mycobacterium avium subsp. paratuberculosis
gccgaguucgaccucgg

SEQ ID NO: 908518 - RNA, 18 nt, Mycobacterium avium subsp. paratuberculosis
gccgaguucgaccucggu

SEQ ID NO: 908519 - RNA, 20 nt, Mycobacterium avium subsp. paratuberculosis
gccgaguucgaccucgguga

SEQ ID NO: 908520 - RNA, 21 nt, Mycobacterium avium subsp. paratuberculosis
gccgagucgcgccgcgucgcg

SEQ ID NO: 908521 - RNA, 18 nt, Mycobacterium avium subsp. paratuberculosis
gccgaggucgcggcggcc

SEQ ID NO: 908522 - RNA, 21 nt, Mycobacterium avium subsp. paratuberculosis
gccgaggucgcggcggccggc

SEQ ID NO: 908523 - RNA, 13 nt, Mycobacterium avium subsp. paratuberculosis
gccgaggaaccgg

SEQ ID NO: 908524 - RNA, 14 nt, Mycobacterium avium subsp. paratuberculosis
gccgaggaaccggc

SEQ ID NO: 908525 - RNA, 21 nt, Mycobacterium avium subsp. paratuberculosis
gccgaggaaccggcagccggc

SEQ ID NO: 908526 - RNA, 18 nt, Mycobacterium avium subsp. paratuberculosis
gccgaggacacguuggcc

SEQ ID NO: 908527 - RNA, 18 nt, Mycobacterium avium subsp. paratuberculosis
gccgaggauuucgcgauc

SEQ ID NO: 908528 - RNA, 14 nt, Mycobacterium avium subsp. paratuberculosis
gccgaggaggccgc

SEQ ID NO: 908529 - RNA, 19 nt, Mycobacterium avium subsp. paratuberculosis
gccgaggaggccgcggcga

SEQ ID NO: 908530 - RNA, 15 nt, Mycobacterium avium subsp. paratuberculosis
gccgagcggcgccac

SEQ ID NO: 908531 - RNA, 17 nt, Mycobacterium avium subsp. paratuberculosis
gccgagcggcgccacgu

SEQ ID NO: 908532 - RNA, 21 nt, Mycobacterium avium subsp. paratuberculosis
gccgagcggcgccacgugguc

SEQ ID NO: 908533 - RNA, 17 nt, Mycobacterium avium subsp. paratuberculosis
gccgagcgggcgaucuc

SEQ ID NO: 908534 - RNA, 19 nt, Mycobacterium avium subsp. paratuberculosis
gccgagcgcugguugucga

SEQ ID NO: 908535 - RNA, 16 nt, Mycobacterium avium subsp. paratuberculosis
gccgagcgcgccgagc

SEQ ID NO: 908536 - RNA, 22 nt, Mycobacterium avium subsp. paratuberculosis
gccgagcgcgccgccgccgccc

SEQ ID NO: 908537 - RNA, 12 nt, Mycobacterium avium subsp. paratuberculosis
gccgagcgcgcu

SEQ ID NO: 908538 - RNA, 14 nt, Mycobacterium avium subsp. paratuberculosis
gccgagcgcgcugg

SEQ ID NO: 908539 - RNA, 22 nt, Mycobacterium avium subsp. paratuberculosis
gccgagcuugggccggugcagc

SEQ ID NO: 908540 - RNA, 18 nt, Mycobacterium avium subsp. paratuberculosis
gccgaggaacugcagcga

SEQ ID NO: 908541 - RNA, 21 nt, Mycobacterium avium subsp. paratuberculosis
gccgaggaacugcagcgacug

SEQ ID NO: 908542 - RNA, 22 nt, Mycobacterium avium subsp. paratuberculosis
gccgaggaacugcagcgacugg

SEQ ID NO: 908543 - RNA, 16 nt, Mycobacterium avium subsp. paratuberculosis
gccgaggaagacgucg

SEQ ID NO: 908544 - RNA, 18 nt, Mycobacterium avium subsp. paratuberculosis
gccgccucacgcagggcc

SEQ ID NO: 908545 - RNA, 23 nt, Mycobacterium avium subsp. paratuberculosis
gccgccguugcgagucaucgcca

SEQ ID NO: 908546 - RNA, 14 nt, Mycobacterium avium subsp. paratuberculosis
gccgcgaccgcgau

SEQ ID NO: 908547 - RNA, 15 nt, Mycobacterium avium subsp. paratuberculosis
gccgcgaccgcgauc

SEQ ID NO: 908548 - RNA, 22 nt, Mycobacterium avium subsp. paratuberculosis
gccgccucgaagucgccggccu

SEQ ID NO: 908549 - RNA, 23 nt, Mycobacterium avium subsp. paratuberculosis
gccgccucgaagucgccggccuc

SEQ ID NO: 908550 - RNA, 16 nt, Mycobacterium avium subsp. paratuberculosis
gccgccuccagcacgu

SEQ ID NO: 908551 - RNA, 19 nt, Mycobacterium avium subsp. paratuberculosis
gccgccucccgcagcgcca

SEQ ID NO: 908552 - RNA, 18 nt, Mycobacterium avium subsp. paratuberculosis
gccgccuccgacagccgc

SEQ ID NO: 908553 - RNA, 19 nt, Mycobacterium avium subsp. paratuberculosis
gccgccuccgacagccgca

SEQ ID NO: 908554 - RNA, 19 nt, Mycobacterium avium subsp. paratuberculosis
gccgcgaggauuucgcuca

SEQ ID NO: 908555 - RNA, 21 nt, Mycobacterium avium subsp. paratuberculosis
gccgcgaggauuucgcucagc

SEQ ID NO: 908556 - RNA, 21 nt, Mycobacterium avium subsp. paratuberculosis
gccgcgagcacgacgucgacg

SEQ ID NO: 908557 - RNA, 15 nt, Mycobacterium avium subsp. paratuberculosis
gccgcgagcccggcg

SEQ ID NO: 908558 - RNA, 17 nt, Mycobacterium avium subsp. paratuberculosis
gccgcgagcccggcgac

SEQ ID NO: 908559 - RNA, 18 nt, Mycobacterium avium subsp. paratuberculosis
gccgcgagcccggcgacg

SEQ ID NO: 908560 - RNA, 20 nt, Mycobacterium avium subsp. paratuberculosis
gccgcgagcccggcgacguc

SEQ ID NO: 908561 - RNA, 15 nt, Mycobacterium avium subsp. paratuberculosis
gccgcgagccgccca

SEQ ID NO: 908562 - RNA, 16 nt, Mycobacterium avium subsp. paratuberculosis
gccgcgagccgcccag

SEQ ID NO: 908563 - RNA, 14 nt, Mycobacterium avium subsp. paratuberculosis
gccgcgagcgcagc

SEQ ID NO: 908564 - RNA, 13 nt, Mycobacterium avium subsp. paratuberculosis
gccgcgacgccgc

SEQ ID NO: 908565 - RNA, 16 nt, Mycobacterium avium subsp. paratuberculosis
gccgcgacgccgccgc

SEQ ID NO: 908566 - RNA, 19 nt, Mycobacterium avium subsp. paratuberculosis
gccgcgacgccgccgccga

SEQ ID NO: 908567 - RNA, 16 nt, Mycobacterium avium subsp. paratuberculosis
gccgcgacgccgugcu

SEQ ID NO: 908568 - RNA, 16 nt, Mycobacterium avium subsp. paratuberculosis
gccgcgaccgucagca

SEQ ID NO: 908569 - RNA, 20 nt, Mycobacterium avium subsp. paratuberculosis
gccgcgacgaugucgacccg

SEQ ID NO: 908570 - RNA, 21 nt, Mycobacterium avium subsp. paratuberculosis
gccgcgacgaugucgacccgc

SEQ ID NO: 908571 - RNA, 19 nt, Mycobacterium avium subsp. paratuberculosis
gccgcgacggccgccgauu

SEQ ID NO: 908572 - RNA, 16 nt, Mycobacterium avium subsp. paratuberculosis
gccgcgacggcggguc

SEQ ID NO: 908573 - RNA, 18 nt, Mycobacterium avium subsp. paratuberculosis
gccgcgacggcgggucga

SEQ ID NO: 908574 - RNA, 14 nt, Mycobacterium avium subsp. paratuberculosis
gccgcgacgcgcgg

SEQ ID NO: 908575 - RNA, 14 nt, Mycobacterium avium subsp. paratuberculosis
gccgcgacgggcug

SEQ ID NO: 908576 - RNA, 22 nt, Mycobacterium avium subsp. paratuberculosis
gccgcgacgguuguucagcccg

SEQ ID NO: 908577 - RNA, 13 nt, Mycobacterium avium subsp. paratuberculosis
gccgcgacgucgg

SEQ ID NO: 908578 - RNA, 16 nt, Mycobacterium avium subsp. paratuberculosis
gccgcgacgucggugu

SEQ ID NO: 908579 - RNA, 17 nt, Mycobacterium avium subsp. paratuberculosis
gccgcgacucggugucg

SEQ ID NO: 908580 - RNA, 21 nt, Mycobacterium avium subsp. paratuberculosis
gccgcgacucggugucgcuca

SEQ ID NO: 908581 - RNA, 18 nt, Mycobacterium avium subsp. paratuberculosis
gccgcgacucugcacuca

SEQ ID NO: 908582 - RNA, 16 nt, Mycobacterium avium subsp. paratuberculosis
gccgcgacugcacccg

SEQ ID NO: 908583 - RNA, 15 nt, Mycobacterium avium subsp. paratuberculosis
gccgccgugcgcggc

SEQ ID NO: 908584 - RNA, 16 nt, Mycobacterium avium subsp. paratuberculosis
gccgccgugcgcggcg

SEQ ID NO: 908585 - RNA, 20 nt, Mycobacterium avium subsp. paratuberculosis
gccgccguggaagauguugc

SEQ ID NO: 908586 - RNA, 14 nt, Mycobacterium avium subsp. paratuberculosis
gccgccguggacga

SEQ ID NO: 908587 - RNA, 17 nt, Mycobacterium avium subsp. paratuberculosis
gccgccguggcccacgc

SEQ ID NO: 908588 - RNA, 14 nt, Mycobacterium avium subsp. paratuberculosis
gccgccgucgcgcc

SEQ ID NO: 908589 - RNA, 15 nt, Mycobacterium avium subsp. paratuberculosis
gccgccgucgcgcca

SEQ ID NO: 908590 - RNA, 16 nt, Mycobacterium avium subsp. paratuberculosis
gccgccgucgcgccag

SEQ ID NO: 908591 - RNA, 12 nt, Mycobacterium avium subsp. paratuberculosis
gccgccguucgc

SEQ ID NO: 908592 - RNA, 17 nt, Mycobacterium avium subsp. paratuberculosis
gccgccguucgccggcg

SEQ ID NO: 908593 - RNA, 19 nt, Mycobacterium avium subsp. paratuberculosis
gccgccguucgccggcgac

SEQ ID NO: 908594 - RNA, 24 nt, Mycobacterium avium subsp. paratuberculosis
gccgccguucgccggcgacggcca

SEQ ID NO: 908595 - RNA, 20 nt, Mycobacterium avium subsp. paratuberculosis
gccgccguucucgcgcaggu

SEQ ID NO: 908596 - RNA, 13 nt, Mycobacterium avium subsp. paratuberculosis
gccgccguccagc

SEQ ID NO: 908597 - RNA, 16 nt, Mycobacterium avium subsp. paratuberculosis
gccgccguccagcguc

SEQ ID NO: 908598 - RNA, 18 nt, Mycobacterium avium subsp. paratuberculosis
gccgccguccagcgucac

SEQ ID NO: 908599 - RNA, 18 nt, Mycobacterium avium subsp. paratuberculosis
gccgccgucccaccggcg

SEQ ID NO: 908600 - RNA, 15 nt, Mycobacterium avium subsp. paratuberculosis
gccgccguccccgcg

SEQ ID NO: 908601 - RNA, 16 nt, Mycobacterium avium subsp. paratuberculosis
gccgccguccccgcgc

SEQ ID NO: 908602 - RNA, 17 nt, Mycobacterium avium subsp. paratuberculosis
gccgccguccccgcgcg

SEQ ID NO: 908603 - RNA, 19 nt, Mycobacterium avium subsp. paratuberculosis
gccgccguccccgcgcggc

SEQ ID NO: 908604 - RNA, 13 nt, Mycobacterium avium subsp. paratuberculosis
gccgccgucgacg

SEQ ID NO: 908605 - RNA, 14 nt, Mycobacterium avium subsp. paratuberculosis
gccgccgucgacga

SEQ ID NO: 908606 - RNA, 23 nt, Mycobacterium avium subsp. paratuberculosis
gccgccgucgccaccaccgcgcc

SEQ ID NO: 908607 - RNA, 13 nt, Mycobacterium avium subsp. paratuberculosis
gccgccgucgcca

SEQ ID NO: 908608 - RNA, 13 nt, Mycobacterium avium subsp. paratuberculosis
gccgccgucggug

SEQ ID NO: 908609 - RNA, 17 nt, Mycobacterium avium subsp. paratuberculosis
gccgccguagccggcgg

SEQ ID NO: 908610 - RNA, 21 nt, Mycobacterium avium subsp. paratuberculosis
gccgccguagccggcgguggc

SEQ ID NO: 908611 - RNA, 23 nt, Mycobacterium avium subsp. paratuberculosis
gccgccguagccggcgguggcca

SEQ ID NO: 908612 - RNA, 13 nt, Mycobacterium avium subsp. paratuberculosis
gccgccgguggcg

SEQ ID NO: 908613 - RNA, 17 nt, Mycobacterium avium subsp. paratuberculosis
gccgccgguggcgucgg

SEQ ID NO: 908614 - RNA, 18 nt, Mycobacterium avium subsp. paratuberculosis
gccgccgguggcgucggu

SEQ ID NO: 908615 - RNA, 19 nt, Mycobacterium avium subsp. paratuberculosis
gccgccgguugaucacccg

SEQ ID NO: 908616 - RNA, 22 nt, Mycobacterium avium subsp. paratuberculosis
gccgccgguugaucacccgggu

SEQ ID NO: 908617 - RNA, 13 nt, Mycobacterium avium subsp. paratuberculosis
gccgccgguccag

SEQ ID NO: 908618 - RNA, 14 nt, Mycobacterium avium subsp. paratuberculosis
gccgccggugccga

SEQ ID NO: 908619 - RNA, 13 nt, Mycobacterium avium subsp. paratuberculosis
gccgccggucacg

SEQ ID NO: 908620 - RNA, 23 nt, Mycobacterium avium subsp. paratuberculosis
gccgccggucacggcgucggcgu

SEQ ID NO: 908621 - RNA, 20 nt, Mycobacterium avium subsp. paratuberculosis
gccgccggugaagaucagcg

SEQ ID NO: 908622 - RNA, 23 nt, Mycobacterium avium subsp. paratuberculosis
gccgccggugaagaucagcgcgu

SEQ ID NO: 908623 - RNA, 13 nt, Mycobacterium avium subsp. paratuberculosis
gccgccggugacc

SEQ ID NO: 908624 - RNA, 20 nt, Mycobacterium avium subsp. paratuberculosis
gccgccgggaacagcgacgc

SEQ ID NO: 908625 - RNA, 23 nt, Mycobacterium avium subsp. paratuberculosis
gccgccgggaacagcgacgccca

SEQ ID NO: 908626 - RNA, 12 nt, Mycobacterium avium subsp. paratuberculosis
gccgccgggugg

SEQ ID NO: 908627 - RNA, 18 nt, Mycobacterium avium subsp. paratuberculosis
gccgccggguggcggggc

SEQ ID NO: 908628 - RNA, 14 nt, Mycobacterium avium subsp. paratuberculosis
gccgccggcucagc

SEQ ID NO: 908629 - RNA, 16 nt, Mycobacterium avium subsp. paratuberculosis
gccgccggcucagcgg

SEQ ID NO: 908630 - RNA, 15 nt, Mycobacterium avium subsp. paratuberculosis
gccgccggcggccaa

SEQ ID NO: 908631 - RNA, 22 nt, Mycobacterium avium subsp. paratuberculosis
gccgccgggacgggcauccggc

SEQ ID NO: 908632 - RNA, 21 nt, Mycobacterium avium subsp. paratuberculosis
gccgccgggauaacccagcac

SEQ ID NO: 908633 - RNA, 19 nt, Mycobacterium avium subsp. paratuberculosis
gccgccggguccuugcgcc

SEQ ID NO: 908634 - RNA, 22 nt, Mycobacterium avium subsp. paratuberculosis
gccgccggguccuugcgccccg

SEQ ID NO: 908635 - RNA, 14 nt, Mycobacterium avium subsp. paratuberculosis
gccgccggcgucgc

SEQ ID NO: 908636 - RNA, 16 nt, Mycobacterium avium subsp. paratuberculosis
gccgccggcgucgccg

SEQ ID NO: 908637 - RNA, 17 nt, Mycobacterium avium subsp. paratuberculosis
gccgccggcgucgccgc

SEQ ID NO: 908638 - RNA, 18 nt, Mycobacterium avium subsp. paratuberculosis
gccgccggcgucgccgcu

SEQ ID NO: 908639 - RNA, 21 nt, Mycobacterium avium subsp. paratuberculosis
gccgccggcgguggcguagcg

SEQ ID NO: 908640 - RNA, 12 nt, Mycobacterium avium subsp. paratuberculosis
gccgccggcguc

SEQ ID NO: 908641 - RNA, 16 nt, Mycobacterium avium subsp. paratuberculosis
gccgccggcgucgacg

SEQ ID NO: 908642 - RNA, 18 nt, Mycobacterium avium subsp. paratuberculosis
gccgccggcgucgacguc

SEQ ID NO: 908643 - RNA, 13 nt, Mycobacterium avium subsp. paratuberculosis
gccgccggcggcc

SEQ ID NO: 908644 - RNA, 14 nt, Mycobacterium avium subsp. paratuberculosis
gccgccggcggcca

SEQ ID NO: 908645 - RNA, 13 nt, Mycobacterium avium subsp. paratuberculosis
gccgccggcgcug

SEQ ID NO: 908646 - RNA, 23 nt, Mycobacterium avium subsp. paratuberculosis
gccgccggcgcgguucuugcgcc

SEQ ID NO: 908647 - RNA, 13 nt, Mycobacterium avium subsp. paratuberculosis
gccgccggccacc

SEQ ID NO: 908648 - RNA, 12 nt, Mycobacterium avium subsp. paratuberculosis
gccgccggccac

SEQ ID NO: 908649 - RNA, 15 nt, Mycobacterium avium subsp. paratuberculosis
gccgccggcaccguc

SEQ ID NO: 908650 - RNA, 15 nt, Mycobacterium avium subsp. paratuberculosis
gccgccggaucggca

SEQ ID NO: 908651 - RNA, 24 nt, Mycobacterium avium subsp. paratuberculosis
gccgccggaucggcagcgcguuga

SEQ ID NO: 908652 - RNA, 13 nt, Mycobacterium avium subsp. paratuberculosis
gccgccggaucgu

SEQ ID NO: 908653 - RNA, 21 nt, Mycobacterium avium subsp. paratuberculosis
gccgccggaucgugucccggc

SEQ ID NO: 908654 - RNA, 22 nt, Mycobacterium avium subsp. paratuberculosis
gccgccggaucgugucccggcg

SEQ ID NO: 908655 - RNA, 19 nt, Mycobacterium avium subsp. paratuberculosis
gccgccggauuacucgccg

SEQ ID NO: 908656 - RNA, 20 nt, Mycobacterium avium subsp. paratuberculosis
gccgccggauuacucgccgg

SEQ ID NO: 908657 - RNA, 21 nt, Mycobacterium avium subsp. paratuberculosis
gccgccggauuacucgccggc

SEQ ID NO: 908658 - RNA, 22 nt, Mycobacterium avium subsp. paratuberculosis
gccgccggauuacucgccggcg

SEQ ID NO: 908659 - RNA, 23 nt, Mycobacterium avium subsp. paratuberculosis
gccgccgcggaucuucuccgcca

SEQ ID NO: 908660 - RNA, 16 nt, Mycobacterium avium subsp. paratuberculosis
gccgccgcgcgcggcc

SEQ ID NO: 908661 - RNA, 12 nt, Mycobacterium avium subsp. paratuberculosis
gccgccgcgcau

SEQ ID NO: 908662 - RNA, 13 nt, Mycobacterium avium subsp. paratuberculosis
gccgccgcgcauc

SEQ ID NO: 908663 - RNA, 15 nt, Mycobacterium avium subsp. paratuberculosis
gccgccgccugagcc

SEQ ID NO: 908664 - RNA, 20 nt, Mycobacterium avium subsp. paratuberculosis
gccgccgccugagcccgccu

SEQ ID NO: 908665 - RNA, 20 nt, Mycobacterium avium subsp. paratuberculosis
gccgccgccagcgcgggguc

SEQ ID NO: 908666 - RNA, 15 nt, Mycobacterium avium subsp. paratuberculosis
gccgccgccagcgcg

SEQ ID NO: 908667 - RNA, 14 nt, Mycobacterium avium subsp. paratuberculosis
gccgccgcgaacuc

SEQ ID NO: 908668 - RNA, 19 nt, Mycobacterium avium subsp. paratuberculosis
gccgccgcgaacucaggcg

SEQ ID NO: 908669 - RNA, 18 nt, Mycobacterium avium subsp. paratuberculosis
gccgccgcgacacccgcg

SEQ ID NO: 908670 - RNA, 12 nt, Mycobacterium avium subsp. paratuberculosis
gccgccgcgacc

SEQ ID NO: 908671 - RNA, 15 nt, Mycobacterium avium subsp. paratuberculosis
gccgccgcgaccguc

SEQ ID NO: 908672 - RNA, 13 nt, Mycobacterium avium subsp. paratuberculosis
gccgccgcgacga

SEQ ID NO: 908673 - RNA, 17 nt, Mycobacterium avium subsp. paratuberculosis
gccgccgcgacgaugcc

SEQ ID NO: 908674 - RNA, 18 nt, Mycobacterium avium subsp. paratuberculosis
gccgccgcgacgaugccg

SEQ ID NO: 908675 - RNA, 14 nt, Mycobacterium avium subsp. paratuberculosis
gccgccgcgacggc

SEQ ID NO: 908676 - RNA, 11 nt, Mycobacterium avium subsp. paratuberculosis
gccgccgcgau

SEQ ID NO: 908677 - RNA, 20 nt, Mycobacterium avium subsp. paratuberculosis
gccgccgcgaucagggccca

SEQ ID NO: 908678 - RNA, 19 nt, Mycobacterium avium subsp. paratuberculosis
gccgccgcgaucuugccgc

SEQ ID NO: 908679 - RNA, 12 nt, Mycobacterium avium subsp. paratuberculosis
gccgccgccagc

SEQ ID NO: 908680 - RNA, 16 nt, Mycobacterium avium subsp. paratuberculosis
gccgccgccagcacca

SEQ ID NO: 908681 - RNA, 17 nt, Mycobacterium avium subsp. paratuberculosis
gccgccgccagcaccac

SEQ ID NO: 908682 - RNA, 20 nt, Mycobacterium avium subsp. paratuberculosis
gccgccgccagcaccaccgu

SEQ ID NO: 908683 - RNA, 22 nt, Mycobacterium avium subsp. paratuberculosis
gccgccgccagccagccggugc

SEQ ID NO: 908684 - RNA, 16 nt, Mycobacterium avium subsp. paratuberculosis
gccgccgccaccgucg

SEQ ID NO: 908685 - RNA, 20 nt, Mycobacterium avium subsp. paratuberculosis
gccgccgccaccgucgccgg

SEQ ID NO: 908686 - RNA, 21 nt, Mycobacterium avium subsp. paratuberculosis
gccgccgccaccgucgccggc

SEQ ID NO: 908687 - RNA, 18 nt, Mycobacterium avium subsp. paratuberculosis
gccgccgcauaccgcccg

SEQ ID NO: 908688 - RNA, 20 nt, Mycobacterium avium subsp. paratuberculosis
gccgccgcauaccgcccgcg

SEQ ID NO: 908689 - RNA, 14 nt, Mycobacterium avium subsp. paratuberculosis
gccgccgcagcgca

SEQ ID NO: 908690 - RNA, 20 nt, Mycobacterium avium subsp. paratuberculosis
gccgccgcaauacaccgcga

SEQ ID NO: 908691 - RNA, 15 nt, Mycobacterium avium subsp. paratuberculosis
gccgccgcagcagcc

SEQ ID NO: 908692 - RNA, 17 nt, Mycobacterium avium subsp. paratuberculosis
gccgccgcaccggccgg

SEQ ID NO: 908693 - RNA, 22 nt, Mycobacterium avium subsp. paratuberculosis
gccgccgcaccggccggccccg

SEQ ID NO: 908694 - RNA, 16 nt, Mycobacterium avium subsp. paratuberculosis
gccgccgaugcgcccg

SEQ ID NO: 908695 - RNA, 17 nt, Mycobacterium avium subsp. paratuberculosis
gccgccgaugcgcccgc

SEQ ID NO: 908696 - RNA, 19 nt, Mycobacterium avium subsp. paratuberculosis
gccgccgaugugaucggcg

SEQ ID NO: 908697 - RNA, 21 nt, Mycobacterium avium subsp. paratuberculosis
gccgccgaugugaucggcggc

SEQ ID NO: 908698 - RNA, 20 nt, Mycobacterium avium subsp. paratuberculosis
gccgccgauucaaccccgcg

SEQ ID NO: 908699 - RNA, 19 nt, Mycobacterium avium subsp. paratuberculosis
gccgccgauuccggccggc

SEQ ID NO: 908700 - RNA, 16 nt, Mycobacterium avium subsp. paratuberculosis
gccgcccuuguugaug

SEQ ID NO: 908701 - RNA, 16 nt, Mycobacterium avium subsp. paratuberculosis
gccgcccgucggggcc

SEQ ID NO: 908702 - RNA, 19 nt, Mycobacterium avium subsp. paratuberculosis
gccgcccugcccgucgggc

SEQ ID NO: 908703 - RNA, 22 nt, Mycobacterium avium subsp. paratuberculosis
gccgcccugcccgucgggcgcg

SEQ ID NO: 908704 - RNA, 12 nt, Mycobacterium avium subsp. paratuberculosis
gccgcccugcgg

SEQ ID NO: 908705 - RNA, 18 nt, Mycobacterium avium subsp. paratuberculosis
gccgcccucggugacgaa

SEQ ID NO: 908706 - RNA, 21 nt, Mycobacterium avium subsp. paratuberculosis
gccgcccugcgggaacagcgg

SEQ ID NO: 908707 - RNA, 22 nt, Mycobacterium avium subsp. paratuberculosis
gccgcccucgcccucgcugauc

SEQ ID NO: 908708 - RNA, 15 nt, Mycobacterium avium subsp. paratuberculosis
gccgcccucgccgaa

SEQ ID NO: 908709 - RNA, 16 nt, Mycobacterium avium subsp. paratuberculosis
gccgcccucgccgaac

SEQ ID NO: 908710 - RNA, 17 nt, Mycobacterium avium subsp. paratuberculosis
gccgcccucgccgaacc

SEQ ID NO: 908711 - RNA, 15 nt, Mycobacterium avium subsp. paratuberculosis
gccgcccucgcugcc

SEQ ID NO: 908712 - RNA, 17 nt, Mycobacterium avium subsp. paratuberculosis
gccgcccucgcugccgc

SEQ ID NO: 908713 - RNA, 13 nt, Mycobacterium avium subsp. paratuberculosis
gccgcccgcgcgg

SEQ ID NO: 908714 - RNA, 15 nt, Mycobacterium avium subsp. paratuberculosis
gccgcccgcgcggcg

SEQ ID NO: 908715 - RNA, 13 nt, Mycobacterium avium subsp. paratuberculosis
gccgcccgcgcgu

SEQ ID NO: 908716 - RNA, 14 nt, Mycobacterium avium subsp. paratuberculosis
gccgcccgcgcgug

SEQ ID NO: 908717 - RNA, 15 nt, Mycobacterium avium subsp. paratuberculosis
gccgcccgcgcgugg

SEQ ID NO: 908718 - RNA, 21 nt, Mycobacterium avium subsp. paratuberculosis
gccgccaguuguuggccgggc

SEQ ID NO: 908719 - RNA, 22 nt, Mycobacterium avium subsp. paratuberculosis
gccgccaguuguuggccgggca

SEQ ID NO: 908720 - RNA, 23 nt, Mycobacterium avium subsp. paratuberculosis
gccgccauguacagaccccacac

SEQ ID NO: 908721 - RNA, 14 nt, Mycobacterium avium subsp. paratuberculosis
gccgcccacaccga

SEQ ID NO: 908722 - RNA, 16 nt, Mycobacterium avium subsp. paratuberculosis
gccgcccacaccgaca

SEQ ID NO: 908723 - RNA, 19 nt, Mycobacterium avium subsp. paratuberculosis
gccgcccacaccgacaccg

SEQ ID NO: 908724 - RNA, 15 nt, Mycobacterium avium subsp. paratuberculosis
gccgcccaucacccc

SEQ ID NO: 908725 - RNA, 13 nt, Mycobacterium avium subsp. paratuberculosis
gccgcccaccacc

SEQ ID NO: 908726 - RNA, 22 nt, Mycobacterium avium subsp. paratuberculosis
gccgcccaucgaccggaugaug

SEQ ID NO: 908727 - RNA, 16 nt, Mycobacterium avium subsp. paratuberculosis
gccgcccaucggcagc

SEQ ID NO: 908728 - RNA, 14 nt, Mycobacterium avium subsp. paratuberculosis
gccgcccaugccca

SEQ ID NO: 908729 - RNA, 23 nt, Mycobacterium avium subsp. paratuberculosis
gccgcccaugcccaugucgaucg

SEQ ID NO: 908730 - RNA, 16 nt, Mycobacterium avium subsp. paratuberculosis
gccgcccaacgacguc

SEQ ID NO: 908731 - RNA, 17 nt, Mycobacterium avium subsp. paratuberculosis
gccgcccaacgacgucg

SEQ ID NO: 908732 - RNA, 19 nt, Mycobacterium avium subsp. paratuberculosis
gccgccagggucucgggca

SEQ ID NO: 908733 - RNA, 20 nt, Mycobacterium avium subsp. paratuberculosis
gccgcccgaacuccgaauac

SEQ ID NO: 908734 - RNA, 18 nt, Mycobacterium avium subsp. paratuberculosis
gccgcccgcccgagcguc

SEQ ID NO: 908735 - RNA, 14 nt, Mycobacterium avium subsp. paratuberculosis
gccgcccgcaccag

SEQ ID NO: 908736 - RNA, 16 nt, Mycobacterium avium subsp. paratuberculosis
gccgcccgcaccugcg

SEQ ID NO: 908737 - RNA, 14 nt, Mycobacterium avium subsp. paratuberculosis
gccgcccgacccgu

SEQ ID NO: 908738 - RNA, 17 nt, Mycobacterium avium subsp. paratuberculosis
gccgcccgacccgucca

SEQ ID NO: 908739 - RNA, 18 nt, Mycobacterium avium subsp. paratuberculosis
gccgccccggccgcgcac

SEQ ID NO: 908740 - RNA, 14 nt, Mycobacterium avium subsp. paratuberculosis
gccgccccgucggu

SEQ ID NO: 908741 - RNA, 15 nt, Mycobacterium avium subsp. paratuberculosis
gccgcccccgccgcg

SEQ ID NO: 908742 - RNA, 17 nt, Mycobacterium avium subsp. paratuberculosis
gccgcccccgccgcgag

SEQ ID NO: 908743 - RNA, 14 nt, Mycobacterium avium subsp. paratuberculosis
gccgcccccgcggc

SEQ ID NO: 908744 - RNA, 22 nt, Mycobacterium avium subsp. paratuberculosis
gccgcccccgauagccccgcca

SEQ ID NO: 908745 - RNA, 20 nt, Mycobacterium avium subsp. paratuberculosis
gccgcccccgcccacagcgg

SEQ ID NO: 908746 - RNA, 14 nt, Mycobacterium avium subsp. paratuberculosis
gccgccccgaacag

SEQ ID NO: 908747 - RNA, 23 nt, Mycobacterium avium subsp. paratuberculosis
gccgccacucauguucagggugc

SEQ ID NO: 908748 - RNA, 13 nt, Mycobacterium avium subsp. paratuberculosis
gccgccagcacgu

SEQ ID NO: 908749 - RNA, 15 nt, Mycobacterium avium subsp. paratuberculosis
gccgccagcacguga

SEQ ID NO: 908750 - RNA, 13 nt, Mycobacterium avium subsp. paratuberculosis
gccgccagcagca

SEQ ID NO: 908751 - RNA, 17 nt, Mycobacterium avium subsp. paratuberculosis
gccgccagcagcacggc

SEQ ID NO: 908752 - RNA, 17 nt, Mycobacterium avium subsp. paratuberculosis
gccgccagcagcagcgc

SEQ ID NO: 908753 - RNA, 18 nt, Mycobacterium avium subsp. paratuberculosis
gccgccacggggcccgcg

SEQ ID NO: 908754 - RNA, 21 nt, Mycobacterium avium subsp. paratuberculosis
gccgccacggggcccgcgacc

SEQ ID NO: 908755 - RNA, 19 nt, Mycobacterium avium subsp. paratuberculosis
gccgccacaccucggcgac

SEQ ID NO: 908756 - RNA, 15 nt, Mycobacterium avium subsp. paratuberculosis
gccgccacggcgcca

SEQ ID NO: 908757 - RNA, 20 nt, Mycobacterium avium subsp. paratuberculosis
gccgccacgcuggugugacg

SEQ ID NO: 908758 - RNA, 22 nt, Mycobacterium avium subsp. paratuberculosis
gccgccacgcuggugugacgcu

SEQ ID NO: 908759 - RNA, 14 nt, Mycobacterium avium subsp. paratuberculosis
gccgccacgcggcg

SEQ ID NO: 908760 - RNA, 17 nt, Mycobacterium avium subsp. paratuberculosis
gccgccacgcggcgcgc

SEQ ID NO: 908761 - RNA, 14 nt, Mycobacterium avium subsp. paratuberculosis
gccgccaccgucgc

SEQ ID NO: 908762 - RNA, 20 nt, Mycobacterium avium subsp. paratuberculosis
gccgccaccgucgccggcug

SEQ ID NO: 908763 - RNA, 22 nt, Mycobacterium avium subsp. paratuberculosis
gccgccaccgucgccggcugac

SEQ ID NO: 908764 - RNA, 19 nt, Mycobacterium avium subsp. paratuberculosis
gccgccaccgccaucucgg

SEQ ID NO: 908765 - RNA, 13 nt, Mycobacterium avium subsp. paratuberculosis
gccgccaccgcga

SEQ ID NO: 908766 - RNA, 21 nt, Mycobacterium avium subsp. paratuberculosis
gccgccaccgcgaaagcgucg

SEQ ID NO: 908767 - RNA, 14 nt, Mycobacterium avium subsp. paratuberculosis
gccgccaccggccg

SEQ ID NO: 908768 - RNA, 15 nt, Mycobacterium avium subsp. paratuberculosis
gccgccaccggccgg

SEQ ID NO: 908769 - RNA, 17 nt, Mycobacterium avium subsp. paratuberculosis
gccgccaccggccgguc

SEQ ID NO: 908770 - RNA, 22 nt, Mycobacterium avium subsp. paratuberculosis
gccgccagcaaccccgcggugc

SEQ ID NO: 908771 - RNA, 16 nt, Mycobacterium avium subsp. paratuberculosis
gccgccagcaccaccg

SEQ ID NO: 908772 - RNA, 17 nt, Mycobacterium avium subsp. paratuberculosis
gccgccagcaccaccgu

SEQ ID NO: 908773 - RNA, 18 nt, Mycobacterium avium subsp. paratuberculosis
gccgccagcaccaccguc

SEQ ID NO: 908774 - RNA, 14 nt, Mycobacterium avium subsp. paratuberculosis
gccgccagcaccuc

SEQ ID NO: 908775 - RNA, 13 nt, Mycobacterium avium subsp. paratuberculosis
gccgccagccagc

SEQ ID NO: 908776 - RNA, 15 nt, Mycobacterium avium subsp. paratuberculosis
gccgccagccagccg

SEQ ID NO: 908777 - RNA, 13 nt, Mycobacterium avium subsp. paratuberculosis
gccgccagccgca

SEQ ID NO: 908778 - RNA, 15 nt, Mycobacterium avium subsp. paratuberculosis
gccgccagccgcagc

SEQ ID NO: 908779 - RNA, 17 nt, Mycobacterium avium subsp. paratuberculosis
gccgccaggucggggcc

SEQ ID NO: 908780 - RNA, 21 nt, Mycobacterium avium subsp. paratuberculosis
gccgccaggucggggcccguc

SEQ ID NO: 908781 - RNA, 20 nt, Mycobacterium avium subsp. paratuberculosis
gccgccagguuggcggcggc

SEQ ID NO: 908782 - RNA, 12 nt, Mycobacterium avium subsp. paratuberculosis
gccgccagggcc

SEQ ID NO: 908783 - RNA, 14 nt, Mycobacterium avium subsp. paratuberculosis
gccgccagggccag

SEQ ID NO: 908784 - RNA, 16 nt, Mycobacterium avium subsp. paratuberculosis
gccgcauuggugccgg

SEQ ID NO: 908785 - RNA, 20 nt, Mycobacterium avium subsp. paratuberculosis
gccgcauuggugccggccuc

SEQ ID NO: 908786 - RNA, 15 nt, Mycobacterium avium subsp. paratuberculosis
gccgcauucggugag

SEQ ID NO: 908787 - RNA, 21 nt, Mycobacterium avium subsp. paratuberculosis
gccgcauuggcaccgucgacc

SEQ ID NO: 908788 - RNA, 22 nt, Mycobacterium avium subsp. paratuberculosis
gccgcaugcccuugucgcuggc

SEQ ID NO: 908789 - RNA, 21 nt, Mycobacterium avium subsp. paratuberculosis
gccgcauggugcggguguccg

SEQ ID NO: 908790 - RNA, 22 nt, Mycobacterium avium subsp. paratuberculosis
gccgcaugucgaccucggccac

SEQ ID NO: 908791 - RNA, 20 nt, Mycobacterium avium subsp. paratuberculosis
gccgcauguugugcccgacg

SEQ ID NO: 908792 - RNA, 15 nt, Mycobacterium avium subsp. paratuberculosis
gccgcauuccucggc

SEQ ID NO: 908793 - RNA, 16 nt, Mycobacterium avium subsp. paratuberculosis
gccgcauuccucggcc

SEQ ID NO: 908794 - RNA, 19 nt, Mycobacterium avium subsp. paratuberculosis
gccgcaugaugcggccaug

SEQ ID NO: 908795 - RNA, 20 nt, Mycobacterium avium subsp. paratuberculosis
gccgcaugaugcggccauga

SEQ ID NO: 908796 - RNA, 21 nt, Mycobacterium avium subsp. paratuberculosis
gccgccaccaggcugaacguc

SEQ ID NO: 908797 - RNA, 21 nt, Mycobacterium avium subsp. paratuberculosis
gccgccaccaacaucgacgug

SEQ ID NO: 908798 - RNA, 23 nt, Mycobacterium avium subsp. paratuberculosis
gccgccaccaacaucgacgugcc

SEQ ID NO: 908799 - RNA, 17 nt, Mycobacterium avium subsp. paratuberculosis
gccgccaccccaggcga

SEQ ID NO: 908800 - RNA, 21 nt, Mycobacterium avium subsp. paratuberculosis
gccgccaccccaggcgaugcc

SEQ ID NO: 908801 - RNA, 13 nt, Mycobacterium avium subsp. paratuberculosis
gccgccaccgagg

SEQ ID NO: 908802 - RNA, 13 nt, Mycobacterium avium subsp. paratuberculosis
gccgccaccgcca

SEQ ID NO: 908803 - RNA, 15 nt, Mycobacterium avium subsp. paratuberculosis
gccgccacagcgccu

SEQ ID NO: 908804 - RNA, 19 nt, Mycobacterium avium subsp. paratuberculosis
gccgccacagcgccucgcg

SEQ ID NO: 908805 - RNA, 22 nt, Mycobacterium avium subsp. paratuberculosis
gccgccaaggggaacaacgcgc

SEQ ID NO: 908806 - RNA, 22 nt, Mycobacterium avium subsp. paratuberculosis
gccgccaacggauucagcgucg

SEQ ID NO: 908807 - RNA, 17 nt, Mycobacterium avium subsp. paratuberculosis
gccgccaaccaggucgc

SEQ ID NO: 908808 - RNA, 22 nt, Mycobacterium avium subsp. paratuberculosis
gccgccaaccaggucgcggcgc

SEQ ID NO: 908809 - RNA, 23 nt, Mycobacterium avium subsp. paratuberculosis
gccgccaaccaggucgcggcgcu

SEQ ID NO: 908810 - RNA, 24 nt, Mycobacterium avium subsp. paratuberculosis
gccgccaaccaggucgcggcgcug

SEQ ID NO: 908811 - RNA, 14 nt, Mycobacterium avium subsp. paratuberculosis
gccgcauccgcgag

SEQ ID NO: 908812 - RNA, 13 nt, Mycobacterium avium subsp. paratuberculosis
gccgcauccagcg

SEQ ID NO: 908813 - RNA, 16 nt, Mycobacterium avium subsp. paratuberculosis
gccgcauccagcgccg

SEQ ID NO: 908814 - RNA, 18 nt, Mycobacterium avium subsp. paratuberculosis
gccgcauccagcgccgcc

SEQ ID NO: 908815 - RNA, 19 nt, Mycobacterium avium subsp. paratuberculosis
gccgcauccagcgccgcca

SEQ ID NO: 908816 - RNA, 22 nt, Mycobacterium avium subsp. paratuberculosis
gccgcauccagcgccgccaacc

SEQ ID NO: 908817 - RNA, 12 nt, Mycobacterium avium subsp. paratuberculosis
gccgcauccagc

SEQ ID NO: 908818 - RNA, 17 nt, Mycobacterium avium subsp. paratuberculosis
gccgcauacaccuuguc

SEQ ID NO: 908819 - RNA, 16 nt, Mycobacterium avium subsp. paratuberculosis
gccgcauaccgcccgc

SEQ ID NO: 908820 - RNA, 18 nt, Mycobacterium avium subsp. paratuberculosis
gccgcauaccgcccgcgc

SEQ ID NO: 908821 - RNA, 19 nt, Mycobacterium avium subsp. paratuberculosis
gccgcauaccgcccgcgcu

SEQ ID NO: 908822 - RNA, 21 nt, Mycobacterium avium subsp. paratuberculosis
gccgcauaccgcccgcgcugg

SEQ ID NO: 908823 - RNA, 23 nt, Mycobacterium avium subsp. paratuberculosis
gccgcaggcgaacaccucgguga

SEQ ID NO: 908824 - RNA, 14 nt, Mycobacterium avium subsp. paratuberculosis
gccgcagucgauca

SEQ ID NO: 908825 - RNA, 16 nt, Mycobacterium avium subsp. paratuberculosis
gccgcagucgaucacc

SEQ ID NO: 908826 - RNA, 14 nt, Mycobacterium avium subsp. paratuberculosis
gccgcagugccggc

SEQ ID NO: 908827 - RNA, 13 nt, Mycobacterium avium subsp. paratuberculosis
gccgcaggguggc

SEQ ID NO: 908828 - RNA, 15 nt, Mycobacterium avium subsp. paratuberculosis
gccgcaggguggcca

SEQ ID NO: 908829 - RNA, 17 nt, Mycobacterium avium subsp. paratuberculosis
gccgcaggguggccagc

SEQ ID NO: 908830 - RNA, 18 nt, Mycobacterium avium subsp. paratuberculosis
gccgcaggguggccagca

SEQ ID NO: 908831 - RNA, 19 nt, Mycobacterium avium subsp. paratuberculosis
gccgcaggguggccagcac

SEQ ID NO: 908832 - RNA, 21 nt, Mycobacterium avium subsp. paratuberculosis
gccgcaggguggccagcaccg

SEQ ID NO: 908833 - RNA, 14 nt, Mycobacterium avium subsp. paratuberculosis
gccgcaggugcagc

SEQ ID NO: 908834 - RNA, 16 nt, Mycobacterium avium subsp. paratuberculosis
gccgcaggugcucgcc

SEQ ID NO: 908835 - RNA, 23 nt, Mycobacterium avium subsp. paratuberculosis
gccgcaggugcucgccggcgcgg

SEQ ID NO: 908836 - RNA, 21 nt, Mycobacterium avium subsp. paratuberculosis
gccgcagguggugggcgugca

SEQ ID NO: 908837 - RNA, 16 nt, Mycobacterium avium subsp. paratuberculosis
gccgcagcgugggcac

SEQ ID NO: 908838 - RNA, 20 nt, Mycobacterium avium subsp. paratuberculosis
gccgcagcgugggcaccggc

SEQ ID NO: 908839 - RNA, 15 nt, Mycobacterium avium subsp. paratuberculosis
gccgcagcugcugcg

SEQ ID NO: 908840 - RNA, 18 nt, Mycobacterium avium subsp. paratuberculosis
gccgcagcugcugcggcc

SEQ ID NO: 908841 - RNA, 20 nt, Mycobacterium avium subsp. paratuberculosis
gccgcagcugcugcggccgg

SEQ ID NO: 908842 - RNA, 21 nt, Mycobacterium avium subsp. paratuberculosis
gccgcagcugcugcggccgga

SEQ ID NO: 908843 - RNA, 22 nt, Mycobacterium avium subsp. paratuberculosis
gccgcagcggcgccgcagcucg

SEQ ID NO: 908844 - RNA, 13 nt, Mycobacterium avium subsp. paratuberculosis
gccgcagcggcgg

SEQ ID NO: 908845 - RNA, 14 nt, Mycobacterium avium subsp. paratuberculosis
gccgcagcggcggc

SEQ ID NO: 908846 - RNA, 15 nt, Mycobacterium avium subsp. paratuberculosis
gccgcagcggcggca

SEQ ID NO: 908847 - RNA, 18 nt, Mycobacterium avium subsp. paratuberculosis
gccgcagcggcggcucgu

SEQ ID NO: 908848 - RNA, 20 nt, Mycobacterium avium subsp. paratuberculosis
gccgcagcggcggcucgucc

SEQ ID NO: 908849 - RNA, 14 nt, Mycobacterium avium subsp. paratuberculosis
gccgcagcucgauc

SEQ ID NO: 908850 - RNA, 15 nt, Mycobacterium avium subsp. paratuberculosis
gccgcagcuguucgg

SEQ ID NO: 908851 - RNA, 13 nt, Mycobacterium avium subsp. paratuberculosis
gccgcaggcggcc

SEQ ID NO: 908852 - RNA, 16 nt, Mycobacterium avium subsp. paratuberculosis
gccgcaggcggccagc

SEQ ID NO: 908853 - RNA, 17 nt, Mycobacterium avium subsp. paratuberculosis
gccgcaggcggccagca

SEQ ID NO: 908854 - RNA, 20 nt, Mycobacterium avium subsp. paratuberculosis
gccgcaggcggccagcacca

SEQ ID NO: 908855 - RNA, 17 nt, Mycobacterium avium subsp. paratuberculosis
gccgcaggagaucggcg

SEQ ID NO: 908856 - RNA, 18 nt, Mycobacterium avium subsp. paratuberculosis
gccgcaggagaucggcgc

SEQ ID NO: 908857 - RNA, 22 nt, Mycobacterium avium subsp. paratuberculosis
gccgcaggagaucggcgcggag

SEQ ID NO: 908858 - RNA, 21 nt, Mycobacterium avium subsp. paratuberculosis
gccgcagcgggauuggcgcca

SEQ ID NO: 908859 - RNA, 16 nt, Mycobacterium avium subsp. paratuberculosis
gccggaaaaguucggc

SEQ ID NO: 908860 - RNA, 22 nt, Mycobacterium avium subsp. paratuberculosis
gccggaaaaguucggcgggggc

SEQ ID NO: 908861 - RNA, 14 nt, Mycobacterium avium subsp. paratuberculosis
gccgcuucggggug

SEQ ID NO: 908862 - RNA, 17 nt, Mycobacterium avium subsp. paratuberculosis
gccgcuucggggugguu

SEQ ID NO: 908863 - RNA, 15 nt, Mycobacterium avium subsp. paratuberculosis
gccgcuucccacccg

SEQ ID NO: 908864 - RNA, 17 nt, Mycobacterium avium subsp. paratuberculosis
gccgcuucccacccggu

SEQ ID NO: 908865 - RNA, 14 nt, Mycobacterium avium subsp. paratuberculosis
gccgcugcgacagg

SEQ ID NO: 908866 - RNA, 20 nt, Mycobacterium avium subsp. paratuberculosis
gccgcugcgacaggucggcg

SEQ ID NO: 908867 - RNA, 22 nt, Mycobacterium avium subsp. paratuberculosis
gccgcugcgacaggucggcggu

SEQ ID NO: 908868 - RNA, 14 nt, Mycobacterium avium subsp. paratuberculosis
gccgcugcgcgcgc

SEQ ID NO: 908869 - RNA, 20 nt, Mycobacterium avium subsp. paratuberculosis
gccgcugcgcgcgcgaucgg

SEQ ID NO: 908870 - RNA, 15 nt, Mycobacterium avium subsp. paratuberculosis
gccgcugcgcccagc

SEQ ID NO: 908871 - RNA, 19 nt, Mycobacterium avium subsp. paratuberculosis
gccgcugcgcccagcgcgc

SEQ ID NO: 908872 - RNA, 23 nt, Mycobacterium avium subsp. paratuberculosis
gccgcugcgcccagcgcgcgauc

SEQ ID NO: 908873 - RNA, 14 nt, Mycobacterium avium subsp. paratuberculosis
gccgcugcgccggc

SEQ ID NO: 908874 - RNA, 15 nt, Mycobacterium avium subsp. paratuberculosis
gccgcugcgccggcg

SEQ ID NO: 908875 - RNA, 20 nt, Mycobacterium avium subsp. paratuberculosis
gccgcugcgccggcgcggcc

SEQ ID NO: 908876 - RNA, 18 nt, Mycobacterium avium subsp. paratuberculosis
gccgcugcgggccaucga

SEQ ID NO: 908877 - RNA, 23 nt, Mycobacterium avium subsp. paratuberculosis
gccgcugcgggccaucgacucca

SEQ ID NO: 908878 - RNA, 13 nt, Mycobacterium avium subsp. paratuberculosis
gccgcugcgggcg

SEQ ID NO: 908879 - RNA, 17 nt, Mycobacterium avium subsp. paratuberculosis
gccgcugcgggcgggcc

SEQ ID NO: 908880 - RNA, 21 nt, Mycobacterium avium subsp. paratuberculosis
gccgcugcgggcgggccgcca

SEQ ID NO: 908881 - RNA, 14 nt, Mycobacterium avium subsp. paratuberculosis
gccgcugcgugccc

SEQ ID NO: 908882 - RNA, 14 nt, Mycobacterium avium subsp. paratuberculosis
gccggaacaccucg

SEQ ID NO: 908883 - RNA, 14 nt, Mycobacterium avium subsp. paratuberculosis
gccggaagaccguu

SEQ ID NO: 908884 - RNA, 20 nt, Mycobacterium avium subsp. paratuberculosis
gccggaagaccguugacgac

SEQ ID NO: 908885 - RNA, 16 nt, Mycobacterium avium subsp. paratuberculosis
gccggaacgcccgauc

SEQ ID NO: 908886 - RNA, 15 nt, Mycobacterium avium subsp. paratuberculosis
gccggaagcggcggu

SEQ ID NO: 908887 - RNA, 16 nt, Mycobacterium avium subsp. paratuberculosis
gccggaagcggcggua

SEQ ID NO: 908888 - RNA, 18 nt, Mycobacterium avium subsp. paratuberculosis
gccggaaggucuuucguc

SEQ ID NO: 908889 - RNA, 21 nt, Mycobacterium avium subsp. paratuberculosis
gccggaaucgauuggugcgca

SEQ ID NO: 908890 - RNA, 22 nt, Mycobacterium avium subsp. paratuberculosis
gccggaauggcaaggccagcaa

SEQ ID NO: 908891 - RNA, 23 nt, Mycobacterium avium subsp. paratuberculosis
gccggaauggcaaggccagcaac

SEQ ID NO: 908892 - RNA, 16 nt, Mycobacterium avium subsp. paratuberculosis
gccggacaccaccgcg

SEQ ID NO: 908893 - RNA, 17 nt, Mycobacterium avium subsp. paratuberculosis
gccggacaccaccgcgg

SEQ ID NO: 908894 - RNA, 18 nt, Mycobacterium avium subsp. paratuberculosis
gccggacaccaccgcggu

SEQ ID NO: 908895 - RNA, 19 nt, Mycobacterium avium subsp. paratuberculosis
gccggacaccaccgcggug

SEQ ID NO: 908896 - RNA, 14 nt, Mycobacterium avium subsp. paratuberculosis
gccggacaccccgg

SEQ ID NO: 908897 - RNA, 15 nt, Mycobacterium avium subsp. paratuberculosis
gccggacaccccggc

SEQ ID NO: 908898 - RNA, 19 nt, Mycobacterium avium subsp. paratuberculosis
gccggacaccccggccagu

SEQ ID NO: 908899 - RNA, 23 nt, Mycobacterium avium subsp. paratuberculosis
gccggacaccccggccaguccgc

SEQ ID NO: 908900 - RNA, 16 nt, Mycobacterium avium subsp. paratuberculosis
gccggacaccggcacg

SEQ ID NO: 908901 - RNA, 16 nt, Mycobacterium avium subsp. paratuberculosis
gccggagaccgccgug

SEQ ID NO: 908902 - RNA, 22 nt, Mycobacterium avium subsp. paratuberculosis
gccggagccuucuugaccgcag

SEQ ID NO: 908903 - RNA, 19 nt, Mycobacterium avium subsp. paratuberculosis
gccggagccuugcuggcgg

SEQ ID NO: 908904 - RNA, 18 nt, Mycobacterium avium subsp. paratuberculosis
gccggagccuuggucgcg

SEQ ID NO: 908905 - RNA, 20 nt, Mycobacterium avium subsp. paratuberculosis
gccggagccuuggucgcggc

SEQ ID NO: 908906 - RNA, 13 nt, Mycobacterium avium subsp. paratuberculosis
gccggagcggugc

SEQ ID NO: 908907 - RNA, 15 nt, Mycobacterium avium subsp. paratuberculosis
gccggagcggugcgg

SEQ ID NO: 908908 - RNA, 17 nt, Mycobacterium avium subsp. paratuberculosis
gccggagccgaccucgg

SEQ ID NO: 908909 - RNA, 22 nt, Mycobacterium avium subsp. paratuberculosis
gccggagccgaccucggcgacg

SEQ ID NO: 908910 - RNA, 23 nt, Mycobacterium avium subsp. paratuberculosis
gccggagccgaccucggcgacga

SEQ ID NO: 908911 - RNA, 13 nt, Mycobacterium avium subsp. paratuberculosis
gccggagccgauc

SEQ ID NO: 908912 - RNA, 14 nt, Mycobacterium avium subsp. paratuberculosis
gccggagccggaga

SEQ ID NO: 908913 - RNA, 13 nt, Mycobacterium avium subsp. paratuberculosis
gccggagccggcc

SEQ ID NO: 908914 - RNA, 14 nt, Mycobacterium avium subsp. paratuberculosis
gccggagccggccu

SEQ ID NO: 908915 - RNA, 15 nt, Mycobacterium avium subsp. paratuberculosis
gccggagccggccuc

SEQ ID NO: 908916 - RNA, 17 nt, Mycobacterium avium subsp. paratuberculosis
gccggagccggccucgc

SEQ ID NO: 908917 - RNA, 20 nt, Mycobacterium avium subsp. paratuberculosis
gccggagccggccucgccgg

SEQ ID NO: 908918 - RNA, 19 nt, Mycobacterium avium subsp. paratuberculosis
gccggaauugaagaagcgg

SEQ ID NO: 908919 - RNA, 20 nt, Mycobacterium avium subsp. paratuberculosis
gccggagaugaauucggcga

SEQ ID NO: 908920 - RNA, 14 nt, Mycobacterium avium subsp. paratuberculosis
gccggagcccagcu

SEQ ID NO: 908921 - RNA, 19 nt, Mycobacterium avium subsp. paratuberculosis
gccggaucagcguuccggc

SEQ ID NO: 908922 - RNA, 22 nt, Mycobacterium avium subsp. paratuberculosis
gccggaucagcguuccggcggc

SEQ ID NO: 908923 - RNA, 21 nt, Mycobacterium avium subsp. paratuberculosis
gccggaucaugucguugaugc

SEQ ID NO: 908924 - RNA, 15 nt, Mycobacterium avium subsp. paratuberculosis
gccggauggccagca

SEQ ID NO: 908925 - RNA, 18 nt, Mycobacterium avium subsp. paratuberculosis
gccggauggccagcaggu

SEQ ID NO: 908926 - RNA, 14 nt, Mycobacterium avium subsp. paratuberculosis
gccggaugggcgca

SEQ ID NO: 908927 - RNA, 15 nt, Mycobacterium avium subsp. paratuberculosis
gccggauucucgccc

SEQ ID NO: 908928 - RNA, 18 nt, Mycobacterium avium subsp. paratuberculosis
gccggauugcgagccggu

SEQ ID NO: 908929 - RNA, 17 nt, Mycobacterium avium subsp. paratuberculosis
gccggauuggcgucggu

SEQ ID NO: 908930 - RNA, 17 nt, Mycobacterium avium subsp. paratuberculosis
gccggauuacucgccgg

SEQ ID NO: 908931 - RNA, 22 nt, Mycobacterium avium subsp. paratuberculosis
gccggaugguccgcaugucgaa

SEQ ID NO: 908932 - RNA, 16 nt, Mycobacterium avium subsp. paratuberculosis
gccggcagcggugccg

SEQ ID NO: 908933 - RNA, 17 nt, Mycobacterium avium subsp. paratuberculosis
gccggcacggccggccg

SEQ ID NO: 908934 - RNA, 18 nt, Mycobacterium avium subsp. paratuberculosis
gccggcacggccggccgg

SEQ ID NO: 908935 - RNA, 16 nt, Mycobacterium avium subsp. paratuberculosis
gccggcacggccggcc

SEQ ID NO: 908936 - RNA, 15 nt, Mycobacterium avium subsp. paratuberculosis
gccggcacggccggc

SEQ ID NO: 908937 - RNA, 14 nt, Mycobacterium avium subsp. paratuberculosis
gccggcacgcgcgc

SEQ ID NO: 908938 - RNA, 16 nt, Mycobacterium avium subsp. paratuberculosis
gccggcacgcgcgccg

SEQ ID NO: 908939 - RNA, 15 nt, Mycobacterium avium subsp. paratuberculosis
gccggcacgauggcg

SEQ ID NO: 908940 - RNA, 16 nt, Mycobacterium avium subsp. paratuberculosis
gccggcacgauggcgc

SEQ ID NO: 908941 - RNA, 20 nt, Mycobacterium avium subsp. paratuberculosis
gccggcacgauggcgcggcg

SEQ ID NO: 908942 - RNA, 12 nt, Mycobacterium avium subsp. paratuberculosis
gccggcaccucg

SEQ ID NO: 908943 - RNA, 14 nt, Mycobacterium avium subsp. paratuberculosis
gccggcaccucgaa

SEQ ID NO: 908944 - RNA, 20 nt, Mycobacterium avium subsp. paratuberculosis
gccggcaccucgaagggcgc

SEQ ID NO: 908945 - RNA, 23 nt, Mycobacterium avium subsp. paratuberculosis
gccggcaccucgaagggcgccag

SEQ ID NO: 908946 - RNA, 19 nt, Mycobacterium avium subsp. paratuberculosis
gccggcacgaaaccgugga

SEQ ID NO: 908947 - RNA, 14 nt, Mycobacterium avium subsp. paratuberculosis
gccggcaccguccg

SEQ ID NO: 908948 - RNA, 15 nt, Mycobacterium avium subsp. paratuberculosis
gccggcaccguccgg

SEQ ID NO: 908949 - RNA, 17 nt, Mycobacterium avium subsp. paratuberculosis
gccggcaccguccggcg

SEQ ID NO: 908950 - RNA, 20 nt, Mycobacterium avium subsp. paratuberculosis
gccggcaacaacgccagcgu

SEQ ID NO: 908951 - RNA, 22 nt, Mycobacterium avium subsp. paratuberculosis
gccggcaacaacgccagcguga

SEQ ID NO: 908952 - RNA, 23 nt, Mycobacterium avium subsp. paratuberculosis
gccggccaucuucaguucggccg

SEQ ID NO: 908953 - RNA, 14 nt, Mycobacterium avium subsp. paratuberculosis
gccggccaugacca

SEQ ID NO: 908954 - RNA, 24 nt, Mycobacterium avium subsp. paratuberculosis
gccggccaugaccaugucgacgcu

SEQ ID NO: 908955 - RNA, 23 nt, Mycobacterium avium subsp. paratuberculosis
gccggccagguugaccaccagcg

SEQ ID NO: 908956 - RNA, 17 nt, Mycobacterium avium subsp. paratuberculosis
gccggccaggcccagcc

SEQ ID NO: 908957 - RNA, 14 nt, Mycobacterium avium subsp. paratuberculosis
gccggccaggccgg

SEQ ID NO: 908958 - RNA, 19 nt, Mycobacterium avium subsp. paratuberculosis
gccggccaggccggccugc

SEQ ID NO: 908959 - RNA, 14 nt, Mycobacterium avium subsp. paratuberculosis
gccggccaggcgac

SEQ ID NO: 908960 - RNA, 20 nt, Mycobacterium avium subsp. paratuberculosis
gccggccagcuuuccggccg

SEQ ID NO: 908961 - RNA, 23 nt, Mycobacterium avium subsp. paratuberculosis
gccggccacgcucggcggcgcgc

SEQ ID NO: 908962 - RNA, 21 nt, Mycobacterium avium subsp. paratuberculosis
gccggccacguaguccgacga

SEQ ID NO: 908963 - RNA, 16 nt, Mycobacterium avium subsp. paratuberculosis
gccggccagcucgccg

SEQ ID NO: 908964 - RNA, 19 nt, Mycobacterium avium subsp. paratuberculosis
gccggccagcucgccgccg

SEQ ID NO: 908965 - RNA, 23 nt, Mycobacterium avium subsp. paratuberculosis
gccggccagcucgccgccgacga

SEQ ID NO: 908966 - RNA, 14 nt, Mycobacterium avium subsp. paratuberculosis
gccggccaccgccc

SEQ ID NO: 908967 - RNA, 13 nt, Mycobacterium avium subsp. paratuberculosis
gccggccaccucg

SEQ ID NO: 908968 - RNA, 16 nt, Mycobacterium avium subsp. paratuberculosis
gccggccaccucgucc

SEQ ID NO: 908969 - RNA, 13 nt, Mycobacterium avium subsp. paratuberculosis
gccggccaccggc

SEQ ID NO: 908970 - RNA, 22 nt, Mycobacterium avium subsp. paratuberculosis
gccggccaccggcgcgacggcg

SEQ ID NO: 908971 - RNA, 16 nt, Mycobacterium avium subsp. paratuberculosis
gccggccaccaggucg

SEQ ID NO: 908972 - RNA, 17 nt, Mycobacterium avium subsp. paratuberculosis
gccggccaccaggucgc

SEQ ID NO: 908973 - RNA, 16 nt, Mycobacterium avium subsp. paratuberculosis
gccggccaccagcggc

SEQ ID NO: 908974 - RNA, 19 nt, Mycobacterium avium subsp. paratuberculosis
gccggccaccagcggccgg

SEQ ID NO: 908975 - RNA, 15 nt, Mycobacterium avium subsp. paratuberculosis
gccggccaccagcgg

SEQ ID NO: 908976 - RNA, 20 nt, Mycobacterium avium subsp. paratuberculosis
gccggcauaggccagcacca

SEQ ID NO: 908977 - RNA, 18 nt, Mycobacterium avium subsp. paratuberculosis
gccggccaccaacagguc

SEQ ID NO: 908978 - RNA, 21 nt, Mycobacterium avium subsp. paratuberculosis
gccggccaaggcaagucgucg

SEQ ID NO: 908979 - RNA, 22 nt, Mycobacterium avium subsp. paratuberculosis
gccggcaggucgaggccggcca

SEQ ID NO: 908980 - RNA, 18 nt, Mycobacterium avium subsp. paratuberculosis
gccggcaguuccucgccg

SEQ ID NO: 908981 - RNA, 18 nt, Mycobacterium avium subsp. paratuberculosis
gccggcaguugcggccgc

SEQ ID NO: 908982 - RNA, 18 nt, Mycobacterium avium subsp. paratuberculosis
gccggcagcugcccgucg

SEQ ID NO: 908983 - RNA, 21 nt, Mycobacterium avium subsp. paratuberculosis
gccggcagcugcccgucggag

SEQ ID NO: 908984 - RNA, 13 nt, Mycobacterium avium subsp. paratuberculosis
gccgcuacccggc

SEQ ID NO: 908985 - RNA, 20 nt, Mycobacterium avium subsp. paratuberculosis
gccgcuacccggcgaaccgg

SEQ ID NO: 908986 - RNA, 23 nt, Mycobacterium avium subsp. paratuberculosis
gccgcuacccggcgaaccgggac

SEQ ID NO: 908987 - RNA, 13 nt, Mycobacterium avium subsp. paratuberculosis
gccgcguugucga

SEQ ID NO: 908988 - RNA, 15 nt, Mycobacterium avium subsp. paratuberculosis
gccgcguugucggcg

SEQ ID NO: 908989 - RNA, 16 nt, Mycobacterium avium subsp. paratuberculosis
gccgcguugucggcgu

SEQ ID NO: 908990 - RNA, 19 nt, Mycobacterium avium subsp. paratuberculosis
gccgcguugucggcguccu

SEQ ID NO: 908991 - RNA, 18 nt, Mycobacterium avium subsp. paratuberculosis
gccgcuagaccgauggcg

SEQ ID NO: 908992 - RNA, 21 nt, Mycobacterium avium subsp. paratuberculosis
gccgcuagaccgauggcggcg

SEQ ID NO: 908993 - RNA, 22 nt, Mycobacterium avium subsp. paratuberculosis
gccgcuagaccgauggcggcgg

SEQ ID NO: 908994 - RNA, 24 nt, Mycobacterium avium subsp. paratuberculosis
gccgcuagaccgauggcggcggcc

SEQ ID NO: 908995 - RNA, 15 nt, Mycobacterium avium subsp. paratuberculosis
gccgcuacgccgagg

SEQ ID NO: 908996 - RNA, 22 nt, Mycobacterium avium subsp. paratuberculosis
gccgcuacgccgaggcgcagga

SEQ ID NO: 908997 - RNA, 13 nt, Mycobacterium avium subsp. paratuberculosis
gccgcuccaccgc

SEQ ID NO: 908998 - RNA, 13 nt, Mycobacterium avium subsp. paratuberculosis
gccgcucccgcag

SEQ ID NO: 908999 - RNA, 14 nt, Mycobacterium avium subsp. paratuberculosis
gccgcucccgcagc

SEQ ID NO: 909000 - RNA, 14 nt, Mycobacterium avium subsp. paratuberculosis
gccgcucccggcgc

SEQ ID NO: 909001 - RNA, 22 nt, Mycobacterium avium subsp. paratuberculosis
gccgcucccggcgcagcaacuc

SEQ ID NO: 909002 - RNA, 15 nt, Mycobacterium avium subsp. paratuberculosis
gccgcuccgcggcgg

SEQ ID NO: 909003 - RNA, 21 nt, Mycobacterium avium subsp. paratuberculosis
gccgcuccgcggcgggcgugc

SEQ ID NO: 909004 - RNA, 14 nt, Mycobacterium avium subsp. paratuberculosis
gccgcuccggcccg

SEQ ID NO: 909005 - RNA, 15 nt, Mycobacterium avium subsp. paratuberculosis
gccgcuccggcccga

SEQ ID NO: 909006 - RNA, 21 nt, Mycobacterium avium subsp. paratuberculosis
gccgcuccggcccgagcacca

SEQ ID NO: 909007 - RNA, 13 nt, Mycobacterium avium subsp. paratuberculosis
gccgcuccggucg

SEQ ID NO: 909008 - RNA, 15 nt, Mycobacterium avium subsp. paratuberculosis
gccgcuccggucgcg

SEQ ID NO: 909009 - RNA, 20 nt, Mycobacterium avium subsp. paratuberculosis
gccgcugaaauccgggguca

SEQ ID NO: 909010 - RNA, 15 nt, Mycobacterium avium subsp. paratuberculosis
gccgcugaacgcgau

SEQ ID NO: 909011 - RNA, 21 nt, Mycobacterium avium subsp. paratuberculosis
gccgcugagcuucugcccggc

SEQ ID NO: 909012 - RNA, 16 nt, Mycobacterium avium subsp. paratuberculosis
gccgcugaucaugaag

SEQ ID NO: 909013 - RNA, 21 nt, Mycobacterium avium subsp. paratuberculosis
gccgcugaucaugaagucgcg

SEQ ID NO: 909014 - RNA, 21 nt, Mycobacterium avium subsp. paratuberculosis
gccgcugacugcgaucgccga

SEQ ID NO: 909015 - RNA, 22 nt, Mycobacterium avium subsp. paratuberculosis
gccgcugacugcgaucgccgac

SEQ ID NO: 909016 - RNA, 23 nt, Mycobacterium avium subsp. paratuberculosis
gccgcugacugcgaucgccgacg

SEQ ID NO: 909017 - RNA, 20 nt, Mycobacterium avium subsp. paratuberculosis
gccgcugacgauggcgaccg

SEQ ID NO: 909018 - RNA, 17 nt, Mycobacterium avium subsp. paratuberculosis
gccgcugacgcggcggg

SEQ ID NO: 909019 - RNA, 20 nt, Mycobacterium avium subsp. paratuberculosis
gccgcugacgcggcgggcau

SEQ ID NO: 909020 - RNA, 14 nt, Mycobacterium avium subsp. paratuberculosis
gccgcugacggucg

SEQ ID NO: 909021 - RNA, 20 nt, Mycobacterium avium subsp. paratuberculosis
gccgcugacggucgccgacu

SEQ ID NO: 909022 - RNA, 21 nt, Mycobacterium avium subsp. paratuberculosis
gccgcugacggucgccgacuc

SEQ ID NO: 909023 - RNA, 16 nt, Mycobacterium avium subsp. paratuberculosis
gccgcucuucgacgac

SEQ ID NO: 909024 - RNA, 19 nt, Mycobacterium avium subsp. paratuberculosis
gccgcucgaccccucggca

SEQ ID NO: 909025 - RNA, 15 nt, Mycobacterium avium subsp. paratuberculosis
gccgcgucgaccagc

SEQ ID NO: 909026 - RNA, 16 nt, Mycobacterium avium subsp. paratuberculosis
gccgcgucgaccagcc

SEQ ID NO: 909027 - RNA, 19 nt, Mycobacterium avium subsp. paratuberculosis
gccgcgucgaccagccggu

SEQ ID NO: 909028 - RNA, 13 nt, Mycobacterium avium subsp. paratuberculosis
gccgcgucgacgc

SEQ ID NO: 909029 - RNA, 14 nt, Mycobacterium avium subsp. paratuberculosis
gccgcgucgacgcc

SEQ ID NO: 909030 - RNA, 15 nt, Mycobacterium avium subsp. paratuberculosis
gccgcguccucgucg

SEQ ID NO: 909031 - RNA, 16 nt, Mycobacterium avium subsp. paratuberculosis
gccgcguccucgucga

SEQ ID NO: 909032 - RNA, 15 nt, Mycobacterium avium subsp. paratuberculosis
gccgcguccucgccg

SEQ ID NO: 909033 - RNA, 18 nt, Mycobacterium avium subsp. paratuberculosis
gccgcguccucgccguac

SEQ ID NO: 909034 - RNA, 15 nt, Mycobacterium avium subsp. paratuberculosis
gccgcgucacgucgg

SEQ ID NO: 909035 - RNA, 16 nt, Mycobacterium avium subsp. paratuberculosis
gccgcgucacgucggc

SEQ ID NO: 909036 - RNA, 23 nt, Mycobacterium avium subsp. paratuberculosis
gccgcguaggccaggaccgggac

SEQ ID NO: 909037 - RNA, 14 nt, Mycobacterium avium subsp. paratuberculosis
gccgcggugcagca

SEQ ID NO: 909038 - RNA, 12 nt, Mycobacterium avium subsp. paratuberculosis
gccgcggugcgc

SEQ ID NO: 909039 - RNA, 13 nt, Mycobacterium avium subsp. paratuberculosis
gccgcggugcgcg

SEQ ID NO: 909040 - RNA, 14 nt, Mycobacterium avium subsp. paratuberculosis
gccgcggugcgcga

SEQ ID NO: 909041 - RNA, 16 nt, Mycobacterium avium subsp. paratuberculosis
gccgcggugcgcgagu

SEQ ID NO: 909042 - RNA, 19 nt, Mycobacterium avium subsp. paratuberculosis
gccgcggugcggcccgcgg

SEQ ID NO: 909043 - RNA, 15 nt, Mycobacterium avium subsp. paratuberculosis
gccgcggucucgacc

SEQ ID NO: 909044 - RNA, 18 nt, Mycobacterium avium subsp. paratuberculosis
gccgcggucuuuggcgua

SEQ ID NO: 909045 - RNA, 19 nt, Mycobacterium avium subsp. paratuberculosis
gccgcggugaccgcgccgc

SEQ ID NO: 909046 - RNA, 15 nt, Mycobacterium avium subsp. paratuberculosis
gccgcggucaucgag

SEQ ID NO: 909047 - RNA, 16 nt, Mycobacterium avium subsp. paratuberculosis
gccgcggucaucgagc

SEQ ID NO: 909048 - RNA, 18 nt, Mycobacterium avium subsp. paratuberculosis
gccgcgguagacaccgcc

SEQ ID NO: 909049 - RNA, 19 nt, Mycobacterium avium subsp. paratuberculosis
gccgcgguagacaccgccg

SEQ ID NO: 909050 - RNA, 21 nt, Mycobacterium avium subsp. paratuberculosis
gccgcgguagcggaccugcga

SEQ ID NO: 909051 - RNA, 14 nt, Mycobacterium avium subsp. paratuberculosis
gccgcggucgcccc

SEQ ID NO: 909052 - RNA, 20 nt, Mycobacterium avium subsp. paratuberculosis
gccgcggucgccccggccgc

SEQ ID NO: 909053 - RNA, 16 nt, Mycobacterium avium subsp. paratuberculosis
gccgcggucgcugacc

SEQ ID NO: 909054 - RNA, 18 nt, Mycobacterium avium subsp. paratuberculosis
gccgcggucgcugacccg

SEQ ID NO: 909055 - RNA, 22 nt, Mycobacterium avium subsp. paratuberculosis
gccgcggucgcugacccgccgc

SEQ ID NO: 909056 - RNA, 17 nt, Mycobacterium avium subsp. paratuberculosis
gccgcgggugacgaucu

SEQ ID NO: 909057 - RNA, 21 nt, Mycobacterium avium subsp. paratuberculosis
gccgcgggugacgaucuggcg

SEQ ID NO: 909058 - RNA, 16 nt, Mycobacterium avium subsp. paratuberculosis
gccgcggguggcgcca

SEQ ID NO: 909059 - RNA, 17 nt, Mycobacterium avium subsp. paratuberculosis
gccgcggguggcgccac

SEQ ID NO: 909060 - RNA, 23 nt, Mycobacterium avium subsp. paratuberculosis
gccgcggguggcgccacagccgg

SEQ ID NO: 909061 - RNA, 15 nt, Mycobacterium avium subsp. paratuberculosis
gccgcgggugucgcc

SEQ ID NO: 909062 - RNA, 20 nt, Mycobacterium avium subsp. paratuberculosis
gccgcgggugucgcccucgg

SEQ ID NO: 909063 - RNA, 22 nt, Mycobacterium avium subsp. paratuberculosis
gccgcggcuccagcagcggcuc

SEQ ID NO: 909064 - RNA, 22 nt, Mycobacterium avium subsp. paratuberculosis
gccgcggcucgauggacgccag

SEQ ID NO: 909065 - RNA, 14 nt, Mycobacterium avium subsp. paratuberculosis
gccgcggcucgcga

SEQ ID NO: 909066 - RNA, 19 nt, Mycobacterium avium subsp. paratuberculosis
gccgcggcucgcgacgcgg

SEQ ID NO: 909067 - RNA, 14 nt, Mycobacterium avium subsp. paratuberculosis
gccgcggcgucggg

SEQ ID NO: 909068 - RNA, 12 nt, Mycobacterium avium subsp. paratuberculosis
gccgcggcggug

SEQ ID NO: 909069 - RNA, 14 nt, Mycobacterium avium subsp. paratuberculosis
gccgcggcgguggc

SEQ ID NO: 909070 - RNA, 16 nt, Mycobacterium avium subsp. paratuberculosis
gccgcggcgguggccu

SEQ ID NO: 909071 - RNA, 17 nt, Mycobacterium avium subsp. paratuberculosis
gccgcggcggcgccgac

SEQ ID NO: 909072 - RNA, 15 nt, Mycobacterium avium subsp. paratuberculosis
gccgcggcggcucgg

SEQ ID NO: 909073 - RNA, 20 nt, Mycobacterium avium subsp. paratuberculosis
gccgcggcggcucggcggcg

SEQ ID NO: 909074 - RNA, 22 nt, Mycobacterium avium subsp. paratuberculosis
gccgcggcggcucggcggcguc

SEQ ID NO: 909075 - RNA, 14 nt, Mycobacterium avium subsp. paratuberculosis
gccgcggcgggcgc

SEQ ID NO: 909076 - RNA, 15 nt, Mycobacterium avium subsp. paratuberculosis
gccgcggcgggcgcg

SEQ ID NO: 909077 - RNA, 20 nt, Mycobacterium avium subsp. paratuberculosis
gccgcgcggguacggcggcc

SEQ ID NO: 909078 - RNA, 23 nt, Mycobacterium avium subsp. paratuberculosis
gccgcgcggguacggcggccgcg

SEQ ID NO: 909079 - RNA, 12 nt, Mycobacterium avium subsp. paratuberculosis
gccgcgcggugc

SEQ ID NO: 909080 - RNA, 19 nt, Mycobacterium avium subsp. paratuberculosis
gccgcgcgugcccgcgguc

SEQ ID NO: 909081 - RNA, 17 nt, Mycobacterium avium subsp. paratuberculosis
gccgcgcguuccagcac

SEQ ID NO: 909082 - RNA, 14 nt, Mycobacterium avium subsp. paratuberculosis
gccgcgcgggcggc

SEQ ID NO: 909083 - RNA, 15 nt, Mycobacterium avium subsp. paratuberculosis
gccgcgcgggcggcg

SEQ ID NO: 909084 - RNA, 22 nt, Mycobacterium avium subsp. paratuberculosis
gccgcgcgggcggcgucguaga

SEQ ID NO: 909085 - RNA, 14 nt, Mycobacterium avium subsp. paratuberculosis
gccgcgcggcggug

SEQ ID NO: 909086 - RNA, 15 nt, Mycobacterium avium subsp. paratuberculosis
gccgcgcggcgguga

SEQ ID NO: 909087 - RNA, 14 nt, Mycobacterium avium subsp. paratuberculosis
gccgcgcggcgucg

SEQ ID NO: 909088 - RNA, 15 nt, Mycobacterium avium subsp. paratuberculosis
gccgcgcggcgucgg

SEQ ID NO: 909089 - RNA, 14 nt, Mycobacterium avium subsp. paratuberculosis
gccgcgcggcgcca

SEQ ID NO: 909090 - RNA, 15 nt, Mycobacterium avium subsp. paratuberculosis
gccgcgcggcgccag

SEQ ID NO: 909091 - RNA, 14 nt, Mycobacterium avium subsp. paratuberculosis
gccgcgcggcgaug

SEQ ID NO: 909092 - RNA, 17 nt, Mycobacterium avium subsp. paratuberculosis
gccgcgcggacgcggcg

SEQ ID NO: 909093 - RNA, 14 nt, Mycobacterium avium subsp. paratuberculosis
gccgcgcggccggg

SEQ ID NO: 909094 - RNA, 16 nt, Mycobacterium avium subsp. paratuberculosis
gccgcgcggccgggcu

SEQ ID NO: 909095 - RNA, 14 nt, Mycobacterium avium subsp. paratuberculosis
gccgcgcggccgcc

SEQ ID NO: 909096 - RNA, 16 nt, Mycobacterium avium subsp. paratuberculosis
gccgcgcggccggcca

SEQ ID NO: 909097 - RNA, 17 nt, Mycobacterium avium subsp. paratuberculosis
gccgcgcggccggccac

SEQ ID NO: 909098 - RNA, 18 nt, Mycobacterium avium subsp. paratuberculosis
gccgcgcggccggccacg

SEQ ID NO: 909099 - RNA, 15 nt, Mycobacterium avium subsp. paratuberculosis
gccgcgaucagggcc

SEQ ID NO: 909100 - RNA, 13 nt, Mycobacterium avium subsp. paratuberculosis
gccgcgauccagc

SEQ ID NO: 909101 - RNA, 14 nt, Mycobacterium avium subsp. paratuberculosis
gccgcgauccagcg

SEQ ID NO: 909102 - RNA, 14 nt, Mycobacterium avium subsp. paratuberculosis
gccgcgcgcgcggc

SEQ ID NO: 909103 - RNA, 15 nt, Mycobacterium avium subsp. paratuberculosis
gccgcgcgcgcggcc

SEQ ID NO: 909104 - RNA, 16 nt, Mycobacterium avium subsp. paratuberculosis
gccgcgcgcgcggccu

SEQ ID NO: 909105 - RNA, 12 nt, Mycobacterium avium subsp. paratuberculosis
gccgcgcgcggc

SEQ ID NO: 909106 - RNA, 14 nt, Mycobacterium avium subsp. paratuberculosis
gccgcgcgcggcgc

SEQ ID NO: 909107 - RNA, 21 nt, Mycobacterium avium subsp. paratuberculosis
gccgcgcgcggcgcggagccg

SEQ ID NO: 909108 - RNA, 17 nt, Mycobacterium avium subsp. paratuberculosis
gccgcgauccagcgcug

SEQ ID NO: 909109 - RNA, 13 nt, Mycobacterium avium subsp. paratuberculosis
gccgcgcgcggcc

SEQ ID NO: 909110 - RNA, 14 nt, Mycobacterium avium subsp. paratuberculosis
gccgcgcgcggcca

SEQ ID NO: 909111 - RNA, 16 nt, Mycobacterium avium subsp. paratuberculosis
gccgcgcgcggccacc

SEQ ID NO: 909112 - RNA, 20 nt, Mycobacterium avium subsp. paratuberculosis
gccgcgcgcggccaccgcgc

SEQ ID NO: 909113 - RNA, 13 nt, Mycobacterium avium subsp. paratuberculosis
gccgcgcgcgucg

SEQ ID NO: 909114 - RNA, 16 nt, Mycobacterium avium subsp. paratuberculosis
gccgcgcgcgucgacg

SEQ ID NO: 909115 - RNA, 17 nt, Mycobacterium avium subsp. paratuberculosis
gccgcgcgcgucgacgu

SEQ ID NO: 909116 - RNA, 18 nt, Mycobacterium avium subsp. paratuberculosis
gccgcggcgcggcccggc

SEQ ID NO: 909117 - RNA, 19 nt, Mycobacterium avium subsp. paratuberculosis
gccgcggcgcggcccggcc

SEQ ID NO: 909118 - RNA, 21 nt, Mycobacterium avium subsp. paratuberculosis
gccgcggcgcggcccggcccg

SEQ ID NO: 909119 - RNA, 15 nt, Mycobacterium avium subsp. paratuberculosis
gccgcggcggcagca

SEQ ID NO: 909120 - RNA, 20 nt, Mycobacterium avium subsp. paratuberculosis
gccgcggcggcagcacccgc

SEQ ID NO: 909121 - RNA, 14 nt, Mycobacterium avium subsp. paratuberculosis
gccgcggcggcccg

SEQ ID NO: 909122 - RNA, 20 nt, Mycobacterium avium subsp. paratuberculosis
gccgcggcggcccggcguca

SEQ ID NO: 909123 - RNA, 12 nt, Mycobacterium avium subsp. paratuberculosis
gccgcggcggcg

SEQ ID NO: 909124 - RNA, 13 nt, Mycobacterium avium subsp. paratuberculosis
gccgcggcgcgca

SEQ ID NO: 909125 - RNA, 15 nt, Mycobacterium avium subsp. paratuberculosis
gccgcggcgcgcauc

SEQ ID NO: 909126 - RNA, 20 nt, Mycobacterium avium subsp. paratuberculosis
gccgcggcgcgcaucccgau

SEQ ID NO: 909127 - RNA, 16 nt, Mycobacterium avium subsp. paratuberculosis
gccgcggcgaccacga

SEQ ID NO: 909128 - RNA, 20 nt, Mycobacterium avium subsp. paratuberculosis
gccgcggcgcccggcgcccg

SEQ ID NO: 909129 - RNA, 14 nt, Mycobacterium avium subsp. paratuberculosis
gccgcggcgccgcc

SEQ ID NO: 909130 - RNA, 16 nt, Mycobacterium avium subsp. paratuberculosis
gccgcggcgccguuga

SEQ ID NO: 909131 - RNA, 13 nt, Mycobacterium avium subsp. paratuberculosis
gccgcggcgaucg

SEQ ID NO: 909132 - RNA, 14 nt, Mycobacterium avium subsp. paratuberculosis
gccgcggcgaucgg

SEQ ID NO: 909133 - RNA, 18 nt, Mycobacterium avium subsp. paratuberculosis
gccgcggcgaucggcggu

SEQ ID NO: 909134 - RNA, 19 nt, Mycobacterium avium subsp. paratuberculosis
gccgcggcgaucggcgguc

SEQ ID NO: 909135 - RNA, 21 nt, Mycobacterium avium subsp. paratuberculosis
gccgcggcgaucggcgguccg

SEQ ID NO: 909136 - RNA, 14 nt, Mycobacterium avium subsp. paratuberculosis
gccgcggcgcaccc

SEQ ID NO: 909137 - RNA, 17 nt, Mycobacterium avium subsp. paratuberculosis
gccgcggcgcaccccga

SEQ ID NO: 909138 - RNA, 15 nt, Mycobacterium avium subsp. paratuberculosis
gccgcggcgacaccc

SEQ ID NO: 909139 - RNA, 23 nt, Mycobacterium avium subsp. paratuberculosis
gccgcggcgacacccagcggcgc

SEQ ID NO: 909140 - RNA, 18 nt, Mycobacterium avium subsp. paratuberculosis
gccgcggcgaccggggcg

SEQ ID NO: 909141 - RNA, 19 nt, Mycobacterium avium subsp. paratuberculosis
gccgcggcgaccggggcgg

SEQ ID NO: 909142 - RNA, 21 nt, Mycobacterium avium subsp. paratuberculosis
gccgcggcgaccggggcggug

SEQ ID NO: 909143 - RNA, 16 nt, Mycobacterium avium subsp. paratuberculosis
gccgcggcgagccggc

SEQ ID NO: 909144 - RNA, 18 nt, Mycobacterium avium subsp. paratuberculosis
gccgcggcgagccggccg

SEQ ID NO: 909145 - RNA, 23 nt, Mycobacterium avium subsp. paratuberculosis
gccgcggccuugcgagccggagc

SEQ ID NO: 909146 - RNA, 20 nt, Mycobacterium avium subsp. paratuberculosis
gccgcggaucuucuccgcca

SEQ ID NO: 909147 - RNA, 18 nt, Mycobacterium avium subsp. paratuberculosis
gccgcggaugaccagguc

SEQ ID NO: 909148 - RNA, 19 nt, Mycobacterium avium subsp. paratuberculosis
gccgcggccggugccacgg

SEQ ID NO: 909149 - RNA, 15 nt, Mycobacterium avium subsp. paratuberculosis
gccgcggccgucguc

SEQ ID NO: 909150 - RNA, 17 nt, Mycobacterium avium subsp. paratuberculosis
gccgcggccgucgucgu

SEQ ID NO: 909151 - RNA, 17 nt, Mycobacterium avium subsp. paratuberculosis
gccgcggaucagcagga

SEQ ID NO: 909152 - RNA, 22 nt, Mycobacterium avium subsp. paratuberculosis
gccgcggaucagcaggaccggg

SEQ ID NO: 909153 - RNA, 18 nt, Mycobacterium avium subsp. paratuberculosis
gccgcggaccccagcgug

SEQ ID NO: 909154 - RNA, 19 nt, Mycobacterium avium subsp. paratuberculosis
gccgcggaccccagcguga

SEQ ID NO: 909155 - RNA, 15 nt, Mycobacterium avium subsp. paratuberculosis
gccgcggacccgacg

SEQ ID NO: 909156 - RNA, 19 nt, Mycobacterium avium subsp. paratuberculosis
gccgcggaauucgcgggug

SEQ ID NO: 909157 - RNA, 14 nt, Mycobacterium avium subsp. paratuberculosis
gccgcggacggcca

SEQ ID NO: 909158 - RNA, 15 nt, Mycobacterium avium subsp. paratuberculosis
gccgcggacggccag

SEQ ID NO: 909159 - RNA, 13 nt, Mycobacterium avium subsp. paratuberculosis
gccgcggacggcg

SEQ ID NO: 909160 - RNA, 14 nt, Mycobacterium avium subsp. paratuberculosis
gccgcggagcggcg

SEQ ID NO: 909161 - RNA, 15 nt, Mycobacterium avium subsp. paratuberculosis
gccgcggagcggcgg

SEQ ID NO: 909162 - RNA, 17 nt, Mycobacterium avium subsp. paratuberculosis
gccgcggagcggcgguc

SEQ ID NO: 909163 - RNA, 21 nt, Mycobacterium avium subsp. paratuberculosis
gccgcggagcggcggucacga

SEQ ID NO: 909164 - RNA, 14 nt, Mycobacterium avium subsp. paratuberculosis
gccgcgcucggcca

SEQ ID NO: 909165 - RNA, 15 nt, Mycobacterium avium subsp. paratuberculosis
gccgcgcucggccau

SEQ ID NO: 909166 - RNA, 18 nt, Mycobacterium avium subsp. paratuberculosis
gccgcgcucggccauccg

SEQ ID NO: 909167 - RNA, 21 nt, Mycobacterium avium subsp. paratuberculosis
gccgcgcucggccauccgggc

SEQ ID NO: 909168 - RNA, 19 nt, Mycobacterium avium subsp. paratuberculosis
gccgcgcucgaacucaccg

SEQ ID NO: 909169 - RNA, 20 nt, Mycobacterium avium subsp. paratuberculosis
gccgcgcucgaacucaccgg

SEQ ID NO: 909170 - RNA, 20 nt, Mycobacterium avium subsp. paratuberculosis
gccgcgcucaacccgggccg

SEQ ID NO: 909171 - RNA, 22 nt, Mycobacterium avium subsp. paratuberculosis
gccgcgcucaacccgggccgga

SEQ ID NO: 909172 - RNA, 17 nt, Mycobacterium avium subsp. paratuberculosis
gccgcgcucgcaccagc

SEQ ID NO: 909173 - RNA, 18 nt, Mycobacterium avium subsp. paratuberculosis
gccgcgcucgcaccagcg

SEQ ID NO: 909174 - RNA, 14 nt, Mycobacterium avium subsp. paratuberculosis
gccggcgagucgcg

SEQ ID NO: 909175 - RNA, 17 nt, Mycobacterium avium subsp. paratuberculosis
gccggcgauaggcggcc

SEQ ID NO: 909176 - RNA, 20 nt, Mycobacterium avium subsp. paratuberculosis
gccggcgauaggcggccagc

SEQ ID NO: 909177 - RNA, 21 nt, Mycobacterium avium subsp. paratuberculosis
gccggcgauaggcggccagcu

SEQ ID NO: 909178 - RNA, 16 nt, Mycobacterium avium subsp. paratuberculosis
gccggcgagcucgcgg

SEQ ID NO: 909179 - RNA, 19 nt, Mycobacterium avium subsp. paratuberculosis
gccggcgagcucgcggccg

SEQ ID NO: 909180 - RNA, 19 nt, Mycobacterium avium subsp. paratuberculosis
gccggcgaggcggucggcg

SEQ ID NO: 909181 - RNA, 13 nt, Mycobacterium avium subsp. paratuberculosis
gccggcgacggcc

SEQ ID NO: 909182 - RNA, 14 nt, Mycobacterium avium subsp. paratuberculosis
gccggcgacggcca

SEQ ID NO: 909183 - RNA, 16 nt, Mycobacterium avium subsp. paratuberculosis
gccggcgacggccagc

SEQ ID NO: 909184 - RNA, 17 nt, Mycobacterium avium subsp. paratuberculosis
gccggcgacggccagcg

SEQ ID NO: 909185 - RNA, 18 nt, Mycobacterium avium subsp. paratuberculosis
gccggcgacggccagcgc

SEQ ID NO: 909186 - RNA, 20 nt, Mycobacterium avium subsp. paratuberculosis
gccggcgacggccagcgcgg

SEQ ID NO: 909187 - RNA, 15 nt, Mycobacterium avium subsp. paratuberculosis
gccggcgacggcgag

SEQ ID NO: 909188 - RNA, 17 nt, Mycobacterium avium subsp. paratuberculosis
gccggcgaucgucgccg

SEQ ID NO: 909189 - RNA, 19 nt, Mycobacterium avium subsp. paratuberculosis
gccggcgaucgucgccguc

SEQ ID NO: 909190 - RNA, 20 nt, Mycobacterium avium subsp. paratuberculosis
gccggcgaucgucgccguca

SEQ ID NO: 909191 - RNA, 21 nt, Mycobacterium avium subsp. paratuberculosis
gccggcgaucgucgccgucac

SEQ ID NO: 909192 - RNA, 16 nt, Mycobacterium avium subsp. paratuberculosis
gccggcgaucuccacc

SEQ ID NO: 909193 - RNA, 18 nt, Mycobacterium avium subsp. paratuberculosis
gccggcgacgguggcgcc

SEQ ID NO: 909194 - RNA, 20 nt, Mycobacterium avium subsp. paratuberculosis
gccggcgaucucgucgcgca

SEQ ID NO: 909195 - RNA, 22 nt, Mycobacterium avium subsp. paratuberculosis
gccggcgaugaacacgccgaua

SEQ ID NO: 909196 - RNA, 12 nt, Mycobacterium avium subsp. paratuberculosis
gccggcgaucac

SEQ ID NO: 909197 - RNA, 17 nt, Mycobacterium avium subsp. paratuberculosis
gccggcgauccgcgcgg

SEQ ID NO: 909198 - RNA, 18 nt, Mycobacterium avium subsp. paratuberculosis
gccggcgauccgcgcggc

SEQ ID NO: 909199 - RNA, 19 nt, Mycobacterium avium subsp. paratuberculosis
gccggcgauccgcgcggcg

SEQ ID NO: 909200 - RNA, 16 nt, Mycobacterium avium subsp. paratuberculosis
gccggcgaucgacguc

SEQ ID NO: 909201 - RNA, 22 nt, Mycobacterium avium subsp. paratuberculosis
gccggcgaucgacgucaccacc

SEQ ID NO: 909202 - RNA, 23 nt, Mycobacterium avium subsp. paratuberculosis
gccggcgaucgacgucaccaccg

SEQ ID NO: 909203 - RNA, 15 nt, Mycobacterium avium subsp. paratuberculosis
gccggccuccagcug

SEQ ID NO: 909204 - RNA, 16 nt, Mycobacterium avium subsp. paratuberculosis
gccggcgaacucgcgg

SEQ ID NO: 909205 - RNA, 17 nt, Mycobacterium avium subsp. paratuberculosis
gccggcgaacucgcggc

SEQ ID NO: 909206 - RNA, 20 nt, Mycobacterium avium subsp. paratuberculosis
gccggcgaacucgcggcggg

SEQ ID NO: 909207 - RNA, 22 nt, Mycobacterium avium subsp. paratuberculosis
gccggcgaacucgcggcggguc

SEQ ID NO: 909208 - RNA, 23 nt, Mycobacterium avium subsp. paratuberculosis
gccggcgaacucgcggcggguca

SEQ ID NO: 909209 - RNA, 17 nt, Mycobacterium avium subsp. paratuberculosis
gccggcgaagccgcuca

SEQ ID NO: 909210 - RNA, 18 nt, Mycobacterium avium subsp. paratuberculosis
gccggcgaagccgcucaa

SEQ ID NO: 909211 - RNA, 18 nt, Mycobacterium avium subsp. paratuberculosis
gccggcgaagcucgacga

SEQ ID NO: 909212 - RNA, 19 nt, Mycobacterium avium subsp. paratuberculosis
gccggcgaagcucgacgau

SEQ ID NO: 909213 - RNA, 19 nt, Mycobacterium avium subsp. paratuberculosis
gccggcgaaggacagccgg

SEQ ID NO: 909214 - RNA, 20 nt, Mycobacterium avium subsp. paratuberculosis
gccggcgaaggacagccgga

SEQ ID NO: 909215 - RNA, 16 nt, Mycobacterium avium subsp. paratuberculosis
gccggccuugcucgcc

SEQ ID NO: 909216 - RNA, 17 nt, Mycobacterium avium subsp. paratuberculosis
gccggccuugcucgccg

SEQ ID NO: 909217 - RNA, 15 nt, Mycobacterium avium subsp. paratuberculosis
gccggcgaaccgccg

SEQ ID NO: 909218 - RNA, 16 nt, Mycobacterium avium subsp. paratuberculosis
gccggcgaaccgccgc

SEQ ID NO: 909219 - RNA, 21 nt, Mycobacterium avium subsp. paratuberculosis
gccggcgaaccgccgcaccca

SEQ ID NO: 909220 - RNA, 18 nt, Mycobacterium avium subsp. paratuberculosis
gccggcgaacgacgucga

SEQ ID NO: 909221 - RNA, 20 nt, Mycobacterium avium subsp. paratuberculosis
gccggcgaauguccuugacg

SEQ ID NO: 909222 - RNA, 13 nt, Mycobacterium avium subsp. paratuberculosis
gccggcgaccagc

SEQ ID NO: 909223 - RNA, 13 nt, Mycobacterium avium subsp. paratuberculosis
gccggcgaccgcc

SEQ ID NO: 909224 - RNA, 23 nt, Mycobacterium avium subsp. paratuberculosis
gccggcgaccgccuugucggcga

SEQ ID NO: 909225 - RNA, 17 nt, Mycobacterium avium subsp. paratuberculosis
gccggcgaccgugccca

SEQ ID NO: 909226 - RNA, 20 nt, Mycobacterium avium subsp. paratuberculosis
gccggcgaccgugcccacca

SEQ ID NO: 909227 - RNA, 22 nt, Mycobacterium avium subsp. paratuberculosis
gccggcgaccgugcccaccagc

SEQ ID NO: 909228 - RNA, 15 nt, Mycobacterium avium subsp. paratuberculosis
gccggcgacgaccgc

SEQ ID NO: 909229 - RNA, 16 nt, Mycobacterium avium subsp. paratuberculosis
gccggcgacgaccgca

SEQ ID NO: 909230 - RNA, 23 nt, Mycobacterium avium subsp. paratuberculosis
gccggcgacgaccgcaccgacca

SEQ ID NO: 909231 - RNA, 16 nt, Mycobacterium avium subsp. paratuberculosis
gccggcgacgccgcgc

SEQ ID NO: 909232 - RNA, 17 nt, Mycobacterium avium subsp. paratuberculosis
gccggcgacgccgcgcu

SEQ ID NO: 909233 - RNA, 19 nt, Mycobacterium avium subsp. paratuberculosis
gccggcgacgccgcgcugg

SEQ ID NO: 909234 - RNA, 19 nt, Mycobacterium avium subsp. paratuberculosis
gccggcgacgccggcgagg

SEQ ID NO: 909235 - RNA, 21 nt, Mycobacterium avium subsp. paratuberculosis
gccggcgacgauaucggccgc

SEQ ID NO: 909236 - RNA, 13 nt, Mycobacterium avium subsp. paratuberculosis
gccggcgacgccg

SEQ ID NO: 909237 - RNA, 16 nt, Mycobacterium avium subsp. paratuberculosis
gccggcgccggcgguc

SEQ ID NO: 909238 - RNA, 23 nt, Mycobacterium avium subsp. paratuberculosis
gccggcgccgggaaaguuguagc

SEQ ID NO: 909239 - RNA, 13 nt, Mycobacterium avium subsp. paratuberculosis
gccggcgccgggc

SEQ ID NO: 909240 - RNA, 24 nt, Mycobacterium avium subsp. paratuberculosis
gccggcgccgggcgggcgcaggug

SEQ ID NO: 909241 - RNA, 13 nt, Mycobacterium avium subsp. paratuberculosis
gccggcgccggug

SEQ ID NO: 909242 - RNA, 15 nt, Mycobacterium avium subsp. paratuberculosis
gccggcgccggugcc

SEQ ID NO: 909243 - RNA, 14 nt, Mycobacterium avium subsp. paratuberculosis
gccggcgccgcggg

SEQ ID NO: 909244 - RNA, 16 nt, Mycobacterium avium subsp. paratuberculosis
gccggcgccgcgggug

SEQ ID NO: 909245 - RNA, 14 nt, Mycobacterium avium subsp. paratuberculosis
gccggcgccgccgg

SEQ ID NO: 909246 - RNA, 17 nt, Mycobacterium avium subsp. paratuberculosis
gccggcgcccugcgcgc

SEQ ID NO: 909247 - RNA, 18 nt, Mycobacterium avium subsp. paratuberculosis
gccggcgcccugcgcgcc

SEQ ID NO: 909248 - RNA, 22 nt, Mycobacterium avium subsp. paratuberculosis
gccggcgcccugcgcgcccugc

SEQ ID NO: 909249 - RNA, 14 nt, Mycobacterium avium subsp. paratuberculosis
gccggcgcccagcg

SEQ ID NO: 909250 - RNA, 16 nt, Mycobacterium avium subsp. paratuberculosis
gccggcgcccagcggc

SEQ ID NO: 909251 - RNA, 21 nt, Mycobacterium avium subsp. paratuberculosis
gccggcgcccagcggcgaugc

SEQ ID NO: 909252 - RNA, 12 nt, Mycobacterium avium subsp. paratuberculosis
gccggcgcccgu

SEQ ID NO: 909253 - RNA, 18 nt, Mycobacterium avium subsp. paratuberculosis
gccggcgcccgucacgcu

SEQ ID NO: 909254 - RNA, 20 nt, Mycobacterium avium subsp. paratuberculosis
gccggcgcccgucacgcugg

SEQ ID NO: 909255 - RNA, 22 nt, Mycobacterium avium subsp. paratuberculosis
gccggcgccgaagccgucgacc

SEQ ID NO: 909256 - RNA, 12 nt, Mycobacterium avium subsp. paratuberculosis
gccggcgccgac

SEQ ID NO: 909257 - RNA, 13 nt, Mycobacterium avium subsp. paratuberculosis
gccggcgccgacc

SEQ ID NO: 909258 - RNA, 14 nt, Mycobacterium avium subsp. paratuberculosis
gccggcgccgacga

SEQ ID NO: 909259 - RNA, 15 nt, Mycobacterium avium subsp. paratuberculosis
gccggcgccgacgac

SEQ ID NO: 909260 - RNA, 21 nt, Mycobacterium avium subsp. paratuberculosis
gccggcgccgacgacgucgcg

SEQ ID NO: 909261 - RNA, 14 nt, Mycobacterium avium subsp. paratuberculosis
gccggcgccgauuc

SEQ ID NO: 909262 - RNA, 23 nt, Mycobacterium avium subsp. paratuberculosis
gccggcgccgauuccgucggugg

SEQ ID NO: 909263 - RNA, 15 nt, Mycobacterium avium subsp. paratuberculosis
gccggcgcccgcagg

SEQ ID NO: 909264 - RNA, 19 nt, Mycobacterium avium subsp. paratuberculosis
gccggcgcccgcaggccgc

SEQ ID NO: 909265 - RNA, 11 nt, Mycobacterium avium subsp. paratuberculosis
gccggcgcagc

SEQ ID NO: 909266 - RNA, 14 nt, Mycobacterium avium subsp. paratuberculosis
gccggcgcagccgg

SEQ ID NO: 909267 - RNA, 17 nt, Mycobacterium avium subsp. paratuberculosis
gccggcgcagccggcca

SEQ ID NO: 909268 - RNA, 22 nt, Mycobacterium avium subsp. paratuberculosis
gccggcgcagccggccaccgcc

SEQ ID NO: 909269 - RNA, 15 nt, Mycobacterium avium subsp. paratuberculosis
gccggcgcagcggcc

SEQ ID NO: 909270 - RNA, 18 nt, Mycobacterium avium subsp. paratuberculosis
gccggcgcagcggcccga

SEQ ID NO: 909271 - RNA, 15 nt, Mycobacterium avium subsp. paratuberculosis
gccggcgcagguguc

SEQ ID NO: 909272 - RNA, 21 nt, Mycobacterium avium subsp. paratuberculosis
gccggcgcagguguccagccc

SEQ ID NO: 909273 - RNA, 17 nt, Mycobacterium avium subsp. paratuberculosis
gccggcgcaucaucucg

SEQ ID NO: 909274 - RNA, 14 nt, Mycobacterium avium subsp. paratuberculosis
gccggcgcaccgcg

SEQ ID NO: 909275 - RNA, 17 nt, Mycobacterium avium subsp. paratuberculosis
gccggcgcaccgcgucg

SEQ ID NO: 909276 - RNA, 21 nt, Mycobacterium avium subsp. paratuberculosis
gccggcgcaccgcgucgaugc

SEQ ID NO: 909277 - RNA, 23 nt, Mycobacterium avium subsp. paratuberculosis
gccggcgcacaucguggcgacga

SEQ ID NO: 909278 - RNA, 22 nt, Mycobacterium avium subsp. paratuberculosis
gccggcgcaacucguccagcgu

SEQ ID NO: 909279 - RNA, 16 nt, Mycobacterium avium subsp. paratuberculosis
gccggcgaugguggcg

SEQ ID NO: 909280 - RNA, 18 nt, Mycobacterium avium subsp. paratuberculosis
gccggcgaugguggcgcu

SEQ ID NO: 909281 - RNA, 14 nt, Mycobacterium avium subsp. paratuberculosis
gccggcgaugcccg

SEQ ID NO: 909282 - RNA, 15 nt, Mycobacterium avium subsp. paratuberculosis
gccggcgaugcccgu

SEQ ID NO: 909283 - RNA, 13 nt, Mycobacterium avium subsp. paratuberculosis
gccggcgauggcg

SEQ ID NO: 909284 - RNA, 18 nt, Mycobacterium avium subsp. paratuberculosis
gccggcgauggcgcggcc

SEQ ID NO: 909285 - RNA, 20 nt, Mycobacterium avium subsp. paratuberculosis
gccggccugcuuuucggccg

SEQ ID NO: 909286 - RNA, 15 nt, Mycobacterium avium subsp. paratuberculosis
gccggccuggcccag

SEQ ID NO: 909287 - RNA, 19 nt, Mycobacterium avium subsp. paratuberculosis
gccggccuggcccagccgc

SEQ ID NO: 909288 - RNA, 20 nt, Mycobacterium avium subsp. paratuberculosis
gccggccuggcccagccgcg

SEQ ID NO: 909289 - RNA, 23 nt, Mycobacterium avium subsp. paratuberculosis
gccggccuggcccagccgcguca

SEQ ID NO: 909290 - RNA, 16 nt, Mycobacterium avium subsp. paratuberculosis
gccggccucucgucga

SEQ ID NO: 909291 - RNA, 18 nt, Mycobacterium avium subsp. paratuberculosis
gccggccucucgucgacg

SEQ ID NO: 909292 - RNA, 22 nt, Mycobacterium avium subsp. paratuberculosis
gccggccuucucgcgcaccgcg

SEQ ID NO: 909293 - RNA, 12 nt, Mycobacterium avium subsp. paratuberculosis
gccggccuggug

SEQ ID NO: 909294 - RNA, 13 nt, Mycobacterium avium subsp. paratuberculosis
gccggccuggugc

SEQ ID NO: 909295 - RNA, 14 nt, Mycobacterium avium subsp. paratuberculosis
gccggccuggugcg

SEQ ID NO: 909296 - RNA, 16 nt, Mycobacterium avium subsp. paratuberculosis
gccggccuggugcgga

SEQ ID NO: 909297 - RNA, 16 nt, Mycobacterium avium subsp. paratuberculosis
gccggccugccaccgc

SEQ ID NO: 909298 - RNA, 16 nt, Mycobacterium avium subsp. paratuberculosis
gccggccugcccgccg

SEQ ID NO: 909299 - RNA, 18 nt, Mycobacterium avium subsp. paratuberculosis
gccggccugcccgccgcg

SEQ ID NO: 909300 - RNA, 20 nt, Mycobacterium avium subsp. paratuberculosis
gccggccugcccgccgcggc

SEQ ID NO: 909301 - RNA, 19 nt, Mycobacterium avium subsp. paratuberculosis
gccggccugccggaugccg

SEQ ID NO: 909302 - RNA, 13 nt, Mycobacterium avium subsp. paratuberculosis
gccggccucgggg

SEQ ID NO: 909303 - RNA, 17 nt, Mycobacterium avium subsp. paratuberculosis
gccggccucgggguugc

SEQ ID NO: 909304 - RNA, 13 nt, Mycobacterium avium subsp. paratuberculosis
gccggccucgucg

SEQ ID NO: 909305 - RNA, 14 nt, Mycobacterium avium subsp. paratuberculosis
gccggccucgucgg

SEQ ID NO: 909306 - RNA, 15 nt, Mycobacterium avium subsp. paratuberculosis
gccggccucgucggc

SEQ ID NO: 909307 - RNA, 13 nt, Mycobacterium avium subsp. paratuberculosis
gccggccucgccg

SEQ ID NO: 909308 - RNA, 17 nt, Mycobacterium avium subsp. paratuberculosis
gccggccguugcgggug

SEQ ID NO: 909309 - RNA, 19 nt, Mycobacterium avium subsp. paratuberculosis
gccggccguugcggguguc

SEQ ID NO: 909310 - RNA, 15 nt, Mycobacterium avium subsp. paratuberculosis
gccggccguucgccg

SEQ ID NO: 909311 - RNA, 18 nt, Mycobacterium avium subsp. paratuberculosis
gccggccguucgccggcc

SEQ ID NO: 909312 - RNA, 22 nt, Mycobacterium avium subsp. paratuberculosis
gccggccgucacgcuggcguga

SEQ ID NO: 909313 - RNA, 14 nt, Mycobacterium avium subsp. paratuberculosis
gccggccguagcgg

SEQ ID NO: 909314 - RNA, 18 nt, Mycobacterium avium subsp. paratuberculosis
gccggccguagcggacga

SEQ ID NO: 909315 - RNA, 23 nt, Mycobacterium avium subsp. paratuberculosis
gccggccgucaggaacgccggcu

SEQ ID NO: 909316 - RNA, 15 nt, Mycobacterium avium subsp. paratuberculosis
gccggccguccacgg

SEQ ID NO: 909317 - RNA, 21 nt, Mycobacterium avium subsp. paratuberculosis
gccggccguccacggcggugg

SEQ ID NO: 909318 - RNA, 12 nt, Mycobacterium avium subsp. paratuberculosis
gccggccgugcc

SEQ ID NO: 909319 - RNA, 14 nt, Mycobacterium avium subsp. paratuberculosis
gccggccgugccgg

SEQ ID NO: 909320 - RNA, 16 nt, Mycobacterium avium subsp. paratuberculosis
gccggccgugccggcu

SEQ ID NO: 909321 - RNA, 13 nt, Mycobacterium avium subsp. paratuberculosis
gccggccgggacg

SEQ ID NO: 909322 - RNA, 13 nt, Mycobacterium avium subsp. paratuberculosis
gccggccggcgaa

SEQ ID NO: 909323 - RNA, 16 nt, Mycobacterium avium subsp. paratuberculosis
gccggccggggcggcg

SEQ ID NO: 909324 - RNA, 18 nt, Mycobacterium avium subsp. paratuberculosis
gccggccgggucgaccgc

SEQ ID NO: 909325 - RNA, 23 nt, Mycobacterium avium subsp. paratuberculosis
gccggccgggcggacggcaccga

SEQ ID NO: 909326 - RNA, 15 nt, Mycobacterium avium subsp. paratuberculosis
gccggccgggcugcg

SEQ ID NO: 909327 - RNA, 19 nt, Mycobacterium avium subsp. paratuberculosis
gccggccgggcugcgcagc

SEQ ID NO: 909328 - RNA, 17 nt, Mycobacterium avium subsp. paratuberculosis
gccggccggcaggucga

SEQ ID NO: 909329 - RNA, 22 nt, Mycobacterium avium subsp. paratuberculosis
gccggccggcaggucgaggccg

SEQ ID NO: 909330 - RNA, 13 nt, Mycobacterium avium subsp. paratuberculosis
gccggccggccga

SEQ ID NO: 909331 - RNA, 16 nt, Mycobacterium avium subsp. paratuberculosis
gccggccggccgacaa

SEQ ID NO: 909332 - RNA, 17 nt, Mycobacterium avium subsp. paratuberculosis
gccggccggccgagccg

SEQ ID NO: 909333 - RNA, 11 nt, Mycobacterium avium subsp. paratuberculosis
gccggccggcg

SEQ ID NO: 909334 - RNA, 21 nt, Mycobacterium avium subsp. paratuberculosis
gccggccggacaccgaaccgc

SEQ ID NO: 909335 - RNA, 21 nt, Mycobacterium avium subsp. paratuberculosis
gccggccggacagaucgccca

SEQ ID NO: 909336 - RNA, 14 nt, Mycobacterium avium subsp. paratuberculosis
gccggccggcacga

SEQ ID NO: 909337 - RNA, 15 nt, Mycobacterium avium subsp. paratuberculosis
gccggccgcuacccg

SEQ ID NO: 909338 - RNA, 17 nt, Mycobacterium avium subsp. paratuberculosis
gccggccgcuacccggc

SEQ ID NO: 909339 - RNA, 19 nt, Mycobacterium avium subsp. paratuberculosis
gccggccgcuacccggcga

SEQ ID NO: 909340 - RNA, 13 nt, Mycobacterium avium subsp. paratuberculosis
gccggccgcgcgc

SEQ ID NO: 909341 - RNA, 16 nt, Mycobacterium avium subsp. paratuberculosis
gccggccgcggcgugc

SEQ ID NO: 909342 - RNA, 16 nt, Mycobacterium avium subsp. paratuberculosis
gccggccgcgggcgau

SEQ ID NO: 909343 - RNA, 17 nt, Mycobacterium avium subsp. paratuberculosis
gccggccgcgggcgauu

SEQ ID NO: 909344 - RNA, 20 nt, Mycobacterium avium subsp. paratuberculosis
gccggccgcguacuucgcgc

SEQ ID NO: 909345 - RNA, 14 nt, Mycobacterium avium subsp. paratuberculosis
gccggccgcgucgc

SEQ ID NO: 909346 - RNA, 14 nt, Mycobacterium avium subsp. paratuberculosis
gccggccgcgcgug

SEQ ID NO: 909347 - RNA, 21 nt, Mycobacterium avium subsp. paratuberculosis
gccggccgcgcgcggcgcgga

SEQ ID NO: 909348 - RNA, 12 nt, Mycobacterium avium subsp. paratuberculosis
gccggccgcgcg

SEQ ID NO: 909349 - RNA, 16 nt, Mycobacterium avium subsp. paratuberculosis
gccggccgcgcccauc

SEQ ID NO: 909350 - RNA, 21 nt, Mycobacterium avium subsp. paratuberculosis
gccggccgcgcccaucgcggc

SEQ ID NO: 909351 - RNA, 23 nt, Mycobacterium avium subsp. paratuberculosis
gccggccgcgcccaucgcggccg

SEQ ID NO: 909352 - RNA, 13 nt, Mycobacterium avium subsp. paratuberculosis
gccggccgccugg

SEQ ID NO: 909353 - RNA, 14 nt, Mycobacterium avium subsp. paratuberculosis
gccggccgccugga

SEQ ID NO: 909354 - RNA, 12 nt, Mycobacterium avium subsp. paratuberculosis
gccggccgccgu

SEQ ID NO: 909355 - RNA, 13 nt, Mycobacterium avium subsp. paratuberculosis
gccggccgccgug

SEQ ID NO: 909356 - RNA, 16 nt, Mycobacterium avium subsp. paratuberculosis
gccggccgccguggcc

SEQ ID NO: 909357 - RNA, 19 nt, Mycobacterium avium subsp. paratuberculosis
gccggccgccggcggccaa

SEQ ID NO: 909358 - RNA, 14 nt, Mycobacterium avium subsp. paratuberculosis
gccggccgccgcgc

SEQ ID NO: 909359 - RNA, 17 nt, Mycobacterium avium subsp. paratuberculosis
gccggccgccgcgcauc

SEQ ID NO: 909360 - RNA, 12 nt, Mycobacterium avium subsp. paratuberculosis
gccggccgccgg

SEQ ID NO: 909361 - RNA, 17 nt, Mycobacterium avium subsp. paratuberculosis
gccggccgccgaagccg

SEQ ID NO: 909362 - RNA, 13 nt, Mycobacterium avium subsp. paratuberculosis
gccggccgccgcg

SEQ ID NO: 909363 - RNA, 12 nt, Mycobacterium avium subsp. paratuberculosis
gccggccgccga

SEQ ID NO: 909364 - RNA, 21 nt, Mycobacterium avium subsp. paratuberculosis
gccggccgcagcugcugcggc

SEQ ID NO: 909365 - RNA, 14 nt, Mycobacterium avium subsp. paratuberculosis
gccggccgccagcg

SEQ ID NO: 909366 - RNA, 15 nt, Mycobacterium avium subsp. paratuberculosis
gccggccgccagcgc

SEQ ID NO: 909367 - RNA, 17 nt, Mycobacterium avium subsp. paratuberculosis
gccggccgccagcgccc

SEQ ID NO: 909368 - RNA, 22 nt, Mycobacterium avium subsp. paratuberculosis
gccggccgccagcgcccgcgcg

SEQ ID NO: 909369 - RNA, 21 nt, Mycobacterium avium subsp. paratuberculosis
gccggccgagccgagccgacc

SEQ ID NO: 909370 - RNA, 14 nt, Mycobacterium avium subsp. paratuberculosis
gccggccgacgcgg

SEQ ID NO: 909371 - RNA, 17 nt, Mycobacterium avium subsp. paratuberculosis
gccggccgacgcggccu

SEQ ID NO: 909372 - RNA, 15 nt, Mycobacterium avium subsp. paratuberculosis
gccggcccugcggcc

SEQ ID NO: 909373 - RNA, 22 nt, Mycobacterium avium subsp. paratuberculosis
gccggcccugcggccagugccg

SEQ ID NO: 909374 - RNA, 13 nt, Mycobacterium avium subsp. paratuberculosis
gccggccgaacac

SEQ ID NO: 909375 - RNA, 18 nt, Mycobacterium avium subsp. paratuberculosis
gccggccgaagaccgccg

SEQ ID NO: 909376 - RNA, 21 nt, Mycobacterium avium subsp. paratuberculosis
gccggccgaagcguuccgccg

SEQ ID NO: 909377 - RNA, 22 nt, Mycobacterium avium subsp. paratuberculosis
gccggccgaagcguuccgccgu

SEQ ID NO: 909378 - RNA, 18 nt, Mycobacterium avium subsp. paratuberculosis
gccggccgacaacgacag

SEQ ID NO: 909379 - RNA, 22 nt, Mycobacterium avium subsp. paratuberculosis
gccggccgacaccccgaugccg

SEQ ID NO: 909380 - RNA, 15 nt, Mycobacterium avium subsp. paratuberculosis
gccggccgaccgccu

SEQ ID NO: 909381 - RNA, 20 nt, Mycobacterium avium subsp. paratuberculosis
gccggccgaccgccucgaug

SEQ ID NO: 909382 - RNA, 14 nt, Mycobacterium avium subsp. paratuberculosis
gccggcccgcggcg

SEQ ID NO: 909383 - RNA, 23 nt, Mycobacterium avium subsp. paratuberculosis
gccggcccgcggcggauccagca

SEQ ID NO: 909384 - RNA, 17 nt, Mycobacterium avium subsp. paratuberculosis
gccggcccggcccgacg

SEQ ID NO: 909385 - RNA, 17 nt, Mycobacterium avium subsp. paratuberculosis
gccggcccggcggguca

SEQ ID NO: 909386 - RNA, 18 nt, Mycobacterium avium subsp. paratuberculosis
gccggcccggcgggucag

SEQ ID NO: 909387 - RNA, 13 nt, Mycobacterium avium subsp. paratuberculosis
gccggcccggggu

SEQ ID NO: 909388 - RNA, 14 nt, Mycobacterium avium subsp. paratuberculosis
gccggcccggggug

SEQ ID NO: 909389 - RNA, 15 nt, Mycobacterium avium subsp. paratuberculosis
gccggcccggggugu

SEQ ID NO: 909390 - RNA, 14 nt, Mycobacterium avium subsp. paratuberculosis
gccggcccgcccgg

SEQ ID NO: 909391 - RNA, 15 nt, Mycobacterium avium subsp. paratuberculosis
gccggcccgcccggc

SEQ ID NO: 909392 - RNA, 16 nt, Mycobacterium avium subsp. paratuberculosis
gccggcccgcccggcg

SEQ ID NO: 909393 - RNA, 17 nt, Mycobacterium avium subsp. paratuberculosis
gccggcccgcccggcgg

SEQ ID NO: 909394 - RNA, 12 nt, Mycobacterium avium subsp. paratuberculosis
gccggcccgcag

SEQ ID NO: 909395 - RNA, 13 nt, Mycobacterium avium subsp. paratuberculosis
gccggcccgcagc

SEQ ID NO: 909396 - RNA, 14 nt, Mycobacterium avium subsp. paratuberculosis
gccggcccgcagcc

SEQ ID NO: 909397 - RNA, 15 nt, Mycobacterium avium subsp. paratuberculosis
gccggcccgcagcca

SEQ ID NO: 909398 - RNA, 17 nt, Mycobacterium avium subsp. paratuberculosis
gccggcccgcagccagc

SEQ ID NO: 909399 - RNA, 20 nt, Mycobacterium avium subsp. paratuberculosis
gccggcccgcagcgccucgg

SEQ ID NO: 909400 - RNA, 21 nt, Mycobacterium avium subsp. paratuberculosis
gccggcccgcagcgccucggc

SEQ ID NO: 909401 - RNA, 22 nt, Mycobacterium avium subsp. paratuberculosis
gccggcccgcagcgccucggcg

SEQ ID NO: 909402 - RNA, 18 nt, Mycobacterium avium subsp. paratuberculosis
gccggcccgcaucgcggc

SEQ ID NO: 909403 - RNA, 18 nt, Mycobacterium avium subsp. paratuberculosis
gccggcccgagcccugcg

SEQ ID NO: 909404 - RNA, 21 nt, Mycobacterium avium subsp. paratuberculosis
gccggcccgagcccugcgcca

SEQ ID NO: 909405 - RNA, 17 nt, Mycobacterium avium subsp. paratuberculosis
gccggcccgauaggccg

SEQ ID NO: 909406 - RNA, 14 nt, Mycobacterium avium subsp. paratuberculosis
gccggccccggccg

SEQ ID NO: 909407 - RNA, 15 nt, Mycobacterium avium subsp. paratuberculosis
gccggccccggccgg

SEQ ID NO: 909408 - RNA, 20 nt, Mycobacterium avium subsp. paratuberculosis
gccggccccggccgggcgac

SEQ ID NO: 909409 - RNA, 17 nt, Mycobacterium avium subsp. paratuberculosis
gccggccccggcgacgg

SEQ ID NO: 909410 - RNA, 23 nt, Mycobacterium avium subsp. paratuberculosis
gccggccccggcgacggcggccg

SEQ ID NO: 909411 - RNA, 13 nt, Mycobacterium avium subsp. paratuberculosis
gccggccccgggg

SEQ ID NO: 909412 - RNA, 19 nt, Mycobacterium avium subsp. paratuberculosis
gccggccccuaccgccgag

SEQ ID NO: 909413 - RNA, 20 nt, Mycobacterium avium subsp. paratuberculosis
gccggccccuaccgccgagc

SEQ ID NO: 909414 - RNA, 12 nt, Mycobacterium avium subsp. paratuberculosis
gccggcuucggc

SEQ ID NO: 909415 - RNA, 16 nt, Mycobacterium avium subsp. paratuberculosis
gccggcuucggccaag

SEQ ID NO: 909416 - RNA, 14 nt, Mycobacterium avium subsp. paratuberculosis
gccggcuuaccgac

SEQ ID NO: 909417 - RNA, 19 nt, Mycobacterium avium subsp. paratuberculosis
gccggcuuaccgaccucga

SEQ ID NO: 909418 - RNA, 22 nt, Mycobacterium avium subsp. paratuberculosis
gccggcuuaccgaccucgaggc

SEQ ID NO: 909419 - RNA, 19 nt, Mycobacterium avium subsp. paratuberculosis
gccggcuugccccgguccc

SEQ ID NO: 909420 - RNA, 20 nt, Mycobacterium avium subsp. paratuberculosis
gccggcuugccccggucccg

SEQ ID NO: 909421 - RNA, 16 nt, Mycobacterium avium subsp. paratuberculosis
gccggcuucucggcgu

SEQ ID NO: 909422 - RNA, 18 nt, Mycobacterium avium subsp. paratuberculosis
gccggcuugaucucgacc

SEQ ID NO: 909423 - RNA, 19 nt, Mycobacterium avium subsp. paratuberculosis
gccgggaaacccucgacgc

SEQ ID NO: 909424 - RNA, 22 nt, Mycobacterium avium subsp. paratuberculosis
gccgggaaacccucgacgccgg

SEQ ID NO: 909425 - RNA, 12 nt, Mycobacterium avium subsp. paratuberculosis
gccggcugcagc

SEQ ID NO: 909426 - RNA, 16 nt, Mycobacterium avium subsp. paratuberculosis
gccggcugcagccggg

SEQ ID NO: 909427 - RNA, 17 nt, Mycobacterium avium subsp. paratuberculosis
gccggcugcagccgggc

SEQ ID NO: 909428 - RNA, 18 nt, Mycobacterium avium subsp. paratuberculosis
gccggcugcagccgggcg

SEQ ID NO: 909429 - RNA, 21 nt, Mycobacterium avium subsp. paratuberculosis
gccggcugcagccgggcggcg

SEQ ID NO: 909430 - RNA, 17 nt, Mycobacterium avium subsp. paratuberculosis
gccggcugcccgcgacu

SEQ ID NO: 909431 - RNA, 18 nt, Mycobacterium avium subsp. paratuberculosis
gccggcugaaccugcugg

SEQ ID NO: 909432 - RNA, 16 nt, Mycobacterium avium subsp. paratuberculosis
gccggcugacugccgg

SEQ ID NO: 909433 - RNA, 21 nt, Mycobacterium avium subsp. paratuberculosis
gccggcugacugccggcgacg

SEQ ID NO: 909434 - RNA, 15 nt, Mycobacterium avium subsp. paratuberculosis
gccggcugagcagcc

SEQ ID NO: 909435 - RNA, 14 nt, Mycobacterium avium subsp. paratuberculosis
gccggcucggcggc

SEQ ID NO: 909436 - RNA, 15 nt, Mycobacterium avium subsp. paratuberculosis
gccggcucggcggcu

SEQ ID NO: 909437 - RNA, 22 nt, Mycobacterium avium subsp. paratuberculosis
gccggcucgguaugcggcgacg

SEQ ID NO: 909438 - RNA, 18 nt, Mycobacterium avium subsp. paratuberculosis
gccggcuccaccgcgccg

SEQ ID NO: 909439 - RNA, 19 nt, Mycobacterium avium subsp. paratuberculosis
gccggcuccaccgcgccgg

SEQ ID NO: 909440 - RNA, 22 nt, Mycobacterium avium subsp. paratuberculosis
gccggcuccaccgcgccggcgg

SEQ ID NO: 909441 - RNA, 23 nt, Mycobacterium avium subsp. paratuberculosis
gccggcuccaccgcgccggcggc

SEQ ID NO: 909442 - RNA, 24 nt, Mycobacterium avium subsp. paratuberculosis
gccggcuccaccgcgccggcggcg

SEQ ID NO: 909443 - RNA, 14 nt, Mycobacterium avium subsp. paratuberculosis
gccggcucagcggc

SEQ ID NO: 909444 - RNA, 15 nt, Mycobacterium avium subsp. paratuberculosis
gccggcucagcggca

SEQ ID NO: 909445 - RNA, 17 nt, Mycobacterium avium subsp. paratuberculosis
gccggcucagggugcgc

SEQ ID NO: 909446 - RNA, 18 nt, Mycobacterium avium subsp. paratuberculosis
gccggcucagggugcgcu

SEQ ID NO: 909447 - RNA, 20 nt, Mycobacterium avium subsp. paratuberculosis
gccggcucagggugcgcugg

SEQ ID NO: 909448 - RNA, 14 nt, Mycobacterium avium subsp. paratuberculosis
gccggcuaccgcgc

SEQ ID NO: 909449 - RNA, 17 nt, Mycobacterium avium subsp. paratuberculosis
gccggcuaccggcgcug

SEQ ID NO: 909450 - RNA, 16 nt, Mycobacterium avium subsp. paratuberculosis
gccggcuaccgcgcgg

SEQ ID NO: 909451 - RNA, 18 nt, Mycobacterium avium subsp. paratuberculosis
gccggcuaccgcgcggag

SEQ ID NO: 909452 - RNA, 17 nt, Mycobacterium avium subsp. paratuberculosis
gccggcgugucggcgcc

SEQ ID NO: 909453 - RNA, 19 nt, Mycobacterium avium subsp. paratuberculosis
gccggcgugucggcgccac

SEQ ID NO: 909454 - RNA, 19 nt, Mycobacterium avium subsp. paratuberculosis
gccggcgugggaaccacca

SEQ ID NO: 909455 - RNA, 22 nt, Mycobacterium avium subsp. paratuberculosis
gccggcguguaguacugcucga

SEQ ID NO: 909456 - RNA, 16 nt, Mycobacterium avium subsp. paratuberculosis
gccggcgugcugggcc

SEQ ID NO: 909457 - RNA, 20 nt, Mycobacterium avium subsp. paratuberculosis
gccggcgugcugggccacga

SEQ ID NO: 909458 - RNA, 21 nt, Mycobacterium avium subsp. paratuberculosis
gccggcgugcugggccacgau

SEQ ID NO: 909459 - RNA, 20 nt, Mycobacterium avium subsp. paratuberculosis
gccggcgucuugaucucggc

SEQ ID NO: 909460 - RNA, 19 nt, Mycobacterium avium subsp. paratuberculosis
gccggcgugcacaggccgc

SEQ ID NO: 909461 - RNA, 23 nt, Mycobacterium avium subsp. paratuberculosis
gccggcgugcacaggccgccgca

SEQ ID NO: 909462 - RNA, 16 nt, Mycobacterium avium subsp. paratuberculosis
gccggcgucgaugaug

SEQ ID NO: 909463 - RNA, 18 nt, Mycobacterium avium subsp. paratuberculosis
gccggcgucgaugaugcc

SEQ ID NO: 909464 - RNA, 19 nt, Mycobacterium avium subsp. paratuberculosis
gccggcgucgaugaugccg

SEQ ID NO: 909465 - RNA, 21 nt, Mycobacterium avium subsp. paratuberculosis
gccggcgucgaugaugccggc

SEQ ID NO: 909466 - RNA, 22 nt, Mycobacterium avium subsp. paratuberculosis
gccggcgucgaugaugccggcg

SEQ ID NO: 909467 - RNA, 15 nt, Mycobacterium avium subsp. paratuberculosis
gccggcgucgccgcu

SEQ ID NO: 909468 - RNA, 16 nt, Mycobacterium avium subsp. paratuberculosis
gccggcgucgccgcuc

SEQ ID NO: 909469 - RNA, 15 nt, Mycobacterium avium subsp. paratuberculosis
gccggcgucgcggug

SEQ ID NO: 909470 - RNA, 14 nt, Mycobacterium avium subsp. paratuberculosis
gccggcgucggugu

SEQ ID NO: 909471 - RNA, 21 nt, Mycobacterium avium subsp. paratuberculosis
gccggcgucggugucccgcgc

SEQ ID NO: 909472 - RNA, 22 nt, Mycobacterium avium subsp. paratuberculosis
gccggcgucggugucccgcgcc

SEQ ID NO: 909473 - RNA, 17 nt, Mycobacterium avium subsp. paratuberculosis
gccggcgucgucgucgc

SEQ ID NO: 909474 - RNA, 23 nt, Mycobacterium avium subsp. paratuberculosis
gccggcgucugcauccggaaccg

SEQ ID NO: 909475 - RNA, 15 nt, Mycobacterium avium subsp. paratuberculosis
gccggcgucgacguc

SEQ ID NO: 909476 - RNA, 14 nt, Mycobacterium avium subsp. paratuberculosis
gccggcgucgauga

SEQ ID NO: 909477 - RNA, 12 nt, Mycobacterium avium subsp. paratuberculosis
gccggcguccag

SEQ ID NO: 909478 - RNA, 19 nt, Mycobacterium avium subsp. paratuberculosis
gccggcguccagcgccgcc

SEQ ID NO: 909479 - RNA, 22 nt, Mycobacterium avium subsp. paratuberculosis
gccggcguccagcgccgccacg

SEQ ID NO: 909480 - RNA, 17 nt, Mycobacterium avium subsp. paratuberculosis
gccggcguccaggcgca

SEQ ID NO: 909481 - RNA, 21 nt, Mycobacterium avium subsp. paratuberculosis
gccggcguccaggcgcaccgc

SEQ ID NO: 909482 - RNA, 21 nt, Mycobacterium avium subsp. paratuberculosis
gccggcguccaguucggccag

SEQ ID NO: 909483 - RNA, 21 nt, Mycobacterium avium subsp. paratuberculosis
gccggcgucacucuggcguga

SEQ ID NO: 909484 - RNA, 22 nt, Mycobacterium avium subsp. paratuberculosis
gccggcggugauccgcccggcc

SEQ ID NO: 909485 - RNA, 11 nt, Mycobacterium avium subsp. paratuberculosis
gccggcggugc

SEQ ID NO: 909486 - RNA, 21 nt, Mycobacterium avium subsp. paratuberculosis
gccggcggugcagggucagca

SEQ ID NO: 909487 - RNA, 21 nt, Mycobacterium avium subsp. paratuberculosis
gccggcggugcgucgaaucac

SEQ ID NO: 909488 - RNA, 15 nt, Mycobacterium avium subsp. paratuberculosis
gccggcguagcaguc

SEQ ID NO: 909489 - RNA, 19 nt, Mycobacterium avium subsp. paratuberculosis
gccggcguagcagucggcc

SEQ ID NO: 909490 - RNA, 20 nt, Mycobacterium avium subsp. paratuberculosis
gccggcguagcagucggccu

SEQ ID NO: 909491 - RNA, 19 nt, Mycobacterium avium subsp. paratuberculosis
gccggcgguucggcgggcc

SEQ ID NO: 909492 - RNA, 13 nt, Mycobacterium avium subsp. paratuberculosis
gccggcguacccg

SEQ ID NO: 909493 - RNA, 20 nt, Mycobacterium avium subsp. paratuberculosis
gccggcguacccgcccaugc

SEQ ID NO: 909494 - RNA, 22 nt, Mycobacterium avium subsp. paratuberculosis
gccggcguacccgcccaugcac

SEQ ID NO: 909495 - RNA, 13 nt, Mycobacterium avium subsp. paratuberculosis
gccggcguacucg

SEQ ID NO: 909496 - RNA, 19 nt, Mycobacterium avium subsp. paratuberculosis
gccggcguacucgcacagc

SEQ ID NO: 909497 - RNA, 20 nt, Mycobacterium avium subsp. paratuberculosis
gccggcguacucgcacagcc

SEQ ID NO: 909498 - RNA, 21 nt, Mycobacterium avium subsp. paratuberculosis
gccggcguacucgcacagccg

SEQ ID NO: 909499 - RNA, 23 nt, Mycobacterium avium subsp. paratuberculosis
gccggcguagaccagcgacgcca

SEQ ID NO: 909500 - RNA, 20 nt, Mycobacterium avium subsp. paratuberculosis
gccggcgguaugcccgggcc

SEQ ID NO: 909501 - RNA, 12 nt, Mycobacterium avium subsp. paratuberculosis
gccggcggucga

SEQ ID NO: 909502 - RNA, 14 nt, Mycobacterium avium subsp. paratuberculosis
gccggcgguggcca

SEQ ID NO: 909503 - RNA, 12 nt, Mycobacterium avium subsp. paratuberculosis
gccggcgguggu

SEQ ID NO: 909504 - RNA, 16 nt, Mycobacterium avium subsp. paratuberculosis
gccggcgguggugccg

SEQ ID NO: 909505 - RNA, 17 nt, Mycobacterium avium subsp. paratuberculosis
gccggcgguggugccgc

SEQ ID NO: 909506 - RNA, 12 nt, Mycobacterium avium subsp. paratuberculosis
gccggcgguguc

SEQ ID NO: 909507 - RNA, 17 nt, Mycobacterium avium subsp. paratuberculosis
gccggcgguguccacga

SEQ ID NO: 909508 - RNA, 14 nt, Mycobacterium avium subsp. paratuberculosis
gccggcggugucga

SEQ ID NO: 909509 - RNA, 12 nt, Mycobacterium avium subsp. paratuberculosis
gccggcgggcgc

SEQ ID NO: 909510 - RNA, 13 nt, Mycobacterium avium subsp. paratuberculosis
gccggcggggcgg

SEQ ID NO: 909511 - RNA, 17 nt, Mycobacterium avium subsp. paratuberculosis
gccggcggggcgggggc

SEQ ID NO: 909512 - RNA, 13 nt, Mycobacterium avium subsp. paratuberculosis
gccggcggggcgu

SEQ ID NO: 909513 - RNA, 16 nt, Mycobacterium avium subsp. paratuberculosis
gccggcggggcgucgc

SEQ ID NO: 909514 - RNA, 18 nt, Mycobacterium avium subsp. paratuberculosis
gccggcggggcgucgccc

SEQ ID NO: 909515 - RNA, 20 nt, Mycobacterium avium subsp. paratuberculosis
gccggcggggcgucgcccgc

SEQ ID NO: 909516 - RNA, 22 nt, Mycobacterium avium subsp. paratuberculosis
gccggcggggcgucgcccgccg

SEQ ID NO: 909517 - RNA, 19 nt, Mycobacterium avium subsp. paratuberculosis
gccggcgggggcgcguccg

SEQ ID NO: 909518 - RNA, 12 nt, Mycobacterium avium subsp. paratuberculosis
gccggcggggug

SEQ ID NO: 909519 - RNA, 13 nt, Mycobacterium avium subsp. paratuberculosis
gccggcggggugg

SEQ ID NO: 909520 - RNA, 19 nt, Mycobacterium avium subsp. paratuberculosis
gccggcggggugggcaccu

SEQ ID NO: 909521 - RNA, 15 nt, Mycobacterium avium subsp. paratuberculosis
gccggcgggucagca

SEQ ID NO: 909522 - RNA, 17 nt, Mycobacterium avium subsp. paratuberculosis
gccggcgggucagcagc

SEQ ID NO: 909523 - RNA, 21 nt, Mycobacterium avium subsp. paratuberculosis
gccggcgggugagccggucga

SEQ ID NO: 909524 - RNA, 20 nt, Mycobacterium avium subsp. paratuberculosis
gccggcggguuggccgucga

SEQ ID NO: 909525 - RNA, 14 nt, Mycobacterium avium subsp. paratuberculosis
gccggcgguaccgc

SEQ ID NO: 909526 - RNA, 12 nt, Mycobacterium avium subsp. paratuberculosis
gccggcggcguu

SEQ ID NO: 909527 - RNA, 19 nt, Mycobacterium avium subsp. paratuberculosis
gccggcggcguugaggcgu

SEQ ID NO: 909528 - RNA, 15 nt, Mycobacterium avium subsp. paratuberculosis
gccggcggcugugau

SEQ ID NO: 909529 - RNA, 13 nt, Mycobacterium avium subsp. paratuberculosis
gccggcggcggcg

SEQ ID NO: 909530 - RNA, 18 nt, Mycobacterium avium subsp. paratuberculosis
gccggcggcggcgguccg

SEQ ID NO: 909531 - RNA, 21 nt, Mycobacterium avium subsp. paratuberculosis
gccggcggcggcggucggcau

SEQ ID NO: 909532 - RNA, 17 nt, Mycobacterium avium subsp. paratuberculosis
gccggcggcgucccacg

SEQ ID NO: 909533 - RNA, 20 nt, Mycobacterium avium subsp. paratuberculosis
gccggcggcgucccacgugg

SEQ ID NO: 909534 - RNA, 16 nt, Mycobacterium avium subsp. paratuberculosis
gccggcggcgucguga

SEQ ID NO: 909535 - RNA, 15 nt, Mycobacterium avium subsp. paratuberculosis
gccggcggcggugcg

SEQ ID NO: 909536 - RNA, 14 nt, Mycobacterium avium subsp. paratuberculosis
gccggcggcgggcu

SEQ ID NO: 909537 - RNA, 17 nt, Mycobacterium avium subsp. paratuberculosis
gccggcggcgggcucgg

SEQ ID NO: 909538 - RNA, 14 nt, Mycobacterium avium subsp. paratuberculosis
gccggcggcgcccg

SEQ ID NO: 909539 - RNA, 15 nt, Mycobacterium avium subsp. paratuberculosis
gccggcggcgcccgc

SEQ ID NO: 909540 - RNA, 17 nt, Mycobacterium avium subsp. paratuberculosis
gccggcggcgcccgcgg

SEQ ID NO: 909541 - RNA, 19 nt, Mycobacterium avium subsp. paratuberculosis
gccggcggcggaccgucgg

SEQ ID NO: 909542 - RNA, 17 nt, Mycobacterium avium subsp. paratuberculosis
gccggcgcuggcgugcu

SEQ ID NO: 909543 - RNA, 16 nt, Mycobacterium avium subsp. paratuberculosis
gccggcggcggccagc

SEQ ID NO: 909544 - RNA, 17 nt, Mycobacterium avium subsp. paratuberculosis
gccggcggcggccagcg

SEQ ID NO: 909545 - RNA, 19 nt, Mycobacterium avium subsp. paratuberculosis
gccggcggcggccagcgag

SEQ ID NO: 909546 - RNA, 23 nt, Mycobacterium avium subsp. paratuberculosis
gccggcggcggccagcgagucga

SEQ ID NO: 909547 - RNA, 11 nt, Mycobacterium avium subsp. paratuberculosis
gccggcggcgc

SEQ ID NO: 909548 - RNA, 15 nt, Mycobacterium avium subsp. paratuberculosis
gccggcggcgaugau

SEQ ID NO: 909549 - RNA, 14 nt, Mycobacterium avium subsp. paratuberculosis
gccggcggcgaagc

SEQ ID NO: 909550 - RNA, 19 nt, Mycobacterium avium subsp. paratuberculosis
gccggcggcgaagccggcc

SEQ ID NO: 909551 - RNA, 17 nt, Mycobacterium avium subsp. paratuberculosis
gccggcggcgaucgccg

SEQ ID NO: 909552 - RNA, 20 nt, Mycobacterium avium subsp. paratuberculosis
gccggcggcgaucgccgcga

SEQ ID NO: 909553 - RNA, 13 nt, Mycobacterium avium subsp. paratuberculosis
gccggcggccgac

SEQ ID NO: 909554 - RNA, 13 nt, Mycobacterium avium subsp. paratuberculosis
gccggcggccgcc

SEQ ID NO: 909555 - RNA, 16 nt, Mycobacterium avium subsp. paratuberculosis
gccggcggccgccacg

SEQ ID NO: 909556 - RNA, 15 nt, Mycobacterium avium subsp. paratuberculosis
gccggcggccgccgc

SEQ ID NO: 909557 - RNA, 17 nt, Mycobacterium avium subsp. paratuberculosis
gccggcggccgccgccc

SEQ ID NO: 909558 - RNA, 23 nt, Mycobacterium avium subsp. paratuberculosis
gccggcggccgccgcccgcgcgg

SEQ ID NO: 909559 - RNA, 17 nt, Mycobacterium avium subsp. paratuberculosis
gccggcggccgccggca

SEQ ID NO: 909560 - RNA, 18 nt, Mycobacterium avium subsp. paratuberculosis
gccggcggccgccggcac

SEQ ID NO: 909561 - RNA, 14 nt, Mycobacterium avium subsp. paratuberculosis
gccggcggccgcga

SEQ ID NO: 909562 - RNA, 16 nt, Mycobacterium avium subsp. paratuberculosis
gccggcggccgcgacg

SEQ ID NO: 909563 - RNA, 14 nt, Mycobacterium avium subsp. paratuberculosis
gccggcggccaugg

SEQ ID NO: 909564 - RNA, 23 nt, Mycobacterium avium subsp. paratuberculosis
gccggcggccauggucgcggccg

SEQ ID NO: 909565 - RNA, 13 nt, Mycobacterium avium subsp. paratuberculosis
gccggcggccacg

SEQ ID NO: 909566 - RNA, 15 nt, Mycobacterium avium subsp. paratuberculosis
gccggcggccacgau

SEQ ID NO: 909567 - RNA, 21 nt, Mycobacterium avium subsp. paratuberculosis
gccggcggccacgaucgcggc

SEQ ID NO: 909568 - RNA, 16 nt, Mycobacterium avium subsp. paratuberculosis
gccggcggccagcauc

SEQ ID NO: 909569 - RNA, 19 nt, Mycobacterium avium subsp. paratuberculosis
gccggcggccagcaucgga

SEQ ID NO: 909570 - RNA, 12 nt, Mycobacterium avium subsp. paratuberculosis
gccggcggccaa

SEQ ID NO: 909571 - RNA, 20 nt, Mycobacterium avium subsp. paratuberculosis
gccggcggccaaucccacca

SEQ ID NO: 909572 - RNA, 17 nt, Mycobacterium avium subsp. paratuberculosis
gccggcggacagccccg

SEQ ID NO: 909573 - RNA, 18 nt, Mycobacterium avium subsp. paratuberculosis
gccggcggacagccccga

SEQ ID NO: 909574 - RNA, 14 nt, Mycobacterium avium subsp. paratuberculosis
gccggcggaucgcg

SEQ ID NO: 909575 - RNA, 14 nt, Mycobacterium avium subsp. paratuberculosis
gccggcggcaggug

SEQ ID NO: 909576 - RNA, 19 nt, Mycobacterium avium subsp. paratuberculosis
gccggcggcaguccggcga

SEQ ID NO: 909577 - RNA, 17 nt, Mycobacterium avium subsp. paratuberculosis
gccggcggcagugcgcc

SEQ ID NO: 909578 - RNA, 20 nt, Mycobacterium avium subsp. paratuberculosis
gccggcggcagugcgccguc

SEQ ID NO: 909579 - RNA, 20 nt, Mycobacterium avium subsp. paratuberculosis
gccggcgcuucugcgccggu

SEQ ID NO: 909580 - RNA, 14 nt, Mycobacterium avium subsp. paratuberculosis
gccggcggacgcgg

SEQ ID NO: 909581 - RNA, 19 nt, Mycobacterium avium subsp. paratuberculosis
gccggcggacgcggccagc

SEQ ID NO: 909582 - RNA, 18 nt, Mycobacterium avium subsp. paratuberculosis
gccggcgcuggcgcgccg

SEQ ID NO: 909583 - RNA, 15 nt, Mycobacterium avium subsp. paratuberculosis
gccggcgcucgucgu

SEQ ID NO: 909584 - RNA, 17 nt, Mycobacterium avium subsp. paratuberculosis
gccggcgcucgucgucg

SEQ ID NO: 909585 - RNA, 18 nt, Mycobacterium avium subsp. paratuberculosis
gccggcgcucgucgucgc

SEQ ID NO: 909586 - RNA, 22 nt, Mycobacterium avium subsp. paratuberculosis
gccggcgcucgucgucgccgau

SEQ ID NO: 909587 - RNA, 23 nt, Mycobacterium avium subsp. paratuberculosis
gccggcgcucgucgucgccgaug

SEQ ID NO: 909588 - RNA, 16 nt, Mycobacterium avium subsp. paratuberculosis
gccggcgcgugcgcga

SEQ ID NO: 909589 - RNA, 18 nt, Mycobacterium avium subsp. paratuberculosis
gccggcgcgugcgcgacg

SEQ ID NO: 909590 - RNA, 16 nt, Mycobacterium avium subsp. paratuberculosis
gccggcgcggugggcg

SEQ ID NO: 909591 - RNA, 20 nt, Mycobacterium avium subsp. paratuberculosis
gccggcgcguccggaggugc

SEQ ID NO: 909592 - RNA, 22 nt, Mycobacterium avium subsp. paratuberculosis
gccggcgcguccggaggugccg

SEQ ID NO: 909593 - RNA, 21 nt, Mycobacterium avium subsp. paratuberculosis
gccggcgcgggccgcagcgcg

SEQ ID NO: 909594 - RNA, 22 nt, Mycobacterium avium subsp. paratuberculosis
gccggcgcgggccgcagcgcgc

SEQ ID NO: 909595 - RNA, 18 nt, Mycobacterium avium subsp. paratuberculosis
gccggcgcgggggcggcc

SEQ ID NO: 909596 - RNA, 19 nt, Mycobacterium avium subsp. paratuberculosis
gccggcgcgggggcggccu

SEQ ID NO: 909597 - RNA, 21 nt, Mycobacterium avium subsp. paratuberculosis
gccggcgcgggggcggccuga

SEQ ID NO: 909598 - RNA, 12 nt, Mycobacterium avium subsp. paratuberculosis
gccggcgcggug

SEQ ID NO: 909599 - RNA, 16 nt, Mycobacterium avium subsp. paratuberculosis
gccggcgcggugcucg

SEQ ID NO: 909600 - RNA, 17 nt, Mycobacterium avium subsp. paratuberculosis
gccggcgcggugcucgg

SEQ ID NO: 909601 - RNA, 13 nt, Mycobacterium avium subsp. paratuberculosis
gccggcgcggugg

SEQ ID NO: 909602 - RNA, 17 nt, Mycobacterium avium subsp. paratuberculosis
gccggcgcgcgagcguc

SEQ ID NO: 909603 - RNA, 15 nt, Mycobacterium avium subsp. paratuberculosis
gccggcgcggcggcg

SEQ ID NO: 909604 - RNA, 21 nt, Mycobacterium avium subsp. paratuberculosis
gccggcgcggcggcgacgucg

SEQ ID NO: 909605 - RNA, 18 nt, Mycobacterium avium subsp. paratuberculosis
gccggcgcgcugaagcgc

SEQ ID NO: 909606 - RNA, 20 nt, Mycobacterium avium subsp. paratuberculosis
gccggcgcgcugaagcgcga

SEQ ID NO: 909607 - RNA, 22 nt, Mycobacterium avium subsp. paratuberculosis
gccggcgcgcugaagcgcgacc

SEQ ID NO: 909608 - RNA, 16 nt, Mycobacterium avium subsp. paratuberculosis
gccggcgcggccagcu

SEQ ID NO: 909609 - RNA, 17 nt, Mycobacterium avium subsp. paratuberculosis
gccggcgcgcaccccgg

SEQ ID NO: 909610 - RNA, 14 nt, Mycobacterium avium subsp. paratuberculosis
gccggcgcgcacgg

SEQ ID NO: 909611 - RNA, 15 nt, Mycobacterium avium subsp. paratuberculosis
gccggcgcgcagcgu

SEQ ID NO: 909612 - RNA, 21 nt, Mycobacterium avium subsp. paratuberculosis
gccggcgccggugccgcagcc

SEQ ID NO: 909613 - RNA, 13 nt, Mycobacterium avium subsp. paratuberculosis
gccggcgcgacca

SEQ ID NO: 909614 - RNA, 15 nt, Mycobacterium avium subsp. paratuberculosis
gccggcgcgaccagc

SEQ ID NO: 909615 - RNA, 16 nt, Mycobacterium avium subsp. paratuberculosis
gccggcgcgaccagcg

SEQ ID NO: 909616 - RNA, 17 nt, Mycobacterium avium subsp. paratuberculosis
gccggcgcgaccagcgg

SEQ ID NO: 909617 - RNA, 23 nt, Mycobacterium avium subsp. paratuberculosis
gcaucgggguuccaccguucggg

SEQ ID NO: 909618 - RNA, 17 nt, Mycobacterium avium subsp. paratuberculosis
gcaucggugagacgacc

SEQ ID NO: 909619 - RNA, 18 nt, Mycobacterium avium subsp. paratuberculosis
gcaucggugagacgaccc

SEQ ID NO: 909620 - RNA, 15 nt, Mycobacterium avium subsp. paratuberculosis
gcaucgggucguaga

SEQ ID NO: 909621 - RNA, 18 nt, Mycobacterium avium subsp. paratuberculosis
gcaucggguugccggcgg

SEQ ID NO: 909622 - RNA, 20 nt, Mycobacterium avium subsp. paratuberculosis
gcaucggguugccggcggcc

SEQ ID NO: 909623 - RNA, 15 nt, Mycobacterium avium subsp. paratuberculosis
gcaucgggcgcucgg

SEQ ID NO: 909624 - RNA, 21 nt, Mycobacterium avium subsp. paratuberculosis
gcaucgggcgcucggccagca

SEQ ID NO: 909625 - RNA, 15 nt, Mycobacterium avium subsp. paratuberculosis
gcaucggcucguagc

SEQ ID NO: 909626 - RNA, 16 nt, Mycobacterium avium subsp. paratuberculosis
gcaucggcuggucggc

SEQ ID NO: 909627 - RNA, 21 nt, Mycobacterium avium subsp. paratuberculosis
gcaucgguggcaccccgcgcc

SEQ ID NO: 909628 - RNA, 22 nt, Mycobacterium avium subsp. paratuberculosis
gcaucgguggcaccccgcgccg

SEQ ID NO: 909629 - RNA, 15 nt, Mycobacterium avium subsp. paratuberculosis
gcaucggcgacgccg

SEQ ID NO: 909630 - RNA, 17 nt, Mycobacterium avium subsp. paratuberculosis
gcaucggcgacgccgcc

SEQ ID NO: 909631 - RNA, 16 nt, Mycobacterium avium subsp. paratuberculosis
gcaucggcaguccgcg

SEQ ID NO: 909632 - RNA, 19 nt, Mycobacterium avium subsp. paratuberculosis
gcaucggcaguccgcgccg

SEQ ID NO: 909633 - RNA, 17 nt, Mycobacterium avium subsp. paratuberculosis
gcaucggcgccugcgag

SEQ ID NO: 909634 - RNA, 14 nt, Mycobacterium avium subsp. paratuberculosis
gcaucgcgggccac

SEQ ID NO: 909635 - RNA, 19 nt, Mycobacterium avium subsp. paratuberculosis
gcaucgcgggccaccggcg

SEQ ID NO: 909636 - RNA, 15 nt, Mycobacterium avium subsp. paratuberculosis
gcaucgcgugccgac

SEQ ID NO: 909637 - RNA, 16 nt, Mycobacterium avium subsp. paratuberculosis
gcaucgcugguggccg

SEQ ID NO: 909638 - RNA, 22 nt, Mycobacterium avium subsp. paratuberculosis
gcaucgcugguggccgacgugc

SEQ ID NO: 909639 - RNA, 18 nt, Mycobacterium avium subsp. paratuberculosis
gcaucggcagaucguugg

SEQ ID NO: 909640 - RNA, 20 nt, Mycobacterium avium subsp. paratuberculosis
gcaucggaugccggggcagc

SEQ ID NO: 909641 - RNA, 23 nt, Mycobacterium avium subsp. paratuberculosis
gcaucggaugccggggcagcacc

SEQ ID NO: 909642 - RNA, 15 nt, Mycobacterium avium subsp. paratuberculosis
gcaucuccagccgcg

SEQ ID NO: 909643 - RNA, 20 nt, Mycobacterium avium subsp. paratuberculosis
gcaucuccagccggcgaaug

SEQ ID NO: 909644 - RNA, 21 nt, Mycobacterium avium subsp. paratuberculosis
gcaucucgaaugcggcugccg

SEQ ID NO: 909645 - RNA, 19 nt, Mycobacterium avium subsp. paratuberculosis
gcaucucgacccgggccag

SEQ ID NO: 909646 - RNA, 14 nt, Mycobacterium avium subsp. paratuberculosis
gcaucucgaccugg

SEQ ID NO: 909647 - RNA, 18 nt, Mycobacterium avium subsp. paratuberculosis
gcaucucguugucgucgg

SEQ ID NO: 909648 - RNA, 17 nt, Mycobacterium avium subsp. paratuberculosis
gcaucucuugaugcagc

SEQ ID NO: 909649 - RNA, 21 nt, Mycobacterium avium subsp. paratuberculosis
gcaucucuugaugcagcgccu

SEQ ID NO: 909650 - RNA, 14 nt, Mycobacterium avium subsp. paratuberculosis
gcaucucggccgga

SEQ ID NO: 909651 - RNA, 16 nt, Mycobacterium avium subsp. paratuberculosis
gcaucguugccggcgg

SEQ ID NO: 909652 - RNA, 17 nt, Mycobacterium avium subsp. paratuberculosis
gcaucguugguccaggc

SEQ ID NO: 909653 - RNA, 18 nt, Mycobacterium avium subsp. paratuberculosis
gcaucguugguccaggcg

SEQ ID NO: 909654 - RNA, 23 nt, Mycobacterium avium subsp. paratuberculosis
gcaucguugguccaggcguucga

SEQ ID NO: 909655 - RNA, 22 nt, Mycobacterium avium subsp. paratuberculosis
gcaucguggcuuuggucgccag

SEQ ID NO: 909656 - RNA, 14 nt, Mycobacterium avium subsp. paratuberculosis
gcaucgucgcggcg

SEQ ID NO: 909657 - RNA, 17 nt, Mycobacterium avium subsp. paratuberculosis
gcaucgucgcggcgguc

SEQ ID NO: 909658 - RNA, 15 nt, Mycobacterium avium subsp. paratuberculosis
gcaucgucggcgccg

SEQ ID NO: 909659 - RNA, 17 nt, Mycobacterium avium subsp. paratuberculosis
gcaucgucggcgccggc

SEQ ID NO: 909660 - RNA, 14 nt, Mycobacterium avium subsp. paratuberculosis
gcaucuuggccacg

SEQ ID NO: 909661 - RNA, 20 nt, Mycobacterium avium subsp. paratuberculosis
gcaugaaccaggccgcgcug

SEQ ID NO: 909662 - RNA, 18 nt, Mycobacterium avium subsp. paratuberculosis
gcaugaccgauccgccgg

SEQ ID NO: 909663 - RNA, 21 nt, Mycobacterium avium subsp. paratuberculosis
gcaugaccgauccgccggcga

SEQ ID NO: 909664 - RNA, 21 nt, Mycobacterium avium subsp. paratuberculosis
gcaugaucaccgccagcgcgc

SEQ ID NO: 909665 - RNA, 15 nt, Mycobacterium avium subsp. paratuberculosis
gcaugacgcccagcu

SEQ ID NO: 909666 - RNA, 17 nt, Mycobacterium avium subsp. paratuberculosis
gcaugaugcggccauga

SEQ ID NO: 909667 - RNA, 19 nt, Mycobacterium avium subsp. paratuberculosis
gcaugaucgcccgcuccgc

SEQ ID NO: 909668 - RNA, 13 nt, Mycobacterium avium subsp. paratuberculosis
gcaugcaccggug

SEQ ID NO: 909669 - RNA, 19 nt, Mycobacterium avium subsp. paratuberculosis
gcaugcaccggugcaccgc

SEQ ID NO: 909670 - RNA, 15 nt, Mycobacterium avium subsp. paratuberculosis
gcaugcccgggcgac

SEQ ID NO: 909671 - RNA, 16 nt, Mycobacterium avium subsp. paratuberculosis
gcaugcccgggcgacu

SEQ ID NO: 909672 - RNA, 18 nt, Mycobacterium avium subsp. paratuberculosis
gcaugccguucagcgcgg

SEQ ID NO: 909673 - RNA, 20 nt, Mycobacterium avium subsp. paratuberculosis
gcaugccguucagcgcggcc

SEQ ID NO: 909674 - RNA, 15 nt, Mycobacterium avium subsp. paratuberculosis
gcaugccgucggcgc

SEQ ID NO: 909675 - RNA, 16 nt, Mycobacterium avium subsp. paratuberculosis
gcaugccgucggcgcc

SEQ ID NO: 909676 - RNA, 18 nt, Mycobacterium avium subsp. paratuberculosis
gcaugccgucggcgcccg

SEQ ID NO: 909677 - RNA, 22 nt, Mycobacterium avium subsp. paratuberculosis
gcaugccgucggcgcccggcac

SEQ ID NO: 909678 - RNA, 23 nt, Mycobacterium avium subsp. paratuberculosis
gcaugccgucggcgcccggcacc

SEQ ID NO: 909679 - RNA, 16 nt, Mycobacterium avium subsp. paratuberculosis
gcaugccggccggcac

SEQ ID NO: 909680 - RNA, 14 nt, Mycobacterium avium subsp. paratuberculosis
gcaugccgagcacc

SEQ ID NO: 909681 - RNA, 18 nt, Mycobacterium avium subsp. paratuberculosis
gcaugccgcccgggccgu

SEQ ID NO: 909682 - RNA, 13 nt, Mycobacterium avium subsp. paratuberculosis
gcaugcgccagag

SEQ ID NO: 909683 - RNA, 15 nt, Mycobacterium avium subsp. paratuberculosis
gcaugcgccagagcg

SEQ ID NO: 909684 - RNA, 13 nt, Mycobacterium avium subsp. paratuberculosis
gcaugccgggcag

SEQ ID NO: 909685 - RNA, 13 nt, Mycobacterium avium subsp. paratuberculosis
gcauggccggcga

SEQ ID NO: 909686 - RNA, 14 nt, Mycobacterium avium subsp. paratuberculosis
gcauggccggcgaa

SEQ ID NO: 909687 - RNA, 15 nt, Mycobacterium avium subsp. paratuberculosis
gcauggccggcgaac

SEQ ID NO: 909688 - RNA, 18 nt, Mycobacterium avium subsp. paratuberculosis
gcauggccggcgaaccgc

SEQ ID NO: 909689 - RNA, 22 nt, Mycobacterium avium subsp. paratuberculosis
gcauggccuugagaacgucgcg

SEQ ID NO: 909690 - RNA, 18 nt, Mycobacterium avium subsp. paratuberculosis
gcauggcgaacacgucgg

SEQ ID NO: 909691 - RNA, 23 nt, Mycobacterium avium subsp. paratuberculosis
gcauggcgaacacgucggccagc

SEQ ID NO: 909692 - RNA, 20 nt, Mycobacterium avium subsp. paratuberculosis
gcauggcgaugacgucgucg

SEQ ID NO: 909693 - RNA, 22 nt, Mycobacterium avium subsp. paratuberculosis
gcauggcgaugacgucgucgcg

SEQ ID NO: 909694 - RNA, 16 nt, Mycobacterium avium subsp. paratuberculosis
gcauggcgaucacccc

SEQ ID NO: 909695 - RNA, 18 nt, Mycobacterium avium subsp. paratuberculosis
gcauggcgaucaccccgg

SEQ ID NO: 909696 - RNA, 19 nt, Mycobacterium avium subsp. paratuberculosis
gcauggcgaucaccccggc

SEQ ID NO: 909697 - RNA, 22 nt, Mycobacterium avium subsp. paratuberculosis
gcauggcgaucaccccggcgac

SEQ ID NO: 909698 - RNA, 14 nt, Mycobacterium avium subsp. paratuberculosis
gcauggacagcgau

SEQ ID NO: 909699 - RNA, 18 nt, Mycobacterium avium subsp. paratuberculosis
gcauugcccaucgccacg

SEQ ID NO: 909700 - RNA, 12 nt, Mycobacterium avium subsp. paratuberculosis
gcauugcagcgg

SEQ ID NO: 909701 - RNA, 19 nt, Mycobacterium avium subsp. paratuberculosis
gcauucgccggggucgcgc

SEQ ID NO: 909702 - RNA, 16 nt, Mycobacterium avium subsp. paratuberculosis
gcauucggccgccacc

SEQ ID NO: 909703 - RNA, 17 nt, Mycobacterium avium subsp. paratuberculosis
gcauucggccgccaccg

SEQ ID NO: 909704 - RNA, 18 nt, Mycobacterium avium subsp. paratuberculosis
gcauucggccgccaccga

SEQ ID NO: 909705 - RNA, 18 nt, Mycobacterium avium subsp. paratuberculosis
gcauucaggucaccgcgc

SEQ ID NO: 909706 - RNA, 22 nt, Mycobacterium avium subsp. paratuberculosis
gcauuccgucuuggccaggccc

SEQ ID NO: 909707 - RNA, 14 nt, Mycobacterium avium subsp. paratuberculosis
gcauuccucggcca

SEQ ID NO: 909708 - RNA, 22 nt, Mycobacterium avium subsp. paratuberculosis
gcauguucaaucccguugcggu

SEQ ID NO: 909709 - RNA, 15 nt, Mycobacterium avium subsp. paratuberculosis
gcauguggccgucgc

SEQ ID NO: 909710 - RNA, 16 nt, Mycobacterium avium subsp. paratuberculosis
gcauguggccgucgcc

SEQ ID NO: 909711 - RNA, 13 nt, Mycobacterium avium subsp. paratuberculosis
gcaugugcucggc

SEQ ID NO: 909712 - RNA, 14 nt, Mycobacterium avium subsp. paratuberculosis
gcaugugcucggcg

SEQ ID NO: 909713 - RNA, 12 nt, Mycobacterium avium subsp. paratuberculosis
gcaugucgcccg

SEQ ID NO: 909714 - RNA, 14 nt, Mycobacterium avium subsp. paratuberculosis
gcaugucgccgaac

SEQ ID NO: 909715 - RNA, 22 nt, Mycobacterium avium subsp. paratuberculosis
gcaugucgccgaacgccaccac

SEQ ID NO: 909716 - RNA, 23 nt, Mycobacterium avium subsp. paratuberculosis
gcaugucgccgaacgccaccacc

SEQ ID NO: 909717 - RNA, 23 nt, Mycobacterium avium subsp. paratuberculosis
gcaugucgaccucggccaccacc

SEQ ID NO: 909718 - RNA, 21 nt, Mycobacterium avium subsp. paratuberculosis
gcauguccgccgucaucggcg

SEQ ID NO: 909719 - RNA, 18 nt, Mycobacterium avium subsp. paratuberculosis
gcauguccggggugagca

SEQ ID NO: 909720 - RNA, 14 nt, Mycobacterium avium subsp. paratuberculosis
gcauguagguggcg

SEQ ID NO: 909721 - RNA, 14 nt, Mycobacterium avium subsp. paratuberculosis
gcauggcuggcggc

SEQ ID NO: 909722 - RNA, 17 nt, Mycobacterium avium subsp. paratuberculosis
gcauggcuggcggcaac

SEQ ID NO: 909723 - RNA, 17 nt, Mycobacterium avium subsp. paratuberculosis
gcaugggaucagcagca

SEQ ID NO: 909724 - RNA, 19 nt, Mycobacterium avium subsp. paratuberculosis
gcaugggaucagcagcacc

SEQ ID NO: 909725 - RNA, 22 nt, Mycobacterium avium subsp. paratuberculosis
gcaugggaucagcagcaccggc

SEQ ID NO: 909726 - RNA, 15 nt, Mycobacterium avium subsp. paratuberculosis
gcauggucaccggag

SEQ ID NO: 909727 - RNA, 15 nt, Mycobacterium avium subsp. paratuberculosis
gccaaacagguuggc

SEQ ID NO: 909728 - RNA, 15 nt, Mycobacterium avium subsp. paratuberculosis
gcauuggcaccgucg

SEQ ID NO: 909729 - RNA, 16 nt, Mycobacterium avium subsp. paratuberculosis
gcauuggcagcucggg

SEQ ID NO: 909730 - RNA, 17 nt, Mycobacterium avium subsp. paratuberculosis
gcauuggcagcucgggc

SEQ ID NO: 909731 - RNA, 14 nt, Mycobacterium avium subsp. paratuberculosis
gcauuggcgauggc

SEQ ID NO: 909732 - RNA, 22 nt, Mycobacterium avium subsp. paratuberculosis
gcauuucggcguccucgacgcc

SEQ ID NO: 909733 - RNA, 14 nt, Mycobacterium avium subsp. paratuberculosis
gccaaaucgaucac

SEQ ID NO: 909734 - RNA, 22 nt, Mycobacterium avium subsp. paratuberculosis
gccaaaucgcuugcgccgcagc

SEQ ID NO: 909735 - RNA, 14 nt, Mycobacterium avium subsp. paratuberculosis
gccaacagugcgca

SEQ ID NO: 909736 - RNA, 18 nt, Mycobacterium avium subsp. paratuberculosis
gccaacagugcgcaggcg

SEQ ID NO: 909737 - RNA, 17 nt, Mycobacterium avium subsp. paratuberculosis
gccaaccaggucgcggc

SEQ ID NO: 909738 - RNA, 18 nt, Mycobacterium avium subsp. paratuberculosis
gccaaccaggucgcggcg

SEQ ID NO: 909739 - RNA, 19 nt, Mycobacterium avium subsp. paratuberculosis
gccaaccaggucgcggcgc

SEQ ID NO: 909740 - RNA, 20 nt, Mycobacterium avium subsp. paratuberculosis
gccaaccaggucgcggcgcu

SEQ ID NO: 909741 - RNA, 14 nt, Mycobacterium avium subsp. paratuberculosis
gccaacacggcggc

SEQ ID NO: 909742 - RNA, 15 nt, Mycobacterium avium subsp. paratuberculosis
gccaacacggcggcg

SEQ ID NO: 909743 - RNA, 19 nt, Mycobacterium avium subsp. paratuberculosis
gccaacacggcggcgcgca

SEQ ID NO: 909744 - RNA, 22 nt, Mycobacterium avium subsp. paratuberculosis
gccaacagcagcagaaccagca

SEQ ID NO: 909745 - RNA, 16 nt, Mycobacterium avium subsp. paratuberculosis
gccaacagcagcgccg

SEQ ID NO: 909746 - RNA, 22 nt, Mycobacterium avium subsp. paratuberculosis
gccaacagcagcgccgcggccg

SEQ ID NO: 909747 - RNA, 15 nt, Mycobacterium avium subsp. paratuberculosis
gccaacaacucgacg

SEQ ID NO: 909748 - RNA, 22 nt, Mycobacterium avium subsp. paratuberculosis
gccaacaccagggugucgauga

SEQ ID NO: 909749 - RNA, 16 nt, Mycobacterium avium subsp. paratuberculosis
gccaacgagcgcgccg

SEQ ID NO: 909750 - RNA, 18 nt, Mycobacterium avium subsp. paratuberculosis
gccaacgaggcacggccc

SEQ ID NO: 909751 - RNA, 19 nt, Mycobacterium avium subsp. paratuberculosis
gccaacgaggcacggcccg

SEQ ID NO: 909752 - RNA, 21 nt, Mycobacterium avium subsp. paratuberculosis
gccaacgaggcacggcccgcu

SEQ ID NO: 909753 - RNA, 23 nt, Mycobacterium avium subsp. paratuberculosis
gccaacgaggcacggcccgcucg

SEQ ID NO: 909754 - RNA, 23 nt, Mycobacterium avium subsp. paratuberculosis
gccaaccuguuuggcugucgcgc

SEQ ID NO: 909755 - RNA, 14 nt, Mycobacterium avium subsp. paratuberculosis
gccaacgagcgcgc

SEQ ID NO: 909756 - RNA, 14 nt, Mycobacterium avium subsp. paratuberculosis
gccaaccgcccggc

SEQ ID NO: 909757 - RNA, 15 nt, Mycobacterium avium subsp. paratuberculosis
gccaaccgcccggcg

SEQ ID NO: 909758 - RNA, 23 nt, Mycobacterium avium subsp. paratuberculosis
gccaaccgaggcaaucgagcggg

SEQ ID NO: 909759 - RNA, 14 nt, Mycobacterium avium subsp. paratuberculosis
gccaacccgggcgc

SEQ ID NO: 909760 - RNA, 15 nt, Mycobacterium avium subsp. paratuberculosis
gccaacccgggcgcc

SEQ ID NO: 909761 - RNA, 18 nt, Mycobacterium avium subsp. paratuberculosis
gcauacaccuugucggcg

SEQ ID NO: 909762 - RNA, 21 nt, Mycobacterium avium subsp. paratuberculosis
gcauacugcuugccgucgacg

SEQ ID NO: 909763 - RNA, 17 nt, Mycobacterium avium subsp. paratuberculosis
gcauagcgccgcucggc

SEQ ID NO: 909764 - RNA, 15 nt, Mycobacterium avium subsp. paratuberculosis
gcaguuuguccugcu

SEQ ID NO: 909765 - RNA, 16 nt, Mycobacterium avium subsp. paratuberculosis
gcagugcgcggcgucc

SEQ ID NO: 909766 - RNA, 15 nt, Mycobacterium avium subsp. paratuberculosis
gcaggugugcggcaa

SEQ ID NO: 909767 - RNA, 22 nt, Mycobacterium avium subsp. paratuberculosis
gcagguucaucaccacgaacuc

SEQ ID NO: 909768 - RNA, 16 nt, Mycobacterium avium subsp. paratuberculosis
gcagguggucggcgaa

SEQ ID NO: 909769 - RNA, 16 nt, Mycobacterium avium subsp. paratuberculosis
gcaggugcucgccggc

SEQ ID NO: 909770 - RNA, 17 nt, Mycobacterium avium subsp. paratuberculosis
gcaggugcucgccggcg

SEQ ID NO: 909771 - RNA, 21 nt, Mycobacterium avium subsp. paratuberculosis
gcaggugcucgccggcgcgga

SEQ ID NO: 909772 - RNA, 23 nt, Mycobacterium avium subsp. paratuberculosis
gcaggugcucgccggcgcggaac

SEQ ID NO: 909773 - RNA, 20 nt, Mycobacterium avium subsp. paratuberculosis
gcaggugcccgucggccucg

SEQ ID NO: 909774 - RNA, 15 nt, Mycobacterium avium subsp. paratuberculosis
gcaggugcgccgcuc

SEQ ID NO: 909775 - RNA, 18 nt, Mycobacterium avium subsp. paratuberculosis
gcaggugcgcggucagcg

SEQ ID NO: 909776 - RNA, 20 nt, Mycobacterium avium subsp. paratuberculosis
gcaggugcgcggucagcgcg

SEQ ID NO: 909777 - RNA, 12 nt, Mycobacterium avium subsp. paratuberculosis
gcaggugccggu

SEQ ID NO: 909778 - RNA, 21 nt, Mycobacterium avium subsp. paratuberculosis
gcaggugaucaaagccggugg

SEQ ID NO: 909779 - RNA, 22 nt, Mycobacterium avium subsp. paratuberculosis
gcaggugaucaaagccgguggc

SEQ ID NO: 909780 - RNA, 19 nt, Mycobacterium avium subsp. paratuberculosis
gcaggugaucuugcccagc

SEQ ID NO: 909781 - RNA, 21 nt, Mycobacterium avium subsp. paratuberculosis
gcaggugcaucgccaccgucg

SEQ ID NO: 909782 - RNA, 18 nt, Mycobacterium avium subsp. paratuberculosis
gcaggugcaucgaccggc

SEQ ID NO: 909783 - RNA, 19 nt, Mycobacterium avium subsp. paratuberculosis
gcaggugcaucgaccggcg

SEQ ID NO: 909784 - RNA, 20 nt, Mycobacterium avium subsp. paratuberculosis
gcaggugaugcggcccgacc

SEQ ID NO: 909785 - RNA, 15 nt, Mycobacterium avium subsp. paratuberculosis
gcaggugcaccaccc

SEQ ID NO: 909786 - RNA, 15 nt, Mycobacterium avium subsp. paratuberculosis
gcaggugagccgggu

SEQ ID NO: 909787 - RNA, 20 nt, Mycobacterium avium subsp. paratuberculosis
gcaggugagccgggugcccg

SEQ ID NO: 909788 - RNA, 19 nt, Mycobacterium avium subsp. paratuberculosis
gcagguugauccggauccg

SEQ ID NO: 909789 - RNA, 20 nt, Mycobacterium avium subsp. paratuberculosis
gcagguucgacacgccccga

SEQ ID NO: 909790 - RNA, 18 nt, Mycobacterium avium subsp. paratuberculosis
gcagugcacgacgaccgc

SEQ ID NO: 909791 - RNA, 20 nt, Mycobacterium avium subsp. paratuberculosis
gcagugcacgacgaccgcgu

SEQ ID NO: 909792 - RNA, 12 nt, Mycobacterium avium subsp. paratuberculosis
gcagugcaucgc

SEQ ID NO: 909793 - RNA, 20 nt, Mycobacterium avium subsp. paratuberculosis
gcagugccaacacggcggcg

SEQ ID NO: 909794 - RNA, 21 nt, Mycobacterium avium subsp. paratuberculosis
gcagugccaacacggcggcgc

SEQ ID NO: 909795 - RNA, 20 nt, Mycobacterium avium subsp. paratuberculosis
gcagugccaccaccacggcc

SEQ ID NO: 909796 - RNA, 17 nt, Mycobacterium avium subsp. paratuberculosis
gcagugccccguccggc

SEQ ID NO: 909797 - RNA, 21 nt, Mycobacterium avium subsp. paratuberculosis
gcagugccccguccggcgcca

SEQ ID NO: 909798 - RNA, 13 nt, Mycobacterium avium subsp. paratuberculosis
gcagugccgcacc

SEQ ID NO: 909799 - RNA, 18 nt, Mycobacterium avium subsp. paratuberculosis
gcagugccggcgcaccgc

SEQ ID NO: 909800 - RNA, 21 nt, Mycobacterium avium subsp. paratuberculosis
gcaguucguccacgcuggcgg

SEQ ID NO: 909801 - RNA, 22 nt, Mycobacterium avium subsp. paratuberculosis
gcaguucguccacgcuggcggu

SEQ ID NO: 909802 - RNA, 13 nt, Mycobacterium avium subsp. paratuberculosis
gcagugcgcggcg

SEQ ID NO: 909803 - RNA, 15 nt, Mycobacterium avium subsp. paratuberculosis
gcagugcgaucgccg

SEQ ID NO: 909804 - RNA, 18 nt, Mycobacterium avium subsp. paratuberculosis
gcagugcgaucgccguga

SEQ ID NO: 909805 - RNA, 22 nt, Mycobacterium avium subsp. paratuberculosis
gcagugccggugcagcaccucg

SEQ ID NO: 909806 - RNA, 23 nt, Mycobacterium avium subsp. paratuberculosis
gcagugccggugcagcaccucga

SEQ ID NO: 909807 - RNA, 13 nt, Mycobacterium avium subsp. paratuberculosis
gcaucgccgucgu

SEQ ID NO: 909808 - RNA, 17 nt, Mycobacterium avium subsp. paratuberculosis
gcaucgccgucgucagc

SEQ ID NO: 909809 - RNA, 20 nt, Mycobacterium avium subsp. paratuberculosis
gcaucgccgucgucagccgg

SEQ ID NO: 909810 - RNA, 13 nt, Mycobacterium avium subsp. paratuberculosis
gcaucgccucggc

SEQ ID NO: 909811 - RNA, 16 nt, Mycobacterium avium subsp. paratuberculosis
gcaucgccucggcggc

SEQ ID NO: 909812 - RNA, 20 nt, Mycobacterium avium subsp. paratuberculosis
gcaucgccucggcggccgcc

SEQ ID NO: 909813 - RNA, 23 nt, Mycobacterium avium subsp. paratuberculosis
gcaucgccucggcggccgcccgg

SEQ ID NO: 909814 - RNA, 13 nt, Mycobacterium avium subsp. paratuberculosis
gcaucgccgcggu

SEQ ID NO: 909815 - RNA, 14 nt, Mycobacterium avium subsp. paratuberculosis
gcaucgccgcggug

SEQ ID NO: 909816 - RNA, 19 nt, Mycobacterium avium subsp. paratuberculosis
gcaucgccgagcgcaucga

SEQ ID NO: 909817 - RNA, 20 nt, Mycobacterium avium subsp. paratuberculosis
gcaucgccgagcgcaucgac

SEQ ID NO: 909818 - RNA, 17 nt, Mycobacterium avium subsp. paratuberculosis
gcaucgccgagggcgac

SEQ ID NO: 909819 - RNA, 13 nt, Mycobacterium avium subsp. paratuberculosis
gcaucgccgcgac

SEQ ID NO: 909820 - RNA, 16 nt, Mycobacterium avium subsp. paratuberculosis
gcaucgccgcgacccg

SEQ ID NO: 909821 - RNA, 20 nt, Mycobacterium avium subsp. paratuberculosis
gcaucgcgccgcaugaugcg

SEQ ID NO: 909822 - RNA, 14 nt, Mycobacterium avium subsp. paratuberculosis
gcaucgcgcgcggc

SEQ ID NO: 909823 - RNA, 20 nt, Mycobacterium avium subsp. paratuberculosis
gcaucgcgcgcggcgacggu

SEQ ID NO: 909824 - RNA, 14 nt, Mycobacterium avium subsp. paratuberculosis
gcaucgccggcgau

SEQ ID NO: 909825 - RNA, 16 nt, Mycobacterium avium subsp. paratuberculosis
gcaucgccggcgcgcu

SEQ ID NO: 909826 - RNA, 15 nt, Mycobacterium avium subsp. paratuberculosis
gcaucgccaaggcgc

SEQ ID NO: 909827 - RNA, 13 nt, Mycobacterium avium subsp. paratuberculosis
gcaucgccgaacc

SEQ ID NO: 909828 - RNA, 16 nt, Mycobacterium avium subsp. paratuberculosis
gcaucgccaccgucgu

SEQ ID NO: 909829 - RNA, 19 nt, Mycobacterium avium subsp. paratuberculosis
gcaucgccaccgucgucga

SEQ ID NO: 909830 - RNA, 13 nt, Mycobacterium avium subsp. paratuberculosis
gcaucgccagcac

SEQ ID NO: 909831 - RNA, 14 nt, Mycobacterium avium subsp. paratuberculosis
gcaucgaugccggc

SEQ ID NO: 909832 - RNA, 17 nt, Mycobacterium avium subsp. paratuberculosis
gcaucgaugccggcaac

SEQ ID NO: 909833 - RNA, 20 nt, Mycobacterium avium subsp. paratuberculosis
gcaucgaugccggcaaccgc

SEQ ID NO: 909834 - RNA, 14 nt, Mycobacterium avium subsp. paratuberculosis
gcaucgacugcgac

SEQ ID NO: 909835 - RNA, 21 nt, Mycobacterium avium subsp. paratuberculosis
gcaucgacugcgacacccgcu

SEQ ID NO: 909836 - RNA, 17 nt, Mycobacterium avium subsp. paratuberculosis
gcaucccgccgaacccg

SEQ ID NO: 909837 - RNA, 18 nt, Mycobacterium avium subsp. paratuberculosis
gcaucgagaugcugugga

SEQ ID NO: 909838 - RNA, 19 nt, Mycobacterium avium subsp. paratuberculosis
gcaucgagcugcaacgcgu

SEQ ID NO: 909839 - RNA, 22 nt, Mycobacterium avium subsp. paratuberculosis
gcaucgagcugcaacgcgucgg

SEQ ID NO: 909840 - RNA, 16 nt, Mycobacterium avium subsp. paratuberculosis
gcaucgaggaccggcg

SEQ ID NO: 909841 - RNA, 17 nt, Mycobacterium avium subsp. paratuberculosis
gcaucgaggaccggcgc

SEQ ID NO: 909842 - RNA, 18 nt, Mycobacterium avium subsp. paratuberculosis
gcaucgaggaccggcgcc

SEQ ID NO: 909843 - RNA, 19 nt, Mycobacterium avium subsp. paratuberculosis
gcaucgaggaccggcgccg

SEQ ID NO: 909844 - RNA, 22 nt, Mycobacterium avium subsp. paratuberculosis
gcaucgaggaccggcgccggcc

SEQ ID NO: 909845 - RNA, 13 nt, Mycobacterium avium subsp. paratuberculosis
gcauccgcaccga

SEQ ID NO: 909846 - RNA, 15 nt, Mycobacterium avium subsp. paratuberculosis
gcauccgcaccgaga

SEQ ID NO: 909847 - RNA, 16 nt, Mycobacterium avium subsp. paratuberculosis
gcauccgcagcaccag

SEQ ID NO: 909848 - RNA, 20 nt, Mycobacterium avium subsp. paratuberculosis
gcauccgcagcaccaggguc

SEQ ID NO: 909849 - RNA, 20 nt, Mycobacterium avium subsp. paratuberculosis
gcaucccuuccugggacagc

SEQ ID NO: 909850 - RNA, 15 nt, Mycobacterium avium subsp. paratuberculosis
gcauccgccgggcgg

SEQ ID NO: 909851 - RNA, 19 nt, Mycobacterium avium subsp. paratuberculosis
gcauccgccgggcggcguc

SEQ ID NO: 909852 - RNA, 12 nt, Mycobacterium avium subsp. paratuberculosis
gcauccgcgagc

SEQ ID NO: 909853 - RNA, 23 nt, Mycobacterium avium subsp. paratuberculosis
gcauccgcgagccgagccggucc

SEQ ID NO: 909854 - RNA, 20 nt, Mycobacterium avium subsp. paratuberculosis
gcauccccuuggugcggucg

SEQ ID NO: 909855 - RNA, 23 nt, Mycobacterium avium subsp. paratuberculosis
gcauccgcccguagaugcggccc

SEQ ID NO: 909856 - RNA, 12 nt, Mycobacterium avium subsp. paratuberculosis
gcauccgccgac

SEQ ID NO: 909857 - RNA, 15 nt, Mycobacterium avium subsp. paratuberculosis
gcauccgcucgccgc

SEQ ID NO: 909858 - RNA, 12 nt, Mycobacterium avium subsp. paratuberculosis
gcauccgcuggu

SEQ ID NO: 909859 - RNA, 19 nt, Mycobacterium avium subsp. paratuberculosis
gcauccgcuggugcgcgcc

SEQ ID NO: 909860 - RNA, 20 nt, Mycobacterium avium subsp. paratuberculosis
gcauccgcuggugcgcgccg

SEQ ID NO: 909861 - RNA, 23 nt, Mycobacterium avium subsp. paratuberculosis
gcauccgcuggugcgcgccggcg

SEQ ID NO: 909862 - RNA, 14 nt, Mycobacterium avium subsp. paratuberculosis
gcauccggaaccgg

SEQ ID NO: 909863 - RNA, 21 nt, Mycobacterium avium subsp. paratuberculosis
gcauccggaaccgggcacccg

SEQ ID NO: 909864 - RNA, 23 nt, Mycobacterium avium subsp. paratuberculosis
gcauccggaaccgggcacccggc

SEQ ID NO: 909865 - RNA, 23 nt, Mycobacterium avium subsp. paratuberculosis
gcaucaccgaggucaccgcgacc

SEQ ID NO: 909866 - RNA, 20 nt, Mycobacterium avium subsp. paratuberculosis
gcaucaccgccuuccgccac

SEQ ID NO: 909867 - RNA, 15 nt, Mycobacterium avium subsp. paratuberculosis
gcaucacccggcgcg

SEQ ID NO: 909868 - RNA, 16 nt, Mycobacterium avium subsp. paratuberculosis
gcaucacgucggcgag

SEQ ID NO: 909869 - RNA, 21 nt, Mycobacterium avium subsp. paratuberculosis
gcaucaccuucugcgcgccgu

SEQ ID NO: 909870 - RNA, 20 nt, Mycobacterium avium subsp. paratuberculosis
gcaucaccuucugcgucggc

SEQ ID NO: 909871 - RNA, 16 nt, Mycobacterium avium subsp. paratuberculosis
gcauaggccagcacca

SEQ ID NO: 909872 - RNA, 16 nt, Mycobacterium avium subsp. paratuberculosis
gcauagcuggcgccga

SEQ ID NO: 909873 - RNA, 18 nt, Mycobacterium avium subsp. paratuberculosis
gcauagcgggagccggcc

SEQ ID NO: 909874 - RNA, 17 nt, Mycobacterium avium subsp. paratuberculosis
gcaucaacugcaccagc

SEQ ID NO: 909875 - RNA, 18 nt, Mycobacterium avium subsp. paratuberculosis
gcaucaacugcaccagcg

SEQ ID NO: 909876 - RNA, 16 nt, Mycobacterium avium subsp. paratuberculosis
gcaucaauuacaacug

SEQ ID NO: 909877 - RNA, 12 nt, Mycobacterium avium subsp. paratuberculosis
gcaggguggcca

SEQ ID NO: 909878 - RNA, 13 nt, Mycobacterium avium subsp. paratuberculosis
gcagggcgccgac

SEQ ID NO: 909879 - RNA, 17 nt, Mycobacterium avium subsp. paratuberculosis
gcaggguuuucacgucg

SEQ ID NO: 909880 - RNA, 18 nt, Mycobacterium avium subsp. paratuberculosis
gcagguaaaccagcagcg

SEQ ID NO: 909881 - RNA, 23 nt, Mycobacterium avium subsp. paratuberculosis
gcaggguuuccucgagcaucucg

SEQ ID NO: 909882 - RNA, 20 nt, Mycobacterium avium subsp. paratuberculosis
gcaggguggccagcaccgcg

SEQ ID NO: 909883 - RNA, 15 nt, Mycobacterium avium subsp. paratuberculosis
gcagggcggccggcc

SEQ ID NO: 909884 - RNA, 14 nt, Mycobacterium avium subsp. paratuberculosis
gcagggcggccggc

SEQ ID NO: 909885 - RNA, 17 nt, Mycobacterium avium subsp. paratuberculosis
gcagggcggaaucgcgg

SEQ ID NO: 909886 - RNA, 19 nt, Mycobacterium avium subsp. paratuberculosis
gcagggcggcaccgaucgg

SEQ ID NO: 909887 - RNA, 20 nt, Mycobacterium avium subsp. paratuberculosis
gcagggcggcaccgaucggc

SEQ ID NO: 909888 - RNA, 21 nt, Mycobacterium avium subsp. paratuberculosis
gcagggcggcaccgaucggca

SEQ ID NO: 909889 - RNA, 15 nt, Mycobacterium avium subsp. paratuberculosis
gcagggcgccgguga

SEQ ID NO: 909890 - RNA, 23 nt, Mycobacterium avium subsp. paratuberculosis
gcagggcgcgcaucugcucggcg

SEQ ID NO: 909891 - RNA, 17 nt, Mycobacterium avium subsp. paratuberculosis
gcaggcguggcccagcc

SEQ ID NO: 909892 - RNA, 19 nt, Mycobacterium avium subsp. paratuberculosis
gcaggcguggcccagccgg

SEQ ID NO: 909893 - RNA, 22 nt, Mycobacterium avium subsp. paratuberculosis
gcaggcguccagggccaccgcg

SEQ ID NO: 909894 - RNA, 21 nt, Mycobacterium avium subsp. paratuberculosis
gcaggcguccuugauccgggc

SEQ ID NO: 909895 - RNA, 22 nt, Mycobacterium avium subsp. paratuberculosis
gcaggcguccuugauccgggcg

SEQ ID NO: 909896 - RNA, 17 nt, Mycobacterium avium subsp. paratuberculosis
gcaggcugaucucggcg

SEQ ID NO: 909897 - RNA, 17 nt, Mycobacterium avium subsp. paratuberculosis
gcaggcucagcagcacc

SEQ ID NO: 909898 - RNA, 21 nt, Mycobacterium avium subsp. paratuberculosis
gcaggcucagguaggcgcggg

SEQ ID NO: 909899 - RNA, 14 nt, Mycobacterium avium subsp. paratuberculosis
gcaggcugacgcga

SEQ ID NO: 909900 - RNA, 16 nt, Mycobacterium avium subsp. paratuberculosis
gcaggcugacgcgacc

SEQ ID NO: 909901 - RNA, 20 nt, Mycobacterium avium subsp. paratuberculosis
gcaggcugacgcgaccgcgc

SEQ ID NO: 909902 - RNA, 21 nt, Mycobacterium avium subsp. paratuberculosis
gcaggcugacgcgaccgcgcg

SEQ ID NO: 909903 - RNA, 16 nt, Mycobacterium avium subsp. paratuberculosis
gcaggucgggccggcc

SEQ ID NO: 909904 - RNA, 17 nt, Mycobacterium avium subsp. paratuberculosis
gcaggucgggccggccg

SEQ ID NO: 909905 - RNA, 16 nt, Mycobacterium avium subsp. paratuberculosis
gcaggucggcgggagc

SEQ ID NO: 909906 - RNA, 21 nt, Mycobacterium avium subsp. paratuberculosis
gcaggucggcgggagccggcg

SEQ ID NO: 909907 - RNA, 16 nt, Mycobacterium avium subsp. paratuberculosis
gcaggucgucgacguc

SEQ ID NO: 909908 - RNA, 17 nt, Mycobacterium avium subsp. paratuberculosis
gcaggucgucgacgucg

SEQ ID NO: 909909 - RNA, 16 nt, Mycobacterium avium subsp. paratuberculosis
gcaggucgucgucgcc

SEQ ID NO: 909910 - RNA, 21 nt, Mycobacterium avium subsp. paratuberculosis
gcaggucgucgucgccgcgcg

SEQ ID NO: 909911 - RNA, 17 nt, Mycobacterium avium subsp. paratuberculosis
gcaggucggugcgcggg

SEQ ID NO: 909912 - RNA, 21 nt, Mycobacterium avium subsp. paratuberculosis
gcaggucguaguaggcgccga

SEQ ID NO: 909913 - RNA, 13 nt, Mycobacterium avium subsp. paratuberculosis
gcaggucggccag

SEQ ID NO: 909914 - RNA, 14 nt, Mycobacterium avium subsp. paratuberculosis
gcaggucggccagc

SEQ ID NO: 909915 - RNA, 12 nt, Mycobacterium avium subsp. paratuberculosis
gcaggucgcggu

SEQ ID NO: 909916 - RNA, 17 nt, Mycobacterium avium subsp. paratuberculosis
gcaggucgcggugggcg

SEQ ID NO: 909917 - RNA, 17 nt, Mycobacterium avium subsp. paratuberculosis
gcaggucggccagcgcc

SEQ ID NO: 909918 - RNA, 18 nt, Mycobacterium avium subsp. paratuberculosis
gcaggucggccagcgccg

SEQ ID NO: 909919 - RNA, 20 nt, Mycobacterium avium subsp. paratuberculosis
gcaggucggccagcgccgcc

SEQ ID NO: 909920 - RNA, 23 nt, Mycobacterium avium subsp. paratuberculosis
gcaggucggccagcgccgcccgg

SEQ ID NO: 909921 - RNA, 16 nt, Mycobacterium avium subsp. paratuberculosis
gcaggucggccagcug

SEQ ID NO: 909922 - RNA, 18 nt, Mycobacterium avium subsp. paratuberculosis
gcaggucggccagcugcg

SEQ ID NO: 909923 - RNA, 22 nt, Mycobacterium avium subsp. paratuberculosis
gcaggucggccagcugcggguu

SEQ ID NO: 909924 - RNA, 15 nt, Mycobacterium avium subsp. paratuberculosis
gcaggucgcgccgga

SEQ ID NO: 909925 - RNA, 17 nt, Mycobacterium avium subsp. paratuberculosis
gcaggucgcgccggagc

SEQ ID NO: 909926 - RNA, 17 nt, Mycobacterium avium subsp. paratuberculosis
gcagguccuguccgguc

SEQ ID NO: 909927 - RNA, 18 nt, Mycobacterium avium subsp. paratuberculosis
gcaggucgaaggcggccg

SEQ ID NO: 909928 - RNA, 18 nt, Mycobacterium avium subsp. paratuberculosis
gcagguccggcagcgcgc

SEQ ID NO: 909929 - RNA, 21 nt, Mycobacterium avium subsp. paratuberculosis
gcaggucgagcaugcguccgg

SEQ ID NO: 909930 - RNA, 22 nt, Mycobacterium avium subsp. paratuberculosis
gcaggucgaggccggccagcgg

SEQ ID NO: 909931 - RNA, 13 nt, Mycobacterium avium subsp. paratuberculosis
gcagguccguggu

SEQ ID NO: 909932 - RNA, 15 nt, Mycobacterium avium subsp. paratuberculosis
gcagguccucgaucg

SEQ ID NO: 909933 - RNA, 23 nt, Mycobacterium avium subsp. paratuberculosis
gcagguccucggacucgucgcug

SEQ ID NO: 909934 - RNA, 20 nt, Mycobacterium avium subsp. paratuberculosis
gcagguccauggccuugacg

SEQ ID NO: 909935 - RNA, 14 nt, Mycobacterium avium subsp. paratuberculosis
gcaggucccaggcc

SEQ ID NO: 909936 - RNA, 15 nt, Mycobacterium avium subsp. paratuberculosis
gcagguccacccgcc

SEQ ID NO: 909937 - RNA, 22 nt, Mycobacterium avium subsp. paratuberculosis
gcagguccacccgccccgccgc

SEQ ID NO: 909938 - RNA, 23 nt, Mycobacterium avium subsp. paratuberculosis
gcagguccacccgccccgccgcg

SEQ ID NO: 909939 - RNA, 13 nt, Mycobacterium avium subsp. paratuberculosis
gcagguccgccgg

SEQ ID NO: 909940 - RNA, 16 nt, Mycobacterium avium subsp. paratuberculosis
gcagguccgccggugc

SEQ ID NO: 909941 - RNA, 20 nt, Mycobacterium avium subsp. paratuberculosis
gcagguccgccggugccagc

SEQ ID NO: 909942 - RNA, 22 nt, Mycobacterium avium subsp. paratuberculosis
gcagguccaggaucacgcggcg

SEQ ID NO: 909943 - RNA, 15 nt, Mycobacterium avium subsp. paratuberculosis
gcaggucagccaggu

SEQ ID NO: 909944 - RNA, 20 nt, Mycobacterium avium subsp. paratuberculosis
gcaggucacccuccucgcgg

SEQ ID NO: 909945 - RNA, 23 nt, Mycobacterium avium subsp. paratuberculosis
gcaggucaccggaugcacgugca

SEQ ID NO: 909946 - RNA, 16 nt, Mycobacterium avium subsp. paratuberculosis
gcagguagaagccgcg

SEQ ID NO: 909947 - RNA, 18 nt, Mycobacterium avium subsp. paratuberculosis
gcagguagaagccgcgac

SEQ ID NO: 909948 - RNA, 17 nt, Mycobacterium avium subsp. paratuberculosis
gcagguagaucgccagc

SEQ ID NO: 909949 - RNA, 15 nt, Mycobacterium avium subsp. paratuberculosis
gcagguagguggcca

SEQ ID NO: 909950 - RNA, 20 nt, Mycobacterium avium subsp. paratuberculosis
gcagguagguggccagccgg

SEQ ID NO: 909951 - RNA, 21 nt, Mycobacterium avium subsp. paratuberculosis
gcagguagguggccagccggg

SEQ ID NO: 909952 - RNA, 13 nt, Mycobacterium avium subsp. paratuberculosis
gcaggccggcagc

SEQ ID NO: 909953 - RNA, 14 nt, Mycobacterium avium subsp. paratuberculosis
gcaggccggcagcc

SEQ ID NO: 909954 - RNA, 18 nt, Mycobacterium avium subsp. paratuberculosis
gcaggccggcagccggcg

SEQ ID NO: 909955 - RNA, 22 nt, Mycobacterium avium subsp. paratuberculosis
gcaggccggcagccggcgcggu

SEQ ID NO: 909956 - RNA, 14 nt, Mycobacterium avium subsp. paratuberculosis
gcaggccgcggccg

SEQ ID NO: 909957 - RNA, 15 nt, Mycobacterium avium subsp. paratuberculosis
gcaggccgcggccgu

SEQ ID NO: 909958 - RNA, 14 nt, Mycobacterium avium subsp. paratuberculosis
gcaggccgcgggug

SEQ ID NO: 909959 - RNA, 16 nt, Mycobacterium avium subsp. paratuberculosis
gcaggccgcggguggc

SEQ ID NO: 909960 - RNA, 20 nt, Mycobacterium avium subsp. paratuberculosis
gcaggccgcggguggcgcca

SEQ ID NO: 909961 - RNA, 13 nt, Mycobacterium avium subsp. paratuberculosis
gcaggcccugccc

SEQ ID NO: 909962 - RNA, 15 nt, Mycobacterium avium subsp. paratuberculosis
gcaggccgcccgacc

SEQ ID NO: 909963 - RNA, 14 nt, Mycobacterium avium subsp. paratuberculosis
gcaggccgcccggc

SEQ ID NO: 909964 - RNA, 20 nt, Mycobacterium avium subsp. paratuberculosis
gcaggccgccgacgacggcg

SEQ ID NO: 909965 - RNA, 18 nt, Mycobacterium avium subsp. paratuberculosis
gcaggccgaggcugucgg

SEQ ID NO: 909966 - RNA, 13 nt, Mycobacterium avium subsp. paratuberculosis
gcaggccgagccg

SEQ ID NO: 909967 - RNA, 19 nt, Mycobacterium avium subsp. paratuberculosis
gcaggccgagccgccggau

SEQ ID NO: 909968 - RNA, 20 nt, Mycobacterium avium subsp. paratuberculosis
gcaggccgaggccaacucgc

SEQ ID NO: 909969 - RNA, 17 nt, Mycobacterium avium subsp. paratuberculosis
gcaggcgcgcagcaggc

SEQ ID NO: 909970 - RNA, 17 nt, Mycobacterium avium subsp. paratuberculosis
gcaggcgcgcggccagc

SEQ ID NO: 909971 - RNA, 18 nt, Mycobacterium avium subsp. paratuberculosis
gcaggcgcgcggccagcc

SEQ ID NO: 909972 - RNA, 12 nt, Mycobacterium avium subsp. paratuberculosis
gcaggcgcgccg

SEQ ID NO: 909973 - RNA, 17 nt, Mycobacterium avium subsp. paratuberculosis
gcaggcgcgccgagcgc

SEQ ID NO: 909974 - RNA, 16 nt, Mycobacterium avium subsp. paratuberculosis
gcaggcgcccaggauc

SEQ ID NO: 909975 - RNA, 21 nt, Mycobacterium avium subsp. paratuberculosis
gcaggcgccccagcuccucgg

SEQ ID NO: 909976 - RNA, 13 nt, Mycobacterium avium subsp. paratuberculosis
gcaggccgucgcc

SEQ ID NO: 909977 - RNA, 14 nt, Mycobacterium avium subsp. paratuberculosis
gcaggccgucgccg

SEQ ID NO: 909978 - RNA, 16 nt, Mycobacterium avium subsp. paratuberculosis
gcaggccguccagcag

SEQ ID NO: 909979 - RNA, 17 nt, Mycobacterium avium subsp. paratuberculosis
gcaggccguccagcagc

SEQ ID NO: 909980 - RNA, 13 nt, Mycobacterium avium subsp. paratuberculosis
gcaggccgcgacg

SEQ ID NO: 909981 - RNA, 14 nt, Mycobacterium avium subsp. paratuberculosis
gcaggccgcgacgg

SEQ ID NO: 909982 - RNA, 13 nt, Mycobacterium avium subsp. paratuberculosis
gcaggccgcgagc

SEQ ID NO: 909983 - RNA, 17 nt, Mycobacterium avium subsp. paratuberculosis
gcaggccggucacccag

SEQ ID NO: 909984 - RNA, 15 nt, Mycobacterium avium subsp. paratuberculosis
gcaggcagcagcacc

SEQ ID NO: 909985 - RNA, 17 nt, Mycobacterium avium subsp. paratuberculosis
gcaggcaggccccucca

SEQ ID NO: 909986 - RNA, 15 nt, Mycobacterium avium subsp. paratuberculosis
gcaggcaggccggca

SEQ ID NO: 909987 - RNA, 17 nt, Mycobacterium avium subsp. paratuberculosis
gcaggcaggccggcagc

SEQ ID NO: 909988 - RNA, 20 nt, Mycobacterium avium subsp. paratuberculosis
gcaggccgaacaccgucauc

SEQ ID NO: 909989 - RNA, 16 nt, Mycobacterium avium subsp. paratuberculosis
gcaggccacgcccacg

SEQ ID NO: 909990 - RNA, 19 nt, Mycobacterium avium subsp. paratuberculosis
gcaggccacgcccacgccg

SEQ ID NO: 909991 - RNA, 18 nt, Mycobacterium avium subsp. paratuberculosis
gcaggcccucggccagcc

SEQ ID NO: 909992 - RNA, 16 nt, Mycobacterium avium subsp. paratuberculosis
gcagcgggccgaagac

SEQ ID NO: 909993 - RNA, 16 nt, Mycobacterium avium subsp. paratuberculosis
gcagcggcuccgagcg

SEQ ID NO: 909994 - RNA, 15 nt, Mycobacterium avium subsp. paratuberculosis
gcagcgggauuggcg

SEQ ID NO: 909995 - RNA, 17 nt, Mycobacterium avium subsp. paratuberculosis
gcagcgucgccagccgc

SEQ ID NO: 909996 - RNA, 18 nt, Mycobacterium avium subsp. paratuberculosis
gcagcgucgccagccgcc

SEQ ID NO: 909997 - RNA, 19 nt, Mycobacterium avium subsp. paratuberculosis
gcagcgucggguacaccga

SEQ ID NO: 909998 - RNA, 21 nt, Mycobacterium avium subsp. paratuberculosis
gcagcgucggguacaccgagc

SEQ ID NO: 909999 - RNA, 22 nt, Mycobacterium avium subsp. paratuberculosis
gcagcgucggguacaccgagcc

SEQ ID NO: 910000 - RNA, 16 nt, Mycobacterium avium subsp. paratuberculosis
gcagcgucugcgccag

SEQ ID NO: 910001 - RNA, 17 nt, Mycobacterium avium subsp. paratuberculosis
gcagcgucugcgccagc

SEQ ID NO: 910002 - RNA, 19 nt, Mycobacterium avium subsp. paratuberculosis
gcagcgucugcgccagcug

SEQ ID NO: 910003 - RNA, 17 nt, Mycobacterium avium subsp. paratuberculosis
gcagcgucugcgccccg

SEQ ID NO: 910004 - RNA, 23 nt, Mycobacterium avium subsp. paratuberculosis
gcagcgucuucuucucgccgucc

SEQ ID NO: 910005 - RNA, 17 nt, Mycobacterium avium subsp. paratuberculosis
gcagcgucuugcccagc

SEQ ID NO: 910006 - RNA, 19 nt, Mycobacterium avium subsp. paratuberculosis
gcagcgucuugcccagcgg

SEQ ID NO: 910007 - RNA, 23 nt, Mycobacterium avium subsp. paratuberculosis
gcagcgucuugcccagcggggcg

SEQ ID NO: 910008 - RNA, 21 nt, Mycobacterium avium subsp. paratuberculosis
gcagcgucuuggacgcccggu

SEQ ID NO: 910009 - RNA, 14 nt, Mycobacterium avium subsp. paratuberculosis
gcagcgucuccucg

SEQ ID NO: 910010 - RNA, 16 nt, Mycobacterium avium subsp. paratuberculosis
gcaggcacggugucga

SEQ ID NO: 910011 - RNA, 17 nt, Mycobacterium avium subsp. paratuberculosis
gcagcccaggcccagca

SEQ ID NO: 910012 - RNA, 22 nt, Mycobacterium avium subsp. paratuberculosis
gcagcccagguaaucgaaggcc

SEQ ID NO: 910013 - RNA, 15 nt, Mycobacterium avium subsp. paratuberculosis
gcagccccgcacuga

SEQ ID NO: 910014 - RNA, 14 nt, Mycobacterium avium subsp. paratuberculosis
gcagccccugcacc

SEQ ID NO: 910015 - RNA, 16 nt, Mycobacterium avium subsp. paratuberculosis
gcagcccgaacagccg

SEQ ID NO: 910016 - RNA, 19 nt, Mycobacterium avium subsp. paratuberculosis
gcagcccgaacagccgggc

SEQ ID NO: 910017 - RNA, 23 nt, Mycobacterium avium subsp. paratuberculosis
gcagcccgaccaccuccccgcgg

SEQ ID NO: 910018 - RNA, 14 nt, Mycobacterium avium subsp. paratuberculosis
gcagcccgagcggc

SEQ ID NO: 910019 - RNA, 19 nt, Mycobacterium avium subsp. paratuberculosis
gcagcccgaucacccccga

SEQ ID NO: 910020 - RNA, 18 nt, Mycobacterium avium subsp. paratuberculosis
gcagcccgaucgccagcg

SEQ ID NO: 910021 - RNA, 21 nt, Mycobacterium avium subsp. paratuberculosis
gcagcccgaucgccagcgccc

SEQ ID NO: 910022 - RNA, 23 nt, Mycobacterium avium subsp. paratuberculosis
gcagcccgaucgccagcgcccga

SEQ ID NO: 910023 - RNA, 19 nt, Mycobacterium avium subsp. paratuberculosis
gcagcagcguuccgucggc

SEQ ID NO: 910024 - RNA, 16 nt, Mycobacterium avium subsp. paratuberculosis
gcagcagcucggcgau

SEQ ID NO: 910025 - RNA, 23 nt, Mycobacterium avium subsp. paratuberculosis
gcagcagcugcgucggcaccagc

SEQ ID NO: 910026 - RNA, 14 nt, Mycobacterium avium subsp. paratuberculosis
gcagcagcuggaac

SEQ ID NO: 910027 - RNA, 15 nt, Mycobacterium avium subsp. paratuberculosis
gcagccgaucuggcg

SEQ ID NO: 910028 - RNA, 21 nt, Mycobacterium avium subsp. paratuberculosis
gcagccgaugucgucgaacgc

SEQ ID NO: 910029 - RNA, 22 nt, Mycobacterium avium subsp. paratuberculosis
gcagccgaugucgucgaacgcg

SEQ ID NO: 910030 - RNA, 14 nt, Mycobacterium avium subsp. paratuberculosis
gcagcccggcugcg

SEQ ID NO: 910031 - RNA, 18 nt, Mycobacterium avium subsp. paratuberculosis
gcagcccggcugcgcagc

SEQ ID NO: 910032 - RNA, 19 nt, Mycobacterium avium subsp. paratuberculosis
gcagcccggcugcgcagcg

SEQ ID NO: 910033 - RNA, 21 nt, Mycobacterium avium subsp. paratuberculosis
gcagcccgggcugcagcagcg

SEQ ID NO: 910034 - RNA, 22 nt, Mycobacterium avium subsp. paratuberculosis
gcagcccgguuuccaguccggc

SEQ ID NO: 910035 - RNA, 17 nt, Mycobacterium avium subsp. paratuberculosis
gcagcccgucccggccc

SEQ ID NO: 910036 - RNA, 15 nt, Mycobacterium avium subsp. paratuberculosis
gcagcccgucgaucc

SEQ ID NO: 910037 - RNA, 13 nt, Mycobacterium avium subsp. paratuberculosis
gcagcccggccag

SEQ ID NO: 910038 - RNA, 14 nt, Mycobacterium avium subsp. paratuberculosis
gcagcccggccagc

SEQ ID NO: 910039 - RNA, 18 nt, Mycobacterium avium subsp. paratuberculosis
gcagcccggccagccggg

SEQ ID NO: 910040 - RNA, 20 nt, Mycobacterium avium subsp. paratuberculosis
gcagcccggccagccgggcg

SEQ ID NO: 910041 - RNA, 20 nt, Mycobacterium avium subsp. paratuberculosis
gcagcccgcguccagcagca

SEQ ID NO: 910042 - RNA, 14 nt, Mycobacterium avium subsp. paratuberculosis
gcagcccgcugacc

SEQ ID NO: 910043 - RNA, 23 nt, Mycobacterium avium subsp. paratuberculosis
gcagcccggaggcgaugcggguc

SEQ ID NO: 910044 - RNA, 13 nt, Mycobacterium avium subsp. paratuberculosis
gcagcccgccgac

SEQ ID NO: 910045 - RNA, 14 nt, Mycobacterium avium subsp. paratuberculosis
gcagcccgccgcgg

SEQ ID NO: 910046 - RNA, 19 nt, Mycobacterium avium subsp. paratuberculosis
gcagccccgucggucccga

SEQ ID NO: 910047 - RNA, 13 nt, Mycobacterium avium subsp. paratuberculosis
gcagcccgccggg

SEQ ID NO: 910048 - RNA, 15 nt, Mycobacterium avium subsp. paratuberculosis
gcagccgcuuggccg

SEQ ID NO: 910049 - RNA, 19 nt, Mycobacterium avium subsp. paratuberculosis
gcagccgcuuggccgggcg

SEQ ID NO: 910050 - RNA, 13 nt, Mycobacterium avium subsp. paratuberculosis
gcagccggaucac

SEQ ID NO: 910051 - RNA, 20 nt, Mycobacterium avium subsp. paratuberculosis
gcagccggaucucgucgggc

SEQ ID NO: 910052 - RNA, 21 nt, Mycobacterium avium subsp. paratuberculosis
gcagccggaucucgucgggca

SEQ ID NO: 910053 - RNA, 21 nt, Mycobacterium avium subsp. paratuberculosis
gcagccggcaacucccgaucg

SEQ ID NO: 910054 - RNA, 15 nt, Mycobacterium avium subsp. paratuberculosis
gcagccgcucguagu

SEQ ID NO: 910055 - RNA, 14 nt, Mycobacterium avium subsp. paratuberculosis
gcagccgcugcagc

SEQ ID NO: 910056 - RNA, 15 nt, Mycobacterium avium subsp. paratuberculosis
gcagccgcugcagcg

SEQ ID NO: 910057 - RNA, 14 nt, Mycobacterium avium subsp. paratuberculosis
gcagccgcugcugg

SEQ ID NO: 910058 - RNA, 19 nt, Mycobacterium avium subsp. paratuberculosis
gcagccgcuggccgcgcca

SEQ ID NO: 910059 - RNA, 23 nt, Mycobacterium avium subsp. paratuberculosis
gcagccgcuggccgcgccacagc

SEQ ID NO: 910060 - RNA, 14 nt, Mycobacterium avium subsp. paratuberculosis
gcagccggccggcg

SEQ ID NO: 910061 - RNA, 21 nt, Mycobacterium avium subsp. paratuberculosis
gcagccggccguccacggcgg

SEQ ID NO: 910062 - RNA, 14 nt, Mycobacterium avium subsp. paratuberculosis
gcagccggccgacc

SEQ ID NO: 910063 - RNA, 13 nt, Mycobacterium avium subsp. paratuberculosis
gcagccggccacc

SEQ ID NO: 910064 - RNA, 17 nt, Mycobacterium avium subsp. paratuberculosis
gcagccggccaucucgg

SEQ ID NO: 910065 - RNA, 18 nt, Mycobacterium avium subsp. paratuberculosis
gcagccggccaucucggc

SEQ ID NO: 910066 - RNA, 19 nt, Mycobacterium avium subsp. paratuberculosis
gcagccggccaucucggcg

SEQ ID NO: 910067 - RNA, 21 nt, Mycobacterium avium subsp. paratuberculosis
gcagccuucuucgccggggcc

SEQ ID NO: 910068 - RNA, 20 nt, Mycobacterium avium subsp. paratuberculosis
gcagccuucuuggcgggcgc

SEQ ID NO: 910069 - RNA, 21 nt, Mycobacterium avium subsp. paratuberculosis
gcagccuucuuggcgggcgcc

SEQ ID NO: 910070 - RNA, 12 nt, Mycobacterium avium subsp. paratuberculosis
gcagccggggug

SEQ ID NO: 910071 - RNA, 21 nt, Mycobacterium avium subsp. paratuberculosis
gcagccggggugcccgggccg

SEQ ID NO: 910072 - RNA, 17 nt, Mycobacterium avium subsp. paratuberculosis
gcagccgggccagcaac

SEQ ID NO: 910073 - RNA, 15 nt, Mycobacterium avium subsp. paratuberculosis
gcagccggcgcggug

SEQ ID NO: 910074 - RNA, 14 nt, Mycobacterium avium subsp. paratuberculosis
gcagccggcguacu

SEQ ID NO: 910075 - RNA, 22 nt, Mycobacterium avium subsp. paratuberculosis
gcagccggcguacucgcacagc

SEQ ID NO: 910076 - RNA, 17 nt, Mycobacterium avium subsp. paratuberculosis
gcagccgggccugcggc

SEQ ID NO: 910077 - RNA, 19 nt, Mycobacterium avium subsp. paratuberculosis
gcagccgggccugcggcgc

SEQ ID NO: 910078 - RNA, 22 nt, Mycobacterium avium subsp. paratuberculosis
gcagccgggccugcggcgcggc

SEQ ID NO: 910079 - RNA, 17 nt, Mycobacterium avium subsp. paratuberculosis
gcagccgggcgaucauc

SEQ ID NO: 910080 - RNA, 14 nt, Mycobacterium avium subsp. paratuberculosis
gcagccgggcggcg

SEQ ID NO: 910081 - RNA, 16 nt, Mycobacterium avium subsp. paratuberculosis
gcagccgggcggcgcc

SEQ ID NO: 910082 - RNA, 17 nt, Mycobacterium avium subsp. paratuberculosis
gcagccgggcggcgccg

SEQ ID NO: 910083 - RNA, 16 nt, Mycobacterium avium subsp. paratuberculosis
gcagccgggcggcgcu

SEQ ID NO: 910084 - RNA, 20 nt, Mycobacterium avium subsp. paratuberculosis
gcagccgggcggugaugguc

SEQ ID NO: 910085 - RNA, 14 nt, Mycobacterium avium subsp. paratuberculosis
gcagccgccgcgcc

SEQ ID NO: 910086 - RNA, 16 nt, Mycobacterium avium subsp. paratuberculosis
gcagccgccgcgccac

SEQ ID NO: 910087 - RNA, 19 nt, Mycobacterium avium subsp. paratuberculosis
gcagccgccgcggagcggc

SEQ ID NO: 910088 - RNA, 16 nt, Mycobacterium avium subsp. paratuberculosis
gcagccgccgggccac

SEQ ID NO: 910089 - RNA, 14 nt, Mycobacterium avium subsp. paratuberculosis
gcagccgccgggcu

SEQ ID NO: 910090 - RNA, 13 nt, Mycobacterium avium subsp. paratuberculosis
gcagccgcgacac

SEQ ID NO: 910091 - RNA, 14 nt, Mycobacterium avium subsp. paratuberculosis
gcagccgcagcggc

SEQ ID NO: 910092 - RNA, 15 nt, Mycobacterium avium subsp. paratuberculosis
gcagccgcagcggcg

SEQ ID NO: 910093 - RNA, 19 nt, Mycobacterium avium subsp. paratuberculosis
gcagccgcaccucggggcg

SEQ ID NO: 910094 - RNA, 14 nt, Mycobacterium avium subsp. paratuberculosis
gcagccgcacaccg

SEQ ID NO: 910095 - RNA, 15 nt, Mycobacterium avium subsp. paratuberculosis
gcagccgcacaccgc

SEQ ID NO: 910096 - RNA, 17 nt, Mycobacterium avium subsp. paratuberculosis
gcagccgcacaccgcgg

SEQ ID NO: 910097 - RNA, 18 nt, Mycobacterium avium subsp. paratuberculosis
gcagccgcacaccgcggc

SEQ ID NO: 910098 - RNA, 15 nt, Mycobacterium avium subsp. paratuberculosis
gcagccgcgcggccg

SEQ ID NO: 910099 - RNA, 17 nt, Mycobacterium avium subsp. paratuberculosis
gcagccgcgcggccggc

SEQ ID NO: 910100 - RNA, 21 nt, Mycobacterium avium subsp. paratuberculosis
gcagccgcgcgugcagccggg

SEQ ID NO: 910101 - RNA, 14 nt, Mycobacterium avium subsp. paratuberculosis
gcagccgcgcggcc

SEQ ID NO: 910102 - RNA, 15 nt, Mycobacterium avium subsp. paratuberculosis
gcagccgcgacggcg

SEQ ID NO: 910103 - RNA, 14 nt, Mycobacterium avium subsp. paratuberculosis
gcagccgcgccggg

SEQ ID NO: 910104 - RNA, 14 nt, Mycobacterium avium subsp. paratuberculosis
gcagccgcgcgagc

SEQ ID NO: 910105 - RNA, 15 nt, Mycobacterium avium subsp. paratuberculosis
gcagccgcgcgagca

SEQ ID NO: 910106 - RNA, 18 nt, Mycobacterium avium subsp. paratuberculosis
gcagccgcgcgagcauca

SEQ ID NO: 910107 - RNA, 17 nt, Mycobacterium avium subsp. paratuberculosis
gcagccgcgccaccgcg

SEQ ID NO: 910108 - RNA, 21 nt, Mycobacterium avium subsp. paratuberculosis
gcagccgcgccaccgcggggc

SEQ ID NO: 910109 - RNA, 15 nt, Mycobacterium avium subsp. paratuberculosis
gcagccgcgcccacc

SEQ ID NO: 910110 - RNA, 17 nt, Mycobacterium avium subsp. paratuberculosis
gcagccgcgcccacccg

SEQ ID NO: 910111 - RNA, 13 nt, Mycobacterium avium subsp. paratuberculosis
gcagccgcgcccg

SEQ ID NO: 910112 - RNA, 15 nt, Mycobacterium avium subsp. paratuberculosis
gcagccgcgcccgau

SEQ ID NO: 910113 - RNA, 14 nt, Mycobacterium avium subsp. paratuberculosis
gcagccgcgccgac

SEQ ID NO: 910114 - RNA, 15 nt, Mycobacterium avium subsp. paratuberculosis
gcagccgcgccgacg

SEQ ID NO: 910115 - RNA, 17 nt, Mycobacterium avium subsp. paratuberculosis
gcagccgcgccgacgcc

SEQ ID NO: 910116 - RNA, 15 nt, Mycobacterium avium subsp. paratuberculosis
gcagccgcgccgccg

SEQ ID NO: 910117 - RNA, 13 nt, Mycobacterium avium subsp. paratuberculosis
gcagcgcaccggc

SEQ ID NO: 910118 - RNA, 16 nt, Mycobacterium avium subsp. paratuberculosis
gcagcgcagcgucggc

SEQ ID NO: 910119 - RNA, 17 nt, Mycobacterium avium subsp. paratuberculosis
gcagcgcagcgucggcg

SEQ ID NO: 910120 - RNA, 20 nt, Mycobacterium avium subsp. paratuberculosis
gcagcgcagcgucggcgugc

SEQ ID NO: 910121 - RNA, 18 nt, Mycobacterium avium subsp. paratuberculosis
gcagcgcacgucgccgcc

SEQ ID NO: 910122 - RNA, 20 nt, Mycobacterium avium subsp. paratuberculosis
gcagcgaccugguccaccgc

SEQ ID NO: 910123 - RNA, 21 nt, Mycobacterium avium subsp. paratuberculosis
gcagcgaccugguccaccgcg

SEQ ID NO: 910124 - RNA, 14 nt, Mycobacterium avium subsp. paratuberculosis
gcagcgacgcggug

SEQ ID NO: 910125 - RNA, 18 nt, Mycobacterium avium subsp. paratuberculosis
gcagcgacagcgcgucgg

SEQ ID NO: 910126 - RNA, 18 nt, Mycobacterium avium subsp. paratuberculosis
gcagcgaagcgaggcgcc

SEQ ID NO: 910127 - RNA, 20 nt, Mycobacterium avium subsp. paratuberculosis
gcagcgaagcgaggcgccac

SEQ ID NO: 910128 - RNA, 19 nt, Mycobacterium avium subsp. paratuberculosis
gcagcgaauacaccgucca

SEQ ID NO: 910129 - RNA, 21 nt, Mycobacterium avium subsp. paratuberculosis
gcagcgaaacucguugccagc

SEQ ID NO: 910130 - RNA, 15 nt, Mycobacterium avium subsp. paratuberculosis
gcagcgaacugccgg

SEQ ID NO: 910131 - RNA, 16 nt, Mycobacterium avium subsp. paratuberculosis
gcagcgaacugccggc

SEQ ID NO: 910132 - RNA, 17 nt, Mycobacterium avium subsp. paratuberculosis
gcagcgcgauccggggg

SEQ ID NO: 910133 - RNA, 19 nt, Mycobacterium avium subsp. paratuberculosis
gcagcgcgauccggggggc

SEQ ID NO: 910134 - RNA, 12 nt, Mycobacterium avium subsp. paratuberculosis
gcagcgccuuga

SEQ ID NO: 910135 - RNA, 19 nt, Mycobacterium avium subsp. paratuberculosis
gcagcgccuugccgacgac

SEQ ID NO: 910136 - RNA, 14 nt, Mycobacterium avium subsp. paratuberculosis
gcagcgcgaccagc

SEQ ID NO: 910137 - RNA, 16 nt, Mycobacterium avium subsp. paratuberculosis
gcagcgcgaccagccc

SEQ ID NO: 910138 - RNA, 14 nt, Mycobacterium avium subsp. paratuberculosis
gcagcgcgacgcau

SEQ ID NO: 910139 - RNA, 14 nt, Mycobacterium avium subsp. paratuberculosis
gcagcgcgacgccg

SEQ ID NO: 910140 - RNA, 15 nt, Mycobacterium avium subsp. paratuberculosis
gcagcgcgacgccga

SEQ ID NO: 910141 - RNA, 23 nt, Mycobacterium avium subsp. paratuberculosis
gcagcgcgacgccgacgcccagc

SEQ ID NO: 910142 - RNA, 14 nt, Mycobacterium avium subsp. paratuberculosis
gcagcgcgacuggg

SEQ ID NO: 910143 - RNA, 12 nt, Mycobacterium avium subsp. paratuberculosis
gcagcgccagca

SEQ ID NO: 910144 - RNA, 14 nt, Mycobacterium avium subsp. paratuberculosis
gcagcgccagcacc

SEQ ID NO: 910145 - RNA, 15 nt, Mycobacterium avium subsp. paratuberculosis
gcagcgccagcaccg

SEQ ID NO: 910146 - RNA, 14 nt, Mycobacterium avium subsp. paratuberculosis
gcagcgccucggcg

SEQ ID NO: 910147 - RNA, 16 nt, Mycobacterium avium subsp. paratuberculosis
gcagcgccucggcgau

SEQ ID NO: 910148 - RNA, 23 nt, Mycobacterium avium subsp. paratuberculosis
gcagcgccucggcgaucggccgc

SEQ ID NO: 910149 - RNA, 15 nt, Mycobacterium avium subsp. paratuberculosis
gcagcgccucggcgg

SEQ ID NO: 910150 - RNA, 18 nt, Mycobacterium avium subsp. paratuberculosis
gcagcgccucggcggccc

SEQ ID NO: 910151 - RNA, 19 nt, Mycobacterium avium subsp. paratuberculosis
gcagcgccucggcgggccg

SEQ ID NO: 910152 - RNA, 20 nt, Mycobacterium avium subsp. paratuberculosis
gcagcgccucggcgggccgc

SEQ ID NO: 910153 - RNA, 15 nt, Mycobacterium avium subsp. paratuberculosis
gcagcgccucggcgu

SEQ ID NO: 910154 - RNA, 16 nt, Mycobacterium avium subsp. paratuberculosis
gcagcgccucggcgug

SEQ ID NO: 910155 - RNA, 21 nt, Mycobacterium avium subsp. paratuberculosis
gcagcgccucggugaagccgc

SEQ ID NO: 910156 - RNA, 22 nt, Mycobacterium avium subsp. paratuberculosis
gcagcgccucggugaagccgcg

SEQ ID NO: 910157 - RNA, 13 nt, Mycobacterium avium subsp. paratuberculosis
gcagcgcaucggu

SEQ ID NO: 910158 - RNA, 16 nt, Mycobacterium avium subsp. paratuberculosis
gcagcgcaucguugcc

SEQ ID NO: 910159 - RNA, 22 nt, Mycobacterium avium subsp. paratuberculosis
gcagcgcaucguugccggcggc

SEQ ID NO: 910160 - RNA, 15 nt, Mycobacterium avium subsp. paratuberculosis
gcagcgccaccagcu

SEQ ID NO: 910161 - RNA, 16 nt, Mycobacterium avium subsp. paratuberculosis
gcagcggcgccgcagc

SEQ ID NO: 910162 - RNA, 19 nt, Mycobacterium avium subsp. paratuberculosis
gcagcgcuccugcagcgcg

SEQ ID NO: 910163 - RNA, 14 nt, Mycobacterium avium subsp. paratuberculosis
gcagcgcucgucgu

SEQ ID NO: 910164 - RNA, 14 nt, Mycobacterium avium subsp. paratuberculosis
gcagcgcggcgaug

SEQ ID NO: 910165 - RNA, 15 nt, Mycobacterium avium subsp. paratuberculosis
gcagcgcggugccga

SEQ ID NO: 910166 - RNA, 17 nt, Mycobacterium avium subsp. paratuberculosis
gcagcgcggugccgacc

SEQ ID NO: 910167 - RNA, 19 nt, Mycobacterium avium subsp. paratuberculosis
gcagcgcgguuuccggcga

SEQ ID NO: 910168 - RNA, 18 nt, Mycobacterium avium subsp. paratuberculosis
gcagcgcguaggugcggu

SEQ ID NO: 910169 - RNA, 19 nt, Mycobacterium avium subsp. paratuberculosis
gcagcgcguaggugcgguc

SEQ ID NO: 910170 - RNA, 14 nt, Mycobacterium avium subsp. paratuberculosis
gcagcgcgucgcgc

SEQ ID NO: 910171 - RNA, 20 nt, Mycobacterium avium subsp. paratuberculosis
gcagcgcgucgcgcccggcg

SEQ ID NO: 910172 - RNA, 18 nt, Mycobacterium avium subsp. paratuberculosis
gcagcgcgucgggcucgg

SEQ ID NO: 910173 - RNA, 20 nt, Mycobacterium avium subsp. paratuberculosis
gcagcgcgucgggcucggcc

SEQ ID NO: 910174 - RNA, 23 nt, Mycobacterium avium subsp. paratuberculosis
gcagcgcgucgggcucggccgcc

SEQ ID NO: 910175 - RNA, 12 nt, Mycobacterium avium subsp. paratuberculosis
gcagcgcgucgu

SEQ ID NO: 910176 - RNA, 16 nt, Mycobacterium avium subsp. paratuberculosis
gcagcgcgucgucggu

SEQ ID NO: 910177 - RNA, 23 nt, Mycobacterium avium subsp. paratuberculosis
gcagcgcgucgugcaacucccgc

SEQ ID NO: 910178 - RNA, 19 nt, Mycobacterium avium subsp. paratuberculosis
gcagcgcggcguucagcag

SEQ ID NO: 910179 - RNA, 11 nt, Mycobacterium avium subsp. paratuberculosis
gcagcgcggcu

SEQ ID NO: 910180 - RNA, 16 nt, Mycobacterium avium subsp. paratuberculosis
gcagcggcgccgggau

SEQ ID NO: 910181 - RNA, 12 nt, Mycobacterium avium subsp. paratuberculosis
gcagcggcggcc

SEQ ID NO: 910182 - RNA, 15 nt, Mycobacterium avium subsp. paratuberculosis
gcagcggcggccagu

SEQ ID NO: 910183 - RNA, 23 nt, Mycobacterium avium subsp. paratuberculosis
gcagcggcggccaguugacguug

SEQ ID NO: 910184 - RNA, 22 nt, Mycobacterium avium subsp. paratuberculosis
gcagcggcgguugcucgucggc

SEQ ID NO: 910185 - RNA, 12 nt, Mycobacterium avium subsp. paratuberculosis
gcagcggcguca

SEQ ID NO: 910186 - RNA, 15 nt, Mycobacterium avium subsp. paratuberculosis
gcagcggggaggccc

SEQ ID NO: 910187 - RNA, 21 nt, Mycobacterium avium subsp. paratuberculosis
gcagcggggaggcccagcccg

SEQ ID NO: 910188 - RNA, 22 nt, Mycobacterium avium subsp. paratuberculosis
gcagcggggaggcccagcccgc

SEQ ID NO: 910189 - RNA, 23 nt, Mycobacterium avium subsp. paratuberculosis
gcagcggggaggcccagcccgcc

SEQ ID NO: 910190 - RNA, 14 nt, Mycobacterium avium subsp. paratuberculosis
gcagcggggcgaac

SEQ ID NO: 910191 - RNA, 21 nt, Mycobacterium avium subsp. paratuberculosis
gcagcggggcgaacccggcgc

SEQ ID NO: 910192 - RNA, 22 nt, Mycobacterium avium subsp. paratuberculosis
gcagcggggcgaacccggcgcc

SEQ ID NO: 910193 - RNA, 14 nt, Mycobacterium avium subsp. paratuberculosis
gcagcggggcgagc

SEQ ID NO: 910194 - RNA, 16 nt, Mycobacterium avium subsp. paratuberculosis
gcagcggggcgagcug

SEQ ID NO: 910195 - RNA, 17 nt, Mycobacterium avium subsp. paratuberculosis
gcagcggggcgagcugg

SEQ ID NO: 910196 - RNA, 14 nt, Mycobacterium avium subsp. paratuberculosis
gcagcggggcgcgc

SEQ ID NO: 910197 - RNA, 18 nt, Mycobacterium avium subsp. paratuberculosis
gcagcggggugagcaccg

SEQ ID NO: 910198 - RNA, 21 nt, Mycobacterium avium subsp. paratuberculosis
gcagcggggugugcucggcgg

SEQ ID NO: 910199 - RNA, 19 nt, Mycobacterium avium subsp. paratuberculosis
gcagcggcuugagcgccag

SEQ ID NO: 910200 - RNA, 20 nt, Mycobacterium avium subsp. paratuberculosis
gcagcggcuugagcgccagc

SEQ ID NO: 910201 - RNA, 20 nt, Mycobacterium avium subsp. paratuberculosis
gcagcggcugcugcagcgcc

SEQ ID NO: 910202 - RNA, 21 nt, Mycobacterium avium subsp. paratuberculosis
gcagcggcuuggucaccagcu

SEQ ID NO: 910203 - RNA, 22 nt, Mycobacterium avium subsp. paratuberculosis
gcagcggcuuggucaccagcuc

SEQ ID NO: 910204 - RNA, 18 nt, Mycobacterium avium subsp. paratuberculosis
gcagauggucgccgacgg

SEQ ID NO: 910205 - RNA, 18 nt, Mycobacterium avium subsp. paratuberculosis
gcagauggugaaguugcc

SEQ ID NO: 910206 - RNA, 19 nt, Mycobacterium avium subsp. paratuberculosis
gcagauggugaaguugccg

SEQ ID NO: 910207 - RNA, 17 nt, Mycobacterium avium subsp. paratuberculosis
gcagaugucgguggccu

SEQ ID NO: 910208 - RNA, 20 nt, Mycobacterium avium subsp. paratuberculosis
gcagauucgaggucaucgag

SEQ ID NO: 910209 - RNA, 21 nt, Mycobacterium avium subsp. paratuberculosis
gcagauucgaggucaucgagc

SEQ ID NO: 910210 - RNA, 21 nt, Mycobacterium avium subsp. paratuberculosis
gcagcaacaugauuccgccgg

SEQ ID NO: 910211 - RNA, 13 nt, Mycobacterium avium subsp. paratuberculosis
gcagcaaccggcg

SEQ ID NO: 910212 - RNA, 15 nt, Mycobacterium avium subsp. paratuberculosis
gcagcaaccggcggc

SEQ ID NO: 910213 - RNA, 16 nt, Mycobacterium avium subsp. paratuberculosis
gcagcaaccggcggcu

SEQ ID NO: 910214 - RNA, 17 nt, Mycobacterium avium subsp. paratuberculosis
gcagcaaccggcggcug

SEQ ID NO: 910215 - RNA, 15 nt, Mycobacterium avium subsp. paratuberculosis
gcagcaacggcggcg

SEQ ID NO: 910216 - RNA, 16 nt, Mycobacterium avium subsp. paratuberculosis
gcagcaacggcggcgg

SEQ ID NO: 910217 - RNA, 22 nt, Mycobacterium avium subsp. paratuberculosis
gcagcaacucgcgcucccggcg

SEQ ID NO: 910218 - RNA, 15 nt, Mycobacterium avium subsp. paratuberculosis
gcagaugcgcgucgc

SEQ ID NO: 910219 - RNA, 18 nt, Mycobacterium avium subsp. paratuberculosis
gcagaugcgugcgguggu

SEQ ID NO: 910220 - RNA, 20 nt, Mycobacterium avium subsp. paratuberculosis
gcagauggggaucgaacggc

SEQ ID NO: 910221 - RNA, 14 nt, Mycobacterium avium subsp. paratuberculosis
gcagauggucgccg

SEQ ID NO: 910222 - RNA, 22 nt, Mycobacterium avium subsp. paratuberculosis
gcagacgugacgugccccucga

SEQ ID NO: 910223 - RNA, 13 nt, Mycobacterium avium subsp. paratuberculosis
gcagcagcaccag

SEQ ID NO: 910224 - RNA, 14 nt, Mycobacterium avium subsp. paratuberculosis
gcagcagcaccagc

SEQ ID NO: 910225 - RNA, 15 nt, Mycobacterium avium subsp. paratuberculosis
gcagcagcaccagcg

SEQ ID NO: 910226 - RNA, 16 nt, Mycobacterium avium subsp. paratuberculosis
gcagcagcaccagcgc

SEQ ID NO: 910227 - RNA, 19 nt, Mycobacterium avium subsp. paratuberculosis
gcagcagcaccagcgccgc

SEQ ID NO: 910228 - RNA, 15 nt, Mycobacterium avium subsp. paratuberculosis
gcagcagcaccccga

SEQ ID NO: 910229 - RNA, 18 nt, Mycobacterium avium subsp. paratuberculosis
gcagcagcaccccgaucg

SEQ ID NO: 910230 - RNA, 14 nt, Mycobacterium avium subsp. paratuberculosis
gcagcagcagcccg

SEQ ID NO: 910231 - RNA, 12 nt, Mycobacterium avium subsp. paratuberculosis
gcagcagcagcg

SEQ ID NO: 910232 - RNA, 13 nt, Mycobacterium avium subsp. paratuberculosis
gcagcagcagcgg

SEQ ID NO: 910233 - RNA, 15 nt, Mycobacterium avium subsp. paratuberculosis
gcagcagcagcggca

SEQ ID NO: 910234 - RNA, 14 nt, Mycobacterium avium subsp. paratuberculosis
gcagcagcaggucg

SEQ ID NO: 910235 - RNA, 19 nt, Mycobacterium avium subsp. paratuberculosis
gcagcagcaggucggccag

SEQ ID NO: 910236 - RNA, 18 nt, Mycobacterium avium subsp. paratuberculosis
gcagcagcaggucgucga

SEQ ID NO: 910237 - RNA, 13 nt, Mycobacterium avium subsp. paratuberculosis
gcagcagcccgau

SEQ ID NO: 910238 - RNA, 20 nt, Mycobacterium avium subsp. paratuberculosis
gcagcagcccgaucaccccc

SEQ ID NO: 910239 - RNA, 14 nt, Mycobacterium avium subsp. paratuberculosis
gcagcagcccgccg

SEQ ID NO: 910240 - RNA, 15 nt, Mycobacterium avium subsp. paratuberculosis
gcagcagcccgccga

SEQ ID NO: 910241 - RNA, 19 nt, Mycobacterium avium subsp. paratuberculosis
gcagcagcccgucccggcc

SEQ ID NO: 910242 - RNA, 17 nt, Mycobacterium avium subsp. paratuberculosis
gcagcagccgcagcggc

SEQ ID NO: 910243 - RNA, 19 nt, Mycobacterium avium subsp. paratuberculosis
gcagcagccgcagcggcgg

SEQ ID NO: 910244 - RNA, 23 nt, Mycobacterium avium subsp. paratuberculosis
gcagcagccgcagcggcggcucg

SEQ ID NO: 910245 - RNA, 16 nt, Mycobacterium avium subsp. paratuberculosis
gcagcagccgcgccac

SEQ ID NO: 910246 - RNA, 17 nt, Mycobacterium avium subsp. paratuberculosis
gcagcagccgcgccgcc

SEQ ID NO: 910247 - RNA, 20 nt, Mycobacterium avium subsp. paratuberculosis
gcagcagccgcugcugggug

SEQ ID NO: 910248 - RNA, 22 nt, Mycobacterium avium subsp. paratuberculosis
gcagcagccacgccagccaggc

SEQ ID NO: 910249 - RNA, 14 nt, Mycobacterium avium subsp. paratuberculosis
gcagcagccaugac

SEQ ID NO: 910250 - RNA, 24 nt, Mycobacterium avium subsp. paratuberculosis
gcagcagcccgaacagccgggcgg

SEQ ID NO: 910251 - RNA, 22 nt, Mycobacterium avium subsp. paratuberculosis
gcagcagcgacuugaccagcag

SEQ ID NO: 910252 - RNA, 21 nt, Mycobacterium avium subsp. paratuberculosis
gcagcagcgaggccucgccgc

SEQ ID NO: 910253 - RNA, 13 nt, Mycobacterium avium subsp. paratuberculosis
gcagcagcgccag

SEQ ID NO: 910254 - RNA, 18 nt, Mycobacterium avium subsp. paratuberculosis
gcagcagcgccgcgacga

SEQ ID NO: 910255 - RNA, 21 nt, Mycobacterium avium subsp. paratuberculosis
gcagcagcgccgcgacgaacu

SEQ ID NO: 910256 - RNA, 23 nt, Mycobacterium avium subsp. paratuberculosis
gcagcaacgguacgugcgccggc

SEQ ID NO: 910257 - RNA, 14 nt, Mycobacterium avium subsp. paratuberculosis
gcagcagcgcggug

SEQ ID NO: 910258 - RNA, 15 nt, Mycobacterium avium subsp. paratuberculosis
gcagcagcgcggugc

SEQ ID NO: 910259 - RNA, 21 nt, Mycobacterium avium subsp. paratuberculosis
gcagcagcgcggugccgaccu

SEQ ID NO: 910260 - RNA, 15 nt, Mycobacterium avium subsp. paratuberculosis
gcagcagcgcgucgu

SEQ ID NO: 910261 - RNA, 22 nt, Mycobacterium avium subsp. paratuberculosis
gcagcagcggcuugagcgccag

SEQ ID NO: 910262 - RNA, 14 nt, Mycobacterium avium subsp. paratuberculosis
gcagcagcgggauc

SEQ ID NO: 910263 - RNA, 14 nt, Mycobacterium avium subsp. paratuberculosis
gcagcacgcccaga

SEQ ID NO: 910264 - RNA, 14 nt, Mycobacterium avium subsp. paratuberculosis
gcagcacgcccagc

SEQ ID NO: 910265 - RNA, 15 nt, Mycobacterium avium subsp. paratuberculosis
gcagcacgcccagcc

SEQ ID NO: 910266 - RNA, 20 nt, Mycobacterium avium subsp. paratuberculosis
gcagcacgcccagcccgcgg

SEQ ID NO: 910267 - RNA, 17 nt, Mycobacterium avium subsp. paratuberculosis
gcagcacgcccguagcg

SEQ ID NO: 910268 - RNA, 17 nt, Mycobacterium avium subsp. paratuberculosis
gcagcacgcccucggcu

SEQ ID NO: 910269 - RNA, 12 nt, Mycobacterium avium subsp. paratuberculosis
gcagcacgccca

SEQ ID NO: 910270 - RNA, 14 nt, Mycobacterium avium subsp. paratuberculosis
gcagcacgaugauc

SEQ ID NO: 910271 - RNA, 19 nt, Mycobacterium avium subsp. paratuberculosis
gcagcaccuugccggucgg

SEQ ID NO: 910272 - RNA, 20 nt, Mycobacterium avium subsp. paratuberculosis
gcagcaccuugccggucggg

SEQ ID NO: 910273 - RNA, 17 nt, Mycobacterium avium subsp. paratuberculosis
gcagcaacuccaccucg

SEQ ID NO: 910274 - RNA, 22 nt, Mycobacterium avium subsp. paratuberculosis
gcagcaccuccgacagcccccg

SEQ ID NO: 910275 - RNA, 22 nt, Mycobacterium avium subsp. paratuberculosis
gcagcaccucgaagccgacguc

SEQ ID NO: 910276 - RNA, 14 nt, Mycobacterium avium subsp. paratuberculosis
gcagcaccucgcgc

SEQ ID NO: 910277 - RNA, 18 nt, Mycobacterium avium subsp. paratuberculosis
gcagcaccucgcgcagca

SEQ ID NO: 910278 - RNA, 18 nt, Mycobacterium avium subsp. paratuberculosis
gcagaaaaaggccgccgc

SEQ ID NO: 910279 - RNA, 14 nt, Mycobacterium avium subsp. paratuberculosis
gcacuuucggcagc

SEQ ID NO: 910280 - RNA, 17 nt, Mycobacterium avium subsp. paratuberculosis
gcagaaaauagcccagc

SEQ ID NO: 910281 - RNA, 20 nt, Mycobacterium avium subsp. paratuberculosis
gcagaaaauagcccagccag

SEQ ID NO: 910282 - RNA, 16 nt, Mycobacterium avium subsp. paratuberculosis
gcagaaauccgucgaa

SEQ ID NO: 910283 - RNA, 14 nt, Mycobacterium avium subsp. paratuberculosis
gcagaacagccggu

SEQ ID NO: 910284 - RNA, 18 nt, Mycobacterium avium subsp. paratuberculosis
gcagaacagccgguccga

SEQ ID NO: 910285 - RNA, 17 nt, Mycobacterium avium subsp. paratuberculosis
gcagaaaugggccaugc

SEQ ID NO: 910286 - RNA, 18 nt, Mycobacterium avium subsp. paratuberculosis
gcagaacaccaccgccag

SEQ ID NO: 910287 - RNA, 19 nt, Mycobacterium avium subsp. paratuberculosis
gcagaacaccacgguguag

SEQ ID NO: 910288 - RNA, 20 nt, Mycobacterium avium subsp. paratuberculosis
gcagaacaccacgguguagc

SEQ ID NO: 910289 - RNA, 14 nt, Mycobacterium avium subsp. paratuberculosis
gcagaacaccagcg

SEQ ID NO: 910290 - RNA, 19 nt, Mycobacterium avium subsp. paratuberculosis
gcagaacgccaucaccagc

SEQ ID NO: 910291 - RNA, 20 nt, Mycobacterium avium subsp. paratuberculosis
gcagaacgccaucaccagcg

SEQ ID NO: 910292 - RNA, 21 nt, Mycobacterium avium subsp. paratuberculosis
gcagaacgccaucaccagcgc

SEQ ID NO: 910293 - RNA, 13 nt, Mycobacterium avium subsp. paratuberculosis
gcagaacgacgcc

SEQ ID NO: 910294 - RNA, 15 nt, Mycobacterium avium subsp. paratuberculosis
gcagaaccagcaccg

SEQ ID NO: 910295 - RNA, 18 nt, Mycobacterium avium subsp. paratuberculosis
gcagaaccagcaccgccg

SEQ ID NO: 910296 - RNA, 19 nt, Mycobacterium avium subsp. paratuberculosis
gcagaaccagcaccgccgc

SEQ ID NO: 910297 - RNA, 21 nt, Mycobacterium avium subsp. paratuberculosis
gcagaaccagcaccgccgcgg

SEQ ID NO: 910298 - RNA, 15 nt, Mycobacterium avium subsp. paratuberculosis
gcagaaccgcacccc

SEQ ID NO: 910299 - RNA, 17 nt, Mycobacterium avium subsp. paratuberculosis
gcagaaccgcaccccgu

SEQ ID NO: 910300 - RNA, 21 nt, Mycobacterium avium subsp. paratuberculosis
gcagaagcuccacgccgccgg

SEQ ID NO: 910301 - RNA, 17 nt, Mycobacterium avium subsp. paratuberculosis
gcagaacucgucgccac

SEQ ID NO: 910302 - RNA, 18 nt, Mycobacterium avium subsp. paratuberculosis
gcagaacuucuccgccgg

SEQ ID NO: 910303 - RNA, 21 nt, Mycobacterium avium subsp. paratuberculosis
gcagaacuucuccgccggcag

SEQ ID NO: 910304 - RNA, 17 nt, Mycobacterium avium subsp. paratuberculosis
gcagaaguugacggucu

SEQ ID NO: 910305 - RNA, 19 nt, Mycobacterium avium subsp. paratuberculosis
gcagacacaaaagcaccca

SEQ ID NO: 910306 - RNA, 19 nt, Mycobacterium avium subsp. paratuberculosis
gcagacacaaaagcgcccg

SEQ ID NO: 910307 - RNA, 13 nt, Mycobacterium avium subsp. paratuberculosis
gcagaccagcccg

SEQ ID NO: 910308 - RNA, 14 nt, Mycobacterium avium subsp. paratuberculosis
gcagacccagcagc

SEQ ID NO: 910309 - RNA, 15 nt, Mycobacterium avium subsp. paratuberculosis
gcagacccagcagcg

SEQ ID NO: 910310 - RNA, 18 nt, Mycobacterium avium subsp. paratuberculosis
gcagacccagcagcggcc

SEQ ID NO: 910311 - RNA, 22 nt, Mycobacterium avium subsp. paratuberculosis
gcagacccagcagcggccggcg

SEQ ID NO: 910312 - RNA, 17 nt, Mycobacterium avium subsp. paratuberculosis
gcagacccccagcagcg

SEQ ID NO: 910313 - RNA, 16 nt, Mycobacterium avium subsp. paratuberculosis
gcagaccccggcgucc

SEQ ID NO: 910314 - RNA, 17 nt, Mycobacterium avium subsp. paratuberculosis
gcagaccccggcgucca

SEQ ID NO: 910315 - RNA, 21 nt, Mycobacterium avium subsp. paratuberculosis
gcagaccccggcguccaguag

SEQ ID NO: 910316 - RNA, 23 nt, Mycobacterium avium subsp. paratuberculosis
gcagaccccggcguccaguagcc

SEQ ID NO: 910317 - RNA, 15 nt, Mycobacterium avium subsp. paratuberculosis
gcagacccgccgcgg

SEQ ID NO: 910318 - RNA, 16 nt, Mycobacterium avium subsp. paratuberculosis
gcagacccgccgcggc

SEQ ID NO: 910319 - RNA, 18 nt, Mycobacterium avium subsp. paratuberculosis
gcagacccgccgcggcaa

SEQ ID NO: 910320 - RNA, 22 nt, Mycobacterium avium subsp. paratuberculosis
gcagacccgccgcggcaacgcc

SEQ ID NO: 910321 - RNA, 15 nt, Mycobacterium avium subsp. paratuberculosis
gcagacccgcgucga

SEQ ID NO: 910322 - RNA, 17 nt, Mycobacterium avium subsp. paratuberculosis
gcagaccgaacccgggc

SEQ ID NO: 910323 - RNA, 18 nt, Mycobacterium avium subsp. paratuberculosis
gcagaccgaacccgggcg

SEQ ID NO: 910324 - RNA, 20 nt, Mycobacterium avium subsp. paratuberculosis
gcagaccgaacccgggcgcg

SEQ ID NO: 910325 - RNA, 17 nt, Mycobacterium avium subsp. paratuberculosis
gcagaccgaacgucacg

SEQ ID NO: 910326 - RNA, 20 nt, Mycobacterium avium subsp. paratuberculosis
gcagaccgaacgucacggcg

SEQ ID NO: 910327 - RNA, 17 nt, Mycobacterium avium subsp. paratuberculosis
gcagaccgccggugcgc

SEQ ID NO: 910328 - RNA, 18 nt, Mycobacterium avium subsp. paratuberculosis
gcagaccgccggugcgca

SEQ ID NO: 910329 - RNA, 14 nt, Mycobacterium avium subsp. paratuberculosis
gcagaccggacagc

SEQ ID NO: 910330 - RNA, 18 nt, Mycobacterium avium subsp. paratuberculosis
gcagaccggugagcaccg

SEQ ID NO: 910331 - RNA, 14 nt, Mycobacterium avium subsp. paratuberculosis
gcagaccgguggcg

SEQ ID NO: 910332 - RNA, 18 nt, Mycobacterium avium subsp. paratuberculosis
gcagaccguccgguucgg

SEQ ID NO: 910333 - RNA, 19 nt, Mycobacterium avium subsp. paratuberculosis
gcagaccguccgguucggc

SEQ ID NO: 910334 - RNA, 20 nt, Mycobacterium avium subsp. paratuberculosis
gcagacggacacccgcgcgg

SEQ ID NO: 910335 - RNA, 22 nt, Mycobacterium avium subsp. paratuberculosis
gcagacggacacccgcgcggug

SEQ ID NO: 910336 - RNA, 18 nt, Mycobacterium avium subsp. paratuberculosis
gcagacgcgaaagcaccc

SEQ ID NO: 910337 - RNA, 19 nt, Mycobacterium avium subsp. paratuberculosis
gcagacgcgaaagcacccg

SEQ ID NO: 910338 - RNA, 18 nt, Mycobacterium avium subsp. paratuberculosis
gcagacguagcaccaguc

SEQ ID NO: 910339 - RNA, 21 nt, Mycobacterium avium subsp. paratuberculosis
gcagacguagcaccagucggc

SEQ ID NO: 910340 - RNA, 14 nt, Mycobacterium avium subsp. paratuberculosis
gcagacgaauucgg

SEQ ID NO: 910341 - RNA, 23 nt, Mycobacterium avium subsp. paratuberculosis
gcagacgaauucggagaccaggu

SEQ ID NO: 910342 - RNA, 23 nt, Mycobacterium avium subsp. paratuberculosis
gcaccgaguagaacuucgccagc

SEQ ID NO: 910343 - RNA, 24 nt, Mycobacterium avium subsp. paratuberculosis
gcaccgauggguuggccgucgcgu

SEQ ID NO: 910344 - RNA, 14 nt, Mycobacterium avium subsp. paratuberculosis
gcaccgccgcggga

SEQ ID NO: 910345 - RNA, 13 nt, Mycobacterium avium subsp. paratuberculosis
gcaccgccgcggu

SEQ ID NO: 910346 - RNA, 18 nt, Mycobacterium avium subsp. paratuberculosis
gcaccgcaaagcaccgcg

SEQ ID NO: 910347 - RNA, 15 nt, Mycobacterium avium subsp. paratuberculosis
gcaccgccacgccgu

SEQ ID NO: 910348 - RNA, 16 nt, Mycobacterium avium subsp. paratuberculosis
gcaccgccacggcgac

SEQ ID NO: 910349 - RNA, 11 nt, Mycobacterium avium subsp. paratuberculosis
gcaccgccagc

SEQ ID NO: 910350 - RNA, 17 nt, Mycobacterium avium subsp. paratuberculosis
gcaccgccgcgcggccg

SEQ ID NO: 910351 - RNA, 18 nt, Mycobacterium avium subsp. paratuberculosis
gcaccgccaccgcccgcu

SEQ ID NO: 910352 - RNA, 16 nt, Mycobacterium avium subsp. paratuberculosis
gcaccgccaccgcgca

SEQ ID NO: 910353 - RNA, 18 nt, Mycobacterium avium subsp. paratuberculosis
gcaccgccaccggcccgg

SEQ ID NO: 910354 - RNA, 19 nt, Mycobacterium avium subsp. paratuberculosis
gcaccgccaccggcccggc

SEQ ID NO: 910355 - RNA, 23 nt, Mycobacterium avium subsp. paratuberculosis
gcaccgcauagcgggagccggcc

SEQ ID NO: 910356 - RNA, 20 nt, Mycobacterium avium subsp. paratuberculosis
gcaccgcauaggaccggaug

SEQ ID NO: 910357 - RNA, 20 nt, Mycobacterium avium subsp. paratuberculosis
gcaccgcaucccccucggcg

SEQ ID NO: 910358 - RNA, 21 nt, Mycobacterium avium subsp. paratuberculosis
gcaccgcaucccccucggcgg

SEQ ID NO: 910359 - RNA, 15 nt, Mycobacterium avium subsp. paratuberculosis
gcaccgcgacgagau

SEQ ID NO: 910360 - RNA, 13 nt, Mycobacterium avium subsp. paratuberculosis
gcaccgcgcccgc

SEQ ID NO: 910361 - RNA, 14 nt, Mycobacterium avium subsp. paratuberculosis
gcaccgcgcccgcc

SEQ ID NO: 910362 - RNA, 18 nt, Mycobacterium avium subsp. paratuberculosis
gcaccgcgcgcaccacgu

SEQ ID NO: 910363 - RNA, 20 nt, Mycobacterium avium subsp. paratuberculosis
gcaccgcggauuccagcgcg

SEQ ID NO: 910364 - RNA, 22 nt, Mycobacterium avium subsp. paratuberculosis
gcaccgcggccaacccgggcgc

SEQ ID NO: 910365 - RNA, 17 nt, Mycobacterium avium subsp. paratuberculosis
gcaccgcggagcgcaac

SEQ ID NO: 910366 - RNA, 17 nt, Mycobacterium avium subsp. paratuberculosis
gcaccgcgaccgguccg

SEQ ID NO: 910367 - RNA, 13 nt, Mycobacterium avium subsp. paratuberculosis
gcaccgcgcggcg

SEQ ID NO: 910368 - RNA, 14 nt, Mycobacterium avium subsp. paratuberculosis
gcaccgcgcggcgg

SEQ ID NO: 910369 - RNA, 15 nt, Mycobacterium avium subsp. paratuberculosis
gcaccgcgcggcggu

SEQ ID NO: 910370 - RNA, 20 nt, Mycobacterium avium subsp. paratuberculosis
gcaccgcgcggcggugcucg

SEQ ID NO: 910371 - RNA, 19 nt, Mycobacterium avium subsp. paratuberculosis
gcaccgcgcguucgaguuc

SEQ ID NO: 910372 - RNA, 16 nt, Mycobacterium avium subsp. paratuberculosis
gcaccgcgacccaggc

SEQ ID NO: 910373 - RNA, 20 nt, Mycobacterium avium subsp. paratuberculosis
gcaccgcgacccaggccgcc

SEQ ID NO: 910374 - RNA, 21 nt, Mycobacterium avium subsp. paratuberculosis
gcaccgcgacccaggccgccg

SEQ ID NO: 910375 - RNA, 12 nt, Mycobacterium avium subsp. paratuberculosis
gcaccgcgaccg

SEQ ID NO: 910376 - RNA, 21 nt, Mycobacterium avium subsp. paratuberculosis
gcaccgcgaaagugcaacugg

SEQ ID NO: 910377 - RNA, 14 nt, Mycobacterium avium subsp. paratuberculosis
gcaccgcgaacauc

SEQ ID NO: 910378 - RNA, 18 nt, Mycobacterium avium subsp. paratuberculosis
gcaccgcgaacaucgcca

SEQ ID NO: 910379 - RNA, 19 nt, Mycobacterium avium subsp. paratuberculosis
gcaccgcgaacaucgccag

SEQ ID NO: 910380 - RNA, 20 nt, Mycobacterium avium subsp. paratuberculosis
gcaccgcgaacaucgccagc

SEQ ID NO: 910381 - RNA, 17 nt, Mycobacterium avium subsp. paratuberculosis
gcaccgcgaccacgccg

SEQ ID NO: 910382 - RNA, 15 nt, Mycobacterium avium subsp. paratuberculosis
gcaccgcgaccagcu

SEQ ID NO: 910383 - RNA, 19 nt, Mycobacterium avium subsp. paratuberculosis
gcaccgcgagcaccgcgau

SEQ ID NO: 910384 - RNA, 15 nt, Mycobacterium avium subsp. paratuberculosis
gcaccgcgaucgccg

SEQ ID NO: 910385 - RNA, 17 nt, Mycobacterium avium subsp. paratuberculosis
gcaccgcgaucgccgac

SEQ ID NO: 910386 - RNA, 18 nt, Mycobacterium avium subsp. paratuberculosis
gcaccgcgaucgccgacg

SEQ ID NO: 910387 - RNA, 20 nt, Mycobacterium avium subsp. paratuberculosis
gcaccgcgaucgccgacguc

SEQ ID NO: 910388 - RNA, 22 nt, Mycobacterium avium subsp. paratuberculosis
gcaccgcgaucgccgacgucgg

SEQ ID NO: 910389 - RNA, 15 nt, Mycobacterium avium subsp. paratuberculosis
gcaccgcgauggccc

SEQ ID NO: 910390 - RNA, 15 nt, Mycobacterium avium subsp. paratuberculosis
gcaccgccgucccgu

SEQ ID NO: 910391 - RNA, 16 nt, Mycobacterium avium subsp. paratuberculosis
gcaccgccgucggggc

SEQ ID NO: 910392 - RNA, 21 nt, Mycobacterium avium subsp. paratuberculosis
gcaccgccgucggggcgucgg

SEQ ID NO: 910393 - RNA, 23 nt, Mycobacterium avium subsp. paratuberculosis
gcaccgccgucggggcgucggcg

SEQ ID NO: 910394 - RNA, 22 nt, Mycobacterium avium subsp. paratuberculosis
gcaccgccucaugccagacgcg

SEQ ID NO: 910395 - RNA, 23 nt, Mycobacterium avium subsp. paratuberculosis
gcaccgccucaugccagacgcgc

SEQ ID NO: 910396 - RNA, 17 nt, Mycobacterium avium subsp. paratuberculosis
gcaccgccuccucgaug

SEQ ID NO: 910397 - RNA, 23 nt, Mycobacterium avium subsp. paratuberculosis
gcaccgccuccucgaugucggug

SEQ ID NO: 910398 - RNA, 17 nt, Mycobacterium avium subsp. paratuberculosis
gcaccgccucggccacc

SEQ ID NO: 910399 - RNA, 14 nt, Mycobacterium avium subsp. paratuberculosis
gcaccgccggcggc

SEQ ID NO: 910400 - RNA, 16 nt, Mycobacterium avium subsp. paratuberculosis
gcaccgccggcggccu

SEQ ID NO: 910401 - RNA, 19 nt, Mycobacterium avium subsp. paratuberculosis
gcaccgccugugcgacggc

SEQ ID NO: 910402 - RNA, 20 nt, Mycobacterium avium subsp. paratuberculosis
gcaccgccugugcgacggcg

SEQ ID NO: 910403 - RNA, 23 nt, Mycobacterium avium subsp. paratuberculosis
gcaccgcgaaacgcaacagcgag

SEQ ID NO: 910404 - RNA, 13 nt, Mycobacterium avium subsp. paratuberculosis
gcacccucggugc

SEQ ID NO: 910405 - RNA, 18 nt, Mycobacterium avium subsp. paratuberculosis
gcacccucugccacggcg

SEQ ID NO: 910406 - RNA, 19 nt, Mycobacterium avium subsp. paratuberculosis
gcacccucugccacggcgg

SEQ ID NO: 910407 - RNA, 13 nt, Mycobacterium avium subsp. paratuberculosis
gcacccguucggc

SEQ ID NO: 910408 - RNA, 18 nt, Mycobacterium avium subsp. paratuberculosis
gcacccgguccggcccgg

SEQ ID NO: 910409 - RNA, 20 nt, Mycobacterium avium subsp. paratuberculosis
gcacccgguccggcuggucg

SEQ ID NO: 910410 - RNA, 14 nt, Mycobacterium avium subsp. paratuberculosis
gcacccggucgccg

SEQ ID NO: 910411 - RNA, 17 nt, Mycobacterium avium subsp. paratuberculosis
gcacccggucgccggug

SEQ ID NO: 910412 - RNA, 13 nt, Mycobacterium avium subsp. paratuberculosis
gcacccgggucag

SEQ ID NO: 910413 - RNA, 13 nt, Mycobacterium avium subsp. paratuberculosis
gcacccgggugcc

SEQ ID NO: 910414 - RNA, 18 nt, Mycobacterium avium subsp. paratuberculosis
gcacccgggugcccggcu

SEQ ID NO: 910415 - RNA, 18 nt, Mycobacterium avium subsp. paratuberculosis
gcacccggguggacaccg

SEQ ID NO: 910416 - RNA, 19 nt, Mycobacterium avium subsp. paratuberculosis
gcacccggguggacaccgc

SEQ ID NO: 910417 - RNA, 21 nt, Mycobacterium avium subsp. paratuberculosis
gcacccggguggacaccgcga

SEQ ID NO: 910418 - RNA, 19 nt, Mycobacterium avium subsp. paratuberculosis
gcacccggucggugagcug

SEQ ID NO: 910419 - RNA, 20 nt, Mycobacterium avium subsp. paratuberculosis
gcacccggucggugagcugg

SEQ ID NO: 910420 - RNA, 23 nt, Mycobacterium avium subsp. paratuberculosis
gcacccggucggugagcuggccg

SEQ ID NO: 910421 - RNA, 15 nt, Mycobacterium avium subsp. paratuberculosis
gcacccgguucuggg

SEQ ID NO: 910422 - RNA, 15 nt, Mycobacterium avium subsp. paratuberculosis
gcacccguaacacga

SEQ ID NO: 910423 - RNA, 18 nt, Mycobacterium avium subsp. paratuberculosis
gcacccggccacgccggg

SEQ ID NO: 910424 - RNA, 12 nt, Mycobacterium avium subsp. paratuberculosis
gcacccggccca

SEQ ID NO: 910425 - RNA, 15 nt, Mycobacterium avium subsp. paratuberculosis
gcacccggcccacgc

SEQ ID NO: 910426 - RNA, 18 nt, Mycobacterium avium subsp. paratuberculosis
gcacccggcccacgccgu

SEQ ID NO: 910427 - RNA, 19 nt, Mycobacterium avium subsp. paratuberculosis
gcacccggcccacgccguc

SEQ ID NO: 910428 - RNA, 16 nt, Mycobacterium avium subsp. paratuberculosis
gcacccggcccccuga

SEQ ID NO: 910429 - RNA, 23 nt, Mycobacterium avium subsp. paratuberculosis
gcacccggcgcggccgcccagcc

SEQ ID NO: 910430 - RNA, 12 nt, Mycobacterium avium subsp. paratuberculosis
gcacccggcggg

SEQ ID NO: 910431 - RNA, 15 nt, Mycobacterium avium subsp. paratuberculosis
gcacccggcggggac

SEQ ID NO: 910432 - RNA, 13 nt, Mycobacterium avium subsp. paratuberculosis
gcacccgggcagc

SEQ ID NO: 910433 - RNA, 14 nt, Mycobacterium avium subsp. paratuberculosis
gcacccgggcagcu

SEQ ID NO: 910434 - RNA, 13 nt, Mycobacterium avium subsp. paratuberculosis
gcacccgggccug

SEQ ID NO: 910435 - RNA, 19 nt, Mycobacterium avium subsp. paratuberculosis
gcacccgggccugcggcgg

SEQ ID NO: 910436 - RNA, 21 nt, Mycobacterium avium subsp. paratuberculosis
gcacccgggccugcggcggcc

SEQ ID NO: 910437 - RNA, 12 nt, Mycobacterium avium subsp. paratuberculosis
gcacccgggcga

SEQ ID NO: 910438 - RNA, 13 nt, Mycobacterium avium subsp. paratuberculosis
gcacccgggcgcg

SEQ ID NO: 910439 - RNA, 17 nt, Mycobacterium avium subsp. paratuberculosis
gcacccgggcgcgacgg

SEQ ID NO: 910440 - RNA, 18 nt, Mycobacterium avium subsp. paratuberculosis
gcacccgggcgcgacggu

SEQ ID NO: 910441 - RNA, 13 nt, Mycobacterium avium subsp. paratuberculosis
gcacaccggugcu

SEQ ID NO: 910442 - RNA, 16 nt, Mycobacterium avium subsp. paratuberculosis
gcacaccgcggcggcg

SEQ ID NO: 910443 - RNA, 16 nt, Mycobacterium avium subsp. paratuberculosis
gcacaccggaucggcu

SEQ ID NO: 910444 - RNA, 12 nt, Mycobacterium avium subsp. paratuberculosis
gcacaccggcca

SEQ ID NO: 910445 - RNA, 18 nt, Mycobacterium avium subsp. paratuberculosis
gcacccgcugcaccagcc

SEQ ID NO: 910446 - RNA, 14 nt, Mycobacterium avium subsp. paratuberculosis
gcacccgcugcagc

SEQ ID NO: 910447 - RNA, 22 nt, Mycobacterium avium subsp. paratuberculosis
gcacccgcuuuugccgucggug

SEQ ID NO: 910448 - RNA, 16 nt, Mycobacterium avium subsp. paratuberculosis
gcacccggacgugauc

SEQ ID NO: 910449 - RNA, 18 nt, Mycobacterium avium subsp. paratuberculosis
gcacccggacgugaucgc

SEQ ID NO: 910450 - RNA, 13 nt, Mycobacterium avium subsp. paratuberculosis
gcacccggauggu

SEQ ID NO: 910451 - RNA, 14 nt, Mycobacterium avium subsp. paratuberculosis
gcacacccagcgag

SEQ ID NO: 910452 - RNA, 19 nt, Mycobacterium avium subsp. paratuberculosis
gcacaccagcguucgucgc

SEQ ID NO: 910453 - RNA, 23 nt, Mycobacterium avium subsp. paratuberculosis
gcacaccagcguucgucgccggu

SEQ ID NO: 910454 - RNA, 15 nt, Mycobacterium avium subsp. paratuberculosis
gcacaccagguaggc

SEQ ID NO: 910455 - RNA, 14 nt, Mycobacterium avium subsp. paratuberculosis
gcacacccggugcg

SEQ ID NO: 910456 - RNA, 19 nt, Mycobacterium avium subsp. paratuberculosis
gcacacccggugcgccggu

SEQ ID NO: 910457 - RNA, 16 nt, Mycobacterium avium subsp. paratuberculosis
gcacacacaggucgcc

SEQ ID NO: 910458 - RNA, 23 nt, Mycobacterium avium subsp. paratuberculosis
gcacacccucgacccguuccggc

SEQ ID NO: 910459 - RNA, 23 nt, Mycobacterium avium subsp. paratuberculosis
gcacacccuuuuccaucugggcg

SEQ ID NO: 910460 - RNA, 13 nt, Mycobacterium avium subsp. paratuberculosis
gcacaccgcgcag

SEQ ID NO: 910461 - RNA, 12 nt, Mycobacterium avium subsp. paratuberculosis
gcacaccgcgcg

SEQ ID NO: 910462 - RNA, 13 nt, Mycobacterium avium subsp. paratuberculosis
gcacaccgcgcga

SEQ ID NO: 910463 - RNA, 13 nt, Mycobacterium avium subsp. paratuberculosis
gcacaccgcgcgc

SEQ ID NO: 910464 - RNA, 16 nt, Mycobacterium avium subsp. paratuberculosis
gcacaccgcgcgcagg

SEQ ID NO: 910465 - RNA, 18 nt, Mycobacterium avium subsp. paratuberculosis
gcacaccgcgcgcaggcc

SEQ ID NO: 910466 - RNA, 21 nt, Mycobacterium avium subsp. paratuberculosis
gcaccguggugacccggaccg

SEQ ID NO: 910467 - RNA, 15 nt, Mycobacterium avium subsp. paratuberculosis
gcaccguguagccga

SEQ ID NO: 910468 - RNA, 17 nt, Mycobacterium avium subsp. paratuberculosis
gcaccguguagccgacc

SEQ ID NO: 910469 - RNA, 18 nt, Mycobacterium avium subsp. paratuberculosis
gcaccguguagccgaccg

SEQ ID NO: 910470 - RNA, 20 nt, Mycobacterium avium subsp. paratuberculosis
gcaccgugcugauccacgcc

SEQ ID NO: 910471 - RNA, 18 nt, Mycobacterium avium subsp. paratuberculosis
gcaccgugucgucgcuga

SEQ ID NO: 910472 - RNA, 16 nt, Mycobacterium avium subsp. paratuberculosis
gcaccguuuccggugc

SEQ ID NO: 910473 - RNA, 13 nt, Mycobacterium avium subsp. paratuberculosis
gcaccucgaugcc

SEQ ID NO: 910474 - RNA, 16 nt, Mycobacterium avium subsp. paratuberculosis
gcaccucgaucaccgg

SEQ ID NO: 910475 - RNA, 21 nt, Mycobacterium avium subsp. paratuberculosis
gcaccucgaucaccgggcggc

SEQ ID NO: 910476 - RNA, 15 nt, Mycobacterium avium subsp. paratuberculosis
gcaccucgaucuugu

SEQ ID NO: 910477 - RNA, 20 nt, Mycobacterium avium subsp. paratuberculosis
gcaccucgcccugcagccgg

SEQ ID NO: 910478 - RNA, 20 nt, Mycobacterium avium subsp. paratuberculosis
gcaccucgcccugcagcgcg

SEQ ID NO: 910479 - RNA, 17 nt, Mycobacterium avium subsp. paratuberculosis
gcaccucgccggccgcc

SEQ ID NO: 910480 - RNA, 19 nt, Mycobacterium avium subsp. paratuberculosis
gcaccucgccggccgccgu

SEQ ID NO: 910481 - RNA, 13 nt, Mycobacterium avium subsp. paratuberculosis
gcaccucgcgcag

SEQ ID NO: 910482 - RNA, 15 nt, Mycobacterium avium subsp. paratuberculosis
gcaccucgcgcagca

SEQ ID NO: 910483 - RNA, 18 nt, Mycobacterium avium subsp. paratuberculosis
gcaccucgcgcagcaccg

SEQ ID NO: 910484 - RNA, 19 nt, Mycobacterium avium subsp. paratuberculosis
gcaccucgcgcagcaccga

SEQ ID NO: 910485 - RNA, 17 nt, Mycobacterium avium subsp. paratuberculosis
gcaccucgcgcgcgagc

SEQ ID NO: 910486 - RNA, 14 nt, Mycobacterium avium subsp. paratuberculosis
gcaccucgcggcag

SEQ ID NO: 910487 - RNA, 21 nt, Mycobacterium avium subsp. paratuberculosis
gcaccucgcuggcggcgcggu

SEQ ID NO: 910488 - RNA, 17 nt, Mycobacterium avium subsp. paratuberculosis
gcaccggcagccagaug

SEQ ID NO: 910489 - RNA, 16 nt, Mycobacterium avium subsp. paratuberculosis
gcaccuccagcccggc

SEQ ID NO: 910490 - RNA, 21 nt, Mycobacterium avium subsp. paratuberculosis
gcaccuccaguugcgaccccg

SEQ ID NO: 910491 - RNA, 15 nt, Mycobacterium avium subsp. paratuberculosis
gcaccuccgacagcc

SEQ ID NO: 910492 - RNA, 16 nt, Mycobacterium avium subsp. paratuberculosis
gcaccuccugcacccg

SEQ ID NO: 910493 - RNA, 18 nt, Mycobacterium avium subsp. paratuberculosis
gcaccuccugggugagcg

SEQ ID NO: 910494 - RNA, 20 nt, Mycobacterium avium subsp. paratuberculosis
gcaccucgaagccgacgucc

SEQ ID NO: 910495 - RNA, 17 nt, Mycobacterium avium subsp. paratuberculosis
gcaccucgaagggcgcc

SEQ ID NO: 910496 - RNA, 21 nt, Mycobacterium avium subsp. paratuberculosis
gcaccucgaagggcgccagcc

SEQ ID NO: 910497 - RNA, 23 nt, Mycobacterium avium subsp. paratuberculosis
gcaccucgaagggcgccagccgu

SEQ ID NO: 910498 - RNA, 14 nt, Mycobacterium avium subsp. paratuberculosis
gcaccgugccgcgc

SEQ ID NO: 910499 - RNA, 22 nt, Mycobacterium avium subsp. paratuberculosis
gcaccgugccgcgcggcgguga

SEQ ID NO: 910500 - RNA, 13 nt, Mycobacterium avium subsp. paratuberculosis
gcaccgugccguc

SEQ ID NO: 910501 - RNA, 15 nt, Mycobacterium avium subsp. paratuberculosis
gcaccgugccgucgg

SEQ ID NO: 910502 - RNA, 16 nt, Mycobacterium avium subsp. paratuberculosis
gcaccgugccgucggc

SEQ ID NO: 910503 - RNA, 20 nt, Mycobacterium avium subsp. paratuberculosis
gcaccgugccgucggcgucg

SEQ ID NO: 910504 - RNA, 16 nt, Mycobacterium avium subsp. paratuberculosis
gcaccggcgaguccgc

SEQ ID NO: 910505 - RNA, 18 nt, Mycobacterium avium subsp. paratuberculosis
gcaccggcgaguccgcgg

SEQ ID NO: 910506 - RNA, 14 nt, Mycobacterium avium subsp. paratuberculosis
gcaccgucugcgcc

SEQ ID NO: 910507 - RNA, 21 nt, Mycobacterium avium subsp. paratuberculosis
gcaccgucugcgccgucaccg

SEQ ID NO: 910508 - RNA, 22 nt, Mycobacterium avium subsp. paratuberculosis
gcaccgucugcgccgucaccgg

SEQ ID NO: 910509 - RNA, 13 nt, Mycobacterium avium subsp. paratuberculosis
gcaccggccggau

SEQ ID NO: 910510 - RNA, 15 nt, Mycobacterium avium subsp. paratuberculosis
gcaccggcagccgca

SEQ ID NO: 910511 - RNA, 18 nt, Mycobacterium avium subsp. paratuberculosis
gcaccggaugcucaccgg

SEQ ID NO: 910512 - RNA, 16 nt, Mycobacterium avium subsp. paratuberculosis
gcaccggcacgucgag

SEQ ID NO: 910513 - RNA, 15 nt, Mycobacterium avium subsp. paratuberculosis
gcaccggcagcaacc

SEQ ID NO: 910514 - RNA, 19 nt, Mycobacterium avium subsp. paratuberculosis
gcaccggcagcaccgccga

SEQ ID NO: 910515 - RNA, 20 nt, Mycobacterium avium subsp. paratuberculosis
gcaccggacgcagcgaucgg

SEQ ID NO: 910516 - RNA, 12 nt, Mycobacterium avium subsp. paratuberculosis
gcaccggcaccg

SEQ ID NO: 910517 - RNA, 15 nt, Mycobacterium avium subsp. paratuberculosis
gcaccggcaccgcca

SEQ ID NO: 910518 - RNA, 14 nt, Mycobacterium avium subsp. paratuberculosis
gcaccggcaccgcg

SEQ ID NO: 910519 - RNA, 15 nt, Mycobacterium avium subsp. paratuberculosis
gcaccggcaccgcgg

SEQ ID NO: 910520 - RNA, 17 nt, Mycobacterium avium subsp. paratuberculosis
gcaccggcaccgcggcg

SEQ ID NO: 910521 - RNA, 16 nt, Mycobacterium avium subsp. paratuberculosis
gcaccggcaccgcggu

SEQ ID NO: 910522 - RNA, 12 nt, Mycobacterium avium subsp. paratuberculosis
gcaccucgacga

SEQ ID NO: 910523 - RNA, 17 nt, Mycobacterium avium subsp. paratuberculosis
gcaccugccgucgacga

SEQ ID NO: 910524 - RNA, 20 nt, Mycobacterium avium subsp. paratuberculosis
gcaccugcuccucgaaccuc

SEQ ID NO: 910525 - RNA, 15 nt, Mycobacterium avium subsp. paratuberculosis
gcaccugcucgaugc

SEQ ID NO: 910526 - RNA, 20 nt, Mycobacterium avium subsp. paratuberculosis
gcaccugcucgaugcgcgcc

SEQ ID NO: 910527 - RNA, 12 nt, Mycobacterium avium subsp. paratuberculosis
gcaccugcgcgc

SEQ ID NO: 910528 - RNA, 12 nt, Mycobacterium avium subsp. paratuberculosis
gcaccucgcccg

SEQ ID NO: 910529 - RNA, 15 nt, Mycobacterium avium subsp. paratuberculosis
gcaccugcagccggu

SEQ ID NO: 910530 - RNA, 18 nt, Mycobacterium avium subsp. paratuberculosis
gcaccugcagccggucgg

SEQ ID NO: 910531 - RNA, 13 nt, Mycobacterium avium subsp. paratuberculosis
gcaccucggccag

SEQ ID NO: 910532 - RNA, 15 nt, Mycobacterium avium subsp. paratuberculosis
gcaccugagucuggg

SEQ ID NO: 910533 - RNA, 22 nt, Mycobacterium avium subsp. paratuberculosis
gcaccugagucugggucacgcu

SEQ ID NO: 910534 - RNA, 22 nt, Mycobacterium avium subsp. paratuberculosis
gcaccugauaggggucggcgaa

SEQ ID NO: 910535 - RNA, 16 nt, Mycobacterium avium subsp. paratuberculosis
gcaccugaucgaugcc

SEQ ID NO: 910536 - RNA, 17 nt, Mycobacterium avium subsp. paratuberculosis
gcaccugaucgaugccg

SEQ ID NO: 910537 - RNA, 21 nt, Mycobacterium avium subsp. paratuberculosis
gcaccugaucgaugccguggu

SEQ ID NO: 910538 - RNA, 17 nt, Mycobacterium avium subsp. paratuberculosis
gcaccuggauccaguuc

SEQ ID NO: 910539 - RNA, 16 nt, Mycobacterium avium subsp. paratuberculosis
gcaccuggcagcaucc

SEQ ID NO: 910540 - RNA, 12 nt, Mycobacterium avium subsp. paratuberculosis
gcaccuggccgu

SEQ ID NO: 910541 - RNA, 16 nt, Mycobacterium avium subsp. paratuberculosis
gcaccuggccgucggu

SEQ ID NO: 910542 - RNA, 21 nt, Mycobacterium avium subsp. paratuberculosis
gcaccuggccgucgguggccg

SEQ ID NO: 910543 - RNA, 21 nt, Mycobacterium avium subsp. paratuberculosis
gcaccugcuuggucuccggcc

SEQ ID NO: 910544 - RNA, 23 nt, Mycobacterium avium subsp. paratuberculosis
gcaccugcuuggucuccggcccc

SEQ ID NO: 910545 - RNA, 16 nt, Mycobacterium avium subsp. paratuberculosis
gcaccuuggucagcuc

SEQ ID NO: 910546 - RNA, 20 nt, Mycobacterium avium subsp. paratuberculosis
gcaccuuggucagcucccgg

SEQ ID NO: 910547 - RNA, 20 nt, Mycobacterium avium subsp. paratuberculosis
gcaccuuggugagcaccgcg

SEQ ID NO: 910548 - RNA, 18 nt, Mycobacterium avium subsp. paratuberculosis
gcacgaagucgaccgcgg

SEQ ID NO: 910549 - RNA, 23 nt, Mycobacterium avium subsp. paratuberculosis
gcacgaagucgaccgcggcuccg

SEQ ID NO: 910550 - RNA, 17 nt, Mycobacterium avium subsp. paratuberculosis
gcacgaauucgguggcg

SEQ ID NO: 910551 - RNA, 22 nt, Mycobacterium avium subsp. paratuberculosis
gcacgaauucgguggcgauggu

SEQ ID NO: 910552 - RNA, 15 nt, Mycobacterium avium subsp. paratuberculosis
gcacgaaggccgccg

SEQ ID NO: 910553 - RNA, 16 nt, Mycobacterium avium subsp. paratuberculosis
gcacgaaggccgccgg

SEQ ID NO: 910554 - RNA, 18 nt, Mycobacterium avium subsp. paratuberculosis
gcacgaccaugucggcga

SEQ ID NO: 910555 - RNA, 16 nt, Mycobacterium avium subsp. paratuberculosis
gcacgaccccgcccac

SEQ ID NO: 910556 - RNA, 18 nt, Mycobacterium avium subsp. paratuberculosis
gcacgaccccgcccacga

SEQ ID NO: 910557 - RNA, 16 nt, Mycobacterium avium subsp. paratuberculosis
gcacgacaccgacgac

SEQ ID NO: 910558 - RNA, 17 nt, Mycobacterium avium subsp. paratuberculosis
gcacgacaccgacgacc

SEQ ID NO: 910559 - RNA, 15 nt, Mycobacterium avium subsp. paratuberculosis
gcacgaccacacccg

SEQ ID NO: 910560 - RNA, 16 nt, Mycobacterium avium subsp. paratuberculosis
gcacgaccacacccgc

SEQ ID NO: 910561 - RNA, 16 nt, Mycobacterium avium subsp. paratuberculosis
gcacgaacagcagcgg

SEQ ID NO: 910562 - RNA, 18 nt, Mycobacterium avium subsp. paratuberculosis
gcacgaacagcagcggga

SEQ ID NO: 910563 - RNA, 19 nt, Mycobacterium avium subsp. paratuberculosis
gcacgaaauaaccgcgcgg

SEQ ID NO: 910564 - RNA, 16 nt, Mycobacterium avium subsp. paratuberculosis
gcacgaaaugcgggcg

SEQ ID NO: 910565 - RNA, 20 nt, Mycobacterium avium subsp. paratuberculosis
gcacgaaaugcgggcgaugg

SEQ ID NO: 910566 - RNA, 16 nt, Mycobacterium avium subsp. paratuberculosis
gcacgaaaccgcgugg

SEQ ID NO: 910567 - RNA, 13 nt, Mycobacterium avium subsp. paratuberculosis
gcacgaacaacug

SEQ ID NO: 910568 - RNA, 15 nt, Mycobacterium avium subsp. paratuberculosis
gcacgaacaccacgu

SEQ ID NO: 910569 - RNA, 22 nt, Mycobacterium avium subsp. paratuberculosis
gcacgaaccgcucgaacacccg

SEQ ID NO: 910570 - RNA, 14 nt, Mycobacterium avium subsp. paratuberculosis
gcacgaacgcggcc

SEQ ID NO: 910571 - RNA, 14 nt, Mycobacterium avium subsp. paratuberculosis
gcacgaacggcacg

SEQ ID NO: 910572 - RNA, 23 nt, Mycobacterium avium subsp. paratuberculosis
gcacgaagaaggcuccgccgaug

SEQ ID NO: 910573 - RNA, 16 nt, Mycobacterium avium subsp. paratuberculosis
gcacgacgaacaccac

SEQ ID NO: 910574 - RNA, 18 nt, Mycobacterium avium subsp. paratuberculosis
gcacgacgaacaccaccg

SEQ ID NO: 910575 - RNA, 20 nt, Mycobacterium avium subsp. paratuberculosis
gcacgacgaacaccaccggc

SEQ ID NO: 910576 - RNA, 17 nt, Mycobacterium avium subsp. paratuberculosis
gcacgacgaccgcgacg

SEQ ID NO: 910577 - RNA, 19 nt, Mycobacterium avium subsp. paratuberculosis
gcacgacgaccgcgacggc

SEQ ID NO: 910578 - RNA, 15 nt, Mycobacterium avium subsp. paratuberculosis
gcacgacgaccgcgu

SEQ ID NO: 910579 - RNA, 17 nt, Mycobacterium avium subsp. paratuberculosis
gcacgacgaccgcgucc

SEQ ID NO: 910580 - RNA, 15 nt, Mycobacterium avium subsp. paratuberculosis
gcacgaccgccagca

SEQ ID NO: 910581 - RNA, 21 nt, Mycobacterium avium subsp. paratuberculosis
gcacgaccgccagcagcagcc

SEQ ID NO: 910582 - RNA, 22 nt, Mycobacterium avium subsp. paratuberculosis
gcacgaccgccagcagcagccg

SEQ ID NO: 910583 - RNA, 13 nt, Mycobacterium avium subsp. paratuberculosis
gcacgcccagccc

SEQ ID NO: 910584 - RNA, 14 nt, Mycobacterium avium subsp. paratuberculosis
gcacgcccagcccg

SEQ ID NO: 910585 - RNA, 15 nt, Mycobacterium avium subsp. paratuberculosis
gcacgcccagcccgc

SEQ ID NO: 910586 - RNA, 19 nt, Mycobacterium avium subsp. paratuberculosis
gcacgcccagcccgcgggc

SEQ ID NO: 910587 - RNA, 14 nt, Mycobacterium avium subsp. paratuberculosis
gcacgacgccgccg

SEQ ID NO: 910588 - RNA, 23 nt, Mycobacterium avium subsp. paratuberculosis
gcacgcccagaucgacgccgacc

SEQ ID NO: 910589 - RNA, 17 nt, Mycobacterium avium subsp. paratuberculosis
gcacgcccagaucgccg

SEQ ID NO: 910590 - RNA, 18 nt, Mycobacterium avium subsp. paratuberculosis
gcacgcccagaucgccga

SEQ ID NO: 910591 - RNA, 19 nt, Mycobacterium avium subsp. paratuberculosis
gcacgcccagaucgccgac

SEQ ID NO: 910592 - RNA, 20 nt, Mycobacterium avium subsp. paratuberculosis
gcacgcccagaucgccgacc

SEQ ID NO: 910593 - RNA, 23 nt, Mycobacterium avium subsp. paratuberculosis
gcacgcccagaucgccgacccgg

SEQ ID NO: 910594 - RNA, 21 nt, Mycobacterium avium subsp. paratuberculosis
gcacgcccgcgaucggcgcca

SEQ ID NO: 910595 - RNA, 21 nt, Mycobacterium avium subsp. paratuberculosis
gcacgcccguucgagcgccgg

SEQ ID NO: 910596 - RNA, 23 nt, Mycobacterium avium subsp. paratuberculosis
gcacgcccguucgagcgccggac

SEQ ID NO: 910597 - RNA, 12 nt, Mycobacterium avium subsp. paratuberculosis
gcacgcccccgc

SEQ ID NO: 910598 - RNA, 17 nt, Mycobacterium avium subsp. paratuberculosis
gcacgcccccgcuggcc

SEQ ID NO: 910599 - RNA, 15 nt, Mycobacterium avium subsp. paratuberculosis
gcacgcccugcggcu

SEQ ID NO: 910600 - RNA, 18 nt, Mycobacterium avium subsp. paratuberculosis
gcacgcucggcgcgacgu

SEQ ID NO: 910601 - RNA, 13 nt, Mycobacterium avium subsp. paratuberculosis
gcacgcucggcgg

SEQ ID NO: 910602 - RNA, 14 nt, Mycobacterium avium subsp. paratuberculosis
gcacgcgcgcccgg

SEQ ID NO: 910603 - RNA, 15 nt, Mycobacterium avium subsp. paratuberculosis
gcacgcgcgcccggc

SEQ ID NO: 910604 - RNA, 19 nt, Mycobacterium avium subsp. paratuberculosis
gcacgcgcgcccggcaccg

SEQ ID NO: 910605 - RNA, 21 nt, Mycobacterium avium subsp. paratuberculosis
gcacgcgcgcccggcaccgcg

SEQ ID NO: 910606 - RNA, 14 nt, Mycobacterium avium subsp. paratuberculosis
gcacgcgcgccgga

SEQ ID NO: 910607 - RNA, 13 nt, Mycobacterium avium subsp. paratuberculosis
gcacgcucgcggu

SEQ ID NO: 910608 - RNA, 17 nt, Mycobacterium avium subsp. paratuberculosis
gcacgcucgcggugcgc

SEQ ID NO: 910609 - RNA, 21 nt, Mycobacterium avium subsp. paratuberculosis
gcacgcucgcggugcgcgcgc

SEQ ID NO: 910610 - RNA, 19 nt, Mycobacterium avium subsp. paratuberculosis
gcacgccuuccacgaccug

SEQ ID NO: 910611 - RNA, 21 nt, Mycobacterium avium subsp. paratuberculosis
gcacgccuuccacgaccuggc

SEQ ID NO: 910612 - RNA, 22 nt, Mycobacterium avium subsp. paratuberculosis
gcacgcgaacaccagaugccgc

SEQ ID NO: 910613 - RNA, 22 nt, Mycobacterium avium subsp. paratuberculosis
gcacgcgaccgcgucgacggcg

SEQ ID NO: 910614 - RNA, 23 nt, Mycobacterium avium subsp. paratuberculosis
gcacgcgaccgcgucgacggcgu

SEQ ID NO: 910615 - RNA, 18 nt, Mycobacterium avium subsp. paratuberculosis
gcacgcgagacgagccgc

SEQ ID NO: 910616 - RNA, 22 nt, Mycobacterium avium subsp. paratuberculosis
gcacgcgagacgagccgccgcg

SEQ ID NO: 910617 - RNA, 14 nt, Mycobacterium avium subsp. paratuberculosis
gcacgccguggcgg

SEQ ID NO: 910618 - RNA, 19 nt, Mycobacterium avium subsp. paratuberculosis
gcacgccguggcggcgggc

SEQ ID NO: 910619 - RNA, 20 nt, Mycobacterium avium subsp. paratuberculosis
gcacgccguggcggcgggcc

SEQ ID NO: 910620 - RNA, 19 nt, Mycobacterium avium subsp. paratuberculosis
gcacgccguugaccccgac

SEQ ID NO: 910621 - RNA, 22 nt, Mycobacterium avium subsp. paratuberculosis
gcacgccguugaccccgacggc

SEQ ID NO: 910622 - RNA, 14 nt, Mycobacterium avium subsp. paratuberculosis
gcacgcccaugauc

SEQ ID NO: 910623 - RNA, 22 nt, Mycobacterium avium subsp. paratuberculosis
gcacgccgaccacccccagccc

SEQ ID NO: 910624 - RNA, 15 nt, Mycobacterium avium subsp. paratuberculosis
gcacgccgucgugcu

SEQ ID NO: 910625 - RNA, 18 nt, Mycobacterium avium subsp. paratuberculosis
gcacgccgucgugcucgg

SEQ ID NO: 910626 - RNA, 20 nt, Mycobacterium avium subsp. paratuberculosis
gcacgccgucgugcucggcg

SEQ ID NO: 910627 - RNA, 22 nt, Mycobacterium avium subsp. paratuberculosis
gcacgccgucgugcucggcgag

SEQ ID NO: 910628 - RNA, 18 nt, Mycobacterium avium subsp. paratuberculosis
gcacgcugaagcacaccg

SEQ ID NO: 910629 - RNA, 19 nt, Mycobacterium avium subsp. paratuberculosis
gcacgcugaagcacaccgu

SEQ ID NO: 910630 - RNA, 20 nt, Mycobacterium avium subsp. paratuberculosis
gcacgcugaagcccaccgcc

SEQ ID NO: 910631 - RNA, 22 nt, Mycobacterium avium subsp. paratuberculosis
gcacgcugaucaccacggucag

SEQ ID NO: 910632 - RNA, 18 nt, Mycobacterium avium subsp. paratuberculosis
gcacgcugcgccagccgu

SEQ ID NO: 910633 - RNA, 17 nt, Mycobacterium avium subsp. paratuberculosis
gcacgcugcgcacccgg

SEQ ID NO: 910634 - RNA, 21 nt, Mycobacterium avium subsp. paratuberculosis
gcacgcugcgcacccgguccg

SEQ ID NO: 910635 - RNA, 17 nt, Mycobacterium avium subsp. paratuberculosis
gcacgcuggccggcagc

SEQ ID NO: 910636 - RNA, 19 nt, Mycobacterium avium subsp. paratuberculosis
gcacgcuggccggcagcgu

SEQ ID NO: 910637 - RNA, 23 nt, Mycobacterium avium subsp. paratuberculosis
gcacgcugcuggucuugccgugc

SEQ ID NO: 910638 - RNA, 18 nt, Mycobacterium avium subsp. paratuberculosis
gcacgcugcggaugucgg

SEQ ID NO: 910639 - RNA, 16 nt, Mycobacterium avium subsp. paratuberculosis
gcacggcagcccgacg

SEQ ID NO: 910640 - RNA, 21 nt, Mycobacterium avium subsp. paratuberculosis
gcacggcaaugguugcggcgg

SEQ ID NO: 910641 - RNA, 15 nt, Mycobacterium avium subsp. paratuberculosis
gcacggcacgcccgu

SEQ ID NO: 910642 - RNA, 22 nt, Mycobacterium avium subsp. paratuberculosis
gcacggccaacugcaucgccag

SEQ ID NO: 910643 - RNA, 15 nt, Mycobacterium avium subsp. paratuberculosis
gcacggccaccagca

SEQ ID NO: 910644 - RNA, 16 nt, Mycobacterium avium subsp. paratuberculosis
gcacggccaccagcag

SEQ ID NO: 910645 - RNA, 19 nt, Mycobacterium avium subsp. paratuberculosis
gcacggccaccagcagcga

SEQ ID NO: 910646 - RNA, 17 nt, Mycobacterium avium subsp. paratuberculosis
gcacggccacugccccg

SEQ ID NO: 910647 - RNA, 20 nt, Mycobacterium avium subsp. paratuberculosis
gcacggccacugccccggcg

SEQ ID NO: 910648 - RNA, 19 nt, Mycobacterium avium subsp. paratuberculosis
gcacggccagccagccgcc

SEQ ID NO: 910649 - RNA, 23 nt, Mycobacterium avium subsp. paratuberculosis
gcacggccagccagccgcccagc

SEQ ID NO: 910650 - RNA, 22 nt, Mycobacterium avium subsp. paratuberculosis
gcacggcccgcucgggccauga

SEQ ID NO: 910651 - RNA, 16 nt, Mycobacterium avium subsp. paratuberculosis
gcacggcccaucacca

SEQ ID NO: 910652 - RNA, 20 nt, Mycobacterium avium subsp. paratuberculosis
gcacggcgauguaggacgcc

SEQ ID NO: 910653 - RNA, 17 nt, Mycobacterium avium subsp. paratuberculosis
gcacggcgccaccagcc

SEQ ID NO: 910654 - RNA, 14 nt, Mycobacterium avium subsp. paratuberculosis
gcacggcgcccagg

SEQ ID NO: 910655 - RNA, 16 nt, Mycobacterium avium subsp. paratuberculosis
gcacggcgcccagguc

SEQ ID NO: 910656 - RNA, 13 nt, Mycobacterium avium subsp. paratuberculosis
gcacggcgccgug

SEQ ID NO: 910657 - RNA, 22 nt, Mycobacterium avium subsp. paratuberculosis
gcacggcgccgugccgcgcggc

SEQ ID NO: 910658 - RNA, 23 nt, Mycobacterium avium subsp. paratuberculosis
gcacggcgccgugccgcgcggcg

SEQ ID NO: 910659 - RNA, 17 nt, Mycobacterium avium subsp. paratuberculosis
gcacggcgcgcaccgcg

SEQ ID NO: 910660 - RNA, 13 nt, Mycobacterium avium subsp. paratuberculosis
gcacgggcggcgg

SEQ ID NO: 910661 - RNA, 13 nt, Mycobacterium avium subsp. paratuberculosis
gcacgggcgggca

SEQ ID NO: 910662 - RNA, 20 nt, Mycobacterium avium subsp. paratuberculosis
gcacggccucggucacgguc

SEQ ID NO: 910663 - RNA, 14 nt, Mycobacterium avium subsp. paratuberculosis
gcacggcgaccagc

SEQ ID NO: 910664 - RNA, 15 nt, Mycobacterium avium subsp. paratuberculosis
gcacggcgaccagcg

SEQ ID NO: 910665 - RNA, 16 nt, Mycobacterium avium subsp. paratuberculosis
gcacggcgaccagcga

SEQ ID NO: 910666 - RNA, 19 nt, Mycobacterium avium subsp. paratuberculosis
gcacggcgaccagcgagcc

SEQ ID NO: 910667 - RNA, 15 nt, Mycobacterium avium subsp. paratuberculosis
gcacggccggccggc

SEQ ID NO: 910668 - RNA, 16 nt, Mycobacterium avium subsp. paratuberculosis
gcacggccgccaggau

SEQ ID NO: 910669 - RNA, 11 nt, Mycobacterium avium subsp. paratuberculosis
gcacggccgcg

SEQ ID NO: 910670 - RNA, 17 nt, Mycobacterium avium subsp. paratuberculosis
gcacggccgcggccagc

SEQ ID NO: 910671 - RNA, 19 nt, Mycobacterium avium subsp. paratuberculosis
gcacggccgcggccagcga

SEQ ID NO: 910672 - RNA, 20 nt, Mycobacterium avium subsp. paratuberculosis
gcacggccgcggccagcgag

SEQ ID NO: 910673 - RNA, 20 nt, Mycobacterium avium subsp. paratuberculosis
gcacuggucgugcuggagcg

SEQ ID NO: 910674 - RNA, 23 nt, Mycobacterium avium subsp. paratuberculosis
gcacuucgaucaucuccacccgg

SEQ ID NO: 910675 - RNA, 16 nt, Mycobacterium avium subsp. paratuberculosis
gcacuucgcgggcggc

SEQ ID NO: 910676 - RNA, 18 nt, Mycobacterium avium subsp. paratuberculosis
gcacuucgcgggcggcgc

SEQ ID NO: 910677 - RNA, 20 nt, Mycobacterium avium subsp. paratuberculosis
gcacucucgcggcaaggcgc

SEQ ID NO: 910678 - RNA, 21 nt, Mycobacterium avium subsp. paratuberculosis
gcacucucgcggcaaggcgca

SEQ ID NO: 910679 - RNA, 17 nt, Mycobacterium avium subsp. paratuberculosis
gcacugccgacccggcg

SEQ ID NO: 910680 - RNA, 18 nt, Mycobacterium avium subsp. paratuberculosis
gcacugcugcccgcgacg

SEQ ID NO: 910681 - RNA, 19 nt, Mycobacterium avium subsp. paratuberculosis
gcacugcugcccgcgacgg

SEQ ID NO: 910682 - RNA, 22 nt, Mycobacterium avium subsp. paratuberculosis
gcacugcugcccgcgacggcga

SEQ ID NO: 910683 - RNA, 16 nt, Mycobacterium avium subsp. paratuberculosis
gcacggucagcggcca

SEQ ID NO: 910684 - RNA, 14 nt, Mycobacterium avium subsp. paratuberculosis
gcacggggacgucg

SEQ ID NO: 910685 - RNA, 15 nt, Mycobacterium avium subsp. paratuberculosis
gcacggggacgucgu

SEQ ID NO: 910686 - RNA, 22 nt, Mycobacterium avium subsp. paratuberculosis
gcacggcgaacggccgcgaugu

SEQ ID NO: 910687 - RNA, 14 nt, Mycobacterium avium subsp. paratuberculosis
gcacggucgcggug

SEQ ID NO: 910688 - RNA, 21 nt, Mycobacterium avium subsp. paratuberculosis
gcacggucgcggugucggcgu

SEQ ID NO: 910689 - RNA, 23 nt, Mycobacterium avium subsp. paratuberculosis
gcacggucgcggugucggcgucg

SEQ ID NO: 910690 - RNA, 21 nt, Mycobacterium avium subsp. paratuberculosis
gcacggucggccccgcgcauc

SEQ ID NO: 910691 - RNA, 23 nt, Mycobacterium avium subsp. paratuberculosis
gcacggucggccccgcgcaucgg

SEQ ID NO: 910692 - RNA, 21 nt, Mycobacterium avium subsp. paratuberculosis
gcacggucccguccaucgccg

SEQ ID NO: 910693 - RNA, 17 nt, Mycobacterium avium subsp. paratuberculosis
gcacgugcaggugcggc

SEQ ID NO: 910694 - RNA, 16 nt, Mycobacterium avium subsp. paratuberculosis
gcacgugcccagcccg

SEQ ID NO: 910695 - RNA, 23 nt, Mycobacterium avium subsp. paratuberculosis
gcacgugcccagcccgcgcgagc

SEQ ID NO: 910696 - RNA, 17 nt, Mycobacterium avium subsp. paratuberculosis
gcacguggccgggcucg

SEQ ID NO: 910697 - RNA, 14 nt, Mycobacterium avium subsp. paratuberculosis
gcacgugcgcgccg

SEQ ID NO: 910698 - RNA, 17 nt, Mycobacterium avium subsp. paratuberculosis
gcacgugcgcgccgacc

SEQ ID NO: 910699 - RNA, 18 nt, Mycobacterium avium subsp. paratuberculosis
gcacgugcgcgccgaccg

SEQ ID NO: 910700 - RNA, 19 nt, Mycobacterium avium subsp. paratuberculosis
gcacgugcgcgccgaccgc

SEQ ID NO: 910701 - RNA, 17 nt, Mycobacterium avium subsp. paratuberculosis
gcacgugcggguuggcg

SEQ ID NO: 910702 - RNA, 20 nt, Mycobacterium avium subsp. paratuberculosis
gcacgugcggguuggcgccg

SEQ ID NO: 910703 - RNA, 15 nt, Mycobacterium avium subsp. paratuberculosis
gcacgugcaccgcgg

SEQ ID NO: 910704 - RNA, 18 nt, Mycobacterium avium subsp. paratuberculosis
gcacgugcaccgcggcca

SEQ ID NO: 910705 - RNA, 21 nt, Mycobacterium avium subsp. paratuberculosis
gcacggucugguggcagcgga

SEQ ID NO: 910706 - RNA, 21 nt, Mycobacterium avium subsp. paratuberculosis
gcacggugaacuccgggccca

SEQ ID NO: 910707 - RNA, 23 nt, Mycobacterium avium subsp. paratuberculosis
gcacgugaugagcgaggacgucg

SEQ ID NO: 910708 - RNA, 14 nt, Mycobacterium avium subsp. paratuberculosis
gcacgugaugcagc

SEQ ID NO: 910709 - RNA, 17 nt, Mycobacterium avium subsp. paratuberculosis
gcacgugaugcagcuga

SEQ ID NO: 910710 - RNA, 24 nt, Mycobacterium avium subsp. paratuberculosis
gcacgugguguugaucauccggcg

SEQ ID NO: 910711 - RNA, 22 nt, Mycobacterium avium subsp. paratuberculosis
gcacguguccgacgccgucgag

SEQ ID NO: 910712 - RNA, 16 nt, Mycobacterium avium subsp. paratuberculosis
gcacguguucgggauc

SEQ ID NO: 910713 - RNA, 17 nt, Mycobacterium avium subsp. paratuberculosis
gcacguguucgggaucg

SEQ ID NO: 910714 - RNA, 20 nt, Mycobacterium avium subsp. paratuberculosis
gcacguguucgggaucggcg

SEQ ID NO: 910715 - RNA, 22 nt, Mycobacterium avium subsp. paratuberculosis
gcacguguucgggaucggcgcc

SEQ ID NO: 910716 - RNA, 20 nt, Mycobacterium avium subsp. paratuberculosis
gcacguguucucacggcgaa

SEQ ID NO: 910717 - RNA, 15 nt, Mycobacterium avium subsp. paratuberculosis
gcacguugcccagga

SEQ ID NO: 910718 - RNA, 16 nt, Mycobacterium avium subsp. paratuberculosis
gcacguuggcggccag

SEQ ID NO: 910719 - RNA, 17 nt, Mycobacterium avium subsp. paratuberculosis
gcacguuggcggccagc

SEQ ID NO: 910720 - RNA, 19 nt, Mycobacterium avium subsp. paratuberculosis
gcacguuggcggccagcgc

SEQ ID NO: 910721 - RNA, 20 nt, Mycobacterium avium subsp. paratuberculosis
gcacguuggcggccagcgcg

SEQ ID NO: 910722 - RNA, 21 nt, Mycobacterium avium subsp. paratuberculosis
gcacguuggcggccagcgcgc

SEQ ID NO: 910723 - RNA, 15 nt, Mycobacterium avium subsp. paratuberculosis
gcacucgguguggcc

SEQ ID NO: 910724 - RNA, 14 nt, Mycobacterium avium subsp. paratuberculosis
gcacucgucguggc

SEQ ID NO: 910725 - RNA, 16 nt, Mycobacterium avium subsp. paratuberculosis
gcacuaccgccucgcc

SEQ ID NO: 910726 - RNA, 19 nt, Mycobacterium avium subsp. paratuberculosis
gcacuaccgccucgccagc

SEQ ID NO: 910727 - RNA, 18 nt, Mycobacterium avium subsp. paratuberculosis
gcacuagguccggcgcga

SEQ ID NO: 910728 - RNA, 20 nt, Mycobacterium avium subsp. paratuberculosis
gcacuagguccggcgcgacc

SEQ ID NO: 910729 - RNA, 23 nt, Mycobacterium avium subsp. paratuberculosis
gcacguggcugaccgacggcgac

SEQ ID NO: 910730 - RNA, 18 nt, Mycobacterium avium subsp. paratuberculosis
gcacguugugggcgggcg

SEQ ID NO: 910731 - RNA, 17 nt, Mycobacterium avium subsp. paratuberculosis
gcacguuguucaggucg

SEQ ID NO: 910732 - RNA, 21 nt, Mycobacterium avium subsp. paratuberculosis
gcacguuguucaggucgaugg

SEQ ID NO: 910733 - RNA, 14 nt, Mycobacterium avium subsp. paratuberculosis
gcaagucggcggug

SEQ ID NO: 910734 - RNA, 22 nt, Mycobacterium avium subsp. paratuberculosis
gcaagucggcggugaugcgcgc

SEQ ID NO: 910735 - RNA, 23 nt, Mycobacterium avium subsp. paratuberculosis
gcaagggcuugggcgcgaucggc

SEQ ID NO: 910736 - RNA, 14 nt, Mycobacterium avium subsp. paratuberculosis
gcaaggucgucgcg

SEQ ID NO: 910737 - RNA, 15 nt, Mycobacterium avium subsp. paratuberculosis
gcaaucaggcggucg

SEQ ID NO: 910738 - RNA, 16 nt, Mycobacterium avium subsp. paratuberculosis
gcaaucaggcggucga

SEQ ID NO: 910739 - RNA, 20 nt, Mycobacterium avium subsp. paratuberculosis
gcaaucaggcggucgaacgc

SEQ ID NO: 910740 - RNA, 19 nt, Mycobacterium avium subsp. paratuberculosis
gcaauccggccccgcugcc

SEQ ID NO: 910741 - RNA, 13 nt, Mycobacterium avium subsp. paratuberculosis
gcaaucucgucgg

SEQ ID NO: 910742 - RNA, 20 nt, Mycobacterium avium subsp. paratuberculosis
gcaauccgcugaacgggcag

SEQ ID NO: 910743 - RNA, 20 nt, Mycobacterium avium subsp. paratuberculosis
gcacaccaccgacgcgucgc

SEQ ID NO: 910744 - RNA, 16 nt, Mycobacterium avium subsp. paratuberculosis
gcacacagcgugaccc

SEQ ID NO: 910745 - RNA, 16 nt, Mycobacterium avium subsp. paratuberculosis
gcacaccagcacggcg

SEQ ID NO: 910746 - RNA, 19 nt, Mycobacterium avium subsp. paratuberculosis
gcacaccagcacggcggcg

SEQ ID NO: 910747 - RNA, 17 nt, Mycobacterium avium subsp. paratuberculosis
gcacaauccggucagcg

SEQ ID NO: 910748 - RNA, 15 nt, Mycobacterium avium subsp. paratuberculosis
gcaaugaugucggcg

SEQ ID NO: 910749 - RNA, 20 nt, Mycobacterium avium subsp. paratuberculosis
gcaagaacccgaacgcgucg

SEQ ID NO: 910750 - RNA, 15 nt, Mycobacterium avium subsp. paratuberculosis
gcaagaagucggugu

SEQ ID NO: 910751 - RNA, 14 nt, Mycobacterium avium subsp. paratuberculosis
gcaagaugugggcg

SEQ ID NO: 910752 - RNA, 15 nt, Mycobacterium avium subsp. paratuberculosis
gcaagcagcggcagc

SEQ ID NO: 910753 - RNA, 16 nt, Mycobacterium avium subsp. paratuberculosis
gcaagcagcggcagcc

SEQ ID NO: 910754 - RNA, 15 nt, Mycobacterium avium subsp. paratuberculosis
gcaagcagagcagcg

SEQ ID NO: 910755 - RNA, 13 nt, Mycobacterium avium subsp. paratuberculosis
gcaagcaccggcu

SEQ ID NO: 910756 - RNA, 14 nt, Mycobacterium avium subsp. paratuberculosis
gcaagcaccggcug

SEQ ID NO: 910757 - RNA, 18 nt, Mycobacterium avium subsp. paratuberculosis
gcaagcaccggcuggccg

SEQ ID NO: 910758 - RNA, 21 nt, Mycobacterium avium subsp. paratuberculosis
gcaacuugcccgacggcgucu

SEQ ID NO: 910759 - RNA, 17 nt, Mycobacterium avium subsp. paratuberculosis
gcaacuguucgcggcug

SEQ ID NO: 910760 - RNA, 21 nt, Mycobacterium avium subsp. paratuberculosis
gcaacuguucgcggcuggccg

SEQ ID NO: 910761 - RNA, 15 nt, Mycobacterium avium subsp. paratuberculosis
gcaacugggcggccu

SEQ ID NO: 910762 - RNA, 20 nt, Mycobacterium avium subsp. paratuberculosis
gcaacugggugagcaacagc

SEQ ID NO: 910763 - RNA, 23 nt, Mycobacterium avium subsp. paratuberculosis
gcaacugcucgaccagcccccgc

SEQ ID NO: 910764 - RNA, 14 nt, Mycobacterium avium subsp. paratuberculosis
gcaacuggucgugc

SEQ ID NO: 910765 - RNA, 20 nt, Mycobacterium avium subsp. paratuberculosis
gcaacuggucgugcagcacc

SEQ ID NO: 910766 - RNA, 21 nt, Mycobacterium avium subsp. paratuberculosis
gcaacuggucgugcagcaccg

SEQ ID NO: 910767 - RNA, 17 nt, Mycobacterium avium subsp. paratuberculosis
gcaacucguccagcguc

SEQ ID NO: 910768 - RNA, 15 nt, Mycobacterium avium subsp. paratuberculosis
gcaacucccgcgccg

SEQ ID NO: 910769 - RNA, 16 nt, Mycobacterium avium subsp. paratuberculosis
gcaacucccgcgccgc

SEQ ID NO: 910770 - RNA, 17 nt, Mycobacterium avium subsp. paratuberculosis
gcaacucccgcgccgcg

SEQ ID NO: 910771 - RNA, 18 nt, Mycobacterium avium subsp. paratuberculosis
gcaacucccgcgccgcgg

SEQ ID NO: 910772 - RNA, 19 nt, Mycobacterium avium subsp. paratuberculosis
gcaagggcaaagacgacgg

SEQ ID NO: 910773 - RNA, 21 nt, Mycobacterium avium subsp. paratuberculosis
gcaagggccgacaucgucggc

SEQ ID NO: 910774 - RNA, 19 nt, Mycobacterium avium subsp. paratuberculosis
gcaaggcgagcacggcacg

SEQ ID NO: 910775 - RNA, 23 nt, Mycobacterium avium subsp. paratuberculosis
gcaaggcccccgccucgccgguc

SEQ ID NO: 910776 - RNA, 15 nt, Mycobacterium avium subsp. paratuberculosis
gcaaggccagcaacc

SEQ ID NO: 910777 - RNA, 19 nt, Mycobacterium avium subsp. paratuberculosis
gcaagcugauucgggauca

SEQ ID NO: 910778 - RNA, 15 nt, Mycobacterium avium subsp. paratuberculosis
gcaagcucgccagga

SEQ ID NO: 910779 - RNA, 19 nt, Mycobacterium avium subsp. paratuberculosis
gcaagcccuuuggcggcca

SEQ ID NO: 910780 - RNA, 14 nt, Mycobacterium avium subsp. paratuberculosis
gcaaccacagcggc

SEQ ID NO: 910781 - RNA, 14 nt, Mycobacterium avium subsp. paratuberculosis
gcaaccaacucgcg

SEQ ID NO: 910782 - RNA, 18 nt, Mycobacterium avium subsp. paratuberculosis
gcaaccacuuucgcgagc

SEQ ID NO: 910783 - RNA, 22 nt, Mycobacterium avium subsp. paratuberculosis
gcaaccacuuucgcgagcgcgc

SEQ ID NO: 910784 - RNA, 21 nt, Mycobacterium avium subsp. paratuberculosis
gcaaccagugcacgcucggcg

SEQ ID NO: 910785 - RNA, 22 nt, Mycobacterium avium subsp. paratuberculosis
gcaacccgaaagcccccagcuc

SEQ ID NO: 910786 - RNA, 20 nt, Mycobacterium avium subsp. paratuberculosis
gcaacccgaccucgucgacg

SEQ ID NO: 910787 - RNA, 23 nt, Mycobacterium avium subsp. paratuberculosis
gcaacccgaccucgucgacggcg

SEQ ID NO: 910788 - RNA, 14 nt, Mycobacterium avium subsp. paratuberculosis
gcaacccgccgagc

SEQ ID NO: 910789 - RNA, 16 nt, Mycobacterium avium subsp. paratuberculosis
gcaaccgccacgacgc

SEQ ID NO: 910790 - RNA, 19 nt, Mycobacterium avium subsp. paratuberculosis
gcaaccgccacgacgcggc

SEQ ID NO: 910791 - RNA, 20 nt, Mycobacterium avium subsp. paratuberculosis
gcaaccgccacgacgcggcg

SEQ ID NO: 910792 - RNA, 16 nt, Mycobacterium avium subsp. paratuberculosis
gcaaccgaaucgagcc

SEQ ID NO: 910793 - RNA, 13 nt, Mycobacterium avium subsp. paratuberculosis
gcaaccggcggcu

SEQ ID NO: 910794 - RNA, 19 nt, Mycobacterium avium subsp. paratuberculosis
gcaaccgggauaccgcgac

SEQ ID NO: 910795 - RNA, 21 nt, Mycobacterium avium subsp. paratuberculosis
gcaaccgggauaccgcgaccg

SEQ ID NO: 910796 - RNA, 21 nt, Mycobacterium avium subsp. paratuberculosis
gcaaccggaauggcagcagcc

SEQ ID NO: 910797 - RNA, 12 nt, Mycobacterium avium subsp. paratuberculosis
gcaaccgccggc

SEQ ID NO: 910798 - RNA, 18 nt, Mycobacterium avium subsp. paratuberculosis
gcaaccgccggcagcggc

SEQ ID NO: 910799 - RNA, 19 nt, Mycobacterium avium subsp. paratuberculosis
gcaaccgccggcagcggcu

SEQ ID NO: 910800 - RNA, 21 nt, Mycobacterium avium subsp. paratuberculosis
gcaaccgccggcagcggcugc

SEQ ID NO: 910801 - RNA, 12 nt, Mycobacterium avium subsp. paratuberculosis
gcaaccgccgug

SEQ ID NO: 910802 - RNA, 22 nt, Mycobacterium avium subsp. paratuberculosis
gcaaccgcgaaaacagcgacca

SEQ ID NO: 910803 - RNA, 15 nt, Mycobacterium avium subsp. paratuberculosis
gcaaccgcggcggcg

SEQ ID NO: 910804 - RNA, 18 nt, Mycobacterium avium subsp. paratuberculosis
gcaaccgcggcggcggcc

SEQ ID NO: 910805 - RNA, 18 nt, Mycobacterium avium subsp. paratuberculosis
gcaacacaugguccugca

SEQ ID NO: 910806 - RNA, 21 nt, Mycobacterium avium subsp. paratuberculosis
gcaacaccaccuugguggccg

SEQ ID NO: 910807 - RNA, 16 nt, Mycobacterium avium subsp. paratuberculosis
gcaacaccacgucggu

SEQ ID NO: 910808 - RNA, 19 nt, Mycobacterium avium subsp. paratuberculosis
gcaacaccacgucggugcc

SEQ ID NO: 910809 - RNA, 20 nt, Mycobacterium avium subsp. paratuberculosis
gcaacaccagggugcgcagc

SEQ ID NO: 910810 - RNA, 22 nt, Mycobacterium avium subsp. paratuberculosis
gcaacaccggauuucgccagug

SEQ ID NO: 910811 - RNA, 15 nt, Mycobacterium avium subsp. paratuberculosis
gcaacaccggcggcg

SEQ ID NO: 910812 - RNA, 17 nt, Mycobacterium avium subsp. paratuberculosis
gcaacacgucguccggc

SEQ ID NO: 910813 - RNA, 18 nt, Mycobacterium avium subsp. paratuberculosis
gcaacacgucguccggcg

SEQ ID NO: 910814 - RNA, 23 nt, Mycobacterium avium subsp. paratuberculosis
gcaacacguugagucccucggcg

SEQ ID NO: 910815 - RNA, 17 nt, Mycobacterium avium subsp. paratuberculosis
gcaacaccuuucggccg

SEQ ID NO: 910816 - RNA, 17 nt, Mycobacterium avium subsp. paratuberculosis
gcaacagcaccagcacc

SEQ ID NO: 910817 - RNA, 23 nt, Mycobacterium avium subsp. paratuberculosis
gcaacagcaccucgucgcccggc

SEQ ID NO: 910818 - RNA, 14 nt, Mycobacterium avium subsp. paratuberculosis
gcaacacgaccagg

SEQ ID NO: 910819 - RNA, 14 nt, Mycobacterium avium subsp. paratuberculosis
gcaacacgccggcg

SEQ ID NO: 910820 - RNA, 17 nt, Mycobacterium avium subsp. paratuberculosis
gcaacacgccggcggcc

SEQ ID NO: 910821 - RNA, 18 nt, Mycobacterium avium subsp. paratuberculosis
gcaacacgccggcggcca

SEQ ID NO: 910822 - RNA, 15 nt, Mycobacterium avium subsp. paratuberculosis
gcaacacggccucga

SEQ ID NO: 910823 - RNA, 13 nt, Mycobacterium avium subsp. paratuberculosis
gcaacacgccggc

SEQ ID NO: 910824 - RNA, 18 nt, Mycobacterium avium subsp. paratuberculosis
gcaacacguagucgccga

SEQ ID NO: 910825 - RNA, 12 nt, Mycobacterium avium subsp. paratuberculosis
gcaacagcgcgc

SEQ ID NO: 910826 - RNA, 16 nt, Mycobacterium avium subsp. paratuberculosis
gcaacagcgcgccggc

SEQ ID NO: 910827 - RNA, 18 nt, Mycobacterium avium subsp. paratuberculosis
gcaacagcgcgccggccg

SEQ ID NO: 910828 - RNA, 21 nt, Mycobacterium avium subsp. paratuberculosis
gcaacagcauuucgcgcggca

SEQ ID NO: 910829 - RNA, 17 nt, Mycobacterium avium subsp. paratuberculosis
gcaacagcccgaccguc

SEQ ID NO: 910830 - RNA, 15 nt, Mycobacterium avium subsp. paratuberculosis
gcaacagccggcccg

SEQ ID NO: 910831 - RNA, 18 nt, Mycobacterium avium subsp. paratuberculosis
gcaacagccggcccgagc

SEQ ID NO: 910832 - RNA, 19 nt, Mycobacterium avium subsp. paratuberculosis
gcaacagguuucgcucguc

SEQ ID NO: 910833 - RNA, 21 nt, Mycobacterium avium subsp. paratuberculosis
gcaacagguuucgcucgucgg

SEQ ID NO: 910834 - RNA, 22 nt, Mycobacterium avium subsp. paratuberculosis
gcaacagguuucgcucgucggc

SEQ ID NO: 910835 - RNA, 23 nt, Mycobacterium avium subsp. paratuberculosis
gcaacagguuucgcucgucggcg

SEQ ID NO: 910836 - RNA, 14 nt, Mycobacterium avium subsp. paratuberculosis
gcaacagggccacc

SEQ ID NO: 910837 - RNA, 20 nt, Mycobacterium avium subsp. paratuberculosis
gcaacagggccaccgcguag

SEQ ID NO: 910838 - RNA, 19 nt, Mycobacterium avium subsp. paratuberculosis
gcaacagcgucucgacggc

SEQ ID NO: 910839 - RNA, 21 nt, Mycobacterium avium subsp. paratuberculosis
gcaacagcgugcacacccgca

SEQ ID NO: 910840 - RNA, 18 nt, Mycobacterium avium subsp. paratuberculosis
gcaacaugauuccgccgg

SEQ ID NO: 910841 - RNA, 22 nt, Mycobacterium avium subsp. paratuberculosis
gcaacaugauuccgccgggcgg

SEQ ID NO: 910842 - RNA, 21 nt, Mycobacterium avium subsp. paratuberculosis
gcaacauccugguccggcgcc

SEQ ID NO: 910843 - RNA, 15 nt, Mycobacterium avium subsp. paratuberculosis
gcaacgacauccaga

SEQ ID NO: 910844 - RNA, 16 nt, Mycobacterium avium subsp. paratuberculosis
gcaacgacauccagau

SEQ ID NO: 910845 - RNA, 16 nt, Mycobacterium avium subsp. paratuberculosis
gcaacgacccggccac

SEQ ID NO: 910846 - RNA, 14 nt, Mycobacterium avium subsp. paratuberculosis
gcaacgacgaaguc

SEQ ID NO: 910847 - RNA, 16 nt, Mycobacterium avium subsp. paratuberculosis
gcaacgacgaagucgg

SEQ ID NO: 910848 - RNA, 16 nt, Mycobacterium avium subsp. paratuberculosis
gcaaccugggcggcgg

SEQ ID NO: 910849 - RNA, 18 nt, Mycobacterium avium subsp. paratuberculosis
gcaaccugggcggcggcg

SEQ ID NO: 910850 - RNA, 20 nt, Mycobacterium avium subsp. paratuberculosis
gcaaccuucuuggccggagc

SEQ ID NO: 910851 - RNA, 22 nt, Mycobacterium avium subsp. paratuberculosis
gcaaccucuucggggguggcca

SEQ ID NO: 910852 - RNA, 16 nt, Mycobacterium avium subsp. paratuberculosis
gcaaccguucaacggc

SEQ ID NO: 910853 - RNA, 18 nt, Mycobacterium avium subsp. paratuberculosis
gcaaccgguucggacacg

SEQ ID NO: 910854 - RNA, 21 nt, Mycobacterium avium subsp. paratuberculosis
gcaaccgguucggacacggcg

SEQ ID NO: 910855 - RNA, 15 nt, Mycobacterium avium subsp. paratuberculosis
gcaaccgguccaguc

SEQ ID NO: 910856 - RNA, 16 nt, Mycobacterium avium subsp. paratuberculosis
gcaaccgguccgccgu

SEQ ID NO: 910857 - RNA, 17 nt, Mycobacterium avium subsp. paratuberculosis
gcaacgaggccagggcc

SEQ ID NO: 910858 - RNA, 21 nt, Mycobacterium avium subsp. paratuberculosis
gcaacgaggccagggcccgca

SEQ ID NO: 910859 - RNA, 20 nt, Mycobacterium avium subsp. paratuberculosis
gcaacgauucacccagcgag

SEQ ID NO: 910860 - RNA, 22 nt, Mycobacterium avium subsp. paratuberculosis
gcaacgauucacccagcgagcu

SEQ ID NO: 910861 - RNA, 17 nt, Mycobacterium avium subsp. paratuberculosis
gcaacgccagcgcgacc

SEQ ID NO: 910862 - RNA, 22 nt, Mycobacterium avium subsp. paratuberculosis
gcaacgccagggccccguuggu

SEQ ID NO: 910863 - RNA, 14 nt, Mycobacterium avium subsp. paratuberculosis
gcaacgccgccgac

SEQ ID NO: 910864 - RNA, 17 nt, Mycobacterium avium subsp. paratuberculosis
gcaacgccgccgacagc

SEQ ID NO: 910865 - RNA, 14 nt, Mycobacterium avium subsp. paratuberculosis
gcaacgccggcgug

SEQ ID NO: 910866 - RNA, 16 nt, Mycobacterium avium subsp. paratuberculosis
gcaacggcggcggcac

SEQ ID NO: 910867 - RNA, 18 nt, Mycobacterium avium subsp. paratuberculosis
gcaacggcggucgugcgg

SEQ ID NO: 910868 - RNA, 15 nt, Mycobacterium avium subsp. paratuberculosis
gcaacggcgucgaca

SEQ ID NO: 910869 - RNA, 22 nt, Mycobacterium avium subsp. paratuberculosis
gcaacgcgucggcgccggaucg

SEQ ID NO: 910870 - RNA, 14 nt, Mycobacterium avium subsp. paratuberculosis
gcaacgcugaccgc

SEQ ID NO: 910871 - RNA, 13 nt, Mycobacterium avium subsp. paratuberculosis
gcaacggccauga

SEQ ID NO: 910872 - RNA, 23 nt, Mycobacterium avium subsp. paratuberculosis
gcaacgcuuucgggucgacgagc

SEQ ID NO: 910873 - RNA, 11 nt, Mycobacterium avium subsp. paratuberculosis
gcaacgcggcg

SEQ ID NO: 910874 - RNA, 20 nt, Mycobacterium avium subsp. paratuberculosis
gcaacgcgguguuggcggcg

SEQ ID NO: 910875 - RNA, 19 nt, Mycobacterium avium subsp. paratuberculosis
gcaacgcgccggcggucga

SEQ ID NO: 910876 - RNA, 18 nt, Mycobacterium avium subsp. paratuberculosis
gcaacgcgcgcgacggcg

SEQ ID NO: 910877 - RNA, 22 nt, Mycobacterium avium subsp. paratuberculosis
gcaacgcgcgcgacggcgcgug

SEQ ID NO: 910878 - RNA, 14 nt, Mycobacterium avium subsp. paratuberculosis
gcaacgcgauucgg

SEQ ID NO: 910879 - RNA, 18 nt, Mycobacterium avium subsp. paratuberculosis
gcaacguguacucggcgu

SEQ ID NO: 910880 - RNA, 14 nt, Mycobacterium avium subsp. paratuberculosis
gcaacgugcgccgg

SEQ ID NO: 910881 - RNA, 15 nt, Mycobacterium avium subsp. paratuberculosis
gcaacgugcgccggc

SEQ ID NO: 910882 - RNA, 16 nt, Mycobacterium avium subsp. paratuberculosis
gcaacgugcgccggcc

SEQ ID NO: 910883 - RNA, 23 nt, Mycobacterium avium subsp. paratuberculosis
gcaacuccaccucgggcauuggc

SEQ ID NO: 910884 - RNA, 19 nt, Mycobacterium avium subsp. paratuberculosis
gcaacuccacaaccagcga

SEQ ID NO: 910885 - RNA, 16 nt, Mycobacterium avium subsp. paratuberculosis
gcaacucaguccucgc

SEQ ID NO: 910886 - RNA, 17 nt, Mycobacterium avium subsp. paratuberculosis
gcaacucaguccucgcc

SEQ ID NO: 910887 - RNA, 22 nt, Mycobacterium avium subsp. paratuberculosis
gcaacguuguuccacgugucgg

SEQ ID NO: 910888 - RNA, 16 nt, Mycobacterium avium subsp. paratuberculosis
gcaacuacgcacccga

SEQ ID NO: 910889 - RNA, 16 nt, Mycobacterium avium subsp. paratuberculosis
gcaacgguacgugcgc

SEQ ID NO: 910890 - RNA, 20 nt, Mycobacterium avium subsp. paratuberculosis
gcaacgguacgugcgccggc

SEQ ID NO: 910891 - RNA, 15 nt, Mycobacterium avium subsp. paratuberculosis
gcaacggucgggauc

SEQ ID NO: 910892 - RNA, 13 nt, Mycobacterium avium subsp. paratuberculosis
gcaacggcuggcg

SEQ ID NO: 910893 - RNA, 18 nt, Mycobacterium avium subsp. paratuberculosis
gauuucacgucugcucgg

SEQ ID NO: 910894 - RNA, 17 nt, Mycobacterium avium subsp. paratuberculosis
gauuucgccagugccgc

SEQ ID NO: 910895 - RNA, 21 nt, Mycobacterium avium subsp. paratuberculosis
gauuucgccagugccgcgcgg

SEQ ID NO: 910896 - RNA, 19 nt, Mycobacterium avium subsp. paratuberculosis
gauuugaaauucaccucgc

SEQ ID NO: 910897 - RNA, 17 nt, Mycobacterium avium subsp. paratuberculosis
gauuucgcgcaccaccu

SEQ ID NO: 910898 - RNA, 22 nt, Mycobacterium avium subsp. paratuberculosis
gcaaacacgagcagacccgccg

SEQ ID NO: 910899 - RNA, 16 nt, Mycobacterium avium subsp. paratuberculosis
gcaaagaucggugccu

SEQ ID NO: 910900 - RNA, 14 nt, Mycobacterium avium subsp. paratuberculosis
gcaaauccggcagc

SEQ ID NO: 910901 - RNA, 14 nt, Mycobacterium avium subsp. paratuberculosis
gaugugcugcaggu

SEQ ID NO: 910902 - RNA, 16 nt, Mycobacterium avium subsp. paratuberculosis
gauguggaggcgagca

SEQ ID NO: 910903 - RNA, 18 nt, Mycobacterium avium subsp. paratuberculosis
gauguggguggucagcgc

SEQ ID NO: 910904 - RNA, 20 nt, Mycobacterium avium subsp. paratuberculosis
gauguguaacaacucgccgg

SEQ ID NO: 910905 - RNA, 17 nt, Mycobacterium avium subsp. paratuberculosis
gaugugcucgaucugcu

SEQ ID NO: 910906 - RNA, 20 nt, Mycobacterium avium subsp. paratuberculosis
gaugugcgcgcuggccgcgu

SEQ ID NO: 910907 - RNA, 16 nt, Mycobacterium avium subsp. paratuberculosis
gaugugcggcgcggcg

SEQ ID NO: 910908 - RNA, 18 nt, Mycobacterium avium subsp. paratuberculosis
gaugguggugcaggcgaa

SEQ ID NO: 910909 - RNA, 18 nt, Mycobacterium avium subsp. paratuberculosis
gaugguggucgccgucgu

SEQ ID NO: 910910 - RNA, 22 nt, Mycobacterium avium subsp. paratuberculosis
gauggugaugugcggcgcggcg

SEQ ID NO: 910911 - RNA, 16 nt, Mycobacterium avium subsp. paratuberculosis
gaugguggccgucggc

SEQ ID NO: 910912 - RNA, 22 nt, Mycobacterium avium subsp. paratuberculosis
gaugguggccgucggccugcgc

SEQ ID NO: 910913 - RNA, 17 nt, Mycobacterium avium subsp. paratuberculosis
gauggugcugcccggcg

SEQ ID NO: 910914 - RNA, 13 nt, Mycobacterium avium subsp. paratuberculosis
gaugguggcgcgc

SEQ ID NO: 910915 - RNA, 14 nt, Mycobacterium avium subsp. paratuberculosis
gaugguggcggcca

SEQ ID NO: 910916 - RNA, 16 nt, Mycobacterium avium subsp. paratuberculosis
gaugguggcguagcgg

SEQ ID NO: 910917 - RNA, 17 nt, Mycobacterium avium subsp. paratuberculosis
gauggugggcaccgcga

SEQ ID NO: 910918 - RNA, 16 nt, Mycobacterium avium subsp. paratuberculosis
gauggugcccaccggg

SEQ ID NO: 910919 - RNA, 13 nt, Mycobacterium avium subsp. paratuberculosis
gauggugcccggg

SEQ ID NO: 910920 - RNA, 14 nt, Mycobacterium avium subsp. paratuberculosis
gauggugcccgggg

SEQ ID NO: 910921 - RNA, 18 nt, Mycobacterium avium subsp. paratuberculosis
gauggugaucgaccggac

SEQ ID NO: 910922 - RNA, 18 nt, Mycobacterium avium subsp. paratuberculosis
gauggugcgccgggucgc

SEQ ID NO: 910923 - RNA, 18 nt, Mycobacterium avium subsp. paratuberculosis
gauguugaucacgugucc

SEQ ID NO: 910924 - RNA, 14 nt, Mycobacterium avium subsp. paratuberculosis
gauuacucgccggc

SEQ ID NO: 910925 - RNA, 15 nt, Mycobacterium avium subsp. paratuberculosis
gauuacucgccggcg

SEQ ID NO: 910926 - RNA, 17 nt, Mycobacterium avium subsp. paratuberculosis
gauuacucgccggcggc

SEQ ID NO: 910927 - RNA, 17 nt, Mycobacterium avium subsp. paratuberculosis
gauguugaccacccgca

SEQ ID NO: 910928 - RNA, 19 nt, Mycobacterium avium subsp. paratuberculosis
gauguugaccacccgcagc

SEQ ID NO: 910929 - RNA, 22 nt, Mycobacterium avium subsp. paratuberculosis
gauguucaguucguccagcccg

SEQ ID NO: 910930 - RNA, 13 nt, Mycobacterium avium subsp. paratuberculosis
gauguucuccggc

SEQ ID NO: 910931 - RNA, 17 nt, Mycobacterium avium subsp. paratuberculosis
gauguucuccggcccgg

SEQ ID NO: 910932 - RNA, 15 nt, Mycobacterium avium subsp. paratuberculosis
gauuaggucgguggc

SEQ ID NO: 910933 - RNA, 23 nt, Mycobacterium avium subsp. paratuberculosis
gauucucgcucugccgggccgca

SEQ ID NO: 910934 - RNA, 20 nt, Mycobacterium avium subsp. paratuberculosis
gauuccgucggcggccgacc

SEQ ID NO: 910935 - RNA, 13 nt, Mycobacterium avium subsp. paratuberculosis
gauucgcgguggc

SEQ ID NO: 910936 - RNA, 17 nt, Mycobacterium avium subsp. paratuberculosis
gauucgcgcggcgccca

SEQ ID NO: 910937 - RNA, 16 nt, Mycobacterium avium subsp. paratuberculosis
gauucgaggucaucga

SEQ ID NO: 910938 - RNA, 19 nt, Mycobacterium avium subsp. paratuberculosis
gauucgcggcggcgccgca

SEQ ID NO: 910939 - RNA, 13 nt, Mycobacterium avium subsp. paratuberculosis
gauucggcgccgc

SEQ ID NO: 910940 - RNA, 15 nt, Mycobacterium avium subsp. paratuberculosis
gauucggcgccgcga

SEQ ID NO: 910941 - RNA, 17 nt, Mycobacterium avium subsp. paratuberculosis
gauucggcgccgcgacc

SEQ ID NO: 910942 - RNA, 21 nt, Mycobacterium avium subsp. paratuberculosis
gauucggguggcgucgccgcc

SEQ ID NO: 910943 - RNA, 22 nt, Mycobacterium avium subsp. paratuberculosis
gauucggguggcgucgccgccg

SEQ ID NO: 910944 - RNA, 19 nt, Mycobacterium avium subsp. paratuberculosis
gauucggguuucgcgggcu

SEQ ID NO: 910945 - RNA, 16 nt, Mycobacterium avium subsp. paratuberculosis
gauucgguaccagggc

SEQ ID NO: 910946 - RNA, 16 nt, Mycobacterium avium subsp. paratuberculosis
gauucgucggucaccc

SEQ ID NO: 910947 - RNA, 19 nt, Mycobacterium avium subsp. paratuberculosis
gauucgucggucacccggu

SEQ ID NO: 910948 - RNA, 15 nt, Mycobacterium avium subsp. paratuberculosis
gaugggugcgguuga

SEQ ID NO: 910949 - RNA, 19 nt, Mycobacterium avium subsp. paratuberculosis
gauggguucuucgaccacg

SEQ ID NO: 910950 - RNA, 16 nt, Mycobacterium avium subsp. paratuberculosis
gauggguuggccgucg

SEQ ID NO: 910951 - RNA, 19 nt, Mycobacterium avium subsp. paratuberculosis
gaugggcucgaccacgccg

SEQ ID NO: 910952 - RNA, 15 nt, Mycobacterium avium subsp. paratuberculosis
gauggucaccggggu

SEQ ID NO: 910953 - RNA, 16 nt, Mycobacterium avium subsp. paratuberculosis
gauggucagcugccgc

SEQ ID NO: 910954 - RNA, 15 nt, Mycobacterium avium subsp. paratuberculosis
gaugguccagcaccg

SEQ ID NO: 910955 - RNA, 18 nt, Mycobacterium avium subsp. paratuberculosis
gaugguccagcaccggcg

SEQ ID NO: 910956 - RNA, 16 nt, Mycobacterium avium subsp. paratuberculosis
gaugguccccgggccc

SEQ ID NO: 910957 - RNA, 19 nt, Mycobacterium avium subsp. paratuberculosis
gauggucagccgcaccagg

SEQ ID NO: 910958 - RNA, 16 nt, Mycobacterium avium subsp. paratuberculosis
gauggucucccgggcg

SEQ ID NO: 910959 - RNA, 17 nt, Mycobacterium avium subsp. paratuberculosis
gauggucucccgggcgg

SEQ ID NO: 910960 - RNA, 19 nt, Mycobacterium avium subsp. paratuberculosis
gauggucucccgggcgguc

SEQ ID NO: 910961 - RNA, 22 nt, Mycobacterium avium subsp. paratuberculosis
gauggugaacuccgucucgccg

SEQ ID NO: 910962 - RNA, 20 nt, Mycobacterium avium subsp. paratuberculosis
gauggugaagccgugcacgc

SEQ ID NO: 910963 - RNA, 14 nt, Mycobacterium avium subsp. paratuberculosis
gauggugaccucgg

SEQ ID NO: 910964 - RNA, 19 nt, Mycobacterium avium subsp. paratuberculosis
gauggugacgauccggucg

SEQ ID NO: 910965 - RNA, 22 nt, Mycobacterium avium subsp. paratuberculosis
gauggucucgaucuccaucccg

SEQ ID NO: 910966 - RNA, 17 nt, Mycobacterium avium subsp. paratuberculosis
gauggucugcagcgacg

SEQ ID NO: 910967 - RNA, 19 nt, Mycobacterium avium subsp. paratuberculosis
gauggucugcagcgacgga

SEQ ID NO: 910968 - RNA, 14 nt, Mycobacterium avium subsp. paratuberculosis
gauggucugcccgc

SEQ ID NO: 910969 - RNA, 23 nt, Mycobacterium avium subsp. paratuberculosis
gauggucuggaugaucgucucgg

SEQ ID NO: 910970 - RNA, 14 nt, Mycobacterium avium subsp. paratuberculosis
gauggucgucgugg

SEQ ID NO: 910971 - RNA, 18 nt, Mycobacterium avium subsp. paratuberculosis
gauggucgucguggugac

SEQ ID NO: 910972 - RNA, 21 nt, Mycobacterium avium subsp. paratuberculosis
gauggugaaaucguccaucgu

SEQ ID NO: 910973 - RNA, 14 nt, Mycobacterium avium subsp. paratuberculosis
gaugggagcggggu

SEQ ID NO: 910974 - RNA, 14 nt, Mycobacterium avium subsp. paratuberculosis
gaugggcagcgccc

SEQ ID NO: 910975 - RNA, 22 nt, Mycobacterium avium subsp. paratuberculosis
gaugggcagcgccccgguccgg

SEQ ID NO: 910976 - RNA, 15 nt, Mycobacterium avium subsp. paratuberculosis
gaugggccgcccgcu

SEQ ID NO: 910977 - RNA, 22 nt, Mycobacterium avium subsp. paratuberculosis
gauggcgcggccggccgacacc

SEQ ID NO: 910978 - RNA, 22 nt, Mycobacterium avium subsp. paratuberculosis
gauggcgcggcgcaccgcccgc

SEQ ID NO: 910979 - RNA, 20 nt, Mycobacterium avium subsp. paratuberculosis
gauggcucgcgggggccgcg

SEQ ID NO: 910980 - RNA, 19 nt, Mycobacterium avium subsp. paratuberculosis
gauggcgccgaucgcgcgc

SEQ ID NO: 910981 - RNA, 13 nt, Mycobacterium avium subsp. paratuberculosis
gauggcgaugccg

SEQ ID NO: 910982 - RNA, 14 nt, Mycobacterium avium subsp. paratuberculosis
gauggcgaugccgg

SEQ ID NO: 910983 - RNA, 16 nt, Mycobacterium avium subsp. paratuberculosis
gauggcgcccagcccg

SEQ ID NO: 910984 - RNA, 17 nt, Mycobacterium avium subsp. paratuberculosis
gauggcgcccagcccga

SEQ ID NO: 910985 - RNA, 20 nt, Mycobacterium avium subsp. paratuberculosis
gauggcgcccagcgucucgg

SEQ ID NO: 910986 - RNA, 22 nt, Mycobacterium avium subsp. paratuberculosis
gauggcgcccagcgucucggcg

SEQ ID NO: 910987 - RNA, 14 nt, Mycobacterium avium subsp. paratuberculosis
gauggcgcccggca

SEQ ID NO: 910988 - RNA, 16 nt, Mycobacterium avium subsp. paratuberculosis
gauggccugguggccc

SEQ ID NO: 910989 - RNA, 16 nt, Mycobacterium avium subsp. paratuberculosis
gauggcgaaguucggc

SEQ ID NO: 910990 - RNA, 19 nt, Mycobacterium avium subsp. paratuberculosis
gauggcgaccgcgcaggcg

SEQ ID NO: 910991 - RNA, 23 nt, Mycobacterium avium subsp. paratuberculosis
gauggcgaggaaguccggcgcgc

SEQ ID NO: 910992 - RNA, 19 nt, Mycobacterium avium subsp. paratuberculosis
gauggcgacggcgacgacc

SEQ ID NO: 910993 - RNA, 20 nt, Mycobacterium avium subsp. paratuberculosis
gauggcgacggcgacgaccg

SEQ ID NO: 910994 - RNA, 14 nt, Mycobacterium avium subsp. paratuberculosis
gauggcgaagccca

SEQ ID NO: 910995 - RNA, 19 nt, Mycobacterium avium subsp. paratuberculosis
gauggccgggcaggccggg

SEQ ID NO: 910996 - RNA, 23 nt, Mycobacterium avium subsp. paratuberculosis
gauggccggcuaccgcgcggaga

SEQ ID NO: 910997 - RNA, 20 nt, Mycobacterium avium subsp. paratuberculosis
gauggccgcuucgggguggu

SEQ ID NO: 910998 - RNA, 15 nt, Mycobacterium avium subsp. paratuberculosis
gauggccgcgccgcc

SEQ ID NO: 910999 - RNA, 17 nt, Mycobacterium avium subsp. paratuberculosis
gauggccuccgacccgu

SEQ ID NO: 911000 - RNA, 20 nt, Mycobacterium avium subsp. paratuberculosis
gauggccuccgacccgucca

SEQ ID NO: 911001 - RNA, 17 nt, Mycobacterium avium subsp. paratuberculosis
gauggccucggcgaugc

SEQ ID NO: 911002 - RNA, 19 nt, Mycobacterium avium subsp. paratuberculosis
gauggccucggcgaugccg

SEQ ID NO: 911003 - RNA, 14 nt, Mycobacterium avium subsp. paratuberculosis
gauggccugcucgc

SEQ ID NO: 911004 - RNA, 14 nt, Mycobacterium avium subsp. paratuberculosis
gauggccaccaggu

SEQ ID NO: 911005 - RNA, 20 nt, Mycobacterium avium subsp. paratuberculosis
gauggccaccaucaggccgg

SEQ ID NO: 911006 - RNA, 17 nt, Mycobacterium avium subsp. paratuberculosis
gaugcugauacccgcgc

SEQ ID NO: 911007 - RNA, 14 nt, Mycobacterium avium subsp. paratuberculosis
gaugcugcccggcg

SEQ ID NO: 911008 - RNA, 12 nt, Mycobacterium avium subsp. paratuberculosis
gaugcucgucgg

SEQ ID NO: 911009 - RNA, 15 nt, Mycobacterium avium subsp. paratuberculosis
gaugcucgaugcgca

SEQ ID NO: 911010 - RNA, 20 nt, Mycobacterium avium subsp. paratuberculosis
gauggagcgcgacgggcugc

SEQ ID NO: 911011 - RNA, 16 nt, Mycobacterium avium subsp. paratuberculosis
gauggaggugccgcgc

SEQ ID NO: 911012 - RNA, 12 nt, Mycobacterium avium subsp. paratuberculosis
gaugcggggcgg

SEQ ID NO: 911013 - RNA, 14 nt, Mycobacterium avium subsp. paratuberculosis
gaugcgggccagga

SEQ ID NO: 911014 - RNA, 17 nt, Mycobacterium avium subsp. paratuberculosis
gaugcguuggccgagca

SEQ ID NO: 911015 - RNA, 18 nt, Mycobacterium avium subsp. paratuberculosis
gaugcguuggccgagcag

SEQ ID NO: 911016 - RNA, 20 nt, Mycobacterium avium subsp. paratuberculosis
gaugcguuggccgagcagcc

SEQ ID NO: 911017 - RNA, 21 nt, Mycobacterium avium subsp. paratuberculosis
gaugcguucggccgcagcggg

SEQ ID NO: 911018 - RNA, 22 nt, Mycobacterium avium subsp. paratuberculosis
gaugcguucggccgcagcggga

SEQ ID NO: 911019 - RNA, 20 nt, Mycobacterium avium subsp. paratuberculosis
gaugcguugcgccagcaccg

SEQ ID NO: 911020 - RNA, 23 nt, Mycobacterium avium subsp. paratuberculosis
gaugcguugcgccagcaccgaca

SEQ ID NO: 911021 - RNA, 18 nt, Mycobacterium avium subsp. paratuberculosis
gaugcuaccucacaaccg

SEQ ID NO: 911022 - RNA, 14 nt, Mycobacterium avium subsp. paratuberculosis
gaugcucccggucg

SEQ ID NO: 911023 - RNA, 14 nt, Mycobacterium avium subsp. paratuberculosis
gaugcucaccgguc

SEQ ID NO: 911024 - RNA, 11 nt, Mycobacterium avium subsp. paratuberculosis
gaugcgcccgc

SEQ ID NO: 911025 - RNA, 13 nt, Mycobacterium avium subsp. paratuberculosis
gaugcgcccgcgc

SEQ ID NO: 911026 - RNA, 14 nt, Mycobacterium avium subsp. paratuberculosis
gaugcgcccgcgcc

SEQ ID NO: 911027 - RNA, 12 nt, Mycobacterium avium subsp. paratuberculosis
gaugcgcccggu

SEQ ID NO: 911028 - RNA, 13 nt, Mycobacterium avium subsp. paratuberculosis
gaugcgccgcgga

SEQ ID NO: 911029 - RNA, 20 nt, Mycobacterium avium subsp. paratuberculosis
gaugcgccggguccagccgc

SEQ ID NO: 911030 - RNA, 15 nt, Mycobacterium avium subsp. paratuberculosis
gaugcggcccagccc

SEQ ID NO: 911031 - RNA, 16 nt, Mycobacterium avium subsp. paratuberculosis
gaugcggcccagcccg

SEQ ID NO: 911032 - RNA, 22 nt, Mycobacterium avium subsp. paratuberculosis
gaugcggcccagcccggccagc

SEQ ID NO: 911033 - RNA, 21 nt, Mycobacterium avium subsp. paratuberculosis
gaugcggcccuggcgggcggc

SEQ ID NO: 911034 - RNA, 12 nt, Mycobacterium avium subsp. paratuberculosis
gaugcggccgga

SEQ ID NO: 911035 - RNA, 20 nt, Mycobacterium avium subsp. paratuberculosis
gaugcggccggcgggcagca

SEQ ID NO: 911036 - RNA, 14 nt, Mycobacterium avium subsp. paratuberculosis
gaugcgcgccgacg

SEQ ID NO: 911037 - RNA, 18 nt, Mycobacterium avium subsp. paratuberculosis
gaugcgcgccgacgacca

SEQ ID NO: 911038 - RNA, 17 nt, Mycobacterium avium subsp. paratuberculosis
gaugcgcggcgacggcg

SEQ ID NO: 911039 - RNA, 13 nt, Mycobacterium avium subsp. paratuberculosis
gaugcgcggcccg

SEQ ID NO: 911040 - RNA, 12 nt, Mycobacterium avium subsp. paratuberculosis
gaugaccgacau

SEQ ID NO: 911041 - RNA, 16 nt, Mycobacterium avium subsp. paratuberculosis
gaugaccgccugcggc

SEQ ID NO: 911042 - RNA, 18 nt, Mycobacterium avium subsp. paratuberculosis
gaugaccaggucgccggc

SEQ ID NO: 911043 - RNA, 19 nt, Mycobacterium avium subsp. paratuberculosis
gaugaccaggucgccggcg

SEQ ID NO: 911044 - RNA, 24 nt, Mycobacterium avium subsp. paratuberculosis
gaugaccaggucgccggcggccga

SEQ ID NO: 911045 - RNA, 16 nt, Mycobacterium avium subsp. paratuberculosis
gaugacccaccagccg

SEQ ID NO: 911046 - RNA, 17 nt, Mycobacterium avium subsp. paratuberculosis
gaugacccaccagccga

SEQ ID NO: 911047 - RNA, 23 nt, Mycobacterium avium subsp. paratuberculosis
gaugaccagcgcgaacagcgcgg

SEQ ID NO: 911048 - RNA, 14 nt, Mycobacterium avium subsp. paratuberculosis
gaugccgcucggcg

SEQ ID NO: 911049 - RNA, 13 nt, Mycobacterium avium subsp. paratuberculosis
gaugccgcgcagg

SEQ ID NO: 911050 - RNA, 13 nt, Mycobacterium avium subsp. paratuberculosis
gaugccgcgcggc

SEQ ID NO: 911051 - RNA, 15 nt, Mycobacterium avium subsp. paratuberculosis
gaugccgcgcggcgc

SEQ ID NO: 911052 - RNA, 17 nt, Mycobacterium avium subsp. paratuberculosis
gaugccgcgcggcgcca

SEQ ID NO: 911053 - RNA, 13 nt, Mycobacterium avium subsp. paratuberculosis
gaugccgcgcugc

SEQ ID NO: 911054 - RNA, 14 nt, Mycobacterium avium subsp. paratuberculosis
gaugccgcgcugcg

SEQ ID NO: 911055 - RNA, 16 nt, Mycobacterium avium subsp. paratuberculosis
gaugccgcgcugcgcc

SEQ ID NO: 911056 - RNA, 20 nt, Mycobacterium avium subsp. paratuberculosis
gaugccgcgcugcgccgggu

SEQ ID NO: 911057 - RNA, 13 nt, Mycobacterium avium subsp. paratuberculosis
gaugaccgcggcg

SEQ ID NO: 911058 - RNA, 14 nt, Mycobacterium avium subsp. paratuberculosis
gaugaccgcggcga

SEQ ID NO: 911059 - RNA, 15 nt, Mycobacterium avium subsp. paratuberculosis
gaugaccgcggcggg

SEQ ID NO: 911060 - RNA, 16 nt, Mycobacterium avium subsp. paratuberculosis
gaugaccgcggcgggc

SEQ ID NO: 911061 - RNA, 22 nt, Mycobacterium avium subsp. paratuberculosis
gaugaccgcgucggcgccguag

SEQ ID NO: 911062 - RNA, 14 nt, Mycobacterium avium subsp. paratuberculosis
gaugaccggcccgg

SEQ ID NO: 911063 - RNA, 15 nt, Mycobacterium avium subsp. paratuberculosis
gaugaccggcccggc

SEQ ID NO: 911064 - RNA, 19 nt, Mycobacterium avium subsp. paratuberculosis
gaugaccggcccggcggcc

SEQ ID NO: 911065 - RNA, 14 nt, Mycobacterium avium subsp. paratuberculosis
gaugaccggccugc

SEQ ID NO: 911066 - RNA, 15 nt, Mycobacterium avium subsp. paratuberculosis
gaugccgccgccagc

SEQ ID NO: 911067 - RNA, 22 nt, Mycobacterium avium subsp. paratuberculosis
gaugccgccgccagcgcggggu

SEQ ID NO: 911068 - RNA, 13 nt, Mycobacterium avium subsp. paratuberculosis
gaugccgccgacg

SEQ ID NO: 911069 - RNA, 17 nt, Mycobacterium avium subsp. paratuberculosis
gaugccggcaaccgcug

SEQ ID NO: 911070 - RNA, 21 nt, Mycobacterium avium subsp. paratuberculosis
gaugccggacuugaugcugcc

SEQ ID NO: 911071 - RNA, 15 nt, Mycobacterium avium subsp. paratuberculosis
gaugccggccagccg

SEQ ID NO: 911072 - RNA, 17 nt, Mycobacterium avium subsp. paratuberculosis
gaugccggccagccgcg

SEQ ID NO: 911073 - RNA, 15 nt, Mycobacterium avium subsp. paratuberculosis
gaugccggccagcgg

SEQ ID NO: 911074 - RNA, 17 nt, Mycobacterium avium subsp. paratuberculosis
gaugccggccagcggcc

SEQ ID NO: 911075 - RNA, 18 nt, Mycobacterium avium subsp. paratuberculosis
gaugccggccagcggcca

SEQ ID NO: 911076 - RNA, 14 nt, Mycobacterium avium subsp. paratuberculosis
gaugccggccgcgu

SEQ ID NO: 911077 - RNA, 14 nt, Mycobacterium avium subsp. paratuberculosis
gaugccggccuggc

SEQ ID NO: 911078 - RNA, 13 nt, Mycobacterium avium subsp. paratuberculosis
gaugccggccggg

SEQ ID NO: 911079 - RNA, 17 nt, Mycobacterium avium subsp. paratuberculosis
gaugccggccgggacgc

SEQ ID NO: 911080 - RNA, 14 nt, Mycobacterium avium subsp. paratuberculosis
gaugccgugcgcgc

SEQ ID NO: 911081 - RNA, 16 nt, Mycobacterium avium subsp. paratuberculosis
gaugccguggugcccu

SEQ ID NO: 911082 - RNA, 15 nt, Mycobacterium avium subsp. paratuberculosis
gaugccguucgcgcc

SEQ ID NO: 911083 - RNA, 13 nt, Mycobacterium avium subsp. paratuberculosis
gaugcgacaccgc

SEQ ID NO: 911084 - RNA, 20 nt, Mycobacterium avium subsp. paratuberculosis
gaugccuacaggugccggcg

SEQ ID NO: 911085 - RNA, 22 nt, Mycobacterium avium subsp. paratuberculosis
gaugccuacaggugccggcggc

SEQ ID NO: 911086 - RNA, 15 nt, Mycobacterium avium subsp. paratuberculosis
gaugccugcccgcgc

SEQ ID NO: 911087 - RNA, 12 nt, Mycobacterium avium subsp. paratuberculosis
gaucugcaccag

SEQ ID NO: 911088 - RNA, 23 nt, Mycobacterium avium subsp. paratuberculosis
gaucugcaccagcguggugcgcc

SEQ ID NO: 911089 - RNA, 16 nt, Mycobacterium avium subsp. paratuberculosis
gaucugccggugccgc

SEQ ID NO: 911090 - RNA, 20 nt, Mycobacterium avium subsp. paratuberculosis
gaucugggugagcgacacca

SEQ ID NO: 911091 - RNA, 16 nt, Mycobacterium avium subsp. paratuberculosis
gaucugggugccgcgg

SEQ ID NO: 911092 - RNA, 16 nt, Mycobacterium avium subsp. paratuberculosis
gaucugcccgaccuga

SEQ ID NO: 911093 - RNA, 16 nt, Mycobacterium avium subsp. paratuberculosis
gaucuguucggcggcg

SEQ ID NO: 911094 - RNA, 17 nt, Mycobacterium avium subsp. paratuberculosis
gaucuguucggcggcga

SEQ ID NO: 911095 - RNA, 20 nt, Mycobacterium avium subsp. paratuberculosis
gaucuguucggcggcgaucc

SEQ ID NO: 911096 - RNA, 16 nt, Mycobacterium avium subsp. paratuberculosis
gaucuggugcgcgcgc

SEQ ID NO: 911097 - RNA, 16 nt, Mycobacterium avium subsp. paratuberculosis
gaucuggucggccagc

SEQ ID NO: 911098 - RNA, 18 nt, Mycobacterium avium subsp. paratuberculosis
gaucuggucggccagcgc

SEQ ID NO: 911099 - RNA, 22 nt, Mycobacterium avium subsp. paratuberculosis
gaugaaauccgggaccggcguc

SEQ ID NO: 911100 - RNA, 23 nt, Mycobacterium avium subsp. paratuberculosis
gaucugguucaccgccaccagca

SEQ ID NO: 911101 - RNA, 15 nt, Mycobacterium avium subsp. paratuberculosis
gaucuucgcggcgua

SEQ ID NO: 911102 - RNA, 12 nt, Mycobacterium avium subsp. paratuberculosis
gaugaacaucgc

SEQ ID NO: 911103 - RNA, 23 nt, Mycobacterium avium subsp. paratuberculosis
gaugaacagcacgugcccgccgu

SEQ ID NO: 911104 - RNA, 18 nt, Mycobacterium avium subsp. paratuberculosis
gaugaacgcguugaccag

SEQ ID NO: 911105 - RNA, 22 nt, Mycobacterium avium subsp. paratuberculosis
gaugaacgggauggagccgccc

SEQ ID NO: 911106 - RNA, 18 nt, Mycobacterium avium subsp. paratuberculosis
gaugaacgucccguuggu

SEQ ID NO: 911107 - RNA, 13 nt, Mycobacterium avium subsp. paratuberculosis
gaugaagccgccc

SEQ ID NO: 911108 - RNA, 15 nt, Mycobacterium avium subsp. paratuberculosis
gaugaagccgccgac

SEQ ID NO: 911109 - RNA, 18 nt, Mycobacterium avium subsp. paratuberculosis
gaugaagccgugcccgcg

SEQ ID NO: 911110 - RNA, 12 nt, Mycobacterium avium subsp. paratuberculosis
gaugaagccccg

SEQ ID NO: 911111 - RNA, 17 nt, Mycobacterium avium subsp. paratuberculosis
gaugaagacccgccgga

SEQ ID NO: 911112 - RNA, 19 nt, Mycobacterium avium subsp. paratuberculosis
gaugaagaccuggccggcc

SEQ ID NO: 911113 - RNA, 22 nt, Mycobacterium avium subsp. paratuberculosis
gaugaacucgugcggcgccgcc

SEQ ID NO: 911114 - RNA, 23 nt, Mycobacterium avium subsp. paratuberculosis
gaugaacuugccgaucaccucga

SEQ ID NO: 911115 - RNA, 15 nt, Mycobacterium avium subsp. paratuberculosis
gaugacaccgcggac

SEQ ID NO: 911116 - RNA, 23 nt, Mycobacterium avium subsp. paratuberculosis
gaugacaccgcggaccaccgcgu

SEQ ID NO: 911117 - RNA, 15 nt, Mycobacterium avium subsp. paratuberculosis
gaugaauucggcgau

SEQ ID NO: 911118 - RNA, 18 nt, Mycobacterium avium subsp. paratuberculosis
gaugaauucggcgaucuc

SEQ ID NO: 911119 - RNA, 20 nt, Mycobacterium avium subsp. paratuberculosis
gaugaaucgucccgucgacc

SEQ ID NO: 911120 - RNA, 20 nt, Mycobacterium avium subsp. paratuberculosis
gaucgguguccagccgcacg

SEQ ID NO: 911121 - RNA, 13 nt, Mycobacterium avium subsp. paratuberculosis
gaucggugcgcgg

SEQ ID NO: 911122 - RNA, 15 nt, Mycobacterium avium subsp. paratuberculosis
gaucggugcgcggcg

SEQ ID NO: 911123 - RNA, 16 nt, Mycobacterium avium subsp. paratuberculosis
gaucggugcgcggcga

SEQ ID NO: 911124 - RNA, 17 nt, Mycobacterium avium subsp. paratuberculosis
gaucggucugccuggcg

SEQ ID NO: 911125 - RNA, 19 nt, Mycobacterium avium subsp. paratuberculosis
gaucggugaacccgccggc

SEQ ID NO: 911126 - RNA, 18 nt, Mycobacterium avium subsp. paratuberculosis
gaucggugaagcggcgcg

SEQ ID NO: 911127 - RNA, 17 nt, Mycobacterium avium subsp. paratuberculosis
gaucggugcaggccgcg

SEQ ID NO: 911128 - RNA, 15 nt, Mycobacterium avium subsp. paratuberculosis
gaucggugcccgcgg

SEQ ID NO: 911129 - RNA, 20 nt, Mycobacterium avium subsp. paratuberculosis
gaucggugcccgcggguagc

SEQ ID NO: 911130 - RNA, 13 nt, Mycobacterium avium subsp. paratuberculosis
gaucggugccgac

SEQ ID NO: 911131 - RNA, 22 nt, Mycobacterium avium subsp. paratuberculosis
gaucgguucgucguggccgacg

SEQ ID NO: 911132 - RNA, 23 nt, Mycobacterium avium subsp. paratuberculosis
gaucgguucgucguggccgacgg

SEQ ID NO: 911133 - RNA, 13 nt, Mycobacterium avium subsp. paratuberculosis
gaucgucgccgcc

SEQ ID NO: 911134 - RNA, 14 nt, Mycobacterium avium subsp. paratuberculosis
gaucgucgccgcca

SEQ ID NO: 911135 - RNA, 14 nt, Mycobacterium avium subsp. paratuberculosis
gaucgucgccgggc

SEQ ID NO: 911136 - RNA, 17 nt, Mycobacterium avium subsp. paratuberculosis
gaucgucgccgucaccu

SEQ ID NO: 911137 - RNA, 20 nt, Mycobacterium avium subsp. paratuberculosis
gaucgucgccgucaccucga

SEQ ID NO: 911138 - RNA, 18 nt, Mycobacterium avium subsp. paratuberculosis
gaucgucgaccaccacga

SEQ ID NO: 911139 - RNA, 17 nt, Mycobacterium avium subsp. paratuberculosis
gaucgucgaccugcucg

SEQ ID NO: 911140 - RNA, 18 nt, Mycobacterium avium subsp. paratuberculosis
gaucgucgagugcucgau

SEQ ID NO: 911141 - RNA, 19 nt, Mycobacterium avium subsp. paratuberculosis
gaucguccgaggccccgcc

SEQ ID NO: 911142 - RNA, 16 nt, Mycobacterium avium subsp. paratuberculosis
gaucgucaccgacccc

SEQ ID NO: 911143 - RNA, 18 nt, Mycobacterium avium subsp. paratuberculosis
gaucgucaccgugccguc

SEQ ID NO: 911144 - RNA, 19 nt, Mycobacterium avium subsp. paratuberculosis
gaucgucaugccuuggccg

SEQ ID NO: 911145 - RNA, 17 nt, Mycobacterium avium subsp. paratuberculosis
gaucuccucgcgcggca

SEQ ID NO: 911146 - RNA, 14 nt, Mycobacterium avium subsp. paratuberculosis
gaucuccucggcgu

SEQ ID NO: 911147 - RNA, 19 nt, Mycobacterium avium subsp. paratuberculosis
gaucuccuuguugacgaug

SEQ ID NO: 911148 - RNA, 12 nt, Mycobacterium avium subsp. paratuberculosis
gaucuccagcag

SEQ ID NO: 911149 - RNA, 14 nt, Mycobacterium avium subsp. paratuberculosis
gaucuccagcagcu

SEQ ID NO: 911150 - RNA, 15 nt, Mycobacterium avium subsp. paratuberculosis
gaucuccagcagcuu

SEQ ID NO: 911151 - RNA, 17 nt, Mycobacterium avium subsp. paratuberculosis
gaucuccagcggccggg

SEQ ID NO: 911152 - RNA, 15 nt, Mycobacterium avium subsp. paratuberculosis
gaucuccaggcucga

SEQ ID NO: 911153 - RNA, 15 nt, Mycobacterium avium subsp. paratuberculosis
gaucuccaucccgcu

SEQ ID NO: 911154 - RNA, 17 nt, Mycobacterium avium subsp. paratuberculosis
gaucuccgccuucgacg

SEQ ID NO: 911155 - RNA, 18 nt, Mycobacterium avium subsp. paratuberculosis
gaucuccgcggcgaugac

SEQ ID NO: 911156 - RNA, 14 nt, Mycobacterium avium subsp. paratuberculosis
gaucuccggccggu

SEQ ID NO: 911157 - RNA, 16 nt, Mycobacterium avium subsp. paratuberculosis
gaucuccggccgguga

SEQ ID NO: 911158 - RNA, 15 nt, Mycobacterium avium subsp. paratuberculosis
gaucucgucggcggc

SEQ ID NO: 911159 - RNA, 15 nt, Mycobacterium avium subsp. paratuberculosis
gaucucgugccgcac

SEQ ID NO: 911160 - RNA, 18 nt, Mycobacterium avium subsp. paratuberculosis
gaucucgugccgcacccg

SEQ ID NO: 911161 - RNA, 13 nt, Mycobacterium avium subsp. paratuberculosis
gaucucgucgaug

SEQ ID NO: 911162 - RNA, 14 nt, Mycobacterium avium subsp. paratuberculosis
gaucucgucgauga

SEQ ID NO: 911163 - RNA, 16 nt, Mycobacterium avium subsp. paratuberculosis
gaucucgucgaugacg

SEQ ID NO: 911164 - RNA, 23 nt, Mycobacterium avium subsp. paratuberculosis
gaucucgauggacgcgguggugc

SEQ ID NO: 911165 - RNA, 15 nt, Mycobacterium avium subsp. paratuberculosis
gaucucgaccaggcc

SEQ ID NO: 911166 - RNA, 16 nt, Mycobacterium avium subsp. paratuberculosis
gaucucgaccaggccg

SEQ ID NO: 911167 - RNA, 16 nt, Mycobacterium avium subsp. paratuberculosis
gaucucgaccucgucg

SEQ ID NO: 911168 - RNA, 20 nt, Mycobacterium avium subsp. paratuberculosis
gaucucgaccucgucggcgg

SEQ ID NO: 911169 - RNA, 17 nt, Mycobacterium avium subsp. paratuberculosis
gaucucgaccagcgccg

SEQ ID NO: 911170 - RNA, 17 nt, Mycobacterium avium subsp. paratuberculosis
gaucgcguagcgccggu

SEQ ID NO: 911171 - RNA, 17 nt, Mycobacterium avium subsp. paratuberculosis
gaucggauccgccugcc

SEQ ID NO: 911172 - RNA, 16 nt, Mycobacterium avium subsp. paratuberculosis
gaucgcgguccaggau

SEQ ID NO: 911173 - RNA, 23 nt, Mycobacterium avium subsp. paratuberculosis
gaucggcacccgcaacaccacgu

SEQ ID NO: 911174 - RNA, 15 nt, Mycobacterium avium subsp. paratuberculosis
gaucggcacgucgag

SEQ ID NO: 911175 - RNA, 17 nt, Mycobacterium avium subsp. paratuberculosis
gaucggcagcgccaaca

SEQ ID NO: 911176 - RNA, 23 nt, Mycobacterium avium subsp. paratuberculosis
gaucggcagcgccaacauggcgc

SEQ ID NO: 911177 - RNA, 15 nt, Mycobacterium avium subsp. paratuberculosis
gaucggcagcgcgcc

SEQ ID NO: 911178 - RNA, 12 nt, Mycobacterium avium subsp. paratuberculosis
gaucgcggcggc

SEQ ID NO: 911179 - RNA, 14 nt, Mycobacterium avium subsp. paratuberculosis
gaucgcggcggcgu

SEQ ID NO: 911180 - RNA, 18 nt, Mycobacterium avium subsp. paratuberculosis
gaucgcggcgcugccgcc

SEQ ID NO: 911181 - RNA, 14 nt, Mycobacterium avium subsp. paratuberculosis
gaucgccgcccacu

SEQ ID NO: 911182 - RNA, 15 nt, Mycobacterium avium subsp. paratuberculosis
gaucgccgcccaucg

SEQ ID NO: 911183 - RNA, 16 nt, Mycobacterium avium subsp. paratuberculosis
gaucgcggcgaucagc

SEQ ID NO: 911184 - RNA, 19 nt, Mycobacterium avium subsp. paratuberculosis
gaucgcggcgaucagcccg

SEQ ID NO: 911185 - RNA, 22 nt, Mycobacterium avium subsp. paratuberculosis
gaucgcggcgaucagcccggcc

SEQ ID NO: 911186 - RNA, 17 nt, Mycobacterium avium subsp. paratuberculosis
gaucgcggcggcguacg

SEQ ID NO: 911187 - RNA, 17 nt, Mycobacterium avium subsp. paratuberculosis
gaucgcgggcgacccgc

SEQ ID NO: 911188 - RNA, 19 nt, Mycobacterium avium subsp. paratuberculosis
gaucgcgggcugcggcgag

SEQ ID NO: 911189 - RNA, 14 nt, Mycobacterium avium subsp. paratuberculosis
gaucgcggucaccu

SEQ ID NO: 911190 - RNA, 16 nt, Mycobacterium avium subsp. paratuberculosis
gaucgcggugaccgcc

SEQ ID NO: 911191 - RNA, 19 nt, Mycobacterium avium subsp. paratuberculosis
gaucgcggugaccgccgcc

SEQ ID NO: 911192 - RNA, 16 nt, Mycobacterium avium subsp. paratuberculosis
gaucgcggugacgcgc

SEQ ID NO: 911193 - RNA, 20 nt, Mycobacterium avium subsp. paratuberculosis
gaucgcggugacgcgccggc

SEQ ID NO: 911194 - RNA, 21 nt, Mycobacterium avium subsp. paratuberculosis
gaucgcggugacgcgccggcc

SEQ ID NO: 911195 - RNA, 18 nt, Mycobacterium avium subsp. paratuberculosis
gaucgcggugcggggccg

SEQ ID NO: 911196 - RNA, 23 nt, Mycobacterium avium subsp. paratuberculosis
gaucgcggugcggggccgcggcc

SEQ ID NO: 911197 - RNA, 16 nt, Mycobacterium avium subsp. paratuberculosis
gaucgcggugcugcag

SEQ ID NO: 911198 - RNA, 12 nt, Mycobacterium avium subsp. paratuberculosis
gaucgcgguggc

SEQ ID NO: 911199 - RNA, 14 nt, Mycobacterium avium subsp. paratuberculosis
gaucgcgguggccg

SEQ ID NO: 911200 - RNA, 23 nt, Mycobacterium avium subsp. paratuberculosis
gaucgcgguggcgcccgcggugg

SEQ ID NO: 911201 - RNA, 17 nt, Mycobacterium avium subsp. paratuberculosis
gaucgcggcccacccgc

SEQ ID NO: 911202 - RNA, 19 nt, Mycobacterium avium subsp. paratuberculosis
gaucgcggcccacccgcag

SEQ ID NO: 911203 - RNA, 20 nt, Mycobacterium avium subsp. paratuberculosis
gaucgcggcccccugaucgg

SEQ ID NO: 911204 - RNA, 21 nt, Mycobacterium avium subsp. paratuberculosis
gaucgcggcccccugaucggc

SEQ ID NO: 911205 - RNA, 23 nt, Mycobacterium avium subsp. paratuberculosis
gaucgcggcccccugaucggccg

SEQ ID NO: 911206 - RNA, 13 nt, Mycobacterium avium subsp. paratuberculosis
gaucgcggcccgc

SEQ ID NO: 911207 - RNA, 16 nt, Mycobacterium avium subsp. paratuberculosis
gaucgcggcccgccgc

SEQ ID NO: 911208 - RNA, 16 nt, Mycobacterium avium subsp. paratuberculosis
gaucgcggccggcgag

SEQ ID NO: 911209 - RNA, 19 nt, Mycobacterium avium subsp. paratuberculosis
gaucgccgagguagccgcg

SEQ ID NO: 911210 - RNA, 21 nt, Mycobacterium avium subsp. paratuberculosis
gaucgccgagguagccgcgca

SEQ ID NO: 911211 - RNA, 24 nt, Mycobacterium avium subsp. paratuberculosis
gaucgccgagucgaucgccagcgc

SEQ ID NO: 911212 - RNA, 19 nt, Mycobacterium avium subsp. paratuberculosis
gaucgccgauccggcgccg

SEQ ID NO: 911213 - RNA, 17 nt, Mycobacterium avium subsp. paratuberculosis
gaucgccgacccgguug

SEQ ID NO: 911214 - RNA, 17 nt, Mycobacterium avium subsp. paratuberculosis
gaucgccgacgccagca

SEQ ID NO: 911215 - RNA, 20 nt, Mycobacterium avium subsp. paratuberculosis
gaucgccgacgccagcacgu

SEQ ID NO: 911216 - RNA, 13 nt, Mycobacterium avium subsp. paratuberculosis
gaucgccgacguc

SEQ ID NO: 911217 - RNA, 15 nt, Mycobacterium avium subsp. paratuberculosis
gaucgccgacgucug

SEQ ID NO: 911218 - RNA, 23 nt, Mycobacterium avium subsp. paratuberculosis
gaucgcccuggcauccgucggcc

SEQ ID NO: 911219 - RNA, 17 nt, Mycobacterium avium subsp. paratuberculosis
gaucgccaguccggcgc

SEQ ID NO: 911220 - RNA, 15 nt, Mycobacterium avium subsp. paratuberculosis
gaucgcccaucaccg

SEQ ID NO: 911221 - RNA, 16 nt, Mycobacterium avium subsp. paratuberculosis
gaucgcccaucaccgc

SEQ ID NO: 911222 - RNA, 18 nt, Mycobacterium avium subsp. paratuberculosis
gaucgcccaucaccgcac

SEQ ID NO: 911223 - RNA, 12 nt, Mycobacterium avium subsp. paratuberculosis
gaucgccccgcc

SEQ ID NO: 911224 - RNA, 15 nt, Mycobacterium avium subsp. paratuberculosis
gaucgccccgccguu

SEQ ID NO: 911225 - RNA, 13 nt, Mycobacterium avium subsp. paratuberculosis
gaucgccccgggg

SEQ ID NO: 911226 - RNA, 13 nt, Mycobacterium avium subsp. paratuberculosis
gaucgcccgggcg

SEQ ID NO: 911227 - RNA, 16 nt, Mycobacterium avium subsp. paratuberculosis
gaucgcccgggcggcg

SEQ ID NO: 911228 - RNA, 23 nt, Mycobacterium avium subsp. paratuberculosis
gaucgcccgggcggcggggcugc

SEQ ID NO: 911229 - RNA, 15 nt, Mycobacterium avium subsp. paratuberculosis
gaucgccaugcuggc

SEQ ID NO: 911230 - RNA, 22 nt, Mycobacterium avium subsp. paratuberculosis
gaucgccaugcuggcacuccuu

SEQ ID NO: 911231 - RNA, 13 nt, Mycobacterium avium subsp. paratuberculosis
gaucgcccacccg

SEQ ID NO: 911232 - RNA, 14 nt, Mycobacterium avium subsp. paratuberculosis
gaucgcccacccgc

SEQ ID NO: 911233 - RNA, 19 nt, Mycobacterium avium subsp. paratuberculosis
gaucgcccacccgcacgcc

SEQ ID NO: 911234 - RNA, 17 nt, Mycobacterium avium subsp. paratuberculosis
gaucgcccagcaccgcg

SEQ ID NO: 911235 - RNA, 19 nt, Mycobacterium avium subsp. paratuberculosis
gaucgcccagcaccgcgac

SEQ ID NO: 911236 - RNA, 20 nt, Mycobacterium avium subsp. paratuberculosis
gaucgccacggcggugucgg

SEQ ID NO: 911237 - RNA, 22 nt, Mycobacterium avium subsp. paratuberculosis
gaucgccaggcguugcaccgcg

SEQ ID NO: 911238 - RNA, 18 nt, Mycobacterium avium subsp. paratuberculosis
gaucggcucggcgcccca

SEQ ID NO: 911239 - RNA, 19 nt, Mycobacterium avium subsp. paratuberculosis
gaucggcucgagcucgucg

SEQ ID NO: 911240 - RNA, 24 nt, Mycobacterium avium subsp. paratuberculosis
gaucgggaugucgugggcgugccg

SEQ ID NO: 911241 - RNA, 18 nt, Mycobacterium avium subsp. paratuberculosis
gaucgggaugugcguggu

SEQ ID NO: 911242 - RNA, 22 nt, Mycobacterium avium subsp. paratuberculosis
gaucggcuuggggaagccggcc

SEQ ID NO: 911243 - RNA, 16 nt, Mycobacterium avium subsp. paratuberculosis
gaucgggaacagcccg

SEQ ID NO: 911244 - RNA, 13 nt, Mycobacterium avium subsp. paratuberculosis
gaucgggaucggc

SEQ ID NO: 911245 - RNA, 14 nt, Mycobacterium avium subsp. paratuberculosis
gaucgggaucggcu

SEQ ID NO: 911246 - RNA, 20 nt, Mycobacterium avium subsp. paratuberculosis
gaucgggcgguccaccgacg

SEQ ID NO: 911247 - RNA, 18 nt, Mycobacterium avium subsp. paratuberculosis
gaucgggcgucgcagauc

SEQ ID NO: 911248 - RNA, 14 nt, Mycobacterium avium subsp. paratuberculosis
gaucgggucgcccg

SEQ ID NO: 911249 - RNA, 19 nt, Mycobacterium avium subsp. paratuberculosis
gaucgggugagacggccag

SEQ ID NO: 911250 - RNA, 20 nt, Mycobacterium avium subsp. paratuberculosis
gaucgggugagacggccagc

SEQ ID NO: 911251 - RNA, 21 nt, Mycobacterium avium subsp. paratuberculosis
gaucgggugagacggccagca

SEQ ID NO: 911252 - RNA, 20 nt, Mycobacterium avium subsp. paratuberculosis
gaucgggucaccggccgagc

SEQ ID NO: 911253 - RNA, 21 nt, Mycobacterium avium subsp. paratuberculosis
gaucgggucaccggccgagcc

SEQ ID NO: 911254 - RNA, 15 nt, Mycobacterium avium subsp. paratuberculosis
gaucgggucccagau

SEQ ID NO: 911255 - RNA, 20 nt, Mycobacterium avium subsp. paratuberculosis
gaucgggucccagaugcgcg

SEQ ID NO: 911256 - RNA, 20 nt, Mycobacterium avium subsp. paratuberculosis
gaucggggaauccuggccga

SEQ ID NO: 911257 - RNA, 20 nt, Mycobacterium avium subsp. paratuberculosis
gaucgguaacugcguguggc

SEQ ID NO: 911258 - RNA, 14 nt, Mycobacterium avium subsp. paratuberculosis
gaucggggccagga

SEQ ID NO: 911259 - RNA, 17 nt, Mycobacterium avium subsp. paratuberculosis
gaucggggcccaccccg

SEQ ID NO: 911260 - RNA, 14 nt, Mycobacterium avium subsp. paratuberculosis
gaucggggcgaccu

SEQ ID NO: 911261 - RNA, 21 nt, Mycobacterium avium subsp. paratuberculosis
gaucggggcgcagcccggcgg

SEQ ID NO: 911262 - RNA, 14 nt, Mycobacterium avium subsp. paratuberculosis
gaucgggguggacg

SEQ ID NO: 911263 - RNA, 21 nt, Mycobacterium avium subsp. paratuberculosis
gaucggguaacccuccggcgc

SEQ ID NO: 911264 - RNA, 16 nt, Mycobacterium avium subsp. paratuberculosis
gaucggguagacgucg

SEQ ID NO: 911265 - RNA, 18 nt, Mycobacterium avium subsp. paratuberculosis
gaucggcuagcagcuccg

SEQ ID NO: 911266 - RNA, 23 nt, Mycobacterium avium subsp. paratuberculosis
gaucggcuagcagcuccggucgg

SEQ ID NO: 911267 - RNA, 17 nt, Mycobacterium avium subsp. paratuberculosis
gaucggcguuggcggcg

SEQ ID NO: 911268 - RNA, 20 nt, Mycobacterium avium subsp. paratuberculosis
gaucggcuccagcgcccgcc

SEQ ID NO: 911269 - RNA, 21 nt, Mycobacterium avium subsp. paratuberculosis
gaucggcuccagcgcccgccg

SEQ ID NO: 911270 - RNA, 22 nt, Mycobacterium avium subsp. paratuberculosis
gaucggcuccagcgcccgccgc

SEQ ID NO: 911271 - RNA, 15 nt, Mycobacterium avium subsp. paratuberculosis
gaucggcgcgucggc

SEQ ID NO: 911272 - RNA, 12 nt, Mycobacterium avium subsp. paratuberculosis
gaucggcggccu

SEQ ID NO: 911273 - RNA, 17 nt, Mycobacterium avium subsp. paratuberculosis
gaucggcggcgacggcg

SEQ ID NO: 911274 - RNA, 23 nt, Mycobacterium avium subsp. paratuberculosis
gaucggcggcgacggcgacggcc

SEQ ID NO: 911275 - RNA, 18 nt, Mycobacterium avium subsp. paratuberculosis
gaucggcggcucgccggc

SEQ ID NO: 911276 - RNA, 20 nt, Mycobacterium avium subsp. paratuberculosis
gaucggcgggacccgcgacc

SEQ ID NO: 911277 - RNA, 16 nt, Mycobacterium avium subsp. paratuberculosis
gaucggcgggcgccga

SEQ ID NO: 911278 - RNA, 22 nt, Mycobacterium avium subsp. paratuberculosis
gaucggcgggcgccgaaucggc

SEQ ID NO: 911279 - RNA, 14 nt, Mycobacterium avium subsp. paratuberculosis
gaucggcggggcgc

SEQ ID NO: 911280 - RNA, 21 nt, Mycobacterium avium subsp. paratuberculosis
gaucggcggggcgcguucggg

SEQ ID NO: 911281 - RNA, 23 nt, Mycobacterium avium subsp. paratuberculosis
gaucggcgggugcgggcgcugca

SEQ ID NO: 911282 - RNA, 20 nt, Mycobacterium avium subsp. paratuberculosis
gaucggcggucccgugcgcc

SEQ ID NO: 911283 - RNA, 23 nt, Mycobacterium avium subsp. paratuberculosis
gaucggcggaacccggguggccc

SEQ ID NO: 911284 - RNA, 12 nt, Mycobacterium avium subsp. paratuberculosis
gaucggcggcca

SEQ ID NO: 911285 - RNA, 15 nt, Mycobacterium avium subsp. paratuberculosis
gaucggcggccacca

SEQ ID NO: 911286 - RNA, 20 nt, Mycobacterium avium subsp. paratuberculosis
gaucggcggccaccagccgg

SEQ ID NO: 911287 - RNA, 21 nt, Mycobacterium avium subsp. paratuberculosis
gaucggcggccaccagccggc

SEQ ID NO: 911288 - RNA, 22 nt, Mycobacterium avium subsp. paratuberculosis
gaucgcgguggcuuccagcccg

SEQ ID NO: 911289 - RNA, 19 nt, Mycobacterium avium subsp. paratuberculosis
gaucggcaggucgucgacg

SEQ ID NO: 911290 - RNA, 20 nt, Mycobacterium avium subsp. paratuberculosis
gaucggcaggucgucgacgu

SEQ ID NO: 911291 - RNA, 19 nt, Mycobacterium avium subsp. paratuberculosis
gaucggcaugacgcccagc

SEQ ID NO: 911292 - RNA, 15 nt, Mycobacterium avium subsp. paratuberculosis
gaucggccagccacg

SEQ ID NO: 911293 - RNA, 13 nt, Mycobacterium avium subsp. paratuberculosis
gaucggccagcgc

SEQ ID NO: 911294 - RNA, 14 nt, Mycobacterium avium subsp. paratuberculosis
gaucggccagcgcg

SEQ ID NO: 911295 - RNA, 15 nt, Mycobacterium avium subsp. paratuberculosis
gaucggccagcgcgg

SEQ ID NO: 911296 - RNA, 17 nt, Mycobacterium avium subsp. paratuberculosis
gaucggccagcgcggcc

SEQ ID NO: 911297 - RNA, 18 nt, Mycobacterium avium subsp. paratuberculosis
gaucggccagcgcggccg

SEQ ID NO: 911298 - RNA, 14 nt, Mycobacterium avium subsp. paratuberculosis
gaucgcagcgguga

SEQ ID NO: 911299 - RNA, 17 nt, Mycobacterium avium subsp. paratuberculosis
gaucgauggggauggug

SEQ ID NO: 911300 - RNA, 21 nt, Mycobacterium avium subsp. paratuberculosis
gaucgauggggauggugcgcc

SEQ ID NO: 911301 - RNA, 13 nt, Mycobacterium avium subsp. paratuberculosis
gaucgaugcccag

SEQ ID NO: 911302 - RNA, 23 nt, Mycobacterium avium subsp. paratuberculosis
gaucgaauccggcggcgcucagc

SEQ ID NO: 911303 - RNA, 18 nt, Mycobacterium avium subsp. paratuberculosis
gaucgaugaauccgcgca

SEQ ID NO: 911304 - RNA, 17 nt, Mycobacterium avium subsp. paratuberculosis
gaucgaucccgucggcc

SEQ ID NO: 911305 - RNA, 19 nt, Mycobacterium avium subsp. paratuberculosis
gaucgaucccuuggcggcg

SEQ ID NO: 911306 - RNA, 21 nt, Mycobacterium avium subsp. paratuberculosis
gaucgaucccuuggcggcggc

SEQ ID NO: 911307 - RNA, 13 nt, Mycobacterium avium subsp. paratuberculosis
gaucgaucaucgc

SEQ ID NO: 911308 - RNA, 17 nt, Mycobacterium avium subsp. paratuberculosis
gaucgccagcaccggcg

SEQ ID NO: 911309 - RNA, 22 nt, Mycobacterium avium subsp. paratuberculosis
gaucgccagcaccggcgcgccg

SEQ ID NO: 911310 - RNA, 21 nt, Mycobacterium avium subsp. paratuberculosis
gaucgccaacgcgcucaagau

SEQ ID NO: 911311 - RNA, 13 nt, Mycobacterium avium subsp. paratuberculosis
gaucgccagcgcg

SEQ ID NO: 911312 - RNA, 14 nt, Mycobacterium avium subsp. paratuberculosis
gaucgccagcgcgc

SEQ ID NO: 911313 - RNA, 16 nt, Mycobacterium avium subsp. paratuberculosis
gaucgccagcgcggug

SEQ ID NO: 911314 - RNA, 19 nt, Mycobacterium avium subsp. paratuberculosis
gaucgccagcccggcguac

SEQ ID NO: 911315 - RNA, 14 nt, Mycobacterium avium subsp. paratuberculosis
gaucgccagcgccc

SEQ ID NO: 911316 - RNA, 16 nt, Mycobacterium avium subsp. paratuberculosis
gaucgccagcgccccc

SEQ ID NO: 911317 - RNA, 16 nt, Mycobacterium avium subsp. paratuberculosis
gaucgccagcgcccga

SEQ ID NO: 911318 - RNA, 17 nt, Mycobacterium avium subsp. paratuberculosis
gaucgccagcgcccgau

SEQ ID NO: 911319 - RNA, 19 nt, Mycobacterium avium subsp. paratuberculosis
gaucgaacagggcggcggg

SEQ ID NO: 911320 - RNA, 16 nt, Mycobacterium avium subsp. paratuberculosis
gaucgaaacgccgcgc

SEQ ID NO: 911321 - RNA, 19 nt, Mycobacterium avium subsp. paratuberculosis
gaucgaaaggacgggcgug

SEQ ID NO: 911322 - RNA, 18 nt, Mycobacterium avium subsp. paratuberculosis
gaucgaaaugaccgcgcc

SEQ ID NO: 911323 - RNA, 12 nt, Mycobacterium avium subsp. paratuberculosis
gauccggccgcu

SEQ ID NO: 911324 - RNA, 18 nt, Mycobacterium avium subsp. paratuberculosis
gauccggccggcggcggu

SEQ ID NO: 911325 - RNA, 16 nt, Mycobacterium avium subsp. paratuberculosis
gauccggcugagcagc

SEQ ID NO: 911326 - RNA, 19 nt, Mycobacterium avium subsp. paratuberculosis
gauccggcugagcagcucg

SEQ ID NO: 911327 - RNA, 20 nt, Mycobacterium avium subsp. paratuberculosis
gauccgggcacgcagcggcg

SEQ ID NO: 911328 - RNA, 17 nt, Mycobacterium avium subsp. paratuberculosis
gauccugcagcuggcga

SEQ ID NO: 911329 - RNA, 22 nt, Mycobacterium avium subsp. paratuberculosis
gaucgaaggcgugcucgaucgc

SEQ ID NO: 911330 - RNA, 16 nt, Mycobacterium avium subsp. paratuberculosis
gaucgacaacgcguga

SEQ ID NO: 911331 - RNA, 15 nt, Mycobacterium avium subsp. paratuberculosis
gaucgaacggcaccu

SEQ ID NO: 911332 - RNA, 18 nt, Mycobacterium avium subsp. paratuberculosis
gaucgaacggcaccucga

SEQ ID NO: 911333 - RNA, 19 nt, Mycobacterium avium subsp. paratuberculosis
gaucgaacggcaccucgau

SEQ ID NO: 911334 - RNA, 22 nt, Mycobacterium avium subsp. paratuberculosis
gaucgaacggcaccucgaucac

SEQ ID NO: 911335 - RNA, 19 nt, Mycobacterium avium subsp. paratuberculosis
gaucgagucccgcgcggcg

SEQ ID NO: 911336 - RNA, 15 nt, Mycobacterium avium subsp. paratuberculosis
gaucgaguccucgcg

SEQ ID NO: 911337 - RNA, 21 nt, Mycobacterium avium subsp. paratuberculosis
gaucgaguucacccgaauucc

SEQ ID NO: 911338 - RNA, 18 nt, Mycobacterium avium subsp. paratuberculosis
gaucgaguucagcgucga

SEQ ID NO: 911339 - RNA, 19 nt, Mycobacterium avium subsp. paratuberculosis
gaucgaguuccgcgucggc

SEQ ID NO: 911340 - RNA, 21 nt, Mycobacterium avium subsp. paratuberculosis
gauccgcguggcucucguccu

SEQ ID NO: 911341 - RNA, 23 nt, Mycobacterium avium subsp. paratuberculosis
gauccgcugcggauccgacgaac

SEQ ID NO: 911342 - RNA, 20 nt, Mycobacterium avium subsp. paratuberculosis
gauccggacgaccugggcgc

SEQ ID NO: 911343 - RNA, 16 nt, Mycobacterium avium subsp. paratuberculosis
gauccggcgcccgaug

SEQ ID NO: 911344 - RNA, 17 nt, Mycobacterium avium subsp. paratuberculosis
gauccggcgccgcgggc

SEQ ID NO: 911345 - RNA, 17 nt, Mycobacterium avium subsp. paratuberculosis
gauccggcgcgccgcga

SEQ ID NO: 911346 - RNA, 18 nt, Mycobacterium avium subsp. paratuberculosis
gauccggcgcgccgcgau

SEQ ID NO: 911347 - RNA, 17 nt, Mycobacterium avium subsp. paratuberculosis
gauccggaugaucuuga

SEQ ID NO: 911348 - RNA, 19 nt, Mycobacterium avium subsp. paratuberculosis
gauccggauugccgggcag

SEQ ID NO: 911349 - RNA, 21 nt, Mycobacterium avium subsp. paratuberculosis
gauccgcggguacggucggcc

SEQ ID NO: 911350 - RNA, 22 nt, Mycobacterium avium subsp. paratuberculosis
gauccgcggguacggucggccg

SEQ ID NO: 911351 - RNA, 24 nt, Mycobacterium avium subsp. paratuberculosis
gauccgcggguacggucggccgua

SEQ ID NO: 911352 - RNA, 16 nt, Mycobacterium avium subsp. paratuberculosis
gauccgcggcgccggg

SEQ ID NO: 911353 - RNA, 22 nt, Mycobacterium avium subsp. paratuberculosis
gauccgcggcgccgggcggccc

SEQ ID NO: 911354 - RNA, 16 nt, Mycobacterium avium subsp. paratuberculosis
gauccgcgggccggca

SEQ ID NO: 911355 - RNA, 14 nt, Mycobacterium avium subsp. paratuberculosis
gauccgcgccgccg

SEQ ID NO: 911356 - RNA, 13 nt, Mycobacterium avium subsp. paratuberculosis
gauccgcgccgcg

SEQ ID NO: 911357 - RNA, 15 nt, Mycobacterium avium subsp. paratuberculosis
gauccgcgccgcgau

SEQ ID NO: 911358 - RNA, 24 nt, Mycobacterium avium subsp. paratuberculosis
gauccgcgccgcgaugcaacaccg

SEQ ID NO: 911359 - RNA, 20 nt, Mycobacterium avium subsp. paratuberculosis
gauccgcgcggccaccagcg

SEQ ID NO: 911360 - RNA, 21 nt, Mycobacterium avium subsp. paratuberculosis
gauccgcgcggccaccagcgc

SEQ ID NO: 911361 - RNA, 22 nt, Mycobacterium avium subsp. paratuberculosis
gauccgcgcggccaccagcgcg

SEQ ID NO: 911362 - RNA, 13 nt, Mycobacterium avium subsp. paratuberculosis
gauccgcgcggcg

SEQ ID NO: 911363 - RNA, 16 nt, Mycobacterium avium subsp. paratuberculosis
gauccgcccggcccgc

SEQ ID NO: 911364 - RNA, 17 nt, Mycobacterium avium subsp. paratuberculosis
gauccgcccggcccgca

SEQ ID NO: 911365 - RNA, 14 nt, Mycobacterium avium subsp. paratuberculosis
gauccagaugccgg

SEQ ID NO: 911366 - RNA, 18 nt, Mycobacterium avium subsp. paratuberculosis
gauccagaugccgggugg

SEQ ID NO: 911367 - RNA, 19 nt, Mycobacterium avium subsp. paratuberculosis
gauccagaugccggguggg

SEQ ID NO: 911368 - RNA, 14 nt, Mycobacterium avium subsp. paratuberculosis
gauccacggcgacc

SEQ ID NO: 911369 - RNA, 15 nt, Mycobacterium avium subsp. paratuberculosis
gauccacuccagcac

SEQ ID NO: 911370 - RNA, 18 nt, Mycobacterium avium subsp. paratuberculosis
gauccagcgcuggccggc

SEQ ID NO: 911371 - RNA, 14 nt, Mycobacterium avium subsp. paratuberculosis
gauccgcaccgggc

SEQ ID NO: 911372 - RNA, 16 nt, Mycobacterium avium subsp. paratuberculosis
gauccgcaccgggcag

SEQ ID NO: 911373 - RNA, 15 nt, Mycobacterium avium subsp. paratuberculosis
gauccgcagccgcug

SEQ ID NO: 911374 - RNA, 13 nt, Mycobacterium avium subsp. paratuberculosis
gauccgcagcuga

SEQ ID NO: 911375 - RNA, 20 nt, Mycobacterium avium subsp. paratuberculosis
gauccgcaggaaagcgucac

SEQ ID NO: 911376 - RNA, 21 nt, Mycobacterium avium subsp. paratuberculosis
gaucccugcgcucagcacgcg

SEQ ID NO: 911377 - RNA, 15 nt, Mycobacterium avium subsp. paratuberculosis
gauccagcagcgccu

SEQ ID NO: 911378 - RNA, 15 nt, Mycobacterium avium subsp. paratuberculosis
gauccagcggcggcc

SEQ ID NO: 911379 - RNA, 19 nt, Mycobacterium avium subsp. paratuberculosis
gauccaggaacggcacccg

SEQ ID NO: 911380 - RNA, 20 nt, Mycobacterium avium subsp. paratuberculosis
gauccaggaacggcacccgc

SEQ ID NO: 911381 - RNA, 21 nt, Mycobacterium avium subsp. paratuberculosis
gauccaggaacggcacccgca

SEQ ID NO: 911382 - RNA, 17 nt, Mycobacterium avium subsp. paratuberculosis
gauccaggaauucgggc

SEQ ID NO: 911383 - RNA, 17 nt, Mycobacterium avium subsp. paratuberculosis
gaucauguagcgcuggu

SEQ ID NO: 911384 - RNA, 15 nt, Mycobacterium avium subsp. paratuberculosis
gauccacccaccggc

SEQ ID NO: 911385 - RNA, 16 nt, Mycobacterium avium subsp. paratuberculosis
gauccacgcccggacc

SEQ ID NO: 911386 - RNA, 16 nt, Mycobacterium avium subsp. paratuberculosis
gauccaccgcgcggcc

SEQ ID NO: 911387 - RNA, 18 nt, Mycobacterium avium subsp. paratuberculosis
gauccaaccgagucgcug

SEQ ID NO: 911388 - RNA, 20 nt, Mycobacterium avium subsp. paratuberculosis
gaucaugauccggaagccgu

SEQ ID NO: 911389 - RNA, 13 nt, Mycobacterium avium subsp. paratuberculosis
gaucaugccggcg

SEQ ID NO: 911390 - RNA, 17 nt, Mycobacterium avium subsp. paratuberculosis
gaucaugaagucgcgga

SEQ ID NO: 911391 - RNA, 16 nt, Mycobacterium avium subsp. paratuberculosis
gaucauggucggcgac

SEQ ID NO: 911392 - RNA, 22 nt, Mycobacterium avium subsp. paratuberculosis
gaucaugucgguaaggcaggca

SEQ ID NO: 911393 - RNA, 13 nt, Mycobacterium avium subsp. paratuberculosis
gaucaugucgucc

SEQ ID NO: 911394 - RNA, 21 nt, Mycobacterium avium subsp. paratuberculosis
gaucaugucguccucccggcc

SEQ ID NO: 911395 - RNA, 16 nt, Mycobacterium avium subsp. paratuberculosis
gaucaucaccaccgcc

SEQ ID NO: 911396 - RNA, 19 nt, Mycobacterium avium subsp. paratuberculosis
gaucaucaccaccgccgcc

SEQ ID NO: 911397 - RNA, 16 nt, Mycobacterium avium subsp. paratuberculosis
gaucagugccgcgcca

SEQ ID NO: 911398 - RNA, 23 nt, Mycobacterium avium subsp. paratuberculosis
gaucagucgaagaugucgcggcg

SEQ ID NO: 911399 - RNA, 16 nt, Mycobacterium avium subsp. paratuberculosis
gaucaucccggccacc

SEQ ID NO: 911400 - RNA, 17 nt, Mycobacterium avium subsp. paratuberculosis
gaucaucccggccaccc

SEQ ID NO: 911401 - RNA, 19 nt, Mycobacterium avium subsp. paratuberculosis
gaucaucccggccaccccg

SEQ ID NO: 911402 - RNA, 21 nt, Mycobacterium avium subsp. paratuberculosis
gaucaucccggccaccccgca

SEQ ID NO: 911403 - RNA, 17 nt, Mycobacterium avium subsp. paratuberculosis
gaucauccggcggggga

SEQ ID NO: 911404 - RNA, 19 nt, Mycobacterium avium subsp. paratuberculosis
gaucauccggcgggggauc

SEQ ID NO: 911405 - RNA, 13 nt, Mycobacterium avium subsp. paratuberculosis
gaucaucgccucg

SEQ ID NO: 911406 - RNA, 13 nt, Mycobacterium avium subsp. paratuberculosis
gaucagguggggc

SEQ ID NO: 911407 - RNA, 16 nt, Mycobacterium avium subsp. paratuberculosis
gaucaggugcagcgug

SEQ ID NO: 911408 - RNA, 23 nt, Mycobacterium avium subsp. paratuberculosis
gaucagguaccgguuccgggcga

SEQ ID NO: 911409 - RNA, 23 nt, Mycobacterium avium subsp. paratuberculosis
gaucagguccuugcgcgccgcga

SEQ ID NO: 911410 - RNA, 18 nt, Mycobacterium avium subsp. paratuberculosis
gaucagggcggcgccgcg

SEQ ID NO: 911411 - RNA, 15 nt, Mycobacterium avium subsp. paratuberculosis
gaucagggcggcgcg

SEQ ID NO: 911412 - RNA, 16 nt, Mycobacterium avium subsp. paratuberculosis
gaucagggcggcgcgc

SEQ ID NO: 911413 - RNA, 16 nt, Mycobacterium avium subsp. paratuberculosis
gaucagggugcucagc

SEQ ID NO: 911414 - RNA, 20 nt, Mycobacterium avium subsp. paratuberculosis
gaucagggugcucagccgca

SEQ ID NO: 911415 - RNA, 14 nt, Mycobacterium avium subsp. paratuberculosis
gaucaggcugccgc

SEQ ID NO: 911416 - RNA, 22 nt, Mycobacterium avium subsp. paratuberculosis
gaucaggcugccgcugcgccgg

SEQ ID NO: 911417 - RNA, 21 nt, Mycobacterium avium subsp. paratuberculosis
gaucaggcuggacaccacguc

SEQ ID NO: 911418 - RNA, 14 nt, Mycobacterium avium subsp. paratuberculosis
gaucagggcccaca

SEQ ID NO: 911419 - RNA, 23 nt, Mycobacterium avium subsp. paratuberculosis
gaucagggcccacagcagccgca

SEQ ID NO: 911420 - RNA, 17 nt, Mycobacterium avium subsp. paratuberculosis
gaucagggccgcggccg

SEQ ID NO: 911421 - RNA, 18 nt, Mycobacterium avium subsp. paratuberculosis
gaucagggccgcggccgc

SEQ ID NO: 911422 - RNA, 22 nt, Mycobacterium avium subsp. paratuberculosis
gaucagggccgcggccgccgcg

SEQ ID NO: 911423 - RNA, 16 nt, Mycobacterium avium subsp. paratuberculosis
gaucaggccccacccg

SEQ ID NO: 911424 - RNA, 18 nt, Mycobacterium avium subsp. paratuberculosis
gaucaggccccacccgca

SEQ ID NO: 911425 - RNA, 14 nt, Mycobacterium avium subsp. paratuberculosis
gaucaggcgcagcc

SEQ ID NO: 911426 - RNA, 17 nt, Mycobacterium avium subsp. paratuberculosis
gaucaggaucggcgggc

SEQ ID NO: 911427 - RNA, 17 nt, Mycobacterium avium subsp. paratuberculosis
gaucaggaugacgccgc

SEQ ID NO: 911428 - RNA, 12 nt, Mycobacterium avium subsp. paratuberculosis
gaucagcuccuc

SEQ ID NO: 911429 - RNA, 16 nt, Mycobacterium avium subsp. paratuberculosis
gaucagcuccucgcgg

SEQ ID NO: 911430 - RNA, 15 nt, Mycobacterium avium subsp. paratuberculosis
gaucagcgucgcgau

SEQ ID NO: 911431 - RNA, 14 nt, Mycobacterium avium subsp. paratuberculosis
gaucagcucgccga

SEQ ID NO: 911432 - RNA, 13 nt, Mycobacterium avium subsp. paratuberculosis
gaucagcgugguc

SEQ ID NO: 911433 - RNA, 20 nt, Mycobacterium avium subsp. paratuberculosis
gaucagcguggucagcgucu

SEQ ID NO: 911434 - RNA, 18 nt, Mycobacterium avium subsp. paratuberculosis
gaucagcguuccggcggc

SEQ ID NO: 911435 - RNA, 19 nt, Mycobacterium avium subsp. paratuberculosis
gaucagcguuccggcggcc

SEQ ID NO: 911436 - RNA, 20 nt, Mycobacterium avium subsp. paratuberculosis
gaucagcguuccggcggccg

SEQ ID NO: 911437 - RNA, 23 nt, Mycobacterium avium subsp. paratuberculosis
gaucagcugcucggccaccgcgc

SEQ ID NO: 911438 - RNA, 16 nt, Mycobacterium avium subsp. paratuberculosis
gaucagcucguggcgg

SEQ ID NO: 911439 - RNA, 19 nt, Mycobacterium avium subsp. paratuberculosis
gaucagcucguggcgggcc

SEQ ID NO: 911440 - RNA, 12 nt, Mycobacterium avium subsp. paratuberculosis
gaucagcgcgcc

SEQ ID NO: 911441 - RNA, 16 nt, Mycobacterium avium subsp. paratuberculosis
gaucagcgcgcccagg

SEQ ID NO: 911442 - RNA, 16 nt, Mycobacterium avium subsp. paratuberculosis
gaucagcgccuggucc

SEQ ID NO: 911443 - RNA, 18 nt, Mycobacterium avium subsp. paratuberculosis
gaucagcgcgcacagcgc

SEQ ID NO: 911444 - RNA, 21 nt, Mycobacterium avium subsp. paratuberculosis
gaucagcgcgcacagcgccac

SEQ ID NO: 911445 - RNA, 24 nt, Mycobacterium avium subsp. paratuberculosis
gaucagcgcgcacagcgccacacc

SEQ ID NO: 911446 - RNA, 12 nt, Mycobacterium avium subsp. paratuberculosis
gaucagcgccgu

SEQ ID NO: 911447 - RNA, 23 nt, Mycobacterium avium subsp. paratuberculosis
gaucagcgccgucuccucgacca

SEQ ID NO: 911448 - RNA, 14 nt, Mycobacterium avium subsp. paratuberculosis
gaucagcgccagca

SEQ ID NO: 911449 - RNA, 19 nt, Mycobacterium avium subsp. paratuberculosis
gaucagcgggcuguccgcg

SEQ ID NO: 911450 - RNA, 20 nt, Mycobacterium avium subsp. paratuberculosis
gaucagcgggcuguccgcgu

SEQ ID NO: 911451 - RNA, 12 nt, Mycobacterium avium subsp. paratuberculosis
gaucagcggcgg

SEQ ID NO: 911452 - RNA, 13 nt, Mycobacterium avium subsp. paratuberculosis
gagugaccgccag

SEQ ID NO: 911453 - RNA, 15 nt, Mycobacterium avium subsp. paratuberculosis
gagugaccgccagca

SEQ ID NO: 911454 - RNA, 19 nt, Mycobacterium avium subsp. paratuberculosis
gagugacguugagcacccg

SEQ ID NO: 911455 - RNA, 16 nt, Mycobacterium avium subsp. paratuberculosis
gagugaggacgaggcg

SEQ ID NO: 911456 - RNA, 17 nt, Mycobacterium avium subsp. paratuberculosis
gagugaggccgaggcga

SEQ ID NO: 911457 - RNA, 19 nt, Mycobacterium avium subsp. paratuberculosis
gagugaggccgaggcgagu

SEQ ID NO: 911458 - RNA, 14 nt, Mycobacterium avium subsp. paratuberculosis
gagucgucggcgcg

SEQ ID NO: 911459 - RNA, 20 nt, Mycobacterium avium subsp. paratuberculosis
gagucguacuucgcccccgg

SEQ ID NO: 911460 - RNA, 21 nt, Mycobacterium avium subsp. paratuberculosis
gagucguagaggggccggacg

SEQ ID NO: 911461 - RNA, 22 nt, Mycobacterium avium subsp. paratuberculosis
gagucggccaccgcggucgacg

SEQ ID NO: 911462 - RNA, 13 nt, Mycobacterium avium subsp. paratuberculosis
gagucggucgagu

SEQ ID NO: 911463 - RNA, 15 nt, Mycobacterium avium subsp. paratuberculosis
gagucggucgagucg

SEQ ID NO: 911464 - RNA, 20 nt, Mycobacterium avium subsp. paratuberculosis
gagucgcuggcgcgcuuggu

SEQ ID NO: 911465 - RNA, 19 nt, Mycobacterium avium subsp. paratuberculosis
gagucggggugcucgaucg

SEQ ID NO: 911466 - RNA, 20 nt, Mycobacterium avium subsp. paratuberculosis
gagucggggugcucgaucgg

SEQ ID NO: 911467 - RNA, 14 nt, Mycobacterium avium subsp. paratuberculosis
gagucggcgucgga

SEQ ID NO: 911468 - RNA, 19 nt, Mycobacterium avium subsp. paratuberculosis
gagucggcgucggagaugc

SEQ ID NO: 911469 - RNA, 21 nt, Mycobacterium avium subsp. paratuberculosis
gagucgggaaaucggacccag

SEQ ID NO: 911470 - RNA, 16 nt, Mycobacterium avium subsp. paratuberculosis
gagucgcgccgcgucg

SEQ ID NO: 911471 - RNA, 14 nt, Mycobacterium avium subsp. paratuberculosis
gagucgcgcgacca

SEQ ID NO: 911472 - RNA, 22 nt, Mycobacterium avium subsp. paratuberculosis
gagguuagguacgcggcuggcg

SEQ ID NO: 911473 - RNA, 13 nt, Mycobacterium avium subsp. paratuberculosis
gagucgaugaccu

SEQ ID NO: 911474 - RNA, 16 nt, Mycobacterium avium subsp. paratuberculosis
gagguguugucgugcc

SEQ ID NO: 911475 - RNA, 18 nt, Mycobacterium avium subsp. paratuberculosis
gagguugaugccgacguc

SEQ ID NO: 911476 - RNA, 13 nt, Mycobacterium avium subsp. paratuberculosis
gagguggcccgcc

SEQ ID NO: 911477 - RNA, 22 nt, Mycobacterium avium subsp. paratuberculosis
gaggugguuucggggucgccgu

SEQ ID NO: 911478 - RNA, 19 nt, Mycobacterium avium subsp. paratuberculosis
gagguggcguagucgucga

SEQ ID NO: 911479 - RNA, 23 nt, Mycobacterium avium subsp. paratuberculosis
gagguccuugcggaaccgcugca

SEQ ID NO: 911480 - RNA, 13 nt, Mycobacterium avium subsp. paratuberculosis
gaggucgacggag

SEQ ID NO: 911481 - RNA, 14 nt, Mycobacterium avium subsp. paratuberculosis
gaggugccggccgg

SEQ ID NO: 911482 - RNA, 17 nt, Mycobacterium avium subsp. paratuberculosis
gaggugccggccggucg

SEQ ID NO: 911483 - RNA, 15 nt, Mycobacterium avium subsp. paratuberculosis
gaggugcucgacggc

SEQ ID NO: 911484 - RNA, 15 nt, Mycobacterium avium subsp. paratuberculosis
gagguccucggcgau

SEQ ID NO: 911485 - RNA, 19 nt, Mycobacterium avium subsp. paratuberculosis
gaggucauggcgaccgcga

SEQ ID NO: 911486 - RNA, 21 nt, Mycobacterium avium subsp. paratuberculosis
gaggucauggcgaccgcgacg

SEQ ID NO: 911487 - RNA, 17 nt, Mycobacterium avium subsp. paratuberculosis
gaggucauaucgacggc

SEQ ID NO: 911488 - RNA, 13 nt, Mycobacterium avium subsp. paratuberculosis
gaggucagcgcgu

SEQ ID NO: 911489 - RNA, 16 nt, Mycobacterium avium subsp. paratuberculosis
gaggucagcggcccga

SEQ ID NO: 911490 - RNA, 23 nt, Mycobacterium avium subsp. paratuberculosis
gaggucagcggcccgaucaccag

SEQ ID NO: 911491 - RNA, 15 nt, Mycobacterium avium subsp. paratuberculosis
gaguggucggccgcc

SEQ ID NO: 911492 - RNA, 22 nt, Mycobacterium avium subsp. paratuberculosis
gagugcgugucacuacccgcga

SEQ ID NO: 911493 - RNA, 15 nt, Mycobacterium avium subsp. paratuberculosis
gagugcggcgcggug

SEQ ID NO: 911494 - RNA, 16 nt, Mycobacterium avium subsp. paratuberculosis
gagugcgaaacucacc

SEQ ID NO: 911495 - RNA, 18 nt, Mycobacterium avium subsp. paratuberculosis
gagugcugcagaccgaac

SEQ ID NO: 911496 - RNA, 15 nt, Mycobacterium avium subsp. paratuberculosis
gagugcuggacggcc

SEQ ID NO: 911497 - RNA, 20 nt, Mycobacterium avium subsp. paratuberculosis
gagugcucgauggccagcgc

SEQ ID NO: 911498 - RNA, 16 nt, Mycobacterium avium subsp. paratuberculosis
gaguggaacagccgga

SEQ ID NO: 911499 - RNA, 17 nt, Mycobacterium avium subsp. paratuberculosis
gaguggaacagccggau

SEQ ID NO: 911500 - RNA, 18 nt, Mycobacterium avium subsp. paratuberculosis
gaguucagaagucgcccg

SEQ ID NO: 911501 - RNA, 22 nt, Mycobacterium avium subsp. paratuberculosis
gaguucagcgucgaugugggcc

SEQ ID NO: 911502 - RNA, 19 nt, Mycobacterium avium subsp. paratuberculosis
gaguucaucgacgucgaag

SEQ ID NO: 911503 - RNA, 18 nt, Mycobacterium avium subsp. paratuberculosis
gaguuccucgugcgugcg

SEQ ID NO: 911504 - RNA, 14 nt, Mycobacterium avium subsp. paratuberculosis
gaguucgaccucgg

SEQ ID NO: 911505 - RNA, 19 nt, Mycobacterium avium subsp. paratuberculosis
gaguucgaccucggugaug

SEQ ID NO: 911506 - RNA, 14 nt, Mycobacterium avium subsp. paratuberculosis
gaguuggccaucgu

SEQ ID NO: 911507 - RNA, 13 nt, Mycobacterium avium subsp. paratuberculosis
gaguuggccggca

SEQ ID NO: 911508 - RNA, 17 nt, Mycobacterium avium subsp. paratuberculosis
gaguugggucacaucgc

SEQ ID NO: 911509 - RNA, 12 nt, Mycobacterium avium subsp. paratuberculosis
gaguugggucgc

SEQ ID NO: 911510 - RNA, 18 nt, Mycobacterium avium subsp. paratuberculosis
gaguuuuucgggguggug

SEQ ID NO: 911511 - RNA, 20 nt, Mycobacterium avium subsp. paratuberculosis
gaguuuuucgggguggugga

SEQ ID NO: 911512 - RNA, 18 nt, Mycobacterium avium subsp. paratuberculosis
gaggccagcugcaccggg

SEQ ID NO: 911513 - RNA, 15 nt, Mycobacterium avium subsp. paratuberculosis
gaggccagcacgccg

SEQ ID NO: 911514 - RNA, 15 nt, Mycobacterium avium subsp. paratuberculosis
gaggccaccgcgccg

SEQ ID NO: 911515 - RNA, 16 nt, Mycobacterium avium subsp. paratuberculosis
gaggccaccgcgccgu

SEQ ID NO: 911516 - RNA, 14 nt, Mycobacterium avium subsp. paratuberculosis
gaggccagcacccg

SEQ ID NO: 911517 - RNA, 13 nt, Mycobacterium avium subsp. paratuberculosis
gaggccagcaccu

SEQ ID NO: 911518 - RNA, 15 nt, Mycobacterium avium subsp. paratuberculosis
gaggcccggacggcc

SEQ ID NO: 911519 - RNA, 19 nt, Mycobacterium avium subsp. paratuberculosis
gaggcccucgacaccggug

SEQ ID NO: 911520 - RNA, 19 nt, Mycobacterium avium subsp. paratuberculosis
gaggcccacguugagcacg

SEQ ID NO: 911521 - RNA, 13 nt, Mycobacterium avium subsp. paratuberculosis
gaggcccagcccg

SEQ ID NO: 911522 - RNA, 17 nt, Mycobacterium avium subsp. paratuberculosis
gaggcccagcccgccgc

SEQ ID NO: 911523 - RNA, 12 nt, Mycobacterium avium subsp. paratuberculosis
gaggccaggcgu

SEQ ID NO: 911524 - RNA, 22 nt, Mycobacterium avium subsp. paratuberculosis
gaggcaguuccaugucgacgac

SEQ ID NO: 911525 - RNA, 22 nt, Mycobacterium avium subsp. paratuberculosis
gaggccagcgcgaucgccggga

SEQ ID NO: 911526 - RNA, 17 nt, Mycobacterium avium subsp. paratuberculosis
gaggccgauggcgccca

SEQ ID NO: 911527 - RNA, 18 nt, Mycobacterium avium subsp. paratuberculosis
gaggccgauggcgcccag

SEQ ID NO: 911528 - RNA, 22 nt, Mycobacterium avium subsp. paratuberculosis
gaggccgacgugcuuggccagc

SEQ ID NO: 911529 - RNA, 17 nt, Mycobacterium avium subsp. paratuberculosis
gaggccgcggcgacacc

SEQ ID NO: 911530 - RNA, 14 nt, Mycobacterium avium subsp. paratuberculosis
gaggccggccagcg

SEQ ID NO: 911531 - RNA, 20 nt, Mycobacterium avium subsp. paratuberculosis
gaggccgccccggccgcgca

SEQ ID NO: 911532 - RNA, 22 nt, Mycobacterium avium subsp. paratuberculosis
gaggccgccccggccgcgcacc

SEQ ID NO: 911533 - RNA, 19 nt, Mycobacterium avium subsp. paratuberculosis
gagcagacgcgaaagcacc

SEQ ID NO: 911534 - RNA, 22 nt, Mycobacterium avium subsp. paratuberculosis
gagcagacgcgaaagcacccga

SEQ ID NO: 911535 - RNA, 14 nt, Mycobacterium avium subsp. paratuberculosis
gagcagauccugca

SEQ ID NO: 911536 - RNA, 21 nt, Mycobacterium avium subsp. paratuberculosis
gagcagauccugcagcuggcg

SEQ ID NO: 911537 - RNA, 11 nt, Mycobacterium avium subsp. paratuberculosis
gaggcacccgc

SEQ ID NO: 911538 - RNA, 19 nt, Mycobacterium avium subsp. paratuberculosis
gaggcacccgcugcaccag

SEQ ID NO: 911539 - RNA, 20 nt, Mycobacterium avium subsp. paratuberculosis
gaggcacccgcugcaccagc

SEQ ID NO: 911540 - RNA, 18 nt, Mycobacterium avium subsp. paratuberculosis
gaggcaccgaacgccagc

SEQ ID NO: 911541 - RNA, 14 nt, Mycobacterium avium subsp. paratuberculosis
gaggcacggcccgc

SEQ ID NO: 911542 - RNA, 15 nt, Mycobacterium avium subsp. paratuberculosis
gagcagcaccacccg

SEQ ID NO: 911543 - RNA, 13 nt, Mycobacterium avium subsp. paratuberculosis
gagcagcacccga

SEQ ID NO: 911544 - RNA, 13 nt, Mycobacterium avium subsp. paratuberculosis
gagcagcaccgcg

SEQ ID NO: 911545 - RNA, 14 nt, Mycobacterium avium subsp. paratuberculosis
gagcagcaccgcga

SEQ ID NO: 911546 - RNA, 17 nt, Mycobacterium avium subsp. paratuberculosis
gagcagcaccgcgaccc

SEQ ID NO: 911547 - RNA, 23 nt, Mycobacterium avium subsp. paratuberculosis
gagcagcaccgcgacccaggccg

SEQ ID NO: 911548 - RNA, 13 nt, Mycobacterium avium subsp. paratuberculosis
gagcagcaccggc

SEQ ID NO: 911549 - RNA, 15 nt, Mycobacterium avium subsp. paratuberculosis
gagcagcaccggcau

SEQ ID NO: 911550 - RNA, 17 nt, Mycobacterium avium subsp. paratuberculosis
gaggccaacgagcgcgc

SEQ ID NO: 911551 - RNA, 13 nt, Mycobacterium avium subsp. paratuberculosis
gaggcacuggcgc

SEQ ID NO: 911552 - RNA, 17 nt, Mycobacterium avium subsp. paratuberculosis
gagguagccgcgcacca

SEQ ID NO: 911553 - RNA, 19 nt, Mycobacterium avium subsp. paratuberculosis
gagguaggccaccgggucg

SEQ ID NO: 911554 - RNA, 19 nt, Mycobacterium avium subsp. paratuberculosis
gaggucaccaccgagccgg

SEQ ID NO: 911555 - RNA, 22 nt, Mycobacterium avium subsp. paratuberculosis
gaggucaccaccgagccggugc

SEQ ID NO: 911556 - RNA, 13 nt, Mycobacterium avium subsp. paratuberculosis
gaggucaccgcgg

SEQ ID NO: 911557 - RNA, 22 nt, Mycobacterium avium subsp. paratuberculosis
gagggcgccguuguaggccgcg

SEQ ID NO: 911558 - RNA, 19 nt, Mycobacterium avium subsp. paratuberculosis
gagggcgacgaugccggcc

SEQ ID NO: 911559 - RNA, 21 nt, Mycobacterium avium subsp. paratuberculosis
gagggcgacgaugccggccgg

SEQ ID NO: 911560 - RNA, 13 nt, Mycobacterium avium subsp. paratuberculosis
gagggccagcagu

SEQ ID NO: 911561 - RNA, 19 nt, Mycobacterium avium subsp. paratuberculosis
gagggccagcagucgugac

SEQ ID NO: 911562 - RNA, 20 nt, Mycobacterium avium subsp. paratuberculosis
gagggccagcagucgugacg

SEQ ID NO: 911563 - RNA, 17 nt, Mycobacterium avium subsp. paratuberculosis
gagggccauccggccgg

SEQ ID NO: 911564 - RNA, 18 nt, Mycobacterium avium subsp. paratuberculosis
gagggccauccggccggc

SEQ ID NO: 911565 - RNA, 17 nt, Mycobacterium avium subsp. paratuberculosis
gaggcggcggcgggcca

SEQ ID NO: 911566 - RNA, 14 nt, Mycobacterium avium subsp. paratuberculosis
gaggcgcggcgcga

SEQ ID NO: 911567 - RNA, 16 nt, Mycobacterium avium subsp. paratuberculosis
gaggcggccagcggca

SEQ ID NO: 911568 - RNA, 14 nt, Mycobacterium avium subsp. paratuberculosis
gaggcggcgaccgc

SEQ ID NO: 911569 - RNA, 14 nt, Mycobacterium avium subsp. paratuberculosis
gaggcgcggggcgc

SEQ ID NO: 911570 - RNA, 20 nt, Mycobacterium avium subsp. paratuberculosis
gaggccguaucccaccacga

SEQ ID NO: 911571 - RNA, 21 nt, Mycobacterium avium subsp. paratuberculosis
gaggccguaucccaccacgaa

SEQ ID NO: 911572 - RNA, 22 nt, Mycobacterium avium subsp. paratuberculosis
gaggcgcucgcacaacccgccc

SEQ ID NO: 911573 - RNA, 15 nt, Mycobacterium avium subsp. paratuberculosis
gaggcgcucggcccg

SEQ ID NO: 911574 - RNA, 17 nt, Mycobacterium avium subsp. paratuberculosis
gaggcgguuccgguggc

SEQ ID NO: 911575 - RNA, 20 nt, Mycobacterium avium subsp. paratuberculosis
gaggcguagcugcaggcgac

SEQ ID NO: 911576 - RNA, 22 nt, Mycobacterium avium subsp. paratuberculosis
gaggcguagcugcaggcgacga

SEQ ID NO: 911577 - RNA, 16 nt, Mycobacterium avium subsp. paratuberculosis
gaggcggguaggcguc

SEQ ID NO: 911578 - RNA, 13 nt, Mycobacterium avium subsp. paratuberculosis
gaggcggucggcg

SEQ ID NO: 911579 - RNA, 15 nt, Mycobacterium avium subsp. paratuberculosis
gaggcgugcagcccg

SEQ ID NO: 911580 - RNA, 23 nt, Mycobacterium avium subsp. paratuberculosis
gaggcgugccgcugggagcacgu

SEQ ID NO: 911581 - RNA, 20 nt, Mycobacterium avium subsp. paratuberculosis
gagggagcacucgauggcgg

SEQ ID NO: 911582 - RNA, 23 nt, Mycobacterium avium subsp. paratuberculosis
gaggcgucagggguuggcgcgca

SEQ ID NO: 911583 - RNA, 15 nt, Mycobacterium avium subsp. paratuberculosis
gaggcguccagcgcg

SEQ ID NO: 911584 - RNA, 19 nt, Mycobacterium avium subsp. paratuberculosis
gauagauguugcggccggc

SEQ ID NO: 911585 - RNA, 19 nt, Mycobacterium avium subsp. paratuberculosis
gauagaccucacggucggc

SEQ ID NO: 911586 - RNA, 17 nt, Mycobacterium avium subsp. paratuberculosis
gauacgacguccgggcc

SEQ ID NO: 911587 - RNA, 19 nt, Mycobacterium avium subsp. paratuberculosis
gauacgacguccgggccgc

SEQ ID NO: 911588 - RNA, 14 nt, Mycobacterium avium subsp. paratuberculosis
gauagcccagccag

SEQ ID NO: 911589 - RNA, 21 nt, Mycobacterium avium subsp. paratuberculosis
gauagcccagccagccggugg

SEQ ID NO: 911590 - RNA, 13 nt, Mycobacterium avium subsp. paratuberculosis
gauagcccgccgc

SEQ ID NO: 911591 - RNA, 14 nt, Mycobacterium avium subsp. paratuberculosis
gauagcccgccgcg

SEQ ID NO: 911592 - RNA, 23 nt, Mycobacterium avium subsp. paratuberculosis
gauagccggugaucgcggcgcug

SEQ ID NO: 911593 - RNA, 19 nt, Mycobacterium avium subsp. paratuberculosis
gauagccguacacggcggc

SEQ ID NO: 911594 - RNA, 19 nt, Mycobacterium avium subsp. paratuberculosis
gauagccgucggcggaggu

SEQ ID NO: 911595 - RNA, 14 nt, Mycobacterium avium subsp. paratuberculosis
gauaguucgccgcc

SEQ ID NO: 911596 - RNA, 19 nt, Mycobacterium avium subsp. paratuberculosis
gauaguucgccgccgccag

SEQ ID NO: 911597 - RNA, 13 nt, Mycobacterium avium subsp. paratuberculosis
gauaccagccgcg

SEQ ID NO: 911598 - RNA, 17 nt, Mycobacterium avium subsp. paratuberculosis
gauacaucucgguggug

SEQ ID NO: 911599 - RNA, 14 nt, Mycobacterium avium subsp. paratuberculosis
gauacccgcgcggc

SEQ ID NO: 911600 - RNA, 15 nt, Mycobacterium avium subsp. paratuberculosis
gauaccgcgaccgcc

SEQ ID NO: 911601 - RNA, 17 nt, Mycobacterium avium subsp. paratuberculosis
gauaccguccgcgccca

SEQ ID NO: 911602 - RNA, 19 nt, Mycobacterium avium subsp. paratuberculosis
gauaccguccgcgcccacc

SEQ ID NO: 911603 - RNA, 15 nt, Mycobacterium avium subsp. paratuberculosis
gauacccgcggccuc

SEQ ID NO: 911604 - RNA, 17 nt, Mycobacterium avium subsp. paratuberculosis
gauacccgggagcaucg

SEQ ID NO: 911605 - RNA, 17 nt, Mycobacterium avium subsp. paratuberculosis
gauaccggcccagcgcg

SEQ ID NO: 911606 - RNA, 13 nt, Mycobacterium avium subsp. paratuberculosis
gauaccggccggc

SEQ ID NO: 911607 - RNA, 15 nt, Mycobacterium avium subsp. paratuberculosis
gauaccggccggcgc

SEQ ID NO: 911608 - RNA, 20 nt, Mycobacterium avium subsp. paratuberculosis
gauaccggccggcgcggcgg

SEQ ID NO: 911609 - RNA, 13 nt, Mycobacterium avium subsp. paratuberculosis
gaucagagcgggc

SEQ ID NO: 911610 - RNA, 15 nt, Mycobacterium avium subsp. paratuberculosis
gaucagagcgggccg

SEQ ID NO: 911611 - RNA, 16 nt, Mycobacterium avium subsp. paratuberculosis
gaucagaugcucgucg

SEQ ID NO: 911612 - RNA, 22 nt, Mycobacterium avium subsp. paratuberculosis
gaucaccucgcugacgucgaug

SEQ ID NO: 911613 - RNA, 18 nt, Mycobacterium avium subsp. paratuberculosis
gaucacguucucggcgaa

SEQ ID NO: 911614 - RNA, 15 nt, Mycobacterium avium subsp. paratuberculosis
gaucacguugucgcg

SEQ ID NO: 911615 - RNA, 19 nt, Mycobacterium avium subsp. paratuberculosis
gaucacguugucgcggccc

SEQ ID NO: 911616 - RNA, 18 nt, Mycobacterium avium subsp. paratuberculosis
gaucagcacgucgcggcc

SEQ ID NO: 911617 - RNA, 23 nt, Mycobacterium avium subsp. paratuberculosis
gaucagcacuucauggucgucgu

SEQ ID NO: 911618 - RNA, 16 nt, Mycobacterium avium subsp. paratuberculosis
gaucagcaccggguga

SEQ ID NO: 911619 - RNA, 13 nt, Mycobacterium avium subsp. paratuberculosis
gaucagcaccguc

SEQ ID NO: 911620 - RNA, 16 nt, Mycobacterium avium subsp. paratuberculosis
gaucagcaccguccac

SEQ ID NO: 911621 - RNA, 14 nt, Mycobacterium avium subsp. paratuberculosis
gaucagcaccgcca

SEQ ID NO: 911622 - RNA, 15 nt, Mycobacterium avium subsp. paratuberculosis
gaucagcaccagguu

SEQ ID NO: 911623 - RNA, 16 nt, Mycobacterium avium subsp. paratuberculosis
gaucagcaccgccacg

SEQ ID NO: 911624 - RNA, 15 nt, Mycobacterium avium subsp. paratuberculosis
gaucagcagcacccg

SEQ ID NO: 911625 - RNA, 14 nt, Mycobacterium avium subsp. paratuberculosis
gaucagcagcaccu

SEQ ID NO: 911626 - RNA, 13 nt, Mycobacterium avium subsp. paratuberculosis
gaucagcagccgg

SEQ ID NO: 911627 - RNA, 17 nt, Mycobacterium avium subsp. paratuberculosis
gaucagcagcucggugg

SEQ ID NO: 911628 - RNA, 17 nt, Mycobacterium avium subsp. paratuberculosis
gaucagcgacggcccgc

SEQ ID NO: 911629 - RNA, 19 nt, Mycobacterium avium subsp. paratuberculosis
gaucagcgacucgaccccg

SEQ ID NO: 911630 - RNA, 19 nt, Mycobacterium avium subsp. paratuberculosis
gaucagccggcgagcgcgc

SEQ ID NO: 911631 - RNA, 21 nt, Mycobacterium avium subsp. paratuberculosis
gaucagccggguagcgccgcc

SEQ ID NO: 911632 - RNA, 15 nt, Mycobacterium avium subsp. paratuberculosis
gaucagccguaccga

SEQ ID NO: 911633 - RNA, 20 nt, Mycobacterium avium subsp. paratuberculosis
gaucagccguaccgauccgc

SEQ ID NO: 911634 - RNA, 15 nt, Mycobacterium avium subsp. paratuberculosis
gaucagcccgcccac

SEQ ID NO: 911635 - RNA, 18 nt, Mycobacterium avium subsp. paratuberculosis
gaucagcccgcccaccac

SEQ ID NO: 911636 - RNA, 22 nt, Mycobacterium avium subsp. paratuberculosis
gaucagccgcgacagccgcccg

SEQ ID NO: 911637 - RNA, 23 nt, Mycobacterium avium subsp. paratuberculosis
gaucagccaguugaucagcccga

SEQ ID NO: 911638 - RNA, 13 nt, Mycobacterium avium subsp. paratuberculosis
gaucagcccggcc

SEQ ID NO: 911639 - RNA, 16 nt, Mycobacterium avium subsp. paratuberculosis
gaucagcccggcccgc

SEQ ID NO: 911640 - RNA, 17 nt, Mycobacterium avium subsp. paratuberculosis
gaucagcccggcccgca

SEQ ID NO: 911641 - RNA, 12 nt, Mycobacterium avium subsp. paratuberculosis
gaucagcccggg

SEQ ID NO: 911642 - RNA, 21 nt, Mycobacterium avium subsp. paratuberculosis
gaucagcagguugauccgcgc

SEQ ID NO: 911643 - RNA, 22 nt, Mycobacterium avium subsp. paratuberculosis
gaucagcagugccccguccggc

SEQ ID NO: 911644 - RNA, 17 nt, Mycobacterium avium subsp. paratuberculosis
gaucagcaggcccucgg

SEQ ID NO: 911645 - RNA, 16 nt, Mycobacterium avium subsp. paratuberculosis
gaucagccacaccgcc

SEQ ID NO: 911646 - RNA, 17 nt, Mycobacterium avium subsp. paratuberculosis
gaucagccacaccgccg

SEQ ID NO: 911647 - RNA, 20 nt, Mycobacterium avium subsp. paratuberculosis
gaucagccacaccgccggcg

SEQ ID NO: 911648 - RNA, 23 nt, Mycobacterium avium subsp. paratuberculosis
gaucagccacaccgccggcgcgg

SEQ ID NO: 911649 - RNA, 16 nt, Mycobacterium avium subsp. paratuberculosis
gauaguggucgucguc

SEQ ID NO: 911650 - RNA, 20 nt, Mycobacterium avium subsp. paratuberculosis
gauaugcugcaacggcuggc

SEQ ID NO: 911651 - RNA, 18 nt, Mycobacterium avium subsp. paratuberculosis
gauauaggugagaaaagc

SEQ ID NO: 911652 - RNA, 19 nt, Mycobacterium avium subsp. paratuberculosis
gaucaccgcguagcgccgc

SEQ ID NO: 911653 - RNA, 21 nt, Mycobacterium avium subsp. paratuberculosis
gaucaccgcguagcgccgccc

SEQ ID NO: 911654 - RNA, 24 nt, Mycobacterium avium subsp. paratuberculosis
gaucaccgcguagcgccgcccguc

SEQ ID NO: 911655 - RNA, 12 nt, Mycobacterium avium subsp. paratuberculosis
gaucaccgcguc

SEQ ID NO: 911656 - RNA, 21 nt, Mycobacterium avium subsp. paratuberculosis
gaucaccgcguucucggcgga

SEQ ID NO: 911657 - RNA, 11 nt, Mycobacterium avium subsp. paratuberculosis
gaucaccggca

SEQ ID NO: 911658 - RNA, 18 nt, Mycobacterium avium subsp. paratuberculosis
gaucaccggcagcagcgc

SEQ ID NO: 911659 - RNA, 20 nt, Mycobacterium avium subsp. paratuberculosis
gaucaccggcagcagcgcgu

SEQ ID NO: 911660 - RNA, 22 nt, Mycobacterium avium subsp. paratuberculosis
gaucaccggcgcguuggcccgu

SEQ ID NO: 911661 - RNA, 21 nt, Mycobacterium avium subsp. paratuberculosis
gaucaccggcuuggcggugau

SEQ ID NO: 911662 - RNA, 22 nt, Mycobacterium avium subsp. paratuberculosis
gaucaccgggacaccgcuggcc

SEQ ID NO: 911663 - RNA, 19 nt, Mycobacterium avium subsp. paratuberculosis
gaucaccgggacgggggug

SEQ ID NO: 911664 - RNA, 17 nt, Mycobacterium avium subsp. paratuberculosis
gaucaccgggcggccgu

SEQ ID NO: 911665 - RNA, 14 nt, Mycobacterium avium subsp. paratuberculosis
gaucaccgugaucg

SEQ ID NO: 911666 - RNA, 18 nt, Mycobacterium avium subsp. paratuberculosis
gaucaccgugaucgccac

SEQ ID NO: 911667 - RNA, 19 nt, Mycobacterium avium subsp. paratuberculosis
gaucaccgugaucgccacc

SEQ ID NO: 911668 - RNA, 23 nt, Mycobacterium avium subsp. paratuberculosis
gaucaccgugaucgccaccacca

SEQ ID NO: 911669 - RNA, 17 nt, Mycobacterium avium subsp. paratuberculosis
gaucaccucaucgccca

SEQ ID NO: 911670 - RNA, 14 nt, Mycobacterium avium subsp. paratuberculosis
gaucaccucgccgg

SEQ ID NO: 911671 - RNA, 13 nt, Mycobacterium avium subsp. paratuberculosis
gaucaccucggug

SEQ ID NO: 911672 - RNA, 17 nt, Mycobacterium avium subsp. paratuberculosis
cggaguugccgauggcg

SEQ ID NO: 911673 - RNA, 17 nt, Mycobacterium avium subsp. paratuberculosis
cggaguugcgcagccgg

SEQ ID NO: 911674 - RNA, 20 nt, Mycobacterium avium subsp. paratuberculosis
cggaguuggaucgccgcaac

SEQ ID NO: 911675 - RNA, 20 nt, Mycobacterium avium subsp. paratuberculosis
cggaguucgcccgcagcacg

SEQ ID NO: 911676 - RNA, 23 nt, Mycobacterium avium subsp. paratuberculosis
cggagucgguuucgaccugcggg

SEQ ID NO: 911677 - RNA, 15 nt, Mycobacterium avium subsp. paratuberculosis
cggagucguagucga

SEQ ID NO: 911678 - RNA, 18 nt, Mycobacterium avium subsp. paratuberculosis
cggagucguagucgaugc

SEQ ID NO: 911679 - RNA, 19 nt, Mycobacterium avium subsp. paratuberculosis
cggagucguagucgaugcc

SEQ ID NO: 911680 - RNA, 12 nt, Mycobacterium avium subsp. paratuberculosis
cggagucgucgg

SEQ ID NO: 911681 - RNA, 14 nt, Mycobacterium avium subsp. paratuberculosis
cggagucgucggcg

SEQ ID NO: 911682 - RNA, 18 nt, Mycobacterium avium subsp. paratuberculosis
cggagucgucggcgcggu

SEQ ID NO: 911683 - RNA, 18 nt, Mycobacterium avium subsp. paratuberculosis
cggagugaccgccagcac

SEQ ID NO: 911684 - RNA, 19 nt, Mycobacterium avium subsp. paratuberculosis
cggagugaccgccagcacc

SEQ ID NO: 911685 - RNA, 23 nt, Mycobacterium avium subsp. paratuberculosis
cggagugaccgccagcaccgcgg

SEQ ID NO: 911686 - RNA, 16 nt, Mycobacterium avium subsp. paratuberculosis
cggagugacgucgcgc

SEQ ID NO: 911687 - RNA, 17 nt, Mycobacterium avium subsp. paratuberculosis
cggagugacgucgcgcg

SEQ ID NO: 911688 - RNA, 22 nt, Mycobacterium avium subsp. paratuberculosis
cggagugcggauuaccgugacg

SEQ ID NO: 911689 - RNA, 13 nt, Mycobacterium avium subsp. paratuberculosis
cggaaucgcggga

SEQ ID NO: 911690 - RNA, 21 nt, Mycobacterium avium subsp. paratuberculosis
cggaaucgcgggaucggccgg

SEQ ID NO: 911691 - RNA, 15 nt, Mycobacterium avium subsp. paratuberculosis
cggaaucgcgguagc

SEQ ID NO: 911692 - RNA, 14 nt, Mycobacterium avium subsp. paratuberculosis
cggaaucggcgccg

SEQ ID NO: 911693 - RNA, 20 nt, Mycobacterium avium subsp. paratuberculosis
cggagguucgccggaauggc

SEQ ID NO: 911694 - RNA, 21 nt, Mycobacterium avium subsp. paratuberculosis
cggaguagaccuuguccggcg

SEQ ID NO: 911695 - RNA, 14 nt, Mycobacterium avium subsp. paratuberculosis
cggaguaguccagc

SEQ ID NO: 911696 - RNA, 16 nt, Mycobacterium avium subsp. paratuberculosis
cggaguaguccagcac

SEQ ID NO: 911697 - RNA, 18 nt, Mycobacterium avium subsp. paratuberculosis
cggaguaguccagcaccg

SEQ ID NO: 911698 - RNA, 20 nt, Mycobacterium avium subsp. paratuberculosis
cggaguaguccagcaccgcc

SEQ ID NO: 911699 - RNA, 21 nt, Mycobacterium avium subsp. paratuberculosis
cggaguaguccagcaccgcca

SEQ ID NO: 911700 - RNA, 15 nt, Mycobacterium avium subsp. paratuberculosis
cggaguccaccggcg

SEQ ID NO: 911701 - RNA, 17 nt, Mycobacterium avium subsp. paratuberculosis
cggaguccaccggcgga

SEQ ID NO: 911702 - RNA, 14 nt, Mycobacterium avium subsp. paratuberculosis
cggaguccagcacg

SEQ ID NO: 911703 - RNA, 15 nt, Mycobacterium avium subsp. paratuberculosis
cggaguccggcucgg

SEQ ID NO: 911704 - RNA, 18 nt, Mycobacterium avium subsp. paratuberculosis
cggaucgggaccgggaag

SEQ ID NO: 911705 - RNA, 13 nt, Mycobacterium avium subsp. paratuberculosis
cggaucggcggcg

SEQ ID NO: 911706 - RNA, 15 nt, Mycobacterium avium subsp. paratuberculosis
cggaucggcggcgac

SEQ ID NO: 911707 - RNA, 17 nt, Mycobacterium avium subsp. paratuberculosis
cggaucggcggucccgu

SEQ ID NO: 911708 - RNA, 22 nt, Mycobacterium avium subsp. paratuberculosis
cggaucggcuagcagcuccggu

SEQ ID NO: 911709 - RNA, 18 nt, Mycobacterium avium subsp. paratuberculosis
cggaucgcgugcgucacg

SEQ ID NO: 911710 - RNA, 22 nt, Mycobacterium avium subsp. paratuberculosis
cggaucgcgugcgucacgcugg

SEQ ID NO: 911711 - RNA, 14 nt, Mycobacterium avium subsp. paratuberculosis
cggaucggccagca

SEQ ID NO: 911712 - RNA, 15 nt, Mycobacterium avium subsp. paratuberculosis
cggaucggccauggu

SEQ ID NO: 911713 - RNA, 16 nt, Mycobacterium avium subsp. paratuberculosis
cggaucggccgcgucg

SEQ ID NO: 911714 - RNA, 23 nt, Mycobacterium avium subsp. paratuberculosis
cggauccgacgaaccgugcacga

SEQ ID NO: 911715 - RNA, 15 nt, Mycobacterium avium subsp. paratuberculosis
cggauccgggcgccg

SEQ ID NO: 911716 - RNA, 14 nt, Mycobacterium avium subsp. paratuberculosis
cggauccgucgccc

SEQ ID NO: 911717 - RNA, 22 nt, Mycobacterium avium subsp. paratuberculosis
cggauccgucgccccgcaccga

SEQ ID NO: 911718 - RNA, 23 nt, Mycobacterium avium subsp. paratuberculosis
cggauccgucgccccgcaccgag

SEQ ID NO: 911719 - RNA, 16 nt, Mycobacterium avium subsp. paratuberculosis
cggauccgggccgccu

SEQ ID NO: 911720 - RNA, 14 nt, Mycobacterium avium subsp. paratuberculosis
cggauccgggccgg

SEQ ID NO: 911721 - RNA, 16 nt, Mycobacterium avium subsp. paratuberculosis
cggauccgggccggcg

SEQ ID NO: 911722 - RNA, 19 nt, Mycobacterium avium subsp. paratuberculosis
cggaucccggggcgcgcug

SEQ ID NO: 911723 - RNA, 21 nt, Mycobacterium avium subsp. paratuberculosis
cggaucccggggcgcgcuggg

SEQ ID NO: 911724 - RNA, 13 nt, Mycobacterium avium subsp. paratuberculosis
cggaucgcgcuga

SEQ ID NO: 911725 - RNA, 15 nt, Mycobacterium avium subsp. paratuberculosis
cggaucgcgggcgac

SEQ ID NO: 911726 - RNA, 18 nt, Mycobacterium avium subsp. paratuberculosis
cggaucgcgggcgacccg

SEQ ID NO: 911727 - RNA, 19 nt, Mycobacterium avium subsp. paratuberculosis
cggaucgcgggcgacccgc

SEQ ID NO: 911728 - RNA, 21 nt, Mycobacterium avium subsp. paratuberculosis
cggaucgcgggcgacccgcug

SEQ ID NO: 911729 - RNA, 17 nt, Mycobacterium avium subsp. paratuberculosis
cggauagcccagcgugg

SEQ ID NO: 911730 - RNA, 15 nt, Mycobacterium avium subsp. paratuberculosis
cggauagaggcggcg

SEQ ID NO: 911731 - RNA, 16 nt, Mycobacterium avium subsp. paratuberculosis
cggauagccgucggcg

SEQ ID NO: 911732 - RNA, 13 nt, Mycobacterium avium subsp. paratuberculosis
cggaucaggucgg

SEQ ID NO: 911733 - RNA, 15 nt, Mycobacterium avium subsp. paratuberculosis
cggaucaggucgguc

SEQ ID NO: 911734 - RNA, 19 nt, Mycobacterium avium subsp. paratuberculosis
cggaucaguaccggcgaug

SEQ ID NO: 911735 - RNA, 20 nt, Mycobacterium avium subsp. paratuberculosis
cggaucaguaccggcgaugc

SEQ ID NO: 911736 - RNA, 20 nt, Mycobacterium avium subsp. paratuberculosis
cggauccagguggggcacgg

SEQ ID NO: 911737 - RNA, 22 nt, Mycobacterium avium subsp. paratuberculosis
cggauccagguggggcacgggc

SEQ ID NO: 911738 - RNA, 15 nt, Mycobacterium avium subsp. paratuberculosis
cggauccagcaccgc

SEQ ID NO: 911739 - RNA, 17 nt, Mycobacterium avium subsp. paratuberculosis
cggauccagcaccgcca

SEQ ID NO: 911740 - RNA, 18 nt, Mycobacterium avium subsp. paratuberculosis
cggauugcgagccggucu

SEQ ID NO: 911741 - RNA, 13 nt, Mycobacterium avium subsp. paratuberculosis
cggauuggucaga

SEQ ID NO: 911742 - RNA, 19 nt, Mycobacterium avium subsp. paratuberculosis
cggauuggugccgaucacc

SEQ ID NO: 911743 - RNA, 19 nt, Mycobacterium avium subsp. paratuberculosis
cggauugccgggcagcggc

SEQ ID NO: 911744 - RNA, 16 nt, Mycobacterium avium subsp. paratuberculosis
cggauuugguugcggc

SEQ ID NO: 911745 - RNA, 19 nt, Mycobacterium avium subsp. paratuberculosis
cggauuugguugcggcacc

SEQ ID NO: 911746 - RNA, 20 nt, Mycobacterium avium subsp. paratuberculosis
cggauuugguugcggcaccg

SEQ ID NO: 911747 - RNA, 14 nt, Mycobacterium avium subsp. paratuberculosis
cggauucgcggcgg

SEQ ID NO: 911748 - RNA, 16 nt, Mycobacterium avium subsp. paratuberculosis
cggauucgcggcggcg

SEQ ID NO: 911749 - RNA, 17 nt, Mycobacterium avium subsp. paratuberculosis
cggauucgcggcggcgc

SEQ ID NO: 911750 - RNA, 13 nt, Mycobacterium avium subsp. paratuberculosis
cggauucggcucc

SEQ ID NO: 911751 - RNA, 16 nt, Mycobacterium avium subsp. paratuberculosis
cggauuccagcgcgac

SEQ ID NO: 911752 - RNA, 15 nt, Mycobacterium avium subsp. paratuberculosis
cggauuccagcgcgu

SEQ ID NO: 911753 - RNA, 15 nt, Mycobacterium avium subsp. paratuberculosis
cggauucucgcccgg

SEQ ID NO: 911754 - RNA, 14 nt, Mycobacterium avium subsp. paratuberculosis
cggauugaccagca

SEQ ID NO: 911755 - RNA, 13 nt, Mycobacterium avium subsp. paratuberculosis
cggauucccgcuc

SEQ ID NO: 911756 - RNA, 13 nt, Mycobacterium avium subsp. paratuberculosis
cggauuccgcgga

SEQ ID NO: 911757 - RNA, 12 nt, Mycobacterium avium subsp. paratuberculosis
cggauucagcgu

SEQ ID NO: 911758 - RNA, 19 nt, Mycobacterium avium subsp. paratuberculosis
cggauucggguggcgucgc

SEQ ID NO: 911759 - RNA, 21 nt, Mycobacterium avium subsp. paratuberculosis
cggcaaaacgcugggcgccgg

SEQ ID NO: 911760 - RNA, 18 nt, Mycobacterium avium subsp. paratuberculosis
cggcaaagcguugccgcg

SEQ ID NO: 911761 - RNA, 22 nt, Mycobacterium avium subsp. paratuberculosis
cggcaacagcaccagcaccacc

SEQ ID NO: 911762 - RNA, 20 nt, Mycobacterium avium subsp. paratuberculosis
cggcaacacagccaaucgcc

SEQ ID NO: 911763 - RNA, 23 nt, Mycobacterium avium subsp. paratuberculosis
cggcaacacagccaaucgccgau

SEQ ID NO: 911764 - RNA, 14 nt, Mycobacterium avium subsp. paratuberculosis
cggcaacaccggcg

SEQ ID NO: 911765 - RNA, 15 nt, Mycobacterium avium subsp. paratuberculosis
cggcaacaccggcgg

SEQ ID NO: 911766 - RNA, 16 nt, Mycobacterium avium subsp. paratuberculosis
cggcaacaccggcggc

SEQ ID NO: 911767 - RNA, 17 nt, Mycobacterium avium subsp. paratuberculosis
cggcaacaccggcggcg

SEQ ID NO: 911768 - RNA, 19 nt, Mycobacterium avium subsp. paratuberculosis
cggcaacaccggcggcgac

SEQ ID NO: 911769 - RNA, 20 nt, Mycobacterium avium subsp. paratuberculosis
cggcaacaccggcggcgacg

SEQ ID NO: 911770 - RNA, 21 nt, Mycobacterium avium subsp. paratuberculosis
cggcaacaccggcggcgacgg

SEQ ID NO: 911771 - RNA, 16 nt, Mycobacterium avium subsp. paratuberculosis
cggcaacacgccggcg

SEQ ID NO: 911772 - RNA, 19 nt, Mycobacterium avium subsp. paratuberculosis
cggcaacacgccggcggcc

SEQ ID NO: 911773 - RNA, 17 nt, Mycobacterium avium subsp. paratuberculosis
cggauuacucgccggcg

SEQ ID NO: 911774 - RNA, 19 nt, Mycobacterium avium subsp. paratuberculosis
cggauuacucgccggcggc

SEQ ID NO: 911775 - RNA, 21 nt, Mycobacterium avium subsp. paratuberculosis
cggauuacucgccggcggcgc

SEQ ID NO: 911776 - RNA, 22 nt, Mycobacterium avium subsp. paratuberculosis
cggauuacucgccggcggcgcc

SEQ ID NO: 911777 - RNA, 23 nt, Mycobacterium avium subsp. paratuberculosis
cggauuacucgccggcggcgccg

SEQ ID NO: 911778 - RNA, 16 nt, Mycobacterium avium subsp. paratuberculosis
cggauguggucggcca

SEQ ID NO: 911779 - RNA, 17 nt, Mycobacterium avium subsp. paratuberculosis
cggauguggucggccac

SEQ ID NO: 911780 - RNA, 16 nt, Mycobacterium avium subsp. paratuberculosis
cggauguccgaccggu

SEQ ID NO: 911781 - RNA, 13 nt, Mycobacterium avium subsp. paratuberculosis
cggaugggcgagg

SEQ ID NO: 911782 - RNA, 12 nt, Mycobacterium avium subsp. paratuberculosis
cggauggugacg

SEQ ID NO: 911783 - RNA, 22 nt, Mycobacterium avium subsp. paratuberculosis
cggauggugcccaccgggcagc

SEQ ID NO: 911784 - RNA, 15 nt, Mycobacterium avium subsp. paratuberculosis
cggauggcggucgcg

SEQ ID NO: 911785 - RNA, 17 nt, Mycobacterium avium subsp. paratuberculosis
cggauguccuacggcgg

SEQ ID NO: 911786 - RNA, 18 nt, Mycobacterium avium subsp. paratuberculosis
cggauguccuacggcggg

SEQ ID NO: 911787 - RNA, 21 nt, Mycobacterium avium subsp. paratuberculosis
cggauguccuacggcgggugc

SEQ ID NO: 911788 - RNA, 14 nt, Mycobacterium avium subsp. paratuberculosis
cggaugucggugug

SEQ ID NO: 911789 - RNA, 20 nt, Mycobacterium avium subsp. paratuberculosis
cggaugucgguguggaccgc

SEQ ID NO: 911790 - RNA, 12 nt, Mycobacterium avium subsp. paratuberculosis
cggauggccccg

SEQ ID NO: 911791 - RNA, 13 nt, Mycobacterium avium subsp. paratuberculosis
cggauggccgggc

SEQ ID NO: 911792 - RNA, 16 nt, Mycobacterium avium subsp. paratuberculosis
cggauggccucggcga

SEQ ID NO: 911793 - RNA, 16 nt, Mycobacterium avium subsp. paratuberculosis
cggauggcgacggcga

SEQ ID NO: 911794 - RNA, 18 nt, Mycobacterium avium subsp. paratuberculosis
cggauggcgcccggcagc

SEQ ID NO: 911795 - RNA, 13 nt, Mycobacterium avium subsp. paratuberculosis
cggauggcgcccu

SEQ ID NO: 911796 - RNA, 22 nt, Mycobacterium avium subsp. paratuberculosis
cggauggcgcccuuggccuccg

SEQ ID NO: 911797 - RNA, 12 nt, Mycobacterium avium subsp. paratuberculosis
cggauggcgccg

SEQ ID NO: 911798 - RNA, 16 nt, Mycobacterium avium subsp. paratuberculosis
cggauggcgccgucga

SEQ ID NO: 911799 - RNA, 16 nt, Mycobacterium avium subsp. paratuberculosis
cggaugccgcgcggcg

SEQ ID NO: 911800 - RNA, 18 nt, Mycobacterium avium subsp. paratuberculosis
cggaugccgcgcggcgcc

SEQ ID NO: 911801 - RNA, 19 nt, Mycobacterium avium subsp. paratuberculosis
cggaugccgcgcggcgcca

SEQ ID NO: 911802 - RNA, 16 nt, Mycobacterium avium subsp. paratuberculosis
cggaugccggaggcgc

SEQ ID NO: 911803 - RNA, 21 nt, Mycobacterium avium subsp. paratuberculosis
cggaugcugcgggucagcagc

SEQ ID NO: 911804 - RNA, 21 nt, Mycobacterium avium subsp. paratuberculosis
cggaugaucaacacgucgucg

SEQ ID NO: 911805 - RNA, 22 nt, Mycobacterium avium subsp. paratuberculosis
cggaugaugcccuuggcggcca

SEQ ID NO: 911806 - RNA, 15 nt, Mycobacterium avium subsp. paratuberculosis
cggaugaugccggug

SEQ ID NO: 911807 - RNA, 18 nt, Mycobacterium avium subsp. paratuberculosis
cggaugcccaggccggcg

SEQ ID NO: 911808 - RNA, 20 nt, Mycobacterium avium subsp. paratuberculosis
cggaugcccaggccggcgag

SEQ ID NO: 911809 - RNA, 21 nt, Mycobacterium avium subsp. paratuberculosis
cggaugcccaggccggcgagc

SEQ ID NO: 911810 - RNA, 20 nt, Mycobacterium avium subsp. paratuberculosis
cggaucggcugcgggccagc

SEQ ID NO: 911811 - RNA, 17 nt, Mycobacterium avium subsp. paratuberculosis
cggaugacgugcaccac

SEQ ID NO: 911812 - RNA, 12 nt, Mycobacterium avium subsp. paratuberculosis
cggaucggggcg

SEQ ID NO: 911813 - RNA, 14 nt, Mycobacterium avium subsp. paratuberculosis
cggaucggggcgac

SEQ ID NO: 911814 - RNA, 22 nt, Mycobacterium avium subsp. paratuberculosis
cggaugauguucuccggcccgg

SEQ ID NO: 911815 - RNA, 13 nt, Mycobacterium avium subsp. paratuberculosis
cggaugcaccggc

SEQ ID NO: 911816 - RNA, 14 nt, Mycobacterium avium subsp. paratuberculosis
cggaugcaccggca

SEQ ID NO: 911817 - RNA, 16 nt, Mycobacterium avium subsp. paratuberculosis
cggaugcaccggcagc

SEQ ID NO: 911818 - RNA, 23 nt, Mycobacterium avium subsp. paratuberculosis
cggcacuucgaucaucuccaccc

SEQ ID NO: 911819 - RNA, 15 nt, Mycobacterium avium subsp. paratuberculosis
cggcagaacgacgcc

SEQ ID NO: 911820 - RNA, 17 nt, Mycobacterium avium subsp. paratuberculosis
cggcagaacgacgccag

SEQ ID NO: 911821 - RNA, 16 nt, Mycobacterium avium subsp. paratuberculosis
cggcagacccagcagc

SEQ ID NO: 911822 - RNA, 15 nt, Mycobacterium avium subsp. paratuberculosis
cggcacgcugcgcca

SEQ ID NO: 911823 - RNA, 17 nt, Mycobacterium avium subsp. paratuberculosis
cggcacgcugcgccagc

SEQ ID NO: 911824 - RNA, 19 nt, Mycobacterium avium subsp. paratuberculosis
cggcacgcugcgccagccg

SEQ ID NO: 911825 - RNA, 16 nt, Mycobacterium avium subsp. paratuberculosis
cggcacggcaccgcga

SEQ ID NO: 911826 - RNA, 17 nt, Mycobacterium avium subsp. paratuberculosis
cggcacugcugcccgcg

SEQ ID NO: 911827 - RNA, 19 nt, Mycobacterium avium subsp. paratuberculosis
cggcacugcugcccgcgac

SEQ ID NO: 911828 - RNA, 20 nt, Mycobacterium avium subsp. paratuberculosis
cggcacugcugcccgcgacg

SEQ ID NO: 911829 - RNA, 21 nt, Mycobacterium avium subsp. paratuberculosis
cggcacugcugcccgcgacgg

SEQ ID NO: 911830 - RNA, 23 nt, Mycobacterium avium subsp. paratuberculosis
cggcacugcugcccgcgacggcg

SEQ ID NO: 911831 - RNA, 16 nt, Mycobacterium avium subsp. paratuberculosis
cggcacgccggggccc

SEQ ID NO: 911832 - RNA, 15 nt, Mycobacterium avium subsp. paratuberculosis
cggcacgcgucaccg

SEQ ID NO: 911833 - RNA, 17 nt, Mycobacterium avium subsp. paratuberculosis
cggcacgcgucaccgga

SEQ ID NO: 911834 - RNA, 17 nt, Mycobacterium avium subsp. paratuberculosis
cggcagauagaucagca

SEQ ID NO: 911835 - RNA, 20 nt, Mycobacterium avium subsp. paratuberculosis
cggcagauagaucagcaggc

SEQ ID NO: 911836 - RNA, 17 nt, Mycobacterium avium subsp. paratuberculosis
cggcagaucgcggcccg

SEQ ID NO: 911837 - RNA, 18 nt, Mycobacterium avium subsp. paratuberculosis
cggcagaucgcggcccgc

SEQ ID NO: 911838 - RNA, 21 nt, Mycobacterium avium subsp. paratuberculosis
cggcagaucgcggcccgccgc

SEQ ID NO: 911839 - RNA, 12 nt, Mycobacterium avium subsp. paratuberculosis
cggcagaccggu

SEQ ID NO: 911840 - RNA, 16 nt, Mycobacterium avium subsp. paratuberculosis
cggcagauggucucga

SEQ ID NO: 911841 - RNA, 21 nt, Mycobacterium avium subsp. paratuberculosis
cggcagauggucucgaucucc

SEQ ID NO: 911842 - RNA, 21 nt, Mycobacterium avium subsp. paratuberculosis
cggcagaucguugggcauguc

SEQ ID NO: 911843 - RNA, 22 nt, Mycobacterium avium subsp. paratuberculosis
cggcagaucguugggcaugucg

SEQ ID NO: 911844 - RNA, 23 nt, Mycobacterium avium subsp. paratuberculosis
cggcagaucguugggcaugucgc

SEQ ID NO: 911845 - RNA, 17 nt, Mycobacterium avium subsp. paratuberculosis
cggcagcaaccgcgaaa

SEQ ID NO: 911846 - RNA, 17 nt, Mycobacterium avium subsp. paratuberculosis
cggcagcaaccggcggc

SEQ ID NO: 911847 - RNA, 13 nt, Mycobacterium avium subsp. paratuberculosis
cggcagcacaccu

SEQ ID NO: 911848 - RNA, 16 nt, Mycobacterium avium subsp. paratuberculosis
cggcagcacccgcauc

SEQ ID NO: 911849 - RNA, 15 nt, Mycobacterium avium subsp. paratuberculosis
cggcagcaccgccga

SEQ ID NO: 911850 - RNA, 20 nt, Mycobacterium avium subsp. paratuberculosis
cggcaggaauuccagcgaca

SEQ ID NO: 911851 - RNA, 23 nt, Mycobacterium avium subsp. paratuberculosis
cggcaggaauuccagcgacaaca

SEQ ID NO: 911852 - RNA, 17 nt, Mycobacterium avium subsp. paratuberculosis
cggcaggauccggacga

SEQ ID NO: 911853 - RNA, 20 nt, Mycobacterium avium subsp. paratuberculosis
cggcaggauccggucgauca

SEQ ID NO: 911854 - RNA, 22 nt, Mycobacterium avium subsp. paratuberculosis
cggcaggauccggucgaucacc

SEQ ID NO: 911855 - RNA, 16 nt, Mycobacterium avium subsp. paratuberculosis
cggcagcgcgcccucg

SEQ ID NO: 911856 - RNA, 14 nt, Mycobacterium avium subsp. paratuberculosis
cggcagcgccagcg

SEQ ID NO: 911857 - RNA, 14 nt, Mycobacterium avium subsp. paratuberculosis
cggcagcgccaaca

SEQ ID NO: 911858 - RNA, 22 nt, Mycobacterium avium subsp. paratuberculosis
cggcagcgccaacauggcgcag

SEQ ID NO: 911859 - RNA, 13 nt, Mycobacterium avium subsp. paratuberculosis
cggcagcgccacc

SEQ ID NO: 911860 - RNA, 14 nt, Mycobacterium avium subsp. paratuberculosis
cggcagcgccacca

SEQ ID NO: 911861 - RNA, 22 nt, Mycobacterium avium subsp. paratuberculosis
cggcagcgccaccagcuccucg

SEQ ID NO: 911862 - RNA, 17 nt, Mycobacterium avium subsp. paratuberculosis
cggcagcgaggcgcgca

SEQ ID NO: 911863 - RNA, 22 nt, Mycobacterium avium subsp. paratuberculosis
cggcagccccgucggucccgac

SEQ ID NO: 911864 - RNA, 16 nt, Mycobacterium avium subsp. paratuberculosis
cggcagcccggaggcg

SEQ ID NO: 911865 - RNA, 19 nt, Mycobacterium avium subsp. paratuberculosis
cggcagcccggaggcgaug

SEQ ID NO: 911866 - RNA, 21 nt, Mycobacterium avium subsp. paratuberculosis
cggcagcccggaguagccggu

SEQ ID NO: 911867 - RNA, 13 nt, Mycobacterium avium subsp. paratuberculosis
cggcagccacggc

SEQ ID NO: 911868 - RNA, 16 nt, Mycobacterium avium subsp. paratuberculosis
cggcagccacggcagc

SEQ ID NO: 911869 - RNA, 17 nt, Mycobacterium avium subsp. paratuberculosis
cggcagccacggcagcu

SEQ ID NO: 911870 - RNA, 17 nt, Mycobacterium avium subsp. paratuberculosis
cggcagccagaugucgc

SEQ ID NO: 911871 - RNA, 13 nt, Mycobacterium avium subsp. paratuberculosis
cggcagccagccu

SEQ ID NO: 911872 - RNA, 21 nt, Mycobacterium avium subsp. paratuberculosis
cggcagccagccuggcggcga

SEQ ID NO: 911873 - RNA, 23 nt, Mycobacterium avium subsp. paratuberculosis
cggcagccagccuggcggcgacc

SEQ ID NO: 911874 - RNA, 17 nt, Mycobacterium avium subsp. paratuberculosis
cggcagccaggcguugg

SEQ ID NO: 911875 - RNA, 21 nt, Mycobacterium avium subsp. paratuberculosis
cggcacaccagcguucgucgc

SEQ ID NO: 911876 - RNA, 23 nt, Mycobacterium avium subsp. paratuberculosis
cggcacaccagcguucgucgccg

SEQ ID NO: 911877 - RNA, 15 nt, Mycobacterium avium subsp. paratuberculosis
cggcacaccagguag

SEQ ID NO: 911878 - RNA, 19 nt, Mycobacterium avium subsp. paratuberculosis
cggcacaccagguaggcgg

SEQ ID NO: 911879 - RNA, 15 nt, Mycobacterium avium subsp. paratuberculosis
cggcaaugguugcgg

SEQ ID NO: 911880 - RNA, 16 nt, Mycobacterium avium subsp. paratuberculosis
cggcaaugguugcggc

SEQ ID NO: 911881 - RNA, 20 nt, Mycobacterium avium subsp. paratuberculosis
cggcaaugguugcggcgggc

SEQ ID NO: 911882 - RNA, 22 nt, Mycobacterium avium subsp. paratuberculosis
cggcaaugguugcggcgggccg

SEQ ID NO: 911883 - RNA, 14 nt, Mycobacterium avium subsp. paratuberculosis
cggcacaccgagcg

SEQ ID NO: 911884 - RNA, 20 nt, Mycobacterium avium subsp. paratuberculosis
cggcacaccgagcgagcgca

SEQ ID NO: 911885 - RNA, 17 nt, Mycobacterium avium subsp. paratuberculosis
cggcacaccgcgcgaac

SEQ ID NO: 911886 - RNA, 15 nt, Mycobacterium avium subsp. paratuberculosis
cggcaaccgccacga

SEQ ID NO: 911887 - RNA, 15 nt, Mycobacterium avium subsp. paratuberculosis
cggcaaccagcuccg

SEQ ID NO: 911888 - RNA, 17 nt, Mycobacterium avium subsp. paratuberculosis
cggcaaccagcuccggc

SEQ ID NO: 911889 - RNA, 19 nt, Mycobacterium avium subsp. paratuberculosis
cggcaacccgaucgccgag

SEQ ID NO: 911890 - RNA, 23 nt, Mycobacterium avium subsp. paratuberculosis
cggcaacccgaucgccgagucga

SEQ ID NO: 911891 - RNA, 19 nt, Mycobacterium avium subsp. paratuberculosis
cggcaaccgaaucgagccg

SEQ ID NO: 911892 - RNA, 20 nt, Mycobacterium avium subsp. paratuberculosis
cggcaaccgaaucgagccga

SEQ ID NO: 911893 - RNA, 15 nt, Mycobacterium avium subsp. paratuberculosis
cggcaacgccagcca

SEQ ID NO: 911894 - RNA, 12 nt, Mycobacterium avium subsp. paratuberculosis
cggcaacgccgg

SEQ ID NO: 911895 - RNA, 14 nt, Mycobacterium avium subsp. paratuberculosis
cggcaacggcggcg

SEQ ID NO: 911896 - RNA, 15 nt, Mycobacterium avium subsp. paratuberculosis
cggcaacggcggcgg

SEQ ID NO: 911897 - RNA, 13 nt, Mycobacterium avium subsp. paratuberculosis
cggcaacgccggg

SEQ ID NO: 911898 - RNA, 14 nt, Mycobacterium avium subsp. paratuberculosis
cggcaacgccgggu

SEQ ID NO: 911899 - RNA, 15 nt, Mycobacterium avium subsp. paratuberculosis
cggcaaccgcugcgg

SEQ ID NO: 911900 - RNA, 16 nt, Mycobacterium avium subsp. paratuberculosis
cggcaaccgcugcggu

SEQ ID NO: 911901 - RNA, 18 nt, Mycobacterium avium subsp. paratuberculosis
cggcaaccugggcggcgg

SEQ ID NO: 911902 - RNA, 20 nt, Mycobacterium avium subsp. paratuberculosis
cggcaaccugggcggcggcg

SEQ ID NO: 911903 - RNA, 17 nt, Mycobacterium avium subsp. paratuberculosis
cggcaacgacccgucgg

SEQ ID NO: 911904 - RNA, 16 nt, Mycobacterium avium subsp. paratuberculosis
cggcaacgaggccagg

SEQ ID NO: 911905 - RNA, 13 nt, Mycobacterium avium subsp. paratuberculosis
cggcaccccgcgg

SEQ ID NO: 911906 - RNA, 14 nt, Mycobacterium avium subsp. paratuberculosis
cggcaccccgcggu

SEQ ID NO: 911907 - RNA, 17 nt, Mycobacterium avium subsp. paratuberculosis
cggcaccccgcggucgg

SEQ ID NO: 911908 - RNA, 19 nt, Mycobacterium avium subsp. paratuberculosis
cggcaccccgcggucggcg

SEQ ID NO: 911909 - RNA, 23 nt, Mycobacterium avium subsp. paratuberculosis
cggcaccccgcggucggcggcgu

SEQ ID NO: 911910 - RNA, 17 nt, Mycobacterium avium subsp. paratuberculosis
cggcaccagagcgccgg

SEQ ID NO: 911911 - RNA, 18 nt, Mycobacterium avium subsp. paratuberculosis
cggcaccagagcgccgga

SEQ ID NO: 911912 - RNA, 19 nt, Mycobacterium avium subsp. paratuberculosis
cggcaccagagcgccggac

SEQ ID NO: 911913 - RNA, 22 nt, Mycobacterium avium subsp. paratuberculosis
cggcaccaccacgguggcgccg

SEQ ID NO: 911914 - RNA, 23 nt, Mycobacterium avium subsp. paratuberculosis
cggcaccaccacgguggcgccgg

SEQ ID NO: 911915 - RNA, 17 nt, Mycobacterium avium subsp. paratuberculosis
cggcaccaccagcgugu

SEQ ID NO: 911916 - RNA, 12 nt, Mycobacterium avium subsp. paratuberculosis
cggcaccacccg

SEQ ID NO: 911917 - RNA, 15 nt, Mycobacterium avium subsp. paratuberculosis
cggcaccacccgcgg

SEQ ID NO: 911918 - RNA, 18 nt, Mycobacterium avium subsp. paratuberculosis
cggcaccacccgcggccg

SEQ ID NO: 911919 - RNA, 16 nt, Mycobacterium avium subsp. paratuberculosis
cggcaccacccggucc

SEQ ID NO: 911920 - RNA, 18 nt, Mycobacterium avium subsp. paratuberculosis
cggcaccaccacccccga

SEQ ID NO: 911921 - RNA, 22 nt, Mycobacterium avium subsp. paratuberculosis
cggcaccgauaguagccagcau

SEQ ID NO: 911922 - RNA, 14 nt, Mycobacterium avium subsp. paratuberculosis
cggcaccgaucggc

SEQ ID NO: 911923 - RNA, 23 nt, Mycobacterium avium subsp. paratuberculosis
cggcaccgaucggcacgucgagc

SEQ ID NO: 911924 - RNA, 13 nt, Mycobacterium avium subsp. paratuberculosis
cggcacccgcagc

SEQ ID NO: 911925 - RNA, 22 nt, Mycobacterium avium subsp. paratuberculosis
cggcaccgacagggccagcgcc

SEQ ID NO: 911926 - RNA, 20 nt, Mycobacterium avium subsp. paratuberculosis
cggcaccgaccgggcgcucc

SEQ ID NO: 911927 - RNA, 17 nt, Mycobacterium avium subsp. paratuberculosis
cggcaccgacggagccg

SEQ ID NO: 911928 - RNA, 18 nt, Mycobacterium avium subsp. paratuberculosis
cggcaccgacggagccga

SEQ ID NO: 911929 - RNA, 19 nt, Mycobacterium avium subsp. paratuberculosis
cggcaccgacggagccgag

SEQ ID NO: 911930 - RNA, 20 nt, Mycobacterium avium subsp. paratuberculosis
cggcaccgacggagccgagc

SEQ ID NO: 911931 - RNA, 21 nt, Mycobacterium avium subsp. paratuberculosis
cggcacccgcaacaccacguc

SEQ ID NO: 911932 - RNA, 19 nt, Mycobacterium avium subsp. paratuberculosis
cggcaccacgaucaccaga

SEQ ID NO: 911933 - RNA, 21 nt, Mycobacterium avium subsp. paratuberculosis
cggcaccacgaucaccagacc

SEQ ID NO: 911934 - RNA, 19 nt, Mycobacterium avium subsp. paratuberculosis
cggcacgccgcucgucggg

SEQ ID NO: 911935 - RNA, 23 nt, Mycobacterium avium subsp. paratuberculosis
cggcacgcccguucgagcgccgg

SEQ ID NO: 911936 - RNA, 13 nt, Mycobacterium avium subsp. paratuberculosis
cggcacgccgacc

SEQ ID NO: 911937 - RNA, 14 nt, Mycobacterium avium subsp. paratuberculosis
cggcacgccgacca

SEQ ID NO: 911938 - RNA, 15 nt, Mycobacterium avium subsp. paratuberculosis
cggcaccucgaucac

SEQ ID NO: 911939 - RNA, 13 nt, Mycobacterium avium subsp. paratuberculosis
cggcaccucucgg

SEQ ID NO: 911940 - RNA, 15 nt, Mycobacterium avium subsp. paratuberculosis
cggcaccucucggga

SEQ ID NO: 911941 - RNA, 14 nt, Mycobacterium avium subsp. paratuberculosis
cggcaccucggccu

SEQ ID NO: 911942 - RNA, 18 nt, Mycobacterium avium subsp. paratuberculosis
cggcaccuccugcacccg

SEQ ID NO: 911943 - RNA, 22 nt, Mycobacterium avium subsp. paratuberculosis
cggcaccucgaagggcgccagc

SEQ ID NO: 911944 - RNA, 17 nt, Mycobacterium avium subsp. paratuberculosis
cggcaccgugccgcgcg

SEQ ID NO: 911945 - RNA, 20 nt, Mycobacterium avium subsp. paratuberculosis
cggcaccuccagcccggcga

SEQ ID NO: 911946 - RNA, 13 nt, Mycobacterium avium subsp. paratuberculosis
cggcaccuccagc

SEQ ID NO: 911947 - RNA, 16 nt, Mycobacterium avium subsp. paratuberculosis
cggcaccggugcggcg

SEQ ID NO: 911948 - RNA, 17 nt, Mycobacterium avium subsp. paratuberculosis
cggcaccggugcggcgg

SEQ ID NO: 911949 - RNA, 15 nt, Mycobacterium avium subsp. paratuberculosis
cggcaccgucaccga

SEQ ID NO: 911950 - RNA, 16 nt, Mycobacterium avium subsp. paratuberculosis
cggcaccgucaccgac

SEQ ID NO: 911951 - RNA, 21 nt, Mycobacterium avium subsp. paratuberculosis
cggcaccgucaccgacggcug

SEQ ID NO: 911952 - RNA, 15 nt, Mycobacterium avium subsp. paratuberculosis
cggcaccgccagcca

SEQ ID NO: 911953 - RNA, 18 nt, Mycobacterium avium subsp. paratuberculosis
cggcaccgccagccacca

SEQ ID NO: 911954 - RNA, 19 nt, Mycobacterium avium subsp. paratuberculosis
cggcaccgccaucggcauc

SEQ ID NO: 911955 - RNA, 12 nt, Mycobacterium avium subsp. paratuberculosis
cggcaccggcga

SEQ ID NO: 911956 - RNA, 13 nt, Mycobacterium avium subsp. paratuberculosis
cggcaccgggacc

SEQ ID NO: 911957 - RNA, 16 nt, Mycobacterium avium subsp. paratuberculosis
cggcaccgggaccugg

SEQ ID NO: 911958 - RNA, 17 nt, Mycobacterium avium subsp. paratuberculosis
cggcccccacgcagcgg

SEQ ID NO: 911959 - RNA, 13 nt, Mycobacterium avium subsp. paratuberculosis
cggcccaggcaca

SEQ ID NO: 911960 - RNA, 15 nt, Mycobacterium avium subsp. paratuberculosis
cggcccaggcacagc

SEQ ID NO: 911961 - RNA, 18 nt, Mycobacterium avium subsp. paratuberculosis
cggcccaggcacagcgaa

SEQ ID NO: 911962 - RNA, 22 nt, Mycobacterium avium subsp. paratuberculosis
cggcccaggcaguagccgaucu

SEQ ID NO: 911963 - RNA, 16 nt, Mycobacterium avium subsp. paratuberculosis
cggcccaggccaacag

SEQ ID NO: 911964 - RNA, 15 nt, Mycobacterium avium subsp. paratuberculosis
cggccccaccgccgc

SEQ ID NO: 911965 - RNA, 17 nt, Mycobacterium avium subsp. paratuberculosis
cggccccaccgccgcug

SEQ ID NO: 911966 - RNA, 22 nt, Mycobacterium avium subsp. paratuberculosis
cggccccacguugaucaugucg

SEQ ID NO: 911967 - RNA, 12 nt, Mycobacterium avium subsp. paratuberculosis
cggccccagccg

SEQ ID NO: 911968 - RNA, 15 nt, Mycobacterium avium subsp. paratuberculosis
cggccccagccgccg

SEQ ID NO: 911969 - RNA, 19 nt, Mycobacterium avium subsp. paratuberculosis
cggccccccgcacaccggc

SEQ ID NO: 911970 - RNA, 13 nt, Mycobacterium avium subsp. paratuberculosis
cggccccccgggc

SEQ ID NO: 911971 - RNA, 16 nt, Mycobacterium avium subsp. paratuberculosis
cggccccccgggcacc

SEQ ID NO: 911972 - RNA, 18 nt, Mycobacterium avium subsp. paratuberculosis
cggccccccgggcaccag

SEQ ID NO: 911973 - RNA, 20 nt, Mycobacterium avium subsp. paratuberculosis
cggcccccugcucagcggcc

SEQ ID NO: 911974 - RNA, 24 nt, Mycobacterium avium subsp. paratuberculosis
cggcccccugcucagcggccaucg

SEQ ID NO: 911975 - RNA, 13 nt, Mycobacterium avium subsp. paratuberculosis
cggccccgagccg

SEQ ID NO: 911976 - RNA, 14 nt, Mycobacterium avium subsp. paratuberculosis
cggccccgagccga

SEQ ID NO: 911977 - RNA, 16 nt, Mycobacterium avium subsp. paratuberculosis
cggccccgagccgacg

SEQ ID NO: 911978 - RNA, 17 nt, Mycobacterium avium subsp. paratuberculosis
cggccccgagcgucacg

SEQ ID NO: 911979 - RNA, 22 nt, Mycobacterium avium subsp. paratuberculosis
cggccccgagcgucacgccagc

SEQ ID NO: 911980 - RNA, 15 nt, Mycobacterium avium subsp. paratuberculosis
cggccccgccagcag

SEQ ID NO: 911981 - RNA, 14 nt, Mycobacterium avium subsp. paratuberculosis
cggcccagcgcggu

SEQ ID NO: 911982 - RNA, 16 nt, Mycobacterium avium subsp. paratuberculosis
cggcccagcgcggugu

SEQ ID NO: 911983 - RNA, 21 nt, Mycobacterium avium subsp. paratuberculosis
cggcccagcgucaacucgucg

SEQ ID NO: 911984 - RNA, 24 nt, Mycobacterium avium subsp. paratuberculosis
cggcccagcuccacgcguagccga

SEQ ID NO: 911985 - RNA, 16 nt, Mycobacterium avium subsp. paratuberculosis
cggcccagcucgguga

SEQ ID NO: 911986 - RNA, 19 nt, Mycobacterium avium subsp. paratuberculosis
cggcccagcucggugaucu

SEQ ID NO: 911987 - RNA, 13 nt, Mycobacterium avium subsp. paratuberculosis
cggcccagcgcgc

SEQ ID NO: 911988 - RNA, 13 nt, Mycobacterium avium subsp. paratuberculosis
cggcccagccgcu

SEQ ID NO: 911989 - RNA, 12 nt, Mycobacterium avium subsp. paratuberculosis
cggcccagccgg

SEQ ID NO: 911990 - RNA, 15 nt, Mycobacterium avium subsp. paratuberculosis
cggcccagccggcgg

SEQ ID NO: 911991 - RNA, 16 nt, Mycobacterium avium subsp. paratuberculosis
cggcccagccggcggu

SEQ ID NO: 911992 - RNA, 17 nt, Mycobacterium avium subsp. paratuberculosis
cggcccagccuucgccg

SEQ ID NO: 911993 - RNA, 21 nt, Mycobacterium avium subsp. paratuberculosis
cggcccagaucgcgguccacc

SEQ ID NO: 911994 - RNA, 24 nt, Mycobacterium avium subsp. paratuberculosis
cggcccagacgaugucgucgccgg

SEQ ID NO: 911995 - RNA, 23 nt, Mycobacterium avium subsp. paratuberculosis
cggcccagacgguuccaccgguc

SEQ ID NO: 911996 - RNA, 16 nt, Mycobacterium avium subsp. paratuberculosis
cggcccacgucgcgcc

SEQ ID NO: 911997 - RNA, 18 nt, Mycobacterium avium subsp. paratuberculosis
cggcccacgucgcgccga

SEQ ID NO: 911998 - RNA, 20 nt, Mycobacterium avium subsp. paratuberculosis
cggccauucaucgcgcacca

SEQ ID NO: 911999 - RNA, 21 nt, Mycobacterium avium subsp. paratuberculosis
cggccauucaucgcgcaccag

SEQ ID NO: 912000 - RNA, 18 nt, Mycobacterium avium subsp. paratuberculosis
cggccauggucgcggccg

SEQ ID NO: 912001 - RNA, 12 nt, Mycobacterium avium subsp. paratuberculosis
cggccaugucgg

SEQ ID NO: 912002 - RNA, 15 nt, Mycobacterium avium subsp. paratuberculosis
cggccaugucggagc

SEQ ID NO: 912003 - RNA, 23 nt, Mycobacterium avium subsp. paratuberculosis
cggccaugucggagcugcgcgcc

SEQ ID NO: 912004 - RNA, 17 nt, Mycobacterium avium subsp. paratuberculosis
cggccauggugccgccg

SEQ ID NO: 912005 - RNA, 18 nt, Mycobacterium avium subsp. paratuberculosis
cggccauggugccgccgu

SEQ ID NO: 912006 - RNA, 14 nt, Mycobacterium avium subsp. paratuberculosis
cggccauccgggcg

SEQ ID NO: 912007 - RNA, 14 nt, Mycobacterium avium subsp. paratuberculosis
cggccaucccggug

SEQ ID NO: 912008 - RNA, 17 nt, Mycobacterium avium subsp. paratuberculosis
cggccaucccggugccg

SEQ ID NO: 912009 - RNA, 15 nt, Mycobacterium avium subsp. paratuberculosis
cggccauccgcugcg

SEQ ID NO: 912010 - RNA, 22 nt, Mycobacterium avium subsp. paratuberculosis
cggccauccccgcguuggccag

SEQ ID NO: 912011 - RNA, 18 nt, Mycobacterium avium subsp. paratuberculosis
cggccaucaugcccacca

SEQ ID NO: 912012 - RNA, 19 nt, Mycobacterium avium subsp. paratuberculosis
cggccaucaugcccaccau

SEQ ID NO: 912013 - RNA, 20 nt, Mycobacterium avium subsp. paratuberculosis
cggccaucaugcccaccauc

SEQ ID NO: 912014 - RNA, 17 nt, Mycobacterium avium subsp. paratuberculosis
cggccaucacggugccg

SEQ ID NO: 912015 - RNA, 18 nt, Mycobacterium avium subsp. paratuberculosis
cggccaucacggugccga

SEQ ID NO: 912016 - RNA, 13 nt, Mycobacterium avium subsp. paratuberculosis
cggccaucagcac

SEQ ID NO: 912017 - RNA, 15 nt, Mycobacterium avium subsp. paratuberculosis
cggccaucagcaccg

SEQ ID NO: 912018 - RNA, 16 nt, Mycobacterium avium subsp. paratuberculosis
cggccaucagcaccga

SEQ ID NO: 912019 - RNA, 18 nt, Mycobacterium avium subsp. paratuberculosis
cggccaucagcaccgaau

SEQ ID NO: 912020 - RNA, 22 nt, Mycobacterium avium subsp. paratuberculosis
cggccaucagcaccgaaucgcc

SEQ ID NO: 912021 - RNA, 13 nt, Mycobacterium avium subsp. paratuberculosis
cggccaucagccg

SEQ ID NO: 912022 - RNA, 15 nt, Mycobacterium avium subsp. paratuberculosis
cggccaucagccgcc

SEQ ID NO: 912023 - RNA, 16 nt, Mycobacterium avium subsp. paratuberculosis
cggccaucagccgccg

SEQ ID NO: 912024 - RNA, 23 nt, Mycobacterium avium subsp. paratuberculosis
cggccaucagccgccgucgcgcc

SEQ ID NO: 912025 - RNA, 14 nt, Mycobacterium avium subsp. paratuberculosis
cggccagggcggcg

SEQ ID NO: 912026 - RNA, 17 nt, Mycobacterium avium subsp. paratuberculosis
cggccagggcggcgccg

SEQ ID NO: 912027 - RNA, 19 nt, Mycobacterium avium subsp. paratuberculosis
cggccagggcggcgccggc

SEQ ID NO: 912028 - RNA, 21 nt, Mycobacterium avium subsp. paratuberculosis
cggccagggcggcgccggcac

SEQ ID NO: 912029 - RNA, 14 nt, Mycobacterium avium subsp. paratuberculosis
cggccagggcgugg

SEQ ID NO: 912030 - RNA, 15 nt, Mycobacterium avium subsp. paratuberculosis
cggccagggcgugga

SEQ ID NO: 912031 - RNA, 14 nt, Mycobacterium avium subsp. paratuberculosis
cggccagggccgcc

SEQ ID NO: 912032 - RNA, 15 nt, Mycobacterium avium subsp. paratuberculosis
cggccagggccgccg

SEQ ID NO: 912033 - RNA, 18 nt, Mycobacterium avium subsp. paratuberculosis
cggccagggccgccgcau

SEQ ID NO: 912034 - RNA, 19 nt, Mycobacterium avium subsp. paratuberculosis
cggccagggccgccgcaua

SEQ ID NO: 912035 - RNA, 21 nt, Mycobacterium avium subsp. paratuberculosis
cggccagcucggcccgcugcg

SEQ ID NO: 912036 - RNA, 15 nt, Mycobacterium avium subsp. paratuberculosis
cggccaggccggcga

SEQ ID NO: 912037 - RNA, 19 nt, Mycobacterium avium subsp. paratuberculosis
cggccaggccggccugccg

SEQ ID NO: 912038 - RNA, 22 nt, Mycobacterium avium subsp. paratuberculosis
cggccaggccggccugccggau

SEQ ID NO: 912039 - RNA, 12 nt, Mycobacterium avium subsp. paratuberculosis
cggccagcgccg

SEQ ID NO: 912040 - RNA, 17 nt, Mycobacterium avium subsp. paratuberculosis
cggccagcgccgccagc

SEQ ID NO: 912041 - RNA, 19 nt, Mycobacterium avium subsp. paratuberculosis
cggccagcgccgccagccg

SEQ ID NO: 912042 - RNA, 15 nt, Mycobacterium avium subsp. paratuberculosis
cggccagcgccgccc

SEQ ID NO: 912043 - RNA, 16 nt, Mycobacterium avium subsp. paratuberculosis
cggccagcgccgcccg

SEQ ID NO: 912044 - RNA, 18 nt, Mycobacterium avium subsp. paratuberculosis
cggccagcgccgcccggg

SEQ ID NO: 912045 - RNA, 21 nt, Mycobacterium avium subsp. paratuberculosis
cggccagcgccgcccgggcgg

SEQ ID NO: 912046 - RNA, 14 nt, Mycobacterium avium subsp. paratuberculosis
cggccagcgccgcg

SEQ ID NO: 912047 - RNA, 16 nt, Mycobacterium avium subsp. paratuberculosis
cggccagcgccccgcc

SEQ ID NO: 912048 - RNA, 17 nt, Mycobacterium avium subsp. paratuberculosis
cggccagcgccccgccg

SEQ ID NO: 912049 - RNA, 17 nt, Mycobacterium avium subsp. paratuberculosis
cggccagcgcccgcgcg

SEQ ID NO: 912050 - RNA, 21 nt, Mycobacterium avium subsp. paratuberculosis
cggccagcgcccgcgcgaucg

SEQ ID NO: 912051 - RNA, 24 nt, Mycobacterium avium subsp. paratuberculosis
cggccagcgcccgcgcgaucggcg

SEQ ID NO: 912052 - RNA, 16 nt, Mycobacterium avium subsp. paratuberculosis
cggccagcgcccgcgg

SEQ ID NO: 912053 - RNA, 13 nt, Mycobacterium avium subsp. paratuberculosis
cggccagcgcggc

SEQ ID NO: 912054 - RNA, 17 nt, Mycobacterium avium subsp. paratuberculosis
cggccagcgcgcgggcg

SEQ ID NO: 912055 - RNA, 20 nt, Mycobacterium avium subsp. paratuberculosis
cggccagcgcgcgggcgucc

SEQ ID NO: 912056 - RNA, 12 nt, Mycobacterium avium subsp. paratuberculosis
cggccagcgcgg

SEQ ID NO: 912057 - RNA, 14 nt, Mycobacterium avium subsp. paratuberculosis
cggccagcgcgccg

SEQ ID NO: 912058 - RNA, 18 nt, Mycobacterium avium subsp. paratuberculosis
cggccagcgcgccgcaca

SEQ ID NO: 912059 - RNA, 20 nt, Mycobacterium avium subsp. paratuberculosis
cggccagcgcgccgcacagc

SEQ ID NO: 912060 - RNA, 20 nt, Mycobacterium avium subsp. paratuberculosis
cggccagcgcgacgcgcaug

SEQ ID NO: 912061 - RNA, 13 nt, Mycobacterium avium subsp. paratuberculosis
cggccagcgccuu

SEQ ID NO: 912062 - RNA, 11 nt, Mycobacterium avium subsp. paratuberculosis
cggccagcgcg

SEQ ID NO: 912063 - RNA, 23 nt, Mycobacterium avium subsp. paratuberculosis
cggccagcgccgucaucaccgcc

SEQ ID NO: 912064 - RNA, 17 nt, Mycobacterium avium subsp. paratuberculosis
cggccagcgccgcgcgc

SEQ ID NO: 912065 - RNA, 22 nt, Mycobacterium avium subsp. paratuberculosis
cggccagccggcucuuggcgac

SEQ ID NO: 912066 - RNA, 15 nt, Mycobacterium avium subsp. paratuberculosis
cggccagcgaggugg

SEQ ID NO: 912067 - RNA, 17 nt, Mycobacterium avium subsp. paratuberculosis
cggccagcgaguccagc

SEQ ID NO: 912068 - RNA, 20 nt, Mycobacterium avium subsp. paratuberculosis
cggccagcgaguccagccag

SEQ ID NO: 912069 - RNA, 15 nt, Mycobacterium avium subsp. paratuberculosis
cggccagcgagucga

SEQ ID NO: 912070 - RNA, 20 nt, Mycobacterium avium subsp. paratuberculosis
cggccagcgagucgaugacc

SEQ ID NO: 912071 - RNA, 19 nt, Mycobacterium avium subsp. paratuberculosis
cggccagccggucgucggg

SEQ ID NO: 912072 - RNA, 18 nt, Mycobacterium avium subsp. paratuberculosis
cggccagccgggcggcca

SEQ ID NO: 912073 - RNA, 19 nt, Mycobacterium avium subsp. paratuberculosis
cggccagccgggcggccag

SEQ ID NO: 912074 - RNA, 14 nt, Mycobacterium avium subsp. paratuberculosis
cggccagccggggu

SEQ ID NO: 912075 - RNA, 15 nt, Mycobacterium avium subsp. paratuberculosis
cggccagccggccgc

SEQ ID NO: 912076 - RNA, 16 nt, Mycobacterium avium subsp. paratuberculosis
cggccagccggccgcu

SEQ ID NO: 912077 - RNA, 20 nt, Mycobacterium avium subsp. paratuberculosis
cggccagccgcucccggcgc

SEQ ID NO: 912078 - RNA, 21 nt, Mycobacterium avium subsp. paratuberculosis
cggccagccgcucccggcgca

SEQ ID NO: 912079 - RNA, 11 nt, Mycobacterium avium subsp. paratuberculosis
cggccagccgg

SEQ ID NO: 912080 - RNA, 18 nt, Mycobacterium avium subsp. paratuberculosis
cggccagccacgccgaca

SEQ ID NO: 912081 - RNA, 19 nt, Mycobacterium avium subsp. paratuberculosis
cggccagccacgccgacac

SEQ ID NO: 912082 - RNA, 18 nt, Mycobacterium avium subsp. paratuberculosis
cggccagccaggccgucg

SEQ ID NO: 912083 - RNA, 17 nt, Mycobacterium avium subsp. paratuberculosis
cggccagcccgcggcag

SEQ ID NO: 912084 - RNA, 20 nt, Mycobacterium avium subsp. paratuberculosis
cggccagcccgcggcagcca

SEQ ID NO: 912085 - RNA, 17 nt, Mycobacterium avium subsp. paratuberculosis
cggccagcccaucccga

SEQ ID NO: 912086 - RNA, 11 nt, Mycobacterium avium subsp. paratuberculosis
cggccagcccc

SEQ ID NO: 912087 - RNA, 14 nt, Mycobacterium avium subsp. paratuberculosis
cggccagccccacc

SEQ ID NO: 912088 - RNA, 15 nt, Mycobacterium avium subsp. paratuberculosis
cggccagccccacca

SEQ ID NO: 912089 - RNA, 17 nt, Mycobacterium avium subsp. paratuberculosis
cggccagccccaccacc

SEQ ID NO: 912090 - RNA, 19 nt, Mycobacterium avium subsp. paratuberculosis
cggccagccccaccaccgc

SEQ ID NO: 912091 - RNA, 20 nt, Mycobacterium avium subsp. paratuberculosis
cggccagccccaccaccgcc

SEQ ID NO: 912092 - RNA, 22 nt, Mycobacterium avium subsp. paratuberculosis
cggccagccccaccaccgccac

SEQ ID NO: 912093 - RNA, 17 nt, Mycobacterium avium subsp. paratuberculosis
cggccagccccgggaac

SEQ ID NO: 912094 - RNA, 14 nt, Mycobacterium avium subsp. paratuberculosis
cggccagccgcgcg

SEQ ID NO: 912095 - RNA, 17 nt, Mycobacterium avium subsp. paratuberculosis
cggccagccgcgcgacg

SEQ ID NO: 912096 - RNA, 19 nt, Mycobacterium avium subsp. paratuberculosis
cggccagccgcgcgacgcc

SEQ ID NO: 912097 - RNA, 18 nt, Mycobacterium avium subsp. paratuberculosis
cggccagccgcgcggcgu

SEQ ID NO: 912098 - RNA, 19 nt, Mycobacterium avium subsp. paratuberculosis
cggccagccgcgcggcguc

SEQ ID NO: 912099 - RNA, 14 nt, Mycobacterium avium subsp. paratuberculosis
cggccagcccgucg

SEQ ID NO: 912100 - RNA, 15 nt, Mycobacterium avium subsp. paratuberculosis
cggccagcccgucgg

SEQ ID NO: 912101 - RNA, 16 nt, Mycobacterium avium subsp. paratuberculosis
cggccagcccgucggg

SEQ ID NO: 912102 - RNA, 13 nt, Mycobacterium avium subsp. paratuberculosis
cggccagccgcuc

SEQ ID NO: 912103 - RNA, 13 nt, Mycobacterium avium subsp. paratuberculosis
cggccaggcccag

SEQ ID NO: 912104 - RNA, 14 nt, Mycobacterium avium subsp. paratuberculosis
cggccaggcccagc

SEQ ID NO: 912105 - RNA, 16 nt, Mycobacterium avium subsp. paratuberculosis
cggccaggcccagccc

SEQ ID NO: 912106 - RNA, 14 nt, Mycobacterium avium subsp. paratuberculosis
cggccaggcacagc

SEQ ID NO: 912107 - RNA, 15 nt, Mycobacterium avium subsp. paratuberculosis
cggccaggcacagca

SEQ ID NO: 912108 - RNA, 16 nt, Mycobacterium avium subsp. paratuberculosis
cggccaggcacagcag

SEQ ID NO: 912109 - RNA, 19 nt, Mycobacterium avium subsp. paratuberculosis
cggccaggcacagcagggc

SEQ ID NO: 912110 - RNA, 20 nt, Mycobacterium avium subsp. paratuberculosis
cggccaggcacagcagggca

SEQ ID NO: 912111 - RNA, 21 nt, Mycobacterium avium subsp. paratuberculosis
cggccaggaucuugucggcgg

SEQ ID NO: 912112 - RNA, 22 nt, Mycobacterium avium subsp. paratuberculosis
cggccaggaucuugucggcggc

SEQ ID NO: 912113 - RNA, 22 nt, Mycobacterium avium subsp. paratuberculosis
cggccagcuuuccggccgccuc

SEQ ID NO: 912114 - RNA, 16 nt, Mycobacterium avium subsp. paratuberculosis
cggccaggaaccaccg

SEQ ID NO: 912115 - RNA, 18 nt, Mycobacterium avium subsp. paratuberculosis
cggccaggaaccaccgga

SEQ ID NO: 912116 - RNA, 19 nt, Mycobacterium avium subsp. paratuberculosis
cggccaggaaccaccggaa

SEQ ID NO: 912117 - RNA, 19 nt, Mycobacterium avium subsp. paratuberculosis
cggccaggaagccggcgac

SEQ ID NO: 912118 - RNA, 20 nt, Mycobacterium avium subsp. paratuberculosis
cggccaggaagccggcgacg

SEQ ID NO: 912119 - RNA, 15 nt, Mycobacterium avium subsp. paratuberculosis
cggccagcuggucgu

SEQ ID NO: 912120 - RNA, 14 nt, Mycobacterium avium subsp. paratuberculosis
cggccagcugaaca

SEQ ID NO: 912121 - RNA, 23 nt, Mycobacterium avium subsp. paratuberculosis
cggccagcugauagccgcccugc

SEQ ID NO: 912122 - RNA, 17 nt, Mycobacterium avium subsp. paratuberculosis
cggccagcugcccgccg

SEQ ID NO: 912123 - RNA, 20 nt, Mycobacterium avium subsp. paratuberculosis
cggccagcugcccgccgacg

SEQ ID NO: 912124 - RNA, 23 nt, Mycobacterium avium subsp. paratuberculosis
cggccagcugcccgccgacgccc

SEQ ID NO: 912125 - RNA, 16 nt, Mycobacterium avium subsp. paratuberculosis
cggccagcugcggguu

SEQ ID NO: 912126 - RNA, 14 nt, Mycobacterium avium subsp. paratuberculosis
cggccagcucgagc

SEQ ID NO: 912127 - RNA, 21 nt, Mycobacterium avium subsp. paratuberculosis
cggccagcucgagcaucacga

SEQ ID NO: 912128 - RNA, 22 nt, Mycobacterium avium subsp. paratuberculosis
cggccagcucgagcaucacgaa

SEQ ID NO: 912129 - RNA, 17 nt, Mycobacterium avium subsp. paratuberculosis
cggccagcucgccgccg

SEQ ID NO: 912130 - RNA, 18 nt, Mycobacterium avium subsp. paratuberculosis
cggccagcucgccgccga

SEQ ID NO: 912131 - RNA, 20 nt, Mycobacterium avium subsp. paratuberculosis
cggccagcucgccgccgacg

SEQ ID NO: 912132 - RNA, 14 nt, Mycobacterium avium subsp. paratuberculosis
cggccagcguggcg

SEQ ID NO: 912133 - RNA, 19 nt, Mycobacterium avium subsp. paratuberculosis
cggccagcguggcgcgccc

SEQ ID NO: 912134 - RNA, 17 nt, Mycobacterium avium subsp. paratuberculosis
cggccagcucccgggcg

SEQ ID NO: 912135 - RNA, 22 nt, Mycobacterium avium subsp. paratuberculosis
cggccagcucccgggcggcgcc

SEQ ID NO: 912136 - RNA, 16 nt, Mycobacterium avium subsp. paratuberculosis
cggccagcuccgccac

SEQ ID NO: 912137 - RNA, 19 nt, Mycobacterium avium subsp. paratuberculosis
cggccagcuccgccacccu

SEQ ID NO: 912138 - RNA, 16 nt, Mycobacterium avium subsp. paratuberculosis
cggccagcucaccggc

SEQ ID NO: 912139 - RNA, 19 nt, Mycobacterium avium subsp. paratuberculosis
cggccagcucaccggccag

SEQ ID NO: 912140 - RNA, 15 nt, Mycobacterium avium subsp. paratuberculosis
cggccagcuccgggu

SEQ ID NO: 912141 - RNA, 18 nt, Mycobacterium avium subsp. paratuberculosis
cggccagcuccgggucga

SEQ ID NO: 912142 - RNA, 18 nt, Mycobacterium avium subsp. paratuberculosis
cggccagcggcuuggccg

SEQ ID NO: 912143 - RNA, 19 nt, Mycobacterium avium subsp. paratuberculosis
cggccagcggcuuggccgu

SEQ ID NO: 912144 - RNA, 21 nt, Mycobacterium avium subsp. paratuberculosis
cggccagcggcuuggccgugc

SEQ ID NO: 912145 - RNA, 16 nt, Mycobacterium avium subsp. paratuberculosis
cggccagcgggcggcc

SEQ ID NO: 912146 - RNA, 18 nt, Mycobacterium avium subsp. paratuberculosis
cggccagcgggcggcccc

SEQ ID NO: 912147 - RNA, 22 nt, Mycobacterium avium subsp. paratuberculosis
cggccagcgggcggccccgggc

SEQ ID NO: 912148 - RNA, 13 nt, Mycobacterium avium subsp. paratuberculosis
cggccagcgggug

SEQ ID NO: 912149 - RNA, 14 nt, Mycobacterium avium subsp. paratuberculosis
cggccagcgucgcg

SEQ ID NO: 912150 - RNA, 17 nt, Mycobacterium avium subsp. paratuberculosis
cggccagcgucgcgccg

SEQ ID NO: 912151 - RNA, 20 nt, Mycobacterium avium subsp. paratuberculosis
cggccagcgucgcgccgcca

SEQ ID NO: 912152 - RNA, 21 nt, Mycobacterium avium subsp. paratuberculosis
cggccagcgucgcgccgccac

SEQ ID NO: 912153 - RNA, 17 nt, Mycobacterium avium subsp. paratuberculosis
cggccagcgucuccggc

SEQ ID NO: 912154 - RNA, 19 nt, Mycobacterium avium subsp. paratuberculosis
cggccagcgucuccggcgg

SEQ ID NO: 912155 - RNA, 20 nt, Mycobacterium avium subsp. paratuberculosis
cggccagcgucuccggcggg

SEQ ID NO: 912156 - RNA, 23 nt, Mycobacterium avium subsp. paratuberculosis
cggccagcgucuccggcgggcug

SEQ ID NO: 912157 - RNA, 13 nt, Mycobacterium avium subsp. paratuberculosis
cggccagcggcgc

SEQ ID NO: 912158 - RNA, 16 nt, Mycobacterium avium subsp. paratuberculosis
cggccagcggcgccga

SEQ ID NO: 912159 - RNA, 13 nt, Mycobacterium avium subsp. paratuberculosis
cggccagcggcca

SEQ ID NO: 912160 - RNA, 14 nt, Mycobacterium avium subsp. paratuberculosis
cggccagcggccag

SEQ ID NO: 912161 - RNA, 17 nt, Mycobacterium avium subsp. paratuberculosis
cggccagcggccagccc

SEQ ID NO: 912162 - RNA, 22 nt, Mycobacterium avium subsp. paratuberculosis
cggccagcggccagcccgcggc

SEQ ID NO: 912163 - RNA, 14 nt, Mycobacterium avium subsp. paratuberculosis
cggccagcggcagc

SEQ ID NO: 912164 - RNA, 18 nt, Mycobacterium avium subsp. paratuberculosis
cggccagcggcagcggcg

SEQ ID NO: 912165 - RNA, 20 nt, Mycobacterium avium subsp. paratuberculosis
cggccagcggcagcggcguc

SEQ ID NO: 912166 - RNA, 21 nt, Mycobacterium avium subsp. paratuberculosis
cggccagcggcagcggcgucg

SEQ ID NO: 912167 - RNA, 23 nt, Mycobacterium avium subsp. paratuberculosis
cggccagcggcagcggcgucguc

SEQ ID NO: 912168 - RNA, 20 nt, Mycobacterium avium subsp. paratuberculosis
cggccagcggcagcgucggg

SEQ ID NO: 912169 - RNA, 18 nt, Mycobacterium avium subsp. paratuberculosis
cggccagcgcgucggcca

SEQ ID NO: 912170 - RNA, 20 nt, Mycobacterium avium subsp. paratuberculosis
cggccagcgcgucggccagc

SEQ ID NO: 912171 - RNA, 21 nt, Mycobacterium avium subsp. paratuberculosis
cggccagcgcgucggccagca

SEQ ID NO: 912172 - RNA, 14 nt, Mycobacterium avium subsp. paratuberculosis
cggccagcgcgucg

SEQ ID NO: 912173 - RNA, 15 nt, Mycobacterium avium subsp. paratuberculosis
cggccagcgcggcgg

SEQ ID NO: 912174 - RNA, 16 nt, Mycobacterium avium subsp. paratuberculosis
cggccagcgcggcggc

SEQ ID NO: 912175 - RNA, 17 nt, Mycobacterium avium subsp. paratuberculosis
cggccagcgcgcggccc

SEQ ID NO: 912176 - RNA, 16 nt, Mycobacterium avium subsp. paratuberculosis
cggccagcgcggccgg

SEQ ID NO: 912177 - RNA, 19 nt, Mycobacterium avium subsp. paratuberculosis
cggccagcgcggccgggcg

SEQ ID NO: 912178 - RNA, 21 nt, Mycobacterium avium subsp. paratuberculosis
cggccagcgcggccgggcgcc

SEQ ID NO: 912179 - RNA, 19 nt, Mycobacterium avium subsp. paratuberculosis
cggccagcgcggcggccag

SEQ ID NO: 912180 - RNA, 22 nt, Mycobacterium avium subsp. paratuberculosis
cggccagcgcggcggucgcgcg

SEQ ID NO: 912181 - RNA, 15 nt, Mycobacterium avium subsp. paratuberculosis
cggccagcgcggugu

SEQ ID NO: 912182 - RNA, 18 nt, Mycobacterium avium subsp. paratuberculosis
cggccagcgcggugugcg

SEQ ID NO: 912183 - RNA, 22 nt, Mycobacterium avium subsp. paratuberculosis
cggccagcgcggugugcggcgg

SEQ ID NO: 912184 - RNA, 23 nt, Mycobacterium avium subsp. paratuberculosis
cggccagcgcggugugcggcggc

SEQ ID NO: 912185 - RNA, 13 nt, Mycobacterium avium subsp. paratuberculosis
cggccagcgcguc

SEQ ID NO: 912186 - RNA, 17 nt, Mycobacterium avium subsp. paratuberculosis
cggccacugccccggcg

SEQ ID NO: 912187 - RNA, 18 nt, Mycobacterium avium subsp. paratuberculosis
cggccacugccccggcga

SEQ ID NO: 912188 - RNA, 19 nt, Mycobacterium avium subsp. paratuberculosis
cggccacugccccggcgaa

SEQ ID NO: 912189 - RNA, 20 nt, Mycobacterium avium subsp. paratuberculosis
cggccacugccccggcgaac

SEQ ID NO: 912190 - RNA, 23 nt, Mycobacterium avium subsp. paratuberculosis
cggccacugccccggcgaacgcc

SEQ ID NO: 912191 - RNA, 20 nt, Mycobacterium avium subsp. paratuberculosis
cggccagaucggccagguug

SEQ ID NO: 912192 - RNA, 17 nt, Mycobacterium avium subsp. paratuberculosis
cggccagauagaugagc

SEQ ID NO: 912193 - RNA, 16 nt, Mycobacterium avium subsp. paratuberculosis
cggccagcacgccguc

SEQ ID NO: 912194 - RNA, 18 nt, Mycobacterium avium subsp. paratuberculosis
cggccagcacgccguccu

SEQ ID NO: 912195 - RNA, 16 nt, Mycobacterium avium subsp. paratuberculosis
cggccagcacggccag

SEQ ID NO: 912196 - RNA, 14 nt, Mycobacterium avium subsp. paratuberculosis
cggccagcacggcg

SEQ ID NO: 912197 - RNA, 16 nt, Mycobacterium avium subsp. paratuberculosis
cggccagcacggcggc

SEQ ID NO: 912198 - RNA, 15 nt, Mycobacterium avium subsp. paratuberculosis
cggccagcacgguca

SEQ ID NO: 912199 - RNA, 17 nt, Mycobacterium avium subsp. paratuberculosis
cggccagcaccgccagc

SEQ ID NO: 912200 - RNA, 19 nt, Mycobacterium avium subsp. paratuberculosis
cggccagcaccgccagcgc

SEQ ID NO: 912201 - RNA, 14 nt, Mycobacterium avium subsp. paratuberculosis
cggccagcaccagg

SEQ ID NO: 912202 - RNA, 14 nt, Mycobacterium avium subsp. paratuberculosis
cggccagcaccagu

SEQ ID NO: 912203 - RNA, 19 nt, Mycobacterium avium subsp. paratuberculosis
cggccagaucgacgccgcg

SEQ ID NO: 912204 - RNA, 21 nt, Mycobacterium avium subsp. paratuberculosis
cggccagaucgacgccgcggu

SEQ ID NO: 912205 - RNA, 15 nt, Mycobacterium avium subsp. paratuberculosis
cggccagcaccacca

SEQ ID NO: 912206 - RNA, 16 nt, Mycobacterium avium subsp. paratuberculosis
cggccagcaccaccaa

SEQ ID NO: 912207 - RNA, 14 nt, Mycobacterium avium subsp. paratuberculosis
cggccagcaccacg

SEQ ID NO: 912208 - RNA, 13 nt, Mycobacterium avium subsp. paratuberculosis
cggccagcaccag

SEQ ID NO: 912209 - RNA, 16 nt, Mycobacterium avium subsp. paratuberculosis
cggccagcaccagcag

SEQ ID NO: 912210 - RNA, 20 nt, Mycobacterium avium subsp. paratuberculosis
cggccagcaccagcagccgg

SEQ ID NO: 912211 - RNA, 22 nt, Mycobacterium avium subsp. paratuberculosis
cggccagcaccagcagccgguc

SEQ ID NO: 912212 - RNA, 12 nt, Mycobacterium avium subsp. paratuberculosis
cggccagcaucg

SEQ ID NO: 912213 - RNA, 18 nt, Mycobacterium avium subsp. paratuberculosis
cggccagccagccgccca

SEQ ID NO: 912214 - RNA, 19 nt, Mycobacterium avium subsp. paratuberculosis
cggccagccagccgcccag

SEQ ID NO: 912215 - RNA, 20 nt, Mycobacterium avium subsp. paratuberculosis
cggccagccagccgcccagc

SEQ ID NO: 912216 - RNA, 21 nt, Mycobacterium avium subsp. paratuberculosis
cggccagccagccgcccagca

SEQ ID NO: 912217 - RNA, 15 nt, Mycobacterium avium subsp. paratuberculosis
cggccagcagcggcu

SEQ ID NO: 912218 - RNA, 16 nt, Mycobacterium avium subsp. paratuberculosis
cggccagcagcggcuu

SEQ ID NO: 912219 - RNA, 18 nt, Mycobacterium avium subsp. paratuberculosis
cggccagcaggucgaagg

SEQ ID NO: 912220 - RNA, 17 nt, Mycobacterium avium subsp. paratuberculosis
cggccagcaggucgucg

SEQ ID NO: 912221 - RNA, 18 nt, Mycobacterium avium subsp. paratuberculosis
cggccagcaggucgucga

SEQ ID NO: 912222 - RNA, 20 nt, Mycobacterium avium subsp. paratuberculosis
cggccagcaggucgucgacg

SEQ ID NO: 912223 - RNA, 21 nt, Mycobacterium avium subsp. paratuberculosis
cggccagcagggcgccgacga

SEQ ID NO: 912224 - RNA, 15 nt, Mycobacterium avium subsp. paratuberculosis
cggccagcagcgcgu

SEQ ID NO: 912225 - RNA, 16 nt, Mycobacterium avium subsp. paratuberculosis
cggccagcagcgcguc

SEQ ID NO: 912226 - RNA, 20 nt, Mycobacterium avium subsp. paratuberculosis
cggccagcagcgcgucgcgg

SEQ ID NO: 912227 - RNA, 17 nt, Mycobacterium avium subsp. paratuberculosis
cggccagcagcagcccg

SEQ ID NO: 912228 - RNA, 20 nt, Mycobacterium avium subsp. paratuberculosis
cggccagcagcagcccgccg

SEQ ID NO: 912229 - RNA, 14 nt, Mycobacterium avium subsp. paratuberculosis
cggccagcagcagg

SEQ ID NO: 912230 - RNA, 15 nt, Mycobacterium avium subsp. paratuberculosis
cggccagcagcaggu

SEQ ID NO: 912231 - RNA, 12 nt, Mycobacterium avium subsp. paratuberculosis
cggccagcagca

SEQ ID NO: 912232 - RNA, 15 nt, Mycobacterium avium subsp. paratuberculosis
cggccacgucgaugc

SEQ ID NO: 912233 - RNA, 16 nt, Mycobacterium avium subsp. paratuberculosis
cggccacgucgaugcc

SEQ ID NO: 912234 - RNA, 18 nt, Mycobacterium avium subsp. paratuberculosis
cggccacgucgaugccga

SEQ ID NO: 912235 - RNA, 20 nt, Mycobacterium avium subsp. paratuberculosis
cggccacgucgaugccgaac

SEQ ID NO: 912236 - RNA, 15 nt, Mycobacterium avium subsp. paratuberculosis
cggccacucgccgcg

SEQ ID NO: 912237 - RNA, 16 nt, Mycobacterium avium subsp. paratuberculosis
cggccacucgccgcga

SEQ ID NO: 912238 - RNA, 18 nt, Mycobacterium avium subsp. paratuberculosis
cggccacucgccgcgaac

SEQ ID NO: 912239 - RNA, 13 nt, Mycobacterium avium subsp. paratuberculosis
cggccacgcucgc

SEQ ID NO: 912240 - RNA, 14 nt, Mycobacterium avium subsp. paratuberculosis
cggccacgcucgcc

SEQ ID NO: 912241 - RNA, 16 nt, Mycobacterium avium subsp. paratuberculosis
cggccacgcucggcgg

SEQ ID NO: 912242 - RNA, 20 nt, Mycobacterium avium subsp. paratuberculosis
cggccacgcucggcggcgcg

SEQ ID NO: 912243 - RNA, 18 nt, Mycobacterium avium subsp. paratuberculosis
cggccacgcucgggccgg

SEQ ID NO: 912244 - RNA, 19 nt, Mycobacterium avium subsp. paratuberculosis
cggccacgcucgggccggc

SEQ ID NO: 912245 - RNA, 20 nt, Mycobacterium avium subsp. paratuberculosis
cggccacgcucgggccggcg

SEQ ID NO: 912246 - RNA, 22 nt, Mycobacterium avium subsp. paratuberculosis
cggccacgcucgggccggcgcc

SEQ ID NO: 912247 - RNA, 12 nt, Mycobacterium avium subsp. paratuberculosis
cggccaccggcg

SEQ ID NO: 912248 - RNA, 14 nt, Mycobacterium avium subsp. paratuberculosis
cggccaccggcgcg

SEQ ID NO: 912249 - RNA, 17 nt, Mycobacterium avium subsp. paratuberculosis
cggccaccggcgcgacg

SEQ ID NO: 912250 - RNA, 18 nt, Mycobacterium avium subsp. paratuberculosis
cggccaccggcgcgacgg

SEQ ID NO: 912251 - RNA, 20 nt, Mycobacterium avium subsp. paratuberculosis
cggccaccgggucguccgcg

SEQ ID NO: 912252 - RNA, 14 nt, Mycobacterium avium subsp. paratuberculosis
cggccaccgucagc

SEQ ID NO: 912253 - RNA, 15 nt, Mycobacterium avium subsp. paratuberculosis
cggccaccgucagcg

SEQ ID NO: 912254 - RNA, 15 nt, Mycobacterium avium subsp. paratuberculosis
cggccaccgcggucg

SEQ ID NO: 912255 - RNA, 19 nt, Mycobacterium avium subsp. paratuberculosis
cggccaccgcggucgacgg

SEQ ID NO: 912256 - RNA, 15 nt, Mycobacterium avium subsp. paratuberculosis
cggccaccgcguccg

SEQ ID NO: 912257 - RNA, 17 nt, Mycobacterium avium subsp. paratuberculosis
cggccaccgcguccgcg

SEQ ID NO: 912258 - RNA, 22 nt, Mycobacterium avium subsp. paratuberculosis
cggccaccgcgacgcugccggg

SEQ ID NO: 912259 - RNA, 21 nt, Mycobacterium avium subsp. paratuberculosis
cggccaccgcgaucucgaugg

SEQ ID NO: 912260 - RNA, 13 nt, Mycobacterium avium subsp. paratuberculosis
cggccaccgcgcc

SEQ ID NO: 912261 - RNA, 14 nt, Mycobacterium avium subsp. paratuberculosis
cggccaccgcgccc

SEQ ID NO: 912262 - RNA, 17 nt, Mycobacterium avium subsp. paratuberculosis
cggccaccgcgccccgg

SEQ ID NO: 912263 - RNA, 18 nt, Mycobacterium avium subsp. paratuberculosis
cggccaccgcgccccggc

SEQ ID NO: 912264 - RNA, 16 nt, Mycobacterium avium subsp. paratuberculosis
cggccaccgcgcgcug

SEQ ID NO: 912265 - RNA, 19 nt, Mycobacterium avium subsp. paratuberculosis
cggccaccgcgcgcugccg

SEQ ID NO: 912266 - RNA, 14 nt, Mycobacterium avium subsp. paratuberculosis
cggccaccgcgcgg

SEQ ID NO: 912267 - RNA, 16 nt, Mycobacterium avium subsp. paratuberculosis
cggccaccgcgcggcg

SEQ ID NO: 912268 - RNA, 18 nt, Mycobacterium avium subsp. paratuberculosis
cggccaccgcgcggcggu

SEQ ID NO: 912269 - RNA, 12 nt, Mycobacterium avium subsp. paratuberculosis
cggccaccgcgg

SEQ ID NO: 912270 - RNA, 15 nt, Mycobacterium avium subsp. paratuberculosis
cggccaccgcggcca

SEQ ID NO: 912271 - RNA, 17 nt, Mycobacterium avium subsp. paratuberculosis
cggccaccgcggccagc

SEQ ID NO: 912272 - RNA, 15 nt, Mycobacterium avium subsp. paratuberculosis
cggccaccagccggc

SEQ ID NO: 912273 - RNA, 17 nt, Mycobacterium avium subsp. paratuberculosis
cggccaccagccggccg

SEQ ID NO: 912274 - RNA, 22 nt, Mycobacterium avium subsp. paratuberculosis
cggccaccagccggccggccga

SEQ ID NO: 912275 - RNA, 14 nt, Mycobacterium avium subsp. paratuberculosis
cggccaccgcccca

SEQ ID NO: 912276 - RNA, 19 nt, Mycobacterium avium subsp. paratuberculosis
cggccaccgccccagccga

SEQ ID NO: 912277 - RNA, 21 nt, Mycobacterium avium subsp. paratuberculosis
cggccaccgccccagccgacc

SEQ ID NO: 912278 - RNA, 13 nt, Mycobacterium avium subsp. paratuberculosis
cggccaccgccgc

SEQ ID NO: 912279 - RNA, 18 nt, Mycobacterium avium subsp. paratuberculosis
cggccaccgccgccagca

SEQ ID NO: 912280 - RNA, 20 nt, Mycobacterium avium subsp. paratuberculosis
cggccaccgccgccagcagc

SEQ ID NO: 912281 - RNA, 20 nt, Mycobacterium avium subsp. paratuberculosis
cggccaccacggcaccgccg

SEQ ID NO: 912282 - RNA, 18 nt, Mycobacterium avium subsp. paratuberculosis
cggccaccagaugccggg

SEQ ID NO: 912283 - RNA, 13 nt, Mycobacterium avium subsp. paratuberculosis
cggccaccagcag

SEQ ID NO: 912284 - RNA, 14 nt, Mycobacterium avium subsp. paratuberculosis
cggccaccagcagc

SEQ ID NO: 912285 - RNA, 17 nt, Mycobacterium avium subsp. paratuberculosis
cggccaccagcagcgag

SEQ ID NO: 912286 - RNA, 16 nt, Mycobacterium avium subsp. paratuberculosis
cggccaccacgacgcc

SEQ ID NO: 912287 - RNA, 17 nt, Mycobacterium avium subsp. paratuberculosis
cggccaccacgacgccg

SEQ ID NO: 912288 - RNA, 14 nt, Mycobacterium avium subsp. paratuberculosis
cggccaccaccgcc

SEQ ID NO: 912289 - RNA, 20 nt, Mycobacterium avium subsp. paratuberculosis
cggccaccaccacggccaug

SEQ ID NO: 912290 - RNA, 23 nt, Mycobacterium avium subsp. paratuberculosis
cggccaccaccacggccaugcag

SEQ ID NO: 912291 - RNA, 12 nt, Mycobacterium avium subsp. paratuberculosis
cggccaccaccg

SEQ ID NO: 912292 - RNA, 23 nt, Mycobacterium avium subsp. paratuberculosis
cggccaccaacaggucggcgugc

SEQ ID NO: 912293 - RNA, 20 nt, Mycobacterium avium subsp. paratuberculosis
cggccaccaacggcagcagc

SEQ ID NO: 912294 - RNA, 15 nt, Mycobacterium avium subsp. paratuberculosis
cggccacacuggcgu

SEQ ID NO: 912295 - RNA, 16 nt, Mycobacterium avium subsp. paratuberculosis
cggccacaccgaucag

SEQ ID NO: 912296 - RNA, 19 nt, Mycobacterium avium subsp. paratuberculosis
cggccacaccgaucagcau

SEQ ID NO: 912297 - RNA, 14 nt, Mycobacterium avium subsp. paratuberculosis
cggccaaucccacc

SEQ ID NO: 912298 - RNA, 18 nt, Mycobacterium avium subsp. paratuberculosis
cggccaaucccaccauga

SEQ ID NO: 912299 - RNA, 19 nt, Mycobacterium avium subsp. paratuberculosis
cggccaauuccucagcccg

SEQ ID NO: 912300 - RNA, 15 nt, Mycobacterium avium subsp. paratuberculosis
cggcaucucggccgg

SEQ ID NO: 912301 - RNA, 16 nt, Mycobacterium avium subsp. paratuberculosis
cggcaucucggccgga

SEQ ID NO: 912302 - RNA, 18 nt, Mycobacterium avium subsp. paratuberculosis
cggcauggcuggcggcaa

SEQ ID NO: 912303 - RNA, 22 nt, Mycobacterium avium subsp. paratuberculosis
cggcauggcuggcggcaacggc

SEQ ID NO: 912304 - RNA, 18 nt, Mycobacterium avium subsp. paratuberculosis
cggcaugaccggccagca

SEQ ID NO: 912305 - RNA, 21 nt, Mycobacterium avium subsp. paratuberculosis
cggcaugaccggccagcaugg

SEQ ID NO: 912306 - RNA, 18 nt, Mycobacterium avium subsp. paratuberculosis
cggcaugacgcccagcug

SEQ ID NO: 912307 - RNA, 12 nt, Mycobacterium avium subsp. paratuberculosis
cggcauggugau

SEQ ID NO: 912308 - RNA, 14 nt, Mycobacterium avium subsp. paratuberculosis
cggcaugggcggca

SEQ ID NO: 912309 - RNA, 23 nt, Mycobacterium avium subsp. paratuberculosis
cggcaugucgguggacagcgcga

SEQ ID NO: 912310 - RNA, 15 nt, Mycobacterium avium subsp. paratuberculosis
cggcaugugccacag

SEQ ID NO: 912311 - RNA, 14 nt, Mycobacterium avium subsp. paratuberculosis
cggcagggccaccg

SEQ ID NO: 912312 - RNA, 12 nt, Mycobacterium avium subsp. paratuberculosis
cggcaucgccgc

SEQ ID NO: 912313 - RNA, 14 nt, Mycobacterium avium subsp. paratuberculosis
cggcaucgccgcca

SEQ ID NO: 912314 - RNA, 14 nt, Mycobacterium avium subsp. paratuberculosis
cggcaucgcgccgc

SEQ ID NO: 912315 - RNA, 15 nt, Mycobacterium avium subsp. paratuberculosis
cggcaucgcgccgca

SEQ ID NO: 912316 - RNA, 17 nt, Mycobacterium avium subsp. paratuberculosis
cggcaucgcgccgcaug

SEQ ID NO: 912317 - RNA, 19 nt, Mycobacterium avium subsp. paratuberculosis
cggcaucgcgcgcggcgac

SEQ ID NO: 912318 - RNA, 20 nt, Mycobacterium avium subsp. paratuberculosis
cggcaucgcgcgcggcgacg

SEQ ID NO: 912319 - RNA, 21 nt, Mycobacterium avium subsp. paratuberculosis
cggcaucgcgcgcggcgacgg

SEQ ID NO: 912320 - RNA, 23 nt, Mycobacterium avium subsp. paratuberculosis
cggcaucgcgcgcggcgacggug

SEQ ID NO: 912321 - RNA, 18 nt, Mycobacterium avium subsp. paratuberculosis
cggcaucgcgcgcggcgg

SEQ ID NO: 912322 - RNA, 22 nt, Mycobacterium avium subsp. paratuberculosis
cggcaucgcgcgcggcggccac

SEQ ID NO: 912323 - RNA, 13 nt, Mycobacterium avium subsp. paratuberculosis
cggcaucgucggg

SEQ ID NO: 912324 - RNA, 16 nt, Mycobacterium avium subsp. paratuberculosis
cggcaucggcgacggc

SEQ ID NO: 912325 - RNA, 19 nt, Mycobacterium avium subsp. paratuberculosis
cggcaucgguggcaccccg

SEQ ID NO: 912326 - RNA, 18 nt, Mycobacterium avium subsp. paratuberculosis
cggcaucgucaccucgag

SEQ ID NO: 912327 - RNA, 14 nt, Mycobacterium avium subsp. paratuberculosis
cggcaucggcgccc

SEQ ID NO: 912328 - RNA, 15 nt, Mycobacterium avium subsp. paratuberculosis
cggcaucggcgcccu

SEQ ID NO: 912329 - RNA, 22 nt, Mycobacterium avium subsp. paratuberculosis
cggcaucggcgcccucgccgac

SEQ ID NO: 912330 - RNA, 14 nt, Mycobacterium avium subsp. paratuberculosis
cggcaucggcgacg

SEQ ID NO: 912331 - RNA, 16 nt, Mycobacterium avium subsp. paratuberculosis
cggcaggccgcggccg

SEQ ID NO: 912332 - RNA, 15 nt, Mycobacterium avium subsp. paratuberculosis
cggcaggcucagcag

SEQ ID NO: 912333 - RNA, 22 nt, Mycobacterium avium subsp. paratuberculosis
cggcaggcucagcagcaccgca

SEQ ID NO: 912334 - RNA, 14 nt, Mycobacterium avium subsp. paratuberculosis
cggcaggcggcccg

SEQ ID NO: 912335 - RNA, 15 nt, Mycobacterium avium subsp. paratuberculosis
cggcaggcggcccgc

SEQ ID NO: 912336 - RNA, 18 nt, Mycobacterium avium subsp. paratuberculosis
cggcagggccagcaccau

SEQ ID NO: 912337 - RNA, 19 nt, Mycobacterium avium subsp. paratuberculosis
cggcagggccagcaccaug

SEQ ID NO: 912338 - RNA, 20 nt, Mycobacterium avium subsp. paratuberculosis
cggcaucgaggaccggcgcc

SEQ ID NO: 912339 - RNA, 20 nt, Mycobacterium avium subsp. paratuberculosis
cggcaucgauggcgggcgcg

SEQ ID NO: 912340 - RNA, 23 nt, Mycobacterium avium subsp. paratuberculosis
cggcaucgauggcgggcgcgccg

SEQ ID NO: 912341 - RNA, 14 nt, Mycobacterium avium subsp. paratuberculosis
cggcaggcgcccca

SEQ ID NO: 912342 - RNA, 17 nt, Mycobacterium avium subsp. paratuberculosis
cggcaggcgccccagcu

SEQ ID NO: 912343 - RNA, 20 nt, Mycobacterium avium subsp. paratuberculosis
cggcgcgaucggccgcugcc

SEQ ID NO: 912344 - RNA, 13 nt, Mycobacterium avium subsp. paratuberculosis
cggcgcgaucguc

SEQ ID NO: 912345 - RNA, 15 nt, Mycobacterium avium subsp. paratuberculosis
cggcgcgaucgucga

SEQ ID NO: 912346 - RNA, 16 nt, Mycobacterium avium subsp. paratuberculosis
cggcgcgaucgucgac

SEQ ID NO: 912347 - RNA, 17 nt, Mycobacterium avium subsp. paratuberculosis
cggcgcgaucgucgacc

SEQ ID NO: 912348 - RNA, 17 nt, Mycobacterium avium subsp. paratuberculosis
cggcgcgaugaucgccg

SEQ ID NO: 912349 - RNA, 19 nt, Mycobacterium avium subsp. paratuberculosis
cggcgcgaugaucgccggc

SEQ ID NO: 912350 - RNA, 21 nt, Mycobacterium avium subsp. paratuberculosis
cggcgcgaugaucgccggcgc

SEQ ID NO: 912351 - RNA, 22 nt, Mycobacterium avium subsp. paratuberculosis
cggcgcgaugaucgccggcgcc

SEQ ID NO: 912352 - RNA, 23 nt, Mycobacterium avium subsp. paratuberculosis
cggcgcgaugaucgccggcgccg

SEQ ID NO: 912353 - RNA, 22 nt, Mycobacterium avium subsp. paratuberculosis
cggcgcgaugcuauucgggcca

SEQ ID NO: 912354 - RNA, 22 nt, Mycobacterium avium subsp. paratuberculosis
cggcgcgcaacgauucacccag

SEQ ID NO: 912355 - RNA, 23 nt, Mycobacterium avium subsp. paratuberculosis
cggcgcgcaacgauucacccagc

SEQ ID NO: 912356 - RNA, 15 nt, Mycobacterium avium subsp. paratuberculosis
cggcgcgcaccccgg

SEQ ID NO: 912357 - RNA, 16 nt, Mycobacterium avium subsp. paratuberculosis
cggcgcgcaccccggc

SEQ ID NO: 912358 - RNA, 15 nt, Mycobacterium avium subsp. paratuberculosis
cggcgcgcaccgcga

SEQ ID NO: 912359 - RNA, 22 nt, Mycobacterium avium subsp. paratuberculosis
cggcgcgcaccgcgggcagcag

SEQ ID NO: 912360 - RNA, 21 nt, Mycobacterium avium subsp. paratuberculosis
cggcgcgcagccagucgccgg

SEQ ID NO: 912361 - RNA, 13 nt, Mycobacterium avium subsp. paratuberculosis
cggcgcgcagccc

SEQ ID NO: 912362 - RNA, 16 nt, Mycobacterium avium subsp. paratuberculosis
cggcgcgcagcccagc

SEQ ID NO: 912363 - RNA, 22 nt, Mycobacterium avium subsp. paratuberculosis
cggcgcgcagcccagccagcga

SEQ ID NO: 912364 - RNA, 15 nt, Mycobacterium avium subsp. paratuberculosis
cggcgcgcagccggc

SEQ ID NO: 912365 - RNA, 18 nt, Mycobacterium avium subsp. paratuberculosis
cggcgcgcagccggccgu

SEQ ID NO: 912366 - RNA, 19 nt, Mycobacterium avium subsp. paratuberculosis
cggcgcgcagccggccguc

SEQ ID NO: 912367 - RNA, 15 nt, Mycobacterium avium subsp. paratuberculosis
cggcgcgcaucgucg

SEQ ID NO: 912368 - RNA, 16 nt, Mycobacterium avium subsp. paratuberculosis
cggcgcgcaucgucgc

SEQ ID NO: 912369 - RNA, 18 nt, Mycobacterium avium subsp. paratuberculosis
cggcgcgcaucgucgcgg

SEQ ID NO: 912370 - RNA, 22 nt, Mycobacterium avium subsp. paratuberculosis
cggcgcgcaucgucgcggcgcu

SEQ ID NO: 912371 - RNA, 19 nt, Mycobacterium avium subsp. paratuberculosis
cggcgcgcaucuugaucuc

SEQ ID NO: 912372 - RNA, 23 nt, Mycobacterium avium subsp. paratuberculosis
cggcgcgaggcggguaggcgucg

SEQ ID NO: 912373 - RNA, 14 nt, Mycobacterium avium subsp. paratuberculosis
cggcgcgcacggca

SEQ ID NO: 912374 - RNA, 24 nt, Mycobacterium avium subsp. paratuberculosis
cggcgcgcacgucaccgcgcuugc

SEQ ID NO: 912375 - RNA, 21 nt, Mycobacterium avium subsp. paratuberculosis
cggcgcgcagcaauugacgcc

SEQ ID NO: 912376 - RNA, 15 nt, Mycobacterium avium subsp. paratuberculosis
cggcgcgcagcgugu

SEQ ID NO: 912377 - RNA, 16 nt, Mycobacterium avium subsp. paratuberculosis
cggcgcgcagcgugug

SEQ ID NO: 912378 - RNA, 20 nt, Mycobacterium avium subsp. paratuberculosis
cggcgcgcagcgugugcacc

SEQ ID NO: 912379 - RNA, 15 nt, Mycobacterium avium subsp. paratuberculosis
cggcgcgcagcucgc

SEQ ID NO: 912380 - RNA, 17 nt, Mycobacterium avium subsp. paratuberculosis
cggcgcgcagcucgcgc

SEQ ID NO: 912381 - RNA, 22 nt, Mycobacterium avium subsp. paratuberculosis
cggcgcgcagcucgcgcagccg

SEQ ID NO: 912382 - RNA, 23 nt, Mycobacterium avium subsp. paratuberculosis
cggcgcgcagcucgcgcagccgg

SEQ ID NO: 912383 - RNA, 24 nt, Mycobacterium avium subsp. paratuberculosis
cggcgcgcagcucgcgcagccggc

SEQ ID NO: 912384 - RNA, 14 nt, Mycobacterium avium subsp. paratuberculosis
cggcgcgcaggcgc

SEQ ID NO: 912385 - RNA, 15 nt, Mycobacterium avium subsp. paratuberculosis
cggcgcgcaggcgcg

SEQ ID NO: 912386 - RNA, 16 nt, Mycobacterium avium subsp. paratuberculosis
cggcgcgcaggcgcgc

SEQ ID NO: 912387 - RNA, 19 nt, Mycobacterium avium subsp. paratuberculosis
cggcgcgcaggcgcgcggc

SEQ ID NO: 912388 - RNA, 22 nt, Mycobacterium avium subsp. paratuberculosis
cggcgcgcaggcgcgcggccag

SEQ ID NO: 912389 - RNA, 21 nt, Mycobacterium avium subsp. paratuberculosis
cggcgccuugaaccggcugga

SEQ ID NO: 912390 - RNA, 17 nt, Mycobacterium avium subsp. paratuberculosis
cggcgcgaaccgggcca

SEQ ID NO: 912391 - RNA, 18 nt, Mycobacterium avium subsp. paratuberculosis
cggcgcgaaccgggccag

SEQ ID NO: 912392 - RNA, 21 nt, Mycobacterium avium subsp. paratuberculosis
cggcgcgaaccgggccaggau

SEQ ID NO: 912393 - RNA, 22 nt, Mycobacterium avium subsp. paratuberculosis
cggcgcgaaccgggccaggaug

SEQ ID NO: 912394 - RNA, 17 nt, Mycobacterium avium subsp. paratuberculosis
cggcgcgaagucgagca

SEQ ID NO: 912395 - RNA, 20 nt, Mycobacterium avium subsp. paratuberculosis
cggcgcgaagucgagcaggu

SEQ ID NO: 912396 - RNA, 14 nt, Mycobacterium avium subsp. paratuberculosis
cggcgcgacggcgg

SEQ ID NO: 912397 - RNA, 15 nt, Mycobacterium avium subsp. paratuberculosis
cggcgcgacggcggc

SEQ ID NO: 912398 - RNA, 17 nt, Mycobacterium avium subsp. paratuberculosis
cggcgcgacggcggcga

SEQ ID NO: 912399 - RNA, 19 nt, Mycobacterium avium subsp. paratuberculosis
cggcgcgacggcggcgaag

SEQ ID NO: 912400 - RNA, 14 nt, Mycobacterium avium subsp. paratuberculosis
cggcgcgacaccgc

SEQ ID NO: 912401 - RNA, 19 nt, Mycobacterium avium subsp. paratuberculosis
cggcgcgacaccgcggcga

SEQ ID NO: 912402 - RNA, 15 nt, Mycobacterium avium subsp. paratuberculosis
cggcgcgaccagcgg

SEQ ID NO: 912403 - RNA, 22 nt, Mycobacterium avium subsp. paratuberculosis
cggcgcgaccagcggcagcagc

SEQ ID NO: 912404 - RNA, 15 nt, Mycobacterium avium subsp. paratuberculosis
cggcgcgaccagguu

SEQ ID NO: 912405 - RNA, 16 nt, Mycobacterium avium subsp. paratuberculosis
cggcgcgaagcccucg

SEQ ID NO: 912406 - RNA, 13 nt, Mycobacterium avium subsp. paratuberculosis
cggcgcgaggacg

SEQ ID NO: 912407 - RNA, 13 nt, Mycobacterium avium subsp. paratuberculosis
cggcgcgaggcgc

SEQ ID NO: 912408 - RNA, 18 nt, Mycobacterium avium subsp. paratuberculosis
cggcgcggaacagcgucg

SEQ ID NO: 912409 - RNA, 23 nt, Mycobacterium avium subsp. paratuberculosis
cggcgcggaacagcgucgccgac

SEQ ID NO: 912410 - RNA, 24 nt, Mycobacterium avium subsp. paratuberculosis
cggcgcggaacagcgucgccgacg

SEQ ID NO: 912411 - RNA, 14 nt, Mycobacterium avium subsp. paratuberculosis
cggcgcggaacgcg

SEQ ID NO: 912412 - RNA, 17 nt, Mycobacterium avium subsp. paratuberculosis
cggcgcggaacgcgccg

SEQ ID NO: 912413 - RNA, 16 nt, Mycobacterium avium subsp. paratuberculosis
cggcgcgcgagcguca

SEQ ID NO: 912414 - RNA, 20 nt, Mycobacterium avium subsp. paratuberculosis
cggcgcgcugaagcgcgacc

SEQ ID NO: 912415 - RNA, 16 nt, Mycobacterium avium subsp. paratuberculosis
cggcgcgcggccgcga

SEQ ID NO: 912416 - RNA, 15 nt, Mycobacterium avium subsp. paratuberculosis
cggcgcgcucggugc

SEQ ID NO: 912417 - RNA, 14 nt, Mycobacterium avium subsp. paratuberculosis
cggcgcgcucgucg

SEQ ID NO: 912418 - RNA, 15 nt, Mycobacterium avium subsp. paratuberculosis
cggcgcgcucgucgu

SEQ ID NO: 912419 - RNA, 18 nt, Mycobacterium avium subsp. paratuberculosis
cggcgcgcucgucgucgg

SEQ ID NO: 912420 - RNA, 21 nt, Mycobacterium avium subsp. paratuberculosis
cggcgcgcucgucgucgguga

SEQ ID NO: 912421 - RNA, 23 nt, Mycobacterium avium subsp. paratuberculosis
cggcgcgcucuaacuccgcucgg

SEQ ID NO: 912422 - RNA, 14 nt, Mycobacterium avium subsp. paratuberculosis
cggcgcgcggggug

SEQ ID NO: 912423 - RNA, 20 nt, Mycobacterium avium subsp. paratuberculosis
cggcgcgcggggugucgcgg

SEQ ID NO: 912424 - RNA, 14 nt, Mycobacterium avium subsp. paratuberculosis
cggcgcgcgguggu

SEQ ID NO: 912425 - RNA, 22 nt, Mycobacterium avium subsp. paratuberculosis
cggcgcgcggugguguugcggu

SEQ ID NO: 912426 - RNA, 19 nt, Mycobacterium avium subsp. paratuberculosis
cggcgcgcguauuccagcg

SEQ ID NO: 912427 - RNA, 21 nt, Mycobacterium avium subsp. paratuberculosis
cggcgcgcguauuccagcgcc

SEQ ID NO: 912428 - RNA, 22 nt, Mycobacterium avium subsp. paratuberculosis
cggcgcgcguauuccagcgcca

SEQ ID NO: 912429 - RNA, 18 nt, Mycobacterium avium subsp. paratuberculosis
cggcgcgcggggccggcg

SEQ ID NO: 912430 - RNA, 19 nt, Mycobacterium avium subsp. paratuberculosis
cggcgcgcggggccggcgc

SEQ ID NO: 912431 - RNA, 14 nt, Mycobacterium avium subsp. paratuberculosis
cggcgcgcgccgau

SEQ ID NO: 912432 - RNA, 16 nt, Mycobacterium avium subsp. paratuberculosis
cggcgcgcgccgauca

SEQ ID NO: 912433 - RNA, 12 nt, Mycobacterium avium subsp. paratuberculosis
cggcgcgcgccg

SEQ ID NO: 912434 - RNA, 19 nt, Mycobacterium avium subsp. paratuberculosis
cggcgcgcgcgccccagcc

SEQ ID NO: 912435 - RNA, 17 nt, Mycobacterium avium subsp. paratuberculosis
cggcgcgcgccagcguc

SEQ ID NO: 912436 - RNA, 18 nt, Mycobacterium avium subsp. paratuberculosis
cggcgcgcgccagcgucu

SEQ ID NO: 912437 - RNA, 13 nt, Mycobacterium avium subsp. paratuberculosis
cggcgcgcgaugg

SEQ ID NO: 912438 - RNA, 14 nt, Mycobacterium avium subsp. paratuberculosis
cggcgcgcgaugga

SEQ ID NO: 912439 - RNA, 16 nt, Mycobacterium avium subsp. paratuberculosis
cggcgcgccugcgcgg

SEQ ID NO: 912440 - RNA, 17 nt, Mycobacterium avium subsp. paratuberculosis
cggcgcgccugcgcggc

SEQ ID NO: 912441 - RNA, 19 nt, Mycobacterium avium subsp. paratuberculosis
cggcgcgccugcgcggcgg

SEQ ID NO: 912442 - RNA, 14 nt, Mycobacterium avium subsp. paratuberculosis
cggcgcgccguccu

SEQ ID NO: 912443 - RNA, 15 nt, Mycobacterium avium subsp. paratuberculosis
cggcgcgccggccgg

SEQ ID NO: 912444 - RNA, 13 nt, Mycobacterium avium subsp. paratuberculosis
cggcgcgccgucc

SEQ ID NO: 912445 - RNA, 14 nt, Mycobacterium avium subsp. paratuberculosis
cggcgcgccggcga

SEQ ID NO: 912446 - RNA, 14 nt, Mycobacterium avium subsp. paratuberculosis
cggcgcgccgcguu

SEQ ID NO: 912447 - RNA, 12 nt, Mycobacterium avium subsp. paratuberculosis
cggcgcgccgca

SEQ ID NO: 912448 - RNA, 13 nt, Mycobacterium avium subsp. paratuberculosis
cggcgcgccgcag

SEQ ID NO: 912449 - RNA, 14 nt, Mycobacterium avium subsp. paratuberculosis
cggcgcgccgaaga

SEQ ID NO: 912450 - RNA, 14 nt, Mycobacterium avium subsp. paratuberculosis
cggcgcgcccgacg

SEQ ID NO: 912451 - RNA, 16 nt, Mycobacterium avium subsp. paratuberculosis
cggcgcgcccggaaag

SEQ ID NO: 912452 - RNA, 16 nt, Mycobacterium avium subsp. paratuberculosis
cggcgcgccagcgugg

SEQ ID NO: 912453 - RNA, 15 nt, Mycobacterium avium subsp. paratuberculosis
cggcgcgcaucgccg

SEQ ID NO: 912454 - RNA, 17 nt, Mycobacterium avium subsp. paratuberculosis
cggcgcgcaucgccguc

SEQ ID NO: 912455 - RNA, 19 nt, Mycobacterium avium subsp. paratuberculosis
cggcgcgcaucgccgucca

SEQ ID NO: 912456 - RNA, 20 nt, Mycobacterium avium subsp. paratuberculosis
cggcgcgccacgacguaccc

SEQ ID NO: 912457 - RNA, 16 nt, Mycobacterium avium subsp. paratuberculosis
cggcgccuugccgguc

SEQ ID NO: 912458 - RNA, 17 nt, Mycobacterium avium subsp. paratuberculosis
cggcgccuugccggucu

SEQ ID NO: 912459 - RNA, 15 nt, Mycobacterium avium subsp. paratuberculosis
cggcgccuugguccg

SEQ ID NO: 912460 - RNA, 19 nt, Mycobacterium avium subsp. paratuberculosis
cggcgccuugguccgcaac

SEQ ID NO: 912461 - RNA, 22 nt, Mycobacterium avium subsp. paratuberculosis
cggcgccuugguccgcaacgcg

SEQ ID NO: 912462 - RNA, 22 nt, Mycobacterium avium subsp. paratuberculosis
cggcgccuggucaaggugcuga

SEQ ID NO: 912463 - RNA, 18 nt, Mycobacterium avium subsp. paratuberculosis
cggcgccugauccgcggu

SEQ ID NO: 912464 - RNA, 16 nt, Mycobacterium avium subsp. paratuberculosis
cggcgccugcacgcag

SEQ ID NO: 912465 - RNA, 23 nt, Mycobacterium avium subsp. paratuberculosis
cggcgccucgaugcggguguugc

SEQ ID NO: 912466 - RNA, 14 nt, Mycobacterium avium subsp. paratuberculosis
cggcgccucggcgu

SEQ ID NO: 912467 - RNA, 23 nt, Mycobacterium avium subsp. paratuberculosis
cggcgccguuucggacgagccgu

SEQ ID NO: 912468 - RNA, 15 nt, Mycobacterium avium subsp. paratuberculosis
cggcgccguugaccg

SEQ ID NO: 912469 - RNA, 19 nt, Mycobacterium avium subsp. paratuberculosis
cggcgccguugaccggccg

SEQ ID NO: 912470 - RNA, 13 nt, Mycobacterium avium subsp. paratuberculosis
cggcgccgugccg

SEQ ID NO: 912471 - RNA, 18 nt, Mycobacterium avium subsp. paratuberculosis
cggcgccgugccgcgcgg

SEQ ID NO: 912472 - RNA, 19 nt, Mycobacterium avium subsp. paratuberculosis
cggcgccgugccgcgcggc

SEQ ID NO: 912473 - RNA, 12 nt, Mycobacterium avium subsp. paratuberculosis
cggcgccgugcg

SEQ ID NO: 912474 - RNA, 14 nt, Mycobacterium avium subsp. paratuberculosis
cggcgccgucgucg

SEQ ID NO: 912475 - RNA, 23 nt, Mycobacterium avium subsp. paratuberculosis
cggcgccgucguucuccauccgg

SEQ ID NO: 912476 - RNA, 14 nt, Mycobacterium avium subsp. paratuberculosis
cggcgccgucgccg

SEQ ID NO: 912477 - RNA, 13 nt, Mycobacterium avium subsp. paratuberculosis
cggcgccgucgcg

SEQ ID NO: 912478 - RNA, 14 nt, Mycobacterium avium subsp. paratuberculosis
cggcgccgucgcgg

SEQ ID NO: 912479 - RNA, 18 nt, Mycobacterium avium subsp. paratuberculosis
cggcgccguccagcucgc

SEQ ID NO: 912480 - RNA, 17 nt, Mycobacterium avium subsp. paratuberculosis
cggcgccguccuccucg

SEQ ID NO: 912481 - RNA, 15 nt, Mycobacterium avium subsp. paratuberculosis
cggcgccgucgacca

SEQ ID NO: 912482 - RNA, 17 nt, Mycobacterium avium subsp. paratuberculosis
cggcgccgucgaccagc

SEQ ID NO: 912483 - RNA, 17 nt, Mycobacterium avium subsp. paratuberculosis
cggcgccgcgaccccgg

SEQ ID NO: 912484 - RNA, 15 nt, Mycobacterium avium subsp. paratuberculosis
cggcgccggugccca

SEQ ID NO: 912485 - RNA, 14 nt, Mycobacterium avium subsp. paratuberculosis
cggcgccgggucgc

SEQ ID NO: 912486 - RNA, 16 nt, Mycobacterium avium subsp. paratuberculosis
cggcgccgggucgcgg

SEQ ID NO: 912487 - RNA, 17 nt, Mycobacterium avium subsp. paratuberculosis
cggcgccgggucgcggu

SEQ ID NO: 912488 - RNA, 21 nt, Mycobacterium avium subsp. paratuberculosis
cggcgccgguauauucgcgau

SEQ ID NO: 912489 - RNA, 22 nt, Mycobacterium avium subsp. paratuberculosis
cggcgccgguauauucgcgaug

SEQ ID NO: 912490 - RNA, 13 nt, Mycobacterium avium subsp. paratuberculosis
cggcgccggucag

SEQ ID NO: 912491 - RNA, 20 nt, Mycobacterium avium subsp. paratuberculosis
cggcgccggucagcggcaac

SEQ ID NO: 912492 - RNA, 18 nt, Mycobacterium avium subsp. paratuberculosis
cggcgccggugccgcagc

SEQ ID NO: 912493 - RNA, 20 nt, Mycobacterium avium subsp. paratuberculosis
cggcgccgguggugucgacg

SEQ ID NO: 912494 - RNA, 21 nt, Mycobacterium avium subsp. paratuberculosis
cggcgccgguggugucgacgg

SEQ ID NO: 912495 - RNA, 13 nt, Mycobacterium avium subsp. paratuberculosis
cggcgccgggcgg

SEQ ID NO: 912496 - RNA, 14 nt, Mycobacterium avium subsp. paratuberculosis
cggcgccgggcggc

SEQ ID NO: 912497 - RNA, 21 nt, Mycobacterium avium subsp. paratuberculosis
cggcgccgggcgggcgcaggu

SEQ ID NO: 912498 - RNA, 12 nt, Mycobacterium avium subsp. paratuberculosis
cggcgccggguc

SEQ ID NO: 912499 - RNA, 18 nt, Mycobacterium avium subsp. paratuberculosis
cggcgccgggcagcccgg

SEQ ID NO: 912500 - RNA, 21 nt, Mycobacterium avium subsp. paratuberculosis
cggcgccgggcagcccggguc

SEQ ID NO: 912501 - RNA, 13 nt, Mycobacterium avium subsp. paratuberculosis
cggcgccgggcau

SEQ ID NO: 912502 - RNA, 14 nt, Mycobacterium avium subsp. paratuberculosis
cggcgccggcuccg

SEQ ID NO: 912503 - RNA, 16 nt, Mycobacterium avium subsp. paratuberculosis
cggcgccggcuccgca

SEQ ID NO: 912504 - RNA, 19 nt, Mycobacterium avium subsp. paratuberculosis
cggcgccgggaucggcagc

SEQ ID NO: 912505 - RNA, 21 nt, Mycobacterium avium subsp. paratuberculosis
cggcgccgggaucggcagcgc

SEQ ID NO: 912506 - RNA, 23 nt, Mycobacterium avium subsp. paratuberculosis
cggcgccgggaucggcagcgcgc

SEQ ID NO: 912507 - RNA, 20 nt, Mycobacterium avium subsp. paratuberculosis
cggcgccggcgggugagccg

SEQ ID NO: 912508 - RNA, 13 nt, Mycobacterium avium subsp. paratuberculosis
cggcgccggcggu

SEQ ID NO: 912509 - RNA, 14 nt, Mycobacterium avium subsp. paratuberculosis
cggcgccggcgguc

SEQ ID NO: 912510 - RNA, 15 nt, Mycobacterium avium subsp. paratuberculosis
cggcgccggcgguca

SEQ ID NO: 912511 - RNA, 13 nt, Mycobacterium avium subsp. paratuberculosis
cggcgccggccgc

SEQ ID NO: 912512 - RNA, 14 nt, Mycobacterium avium subsp. paratuberculosis
cggcgccggcgcgc

SEQ ID NO: 912513 - RNA, 20 nt, Mycobacterium avium subsp. paratuberculosis
cggcgccggcgcgcaacagc

SEQ ID NO: 912514 - RNA, 16 nt, Mycobacterium avium subsp. paratuberculosis
cggcgccggccgccgg

SEQ ID NO: 912515 - RNA, 15 nt, Mycobacterium avium subsp. paratuberculosis
cggcgccggccgggc

SEQ ID NO: 912516 - RNA, 17 nt, Mycobacterium avium subsp. paratuberculosis
cggcgccggccgggcug

SEQ ID NO: 912517 - RNA, 13 nt, Mycobacterium avium subsp. paratuberculosis
cggcgccggccgu

SEQ ID NO: 912518 - RNA, 15 nt, Mycobacterium avium subsp. paratuberculosis
cggcgccggccguca

SEQ ID NO: 912519 - RNA, 16 nt, Mycobacterium avium subsp. paratuberculosis
cggcgccggccgucac

SEQ ID NO: 912520 - RNA, 20 nt, Mycobacterium avium subsp. paratuberculosis
cggcgccggccgucacgcug

SEQ ID NO: 912521 - RNA, 12 nt, Mycobacterium avium subsp. paratuberculosis
cggcgccggccg

SEQ ID NO: 912522 - RNA, 13 nt, Mycobacterium avium subsp. paratuberculosis
cggcgccggccga

SEQ ID NO: 912523 - RNA, 14 nt, Mycobacterium avium subsp. paratuberculosis
cggcgccggccgac

SEQ ID NO: 912524 - RNA, 12 nt, Mycobacterium avium subsp. paratuberculosis
cggcgccggcca

SEQ ID NO: 912525 - RNA, 18 nt, Mycobacterium avium subsp. paratuberculosis
cggcgccggccagcggcu

SEQ ID NO: 912526 - RNA, 13 nt, Mycobacterium avium subsp. paratuberculosis
cggcgccggcccg

SEQ ID NO: 912527 - RNA, 17 nt, Mycobacterium avium subsp. paratuberculosis
cggcgccggcccgcggc

SEQ ID NO: 912528 - RNA, 20 nt, Mycobacterium avium subsp. paratuberculosis
cggcgccggcccgcggcgga

SEQ ID NO: 912529 - RNA, 13 nt, Mycobacterium avium subsp. paratuberculosis
cggcgccggcacu

SEQ ID NO: 912530 - RNA, 15 nt, Mycobacterium avium subsp. paratuberculosis
cggcgccggcacugc

SEQ ID NO: 912531 - RNA, 13 nt, Mycobacterium avium subsp. paratuberculosis
cggcgccggcauc

SEQ ID NO: 912532 - RNA, 19 nt, Mycobacterium avium subsp. paratuberculosis
cggcgccggcauccagcac

SEQ ID NO: 912533 - RNA, 21 nt, Mycobacterium avium subsp. paratuberculosis
cggcgccggcauccagcacgg

SEQ ID NO: 912534 - RNA, 14 nt, Mycobacterium avium subsp. paratuberculosis
cggcgccggaugcc

SEQ ID NO: 912535 - RNA, 20 nt, Mycobacterium avium subsp. paratuberculosis
cggcgccggaugccagcagg

SEQ ID NO: 912536 - RNA, 13 nt, Mycobacterium avium subsp. paratuberculosis
cggcgccggaggg

SEQ ID NO: 912537 - RNA, 17 nt, Mycobacterium avium subsp. paratuberculosis
cggcgccggaggggcga

SEQ ID NO: 912538 - RNA, 13 nt, Mycobacterium avium subsp. paratuberculosis
cggcgccggacac

SEQ ID NO: 912539 - RNA, 17 nt, Mycobacterium avium subsp. paratuberculosis
cggcgccggaggccagc

SEQ ID NO: 912540 - RNA, 15 nt, Mycobacterium avium subsp. paratuberculosis
cggcgccgcgcgcca

SEQ ID NO: 912541 - RNA, 16 nt, Mycobacterium avium subsp. paratuberculosis
cggcgccgcgcgccag

SEQ ID NO: 912542 - RNA, 19 nt, Mycobacterium avium subsp. paratuberculosis
cggcgccgcgcgccagcgc

SEQ ID NO: 912543 - RNA, 13 nt, Mycobacterium avium subsp. paratuberculosis
cggcgccgcggua

SEQ ID NO: 912544 - RNA, 18 nt, Mycobacterium avium subsp. paratuberculosis
cggcgccgcgguagcgga

SEQ ID NO: 912545 - RNA, 13 nt, Mycobacterium avium subsp. paratuberculosis
cggcgccgcguac

SEQ ID NO: 912546 - RNA, 14 nt, Mycobacterium avium subsp. paratuberculosis
cggcgccgcgucgg

SEQ ID NO: 912547 - RNA, 15 nt, Mycobacterium avium subsp. paratuberculosis
cggcgccgcgccggc

SEQ ID NO: 912548 - RNA, 17 nt, Mycobacterium avium subsp. paratuberculosis
cggcgccgcgccggcac

SEQ ID NO: 912549 - RNA, 14 nt, Mycobacterium avium subsp. paratuberculosis
cggcgccgcggccc

SEQ ID NO: 912550 - RNA, 20 nt, Mycobacterium avium subsp. paratuberculosis
cggcgccgcggcccugcagc

SEQ ID NO: 912551 - RNA, 14 nt, Mycobacterium avium subsp. paratuberculosis
cggcgccgcggcgg

SEQ ID NO: 912552 - RNA, 17 nt, Mycobacterium avium subsp. paratuberculosis
cggcgccgcggcggcac

SEQ ID NO: 912553 - RNA, 18 nt, Mycobacterium avium subsp. paratuberculosis
cggcgccgcggcggcacc

SEQ ID NO: 912554 - RNA, 20 nt, Mycobacterium avium subsp. paratuberculosis
cggcgccgcggcggcaccca

SEQ ID NO: 912555 - RNA, 21 nt, Mycobacterium avium subsp. paratuberculosis
cggcgccgcggcggcacccag

SEQ ID NO: 912556 - RNA, 13 nt, Mycobacterium avium subsp. paratuberculosis
cggcgccgcgggc

SEQ ID NO: 912557 - RNA, 17 nt, Mycobacterium avium subsp. paratuberculosis
cggcgccgcgggcgccg

SEQ ID NO: 912558 - RNA, 18 nt, Mycobacterium avium subsp. paratuberculosis
cggcgccgcgggugcggc

SEQ ID NO: 912559 - RNA, 17 nt, Mycobacterium avium subsp. paratuberculosis
cggcgccgccguucgcc

SEQ ID NO: 912560 - RNA, 20 nt, Mycobacterium avium subsp. paratuberculosis
cggcgccgccguucgccggc

SEQ ID NO: 912561 - RNA, 16 nt, Mycobacterium avium subsp. paratuberculosis
cggcgccgccggggcg

SEQ ID NO: 912562 - RNA, 12 nt, Mycobacterium avium subsp. paratuberculosis
cggcgccgccgu

SEQ ID NO: 912563 - RNA, 15 nt, Mycobacterium avium subsp. paratuberculosis
cggcgccgccggucg

SEQ ID NO: 912564 - RNA, 18 nt, Mycobacterium avium subsp. paratuberculosis
cggcgccgccggucgccc

SEQ ID NO: 912565 - RNA, 19 nt, Mycobacterium avium subsp. paratuberculosis
cggcgccgccggucgcccc

SEQ ID NO: 912566 - RNA, 15 nt, Mycobacterium avium subsp. paratuberculosis
cggcgccgccacggc

SEQ ID NO: 912567 - RNA, 20 nt, Mycobacterium avium subsp. paratuberculosis
cggcgccgccacggcacguc

SEQ ID NO: 912568 - RNA, 14 nt, Mycobacterium avium subsp. paratuberculosis
cggcgccgcccggc

SEQ ID NO: 912569 - RNA, 16 nt, Mycobacterium avium subsp. paratuberculosis
cggcgccgcccggcga

SEQ ID NO: 912570 - RNA, 17 nt, Mycobacterium avium subsp. paratuberculosis
cggcgccgcccggcgau

SEQ ID NO: 912571 - RNA, 15 nt, Mycobacterium avium subsp. paratuberculosis
cggcgccgcccgggc

SEQ ID NO: 912572 - RNA, 11 nt, Mycobacterium avium subsp. paratuberculosis
cggcgccgccg

SEQ ID NO: 912573 - RNA, 13 nt, Mycobacterium avium subsp. paratuberculosis
cggcgccgccgag

SEQ ID NO: 912574 - RNA, 20 nt, Mycobacterium avium subsp. paratuberculosis
cggcgcaccaaccggccccg

SEQ ID NO: 912575 - RNA, 21 nt, Mycobacterium avium subsp. paratuberculosis
cggcgcaccaaccggccccga

SEQ ID NO: 912576 - RNA, 22 nt, Mycobacterium avium subsp. paratuberculosis
cggcgcaccaaccggccccgag

SEQ ID NO: 912577 - RNA, 17 nt, Mycobacterium avium subsp. paratuberculosis
cggcgcaccaggcgcca

SEQ ID NO: 912578 - RNA, 20 nt, Mycobacterium avium subsp. paratuberculosis
cggcgcaccaggcgccacag

SEQ ID NO: 912579 - RNA, 21 nt, Mycobacterium avium subsp. paratuberculosis
cggcgcaccagggugucgucg

SEQ ID NO: 912580 - RNA, 15 nt, Mycobacterium avium subsp. paratuberculosis
cggcgcacaucgugg

SEQ ID NO: 912581 - RNA, 22 nt, Mycobacterium avium subsp. paratuberculosis
cggcgcacagcuaggucguggc

SEQ ID NO: 912582 - RNA, 23 nt, Mycobacterium avium subsp. paratuberculosis
cggcgcacaggaacgcgucgacc

SEQ ID NO: 912583 - RNA, 21 nt, Mycobacterium avium subsp. paratuberculosis
cggcgcaaucggggccgaccc

SEQ ID NO: 912584 - RNA, 15 nt, Mycobacterium avium subsp. paratuberculosis
cggcgcaacgggaug

SEQ ID NO: 912585 - RNA, 20 nt, Mycobacterium avium subsp. paratuberculosis
cggcgcagcgcacgucgccg

SEQ ID NO: 912586 - RNA, 13 nt, Mycobacterium avium subsp. paratuberculosis
cggcgcagccggc

SEQ ID NO: 912587 - RNA, 17 nt, Mycobacterium avium subsp. paratuberculosis
cggcgcagccggccacc

SEQ ID NO: 912588 - RNA, 21 nt, Mycobacterium avium subsp. paratuberculosis
cggcgcagccggccaccgccc

SEQ ID NO: 912589 - RNA, 16 nt, Mycobacterium avium subsp. paratuberculosis
cggcgcagccagcgcc

SEQ ID NO: 912590 - RNA, 14 nt, Mycobacterium avium subsp. paratuberculosis
cggcgcagccagcu

SEQ ID NO: 912591 - RNA, 15 nt, Mycobacterium avium subsp. paratuberculosis
cggcgcagccagcuc

SEQ ID NO: 912592 - RNA, 17 nt, Mycobacterium avium subsp. paratuberculosis
cggcgcagccagcucgg

SEQ ID NO: 912593 - RNA, 19 nt, Mycobacterium avium subsp. paratuberculosis
cggcgcaaccaacucgcga

SEQ ID NO: 912594 - RNA, 15 nt, Mycobacterium avium subsp. paratuberculosis
cggcgauuucggccg

SEQ ID NO: 912595 - RNA, 18 nt, Mycobacterium avium subsp. paratuberculosis
cggcgauuucggccguga

SEQ ID NO: 912596 - RNA, 19 nt, Mycobacterium avium subsp. paratuberculosis
cggcgauuucggccgugau

SEQ ID NO: 912597 - RNA, 23 nt, Mycobacterium avium subsp. paratuberculosis
cggcgauggaguagcugaccgau

SEQ ID NO: 912598 - RNA, 12 nt, Mycobacterium avium subsp. paratuberculosis
cggcgauggccu

SEQ ID NO: 912599 - RNA, 14 nt, Mycobacterium avium subsp. paratuberculosis
cggcgauggcgcgg

SEQ ID NO: 912600 - RNA, 17 nt, Mycobacterium avium subsp. paratuberculosis
cggcgauggcgcggccg

SEQ ID NO: 912601 - RNA, 19 nt, Mycobacterium avium subsp. paratuberculosis
cggcgauggcgcggccggc

SEQ ID NO: 912602 - RNA, 15 nt, Mycobacterium avium subsp. paratuberculosis
cggcgauggcggcgu

SEQ ID NO: 912603 - RNA, 16 nt, Mycobacterium avium subsp. paratuberculosis
cggcgauggcggcgug

SEQ ID NO: 912604 - RNA, 19 nt, Mycobacterium avium subsp. paratuberculosis
cggcgauggcccgcugcgc

SEQ ID NO: 912605 - RNA, 18 nt, Mycobacterium avium subsp. paratuberculosis
cggcgauggccgacaaca

SEQ ID NO: 912606 - RNA, 13 nt, Mycobacterium avium subsp. paratuberculosis
cggcgaugcggug

SEQ ID NO: 912607 - RNA, 21 nt, Mycobacterium avium subsp. paratuberculosis
cggcgaugcguugcgccagca

SEQ ID NO: 912608 - RNA, 17 nt, Mycobacterium avium subsp. paratuberculosis
cggcgaugcgcuccagc

SEQ ID NO: 912609 - RNA, 23 nt, Mycobacterium avium subsp. paratuberculosis
cggcgaugcgcuccagcaggcug

SEQ ID NO: 912610 - RNA, 21 nt, Mycobacterium avium subsp. paratuberculosis
cggcgaugaagccccggaccg

SEQ ID NO: 912611 - RNA, 17 nt, Mycobacterium avium subsp. paratuberculosis
cggcgaugaccgccugc

SEQ ID NO: 912612 - RNA, 20 nt, Mycobacterium avium subsp. paratuberculosis
cggcgaugaccgccugcggc

SEQ ID NO: 912613 - RNA, 14 nt, Mycobacterium avium subsp. paratuberculosis
cggcgaugaucagg

SEQ ID NO: 912614 - RNA, 17 nt, Mycobacterium avium subsp. paratuberculosis
cggcgaugaucaggccg

SEQ ID NO: 912615 - RNA, 15 nt, Mycobacterium avium subsp. paratuberculosis
cggcgaugcgcgccu

SEQ ID NO: 912616 - RNA, 16 nt, Mycobacterium avium subsp. paratuberculosis
cggcgaugcgcggccc

SEQ ID NO: 912617 - RNA, 18 nt, Mycobacterium avium subsp. paratuberculosis
cggcgaugcgcggcccgu

SEQ ID NO: 912618 - RNA, 21 nt, Mycobacterium avium subsp. paratuberculosis
cggcgaucuugucccgcaugg

SEQ ID NO: 912619 - RNA, 18 nt, Mycobacterium avium subsp. paratuberculosis
cggcgaucuuugcggccg

SEQ ID NO: 912620 - RNA, 20 nt, Mycobacterium avium subsp. paratuberculosis
cggcgaucuuugcggccgug

SEQ ID NO: 912621 - RNA, 15 nt, Mycobacterium avium subsp. paratuberculosis
cggcgaucuggcggu

SEQ ID NO: 912622 - RNA, 23 nt, Mycobacterium avium subsp. paratuberculosis
cggcgaucugcuccucggucagc

SEQ ID NO: 912623 - RNA, 15 nt, Mycobacterium avium subsp. paratuberculosis
cggcgaucucgucgc

SEQ ID NO: 912624 - RNA, 18 nt, Mycobacterium avium subsp. paratuberculosis
cggcgaucucgucgcgca

SEQ ID NO: 912625 - RNA, 21 nt, Mycobacterium avium subsp. paratuberculosis
cggcgaucucgucgcgguuga

SEQ ID NO: 912626 - RNA, 13 nt, Mycobacterium avium subsp. paratuberculosis
cggcgauccacgc

SEQ ID NO: 912627 - RNA, 14 nt, Mycobacterium avium subsp. paratuberculosis
cggcgauccacgcc

SEQ ID NO: 912628 - RNA, 15 nt, Mycobacterium avium subsp. paratuberculosis
cggcgauccacgccu

SEQ ID NO: 912629 - RNA, 17 nt, Mycobacterium avium subsp. paratuberculosis
cggcgauccacgccucc

SEQ ID NO: 912630 - RNA, 22 nt, Mycobacterium avium subsp. paratuberculosis
cggcgauccacgccuccggcag

SEQ ID NO: 912631 - RNA, 15 nt, Mycobacterium avium subsp. paratuberculosis
cggcgaucagcugcc

SEQ ID NO: 912632 - RNA, 19 nt, Mycobacterium avium subsp. paratuberculosis
cggcgaucagcugcccgga

SEQ ID NO: 912633 - RNA, 24 nt, Mycobacterium avium subsp. paratuberculosis
cggcgaucagcugcccggaguccg

SEQ ID NO: 912634 - RNA, 16 nt, Mycobacterium avium subsp. paratuberculosis
cggcgaucagcugcuc

SEQ ID NO: 912635 - RNA, 18 nt, Mycobacterium avium subsp. paratuberculosis
cggcgaucagcugcucgu

SEQ ID NO: 912636 - RNA, 14 nt, Mycobacterium avium subsp. paratuberculosis
cggcgaucagcugg

SEQ ID NO: 912637 - RNA, 17 nt, Mycobacterium avium subsp. paratuberculosis
cggcgaucagcuggauc

SEQ ID NO: 912638 - RNA, 23 nt, Mycobacterium avium subsp. paratuberculosis
cggcgaucagcuggaucaucucg

SEQ ID NO: 912639 - RNA, 16 nt, Mycobacterium avium subsp. paratuberculosis
cggcgauccgcgcggc

SEQ ID NO: 912640 - RNA, 14 nt, Mycobacterium avium subsp. paratuberculosis
cggcgauccggccg

SEQ ID NO: 912641 - RNA, 16 nt, Mycobacterium avium subsp. paratuberculosis
cggcgauccggccggc

SEQ ID NO: 912642 - RNA, 17 nt, Mycobacterium avium subsp. paratuberculosis
cggcgauccggccggcg

SEQ ID NO: 912643 - RNA, 19 nt, Mycobacterium avium subsp. paratuberculosis
cggcgauccggccggcggc

SEQ ID NO: 912644 - RNA, 16 nt, Mycobacterium avium subsp. paratuberculosis
cggcgauccgggcacg

SEQ ID NO: 912645 - RNA, 23 nt, Mycobacterium avium subsp. paratuberculosis
cggcgauccgggcacgcagcggc

SEQ ID NO: 912646 - RNA, 13 nt, Mycobacterium avium subsp. paratuberculosis
cggcgaucagcuc

SEQ ID NO: 912647 - RNA, 14 nt, Mycobacterium avium subsp. paratuberculosis
cggcgaucagcucc

SEQ ID NO: 912648 - RNA, 22 nt, Mycobacterium avium subsp. paratuberculosis
cggcgaucagcuccuccugcgg

SEQ ID NO: 912649 - RNA, 12 nt, Mycobacterium avium subsp. paratuberculosis
cggcgaucucgg

SEQ ID NO: 912650 - RNA, 15 nt, Mycobacterium avium subsp. paratuberculosis
cggcgaucucggcgg

SEQ ID NO: 912651 - RNA, 17 nt, Mycobacterium avium subsp. paratuberculosis
cggcgaucucggcggcc

SEQ ID NO: 912652 - RNA, 18 nt, Mycobacterium avium subsp. paratuberculosis
cggcgaucucggcggccg

SEQ ID NO: 912653 - RNA, 21 nt, Mycobacterium avium subsp. paratuberculosis
cggcgaucucggcggccgcgu

SEQ ID NO: 912654 - RNA, 19 nt, Mycobacterium avium subsp. paratuberculosis
cggcgaucucggucaccga

SEQ ID NO: 912655 - RNA, 24 nt, Mycobacterium avium subsp. paratuberculosis
cggcgaucucggucaccgagcggc

SEQ ID NO: 912656 - RNA, 16 nt, Mycobacterium avium subsp. paratuberculosis
cggcgaucagcagcac

SEQ ID NO: 912657 - RNA, 17 nt, Mycobacterium avium subsp. paratuberculosis
cggcgaucagcagcacc

SEQ ID NO: 912658 - RNA, 19 nt, Mycobacterium avium subsp. paratuberculosis
cggcgaucagcagcacccg

SEQ ID NO: 912659 - RNA, 23 nt, Mycobacterium avium subsp. paratuberculosis
cggcgaucagcagcacccgggcc

SEQ ID NO: 912660 - RNA, 21 nt, Mycobacterium avium subsp. paratuberculosis
cggcgaucaccgggacaccgc

SEQ ID NO: 912661 - RNA, 13 nt, Mycobacterium avium subsp. paratuberculosis
cggcgaucagccc

SEQ ID NO: 912662 - RNA, 19 nt, Mycobacterium avium subsp. paratuberculosis
cggcgaucagcccggcccg

SEQ ID NO: 912663 - RNA, 20 nt, Mycobacterium avium subsp. paratuberculosis
cggcgacguccuugaucagc

SEQ ID NO: 912664 - RNA, 19 nt, Mycobacterium avium subsp. paratuberculosis
cggcgacgucgacggcagc

SEQ ID NO: 912665 - RNA, 23 nt, Mycobacterium avium subsp. paratuberculosis
cggcgacgucgacggcagcgcua

SEQ ID NO: 912666 - RNA, 17 nt, Mycobacterium avium subsp. paratuberculosis
cggcgacgucgccggcc

SEQ ID NO: 912667 - RNA, 23 nt, Mycobacterium avium subsp. paratuberculosis
cggcgacgucgccggccugcccg

SEQ ID NO: 912668 - RNA, 15 nt, Mycobacterium avium subsp. paratuberculosis
cggcgacgucgucga

SEQ ID NO: 912669 - RNA, 19 nt, Mycobacterium avium subsp. paratuberculosis
cggcgacgucgucgaugcc

SEQ ID NO: 912670 - RNA, 17 nt, Mycobacterium avium subsp. paratuberculosis
cggcgacgucgugcacg

SEQ ID NO: 912671 - RNA, 20 nt, Mycobacterium avium subsp. paratuberculosis
cggcgacgucgugcacgccg

SEQ ID NO: 912672 - RNA, 14 nt, Mycobacterium avium subsp. paratuberculosis
cggcgacgucgugg

SEQ ID NO: 912673 - RNA, 22 nt, Mycobacterium avium subsp. paratuberculosis
cggcgacgucguggcccggaug

SEQ ID NO: 912674 - RNA, 22 nt, Mycobacterium avium subsp. paratuberculosis
cggcgacgugccggcggcaggu

SEQ ID NO: 912675 - RNA, 14 nt, Mycobacterium avium subsp. paratuberculosis
cggcgacggcgucg

SEQ ID NO: 912676 - RNA, 14 nt, Mycobacterium avium subsp. paratuberculosis
cggcgacgguggcg

SEQ ID NO: 912677 - RNA, 17 nt, Mycobacterium avium subsp. paratuberculosis
cggcgacgguggcgccc

SEQ ID NO: 912678 - RNA, 19 nt, Mycobacterium avium subsp. paratuberculosis
cggcgacgguggcgcccag

SEQ ID NO: 912679 - RNA, 20 nt, Mycobacterium avium subsp. paratuberculosis
cggcgacgguggcgcccagc

SEQ ID NO: 912680 - RNA, 16 nt, Mycobacterium avium subsp. paratuberculosis
cggcgacgguggcggg

SEQ ID NO: 912681 - RNA, 19 nt, Mycobacterium avium subsp. paratuberculosis
cggcgacgguggcgggccg

SEQ ID NO: 912682 - RNA, 22 nt, Mycobacterium avium subsp. paratuberculosis
cggcgacgguggcgggccgccg

SEQ ID NO: 912683 - RNA, 17 nt, Mycobacterium avium subsp. paratuberculosis
cggcgacgguguccgcg

SEQ ID NO: 912684 - RNA, 20 nt, Mycobacterium avium subsp. paratuberculosis
cggcgacgguguccgcggcg

SEQ ID NO: 912685 - RNA, 22 nt, Mycobacterium avium subsp. paratuberculosis
cggcgacgguguccgcggcguc

SEQ ID NO: 912686 - RNA, 18 nt, Mycobacterium avium subsp. paratuberculosis
cggcgacguacagcgagc

SEQ ID NO: 912687 - RNA, 15 nt, Mycobacterium avium subsp. paratuberculosis
cggcgacggcgucgg

SEQ ID NO: 912688 - RNA, 17 nt, Mycobacterium avium subsp. paratuberculosis
cggcgacggcgucggcg

SEQ ID NO: 912689 - RNA, 19 nt, Mycobacterium avium subsp. paratuberculosis
cggcgacggcgucggcggc

SEQ ID NO: 912690 - RNA, 22 nt, Mycobacterium avium subsp. paratuberculosis
cggcgacggcguugcuggcgcg

SEQ ID NO: 912691 - RNA, 15 nt, Mycobacterium avium subsp. paratuberculosis
cggcgacggcggccg

SEQ ID NO: 912692 - RNA, 15 nt, Mycobacterium avium subsp. paratuberculosis
cggcgacggcggggu

SEQ ID NO: 912693 - RNA, 17 nt, Mycobacterium avium subsp. paratuberculosis
cggcgacggcggggugc

SEQ ID NO: 912694 - RNA, 18 nt, Mycobacterium avium subsp. paratuberculosis
cggcgacggcggggugcg

SEQ ID NO: 912695 - RNA, 14 nt, Mycobacterium avium subsp. paratuberculosis
cggcgacggcggug

SEQ ID NO: 912696 - RNA, 17 nt, Mycobacterium avium subsp. paratuberculosis
cggcgacggcggugggc

SEQ ID NO: 912697 - RNA, 15 nt, Mycobacterium avium subsp. paratuberculosis
cggcgacggcgucca

SEQ ID NO: 912698 - RNA, 19 nt, Mycobacterium avium subsp. paratuberculosis
cggcgacggcgcucaccgg

SEQ ID NO: 912699 - RNA, 22 nt, Mycobacterium avium subsp. paratuberculosis
cggcgacggcgcucaccggcgu

SEQ ID NO: 912700 - RNA, 15 nt, Mycobacterium avium subsp. paratuberculosis
cggcgacggcgccug

SEQ ID NO: 912701 - RNA, 21 nt, Mycobacterium avium subsp. paratuberculosis
cggcgacgcucaggcguccag

SEQ ID NO: 912702 - RNA, 19 nt, Mycobacterium avium subsp. paratuberculosis
cggcgccgcagcggcgccg

SEQ ID NO: 912703 - RNA, 10 nt, Mycobacterium avium subsp. paratuberculosis
cggcgccgcc

SEQ ID NO: 912704 - RNA, 18 nt, Mycobacterium avium subsp. paratuberculosis
cggcgccgccaccacgau

SEQ ID NO: 912705 - RNA, 12 nt, Mycobacterium avium subsp. paratuberculosis
cggcgccgaucu

SEQ ID NO: 912706 - RNA, 22 nt, Mycobacterium avium subsp. paratuberculosis
cggcgccgaucugcucggcugc

SEQ ID NO: 912707 - RNA, 14 nt, Mycobacterium avium subsp. paratuberculosis
cggcgccgaugcag

SEQ ID NO: 912708 - RNA, 19 nt, Mycobacterium avium subsp. paratuberculosis
cggcgccgaugcagcacau

SEQ ID NO: 912709 - RNA, 19 nt, Mycobacterium avium subsp. paratuberculosis
cggcgccgaagcccgcagc

SEQ ID NO: 912710 - RNA, 19 nt, Mycobacterium avium subsp. paratuberculosis
cggcgccgaagccgucgac

SEQ ID NO: 912711 - RNA, 20 nt, Mycobacterium avium subsp. paratuberculosis
cggcgccgaagccgucgacc

SEQ ID NO: 912712 - RNA, 14 nt, Mycobacterium avium subsp. paratuberculosis
cggcgccgagcacg

SEQ ID NO: 912713 - RNA, 23 nt, Mycobacterium avium subsp. paratuberculosis
cggcgccgagcacgaacgcggcc

SEQ ID NO: 912714 - RNA, 16 nt, Mycobacterium avium subsp. paratuberculosis
cggcgccgacggccag

SEQ ID NO: 912715 - RNA, 21 nt, Mycobacterium avium subsp. paratuberculosis
cggcgccgacggccagcagga

SEQ ID NO: 912716 - RNA, 14 nt, Mycobacterium avium subsp. paratuberculosis
cggcgccgacgggc

SEQ ID NO: 912717 - RNA, 20 nt, Mycobacterium avium subsp. paratuberculosis
cggcgccgacgggcccgcgc

SEQ ID NO: 912718 - RNA, 14 nt, Mycobacterium avium subsp. paratuberculosis
cggcgccgacgucc

SEQ ID NO: 912719 - RNA, 21 nt, Mycobacterium avium subsp. paratuberculosis
cggcgccgacguccugguuga

SEQ ID NO: 912720 - RNA, 14 nt, Mycobacterium avium subsp. paratuberculosis
cggcgccgaccgag

SEQ ID NO: 912721 - RNA, 19 nt, Mycobacterium avium subsp. paratuberculosis
cggcgccgaccucggccag

SEQ ID NO: 912722 - RNA, 20 nt, Mycobacterium avium subsp. paratuberculosis
cggcgccgaccucggccagc

SEQ ID NO: 912723 - RNA, 21 nt, Mycobacterium avium subsp. paratuberculosis
cggcgccgacgacgucgcgca

SEQ ID NO: 912724 - RNA, 14 nt, Mycobacterium avium subsp. paratuberculosis
cggcgccgacgaug

SEQ ID NO: 912725 - RNA, 13 nt, Mycobacterium avium subsp. paratuberculosis
cggcgccgagcgu

SEQ ID NO: 912726 - RNA, 17 nt, Mycobacterium avium subsp. paratuberculosis
cggcgccgagcgucacg

SEQ ID NO: 912727 - RNA, 20 nt, Mycobacterium avium subsp. paratuberculosis
cggcgccgagcgucacgcug

SEQ ID NO: 912728 - RNA, 21 nt, Mycobacterium avium subsp. paratuberculosis
cggcgccgagcgucacgcugg

SEQ ID NO: 912729 - RNA, 15 nt, Mycobacterium avium subsp. paratuberculosis
cggcgccgagcguga

SEQ ID NO: 912730 - RNA, 12 nt, Mycobacterium avium subsp. paratuberculosis
cggcgccgaccc

SEQ ID NO: 912731 - RNA, 21 nt, Mycobacterium avium subsp. paratuberculosis
cggcgccgacccccgccgcgu

SEQ ID NO: 912732 - RNA, 13 nt, Mycobacterium avium subsp. paratuberculosis
cggcgccgaaccg

SEQ ID NO: 912733 - RNA, 18 nt, Mycobacterium avium subsp. paratuberculosis
cggcgccgaaccggguga

SEQ ID NO: 912734 - RNA, 15 nt, Mycobacterium avium subsp. paratuberculosis
cggcgccgaacucgg

SEQ ID NO: 912735 - RNA, 18 nt, Mycobacterium avium subsp. paratuberculosis
cggcgccgaacucggcgc

SEQ ID NO: 912736 - RNA, 15 nt, Mycobacterium avium subsp. paratuberculosis
cggcgcccugcaccc

SEQ ID NO: 912737 - RNA, 18 nt, Mycobacterium avium subsp. paratuberculosis
cggcgcccugcacccagc

SEQ ID NO: 912738 - RNA, 19 nt, Mycobacterium avium subsp. paratuberculosis
cggcgcccuucccggucgg

SEQ ID NO: 912739 - RNA, 20 nt, Mycobacterium avium subsp. paratuberculosis
cggcgcccuucccggucggc

SEQ ID NO: 912740 - RNA, 13 nt, Mycobacterium avium subsp. paratuberculosis
cggcgcccuucgg

SEQ ID NO: 912741 - RNA, 17 nt, Mycobacterium avium subsp. paratuberculosis
cggcgcccuucggcgcc

SEQ ID NO: 912742 - RNA, 20 nt, Mycobacterium avium subsp. paratuberculosis
cggcgcccuucggcgcccgc

SEQ ID NO: 912743 - RNA, 21 nt, Mycobacterium avium subsp. paratuberculosis
cggcgccgaaaaacgcgacgg

SEQ ID NO: 912744 - RNA, 23 nt, Mycobacterium avium subsp. paratuberculosis
cggcgccgaaaaacgcgacggcc

SEQ ID NO: 912745 - RNA, 14 nt, Mycobacterium avium subsp. paratuberculosis
cggcgcccgucacg

SEQ ID NO: 912746 - RNA, 16 nt, Mycobacterium avium subsp. paratuberculosis
cggcgcccgucacgcu

SEQ ID NO: 912747 - RNA, 17 nt, Mycobacterium avium subsp. paratuberculosis
cggcgcccgucacgcug

SEQ ID NO: 912748 - RNA, 18 nt, Mycobacterium avium subsp. paratuberculosis
cggcgcccgucacgcugg

SEQ ID NO: 912749 - RNA, 20 nt, Mycobacterium avium subsp. paratuberculosis
cggcgcccucgaugcgcacc

SEQ ID NO: 912750 - RNA, 16 nt, Mycobacterium avium subsp. paratuberculosis
cggcgcccucgccgac

SEQ ID NO: 912751 - RNA, 18 nt, Mycobacterium avium subsp. paratuberculosis
cggcgcccucgccgaccu

SEQ ID NO: 912752 - RNA, 15 nt, Mycobacterium avium subsp. paratuberculosis
cggcgcccucgccgg

SEQ ID NO: 912753 - RNA, 16 nt, Mycobacterium avium subsp. paratuberculosis
cggcgcccucgccggc

SEQ ID NO: 912754 - RNA, 19 nt, Mycobacterium avium subsp. paratuberculosis
cggcgcccucgccggcggc

SEQ ID NO: 912755 - RNA, 12 nt, Mycobacterium avium subsp. paratuberculosis
cggcgcccucgg

SEQ ID NO: 912756 - RNA, 13 nt, Mycobacterium avium subsp. paratuberculosis
cggcgcccucggc

SEQ ID NO: 912757 - RNA, 16 nt, Mycobacterium avium subsp. paratuberculosis
cggcgcccucggcgau

SEQ ID NO: 912758 - RNA, 18 nt, Mycobacterium avium subsp. paratuberculosis
cggcgcccucggcgaucu

SEQ ID NO: 912759 - RNA, 19 nt, Mycobacterium avium subsp. paratuberculosis
cggcgcccucggcgaucuc

SEQ ID NO: 912760 - RNA, 15 nt, Mycobacterium avium subsp. paratuberculosis
cggcgcccggcgcgc

SEQ ID NO: 912761 - RNA, 19 nt, Mycobacterium avium subsp. paratuberculosis
cggcgcccggcgcgccacg

SEQ ID NO: 912762 - RNA, 18 nt, Mycobacterium avium subsp. paratuberculosis
cggcgcccggcgcccggc

SEQ ID NO: 912763 - RNA, 19 nt, Mycobacterium avium subsp. paratuberculosis
cggcgcccggcccagccgc

SEQ ID NO: 912764 - RNA, 13 nt, Mycobacterium avium subsp. paratuberculosis
cggcgcccggccg

SEQ ID NO: 912765 - RNA, 15 nt, Mycobacterium avium subsp. paratuberculosis
cggcgcccggccggc

SEQ ID NO: 912766 - RNA, 21 nt, Mycobacterium avium subsp. paratuberculosis
cggcgcccggccggccccuac

SEQ ID NO: 912767 - RNA, 13 nt, Mycobacterium avium subsp. paratuberculosis
cggcgcccggcac

SEQ ID NO: 912768 - RNA, 16 nt, Mycobacterium avium subsp. paratuberculosis
cggcgcccggcaccgg

SEQ ID NO: 912769 - RNA, 18 nt, Mycobacterium avium subsp. paratuberculosis
cggcgcccggcaccggga

SEQ ID NO: 912770 - RNA, 16 nt, Mycobacterium avium subsp. paratuberculosis
cggcgcccgcggccuc

SEQ ID NO: 912771 - RNA, 15 nt, Mycobacterium avium subsp. paratuberculosis
cggcgcccgcuccgg

SEQ ID NO: 912772 - RNA, 18 nt, Mycobacterium avium subsp. paratuberculosis
cggcgcccgcuccggcgg

SEQ ID NO: 912773 - RNA, 19 nt, Mycobacterium avium subsp. paratuberculosis
cggcgcccgcuccggcgga

SEQ ID NO: 912774 - RNA, 21 nt, Mycobacterium avium subsp. paratuberculosis
cggcgcccgacauccaggacc

SEQ ID NO: 912775 - RNA, 13 nt, Mycobacterium avium subsp. paratuberculosis
cggcgcccgaucg

SEQ ID NO: 912776 - RNA, 14 nt, Mycobacterium avium subsp. paratuberculosis
cggcgcccgaucgg

SEQ ID NO: 912777 - RNA, 15 nt, Mycobacterium avium subsp. paratuberculosis
cggcgcccgaucggc

SEQ ID NO: 912778 - RNA, 14 nt, Mycobacterium avium subsp. paratuberculosis
cggcgccccggcgc

SEQ ID NO: 912779 - RNA, 16 nt, Mycobacterium avium subsp. paratuberculosis
cggcgccccggcgcug

SEQ ID NO: 912780 - RNA, 16 nt, Mycobacterium avium subsp. paratuberculosis
cggcgccccgggcagc

SEQ ID NO: 912781 - RNA, 12 nt, Mycobacterium avium subsp. paratuberculosis
cggcgccccgcc

SEQ ID NO: 912782 - RNA, 22 nt, Mycobacterium avium subsp. paratuberculosis
cggcgccccgcccgcgacuguc

SEQ ID NO: 912783 - RNA, 14 nt, Mycobacterium avium subsp. paratuberculosis
cggcgcccccgcga

SEQ ID NO: 912784 - RNA, 19 nt, Mycobacterium avium subsp. paratuberculosis
cggcgcccccgcgacgucc

SEQ ID NO: 912785 - RNA, 14 nt, Mycobacterium avium subsp. paratuberculosis
cggcgccccacgcc

SEQ ID NO: 912786 - RNA, 21 nt, Mycobacterium avium subsp. paratuberculosis
cggcgccccacgccuggcgga

SEQ ID NO: 912787 - RNA, 13 nt, Mycobacterium avium subsp. paratuberculosis
cggcgcccagauc

SEQ ID NO: 912788 - RNA, 19 nt, Mycobacterium avium subsp. paratuberculosis
cggcgcccagaucggccag

SEQ ID NO: 912789 - RNA, 14 nt, Mycobacterium avium subsp. paratuberculosis
cggcgcccacagca

SEQ ID NO: 912790 - RNA, 17 nt, Mycobacterium avium subsp. paratuberculosis
cggcgcccacagcaggu

SEQ ID NO: 912791 - RNA, 19 nt, Mycobacterium avium subsp. paratuberculosis
cggcgcccaccgcggcgcg

SEQ ID NO: 912792 - RNA, 13 nt, Mycobacterium avium subsp. paratuberculosis
cggcgcccagcgg

SEQ ID NO: 912793 - RNA, 14 nt, Mycobacterium avium subsp. paratuberculosis
cggcgcccagcggc

SEQ ID NO: 912794 - RNA, 15 nt, Mycobacterium avium subsp. paratuberculosis
cggcgcccagcggcg

SEQ ID NO: 912795 - RNA, 17 nt, Mycobacterium avium subsp. paratuberculosis
cggcgcccagcggcgau

SEQ ID NO: 912796 - RNA, 19 nt, Mycobacterium avium subsp. paratuberculosis
cggcgcccagcggcgaugc

SEQ ID NO: 912797 - RNA, 19 nt, Mycobacterium avium subsp. paratuberculosis
cggcgccaugaacuccgac

SEQ ID NO: 912798 - RNA, 22 nt, Mycobacterium avium subsp. paratuberculosis
cggcgccaugaacuccgacucc

SEQ ID NO: 912799 - RNA, 18 nt, Mycobacterium avium subsp. paratuberculosis
cggcgccaugcgccgcgc

SEQ ID NO: 912800 - RNA, 15 nt, Mycobacterium avium subsp. paratuberculosis
cggcgccacgugguc

SEQ ID NO: 912801 - RNA, 19 nt, Mycobacterium avium subsp. paratuberculosis
cggcgccacguggucgagc

SEQ ID NO: 912802 - RNA, 20 nt, Mycobacterium avium subsp. paratuberculosis
cggcgccacguggucgagca

SEQ ID NO: 912803 - RNA, 16 nt, Mycobacterium avium subsp. paratuberculosis
cggcgccagcccgccg

SEQ ID NO: 912804 - RNA, 17 nt, Mycobacterium avium subsp. paratuberculosis
cggcgccagcccgccga

SEQ ID NO: 912805 - RNA, 16 nt, Mycobacterium avium subsp. paratuberculosis
cggcgccagccgcacc

SEQ ID NO: 912806 - RNA, 18 nt, Mycobacterium avium subsp. paratuberculosis
cggcgccagccgcaccgc

SEQ ID NO: 912807 - RNA, 20 nt, Mycobacterium avium subsp. paratuberculosis
cggcgccagccgcaccgcga

SEQ ID NO: 912808 - RNA, 16 nt, Mycobacterium avium subsp. paratuberculosis
cggcgccacgaccagc

SEQ ID NO: 912809 - RNA, 23 nt, Mycobacterium avium subsp. paratuberculosis
cggcgccacgacugcgcggccgg

SEQ ID NO: 912810 - RNA, 22 nt, Mycobacterium avium subsp. paratuberculosis
cggcgccacgcacaccgcgcgc

SEQ ID NO: 912811 - RNA, 20 nt, Mycobacterium avium subsp. paratuberculosis
cggcgccacgccgcgauccg

SEQ ID NO: 912812 - RNA, 15 nt, Mycobacterium avium subsp. paratuberculosis
cggcgcagcggcccg

SEQ ID NO: 912813 - RNA, 12 nt, Mycobacterium avium subsp. paratuberculosis
cggcgccaccgg

SEQ ID NO: 912814 - RNA, 14 nt, Mycobacterium avium subsp. paratuberculosis
cggcgccaccggcu

SEQ ID NO: 912815 - RNA, 16 nt, Mycobacterium avium subsp. paratuberculosis
cggcgccaccggcugg

SEQ ID NO: 912816 - RNA, 19 nt, Mycobacterium avium subsp. paratuberculosis
cggcgccaccggcuggccg

SEQ ID NO: 912817 - RNA, 16 nt, Mycobacterium avium subsp. paratuberculosis
cggcgccaccgggacc

SEQ ID NO: 912818 - RNA, 14 nt, Mycobacterium avium subsp. paratuberculosis
cggcgcagcgccgc

SEQ ID NO: 912819 - RNA, 19 nt, Mycobacterium avium subsp. paratuberculosis
cggcgcagcgccgcgccga

SEQ ID NO: 912820 - RNA, 20 nt, Mycobacterium avium subsp. paratuberculosis
cggcgcagcgccgcgccgac

SEQ ID NO: 912821 - RNA, 15 nt, Mycobacterium avium subsp. paratuberculosis
cggcgcagcgcgaug

SEQ ID NO: 912822 - RNA, 17 nt, Mycobacterium avium subsp. paratuberculosis
cggcgcagcgcgauguc

SEQ ID NO: 912823 - RNA, 19 nt, Mycobacterium avium subsp. paratuberculosis
cggcgcagcgcgauguccg

SEQ ID NO: 912824 - RNA, 13 nt, Mycobacterium avium subsp. paratuberculosis
cggcgcagcgcgu

SEQ ID NO: 912825 - RNA, 17 nt, Mycobacterium avium subsp. paratuberculosis
cggcgcagcgcgucgcg

SEQ ID NO: 912826 - RNA, 19 nt, Mycobacterium avium subsp. paratuberculosis
cggcgcagcgcgucgcgcc

SEQ ID NO: 912827 - RNA, 21 nt, Mycobacterium avium subsp. paratuberculosis
cggcgcagcgcgucgcgcccg

SEQ ID NO: 912828 - RNA, 16 nt, Mycobacterium avium subsp. paratuberculosis
cggcgcagcgucucga

SEQ ID NO: 912829 - RNA, 23 nt, Mycobacterium avium subsp. paratuberculosis
cggcgcagcgucucgaucgacga

SEQ ID NO: 912830 - RNA, 21 nt, Mycobacterium avium subsp. paratuberculosis
cggccguagcggacgacggcc

SEQ ID NO: 912831 - RNA, 22 nt, Mycobacterium avium subsp. paratuberculosis
cggccguagcggacgacggcca

SEQ ID NO: 912832 - RNA, 21 nt, Mycobacterium avium subsp. paratuberculosis
cggccguagcguugccggccg

SEQ ID NO: 912833 - RNA, 15 nt, Mycobacterium avium subsp. paratuberculosis
cggccgucacgcugg

SEQ ID NO: 912834 - RNA, 20 nt, Mycobacterium avium subsp. paratuberculosis
cggccgucacgcuggcguga

SEQ ID NO: 912835 - RNA, 17 nt, Mycobacterium avium subsp. paratuberculosis
cggccgguuggcggccg

SEQ ID NO: 912836 - RNA, 20 nt, Mycobacterium avium subsp. paratuberculosis
cggccgguuguugcggucca

SEQ ID NO: 912837 - RNA, 16 nt, Mycobacterium avium subsp. paratuberculosis
cggccguaccggcgua

SEQ ID NO: 912838 - RNA, 15 nt, Mycobacterium avium subsp. paratuberculosis
cggccguacgcgguu

SEQ ID NO: 912839 - RNA, 17 nt, Mycobacterium avium subsp. paratuberculosis
cggccguacgcgguucg

SEQ ID NO: 912840 - RNA, 24 nt, Mycobacterium avium subsp. paratuberculosis
cggccguacgcgguucgugcgcaa

SEQ ID NO: 912841 - RNA, 18 nt, Mycobacterium avium subsp. paratuberculosis
cggccguagccggaccgc

SEQ ID NO: 912842 - RNA, 19 nt, Mycobacterium avium subsp. paratuberculosis
cggccguagccggaccgcu

SEQ ID NO: 912843 - RNA, 19 nt, Mycobacterium avium subsp. paratuberculosis
cggccgucgcgcaccaccu

SEQ ID NO: 912844 - RNA, 22 nt, Mycobacterium avium subsp. paratuberculosis
cggccgucgcgcaccaccucga

SEQ ID NO: 912845 - RNA, 15 nt, Mycobacterium avium subsp. paratuberculosis
cggccgucgcgcagc

SEQ ID NO: 912846 - RNA, 17 nt, Mycobacterium avium subsp. paratuberculosis
cggccgucgccgggcgg

SEQ ID NO: 912847 - RNA, 16 nt, Mycobacterium avium subsp. paratuberculosis
cggccgucgcgcacca

SEQ ID NO: 912848 - RNA, 17 nt, Mycobacterium avium subsp. paratuberculosis
cggccgucgcggcgauc

SEQ ID NO: 912849 - RNA, 19 nt, Mycobacterium avium subsp. paratuberculosis
cggccgucgcggcgaucgc

SEQ ID NO: 912850 - RNA, 21 nt, Mycobacterium avium subsp. paratuberculosis
cggccgucaggaacgccggcu

SEQ ID NO: 912851 - RNA, 15 nt, Mycobacterium avium subsp. paratuberculosis
cggccguaucggcca

SEQ ID NO: 912852 - RNA, 15 nt, Mycobacterium avium subsp. paratuberculosis
cggccguccggucgc

SEQ ID NO: 912853 - RNA, 18 nt, Mycobacterium avium subsp. paratuberculosis
cggccguccggucgcugg

SEQ ID NO: 912854 - RNA, 20 nt, Mycobacterium avium subsp. paratuberculosis
cggccguccaccaccaaccc

SEQ ID NO: 912855 - RNA, 14 nt, Mycobacterium avium subsp. paratuberculosis
cggccguccacggc

SEQ ID NO: 912856 - RNA, 16 nt, Mycobacterium avium subsp. paratuberculosis
cggccguccacggcgg

SEQ ID NO: 912857 - RNA, 19 nt, Mycobacterium avium subsp. paratuberculosis
cggccguccacggcggugg

SEQ ID NO: 912858 - RNA, 13 nt, Mycobacterium avium subsp. paratuberculosis
cggccguccagcg

SEQ ID NO: 912859 - RNA, 21 nt, Mycobacterium avium subsp. paratuberculosis
cggccguccagcgucuggcag

SEQ ID NO: 912860 - RNA, 14 nt, Mycobacterium avium subsp. paratuberculosis
cggccgguggccgg

SEQ ID NO: 912861 - RNA, 16 nt, Mycobacterium avium subsp. paratuberculosis
cggccgguggccggug

SEQ ID NO: 912862 - RNA, 18 nt, Mycobacterium avium subsp. paratuberculosis
cggccggugcgcgucagc

SEQ ID NO: 912863 - RNA, 18 nt, Mycobacterium avium subsp. paratuberculosis
cggccggugccacgguca

SEQ ID NO: 912864 - RNA, 20 nt, Mycobacterium avium subsp. paratuberculosis
cggccggugccacggucagg

SEQ ID NO: 912865 - RNA, 17 nt, Mycobacterium avium subsp. paratuberculosis
cggccgguccgaucguc

SEQ ID NO: 912866 - RNA, 24 nt, Mycobacterium avium subsp. paratuberculosis
cggccgguccgaucguccggcgcc

SEQ ID NO: 912867 - RNA, 15 nt, Mycobacterium avium subsp. paratuberculosis
cggccgguccgccca

SEQ ID NO: 912868 - RNA, 16 nt, Mycobacterium avium subsp. paratuberculosis
cggccgguccgcccag

SEQ ID NO: 912869 - RNA, 22 nt, Mycobacterium avium subsp. paratuberculosis
cggccgguccgcccagacgcgg

SEQ ID NO: 912870 - RNA, 19 nt, Mycobacterium avium subsp. paratuberculosis
cggccggucgaaggccccg

SEQ ID NO: 912871 - RNA, 21 nt, Mycobacterium avium subsp. paratuberculosis
cggccggucgaaggccccggu

SEQ ID NO: 912872 - RNA, 17 nt, Mycobacterium avium subsp. paratuberculosis
cggccggucgccgaugg

SEQ ID NO: 912873 - RNA, 15 nt, Mycobacterium avium subsp. paratuberculosis
cggccggucgccugc

SEQ ID NO: 912874 - RNA, 21 nt, Mycobacterium avium subsp. paratuberculosis
cggccggugacuccuccucgg

SEQ ID NO: 912875 - RNA, 18 nt, Mycobacterium avium subsp. paratuberculosis
cggccggguuguccuggc

SEQ ID NO: 912876 - RNA, 12 nt, Mycobacterium avium subsp. paratuberculosis
cggccgggucgc

SEQ ID NO: 912877 - RNA, 21 nt, Mycobacterium avium subsp. paratuberculosis
cggccgggucgcaggcagcag

SEQ ID NO: 912878 - RNA, 23 nt, Mycobacterium avium subsp. paratuberculosis
cggccgggucgcaggcagcagca

SEQ ID NO: 912879 - RNA, 22 nt, Mycobacterium avium subsp. paratuberculosis
cggccgggucguaggccggauc

SEQ ID NO: 912880 - RNA, 11 nt, Mycobacterium avium subsp. paratuberculosis
cggccgggucg

SEQ ID NO: 912881 - RNA, 16 nt, Mycobacterium avium subsp. paratuberculosis
cggccgggucgaccgc

SEQ ID NO: 912882 - RNA, 17 nt, Mycobacterium avium subsp. paratuberculosis
cggccgggucgaccgcg

SEQ ID NO: 912883 - RNA, 18 nt, Mycobacterium avium subsp. paratuberculosis
cggccgggucgaccgcga

SEQ ID NO: 912884 - RNA, 15 nt, Mycobacterium avium subsp. paratuberculosis
cggccgggucgagcg

SEQ ID NO: 912885 - RNA, 20 nt, Mycobacterium avium subsp. paratuberculosis
cggccgggucgagcgcgccg

SEQ ID NO: 912886 - RNA, 12 nt, Mycobacterium avium subsp. paratuberculosis
cggccgggguga

SEQ ID NO: 912887 - RNA, 21 nt, Mycobacterium avium subsp. paratuberculosis
cggccgggucacgugcaccca

SEQ ID NO: 912888 - RNA, 17 nt, Mycobacterium avium subsp. paratuberculosis
cggccgggggcgcgggc

SEQ ID NO: 912889 - RNA, 19 nt, Mycobacterium avium subsp. paratuberculosis
cggccgggggcgcgggcgg

SEQ ID NO: 912890 - RNA, 20 nt, Mycobacterium avium subsp. paratuberculosis
cggccgggggcgcgggcggc

SEQ ID NO: 912891 - RNA, 21 nt, Mycobacterium avium subsp. paratuberculosis
cggccgggggcgcgggcggca

SEQ ID NO: 912892 - RNA, 16 nt, Mycobacterium avium subsp. paratuberculosis
cggccggggccagcac

SEQ ID NO: 912893 - RNA, 17 nt, Mycobacterium avium subsp. paratuberculosis
cggccggggccagcacc

SEQ ID NO: 912894 - RNA, 21 nt, Mycobacterium avium subsp. paratuberculosis
cggccggggccagcacccaga

SEQ ID NO: 912895 - RNA, 15 nt, Mycobacterium avium subsp. paratuberculosis
cggccggggcgacca

SEQ ID NO: 912896 - RNA, 16 nt, Mycobacterium avium subsp. paratuberculosis
cggccggggcgaccag

SEQ ID NO: 912897 - RNA, 16 nt, Mycobacterium avium subsp. paratuberculosis
cggccggggcggcggu

SEQ ID NO: 912898 - RNA, 15 nt, Mycobacterium avium subsp. paratuberculosis
cggccggggcgggca

SEQ ID NO: 912899 - RNA, 22 nt, Mycobacterium avium subsp. paratuberculosis
cggccggggcgggcacgucgcg

SEQ ID NO: 912900 - RNA, 23 nt, Mycobacterium avium subsp. paratuberculosis
cggccggggcgggcacgucgcgc

SEQ ID NO: 912901 - RNA, 15 nt, Mycobacterium avium subsp. paratuberculosis
cggccgggcgacugc

SEQ ID NO: 912902 - RNA, 19 nt, Mycobacterium avium subsp. paratuberculosis
cggccgggcgacugcgugc

SEQ ID NO: 912903 - RNA, 21 nt, Mycobacterium avium subsp. paratuberculosis
cggccgggcgacugcgugcug

SEQ ID NO: 912904 - RNA, 13 nt, Mycobacterium avium subsp. paratuberculosis
cggccgggcgccc

SEQ ID NO: 912905 - RNA, 14 nt, Mycobacterium avium subsp. paratuberculosis
cggccgggcggccg

SEQ ID NO: 912906 - RNA, 15 nt, Mycobacterium avium subsp. paratuberculosis
cggccgggcggccgg

SEQ ID NO: 912907 - RNA, 17 nt, Mycobacterium avium subsp. paratuberculosis
cggccgggcgggggcug

SEQ ID NO: 912908 - RNA, 17 nt, Mycobacterium avium subsp. paratuberculosis
cggccgggcugcccacc

SEQ ID NO: 912909 - RNA, 18 nt, Mycobacterium avium subsp. paratuberculosis
cggccgggcugcccacca

SEQ ID NO: 912910 - RNA, 19 nt, Mycobacterium avium subsp. paratuberculosis
cggccgggcugcccaccac

SEQ ID NO: 912911 - RNA, 23 nt, Mycobacterium avium subsp. paratuberculosis
cggccgggcugcgcagcaccguc

SEQ ID NO: 912912 - RNA, 19 nt, Mycobacterium avium subsp. paratuberculosis
cggccggggcagacccgcg

SEQ ID NO: 912913 - RNA, 17 nt, Mycobacterium avium subsp. paratuberculosis
cggccgggcggacggca

SEQ ID NO: 912914 - RNA, 19 nt, Mycobacterium avium subsp. paratuberculosis
cggccgggccgcggcggua

SEQ ID NO: 912915 - RNA, 20 nt, Mycobacterium avium subsp. paratuberculosis
cggccgggccggaacgcccg

SEQ ID NO: 912916 - RNA, 22 nt, Mycobacterium avium subsp. paratuberculosis
cggccgggccggaacgcccgau

SEQ ID NO: 912917 - RNA, 23 nt, Mycobacterium avium subsp. paratuberculosis
cggccgggccggaacgcccgauc

SEQ ID NO: 912918 - RNA, 15 nt, Mycobacterium avium subsp. paratuberculosis
cggccgggccggcgg

SEQ ID NO: 912919 - RNA, 14 nt, Mycobacterium avium subsp. paratuberculosis
cggccgggacgggu

SEQ ID NO: 912920 - RNA, 18 nt, Mycobacterium avium subsp. paratuberculosis
cggccgggaucuggccgg

SEQ ID NO: 912921 - RNA, 23 nt, Mycobacterium avium subsp. paratuberculosis
cggccgggaucuggccggugagc

SEQ ID NO: 912922 - RNA, 18 nt, Mycobacterium avium subsp. paratuberculosis
cggccgggaugccgccgg

SEQ ID NO: 912923 - RNA, 19 nt, Mycobacterium avium subsp. paratuberculosis
cggccgggaugccgccggu

SEQ ID NO: 912924 - RNA, 21 nt, Mycobacterium avium subsp. paratuberculosis
cggccgggauuucccgggcga

SEQ ID NO: 912925 - RNA, 17 nt, Mycobacterium avium subsp. paratuberculosis
cggccggcgccgaccga

SEQ ID NO: 912926 - RNA, 15 nt, Mycobacterium avium subsp. paratuberculosis
cggccggcgccgccg

SEQ ID NO: 912927 - RNA, 16 nt, Mycobacterium avium subsp. paratuberculosis
cggccggcgccgccgg

SEQ ID NO: 912928 - RNA, 16 nt, Mycobacterium avium subsp. paratuberculosis
cggccggcgcagccgg

SEQ ID NO: 912929 - RNA, 19 nt, Mycobacterium avium subsp. paratuberculosis
cggccggcgcagccggcca

SEQ ID NO: 912930 - RNA, 11 nt, Mycobacterium avium subsp. paratuberculosis
cggccggcgaa

SEQ ID NO: 912931 - RNA, 21 nt, Mycobacterium avium subsp. paratuberculosis
cggccggcgaaacacagcagc

SEQ ID NO: 912932 - RNA, 22 nt, Mycobacterium avium subsp. paratuberculosis
cggccggcgaaacacagcagca

SEQ ID NO: 912933 - RNA, 12 nt, Mycobacterium avium subsp. paratuberculosis
cggccggcgaag

SEQ ID NO: 912934 - RNA, 13 nt, Mycobacterium avium subsp. paratuberculosis
cggccggcgaagc

SEQ ID NO: 912935 - RNA, 15 nt, Mycobacterium avium subsp. paratuberculosis
cggccggcgaagccg

SEQ ID NO: 912936 - RNA, 16 nt, Mycobacterium avium subsp. paratuberculosis
cggccggcgaagccgc

SEQ ID NO: 912937 - RNA, 18 nt, Mycobacterium avium subsp. paratuberculosis
cggccggcgacgccgcgc

SEQ ID NO: 912938 - RNA, 21 nt, Mycobacterium avium subsp. paratuberculosis
cggccggcgacgccgcgcugg

SEQ ID NO: 912939 - RNA, 14 nt, Mycobacterium avium subsp. paratuberculosis
cggccggcgaggaa

SEQ ID NO: 912940 - RNA, 14 nt, Mycobacterium avium subsp. paratuberculosis
cggccggcgagucg

SEQ ID NO: 912941 - RNA, 21 nt, Mycobacterium avium subsp. paratuberculosis
cggccggcgagucgcggauca

SEQ ID NO: 912942 - RNA, 17 nt, Mycobacterium avium subsp. paratuberculosis
cggccggccgcgcgcgg

SEQ ID NO: 912943 - RNA, 15 nt, Mycobacterium avium subsp. paratuberculosis
cggccggccggccga

SEQ ID NO: 912944 - RNA, 15 nt, Mycobacterium avium subsp. paratuberculosis
cggccggccggccgu

SEQ ID NO: 912945 - RNA, 17 nt, Mycobacterium avium subsp. paratuberculosis
cggccggccggccuggu

SEQ ID NO: 912946 - RNA, 15 nt, Mycobacterium avium subsp. paratuberculosis
cggccggccgugccg

SEQ ID NO: 912947 - RNA, 14 nt, Mycobacterium avium subsp. paratuberculosis
cggccggccgacac

SEQ ID NO: 912948 - RNA, 15 nt, Mycobacterium avium subsp. paratuberculosis
cggccggccgacacc

SEQ ID NO: 912949 - RNA, 15 nt, Mycobacterium avium subsp. paratuberculosis
cggccggccgagccg

SEQ ID NO: 912950 - RNA, 19 nt, Mycobacterium avium subsp. paratuberculosis
cggccggccgagccgagcc

SEQ ID NO: 912951 - RNA, 14 nt, Mycobacterium avium subsp. paratuberculosis
cggccggccgccgg

SEQ ID NO: 912952 - RNA, 15 nt, Mycobacterium avium subsp. paratuberculosis
cggccggccgccggc

SEQ ID NO: 912953 - RNA, 17 nt, Mycobacterium avium subsp. paratuberculosis
cggccggccgccggcgg

SEQ ID NO: 912954 - RNA, 22 nt, Mycobacterium avium subsp. paratuberculosis
cggccggccgccuggacgacgu

SEQ ID NO: 912955 - RNA, 21 nt, Mycobacterium avium subsp. paratuberculosis
cggccggccgcgcccaucgcg

SEQ ID NO: 912956 - RNA, 20 nt, Mycobacterium avium subsp. paratuberculosis
cggccggcacgaaaccgugg

SEQ ID NO: 912957 - RNA, 18 nt, Mycobacterium avium subsp. paratuberculosis
cggccggauggccagcag

SEQ ID NO: 912958 - RNA, 19 nt, Mycobacterium avium subsp. paratuberculosis
cggccggauggccagcagg

SEQ ID NO: 912959 - RNA, 21 nt, Mycobacterium avium subsp. paratuberculosis
cggccggauguuguccggaac

SEQ ID NO: 912960 - RNA, 18 nt, Mycobacterium avium subsp. paratuberculosis
cggccggauucucgcccg

SEQ ID NO: 912961 - RNA, 20 nt, Mycobacterium avium subsp. paratuberculosis
cggccggcaacgacccgucg

SEQ ID NO: 912962 - RNA, 13 nt, Mycobacterium avium subsp. paratuberculosis
cggccggagcgga

SEQ ID NO: 912963 - RNA, 22 nt, Mycobacterium avium subsp. paratuberculosis
cggccggagcggauggcgccgu

SEQ ID NO: 912964 - RNA, 23 nt, Mycobacterium avium subsp. paratuberculosis
cggccggagcggauggcgccguc

SEQ ID NO: 912965 - RNA, 14 nt, Mycobacterium avium subsp. paratuberculosis
cggccgcgugcacc

SEQ ID NO: 912966 - RNA, 16 nt, Mycobacterium avium subsp. paratuberculosis
cggccggagaccgccg

SEQ ID NO: 912967 - RNA, 21 nt, Mycobacterium avium subsp. paratuberculosis
cggccggagccgaccucggcg

SEQ ID NO: 912968 - RNA, 17 nt, Mycobacterium avium subsp. paratuberculosis
cggccgcguccucgccg

SEQ ID NO: 912969 - RNA, 17 nt, Mycobacterium avium subsp. paratuberculosis
cggccgcgcccaucgcg

SEQ ID NO: 912970 - RNA, 19 nt, Mycobacterium avium subsp. paratuberculosis
cggccgcguacuucgcgcc

SEQ ID NO: 912971 - RNA, 23 nt, Mycobacterium avium subsp. paratuberculosis
cggccgcguacuucgcgcccugg

SEQ ID NO: 912972 - RNA, 17 nt, Mycobacterium avium subsp. paratuberculosis
cggccgcgucgccgacc

SEQ ID NO: 912973 - RNA, 19 nt, Mycobacterium avium subsp. paratuberculosis
cggccgcgucgccgaccag

SEQ ID NO: 912974 - RNA, 13 nt, Mycobacterium avium subsp. paratuberculosis
cggccgcgucggc

SEQ ID NO: 912975 - RNA, 15 nt, Mycobacterium avium subsp. paratuberculosis
cggccgcgucggcgg

SEQ ID NO: 912976 - RNA, 17 nt, Mycobacterium avium subsp. paratuberculosis
cggccgcgucggcggcg

SEQ ID NO: 912977 - RNA, 16 nt, Mycobacterium avium subsp. paratuberculosis
cggccgcgucggcggu

SEQ ID NO: 912978 - RNA, 22 nt, Mycobacterium avium subsp. paratuberculosis
cggccgcgucggcggucgccag

SEQ ID NO: 912979 - RNA, 23 nt, Mycobacterium avium subsp. paratuberculosis
cggccgcgucggcggucgccagc

SEQ ID NO: 912980 - RNA, 16 nt, Mycobacterium avium subsp. paratuberculosis
cggccgcgucgggcag

SEQ ID NO: 912981 - RNA, 15 nt, Mycobacterium avium subsp. paratuberculosis
cggccgcggucucga

SEQ ID NO: 912982 - RNA, 13 nt, Mycobacterium avium subsp. paratuberculosis
cggccgcggugac

SEQ ID NO: 912983 - RNA, 19 nt, Mycobacterium avium subsp. paratuberculosis
cggccgcggugaccgcgcc

SEQ ID NO: 912984 - RNA, 20 nt, Mycobacterium avium subsp. paratuberculosis
cggccgcggugaccgcgccg

SEQ ID NO: 912985 - RNA, 20 nt, Mycobacterium avium subsp. paratuberculosis
cggccgcggugugcccggcg

SEQ ID NO: 912986 - RNA, 22 nt, Mycobacterium avium subsp. paratuberculosis
cggccgcggugugcccggcguu

SEQ ID NO: 912987 - RNA, 17 nt, Mycobacterium avium subsp. paratuberculosis
cggccgcggggccggcg

SEQ ID NO: 912988 - RNA, 18 nt, Mycobacterium avium subsp. paratuberculosis
cggccgcggggccggcgc

SEQ ID NO: 912989 - RNA, 19 nt, Mycobacterium avium subsp. paratuberculosis
cggccgcggggccggcgcu

SEQ ID NO: 912990 - RNA, 21 nt, Mycobacterium avium subsp. paratuberculosis
cggccgcggggccggcgcugg

SEQ ID NO: 912991 - RNA, 12 nt, Mycobacterium avium subsp. paratuberculosis
cggccgcgccga

SEQ ID NO: 912992 - RNA, 23 nt, Mycobacterium avium subsp. paratuberculosis
cggccgcgccgaacaccacgccg

SEQ ID NO: 912993 - RNA, 13 nt, Mycobacterium avium subsp. paratuberculosis
cggccgccggauc

SEQ ID NO: 912994 - RNA, 16 nt, Mycobacterium avium subsp. paratuberculosis
cggccgcgcaccgccc

SEQ ID NO: 912995 - RNA, 20 nt, Mycobacterium avium subsp. paratuberculosis
cggccgcgcagaucgccagc

SEQ ID NO: 912996 - RNA, 12 nt, Mycobacterium avium subsp. paratuberculosis
cggccgcgcagc

SEQ ID NO: 912997 - RNA, 13 nt, Mycobacterium avium subsp. paratuberculosis
cggccgcgcagcu

SEQ ID NO: 912998 - RNA, 16 nt, Mycobacterium avium subsp. paratuberculosis
cggccgcgcagcucga

SEQ ID NO: 912999 - RNA, 13 nt, Mycobacterium avium subsp. paratuberculosis
cggccgcgacugc

SEQ ID NO: 913000 - RNA, 14 nt, Mycobacterium avium subsp. paratuberculosis
cggccgcgacugca

SEQ ID NO: 913001 - RNA, 15 nt, Mycobacterium avium subsp. paratuberculosis
cggccgcgauguagc

SEQ ID NO: 913002 - RNA, 15 nt, Mycobacterium avium subsp. paratuberculosis
cggccgcgaugucgg

SEQ ID NO: 913003 - RNA, 19 nt, Mycobacterium avium subsp. paratuberculosis
cggccgcgaugucgguggg

SEQ ID NO: 913004 - RNA, 20 nt, Mycobacterium avium subsp. paratuberculosis
cggccgcgaugucggugggc

SEQ ID NO: 913005 - RNA, 22 nt, Mycobacterium avium subsp. paratuberculosis
cggccgccgcgcauccgcaccg

SEQ ID NO: 913006 - RNA, 14 nt, Mycobacterium avium subsp. paratuberculosis
cggccgcgacgacc

SEQ ID NO: 913007 - RNA, 17 nt, Mycobacterium avium subsp. paratuberculosis
cggccgcgagcccggcg

SEQ ID NO: 913008 - RNA, 18 nt, Mycobacterium avium subsp. paratuberculosis
cggccgcgagcccggcga

SEQ ID NO: 913009 - RNA, 19 nt, Mycobacterium avium subsp. paratuberculosis
cggccgcgagcccggcgac

SEQ ID NO: 913010 - RNA, 15 nt, Mycobacterium avium subsp. paratuberculosis
cggccgcgauccagc

SEQ ID NO: 913011 - RNA, 16 nt, Mycobacterium avium subsp. paratuberculosis
cggccgcgauccagcg

SEQ ID NO: 913012 - RNA, 17 nt, Mycobacterium avium subsp. paratuberculosis
cggccgcgauccagcgc

SEQ ID NO: 913013 - RNA, 22 nt, Mycobacterium avium subsp. paratuberculosis
cggccgcgauccagcgcuggcc

SEQ ID NO: 913014 - RNA, 15 nt, Mycobacterium avium subsp. paratuberculosis
cggccgcgaucgcca

SEQ ID NO: 913015 - RNA, 15 nt, Mycobacterium avium subsp. paratuberculosis
cggccgcgaaggcgg

SEQ ID NO: 913016 - RNA, 20 nt, Mycobacterium avium subsp. paratuberculosis
cggccgcgaaggcggcgucg

SEQ ID NO: 913017 - RNA, 23 nt, Mycobacterium avium subsp. paratuberculosis
cggccgcgaaggcggcgucgaug

SEQ ID NO: 913018 - RNA, 18 nt, Mycobacterium avium subsp. paratuberculosis
cggccgcgaauucggcga

SEQ ID NO: 913019 - RNA, 14 nt, Mycobacterium avium subsp. paratuberculosis
cggccgcgacagcc

SEQ ID NO: 913020 - RNA, 15 nt, Mycobacterium avium subsp. paratuberculosis
cggccgcgacagccg

SEQ ID NO: 913021 - RNA, 13 nt, Mycobacterium avium subsp. paratuberculosis
cggccgccggcac

SEQ ID NO: 913022 - RNA, 13 nt, Mycobacterium avium subsp. paratuberculosis
cggccgccggcca

SEQ ID NO: 913023 - RNA, 18 nt, Mycobacterium avium subsp. paratuberculosis
cggccgccggccagcucc

SEQ ID NO: 913024 - RNA, 13 nt, Mycobacterium avium subsp. paratuberculosis
cggccgccgcgac

SEQ ID NO: 913025 - RNA, 15 nt, Mycobacterium avium subsp. paratuberculosis
cggccgccgcgacgg

SEQ ID NO: 913026 - RNA, 16 nt, Mycobacterium avium subsp. paratuberculosis
cggccgccgcgacggc

SEQ ID NO: 913027 - RNA, 21 nt, Mycobacterium avium subsp. paratuberculosis
cggccgccgcgacggccgccg

SEQ ID NO: 913028 - RNA, 14 nt, Mycobacterium avium subsp. paratuberculosis
cggccgccgcgauc

SEQ ID NO: 913029 - RNA, 14 nt, Mycobacterium avium subsp. paratuberculosis
cggccgccgcccgc

SEQ ID NO: 913030 - RNA, 18 nt, Mycobacterium avium subsp. paratuberculosis
cggccgccgcccgcgcgg

SEQ ID NO: 913031 - RNA, 13 nt, Mycobacterium avium subsp. paratuberculosis
cggccgccgccgc

SEQ ID NO: 913032 - RNA, 18 nt, Mycobacterium avium subsp. paratuberculosis
cggccgccgccgcggccg

SEQ ID NO: 913033 - RNA, 13 nt, Mycobacterium avium subsp. paratuberculosis
cggccgccaccgc

SEQ ID NO: 913034 - RNA, 15 nt, Mycobacterium avium subsp. paratuberculosis
cggccgccaccgcca

SEQ ID NO: 913035 - RNA, 23 nt, Mycobacterium avium subsp. paratuberculosis
cggccgccgauucaaccccgcgc

SEQ ID NO: 913036 - RNA, 20 nt, Mycobacterium avium subsp. paratuberculosis
cggccgccgauuccggccgg

SEQ ID NO: 913037 - RNA, 12 nt, Mycobacterium avium subsp. paratuberculosis
cggccgccgacu

SEQ ID NO: 913038 - RNA, 16 nt, Mycobacterium avium subsp. paratuberculosis
cggccgccgaagccgg

SEQ ID NO: 913039 - RNA, 18 nt, Mycobacterium avium subsp. paratuberculosis
cggccgccgaagccggcu

SEQ ID NO: 913040 - RNA, 21 nt, Mycobacterium avium subsp. paratuberculosis
cggccgccgaagccggcucga

SEQ ID NO: 913041 - RNA, 21 nt, Mycobacterium avium subsp. paratuberculosis
cggccgccgacaccaccacga

SEQ ID NO: 913042 - RNA, 15 nt, Mycobacterium avium subsp. paratuberculosis
cggccgccgaggaca

SEQ ID NO: 913043 - RNA, 13 nt, Mycobacterium avium subsp. paratuberculosis
cggccgccgaggc

SEQ ID NO: 913044 - RNA, 14 nt, Mycobacterium avium subsp. paratuberculosis
cggccgccgaggcg

SEQ ID NO: 913045 - RNA, 15 nt, Mycobacterium avium subsp. paratuberculosis
cggccgccgaggcga

SEQ ID NO: 913046 - RNA, 20 nt, Mycobacterium avium subsp. paratuberculosis
cggccgccgaggcgaugccg

SEQ ID NO: 913047 - RNA, 13 nt, Mycobacterium avium subsp. paratuberculosis
cggccgccgauca

SEQ ID NO: 913048 - RNA, 14 nt, Mycobacterium avium subsp. paratuberculosis
cggccgccgaucaa

SEQ ID NO: 913049 - RNA, 17 nt, Mycobacterium avium subsp. paratuberculosis
cggccgccgaucaacag

SEQ ID NO: 913050 - RNA, 12 nt, Mycobacterium avium subsp. paratuberculosis
cggccgccagcg

SEQ ID NO: 913051 - RNA, 13 nt, Mycobacterium avium subsp. paratuberculosis
cggccgccagcgc

SEQ ID NO: 913052 - RNA, 15 nt, Mycobacterium avium subsp. paratuberculosis
cggccgccagcagca

SEQ ID NO: 913053 - RNA, 16 nt, Mycobacterium avium subsp. paratuberculosis
cggccgcauuuggcgu

SEQ ID NO: 913054 - RNA, 17 nt, Mycobacterium avium subsp. paratuberculosis
cggccgcauuuggcgua

SEQ ID NO: 913055 - RNA, 23 nt, Mycobacterium avium subsp. paratuberculosis
cggccgcaugucgaccucggcca

SEQ ID NO: 913056 - RNA, 13 nt, Mycobacterium avium subsp. paratuberculosis
cggccgcacgucc

SEQ ID NO: 913057 - RNA, 15 nt, Mycobacterium avium subsp. paratuberculosis
cggccgcacgucccg

SEQ ID NO: 913058 - RNA, 17 nt, Mycobacterium avium subsp. paratuberculosis
cggccgcacgucccgcc

SEQ ID NO: 913059 - RNA, 19 nt, Mycobacterium avium subsp. paratuberculosis
cggccgcacgucccgcccg

SEQ ID NO: 913060 - RNA, 21 nt, Mycobacterium avium subsp. paratuberculosis
cggccgcacgucccgcccggc

SEQ ID NO: 913061 - RNA, 22 nt, Mycobacterium avium subsp. paratuberculosis
cggccgcacgucccgcccggcg

SEQ ID NO: 913062 - RNA, 13 nt, Mycobacterium avium subsp. paratuberculosis
cggccgcagcgca

SEQ ID NO: 913063 - RNA, 21 nt, Mycobacterium avium subsp. paratuberculosis
cggccgcagcgcaucgccggc

SEQ ID NO: 913064 - RNA, 13 nt, Mycobacterium avium subsp. paratuberculosis
cggccgcagcgcc

SEQ ID NO: 913065 - RNA, 17 nt, Mycobacterium avium subsp. paratuberculosis
cggccgcagcgcccggc

SEQ ID NO: 913066 - RNA, 19 nt, Mycobacterium avium subsp. paratuberculosis
cggccgcagcgcccggcag

SEQ ID NO: 913067 - RNA, 22 nt, Mycobacterium avium subsp. paratuberculosis
cggccgcagcgcccggcagcgg

SEQ ID NO: 913068 - RNA, 14 nt, Mycobacterium avium subsp. paratuberculosis
cggccgcagcgcga

SEQ ID NO: 913069 - RNA, 16 nt, Mycobacterium avium subsp. paratuberculosis
cggccgcagcgcgacg

SEQ ID NO: 913070 - RNA, 18 nt, Mycobacterium avium subsp. paratuberculosis
cggccgcacgcgaacacc

SEQ ID NO: 913071 - RNA, 14 nt, Mycobacterium avium subsp. paratuberculosis
cggccgcagcggca

SEQ ID NO: 913072 - RNA, 19 nt, Mycobacterium avium subsp. paratuberculosis
cggccgcagcgugggcacc

SEQ ID NO: 913073 - RNA, 22 nt, Mycobacterium avium subsp. paratuberculosis
cggccgcagcgugggcaccggc

SEQ ID NO: 913074 - RNA, 23 nt, Mycobacterium avium subsp. paratuberculosis
cggccgcagcgugggcaccggca

SEQ ID NO: 913075 - RNA, 14 nt, Mycobacterium avium subsp. paratuberculosis
cggccgcaacggcg

SEQ ID NO: 913076 - RNA, 17 nt, Mycobacterium avium subsp. paratuberculosis
cggccgcaacggcgguc

SEQ ID NO: 913077 - RNA, 18 nt, Mycobacterium avium subsp. paratuberculosis
cggccgcaacggcggucg

SEQ ID NO: 913078 - RNA, 18 nt, Mycobacterium avium subsp. paratuberculosis
cggccgauggcccaggcc

SEQ ID NO: 913079 - RNA, 19 nt, Mycobacterium avium subsp. paratuberculosis
cggccgauggcccaggccg

SEQ ID NO: 913080 - RNA, 15 nt, Mycobacterium avium subsp. paratuberculosis
cggccgauggugugg

SEQ ID NO: 913081 - RNA, 14 nt, Mycobacterium avium subsp. paratuberculosis
cggccgauucggcg

SEQ ID NO: 913082 - RNA, 20 nt, Mycobacterium avium subsp. paratuberculosis
cggccgauucggcgccgcga

SEQ ID NO: 913083 - RNA, 21 nt, Mycobacterium avium subsp. paratuberculosis
cggccgauucggcgccgcgac

SEQ ID NO: 913084 - RNA, 18 nt, Mycobacterium avium subsp. paratuberculosis
cggccgcaaucggcgccg

SEQ ID NO: 913085 - RNA, 13 nt, Mycobacterium avium subsp. paratuberculosis
cggccgcacacca

SEQ ID NO: 913086 - RNA, 16 nt, Mycobacterium avium subsp. paratuberculosis
cggccgcacaccacca

SEQ ID NO: 913087 - RNA, 17 nt, Mycobacterium avium subsp. paratuberculosis
cggccgcacaccaccac

SEQ ID NO: 913088 - RNA, 19 nt, Mycobacterium avium subsp. paratuberculosis
cggccgcacaccaccacgu

SEQ ID NO: 913089 - RNA, 19 nt, Mycobacterium avium subsp. paratuberculosis
cggccgcaccccacccgcg

SEQ ID NO: 913090 - RNA, 20 nt, Mycobacterium avium subsp. paratuberculosis
cggccgcaccccacccgcgc

SEQ ID NO: 913091 - RNA, 22 nt, Mycobacterium avium subsp. paratuberculosis
cggccgcaccccacccgcgcga

SEQ ID NO: 913092 - RNA, 18 nt, Mycobacterium avium subsp. paratuberculosis
cggccccgcugccguccg

SEQ ID NO: 913093 - RNA, 20 nt, Mycobacterium avium subsp. paratuberculosis
cggccccgcugccguccggc

SEQ ID NO: 913094 - RNA, 23 nt, Mycobacterium avium subsp. paratuberculosis
cggccccgcugccguccggcggc

SEQ ID NO: 913095 - RNA, 17 nt, Mycobacterium avium subsp. paratuberculosis
cggcccagcgcgcggcg

SEQ ID NO: 913096 - RNA, 19 nt, Mycobacterium avium subsp. paratuberculosis
cggccccggccgagccggc

SEQ ID NO: 913097 - RNA, 13 nt, Mycobacterium avium subsp. paratuberculosis
cggccccggccgg

SEQ ID NO: 913098 - RNA, 16 nt, Mycobacterium avium subsp. paratuberculosis
cggccccggccggcgg

SEQ ID NO: 913099 - RNA, 18 nt, Mycobacterium avium subsp. paratuberculosis
cggccccggccggcgggu

SEQ ID NO: 913100 - RNA, 16 nt, Mycobacterium avium subsp. paratuberculosis
cggccccggccgggcg

SEQ ID NO: 913101 - RNA, 17 nt, Mycobacterium avium subsp. paratuberculosis
cggccccggccgggcga

SEQ ID NO: 913102 - RNA, 18 nt, Mycobacterium avium subsp. paratuberculosis
cggccccggccgggcgac

SEQ ID NO: 913103 - RNA, 12 nt, Mycobacterium avium subsp. paratuberculosis
cggccccggcga

SEQ ID NO: 913104 - RNA, 13 nt, Mycobacterium avium subsp. paratuberculosis
cggccccggcgac

SEQ ID NO: 913105 - RNA, 17 nt, Mycobacterium avium subsp. paratuberculosis
cggccccggcgacggcg

SEQ ID NO: 913106 - RNA, 15 nt, Mycobacterium avium subsp. paratuberculosis
cggccccgcccggcg

SEQ ID NO: 913107 - RNA, 16 nt, Mycobacterium avium subsp. paratuberculosis
cggccccgcccggcgc

SEQ ID NO: 913108 - RNA, 16 nt, Mycobacterium avium subsp. paratuberculosis
cggccccgcgcaucgg

SEQ ID NO: 913109 - RNA, 21 nt, Mycobacterium avium subsp. paratuberculosis
cggccccgcgcaucggucagc

SEQ ID NO: 913110 - RNA, 12 nt, Mycobacterium avium subsp. paratuberculosis
cggcgaccagcg

SEQ ID NO: 913111 - RNA, 17 nt, Mycobacterium avium subsp. paratuberculosis
cggcgaccacccucacc

SEQ ID NO: 913112 - RNA, 16 nt, Mycobacterium avium subsp. paratuberculosis
cggcgaccagcgacgg

SEQ ID NO: 913113 - RNA, 15 nt, Mycobacterium avium subsp. paratuberculosis
cggcgaccaugccgu

SEQ ID NO: 913114 - RNA, 17 nt, Mycobacterium avium subsp. paratuberculosis
cggcgaccccguucgcc

SEQ ID NO: 913115 - RNA, 20 nt, Mycobacterium avium subsp. paratuberculosis
cggcgaccccguucgccgac

SEQ ID NO: 913116 - RNA, 13 nt, Mycobacterium avium subsp. paratuberculosis
cggcgacgaccuu

SEQ ID NO: 913117 - RNA, 14 nt, Mycobacterium avium subsp. paratuberculosis
cggcgaccagcagg

SEQ ID NO: 913118 - RNA, 15 nt, Mycobacterium avium subsp. paratuberculosis
cggcgaccagcaggu

SEQ ID NO: 913119 - RNA, 17 nt, Mycobacterium avium subsp. paratuberculosis
cggcgaccagcaggucg

SEQ ID NO: 913120 - RNA, 18 nt, Mycobacterium avium subsp. paratuberculosis
cggcgaccagcaggucga

SEQ ID NO: 913121 - RNA, 20 nt, Mycobacterium avium subsp. paratuberculosis
cggcgaccagcaggucgagc

SEQ ID NO: 913122 - RNA, 14 nt, Mycobacterium avium subsp. paratuberculosis
cggcgaccagcccc

SEQ ID NO: 913123 - RNA, 15 nt, Mycobacterium avium subsp. paratuberculosis
cggcgaccagccccu

SEQ ID NO: 913124 - RNA, 21 nt, Mycobacterium avium subsp. paratuberculosis
cggcgaccagccccucgacca

SEQ ID NO: 913125 - RNA, 12 nt, Mycobacterium avium subsp. paratuberculosis
cggcgaccaccu

SEQ ID NO: 913126 - RNA, 16 nt, Mycobacterium avium subsp. paratuberculosis
cggcgaccaccucggc

SEQ ID NO: 913127 - RNA, 23 nt, Mycobacterium avium subsp. paratuberculosis
cggcgaccaccucggcgacgaug

SEQ ID NO: 913128 - RNA, 21 nt, Mycobacterium avium subsp. paratuberculosis
cggcgaccacgaacaccggcg

SEQ ID NO: 913129 - RNA, 22 nt, Mycobacterium avium subsp. paratuberculosis
cggcgaccacgaacaccggcgc

SEQ ID NO: 913130 - RNA, 24 nt, Mycobacterium avium subsp. paratuberculosis
cggcgaccacgaacaccggcgcga

SEQ ID NO: 913131 - RNA, 14 nt, Mycobacterium avium subsp. paratuberculosis
cggcgacggccagc

SEQ ID NO: 913132 - RNA, 15 nt, Mycobacterium avium subsp. paratuberculosis
cggcgacggccagcg

SEQ ID NO: 913133 - RNA, 13 nt, Mycobacterium avium subsp. paratuberculosis
cggcgacggcacc

SEQ ID NO: 913134 - RNA, 14 nt, Mycobacterium avium subsp. paratuberculosis
cggcgacggcaccg

SEQ ID NO: 913135 - RNA, 15 nt, Mycobacterium avium subsp. paratuberculosis
cggcgacggcaccgc

SEQ ID NO: 913136 - RNA, 17 nt, Mycobacterium avium subsp. paratuberculosis
cggcgacggcaccgccg

SEQ ID NO: 913137 - RNA, 17 nt, Mycobacterium avium subsp. paratuberculosis
cggcgacggcagcgcga

SEQ ID NO: 913138 - RNA, 21 nt, Mycobacterium avium subsp. paratuberculosis
cggcgacggcagcgcgauccg

SEQ ID NO: 913139 - RNA, 23 nt, Mycobacterium avium subsp. paratuberculosis
cggcgacggcagcgcgauccggg

SEQ ID NO: 913140 - RNA, 12 nt, Mycobacterium avium subsp. paratuberculosis
cggcgacgcggc

SEQ ID NO: 913141 - RNA, 14 nt, Mycobacterium avium subsp. paratuberculosis
cggcgacgcggcgg

SEQ ID NO: 913142 - RNA, 16 nt, Mycobacterium avium subsp. paratuberculosis
cggcgacgcggcggga

SEQ ID NO: 913143 - RNA, 16 nt, Mycobacterium avium subsp. paratuberculosis
cggcgacgcugguggc

SEQ ID NO: 913144 - RNA, 20 nt, Mycobacterium avium subsp. paratuberculosis
cggcgacgcugguggccugc

SEQ ID NO: 913145 - RNA, 21 nt, Mycobacterium avium subsp. paratuberculosis
cggcgacgcugguggccugca

SEQ ID NO: 913146 - RNA, 14 nt, Mycobacterium avium subsp. paratuberculosis
cggcgacgcugugc

SEQ ID NO: 913147 - RNA, 17 nt, Mycobacterium avium subsp. paratuberculosis
cggcgacggccagcgcg

SEQ ID NO: 913148 - RNA, 22 nt, Mycobacterium avium subsp. paratuberculosis
cggcgacggccagcgcggcggu

SEQ ID NO: 913149 - RNA, 20 nt, Mycobacterium avium subsp. paratuberculosis
cggcgacggccguccggucg

SEQ ID NO: 913150 - RNA, 13 nt, Mycobacterium avium subsp. paratuberculosis
cggcgacggcgaa

SEQ ID NO: 913151 - RNA, 16 nt, Mycobacterium avium subsp. paratuberculosis
cggcgacggcgaacgg

SEQ ID NO: 913152 - RNA, 13 nt, Mycobacterium avium subsp. paratuberculosis
cggcgacggcgac

SEQ ID NO: 913153 - RNA, 14 nt, Mycobacterium avium subsp. paratuberculosis
cggcgacggcgacc

SEQ ID NO: 913154 - RNA, 18 nt, Mycobacterium avium subsp. paratuberculosis
cggcgacggcgaccacac

SEQ ID NO: 913155 - RNA, 16 nt, Mycobacterium avium subsp. paratuberculosis
cggcgacggcgacggc

SEQ ID NO: 913156 - RNA, 20 nt, Mycobacterium avium subsp. paratuberculosis
cggcgacggcgacggcgucc

SEQ ID NO: 913157 - RNA, 15 nt, Mycobacterium avium subsp. paratuberculosis
cggcgacgaugcggc

SEQ ID NO: 913158 - RNA, 19 nt, Mycobacterium avium subsp. paratuberculosis
cggcgacgaugcggccguu

SEQ ID NO: 913159 - RNA, 18 nt, Mycobacterium avium subsp. paratuberculosis
cggcgacgauggccaggc

SEQ ID NO: 913160 - RNA, 16 nt, Mycobacterium avium subsp. paratuberculosis
cggcgacgccgccguc

SEQ ID NO: 913161 - RNA, 18 nt, Mycobacterium avium subsp. paratuberculosis
cggcgacgccgccgucgu

SEQ ID NO: 913162 - RNA, 12 nt, Mycobacterium avium subsp. paratuberculosis
cggcgacgccgg

SEQ ID NO: 913163 - RNA, 14 nt, Mycobacterium avium subsp. paratuberculosis
cggcgacgccggcg

SEQ ID NO: 913164 - RNA, 16 nt, Mycobacterium avium subsp. paratuberculosis
cggcgacgccggcgag

SEQ ID NO: 913165 - RNA, 19 nt, Mycobacterium avium subsp. paratuberculosis
cggcgacgccggcgaggcg

SEQ ID NO: 913166 - RNA, 12 nt, Mycobacterium avium subsp. paratuberculosis
cggcgacgccgu

SEQ ID NO: 913167 - RNA, 20 nt, Mycobacterium avium subsp. paratuberculosis
cggcgacgaugaagacccgc

SEQ ID NO: 913168 - RNA, 23 nt, Mycobacterium avium subsp. paratuberculosis
cggcgacgaugaagacccgccgg

SEQ ID NO: 913169 - RNA, 15 nt, Mycobacterium avium subsp. paratuberculosis
cggcgacgaucggcu

SEQ ID NO: 913170 - RNA, 17 nt, Mycobacterium avium subsp. paratuberculosis
cggcgacgaucggcucg

SEQ ID NO: 913171 - RNA, 20 nt, Mycobacterium avium subsp. paratuberculosis
cggcgacgaucggcucgagc

SEQ ID NO: 913172 - RNA, 13 nt, Mycobacterium avium subsp. paratuberculosis
cggcgacgaucac

SEQ ID NO: 913173 - RNA, 14 nt, Mycobacterium avium subsp. paratuberculosis
cggcgacgaucacc

SEQ ID NO: 913174 - RNA, 15 nt, Mycobacterium avium subsp. paratuberculosis
cggccuuggccaccg

SEQ ID NO: 913175 - RNA, 20 nt, Mycobacterium avium subsp. paratuberculosis
cggcgaaaucgcuccucgau

SEQ ID NO: 913176 - RNA, 15 nt, Mycobacterium avium subsp. paratuberculosis
cggcgaacaccacgg

SEQ ID NO: 913177 - RNA, 20 nt, Mycobacterium avium subsp. paratuberculosis
cggcgaacaccacggucccc

SEQ ID NO: 913178 - RNA, 14 nt, Mycobacterium avium subsp. paratuberculosis
cggcgaacaccagc

SEQ ID NO: 913179 - RNA, 16 nt, Mycobacterium avium subsp. paratuberculosis
cggcgaacaccagcac

SEQ ID NO: 913180 - RNA, 18 nt, Mycobacterium avium subsp. paratuberculosis
cggcgaacaccagcaccc

SEQ ID NO: 913181 - RNA, 19 nt, Mycobacterium avium subsp. paratuberculosis
cggcgaacaccagcaccca

SEQ ID NO: 913182 - RNA, 21 nt, Mycobacterium avium subsp. paratuberculosis
cggcgaacaccagcacccagc

SEQ ID NO: 913183 - RNA, 17 nt, Mycobacterium avium subsp. paratuberculosis
cggcgaagcuaaacccc

SEQ ID NO: 913184 - RNA, 22 nt, Mycobacterium avium subsp. paratuberculosis
cggcgaagcuaaaccccacggc

SEQ ID NO: 913185 - RNA, 16 nt, Mycobacterium avium subsp. paratuberculosis
cggcgaagcucgacga

SEQ ID NO: 913186 - RNA, 20 nt, Mycobacterium avium subsp. paratuberculosis
cggcgaaggagaaccgcugc

SEQ ID NO: 913187 - RNA, 19 nt, Mycobacterium avium subsp. paratuberculosis
cggcgaaccagcaugcgcc

SEQ ID NO: 913188 - RNA, 14 nt, Mycobacterium avium subsp. paratuberculosis
cggcgaacagcggg

SEQ ID NO: 913189 - RNA, 19 nt, Mycobacterium avium subsp. paratuberculosis
cggcgaacagcggggugcc

SEQ ID NO: 913190 - RNA, 23 nt, Mycobacterium avium subsp. paratuberculosis
cggcgaacagugcacugccgacc

SEQ ID NO: 913191 - RNA, 15 nt, Mycobacterium avium subsp. paratuberculosis
cggcgaacaccucgg

SEQ ID NO: 913192 - RNA, 17 nt, Mycobacterium avium subsp. paratuberculosis
cggcgaacaccucggcg

SEQ ID NO: 913193 - RNA, 18 nt, Mycobacterium avium subsp. paratuberculosis
cggcgaacaccucggcga

SEQ ID NO: 913194 - RNA, 21 nt, Mycobacterium avium subsp. paratuberculosis
cggcgaacaccucggcgaugc

SEQ ID NO: 913195 - RNA, 14 nt, Mycobacterium avium subsp. paratuberculosis
cggcgaacaacgcc

SEQ ID NO: 913196 - RNA, 20 nt, Mycobacterium avium subsp. paratuberculosis
cggcgacaugcgcagcgccc

SEQ ID NO: 913197 - RNA, 15 nt, Mycobacterium avium subsp. paratuberculosis
cggcgacauuggccg

SEQ ID NO: 913198 - RNA, 18 nt, Mycobacterium avium subsp. paratuberculosis
cggcgacauuggccgcgc

SEQ ID NO: 913199 - RNA, 23 nt, Mycobacterium avium subsp. paratuberculosis
cggcgacauuggccgcgcgcagg

SEQ ID NO: 913200 - RNA, 15 nt, Mycobacterium avium subsp. paratuberculosis
cggcgacaucgccga

SEQ ID NO: 913201 - RNA, 14 nt, Mycobacterium avium subsp. paratuberculosis
cggcgaccacaccg

SEQ ID NO: 913202 - RNA, 21 nt, Mycobacterium avium subsp. paratuberculosis
cggcgaccacaccgucgacga

SEQ ID NO: 913203 - RNA, 12 nt, Mycobacterium avium subsp. paratuberculosis
cggcgaccacca

SEQ ID NO: 913204 - RNA, 16 nt, Mycobacterium avium subsp. paratuberculosis
cggcgaccaccaccgc

SEQ ID NO: 913205 - RNA, 18 nt, Mycobacterium avium subsp. paratuberculosis
cggcgaccaccaccgccc

SEQ ID NO: 913206 - RNA, 17 nt, Mycobacterium avium subsp. paratuberculosis
cggcgaccaccagccgc

SEQ ID NO: 913207 - RNA, 18 nt, Mycobacterium avium subsp. paratuberculosis
cggcgaauaccagggcga

SEQ ID NO: 913208 - RNA, 21 nt, Mycobacterium avium subsp. paratuberculosis
cggcgaauaccagggcgagga

SEQ ID NO: 913209 - RNA, 21 nt, Mycobacterium avium subsp. paratuberculosis
cggcgaauauuucgccgaucu

SEQ ID NO: 913210 - RNA, 22 nt, Mycobacterium avium subsp. paratuberculosis
cggcgaauauuucgccgaucug

SEQ ID NO: 913211 - RNA, 17 nt, Mycobacterium avium subsp. paratuberculosis
cggcgaauccgaccggc

SEQ ID NO: 913212 - RNA, 22 nt, Mycobacterium avium subsp. paratuberculosis
cggcgaauccgaccggcucagc

SEQ ID NO: 913213 - RNA, 14 nt, Mycobacterium avium subsp. paratuberculosis
cggcgaaggcgcgc

SEQ ID NO: 913214 - RNA, 23 nt, Mycobacterium avium subsp. paratuberculosis
cggcgaaggucugaaaugccggg

SEQ ID NO: 913215 - RNA, 17 nt, Mycobacterium avium subsp. paratuberculosis
cggcgaaggugccccgc

SEQ ID NO: 913216 - RNA, 17 nt, Mycobacterium avium subsp. paratuberculosis
cggcgaagucaucaccg

SEQ ID NO: 913217 - RNA, 18 nt, Mycobacterium avium subsp. paratuberculosis
cggcgaagucaucaccgg

SEQ ID NO: 913218 - RNA, 22 nt, Mycobacterium avium subsp. paratuberculosis
cggcgaagucaucaccggggau

SEQ ID NO: 913219 - RNA, 23 nt, Mycobacterium avium subsp. paratuberculosis
cggcgaagucaucaccggggauc

SEQ ID NO: 913220 - RNA, 18 nt, Mycobacterium avium subsp. paratuberculosis
cggccuucagcguccacg

SEQ ID NO: 913221 - RNA, 14 nt, Mycobacterium avium subsp. paratuberculosis
cggccuucgccucg

SEQ ID NO: 913222 - RNA, 21 nt, Mycobacterium avium subsp. paratuberculosis
cggccuucagugaaccccggg

SEQ ID NO: 913223 - RNA, 17 nt, Mycobacterium avium subsp. paratuberculosis
cggccuucucgcgcacc

SEQ ID NO: 913224 - RNA, 21 nt, Mycobacterium avium subsp. paratuberculosis
cggccuucucgcgcaccgcgg

SEQ ID NO: 913225 - RNA, 16 nt, Mycobacterium avium subsp. paratuberculosis
cggccuugaccaggau

SEQ ID NO: 913226 - RNA, 22 nt, Mycobacterium avium subsp. paratuberculosis
cggccuugacgaguuccaccuc

SEQ ID NO: 913227 - RNA, 23 nt, Mycobacterium avium subsp. paratuberculosis
cggccuucuucugccacucgucg

SEQ ID NO: 913228 - RNA, 15 nt, Mycobacterium avium subsp. paratuberculosis
cggccuucuuggccg

SEQ ID NO: 913229 - RNA, 17 nt, Mycobacterium avium subsp. paratuberculosis
cggccuucuuggccgga

SEQ ID NO: 913230 - RNA, 21 nt, Mycobacterium avium subsp. paratuberculosis
cggccuucuuggccggagccu

SEQ ID NO: 913231 - RNA, 17 nt, Mycobacterium avium subsp. paratuberculosis
cggccuugaacgcgucc

SEQ ID NO: 913232 - RNA, 16 nt, Mycobacterium avium subsp. paratuberculosis
cggccuuggcccgcgc

SEQ ID NO: 913233 - RNA, 17 nt, Mycobacterium avium subsp. paratuberculosis
cggccuuggcccgcgcc

SEQ ID NO: 913234 - RNA, 18 nt, Mycobacterium avium subsp. paratuberculosis
cggccuuggcccgcgccc

SEQ ID NO: 913235 - RNA, 19 nt, Mycobacterium avium subsp. paratuberculosis
cggccuuggcccgcgcccg

SEQ ID NO: 913236 - RNA, 17 nt, Mycobacterium avium subsp. paratuberculosis
cggccuugcucgccgcg

SEQ ID NO: 913237 - RNA, 15 nt, Mycobacterium avium subsp. paratuberculosis
cggccuugcgggccg

SEQ ID NO: 913238 - RNA, 19 nt, Mycobacterium avium subsp. paratuberculosis
cggccuugcgggccggagc

SEQ ID NO: 913239 - RNA, 16 nt, Mycobacterium avium subsp. paratuberculosis
cggccuugccgcugug

SEQ ID NO: 913240 - RNA, 15 nt, Mycobacterium avium subsp. paratuberculosis
cggccuugcgagccg

SEQ ID NO: 913241 - RNA, 13 nt, Mycobacterium avium subsp. paratuberculosis
cggccuugcgcca

SEQ ID NO: 913242 - RNA, 21 nt, Mycobacterium avium subsp. paratuberculosis
cggccuguccggucuucucgg

SEQ ID NO: 913243 - RNA, 14 nt, Mycobacterium avium subsp. paratuberculosis
cggccuuacgcugc

SEQ ID NO: 913244 - RNA, 15 nt, Mycobacterium avium subsp. paratuberculosis
cggccugggcgacca

SEQ ID NO: 913245 - RNA, 19 nt, Mycobacterium avium subsp. paratuberculosis
cggccugguacagcaccgc

SEQ ID NO: 913246 - RNA, 20 nt, Mycobacterium avium subsp. paratuberculosis
cggccugguacagcaccgcc

SEQ ID NO: 913247 - RNA, 18 nt, Mycobacterium avium subsp. paratuberculosis
cggccugcuccagcgagu

SEQ ID NO: 913248 - RNA, 12 nt, Mycobacterium avium subsp. paratuberculosis
cggccugcucga

SEQ ID NO: 913249 - RNA, 22 nt, Mycobacterium avium subsp. paratuberculosis
cggccugcgucacuccucgauc

SEQ ID NO: 913250 - RNA, 21 nt, Mycobacterium avium subsp. paratuberculosis
cggccugcgggcgccggcugc

SEQ ID NO: 913251 - RNA, 22 nt, Mycobacterium avium subsp. paratuberculosis
cggccugcgggcgccggcugcc

SEQ ID NO: 913252 - RNA, 23 nt, Mycobacterium avium subsp. paratuberculosis
cggccugcgggcgccggcugccc

SEQ ID NO: 913253 - RNA, 16 nt, Mycobacterium avium subsp. paratuberculosis
cggccugcgggcgccg

SEQ ID NO: 913254 - RNA, 15 nt, Mycobacterium avium subsp. paratuberculosis
cggccugcgggcgcc

SEQ ID NO: 913255 - RNA, 13 nt, Mycobacterium avium subsp. paratuberculosis
cggccugcggcgg

SEQ ID NO: 913256 - RNA, 14 nt, Mycobacterium avium subsp. paratuberculosis
cggccugcggcggc

SEQ ID NO: 913257 - RNA, 14 nt, Mycobacterium avium subsp. paratuberculosis
cggccugcgcgucg

SEQ ID NO: 913258 - RNA, 16 nt, Mycobacterium avium subsp. paratuberculosis
cggccugcgcgucguc

SEQ ID NO: 913259 - RNA, 17 nt, Mycobacterium avium subsp. paratuberculosis
cggccugcgcgucgucg

SEQ ID NO: 913260 - RNA, 14 nt, Mycobacterium avium subsp. paratuberculosis
cggccugcgcccgg

SEQ ID NO: 913261 - RNA, 15 nt, Mycobacterium avium subsp. paratuberculosis
cggccugcgcccggc

SEQ ID NO: 913262 - RNA, 15 nt, Mycobacterium avium subsp. paratuberculosis
cggccucgucggcga

SEQ ID NO: 913263 - RNA, 16 nt, Mycobacterium avium subsp. paratuberculosis
cggccucgucggcgag

SEQ ID NO: 913264 - RNA, 18 nt, Mycobacterium avium subsp. paratuberculosis
cggccucgugcaaggccu

SEQ ID NO: 913265 - RNA, 14 nt, Mycobacterium avium subsp. paratuberculosis
cggccucgucgacg

SEQ ID NO: 913266 - RNA, 17 nt, Mycobacterium avium subsp. paratuberculosis
cggccucgucgacgucg

SEQ ID NO: 913267 - RNA, 21 nt, Mycobacterium avium subsp. paratuberculosis
cggccucggugcucaucagcg

SEQ ID NO: 913268 - RNA, 14 nt, Mycobacterium avium subsp. paratuberculosis
cggccucggcggcc

SEQ ID NO: 913269 - RNA, 20 nt, Mycobacterium avium subsp. paratuberculosis
cggccucggcggccgggaug

SEQ ID NO: 913270 - RNA, 12 nt, Mycobacterium avium subsp. paratuberculosis
cggccucggcgg

SEQ ID NO: 913271 - RNA, 17 nt, Mycobacterium avium subsp. paratuberculosis
cggccucggcguccgcg

SEQ ID NO: 913272 - RNA, 19 nt, Mycobacterium avium subsp. paratuberculosis
cggccucggcguccgcggc

SEQ ID NO: 913273 - RNA, 14 nt, Mycobacterium avium subsp. paratuberculosis
cggccucggcgucg

SEQ ID NO: 913274 - RNA, 16 nt, Mycobacterium avium subsp. paratuberculosis
cggccucggcaccgug

SEQ ID NO: 913275 - RNA, 18 nt, Mycobacterium avium subsp. paratuberculosis
cggccgugaucucgugcc

SEQ ID NO: 913276 - RNA, 24 nt, Mycobacterium avium subsp. paratuberculosis
cggccgugaugccgggcaaccaca

SEQ ID NO: 913277 - RNA, 17 nt, Mycobacterium avium subsp. paratuberculosis
cggccgugaugcgccgg

SEQ ID NO: 913278 - RNA, 18 nt, Mycobacterium avium subsp. paratuberculosis
cggccgugaugcgccggc

SEQ ID NO: 913279 - RNA, 19 nt, Mycobacterium avium subsp. paratuberculosis
cggccgugaugcgccggcg

SEQ ID NO: 913280 - RNA, 20 nt, Mycobacterium avium subsp. paratuberculosis
cggccgugaugcgccggcgg

SEQ ID NO: 913281 - RNA, 13 nt, Mycobacterium avium subsp. paratuberculosis
cggccgucgucgu

SEQ ID NO: 913282 - RNA, 15 nt, Mycobacterium avium subsp. paratuberculosis
cggccgucgucgugc

SEQ ID NO: 913283 - RNA, 20 nt, Mycobacterium avium subsp. paratuberculosis
cggccgucgucgugcaccac

SEQ ID NO: 913284 - RNA, 18 nt, Mycobacterium avium subsp. paratuberculosis
cggccgucuugcccggcg

SEQ ID NO: 913285 - RNA, 23 nt, Mycobacterium avium subsp. paratuberculosis
cggccgucuugcccggcgagcga

SEQ ID NO: 913286 - RNA, 14 nt, Mycobacterium avium subsp. paratuberculosis
cggccgugaaccgg

SEQ ID NO: 913287 - RNA, 20 nt, Mycobacterium avium subsp. paratuberculosis
cggccgugaaccggcguugc

SEQ ID NO: 913288 - RNA, 15 nt, Mycobacterium avium subsp. paratuberculosis
cggccgucggaucga

SEQ ID NO: 913289 - RNA, 13 nt, Mycobacterium avium subsp. paratuberculosis
cggccgucggcgc

SEQ ID NO: 913290 - RNA, 15 nt, Mycobacterium avium subsp. paratuberculosis
cggccgucggcgccg

SEQ ID NO: 913291 - RNA, 18 nt, Mycobacterium avium subsp. paratuberculosis
cggccgucggcgccgccg

SEQ ID NO: 913292 - RNA, 19 nt, Mycobacterium avium subsp. paratuberculosis
cggccgucggcgccgccga

SEQ ID NO: 913293 - RNA, 23 nt, Mycobacterium avium subsp. paratuberculosis
cggccgucggcgccgccgagccg

SEQ ID NO: 913294 - RNA, 12 nt, Mycobacterium avium subsp. paratuberculosis
cggccgucggga

SEQ ID NO: 913295 - RNA, 13 nt, Mycobacterium avium subsp. paratuberculosis
cggccgucgggaa

SEQ ID NO: 913296 - RNA, 15 nt, Mycobacterium avium subsp. paratuberculosis
cggucuuggcggcca

SEQ ID NO: 913297 - RNA, 18 nt, Mycobacterium avium subsp. paratuberculosis
cggucuuggcggccagcg

SEQ ID NO: 913298 - RNA, 13 nt, Mycobacterium avium subsp. paratuberculosis
cggucuucgaaca

SEQ ID NO: 913299 - RNA, 18 nt, Mycobacterium avium subsp. paratuberculosis
cggucuugggcucggcgc

SEQ ID NO: 913300 - RNA, 15 nt, Mycobacterium avium subsp. paratuberculosis
cggucuucucggcca

SEQ ID NO: 913301 - RNA, 20 nt, Mycobacterium avium subsp. paratuberculosis
cggucuucuuggcgggcgac

SEQ ID NO: 913302 - RNA, 18 nt, Mycobacterium avium subsp. paratuberculosis
cggucuugaagucggugu

SEQ ID NO: 913303 - RNA, 13 nt, Mycobacterium avium subsp. paratuberculosis
cggucuugcggcc

SEQ ID NO: 913304 - RNA, 15 nt, Mycobacterium avium subsp. paratuberculosis
cggucuugcggccgu

SEQ ID NO: 913305 - RNA, 16 nt, Mycobacterium avium subsp. paratuberculosis
cggucuuggacagcag

SEQ ID NO: 913306 - RNA, 20 nt, Mycobacterium avium subsp. paratuberculosis
cggucuugaucaggucgccg

SEQ ID NO: 913307 - RNA, 23 nt, Mycobacterium avium subsp. paratuberculosis
cggucuugaucaggucgccgauc

SEQ ID NO: 913308 - RNA, 14 nt, Mycobacterium avium subsp. paratuberculosis
cggugaagaucgcc

SEQ ID NO: 913309 - RNA, 19 nt, Mycobacterium avium subsp. paratuberculosis
cggugaagaucgcccgccg

SEQ ID NO: 913310 - RNA, 20 nt, Mycobacterium avium subsp. paratuberculosis
cggugaagaucgcccgccgc

SEQ ID NO: 913311 - RNA, 17 nt, Mycobacterium avium subsp. paratuberculosis
cggugaacgcgguaccg

SEQ ID NO: 913312 - RNA, 18 nt, Mycobacterium avium subsp. paratuberculosis
cggugaacgcgguaccga

SEQ ID NO: 913313 - RNA, 14 nt, Mycobacterium avium subsp. paratuberculosis
cggugaacgggccg

SEQ ID NO: 913314 - RNA, 17 nt, Mycobacterium avium subsp. paratuberculosis
cggugaacgggccgcac

SEQ ID NO: 913315 - RNA, 13 nt, Mycobacterium avium subsp. paratuberculosis
cggugaacggguc

SEQ ID NO: 913316 - RNA, 18 nt, Mycobacterium avium subsp. paratuberculosis
cggugaaauagcgcagca

SEQ ID NO: 913317 - RNA, 21 nt, Mycobacterium avium subsp. paratuberculosis
cggugaacacgaacggcgccu

SEQ ID NO: 913318 - RNA, 15 nt, Mycobacterium avium subsp. paratuberculosis
cggugaacccgccgg

SEQ ID NO: 913319 - RNA, 16 nt, Mycobacterium avium subsp. paratuberculosis
cggugaacccgccggc

SEQ ID NO: 913320 - RNA, 17 nt, Mycobacterium avium subsp. paratuberculosis
cggugaacccgccggcg

SEQ ID NO: 913321 - RNA, 19 nt, Mycobacterium avium subsp. paratuberculosis
cggugaacccgccggcgaa

SEQ ID NO: 913322 - RNA, 17 nt, Mycobacterium avium subsp. paratuberculosis
cggugaaccgcugacca

SEQ ID NO: 913323 - RNA, 21 nt, Mycobacterium avium subsp. paratuberculosis
cggugaaccgcugaccaggaa

SEQ ID NO: 913324 - RNA, 18 nt, Mycobacterium avium subsp. paratuberculosis
cggucugguacccgaugg

SEQ ID NO: 913325 - RNA, 15 nt, Mycobacterium avium subsp. paratuberculosis
cggucugguggcagc

SEQ ID NO: 913326 - RNA, 20 nt, Mycobacterium avium subsp. paratuberculosis
cggucugguggcagcggacc

SEQ ID NO: 913327 - RNA, 15 nt, Mycobacterium avium subsp. paratuberculosis
cggucuggcugguga

SEQ ID NO: 913328 - RNA, 20 nt, Mycobacterium avium subsp. paratuberculosis
cggucuggcuggugaccccg

SEQ ID NO: 913329 - RNA, 16 nt, Mycobacterium avium subsp. paratuberculosis
cggucugccuggcgaa

SEQ ID NO: 913330 - RNA, 17 nt, Mycobacterium avium subsp. paratuberculosis
cggucugggaggcggcg

SEQ ID NO: 913331 - RNA, 15 nt, Mycobacterium avium subsp. paratuberculosis
cggucugggcgaacg

SEQ ID NO: 913332 - RNA, 17 nt, Mycobacterium avium subsp. paratuberculosis
cggucugggcgaacggc

SEQ ID NO: 913333 - RNA, 21 nt, Mycobacterium avium subsp. paratuberculosis
cggucugggcgaacggcaacg

SEQ ID NO: 913334 - RNA, 15 nt, Mycobacterium avium subsp. paratuberculosis
cggucugggcgacca

SEQ ID NO: 913335 - RNA, 14 nt, Mycobacterium avium subsp. paratuberculosis
cggucugucgcgcg

SEQ ID NO: 913336 - RNA, 16 nt, Mycobacterium avium subsp. paratuberculosis
cggucugucgcgcgaa

SEQ ID NO: 913337 - RNA, 17 nt, Mycobacterium avium subsp. paratuberculosis
cggucugucgcgcgaac

SEQ ID NO: 913338 - RNA, 16 nt, Mycobacterium avium subsp. paratuberculosis
cggucuucccgccgcc

SEQ ID NO: 913339 - RNA, 17 nt, Mycobacterium avium subsp. paratuberculosis
cggucuucccgccgccg

SEQ ID NO: 913340 - RNA, 18 nt, Mycobacterium avium subsp. paratuberculosis
cggucuucccgccgccgu

SEQ ID NO: 913341 - RNA, 17 nt, Mycobacterium avium subsp. paratuberculosis
cggucugagcccggauu

SEQ ID NO: 913342 - RNA, 15 nt, Mycobacterium avium subsp. paratuberculosis
cggucugaucgccca

SEQ ID NO: 913343 - RNA, 22 nt, Mycobacterium avium subsp. paratuberculosis
cggucugaucgcccagcaccgc

SEQ ID NO: 913344 - RNA, 17 nt, Mycobacterium avium subsp. paratuberculosis
cggucugcaccgggaug

SEQ ID NO: 913345 - RNA, 22 nt, Mycobacterium avium subsp. paratuberculosis
cggucugcgccagcuccagcag

SEQ ID NO: 913346 - RNA, 15 nt, Mycobacterium avium subsp. paratuberculosis
cggucugcgcccgau

SEQ ID NO: 913347 - RNA, 14 nt, Mycobacterium avium subsp. paratuberculosis
cggucugcggccgc

SEQ ID NO: 913348 - RNA, 15 nt, Mycobacterium avium subsp. paratuberculosis
cggucugcggccgcg

SEQ ID NO: 913349 - RNA, 18 nt, Mycobacterium avium subsp. paratuberculosis
cggucugcggccgcgacu

SEQ ID NO: 913350 - RNA, 20 nt, Mycobacterium avium subsp. paratuberculosis
cggucugcggccgcgacugc

SEQ ID NO: 913351 - RNA, 18 nt, Mycobacterium avium subsp. paratuberculosis
cggucugcggugcgccca

SEQ ID NO: 913352 - RNA, 19 nt, Mycobacterium avium subsp. paratuberculosis
cggucugcggugcgcccag

SEQ ID NO: 913353 - RNA, 22 nt, Mycobacterium avium subsp. paratuberculosis
cggucuccaugucgucggcgga

SEQ ID NO: 913354 - RNA, 21 nt, Mycobacterium avium subsp. paratuberculosis
cggucucgacaccggcgguca

SEQ ID NO: 913355 - RNA, 14 nt, Mycobacterium avium subsp. paratuberculosis
cggucucgaccgcg

SEQ ID NO: 913356 - RNA, 18 nt, Mycobacterium avium subsp. paratuberculosis
cggucucgaccgcggcgc

SEQ ID NO: 913357 - RNA, 14 nt, Mycobacterium avium subsp. paratuberculosis
cggucucuggccug

SEQ ID NO: 913358 - RNA, 15 nt, Mycobacterium avium subsp. paratuberculosis
cggucucuucgaccc

SEQ ID NO: 913359 - RNA, 17 nt, Mycobacterium avium subsp. paratuberculosis
cggucucggcggcgccc

SEQ ID NO: 913360 - RNA, 15 nt, Mycobacterium avium subsp. paratuberculosis
cggucucggucgcgg

SEQ ID NO: 913361 - RNA, 17 nt, Mycobacterium avium subsp. paratuberculosis
cggucucgaucugcacc

SEQ ID NO: 913362 - RNA, 19 nt, Mycobacterium avium subsp. paratuberculosis
cggucucgaucugcaccag

SEQ ID NO: 913363 - RNA, 17 nt, Mycobacterium avium subsp. paratuberculosis
cggucucgccccggccg

SEQ ID NO: 913364 - RNA, 18 nt, Mycobacterium avium subsp. paratuberculosis
cggucucgccccggccgu

SEQ ID NO: 913365 - RNA, 21 nt, Mycobacterium avium subsp. paratuberculosis
cggucguuucggccggccccg

SEQ ID NO: 913366 - RNA, 16 nt, Mycobacterium avium subsp. paratuberculosis
cggucguuggccuccu

SEQ ID NO: 913367 - RNA, 23 nt, Mycobacterium avium subsp. paratuberculosis
cggucgugucagggaugccccgu

SEQ ID NO: 913368 - RNA, 15 nt, Mycobacterium avium subsp. paratuberculosis
cggucgugcggcugc

SEQ ID NO: 913369 - RNA, 17 nt, Mycobacterium avium subsp. paratuberculosis
cggucgugcggcugccc

SEQ ID NO: 913370 - RNA, 17 nt, Mycobacterium avium subsp. paratuberculosis
cggucgugcugggccgg

SEQ ID NO: 913371 - RNA, 19 nt, Mycobacterium avium subsp. paratuberculosis
cggucgugcugggccgggc

SEQ ID NO: 913372 - RNA, 21 nt, Mycobacterium avium subsp. paratuberculosis
cggucgugcugggccgggcgg

SEQ ID NO: 913373 - RNA, 20 nt, Mycobacterium avium subsp. paratuberculosis
cggucgucuucuuggccgcg

SEQ ID NO: 913374 - RNA, 21 nt, Mycobacterium avium subsp. paratuberculosis
cggucgucuucuuggccgcgg

SEQ ID NO: 913375 - RNA, 15 nt, Mycobacterium avium subsp. paratuberculosis
cggucgucgagcacc

SEQ ID NO: 913376 - RNA, 16 nt, Mycobacterium avium subsp. paratuberculosis
cggucgucgagcaccg

SEQ ID NO: 913377 - RNA, 17 nt, Mycobacterium avium subsp. paratuberculosis
cggucgucgagcaccgg

SEQ ID NO: 913378 - RNA, 18 nt, Mycobacterium avium subsp. paratuberculosis
cggucgucgagcaccggc

SEQ ID NO: 913379 - RNA, 13 nt, Mycobacterium avium subsp. paratuberculosis
cggucgucgccca

SEQ ID NO: 913380 - RNA, 16 nt, Mycobacterium avium subsp. paratuberculosis
cggucgucgcccaccg

SEQ ID NO: 913381 - RNA, 22 nt, Mycobacterium avium subsp. paratuberculosis
cggucgucgcccaccgacgcgg

SEQ ID NO: 913382 - RNA, 23 nt, Mycobacterium avium subsp. paratuberculosis
cggucgucgcccaccgacgcggc

SEQ ID NO: 913383 - RNA, 12 nt, Mycobacterium avium subsp. paratuberculosis
cggucgucgccg

SEQ ID NO: 913384 - RNA, 13 nt, Mycobacterium avium subsp. paratuberculosis
cggucgucgccgg

SEQ ID NO: 913385 - RNA, 16 nt, Mycobacterium avium subsp. paratuberculosis
cggucgucgccggaug

SEQ ID NO: 913386 - RNA, 19 nt, Mycobacterium avium subsp. paratuberculosis
cggucgucgucgucgguga

SEQ ID NO: 913387 - RNA, 14 nt, Mycobacterium avium subsp. paratuberculosis
cggucggggcggcg

SEQ ID NO: 913388 - RNA, 15 nt, Mycobacterium avium subsp. paratuberculosis
cggucggggcggcgg

SEQ ID NO: 913389 - RNA, 17 nt, Mycobacterium avium subsp. paratuberculosis
cggucggggcggcgggc

SEQ ID NO: 913390 - RNA, 20 nt, Mycobacterium avium subsp. paratuberculosis
cggucggggcggcgggcgaa

SEQ ID NO: 913391 - RNA, 13 nt, Mycobacterium avium subsp. paratuberculosis
cggucgggcgauc

SEQ ID NO: 913392 - RNA, 15 nt, Mycobacterium avium subsp. paratuberculosis
cggucgggcgauccg

SEQ ID NO: 913393 - RNA, 18 nt, Mycobacterium avium subsp. paratuberculosis
cggucggggaauuccggc

SEQ ID NO: 913394 - RNA, 21 nt, Mycobacterium avium subsp. paratuberculosis
cggucggggaauuccggcgcg

SEQ ID NO: 913395 - RNA, 18 nt, Mycobacterium avium subsp. paratuberculosis
cggucgggaucgaucccg

SEQ ID NO: 913396 - RNA, 23 nt, Mycobacterium avium subsp. paratuberculosis
cggucgggaucgaucccgucggc

SEQ ID NO: 913397 - RNA, 18 nt, Mycobacterium avium subsp. paratuberculosis
cggucgggaucggugaag

SEQ ID NO: 913398 - RNA, 20 nt, Mycobacterium avium subsp. paratuberculosis
cggucgggaucugcggugag

SEQ ID NO: 913399 - RNA, 12 nt, Mycobacterium avium subsp. paratuberculosis
cggucgggaugg

SEQ ID NO: 913400 - RNA, 12 nt, Mycobacterium avium subsp. paratuberculosis
cggucggcgguu

SEQ ID NO: 913401 - RNA, 14 nt, Mycobacterium avium subsp. paratuberculosis
cggucggcgguucg

SEQ ID NO: 913402 - RNA, 15 nt, Mycobacterium avium subsp. paratuberculosis
cggucggcguccagc

SEQ ID NO: 913403 - RNA, 17 nt, Mycobacterium avium subsp. paratuberculosis
cggucggcguccagcgc

SEQ ID NO: 913404 - RNA, 18 nt, Mycobacterium avium subsp. paratuberculosis
cggucggcguccagcgcg

SEQ ID NO: 913405 - RNA, 12 nt, Mycobacterium avium subsp. paratuberculosis
cggucggcgucg

SEQ ID NO: 913406 - RNA, 15 nt, Mycobacterium avium subsp. paratuberculosis
cggucggcgucgaag

SEQ ID NO: 913407 - RNA, 14 nt, Mycobacterium avium subsp. paratuberculosis
cggucggcgacgua

SEQ ID NO: 913408 - RNA, 16 nt, Mycobacterium avium subsp. paratuberculosis
cggucggcggaggcga

SEQ ID NO: 913409 - RNA, 12 nt, Mycobacterium avium subsp. paratuberculosis
cggucggcggcg

SEQ ID NO: 913410 - RNA, 18 nt, Mycobacterium avium subsp. paratuberculosis
cggucggcgucguacagc

SEQ ID NO: 913411 - RNA, 22 nt, Mycobacterium avium subsp. paratuberculosis
cggucggcgucguacagcagcc

SEQ ID NO: 913412 - RNA, 22 nt, Mycobacterium avium subsp. paratuberculosis
cggucggugcccagcaccgccg

SEQ ID NO: 913413 - RNA, 16 nt, Mycobacterium avium subsp. paratuberculosis
cggucggugcgcagca

SEQ ID NO: 913414 - RNA, 13 nt, Mycobacterium avium subsp. paratuberculosis
cggucgguggcgg

SEQ ID NO: 913415 - RNA, 16 nt, Mycobacterium avium subsp. paratuberculosis
cggucgguggcggugc

SEQ ID NO: 913416 - RNA, 19 nt, Mycobacterium avium subsp. paratuberculosis
cggucgguggcggugccgc

SEQ ID NO: 913417 - RNA, 19 nt, Mycobacterium avium subsp. paratuberculosis
cggucgguucauccacucg

SEQ ID NO: 913418 - RNA, 18 nt, Mycobacterium avium subsp. paratuberculosis
cggucgggcagugcacga

SEQ ID NO: 913419 - RNA, 12 nt, Mycobacterium avium subsp. paratuberculosis
cggucgggccaa

SEQ ID NO: 913420 - RNA, 23 nt, Mycobacterium avium subsp. paratuberculosis
cggucgggucccggcaacaccgg

SEQ ID NO: 913421 - RNA, 16 nt, Mycobacterium avium subsp. paratuberculosis
cggucggucagcuggu

SEQ ID NO: 913422 - RNA, 20 nt, Mycobacterium avium subsp. paratuberculosis
cggucggucagucgcgccgc

SEQ ID NO: 913423 - RNA, 23 nt, Mycobacterium avium subsp. paratuberculosis
cggucggugagcuggccgcgcag

SEQ ID NO: 913424 - RNA, 20 nt, Mycobacterium avium subsp. paratuberculosis
cggucguaguaggugcgcga

SEQ ID NO: 913425 - RNA, 20 nt, Mycobacterium avium subsp. paratuberculosis
cggucguagucggcccgccg

SEQ ID NO: 913426 - RNA, 21 nt, Mycobacterium avium subsp. paratuberculosis
cggucguagucggcccgccgg

SEQ ID NO: 913427 - RNA, 15 nt, Mycobacterium avium subsp. paratuberculosis
cggucgccgguguga

SEQ ID NO: 913428 - RNA, 15 nt, Mycobacterium avium subsp. paratuberculosis
cggucgcugaccccg

SEQ ID NO: 913429 - RNA, 17 nt, Mycobacterium avium subsp. paratuberculosis
cggucgcugaccccgcu

SEQ ID NO: 913430 - RNA, 15 nt, Mycobacterium avium subsp. paratuberculosis
cggucgcugacccgc

SEQ ID NO: 913431 - RNA, 14 nt, Mycobacterium avium subsp. paratuberculosis
cggucgcugcagcg

SEQ ID NO: 913432 - RNA, 16 nt, Mycobacterium avium subsp. paratuberculosis
cggucgcugcagcggc

SEQ ID NO: 913433 - RNA, 20 nt, Mycobacterium avium subsp. paratuberculosis
cggucgcugcagcggcggcc

SEQ ID NO: 913434 - RNA, 21 nt, Mycobacterium avium subsp. paratuberculosis
cggucgcugcagcggcggcca

SEQ ID NO: 913435 - RNA, 11 nt, Mycobacterium avium subsp. paratuberculosis
cggucgcugcg

SEQ ID NO: 913436 - RNA, 15 nt, Mycobacterium avium subsp. paratuberculosis
cggucgcgucgucgg

SEQ ID NO: 913437 - RNA, 17 nt, Mycobacterium avium subsp. paratuberculosis
cggucgcgucgucggcg

SEQ ID NO: 913438 - RNA, 16 nt, Mycobacterium avium subsp. paratuberculosis
cggucgcgucgugcgg

SEQ ID NO: 913439 - RNA, 16 nt, Mycobacterium avium subsp. paratuberculosis
cggucgcgugaccggc

SEQ ID NO: 913440 - RNA, 17 nt, Mycobacterium avium subsp. paratuberculosis
cggucgcgugaccggcg

SEQ ID NO: 913441 - RNA, 18 nt, Mycobacterium avium subsp. paratuberculosis
cggucgcgugaccggcgg

SEQ ID NO: 913442 - RNA, 19 nt, Mycobacterium avium subsp. paratuberculosis
cggucgcgugaccggcggu

SEQ ID NO: 913443 - RNA, 20 nt, Mycobacterium avium subsp. paratuberculosis
cggucgcgugaccggcggug

SEQ ID NO: 913444 - RNA, 22 nt, Mycobacterium avium subsp. paratuberculosis
cggucgcgugaccggcggugcg

SEQ ID NO: 913445 - RNA, 23 nt, Mycobacterium avium subsp. paratuberculosis
cggucgcguugaaagccgcgaac

SEQ ID NO: 913446 - RNA, 14 nt, Mycobacterium avium subsp. paratuberculosis
cggucgcggcaucc

SEQ ID NO: 913447 - RNA, 21 nt, Mycobacterium avium subsp. paratuberculosis
cggucgcggcaucccugguga

SEQ ID NO: 913448 - RNA, 14 nt, Mycobacterium avium subsp. paratuberculosis
cggucgcggcgauc

SEQ ID NO: 913449 - RNA, 15 nt, Mycobacterium avium subsp. paratuberculosis
cggucgcggcgaucg

SEQ ID NO: 913450 - RNA, 14 nt, Mycobacterium avium subsp. paratuberculosis
cggucgcggcgccg

SEQ ID NO: 913451 - RNA, 17 nt, Mycobacterium avium subsp. paratuberculosis
cggucgcggaaccggcc

SEQ ID NO: 913452 - RNA, 22 nt, Mycobacterium avium subsp. paratuberculosis
cggucgcggaaccggccggggc

SEQ ID NO: 913453 - RNA, 21 nt, Mycobacterium avium subsp. paratuberculosis
cggucgccugcuucuggaugc

SEQ ID NO: 913454 - RNA, 22 nt, Mycobacterium avium subsp. paratuberculosis
cggucgcgccagacguccagcg

SEQ ID NO: 913455 - RNA, 12 nt, Mycobacterium avium subsp. paratuberculosis
cggucgcgcgcc

SEQ ID NO: 913456 - RNA, 13 nt, Mycobacterium avium subsp. paratuberculosis
cggucgcgcgccg

SEQ ID NO: 913457 - RNA, 14 nt, Mycobacterium avium subsp. paratuberculosis
cggucgcgcgccgg

SEQ ID NO: 913458 - RNA, 13 nt, Mycobacterium avium subsp. paratuberculosis
cggucgcggcguc

SEQ ID NO: 913459 - RNA, 14 nt, Mycobacterium avium subsp. paratuberculosis
cggucgcggcgucg

SEQ ID NO: 913460 - RNA, 15 nt, Mycobacterium avium subsp. paratuberculosis
cggucgcggcgucgc

SEQ ID NO: 913461 - RNA, 18 nt, Mycobacterium avium subsp. paratuberculosis
cggucgcggcgucgcggu

SEQ ID NO: 913462 - RNA, 14 nt, Mycobacterium avium subsp. paratuberculosis
cggucgcgggacaa

SEQ ID NO: 913463 - RNA, 14 nt, Mycobacterium avium subsp. paratuberculosis
cggucgcggucggc

SEQ ID NO: 913464 - RNA, 15 nt, Mycobacterium avium subsp. paratuberculosis
cggucgcggucggcg

SEQ ID NO: 913465 - RNA, 21 nt, Mycobacterium avium subsp. paratuberculosis
cggucgcggucggcgcccggc

SEQ ID NO: 913466 - RNA, 22 nt, Mycobacterium avium subsp. paratuberculosis
cggucgcggugaucaggcccuc

SEQ ID NO: 913467 - RNA, 23 nt, Mycobacterium avium subsp. paratuberculosis
cggucgcggugaucaggcccucg

SEQ ID NO: 913468 - RNA, 14 nt, Mycobacterium avium subsp. paratuberculosis
cggucgcggugccc

SEQ ID NO: 913469 - RNA, 19 nt, Mycobacterium avium subsp. paratuberculosis
cggucgcggugcccagccg

SEQ ID NO: 913470 - RNA, 12 nt, Mycobacterium avium subsp. paratuberculosis
cggucgcggugu

SEQ ID NO: 913471 - RNA, 23 nt, Mycobacterium avium subsp. paratuberculosis
cggucgcggugucggcgucgauc

SEQ ID NO: 913472 - RNA, 13 nt, Mycobacterium avium subsp. paratuberculosis
cggucggccccgc

SEQ ID NO: 913473 - RNA, 18 nt, Mycobacterium avium subsp. paratuberculosis
cggucggccccgcgcauc

SEQ ID NO: 913474 - RNA, 23 nt, Mycobacterium avium subsp. paratuberculosis
cggucggcccgcugcggcuggga

SEQ ID NO: 913475 - RNA, 13 nt, Mycobacterium avium subsp. paratuberculosis
cggucggccgcgu

SEQ ID NO: 913476 - RNA, 15 nt, Mycobacterium avium subsp. paratuberculosis
cggucggccguacac

SEQ ID NO: 913477 - RNA, 15 nt, Mycobacterium avium subsp. paratuberculosis
cggucggcgcccggc

SEQ ID NO: 913478 - RNA, 13 nt, Mycobacterium avium subsp. paratuberculosis
cggucggcgccga

SEQ ID NO: 913479 - RNA, 14 nt, Mycobacterium avium subsp. paratuberculosis
cggucggcgccgau

SEQ ID NO: 913480 - RNA, 15 nt, Mycobacterium avium subsp. paratuberculosis
cggucggcgccgauc

SEQ ID NO: 913481 - RNA, 18 nt, Mycobacterium avium subsp. paratuberculosis
cggucggcgccgaucacg

SEQ ID NO: 913482 - RNA, 12 nt, Mycobacterium avium subsp. paratuberculosis
cggucggcgcgg

SEQ ID NO: 913483 - RNA, 14 nt, Mycobacterium avium subsp. paratuberculosis
cggucggcgcgggg

SEQ ID NO: 913484 - RNA, 17 nt, Mycobacterium avium subsp. paratuberculosis
cggucggagcccagcgu

SEQ ID NO: 913485 - RNA, 15 nt, Mycobacterium avium subsp. paratuberculosis
cggucggacgcgggg

SEQ ID NO: 913486 - RNA, 20 nt, Mycobacterium avium subsp. paratuberculosis
cggucggcaggauccggacg

SEQ ID NO: 913487 - RNA, 19 nt, Mycobacterium avium subsp. paratuberculosis
cggucggcauagcgccgcu

SEQ ID NO: 913488 - RNA, 22 nt, Mycobacterium avium subsp. paratuberculosis
cggucgcacuugaagcugaagc

SEQ ID NO: 913489 - RNA, 12 nt, Mycobacterium avium subsp. paratuberculosis
cggucgcaggcc

SEQ ID NO: 913490 - RNA, 15 nt, Mycobacterium avium subsp. paratuberculosis
cggucgcaggccgcc

SEQ ID NO: 913491 - RNA, 17 nt, Mycobacterium avium subsp. paratuberculosis
cggucgcaggccgcccg

SEQ ID NO: 913492 - RNA, 22 nt, Mycobacterium avium subsp. paratuberculosis
cggucgcaggcgagccgguugg

SEQ ID NO: 913493 - RNA, 14 nt, Mycobacterium avium subsp. paratuberculosis
cggucgccaccacc

SEQ ID NO: 913494 - RNA, 23 nt, Mycobacterium avium subsp. paratuberculosis
cggucgccaccaccacggggcgg

SEQ ID NO: 913495 - RNA, 15 nt, Mycobacterium avium subsp. paratuberculosis
cggucgaugacgccg

SEQ ID NO: 913496 - RNA, 22 nt, Mycobacterium avium subsp. paratuberculosis
cggucgaugacgccgcgccgcc

SEQ ID NO: 913497 - RNA, 23 nt, Mycobacterium avium subsp. paratuberculosis
cggucgaugacgccgcgccgccc

SEQ ID NO: 913498 - RNA, 12 nt, Mycobacterium avium subsp. paratuberculosis
cggucgaugagc

SEQ ID NO: 913499 - RNA, 18 nt, Mycobacterium avium subsp. paratuberculosis
cggucgaugagcuggugc

SEQ ID NO: 913500 - RNA, 20 nt, Mycobacterium avium subsp. paratuberculosis
cggucgaugagcuggugcag

SEQ ID NO: 913501 - RNA, 18 nt, Mycobacterium avium subsp. paratuberculosis
cggucgaugaucuggcgg

SEQ ID NO: 913502 - RNA, 17 nt, Mycobacterium avium subsp. paratuberculosis
cggucgaugucggcgaa

SEQ ID NO: 913503 - RNA, 17 nt, Mycobacterium avium subsp. paratuberculosis
cggucgaugugcgcgcu

SEQ ID NO: 913504 - RNA, 14 nt, Mycobacterium avium subsp. paratuberculosis
cggucgcaccgcgg

SEQ ID NO: 913505 - RNA, 15 nt, Mycobacterium avium subsp. paratuberculosis
cggucgcaccgcggc

SEQ ID NO: 913506 - RNA, 20 nt, Mycobacterium avium subsp. paratuberculosis
cggucgcaccgcggcgugga

SEQ ID NO: 913507 - RNA, 15 nt, Mycobacterium avium subsp. paratuberculosis
cggucgaucaacacc

SEQ ID NO: 913508 - RNA, 21 nt, Mycobacterium avium subsp. paratuberculosis
cggucgaucaacaccaacgac

SEQ ID NO: 913509 - RNA, 17 nt, Mycobacterium avium subsp. paratuberculosis
cggucgaucaccucguc

SEQ ID NO: 913510 - RNA, 19 nt, Mycobacterium avium subsp. paratuberculosis
cggucgaucaccucgucga

SEQ ID NO: 913511 - RNA, 14 nt, Mycobacterium avium subsp. paratuberculosis
cggucgagucguag

SEQ ID NO: 913512 - RNA, 15 nt, Mycobacterium avium subsp. paratuberculosis
cggucgagucguaga

SEQ ID NO: 913513 - RNA, 16 nt, Mycobacterium avium subsp. paratuberculosis
cggucgaggucgccga

SEQ ID NO: 913514 - RNA, 17 nt, Mycobacterium avium subsp. paratuberculosis
cggucgaggucgccgac

SEQ ID NO: 913515 - RNA, 19 nt, Mycobacterium avium subsp. paratuberculosis
cggucgaggucgccgacag

SEQ ID NO: 913516 - RNA, 20 nt, Mycobacterium avium subsp. paratuberculosis
cggucgaggucgccgacagc

SEQ ID NO: 913517 - RNA, 15 nt, Mycobacterium avium subsp. paratuberculosis
cggucgaggucggcc

SEQ ID NO: 913518 - RNA, 18 nt, Mycobacterium avium subsp. paratuberculosis
cggucgaggucggccagc

SEQ ID NO: 913519 - RNA, 21 nt, Mycobacterium avium subsp. paratuberculosis
cggucgaggucggccagcagg

SEQ ID NO: 913520 - RNA, 15 nt, Mycobacterium avium subsp. paratuberculosis
cggucgcgacccggu

SEQ ID NO: 913521 - RNA, 12 nt, Mycobacterium avium subsp. paratuberculosis
cggucgcgcagc

SEQ ID NO: 913522 - RNA, 15 nt, Mycobacterium avium subsp. paratuberculosis
cggucgcgcagccgc

SEQ ID NO: 913523 - RNA, 18 nt, Mycobacterium avium subsp. paratuberculosis
cggucgcgcagccgccgg

SEQ ID NO: 913524 - RNA, 21 nt, Mycobacterium avium subsp. paratuberculosis
cggucgcgcagccgggcggcg

SEQ ID NO: 913525 - RNA, 23 nt, Mycobacterium avium subsp. paratuberculosis
cggucgcgcaucgccucggcggc

SEQ ID NO: 913526 - RNA, 13 nt, Mycobacterium avium subsp. paratuberculosis
cggucgccggcuu

SEQ ID NO: 913527 - RNA, 21 nt, Mycobacterium avium subsp. paratuberculosis
cggucgccggcuuaccgaccu

SEQ ID NO: 913528 - RNA, 15 nt, Mycobacterium avium subsp. paratuberculosis
cggucgccgggccgg

SEQ ID NO: 913529 - RNA, 19 nt, Mycobacterium avium subsp. paratuberculosis
cggucgccgggccggccgg

SEQ ID NO: 913530 - RNA, 20 nt, Mycobacterium avium subsp. paratuberculosis
cggucgccgggccggccggu

SEQ ID NO: 913531 - RNA, 18 nt, Mycobacterium avium subsp. paratuberculosis
cggucgccgacguagacg

SEQ ID NO: 913532 - RNA, 15 nt, Mycobacterium avium subsp. paratuberculosis
cggucgccgcgccgc

SEQ ID NO: 913533 - RNA, 16 nt, Mycobacterium avium subsp. paratuberculosis
cggucgccgcgccgcc

SEQ ID NO: 913534 - RNA, 18 nt, Mycobacterium avium subsp. paratuberculosis
cggucgccgcgccgccgg

SEQ ID NO: 913535 - RNA, 13 nt, Mycobacterium avium subsp. paratuberculosis
cggucgccgaugg

SEQ ID NO: 913536 - RNA, 19 nt, Mycobacterium avium subsp. paratuberculosis
cggucgccgauggugacgg

SEQ ID NO: 913537 - RNA, 14 nt, Mycobacterium avium subsp. paratuberculosis
cggucgccgcccac

SEQ ID NO: 913538 - RNA, 23 nt, Mycobacterium avium subsp. paratuberculosis
cggucgccgcccacgccgugcag

SEQ ID NO: 913539 - RNA, 19 nt, Mycobacterium avium subsp. paratuberculosis
cggucgccgaauccggcgg

SEQ ID NO: 913540 - RNA, 20 nt, Mycobacterium avium subsp. paratuberculosis
cggucgccgaauccggcggg

SEQ ID NO: 913541 - RNA, 16 nt, Mycobacterium avium subsp. paratuberculosis
cggucgcccccucggc

SEQ ID NO: 913542 - RNA, 18 nt, Mycobacterium avium subsp. paratuberculosis
cggucgcccccucggccg

SEQ ID NO: 913543 - RNA, 21 nt, Mycobacterium avium subsp. paratuberculosis
cggucgcccccucggccgguc

SEQ ID NO: 913544 - RNA, 23 nt, Mycobacterium avium subsp. paratuberculosis
cggucgcccccucggccgguccg

SEQ ID NO: 913545 - RNA, 24 nt, Mycobacterium avium subsp. paratuberculosis
cggucgcccccucggccgguccga

SEQ ID NO: 913546 - RNA, 16 nt, Mycobacterium avium subsp. paratuberculosis
cggucgccccggccgc

SEQ ID NO: 913547 - RNA, 18 nt, Mycobacterium avium subsp. paratuberculosis
cggucgccccggccgcgg

SEQ ID NO: 913548 - RNA, 20 nt, Mycobacterium avium subsp. paratuberculosis
cggucgccccggccgcggug

SEQ ID NO: 913549 - RNA, 16 nt, Mycobacterium avium subsp. paratuberculosis
cggucgccacggccgg

SEQ ID NO: 913550 - RNA, 17 nt, Mycobacterium avium subsp. paratuberculosis
cggucgccacggccggc

SEQ ID NO: 913551 - RNA, 20 nt, Mycobacterium avium subsp. paratuberculosis
cggucgccacggccggcagc

SEQ ID NO: 913552 - RNA, 18 nt, Mycobacterium avium subsp. paratuberculosis
cggucgccacucgggcgg

SEQ ID NO: 913553 - RNA, 12 nt, Mycobacterium avium subsp. paratuberculosis
cggucgccagca

SEQ ID NO: 913554 - RNA, 14 nt, Mycobacterium avium subsp. paratuberculosis
cggucgccagcacc

SEQ ID NO: 913555 - RNA, 15 nt, Mycobacterium avium subsp. paratuberculosis
cggucgccagcaccg

SEQ ID NO: 913556 - RNA, 17 nt, Mycobacterium avium subsp. paratuberculosis
cggucgccagcaccgug

SEQ ID NO: 913557 - RNA, 16 nt, Mycobacterium avium subsp. paratuberculosis
cggucgccagcgccac

SEQ ID NO: 913558 - RNA, 16 nt, Mycobacterium avium subsp. paratuberculosis
cgguagcgguccucga

SEQ ID NO: 913559 - RNA, 18 nt, Mycobacterium avium subsp. paratuberculosis
cgguagcgguccucgaac

SEQ ID NO: 913560 - RNA, 12 nt, Mycobacterium avium subsp. paratuberculosis
cgguagcgacac

SEQ ID NO: 913561 - RNA, 14 nt, Mycobacterium avium subsp. paratuberculosis
cgguagcgcagcac

SEQ ID NO: 913562 - RNA, 22 nt, Mycobacterium avium subsp. paratuberculosis
cgguagcggcagauggucucga

SEQ ID NO: 913563 - RNA, 19 nt, Mycobacterium avium subsp. paratuberculosis
cgguagcgcucgucguagu

SEQ ID NO: 913564 - RNA, 21 nt, Mycobacterium avium subsp. paratuberculosis
cgguaccagggcagcgccucg

SEQ ID NO: 913565 - RNA, 19 nt, Mycobacterium avium subsp. paratuberculosis
cgguagccgcucgcccagc

SEQ ID NO: 913566 - RNA, 14 nt, Mycobacterium avium subsp. paratuberculosis
cgguacaggcccca

SEQ ID NO: 913567 - RNA, 18 nt, Mycobacterium avium subsp. paratuberculosis
cgguacaggccccacgcg

SEQ ID NO: 913568 - RNA, 17 nt, Mycobacterium avium subsp. paratuberculosis
cgguaaugggcgaucga

SEQ ID NO: 913569 - RNA, 16 nt, Mycobacterium avium subsp. paratuberculosis
cgguacaucccgccgg

SEQ ID NO: 913570 - RNA, 15 nt, Mycobacterium avium subsp. paratuberculosis
cgguacaucgacgcg

SEQ ID NO: 913571 - RNA, 20 nt, Mycobacterium avium subsp. paratuberculosis
cgguacaucgacgcgaccgg

SEQ ID NO: 913572 - RNA, 21 nt, Mycobacterium avium subsp. paratuberculosis
cgguacaucgacgcgaccggc

SEQ ID NO: 913573 - RNA, 16 nt, Mycobacterium avium subsp. paratuberculosis
cgguaccacgccgucg

SEQ ID NO: 913574 - RNA, 18 nt, Mycobacterium avium subsp. paratuberculosis
cggucagcaggcgccgca

SEQ ID NO: 913575 - RNA, 20 nt, Mycobacterium avium subsp. paratuberculosis
cggucagcaggcgccgcagc

SEQ ID NO: 913576 - RNA, 13 nt, Mycobacterium avium subsp. paratuberculosis
cgguaggccgccg

SEQ ID NO: 913577 - RNA, 13 nt, Mycobacterium avium subsp. paratuberculosis
cgguaggccgcgc

SEQ ID NO: 913578 - RNA, 22 nt, Mycobacterium avium subsp. paratuberculosis
cggucagcaccgcgcggcggug

SEQ ID NO: 913579 - RNA, 18 nt, Mycobacterium avium subsp. paratuberculosis
cggucagcaccggggcca

SEQ ID NO: 913580 - RNA, 22 nt, Mycobacterium avium subsp. paratuberculosis
cggucagcccgcccuuggccgc

SEQ ID NO: 913581 - RNA, 20 nt, Mycobacterium avium subsp. paratuberculosis
cggucagcauggcgaugacg

SEQ ID NO: 913582 - RNA, 21 nt, Mycobacterium avium subsp. paratuberculosis
cggucagcauggcgaugacgu

SEQ ID NO: 913583 - RNA, 15 nt, Mycobacterium avium subsp. paratuberculosis
cggucagccgggcgg

SEQ ID NO: 913584 - RNA, 21 nt, Mycobacterium avium subsp. paratuberculosis
cggucagccgggcggccucgu

SEQ ID NO: 913585 - RNA, 20 nt, Mycobacterium avium subsp. paratuberculosis
cggucagcgcgacaucgccg

SEQ ID NO: 913586 - RNA, 22 nt, Mycobacterium avium subsp. paratuberculosis
cggucagcgcgacaucgccggc

SEQ ID NO: 913587 - RNA, 13 nt, Mycobacterium avium subsp. paratuberculosis
cggucagcgcgcc

SEQ ID NO: 913588 - RNA, 14 nt, Mycobacterium avium subsp. paratuberculosis
cggucagcgcgccg

SEQ ID NO: 913589 - RNA, 18 nt, Mycobacterium avium subsp. paratuberculosis
cggucagcgcgccgucgg

SEQ ID NO: 913590 - RNA, 19 nt, Mycobacterium avium subsp. paratuberculosis
cggucagcgcuacugccgc

SEQ ID NO: 913591 - RNA, 16 nt, Mycobacterium avium subsp. paratuberculosis
cggucagcgcguaguc

SEQ ID NO: 913592 - RNA, 15 nt, Mycobacterium avium subsp. paratuberculosis
cggucagcgcgucgg

SEQ ID NO: 913593 - RNA, 17 nt, Mycobacterium avium subsp. paratuberculosis
cggucagcgcgucggcg

SEQ ID NO: 913594 - RNA, 18 nt, Mycobacterium avium subsp. paratuberculosis
cggucagcgcgucggcga

SEQ ID NO: 913595 - RNA, 20 nt, Mycobacterium avium subsp. paratuberculosis
cggucagcgcgucggcgacc

SEQ ID NO: 913596 - RNA, 22 nt, Mycobacterium avium subsp. paratuberculosis
cggucagcgcgucggcgaccgc

SEQ ID NO: 913597 - RNA, 14 nt, Mycobacterium avium subsp. paratuberculosis
cggucagcggccag

SEQ ID NO: 913598 - RNA, 15 nt, Mycobacterium avium subsp. paratuberculosis
cggucagcggccagc

SEQ ID NO: 913599 - RNA, 18 nt, Mycobacterium avium subsp. paratuberculosis
cggucagcggccagccca

SEQ ID NO: 913600 - RNA, 12 nt, Mycobacterium avium subsp. paratuberculosis
cggucagcggcg

SEQ ID NO: 913601 - RNA, 13 nt, Mycobacterium avium subsp. paratuberculosis
cggucagcggcaa

SEQ ID NO: 913602 - RNA, 24 nt, Mycobacterium avium subsp. paratuberculosis
cggucagcggcaacacgccggcgg

SEQ ID NO: 913603 - RNA, 19 nt, Mycobacterium avium subsp. paratuberculosis
cggucaggcgcagccagcg

SEQ ID NO: 913604 - RNA, 15 nt, Mycobacterium avium subsp. paratuberculosis
cggucagucgcgccg

SEQ ID NO: 913605 - RNA, 17 nt, Mycobacterium avium subsp. paratuberculosis
cggucaguucgucgguc

SEQ ID NO: 913606 - RNA, 21 nt, Mycobacterium avium subsp. paratuberculosis
cggucaguucgucggucacgg

SEQ ID NO: 913607 - RNA, 12 nt, Mycobacterium avium subsp. paratuberculosis
cggucagggugu

SEQ ID NO: 913608 - RNA, 17 nt, Mycobacterium avium subsp. paratuberculosis
cggucagggugugacgg

SEQ ID NO: 913609 - RNA, 23 nt, Mycobacterium avium subsp. paratuberculosis
cggucaggguguuguccgagccg

SEQ ID NO: 913610 - RNA, 23 nt, Mycobacterium avium subsp. paratuberculosis
cggucagguagccgaggucgccg

SEQ ID NO: 913611 - RNA, 22 nt, Mycobacterium avium subsp. paratuberculosis
cggucagguggauggucaccgg

SEQ ID NO: 913612 - RNA, 17 nt, Mycobacterium avium subsp. paratuberculosis
cggucagguugacgccg

SEQ ID NO: 913613 - RNA, 20 nt, Mycobacterium avium subsp. paratuberculosis
cggucagguugacgccgaug

SEQ ID NO: 913614 - RNA, 17 nt, Mycobacterium avium subsp. paratuberculosis
cggucaucgugaucgcc

SEQ ID NO: 913615 - RNA, 19 nt, Mycobacterium avium subsp. paratuberculosis
cggucaucgugaucgccca

SEQ ID NO: 913616 - RNA, 19 nt, Mycobacterium avium subsp. paratuberculosis
cggucauccucgccgcgcc

SEQ ID NO: 913617 - RNA, 21 nt, Mycobacterium avium subsp. paratuberculosis
cggucauccucgccgcgccag

SEQ ID NO: 913618 - RNA, 22 nt, Mycobacterium avium subsp. paratuberculosis
cggucauccucgccgcgccagc

SEQ ID NO: 913619 - RNA, 14 nt, Mycobacterium avium subsp. paratuberculosis
cggucagggccagc

SEQ ID NO: 913620 - RNA, 15 nt, Mycobacterium avium subsp. paratuberculosis
cggucagggccagca

SEQ ID NO: 913621 - RNA, 19 nt, Mycobacterium avium subsp. paratuberculosis
cggucagggccagcaacac

SEQ ID NO: 913622 - RNA, 20 nt, Mycobacterium avium subsp. paratuberculosis
cggucaggcacucgaucagc

SEQ ID NO: 913623 - RNA, 23 nt, Mycobacterium avium subsp. paratuberculosis
cggucaggcacucgaucagcacc

SEQ ID NO: 913624 - RNA, 19 nt, Mycobacterium avium subsp. paratuberculosis
cggucaggcauuccaccgc

SEQ ID NO: 913625 - RNA, 22 nt, Mycobacterium avium subsp. paratuberculosis
cggucaggcauuccaccgcgcg

SEQ ID NO: 913626 - RNA, 20 nt, Mycobacterium avium subsp. paratuberculosis
cggucaggcccaggucguga

SEQ ID NO: 913627 - RNA, 15 nt, Mycobacterium avium subsp. paratuberculosis
cggucaggccggcgc

SEQ ID NO: 913628 - RNA, 17 nt, Mycobacterium avium subsp. paratuberculosis
cggucaggccggcgccg

SEQ ID NO: 913629 - RNA, 19 nt, Mycobacterium avium subsp. paratuberculosis
cggucaggccggcgccggg

SEQ ID NO: 913630 - RNA, 12 nt, Mycobacterium avium subsp. paratuberculosis
cggucaggccgu

SEQ ID NO: 913631 - RNA, 17 nt, Mycobacterium avium subsp. paratuberculosis
cggucaggccgucucga

SEQ ID NO: 913632 - RNA, 21 nt, Mycobacterium avium subsp. paratuberculosis
cggucaggccgucucgagccg

SEQ ID NO: 913633 - RNA, 22 nt, Mycobacterium avium subsp. paratuberculosis
cggucaggccgucucgagccgg

SEQ ID NO: 913634 - RNA, 20 nt, Mycobacterium avium subsp. paratuberculosis
cggucaggaacccggcccgg

SEQ ID NO: 913635 - RNA, 18 nt, Mycobacterium avium subsp. paratuberculosis
cggucaggaacgcggaca

SEQ ID NO: 913636 - RNA, 18 nt, Mycobacterium avium subsp. paratuberculosis
cggucagcugguagaugg

SEQ ID NO: 913637 - RNA, 14 nt, Mycobacterium avium subsp. paratuberculosis
cggucagcuggugc

SEQ ID NO: 913638 - RNA, 17 nt, Mycobacterium avium subsp. paratuberculosis
cggucagcuggugcaga

SEQ ID NO: 913639 - RNA, 12 nt, Mycobacterium avium subsp. paratuberculosis
cggucagcucga

SEQ ID NO: 913640 - RNA, 14 nt, Mycobacterium avium subsp. paratuberculosis
cggucagcucgaag

SEQ ID NO: 913641 - RNA, 19 nt, Mycobacterium avium subsp. paratuberculosis
cggucagcucgaucgccgc

SEQ ID NO: 913642 - RNA, 20 nt, Mycobacterium avium subsp. paratuberculosis
cggucagcucgaucgccgcg

SEQ ID NO: 913643 - RNA, 12 nt, Mycobacterium avium subsp. paratuberculosis
cggucagcucgc

SEQ ID NO: 913644 - RNA, 15 nt, Mycobacterium avium subsp. paratuberculosis
cggucagcucgccgu

SEQ ID NO: 913645 - RNA, 18 nt, Mycobacterium avium subsp. paratuberculosis
cggucagcucgccguccg

SEQ ID NO: 913646 - RNA, 16 nt, Mycobacterium avium subsp. paratuberculosis
cggucagcucgcgccc

SEQ ID NO: 913647 - RNA, 17 nt, Mycobacterium avium subsp. paratuberculosis
cggucagcucgcgcccg

SEQ ID NO: 913648 - RNA, 21 nt, Mycobacterium avium subsp. paratuberculosis
cggucagcucgcgcccggcca

SEQ ID NO: 913649 - RNA, 13 nt, Mycobacterium avium subsp. paratuberculosis
cggucagcgucgc

SEQ ID NO: 913650 - RNA, 15 nt, Mycobacterium avium subsp. paratuberculosis
cggucagcgucgccg

SEQ ID NO: 913651 - RNA, 16 nt, Mycobacterium avium subsp. paratuberculosis
cggucagcgucgccgc

SEQ ID NO: 913652 - RNA, 18 nt, Mycobacterium avium subsp. paratuberculosis
cggucagcgucgccgccc

SEQ ID NO: 913653 - RNA, 12 nt, Mycobacterium avium subsp. paratuberculosis
cggucagcgugg

SEQ ID NO: 913654 - RNA, 15 nt, Mycobacterium avium subsp. paratuberculosis
cggucagcguggcgu

SEQ ID NO: 913655 - RNA, 20 nt, Mycobacterium avium subsp. paratuberculosis
cggucagcguggcgucggcg

SEQ ID NO: 913656 - RNA, 23 nt, Mycobacterium avium subsp. paratuberculosis
cggucagcguggcgucggcgcgc

SEQ ID NO: 913657 - RNA, 19 nt, Mycobacterium avium subsp. paratuberculosis
cggucccggggcucgacag

SEQ ID NO: 913658 - RNA, 21 nt, Mycobacterium avium subsp. paratuberculosis
cggucccggggcucgacaggc

SEQ ID NO: 913659 - RNA, 13 nt, Mycobacterium avium subsp. paratuberculosis
cggucccggucga

SEQ ID NO: 913660 - RNA, 20 nt, Mycobacterium avium subsp. paratuberculosis
cggucccguccaucgccgcg

SEQ ID NO: 913661 - RNA, 13 nt, Mycobacterium avium subsp. paratuberculosis
cggucccgcaugu

SEQ ID NO: 913662 - RNA, 13 nt, Mycobacterium avium subsp. paratuberculosis
cggucccggcgga

SEQ ID NO: 913663 - RNA, 15 nt, Mycobacterium avium subsp. paratuberculosis
cgguccgaucguccg

SEQ ID NO: 913664 - RNA, 17 nt, Mycobacterium avium subsp. paratuberculosis
cgguccgaucguccggc

SEQ ID NO: 913665 - RNA, 18 nt, Mycobacterium avium subsp. paratuberculosis
cgguccgaucguccggcg

SEQ ID NO: 913666 - RNA, 19 nt, Mycobacterium avium subsp. paratuberculosis
cgguccgaucguccggcgc

SEQ ID NO: 913667 - RNA, 21 nt, Mycobacterium avium subsp. paratuberculosis
cgguccgaucguccggcgcca

SEQ ID NO: 913668 - RNA, 14 nt, Mycobacterium avium subsp. paratuberculosis
cgguccgccgcagc

SEQ ID NO: 913669 - RNA, 16 nt, Mycobacterium avium subsp. paratuberculosis
cgguccgccgcagcgg

SEQ ID NO: 913670 - RNA, 23 nt, Mycobacterium avium subsp. paratuberculosis
cgguccgccgcagcggcgccgca

SEQ ID NO: 913671 - RNA, 17 nt, Mycobacterium avium subsp. paratuberculosis
cgguccgccgccggcgg

SEQ ID NO: 913672 - RNA, 19 nt, Mycobacterium avium subsp. paratuberculosis
cgguccgcccagacgcggg

SEQ ID NO: 913673 - RNA, 13 nt, Mycobacterium avium subsp. paratuberculosis
cgguccgcccgga

SEQ ID NO: 913674 - RNA, 17 nt, Mycobacterium avium subsp. paratuberculosis
cgguccgcccggaccag

SEQ ID NO: 913675 - RNA, 18 nt, Mycobacterium avium subsp. paratuberculosis
cgguccauccagcgccgc

SEQ ID NO: 913676 - RNA, 20 nt, Mycobacterium avium subsp. paratuberculosis
cgguccgccgucggggugcg

SEQ ID NO: 913677 - RNA, 17 nt, Mycobacterium avium subsp. paratuberculosis
cgguccgcucaucgucg

SEQ ID NO: 913678 - RNA, 18 nt, Mycobacterium avium subsp. paratuberculosis
cgguccgcuccaccagcg

SEQ ID NO: 913679 - RNA, 21 nt, Mycobacterium avium subsp. paratuberculosis
cgguccgcuccaccagcgcgg

SEQ ID NO: 913680 - RNA, 22 nt, Mycobacterium avium subsp. paratuberculosis
cgguccgcuccaccagcgcggu

SEQ ID NO: 913681 - RNA, 19 nt, Mycobacterium avium subsp. paratuberculosis
cgguccgcugugcggcccg

SEQ ID NO: 913682 - RNA, 21 nt, Mycobacterium avium subsp. paratuberculosis
cgguccgcugugcggcccggc

SEQ ID NO: 913683 - RNA, 13 nt, Mycobacterium avium subsp. paratuberculosis
cgguccggcgaau

SEQ ID NO: 913684 - RNA, 13 nt, Mycobacterium avium subsp. paratuberculosis
cgguccggcggca

SEQ ID NO: 913685 - RNA, 15 nt, Mycobacterium avium subsp. paratuberculosis
cgguccggcggcacc

SEQ ID NO: 913686 - RNA, 16 nt, Mycobacterium avium subsp. paratuberculosis
cgguccggcggcacca

SEQ ID NO: 913687 - RNA, 23 nt, Mycobacterium avium subsp. paratuberculosis
cgguccggcugaacgccagcagc

SEQ ID NO: 913688 - RNA, 16 nt, Mycobacterium avium subsp. paratuberculosis
cgguccggcuggucgg

SEQ ID NO: 913689 - RNA, 12 nt, Mycobacterium avium subsp. paratuberculosis
cggucgaacgcc

SEQ ID NO: 913690 - RNA, 19 nt, Mycobacterium avium subsp. paratuberculosis
cggucgaacgccagcgccg

SEQ ID NO: 913691 - RNA, 16 nt, Mycobacterium avium subsp. paratuberculosis
cggucgaacgcggcgc

SEQ ID NO: 913692 - RNA, 18 nt, Mycobacterium avium subsp. paratuberculosis
cggucgaacgcggcgccg

SEQ ID NO: 913693 - RNA, 19 nt, Mycobacterium avium subsp. paratuberculosis
cggucgaacgcggcgccga

SEQ ID NO: 913694 - RNA, 18 nt, Mycobacterium avium subsp. paratuberculosis
cgguccuucucgcacagc

SEQ ID NO: 913695 - RNA, 21 nt, Mycobacterium avium subsp. paratuberculosis
cgguccuucucgcacagcacc

SEQ ID NO: 913696 - RNA, 14 nt, Mycobacterium avium subsp. paratuberculosis
cgguccuuggccug

SEQ ID NO: 913697 - RNA, 15 nt, Mycobacterium avium subsp. paratuberculosis
cgguccuuggccugc

SEQ ID NO: 913698 - RNA, 23 nt, Mycobacterium avium subsp. paratuberculosis
cggucgaacaacgcggugaccgc

SEQ ID NO: 913699 - RNA, 14 nt, Mycobacterium avium subsp. paratuberculosis
cgguccgugcacgg

SEQ ID NO: 913700 - RNA, 17 nt, Mycobacterium avium subsp. paratuberculosis
cgguccgugcacggcca

SEQ ID NO: 913701 - RNA, 18 nt, Mycobacterium avium subsp. paratuberculosis
cgguccgugcacggccaa

SEQ ID NO: 913702 - RNA, 16 nt, Mycobacterium avium subsp. paratuberculosis
cgguccgugccacggc

SEQ ID NO: 913703 - RNA, 22 nt, Mycobacterium avium subsp. paratuberculosis
cgguccgugccacggccgcggc

SEQ ID NO: 913704 - RNA, 23 nt, Mycobacterium avium subsp. paratuberculosis
cgguccguuggaggugaucgcca

SEQ ID NO: 913705 - RNA, 21 nt, Mycobacterium avium subsp. paratuberculosis
cgguccuccccgcuggcgccg

SEQ ID NO: 913706 - RNA, 14 nt, Mycobacterium avium subsp. paratuberculosis
cgguccucgagcug

SEQ ID NO: 913707 - RNA, 16 nt, Mycobacterium avium subsp. paratuberculosis
cggucgagccuggcgc

SEQ ID NO: 913708 - RNA, 18 nt, Mycobacterium avium subsp. paratuberculosis
cggucgagccuggcgcgc

SEQ ID NO: 913709 - RNA, 20 nt, Mycobacterium avium subsp. paratuberculosis
cggucgagccuggcgcgcaa

SEQ ID NO: 913710 - RNA, 24 nt, Mycobacterium avium subsp. paratuberculosis
cggucgagccuggcgcgcaacgcu

SEQ ID NO: 913711 - RNA, 13 nt, Mycobacterium avium subsp. paratuberculosis
cggucgacgcggg

SEQ ID NO: 913712 - RNA, 15 nt, Mycobacterium avium subsp. paratuberculosis
cggucgacgcggggc

SEQ ID NO: 913713 - RNA, 16 nt, Mycobacterium avium subsp. paratuberculosis
cggucgacgcggggcg

SEQ ID NO: 913714 - RNA, 19 nt, Mycobacterium avium subsp. paratuberculosis
cggucgacgcggggcggcg

SEQ ID NO: 913715 - RNA, 13 nt, Mycobacterium avium subsp. paratuberculosis
cggucgaccucga

SEQ ID NO: 913716 - RNA, 16 nt, Mycobacterium avium subsp. paratuberculosis
cggucgaccucgagcg

SEQ ID NO: 913717 - RNA, 19 nt, Mycobacterium avium subsp. paratuberculosis
cggucgaccucgagcguca

SEQ ID NO: 913718 - RNA, 13 nt, Mycobacterium avium subsp. paratuberculosis
cggucgacgaaga

SEQ ID NO: 913719 - RNA, 15 nt, Mycobacterium avium subsp. paratuberculosis
cggucgacgacgaac

SEQ ID NO: 913720 - RNA, 18 nt, Mycobacterium avium subsp. paratuberculosis
cggucgaccagcuccugg

SEQ ID NO: 913721 - RNA, 21 nt, Mycobacterium avium subsp. paratuberculosis
cggucgacacgaucggcauga

SEQ ID NO: 913722 - RNA, 15 nt, Mycobacterium avium subsp. paratuberculosis
cgguccacggucagc

SEQ ID NO: 913723 - RNA, 17 nt, Mycobacterium avium subsp. paratuberculosis
cgguccacggucagcgc

SEQ ID NO: 913724 - RNA, 16 nt, Mycobacterium avium subsp. paratuberculosis
cgguccacgguggcgc

SEQ ID NO: 913725 - RNA, 21 nt, Mycobacterium avium subsp. paratuberculosis
cgguccacgguggcgccgaau

SEQ ID NO: 913726 - RNA, 15 nt, Mycobacterium avium subsp. paratuberculosis
cgguccacguuggcg

SEQ ID NO: 913727 - RNA, 17 nt, Mycobacterium avium subsp. paratuberculosis
cgguccacucgucggcg

SEQ ID NO: 913728 - RNA, 14 nt, Mycobacterium avium subsp. paratuberculosis
cgguccacgccggc

SEQ ID NO: 913729 - RNA, 18 nt, Mycobacterium avium subsp. paratuberculosis
cgguccagaucggcgcgc

SEQ ID NO: 913730 - RNA, 21 nt, Mycobacterium avium subsp. paratuberculosis
cgguccagcccgguguccacg

SEQ ID NO: 913731 - RNA, 14 nt, Mycobacterium avium subsp. paratuberculosis
cgguccagccgccg

SEQ ID NO: 913732 - RNA, 15 nt, Mycobacterium avium subsp. paratuberculosis
cgguccagccgccgc

SEQ ID NO: 913733 - RNA, 16 nt, Mycobacterium avium subsp. paratuberculosis
cgguccagccgccgcg

SEQ ID NO: 913734 - RNA, 15 nt, Mycobacterium avium subsp. paratuberculosis
cgguccagcgagccc

SEQ ID NO: 913735 - RNA, 22 nt, Mycobacterium avium subsp. paratuberculosis
cgguccaaagacguugaccgcg

SEQ ID NO: 913736 - RNA, 14 nt, Mycobacterium avium subsp. paratuberculosis
cgguccaccaccac

SEQ ID NO: 913737 - RNA, 17 nt, Mycobacterium avium subsp. paratuberculosis
cgguccaccaccacacc

SEQ ID NO: 913738 - RNA, 18 nt, Mycobacterium avium subsp. paratuberculosis
cgguccaccaccacaccc

SEQ ID NO: 913739 - RNA, 21 nt, Mycobacterium avium subsp. paratuberculosis
cgguccaccaccacacccgcg

SEQ ID NO: 913740 - RNA, 23 nt, Mycobacterium avium subsp. paratuberculosis
cgguccaccaccacacccgcggc

SEQ ID NO: 913741 - RNA, 23 nt, Mycobacterium avium subsp. paratuberculosis
cgguccaccagaaguggucgauc

SEQ ID NO: 913742 - RNA, 16 nt, Mycobacterium avium subsp. paratuberculosis
cgguccaccaauggcg

SEQ ID NO: 913743 - RNA, 22 nt, Mycobacterium avium subsp. paratuberculosis
cgguccaacguggguggccccu

SEQ ID NO: 913744 - RNA, 18 nt, Mycobacterium avium subsp. paratuberculosis
cgguccaucagcaccgag

SEQ ID NO: 913745 - RNA, 21 nt, Mycobacterium avium subsp. paratuberculosis
cgguccaucagcaccgagaac

SEQ ID NO: 913746 - RNA, 18 nt, Mycobacterium avium subsp. paratuberculosis
cgguccagguggccaugg

SEQ ID NO: 913747 - RNA, 16 nt, Mycobacterium avium subsp. paratuberculosis
cgguccagguggggug

SEQ ID NO: 913748 - RNA, 17 nt, Mycobacterium avium subsp. paratuberculosis
cgguccagguggggugg

SEQ ID NO: 913749 - RNA, 18 nt, Mycobacterium avium subsp. paratuberculosis
cgguccaguacaccgcga

SEQ ID NO: 913750 - RNA, 18 nt, Mycobacterium avium subsp. paratuberculosis
cgguccaguccggccgug

SEQ ID NO: 913751 - RNA, 19 nt, Mycobacterium avium subsp. paratuberculosis
cgguccaguccggccguga

SEQ ID NO: 913752 - RNA, 17 nt, Mycobacterium avium subsp. paratuberculosis
cgguccagugccggcga

SEQ ID NO: 913753 - RNA, 18 nt, Mycobacterium avium subsp. paratuberculosis
cgguccaguugugccgca

SEQ ID NO: 913754 - RNA, 15 nt, Mycobacterium avium subsp. paratuberculosis
cgguccaggcgaccg

SEQ ID NO: 913755 - RNA, 21 nt, Mycobacterium avium subsp. paratuberculosis
cgguccaggcgaccggcccca

SEQ ID NO: 913756 - RNA, 20 nt, Mycobacterium avium subsp. paratuberculosis
cgguccaggauccgcaccgg

SEQ ID NO: 913757 - RNA, 18 nt, Mycobacterium avium subsp. paratuberculosis
cgguccccggagagccgg

SEQ ID NO: 913758 - RNA, 15 nt, Mycobacterium avium subsp. paratuberculosis
cgguccccggcgacc

SEQ ID NO: 913759 - RNA, 15 nt, Mycobacterium avium subsp. paratuberculosis
cggucccgacgcggc

SEQ ID NO: 913760 - RNA, 17 nt, Mycobacterium avium subsp. paratuberculosis
cggucccgacgcggcgc

SEQ ID NO: 913761 - RNA, 13 nt, Mycobacterium avium subsp. paratuberculosis
cggucccgcggcg

SEQ ID NO: 913762 - RNA, 14 nt, Mycobacterium avium subsp. paratuberculosis
cggucccgcggcgg

SEQ ID NO: 913763 - RNA, 17 nt, Mycobacterium avium subsp. paratuberculosis
cggucccgcggcggcgc

SEQ ID NO: 913764 - RNA, 19 nt, Mycobacterium avium subsp. paratuberculosis
cggucccgcggcggcgcca

SEQ ID NO: 913765 - RNA, 13 nt, Mycobacterium avium subsp. paratuberculosis
cggucccgcguca

SEQ ID NO: 913766 - RNA, 20 nt, Mycobacterium avium subsp. paratuberculosis
cggucccgcgucacauccgu

SEQ ID NO: 913767 - RNA, 15 nt, Mycobacterium avium subsp. paratuberculosis
cggguuuucgggccg

SEQ ID NO: 913768 - RNA, 21 nt, Mycobacterium avium subsp. paratuberculosis
cggguuguucuccagcggccg

SEQ ID NO: 913769 - RNA, 22 nt, Mycobacterium avium subsp. paratuberculosis
cggguuguucuccagcggccgc

SEQ ID NO: 913770 - RNA, 21 nt, Mycobacterium avium subsp. paratuberculosis
cggguuucgucucuuccucgg

SEQ ID NO: 913771 - RNA, 18 nt, Mycobacterium avium subsp. paratuberculosis
cggguuugccgacggugu

SEQ ID NO: 913772 - RNA, 17 nt, Mycobacterium avium subsp. paratuberculosis
cggguuuggccgcgggc

SEQ ID NO: 913773 - RNA, 15 nt, Mycobacterium avium subsp. paratuberculosis
cggguuuguccggcc

SEQ ID NO: 913774 - RNA, 17 nt, Mycobacterium avium subsp. paratuberculosis
cggguuuguccggccag

SEQ ID NO: 913775 - RNA, 18 nt, Mycobacterium avium subsp. paratuberculosis
cggguuuguccggccagg

SEQ ID NO: 913776 - RNA, 19 nt, Mycobacterium avium subsp. paratuberculosis
cggguuuguccggccaggu

SEQ ID NO: 913777 - RNA, 15 nt, Mycobacterium avium subsp. paratuberculosis
cggguuuguccggcu

SEQ ID NO: 913778 - RNA, 19 nt, Mycobacterium avium subsp. paratuberculosis
cggguugucgacguggugc

SEQ ID NO: 913779 - RNA, 14 nt, Mycobacterium avium subsp. paratuberculosis
cggguugucgucgu

SEQ ID NO: 913780 - RNA, 19 nt, Mycobacterium avium subsp. paratuberculosis
cggguugucgucgucggcg

SEQ ID NO: 913781 - RNA, 20 nt, Mycobacterium avium subsp. paratuberculosis
cggguugucgucgucggcga

SEQ ID NO: 913782 - RNA, 19 nt, Mycobacterium avium subsp. paratuberculosis
cggguuggucccgaucacc

SEQ ID NO: 913783 - RNA, 14 nt, Mycobacterium avium subsp. paratuberculosis
cggguuggucggcg

SEQ ID NO: 913784 - RNA, 18 nt, Mycobacterium avium subsp. paratuberculosis
cggguucacccuggcgaa

SEQ ID NO: 913785 - RNA, 22 nt, Mycobacterium avium subsp. paratuberculosis
cggguuacguggacgcgcgcgg

SEQ ID NO: 913786 - RNA, 14 nt, Mycobacterium avium subsp. paratuberculosis
cgguaaggcaggca

SEQ ID NO: 913787 - RNA, 19 nt, Mycobacterium avium subsp. paratuberculosis
cgguaaauugaacgccgcc

SEQ ID NO: 913788 - RNA, 19 nt, Mycobacterium avium subsp. paratuberculosis
cgguaaagucuucggcgau

SEQ ID NO: 913789 - RNA, 22 nt, Mycobacterium avium subsp. paratuberculosis
cgguacagcgacuccagcgcga

SEQ ID NO: 913790 - RNA, 20 nt, Mycobacterium avium subsp. paratuberculosis
cgguacagcgccgcggccag

SEQ ID NO: 913791 - RNA, 23 nt, Mycobacterium avium subsp. paratuberculosis
cgguacagcgccgcggccagccg

SEQ ID NO: 913792 - RNA, 12 nt, Mycobacterium avium subsp. paratuberculosis
cgguaauccggc

SEQ ID NO: 913793 - RNA, 21 nt, Mycobacterium avium subsp. paratuberculosis
cggguggaucuugacggcgac

SEQ ID NO: 913794 - RNA, 21 nt, Mycobacterium avium subsp. paratuberculosis
cggguggaacuggacgccgug

SEQ ID NO: 913795 - RNA, 23 nt, Mycobacterium avium subsp. paratuberculosis
cggguggaacuggacgccgugga

SEQ ID NO: 913796 - RNA, 20 nt, Mycobacterium avium subsp. paratuberculosis
cggguggacaccgcgaucac

SEQ ID NO: 913797 - RNA, 16 nt, Mycobacterium avium subsp. paratuberculosis
cgggugcuggucagca

SEQ ID NO: 913798 - RNA, 16 nt, Mycobacterium avium subsp. paratuberculosis
cgggugcugcggcucc

SEQ ID NO: 913799 - RNA, 17 nt, Mycobacterium avium subsp. paratuberculosis
cgggugcucagguugcg

SEQ ID NO: 913800 - RNA, 23 nt, Mycobacterium avium subsp. paratuberculosis
cgggugcucagguugcgcagcag

SEQ ID NO: 913801 - RNA, 20 nt, Mycobacterium avium subsp. paratuberculosis
cgggugcugaacgccugccg

SEQ ID NO: 913802 - RNA, 21 nt, Mycobacterium avium subsp. paratuberculosis
cgggugcgcuugucggcgugg

SEQ ID NO: 913803 - RNA, 17 nt, Mycobacterium avium subsp. paratuberculosis
cgggugcgggccagcag

SEQ ID NO: 913804 - RNA, 23 nt, Mycobacterium avium subsp. paratuberculosis
cgggugcgggccagcagccgcgc

SEQ ID NO: 913805 - RNA, 16 nt, Mycobacterium avium subsp. paratuberculosis
cgggugcggcgcucgg

SEQ ID NO: 913806 - RNA, 16 nt, Mycobacterium avium subsp. paratuberculosis
cgggugcggcgcugcc

SEQ ID NO: 913807 - RNA, 17 nt, Mycobacterium avium subsp. paratuberculosis
cgggugcggcgcugccg

SEQ ID NO: 913808 - RNA, 14 nt, Mycobacterium avium subsp. paratuberculosis
cgggugcggcggug

SEQ ID NO: 913809 - RNA, 16 nt, Mycobacterium avium subsp. paratuberculosis
cgggugcggcgguguu

SEQ ID NO: 913810 - RNA, 14 nt, Mycobacterium avium subsp. paratuberculosis
cgggugcggcgugc

SEQ ID NO: 913811 - RNA, 22 nt, Mycobacterium avium subsp. paratuberculosis
cgggugcggcgugcggucgcgg

SEQ ID NO: 913812 - RNA, 19 nt, Mycobacterium avium subsp. paratuberculosis
cgggugcgcgucgcggugg

SEQ ID NO: 913813 - RNA, 17 nt, Mycobacterium avium subsp. paratuberculosis
cgggugcgcucaccgca

SEQ ID NO: 913814 - RNA, 16 nt, Mycobacterium avium subsp. paratuberculosis
cgggugcgcucgacgg

SEQ ID NO: 913815 - RNA, 17 nt, Mycobacterium avium subsp. paratuberculosis
cgggugcgcucgacggc

SEQ ID NO: 913816 - RNA, 20 nt, Mycobacterium avium subsp. paratuberculosis
cgggugcgcucgacggccug

SEQ ID NO: 913817 - RNA, 22 nt, Mycobacterium avium subsp. paratuberculosis
cgggugcgcucgacggccugca

SEQ ID NO: 913818 - RNA, 13 nt, Mycobacterium avium subsp. paratuberculosis
cgggugcggcacg

SEQ ID NO: 913819 - RNA, 17 nt, Mycobacterium avium subsp. paratuberculosis
cgggugcggccagcgca

SEQ ID NO: 913820 - RNA, 14 nt, Mycobacterium avium subsp. paratuberculosis
cgggugcggccggu

SEQ ID NO: 913821 - RNA, 21 nt, Mycobacterium avium subsp. paratuberculosis
cgggugcgauggcaacgccgg

SEQ ID NO: 913822 - RNA, 23 nt, Mycobacterium avium subsp. paratuberculosis
cgggugccuucuuggcggcgguc

SEQ ID NO: 913823 - RNA, 15 nt, Mycobacterium avium subsp. paratuberculosis
cggguggccagcacc

SEQ ID NO: 913824 - RNA, 17 nt, Mycobacterium avium subsp. paratuberculosis
cggguggccagcaccag

SEQ ID NO: 913825 - RNA, 14 nt, Mycobacterium avium subsp. paratuberculosis
cggguggccagcca

SEQ ID NO: 913826 - RNA, 21 nt, Mycobacterium avium subsp. paratuberculosis
cggguggcccaaucggugcgg

SEQ ID NO: 913827 - RNA, 23 nt, Mycobacterium avium subsp. paratuberculosis
cggguggcccgcacguagacggu

SEQ ID NO: 913828 - RNA, 18 nt, Mycobacterium avium subsp. paratuberculosis
cggguggcccgcccgggc

SEQ ID NO: 913829 - RNA, 20 nt, Mycobacterium avium subsp. paratuberculosis
cggguggcccgcccgggcac

SEQ ID NO: 913830 - RNA, 14 nt, Mycobacterium avium subsp. paratuberculosis
cggguggcccgcgc

SEQ ID NO: 913831 - RNA, 14 nt, Mycobacterium avium subsp. paratuberculosis
cggguggccggguc

SEQ ID NO: 913832 - RNA, 19 nt, Mycobacterium avium subsp. paratuberculosis
cggguggccgggucgccgu

SEQ ID NO: 913833 - RNA, 20 nt, Mycobacterium avium subsp. paratuberculosis
cggguggccgggucgccguc

SEQ ID NO: 913834 - RNA, 22 nt, Mycobacterium avium subsp. paratuberculosis
cggguggccgggucgccgucga

SEQ ID NO: 913835 - RNA, 13 nt, Mycobacterium avium subsp. paratuberculosis
cggguggccuccg

SEQ ID NO: 913836 - RNA, 18 nt, Mycobacterium avium subsp. paratuberculosis
cggguggccuucaucacc

SEQ ID NO: 913837 - RNA, 20 nt, Mycobacterium avium subsp. paratuberculosis
cggguggccuucaucaccgc

SEQ ID NO: 913838 - RNA, 21 nt, Mycobacterium avium subsp. paratuberculosis
cggguggccuucaucaccgcc

SEQ ID NO: 913839 - RNA, 15 nt, Mycobacterium avium subsp. paratuberculosis
cggguggcgccacag

SEQ ID NO: 913840 - RNA, 16 nt, Mycobacterium avium subsp. paratuberculosis
cggguggcgucgccgc

SEQ ID NO: 913841 - RNA, 18 nt, Mycobacterium avium subsp. paratuberculosis
cggguggcgucgccgccg

SEQ ID NO: 913842 - RNA, 13 nt, Mycobacterium avium subsp. paratuberculosis
cgggugugacauc

SEQ ID NO: 913843 - RNA, 12 nt, Mycobacterium avium subsp. paratuberculosis
cggguggccggg

SEQ ID NO: 913844 - RNA, 13 nt, Mycobacterium avium subsp. paratuberculosis
cggguggccagca

SEQ ID NO: 913845 - RNA, 13 nt, Mycobacterium avium subsp. paratuberculosis
cggguggccgcca

SEQ ID NO: 913846 - RNA, 16 nt, Mycobacterium avium subsp. paratuberculosis
cggguggcggccgggg

SEQ ID NO: 913847 - RNA, 21 nt, Mycobacterium avium subsp. paratuberculosis
cggguguggcgccgugcagga

SEQ ID NO: 913848 - RNA, 15 nt, Mycobacterium avium subsp. paratuberculosis
cggguguggugccgg

SEQ ID NO: 913849 - RNA, 18 nt, Mycobacterium avium subsp. paratuberculosis
cggguguggugccggguc

SEQ ID NO: 913850 - RNA, 19 nt, Mycobacterium avium subsp. paratuberculosis
cggguguggugccgggucg

SEQ ID NO: 913851 - RNA, 14 nt, Mycobacterium avium subsp. paratuberculosis
cggguguucagccc

SEQ ID NO: 913852 - RNA, 16 nt, Mycobacterium avium subsp. paratuberculosis
cggguguugcgcagcg

SEQ ID NO: 913853 - RNA, 19 nt, Mycobacterium avium subsp. paratuberculosis
cggguguugcgcagcgucu

SEQ ID NO: 913854 - RNA, 21 nt, Mycobacterium avium subsp. paratuberculosis
cggguguugcggcagggccac

SEQ ID NO: 913855 - RNA, 15 nt, Mycobacterium avium subsp. paratuberculosis
cggguguuggagccg

SEQ ID NO: 913856 - RNA, 19 nt, Mycobacterium avium subsp. paratuberculosis
cggguguuggagccguccg

SEQ ID NO: 913857 - RNA, 15 nt, Mycobacterium avium subsp. paratuberculosis
cggguguuucggucg

SEQ ID NO: 913858 - RNA, 17 nt, Mycobacterium avium subsp. paratuberculosis
cggguguuucggucggc

SEQ ID NO: 913859 - RNA, 13 nt, Mycobacterium avium subsp. paratuberculosis
cggguccgaccag

SEQ ID NO: 913860 - RNA, 21 nt, Mycobacterium avium subsp. paratuberculosis
cggguccgcacccgggcccgg

SEQ ID NO: 913861 - RNA, 14 nt, Mycobacterium avium subsp. paratuberculosis
cggguccgccccga

SEQ ID NO: 913862 - RNA, 16 nt, Mycobacterium avium subsp. paratuberculosis
cgggucaggucgaagc

SEQ ID NO: 913863 - RNA, 22 nt, Mycobacterium avium subsp. paratuberculosis
cgggucaggucgaagcccgccg

SEQ ID NO: 913864 - RNA, 14 nt, Mycobacterium avium subsp. paratuberculosis
cgggucccggcaac

SEQ ID NO: 913865 - RNA, 23 nt, Mycobacterium avium subsp. paratuberculosis
cgggucccggcaacaccggcggc

SEQ ID NO: 913866 - RNA, 21 nt, Mycobacterium avium subsp. paratuberculosis
cggguccgaggugaucgcgaa

SEQ ID NO: 913867 - RNA, 17 nt, Mycobacterium avium subsp. paratuberculosis
cggguccuugccggcgg

SEQ ID NO: 913868 - RNA, 18 nt, Mycobacterium avium subsp. paratuberculosis
cggguccuugccggcggc

SEQ ID NO: 913869 - RNA, 19 nt, Mycobacterium avium subsp. paratuberculosis
cggguccuugccggcggcg

SEQ ID NO: 913870 - RNA, 20 nt, Mycobacterium avium subsp. paratuberculosis
cggguccuugccggcggcgg

SEQ ID NO: 913871 - RNA, 21 nt, Mycobacterium avium subsp. paratuberculosis
cggguccuugcgccccggcgg

SEQ ID NO: 913872 - RNA, 22 nt, Mycobacterium avium subsp. paratuberculosis
cggguccuugcgccccggcggg

SEQ ID NO: 913873 - RNA, 16 nt, Mycobacterium avium subsp. paratuberculosis
cgggucagcgucgcca

SEQ ID NO: 913874 - RNA, 13 nt, Mycobacterium avium subsp. paratuberculosis
cgggucagcgugc

SEQ ID NO: 913875 - RNA, 18 nt, Mycobacterium avium subsp. paratuberculosis
cgggucagcuccaccugc

SEQ ID NO: 913876 - RNA, 21 nt, Mycobacterium avium subsp. paratuberculosis
cgggucagcuccaccugcggc

SEQ ID NO: 913877 - RNA, 14 nt, Mycobacterium avium subsp. paratuberculosis
cgggucacggucag

SEQ ID NO: 913878 - RNA, 21 nt, Mycobacterium avium subsp. paratuberculosis
cgggucacggucaggccggga

SEQ ID NO: 913879 - RNA, 13 nt, Mycobacterium avium subsp. paratuberculosis
cgggucacgugca

SEQ ID NO: 913880 - RNA, 21 nt, Mycobacterium avium subsp. paratuberculosis
cgggucacgugcacccacgcc

SEQ ID NO: 913881 - RNA, 13 nt, Mycobacterium avium subsp. paratuberculosis
cgggucagcagcg

SEQ ID NO: 913882 - RNA, 16 nt, Mycobacterium avium subsp. paratuberculosis
cgggucagcagcgucu

SEQ ID NO: 913883 - RNA, 22 nt, Mycobacterium avium subsp. paratuberculosis
cgggucagcagcgucugcgcca

SEQ ID NO: 913884 - RNA, 13 nt, Mycobacterium avium subsp. paratuberculosis
cgggucagcagcu

SEQ ID NO: 913885 - RNA, 12 nt, Mycobacterium avium subsp. paratuberculosis
cgggucaccgga

SEQ ID NO: 913886 - RNA, 21 nt, Mycobacterium avium subsp. paratuberculosis
cgggucaccggaugcaccggc

SEQ ID NO: 913887 - RNA, 12 nt, Mycobacterium avium subsp. paratuberculosis
cgggucaccggc

SEQ ID NO: 913888 - RNA, 16 nt, Mycobacterium avium subsp. paratuberculosis
cgggucagaccgcggc

SEQ ID NO: 913889 - RNA, 18 nt, Mycobacterium avium subsp. paratuberculosis
cgggucagaccgcggcgg

SEQ ID NO: 913890 - RNA, 19 nt, Mycobacterium avium subsp. paratuberculosis
cgggucagaccgcggcggu

SEQ ID NO: 913891 - RNA, 12 nt, Mycobacterium avium subsp. paratuberculosis
cgggucagcacc

SEQ ID NO: 913892 - RNA, 13 nt, Mycobacterium avium subsp. paratuberculosis
cgggucagcacca

SEQ ID NO: 913893 - RNA, 15 nt, Mycobacterium avium subsp. paratuberculosis
cgggucagcaccacc

SEQ ID NO: 913894 - RNA, 14 nt, Mycobacterium avium subsp. paratuberculosis
cgggucagcacccg

SEQ ID NO: 913895 - RNA, 20 nt, Mycobacterium avium subsp. paratuberculosis
cgggucagcacccgcagccg

SEQ ID NO: 913896 - RNA, 15 nt, Mycobacterium avium subsp. paratuberculosis
cgggguggcgccggc

SEQ ID NO: 913897 - RNA, 21 nt, Mycobacterium avium subsp. paratuberculosis
cgggguggcgccggccagcac

SEQ ID NO: 913898 - RNA, 23 nt, Mycobacterium avium subsp. paratuberculosis
cggggugggcaccuggccgucgg

SEQ ID NO: 913899 - RNA, 20 nt, Mycobacterium avium subsp. paratuberculosis
cggggugggcacgucggcca

SEQ ID NO: 913900 - RNA, 21 nt, Mycobacterium avium subsp. paratuberculosis
cggggugggcacgucggccag

SEQ ID NO: 913901 - RNA, 14 nt, Mycobacterium avium subsp. paratuberculosis
cggggugcgccagg

SEQ ID NO: 913902 - RNA, 15 nt, Mycobacterium avium subsp. paratuberculosis
cggggugcgccaggc

SEQ ID NO: 913903 - RNA, 17 nt, Mycobacterium avium subsp. paratuberculosis
cggggugcucgaucggc

SEQ ID NO: 913904 - RNA, 22 nt, Mycobacterium avium subsp. paratuberculosis
cggggugcuggcguagagccgc

SEQ ID NO: 913905 - RNA, 14 nt, Mycobacterium avium subsp. paratuberculosis
cgggguggaucgcc

SEQ ID NO: 913906 - RNA, 13 nt, Mycobacterium avium subsp. paratuberculosis
cgggguggccacc

SEQ ID NO: 913907 - RNA, 13 nt, Mycobacterium avium subsp. paratuberculosis
cgggguggccggc

SEQ ID NO: 913908 - RNA, 15 nt, Mycobacterium avium subsp. paratuberculosis
cgggguggccggcca

SEQ ID NO: 913909 - RNA, 17 nt, Mycobacterium avium subsp. paratuberculosis
cgggguggccggccagc

SEQ ID NO: 913910 - RNA, 19 nt, Mycobacterium avium subsp. paratuberculosis
cgggguggccggccagcac

SEQ ID NO: 913911 - RNA, 12 nt, Mycobacterium avium subsp. paratuberculosis
cggggucgaaca

SEQ ID NO: 913912 - RNA, 17 nt, Mycobacterium avium subsp. paratuberculosis
cgggguccucucggcgc

SEQ ID NO: 913913 - RNA, 18 nt, Mycobacterium avium subsp. paratuberculosis
cgggguccucucggcgcc

SEQ ID NO: 913914 - RNA, 19 nt, Mycobacterium avium subsp. paratuberculosis
cgggguccgcaacgccggc

SEQ ID NO: 913915 - RNA, 20 nt, Mycobacterium avium subsp. paratuberculosis
cgggguccgcaacgccggcg

SEQ ID NO: 913916 - RNA, 23 nt, Mycobacterium avium subsp. paratuberculosis
cgggguccgcaacgccggcgugc

SEQ ID NO: 913917 - RNA, 13 nt, Mycobacterium avium subsp. paratuberculosis
cggggucgaacau

SEQ ID NO: 913918 - RNA, 21 nt, Mycobacterium avium subsp. paratuberculosis
cggggucgaacaucacccggc

SEQ ID NO: 913919 - RNA, 22 nt, Mycobacterium avium subsp. paratuberculosis
cggggucgaaguccugcgccgc

SEQ ID NO: 913920 - RNA, 24 nt, Mycobacterium avium subsp. paratuberculosis
cggggucgagaagcccgugcgacg

SEQ ID NO: 913921 - RNA, 13 nt, Mycobacterium avium subsp. paratuberculosis
cggggucgccguc

SEQ ID NO: 913922 - RNA, 14 nt, Mycobacterium avium subsp. paratuberculosis
cggggucgccgucg

SEQ ID NO: 913923 - RNA, 12 nt, Mycobacterium avium subsp. paratuberculosis
cggggucgcggc

SEQ ID NO: 913924 - RNA, 15 nt, Mycobacterium avium subsp. paratuberculosis
cggggugcaccgugg

SEQ ID NO: 913925 - RNA, 18 nt, Mycobacterium avium subsp. paratuberculosis
cggggugcagcaccacga

SEQ ID NO: 913926 - RNA, 22 nt, Mycobacterium avium subsp. paratuberculosis
cggggugcagcaccacgaacgc

SEQ ID NO: 913927 - RNA, 16 nt, Mycobacterium avium subsp. paratuberculosis
cggggugcccaccacc

SEQ ID NO: 913928 - RNA, 17 nt, Mycobacterium avium subsp. paratuberculosis
cggggugcccggcgagg

SEQ ID NO: 913929 - RNA, 18 nt, Mycobacterium avium subsp. paratuberculosis
cggggugcccggcgagga

SEQ ID NO: 913930 - RNA, 17 nt, Mycobacterium avium subsp. paratuberculosis
cggggugcccgggccgc

SEQ ID NO: 913931 - RNA, 18 nt, Mycobacterium avium subsp. paratuberculosis
cggggugcccgggccgca

SEQ ID NO: 913932 - RNA, 12 nt, Mycobacterium avium subsp. paratuberculosis
cggggugccgcc

SEQ ID NO: 913933 - RNA, 13 nt, Mycobacterium avium subsp. paratuberculosis
cggggugccgccc

SEQ ID NO: 913934 - RNA, 14 nt, Mycobacterium avium subsp. paratuberculosis
cggggugccgccca

SEQ ID NO: 913935 - RNA, 14 nt, Mycobacterium avium subsp. paratuberculosis
cggggugccgccgg

SEQ ID NO: 913936 - RNA, 16 nt, Mycobacterium avium subsp. paratuberculosis
cggggugccgccgggg

SEQ ID NO: 913937 - RNA, 22 nt, Mycobacterium avium subsp. paratuberculosis
cggggugccgccggggacccgc

SEQ ID NO: 913938 - RNA, 13 nt, Mycobacterium avium subsp. paratuberculosis
cgggucgcacagc

SEQ ID NO: 913939 - RNA, 19 nt, Mycobacterium avium subsp. paratuberculosis
cgggucgcacagccgcagc

SEQ ID NO: 913940 - RNA, 23 nt, Mycobacterium avium subsp. paratuberculosis
cgggucgcacagccgcagcagcc

SEQ ID NO: 913941 - RNA, 13 nt, Mycobacterium avium subsp. paratuberculosis
cgggucgcacgcc

SEQ ID NO: 913942 - RNA, 14 nt, Mycobacterium avium subsp. paratuberculosis
cgggucgcacgccg

SEQ ID NO: 913943 - RNA, 21 nt, Mycobacterium avium subsp. paratuberculosis
cgggucgcacgccgguagccg

SEQ ID NO: 913944 - RNA, 17 nt, Mycobacterium avium subsp. paratuberculosis
cgggucgcagcggcacg

SEQ ID NO: 913945 - RNA, 23 nt, Mycobacterium avium subsp. paratuberculosis
cgggucgcagcggcacgucgccg

SEQ ID NO: 913946 - RNA, 13 nt, Mycobacterium avium subsp. paratuberculosis
cgggucgcaggca

SEQ ID NO: 913947 - RNA, 19 nt, Mycobacterium avium subsp. paratuberculosis
cgggucgcaggcagcagca

SEQ ID NO: 913948 - RNA, 20 nt, Mycobacterium avium subsp. paratuberculosis
cgggucgcaggcagcagcac

SEQ ID NO: 913949 - RNA, 18 nt, Mycobacterium avium subsp. paratuberculosis
cgggucgccaaggucguc

SEQ ID NO: 913950 - RNA, 13 nt, Mycobacterium avium subsp. paratuberculosis
cgggucgcccggg

SEQ ID NO: 913951 - RNA, 20 nt, Mycobacterium avium subsp. paratuberculosis
cgggucgccgaucucggcca

SEQ ID NO: 913952 - RNA, 21 nt, Mycobacterium avium subsp. paratuberculosis
cgggucgccgaucucggccaa

SEQ ID NO: 913953 - RNA, 12 nt, Mycobacterium avium subsp. paratuberculosis
cgggucgccggg

SEQ ID NO: 913954 - RNA, 15 nt, Mycobacterium avium subsp. paratuberculosis
cgggucgccgggcag

SEQ ID NO: 913955 - RNA, 13 nt, Mycobacterium avium subsp. paratuberculosis
cgggucgccgguc

SEQ ID NO: 913956 - RNA, 14 nt, Mycobacterium avium subsp. paratuberculosis
cgggucggcgacgg

SEQ ID NO: 913957 - RNA, 20 nt, Mycobacterium avium subsp. paratuberculosis
cgggucggcgagcagccgcg

SEQ ID NO: 913958 - RNA, 20 nt, Mycobacterium avium subsp. paratuberculosis
cgggucgaucucggcgcagg

SEQ ID NO: 913959 - RNA, 21 nt, Mycobacterium avium subsp. paratuberculosis
cgggucgaucucggcgcaggu

SEQ ID NO: 913960 - RNA, 15 nt, Mycobacterium avium subsp. paratuberculosis
cgggucgauggcgac

SEQ ID NO: 913961 - RNA, 17 nt, Mycobacterium avium subsp. paratuberculosis
cgggucgagcgcgccga

SEQ ID NO: 913962 - RNA, 19 nt, Mycobacterium avium subsp. paratuberculosis
cgggucgagcgcgccgaga

SEQ ID NO: 913963 - RNA, 16 nt, Mycobacterium avium subsp. paratuberculosis
cgggucgagcggcccg

SEQ ID NO: 913964 - RNA, 18 nt, Mycobacterium avium subsp. paratuberculosis
cgggucgagcggcccgca

SEQ ID NO: 913965 - RNA, 20 nt, Mycobacterium avium subsp. paratuberculosis
cggguccuggaaggcguugg

SEQ ID NO: 913966 - RNA, 16 nt, Mycobacterium avium subsp. paratuberculosis
cgggucgaacggcaac

SEQ ID NO: 913967 - RNA, 17 nt, Mycobacterium avium subsp. paratuberculosis
cgggucgaagugcucga

SEQ ID NO: 913968 - RNA, 19 nt, Mycobacterium avium subsp. paratuberculosis
cgggucgaccgccgcgucg

SEQ ID NO: 913969 - RNA, 17 nt, Mycobacterium avium subsp. paratuberculosis
cgggucgaccgccucgg

SEQ ID NO: 913970 - RNA, 19 nt, Mycobacterium avium subsp. paratuberculosis
cgggucgacgagcaggcug

SEQ ID NO: 913971 - RNA, 14 nt, Mycobacterium avium subsp. paratuberculosis
cgggucgacgccga

SEQ ID NO: 913972 - RNA, 15 nt, Mycobacterium avium subsp. paratuberculosis
cgggucgagagccgc

SEQ ID NO: 913973 - RNA, 19 nt, Mycobacterium avium subsp. paratuberculosis
cgggucgagagccgcaucg

SEQ ID NO: 913974 - RNA, 13 nt, Mycobacterium avium subsp. paratuberculosis
cggguccgcgguc

SEQ ID NO: 913975 - RNA, 17 nt, Mycobacterium avium subsp. paratuberculosis
cgggucguagagcgcga

SEQ ID NO: 913976 - RNA, 20 nt, Mycobacterium avium subsp. paratuberculosis
cgggucguagagcgcgaagc

SEQ ID NO: 913977 - RNA, 17 nt, Mycobacterium avium subsp. paratuberculosis
cgggucguagccgaagc

SEQ ID NO: 913978 - RNA, 20 nt, Mycobacterium avium subsp. paratuberculosis
cgggucguagcuuccgccuu

SEQ ID NO: 913979 - RNA, 20 nt, Mycobacterium avium subsp. paratuberculosis
cgggucguaggacaccacgg

SEQ ID NO: 913980 - RNA, 16 nt, Mycobacterium avium subsp. paratuberculosis
cgggucggucggcccg

SEQ ID NO: 913981 - RNA, 16 nt, Mycobacterium avium subsp. paratuberculosis
cgggucguccgcgacg

SEQ ID NO: 913982 - RNA, 14 nt, Mycobacterium avium subsp. paratuberculosis
cgggucgucgacgu

SEQ ID NO: 913983 - RNA, 11 nt, Mycobacterium avium subsp. paratuberculosis
cgggucgucgc

SEQ ID NO: 913984 - RNA, 14 nt, Mycobacterium avium subsp. paratuberculosis
cgggucgucgcgga

SEQ ID NO: 913985 - RNA, 15 nt, Mycobacterium avium subsp. paratuberculosis
cgggucgucgcggaa

SEQ ID NO: 913986 - RNA, 18 nt, Mycobacterium avium subsp. paratuberculosis
cgggucgucgcggaaccg

SEQ ID NO: 913987 - RNA, 16 nt, Mycobacterium avium subsp. paratuberculosis
cgggucgucggcgucg

SEQ ID NO: 913988 - RNA, 15 nt, Mycobacterium avium subsp. paratuberculosis
cgggucggcgccggc

SEQ ID NO: 913989 - RNA, 16 nt, Mycobacterium avium subsp. paratuberculosis
cgggucggcgccggcc

SEQ ID NO: 913990 - RNA, 17 nt, Mycobacterium avium subsp. paratuberculosis
cgggucggcgccggcca

SEQ ID NO: 913991 - RNA, 18 nt, Mycobacterium avium subsp. paratuberculosis
cgggucggcgccggccag

SEQ ID NO: 913992 - RNA, 19 nt, Mycobacterium avium subsp. paratuberculosis
cgggucggcgccggccagc

SEQ ID NO: 913993 - RNA, 13 nt, Mycobacterium avium subsp. paratuberculosis
cgggucggcggcg

SEQ ID NO: 913994 - RNA, 14 nt, Mycobacterium avium subsp. paratuberculosis
cgggucggcggcga

SEQ ID NO: 913995 - RNA, 18 nt, Mycobacterium avium subsp. paratuberculosis
cgggucggcggcgaacgg

SEQ ID NO: 913996 - RNA, 15 nt, Mycobacterium avium subsp. paratuberculosis
cgggucggcgucacc

SEQ ID NO: 913997 - RNA, 18 nt, Mycobacterium avium subsp. paratuberculosis
cgggucgggaggcagcgc

SEQ ID NO: 913998 - RNA, 20 nt, Mycobacterium avium subsp. paratuberculosis
cgggucgggaggcagcgcgg

SEQ ID NO: 913999 - RNA, 22 nt, Mycobacterium avium subsp. paratuberculosis
cgggucgggggugggcucccag

SEQ ID NO: 914000 - RNA, 17 nt, Mycobacterium avium subsp. paratuberculosis
cgggucgguggcgauga

SEQ ID NO: 914001 - RNA, 21 nt, Mycobacterium avium subsp. paratuberculosis
cgggucggugggcagcucguc

SEQ ID NO: 914002 - RNA, 23 nt, Mycobacterium avium subsp. paratuberculosis
cgggucgguggugaucgcggcgg

SEQ ID NO: 914003 - RNA, 15 nt, Mycobacterium avium subsp. paratuberculosis
cgggugcccggcugg

SEQ ID NO: 914004 - RNA, 19 nt, Mycobacterium avium subsp. paratuberculosis
cgggugcccggcugggcgc

SEQ ID NO: 914005 - RNA, 21 nt, Mycobacterium avium subsp. paratuberculosis
cgggugcccggcugggcgcgc

SEQ ID NO: 914006 - RNA, 22 nt, Mycobacterium avium subsp. paratuberculosis
cgggugcccggcugggcgcgca

SEQ ID NO: 914007 - RNA, 21 nt, Mycobacterium avium subsp. paratuberculosis
cgggugccgaacacguacagc

SEQ ID NO: 914008 - RNA, 18 nt, Mycobacterium avium subsp. paratuberculosis
cgggugcaggcccagcug

SEQ ID NO: 914009 - RNA, 13 nt, Mycobacterium avium subsp. paratuberculosis
cgggugcagccgg

SEQ ID NO: 914010 - RNA, 15 nt, Mycobacterium avium subsp. paratuberculosis
cgggugauccggugc

SEQ ID NO: 914011 - RNA, 14 nt, Mycobacterium avium subsp. paratuberculosis
cgggugauggccgc

SEQ ID NO: 914012 - RNA, 16 nt, Mycobacterium avium subsp. paratuberculosis
cgggugauggccgccg

SEQ ID NO: 914013 - RNA, 15 nt, Mycobacterium avium subsp. paratuberculosis
cgggugaugucgccg

SEQ ID NO: 914014 - RNA, 16 nt, Mycobacterium avium subsp. paratuberculosis
cgggugaugucgccga

SEQ ID NO: 914015 - RNA, 17 nt, Mycobacterium avium subsp. paratuberculosis
cgggugaugucgccgac

SEQ ID NO: 914016 - RNA, 14 nt, Mycobacterium avium subsp. paratuberculosis
cggggaggcccagc

SEQ ID NO: 914017 - RNA, 15 nt, Mycobacterium avium subsp. paratuberculosis
cggggaggcccagcc

SEQ ID NO: 914018 - RNA, 17 nt, Mycobacterium avium subsp. paratuberculosis
cggggaggcccagcccg

SEQ ID NO: 914019 - RNA, 20 nt, Mycobacterium avium subsp. paratuberculosis
cggggaggcccagcccgccg

SEQ ID NO: 914020 - RNA, 18 nt, Mycobacterium avium subsp. paratuberculosis
cggggacuugacgauccc

SEQ ID NO: 914021 - RNA, 15 nt, Mycobacterium avium subsp. paratuberculosis
cggggacgucgucgu

SEQ ID NO: 914022 - RNA, 19 nt, Mycobacterium avium subsp. paratuberculosis
cggggacgugucggggugg

SEQ ID NO: 914023 - RNA, 17 nt, Mycobacterium avium subsp. paratuberculosis
cggggacggguugcggu

SEQ ID NO: 914024 - RNA, 18 nt, Mycobacterium avium subsp. paratuberculosis
cggggacggugcagccgg

SEQ ID NO: 914025 - RNA, 15 nt, Mycobacterium avium subsp. paratuberculosis
cggggaucagcgucg

SEQ ID NO: 914026 - RNA, 15 nt, Mycobacterium avium subsp. paratuberculosis
cggggaguucgcggu

SEQ ID NO: 914027 - RNA, 20 nt, Mycobacterium avium subsp. paratuberculosis
cggggaugguuuccacugcc

SEQ ID NO: 914028 - RNA, 20 nt, Mycobacterium avium subsp. paratuberculosis
cggggcacggugggacggcg

SEQ ID NO: 914029 - RNA, 14 nt, Mycobacterium avium subsp. paratuberculosis
cggggcagacccgc

SEQ ID NO: 914030 - RNA, 17 nt, Mycobacterium avium subsp. paratuberculosis
cggggcagaccgugugc

SEQ ID NO: 914031 - RNA, 15 nt, Mycobacterium avium subsp. paratuberculosis
cggggcaagcagcgg

SEQ ID NO: 914032 - RNA, 21 nt, Mycobacterium avium subsp. paratuberculosis
cggggcaagcagcggcagcca

SEQ ID NO: 914033 - RNA, 22 nt, Mycobacterium avium subsp. paratuberculosis
cggggaugucgucgggcgcggu

SEQ ID NO: 914034 - RNA, 14 nt, Mycobacterium avium subsp. paratuberculosis
cggggaucgccagg

SEQ ID NO: 914035 - RNA, 21 nt, Mycobacterium avium subsp. paratuberculosis
cggggaucgcgcagccgcggu

SEQ ID NO: 914036 - RNA, 20 nt, Mycobacterium avium subsp. paratuberculosis
cggggaugccgaaccgcugc

SEQ ID NO: 914037 - RNA, 16 nt, Mycobacterium avium subsp. paratuberculosis
cggggauguagccgcc

SEQ ID NO: 914038 - RNA, 17 nt, Mycobacterium avium subsp. paratuberculosis
cggggauguagccgccg

SEQ ID NO: 914039 - RNA, 18 nt, Mycobacterium avium subsp. paratuberculosis
cggggauguagccgccgg

SEQ ID NO: 914040 - RNA, 19 nt, Mycobacterium avium subsp. paratuberculosis
cggggauguagccgccggu

SEQ ID NO: 914041 - RNA, 22 nt, Mycobacterium avium subsp. paratuberculosis
cggggauguagccgccgguggc

SEQ ID NO: 914042 - RNA, 12 nt, Mycobacterium avium subsp. paratuberculosis
cggggccgccgu

SEQ ID NO: 914043 - RNA, 15 nt, Mycobacterium avium subsp. paratuberculosis
cggggccgccgucgg

SEQ ID NO: 914044 - RNA, 14 nt, Mycobacterium avium subsp. paratuberculosis
cggggcccgggccg

SEQ ID NO: 914045 - RNA, 17 nt, Mycobacterium avium subsp. paratuberculosis
cggggcccgggccggag

SEQ ID NO: 914046 - RNA, 22 nt, Mycobacterium avium subsp. paratuberculosis
cggggcccguccccaccaccga

SEQ ID NO: 914047 - RNA, 19 nt, Mycobacterium avium subsp. paratuberculosis
cggggccaucucagcguuc

SEQ ID NO: 914048 - RNA, 17 nt, Mycobacterium avium subsp. paratuberculosis
cggggcccggcccggcg

SEQ ID NO: 914049 - RNA, 22 nt, Mycobacterium avium subsp. paratuberculosis
cggggcccggcccggcgaugcc

SEQ ID NO: 914050 - RNA, 16 nt, Mycobacterium avium subsp. paratuberculosis
cggggcccuccgcggc

SEQ ID NO: 914051 - RNA, 18 nt, Mycobacterium avium subsp. paratuberculosis
cggggcccuccgcggcgc

SEQ ID NO: 914052 - RNA, 20 nt, Mycobacterium avium subsp. paratuberculosis
cggggcccuccgcggcgccg

SEQ ID NO: 914053 - RNA, 23 nt, Mycobacterium avium subsp. paratuberculosis
cggggcccuccgcggcgccguag

SEQ ID NO: 914054 - RNA, 19 nt, Mycobacterium avium subsp. paratuberculosis
cggggccaacuccggcggc

SEQ ID NO: 914055 - RNA, 15 nt, Mycobacterium avium subsp. paratuberculosis
cggggccaccaggcc

SEQ ID NO: 914056 - RNA, 16 nt, Mycobacterium avium subsp. paratuberculosis
cggggccaccaggcgc

SEQ ID NO: 914057 - RNA, 20 nt, Mycobacterium avium subsp. paratuberculosis
cggggccaccaggcgccguc

SEQ ID NO: 914058 - RNA, 17 nt, Mycobacterium avium subsp. paratuberculosis
cggggccccaacccccc

SEQ ID NO: 914059 - RNA, 12 nt, Mycobacterium avium subsp. paratuberculosis
cggggcaucgca

SEQ ID NO: 914060 - RNA, 15 nt, Mycobacterium avium subsp. paratuberculosis
cggggcaucgcagcg

SEQ ID NO: 914061 - RNA, 18 nt, Mycobacterium avium subsp. paratuberculosis
cggggcaucgcagcgcgc

SEQ ID NO: 914062 - RNA, 20 nt, Mycobacterium avium subsp. paratuberculosis
cggggcaucgcagcgcgcgg

SEQ ID NO: 914063 - RNA, 12 nt, Mycobacterium avium subsp. paratuberculosis
cggggcagccgu

SEQ ID NO: 914064 - RNA, 19 nt, Mycobacterium avium subsp. paratuberculosis
cggggcagccgucgaugcc

SEQ ID NO: 914065 - RNA, 12 nt, Mycobacterium avium subsp. paratuberculosis
cgggggccgccg

SEQ ID NO: 914066 - RNA, 21 nt, Mycobacterium avium subsp. paratuberculosis
cgggggccgcuccauguucgg

SEQ ID NO: 914067 - RNA, 21 nt, Mycobacterium avium subsp. paratuberculosis
cgggggccgucacaggccgcc

SEQ ID NO: 914068 - RNA, 14 nt, Mycobacterium avium subsp. paratuberculosis
cgggggcgcgggcg

SEQ ID NO: 914069 - RNA, 20 nt, Mycobacterium avium subsp. paratuberculosis
cgggggcgcguccgcgggcg

SEQ ID NO: 914070 - RNA, 12 nt, Mycobacterium avium subsp. paratuberculosis
cgggggaggcgu

SEQ ID NO: 914071 - RNA, 15 nt, Mycobacterium avium subsp. paratuberculosis
cgggggagucggggu

SEQ ID NO: 914072 - RNA, 18 nt, Mycobacterium avium subsp. paratuberculosis
cgggggagucggggugcu

SEQ ID NO: 914073 - RNA, 23 nt, Mycobacterium avium subsp. paratuberculosis
cgggggaucggcgggacccgcga

SEQ ID NO: 914074 - RNA, 22 nt, Mycobacterium avium subsp. paratuberculosis
cgggggauuucacgucugcucg

SEQ ID NO: 914075 - RNA, 23 nt, Mycobacterium avium subsp. paratuberculosis
cgggggcagggaauucagccugc

SEQ ID NO: 914076 - RNA, 19 nt, Mycobacterium avium subsp. paratuberculosis
cggggucaccuuggccgga

SEQ ID NO: 914077 - RNA, 22 nt, Mycobacterium avium subsp. paratuberculosis
cggggucacggauacccgcggc

SEQ ID NO: 914078 - RNA, 22 nt, Mycobacterium avium subsp. paratuberculosis
cgggggcgggcaccucgaugcc

SEQ ID NO: 914079 - RNA, 20 nt, Mycobacterium avium subsp. paratuberculosis
cggggucccaauccucgccg

SEQ ID NO: 914080 - RNA, 22 nt, Mycobacterium avium subsp. paratuberculosis
cggggucccaauccucgccgag

SEQ ID NO: 914081 - RNA, 14 nt, Mycobacterium avium subsp. paratuberculosis
cgggguccaccggc

SEQ ID NO: 914082 - RNA, 17 nt, Mycobacterium avium subsp. paratuberculosis
cgggguccaccggccga

SEQ ID NO: 914083 - RNA, 18 nt, Mycobacterium avium subsp. paratuberculosis
cgggguccaccggccgau

SEQ ID NO: 914084 - RNA, 14 nt, Mycobacterium avium subsp. paratuberculosis
cgggguccaggccg

SEQ ID NO: 914085 - RNA, 17 nt, Mycobacterium avium subsp. paratuberculosis
cgggguccaggccgcgc

SEQ ID NO: 914086 - RNA, 18 nt, Mycobacterium avium subsp. paratuberculosis
cgggguccaggccgcgcc

SEQ ID NO: 914087 - RNA, 19 nt, Mycobacterium avium subsp. paratuberculosis
cgggguccaggccgcgccg

SEQ ID NO: 914088 - RNA, 17 nt, Mycobacterium avium subsp. paratuberculosis
cggggucagggcgcuca

SEQ ID NO: 914089 - RNA, 15 nt, Mycobacterium avium subsp. paratuberculosis
cgggguagggcggcg

SEQ ID NO: 914090 - RNA, 16 nt, Mycobacterium avium subsp. paratuberculosis
cgggguagggcggcgg

SEQ ID NO: 914091 - RNA, 21 nt, Mycobacterium avium subsp. paratuberculosis
cgggguagggcggcgggguuc

SEQ ID NO: 914092 - RNA, 22 nt, Mycobacterium avium subsp. paratuberculosis
cgggguaguucuugacgccgau

SEQ ID NO: 914093 - RNA, 15 nt, Mycobacterium avium subsp. paratuberculosis
cgggggcggccgggc

SEQ ID NO: 914094 - RNA, 16 nt, Mycobacterium avium subsp. paratuberculosis
cgggggcggccgggcc

SEQ ID NO: 914095 - RNA, 12 nt, Mycobacterium avium subsp. paratuberculosis
cgggggcggccu

SEQ ID NO: 914096 - RNA, 19 nt, Mycobacterium avium subsp. paratuberculosis
cggggcuucgaacgcccgc

SEQ ID NO: 914097 - RNA, 22 nt, Mycobacterium avium subsp. paratuberculosis
cggggcuucgaacgcccgcacc

SEQ ID NO: 914098 - RNA, 12 nt, Mycobacterium avium subsp. paratuberculosis
cggggcggccgc

SEQ ID NO: 914099 - RNA, 13 nt, Mycobacterium avium subsp. paratuberculosis
cggggcggccgcc

SEQ ID NO: 914100 - RNA, 15 nt, Mycobacterium avium subsp. paratuberculosis
cggggcggccgccgg

SEQ ID NO: 914101 - RNA, 12 nt, Mycobacterium avium subsp. paratuberculosis
cggggcggcggg

SEQ ID NO: 914102 - RNA, 14 nt, Mycobacterium avium subsp. paratuberculosis
cggggcggcgggcg

SEQ ID NO: 914103 - RNA, 15 nt, Mycobacterium avium subsp. paratuberculosis
cggggcgggcagcac

SEQ ID NO: 914104 - RNA, 22 nt, Mycobacterium avium subsp. paratuberculosis
cggggcgggcagcaccagcggc

SEQ ID NO: 914105 - RNA, 15 nt, Mycobacterium avium subsp. paratuberculosis
cggggcgggcggcgg

SEQ ID NO: 914106 - RNA, 20 nt, Mycobacterium avium subsp. paratuberculosis
cggggcgcuguccuggucgc

SEQ ID NO: 914107 - RNA, 14 nt, Mycobacterium avium subsp. paratuberculosis
cggggcggaucccc

SEQ ID NO: 914108 - RNA, 16 nt, Mycobacterium avium subsp. paratuberculosis
cggggcggauccccgc

SEQ ID NO: 914109 - RNA, 18 nt, Mycobacterium avium subsp. paratuberculosis
cggggcggauccccgcgc

SEQ ID NO: 914110 - RNA, 14 nt, Mycobacterium avium subsp. paratuberculosis
cggggcgcggaccg

SEQ ID NO: 914111 - RNA, 16 nt, Mycobacterium avium subsp. paratuberculosis
cggggcgcggaccgca

SEQ ID NO: 914112 - RNA, 21 nt, Mycobacterium avium subsp. paratuberculosis
cggggccggcgaugcccguga

SEQ ID NO: 914113 - RNA, 12 nt, Mycobacterium avium subsp. paratuberculosis
cggggccgcggc

SEQ ID NO: 914114 - RNA, 16 nt, Mycobacterium avium subsp. paratuberculosis
cggggccgcggccggc

SEQ ID NO: 914115 - RNA, 18 nt, Mycobacterium avium subsp. paratuberculosis
cggggccgcggccggcac

SEQ ID NO: 914116 - RNA, 15 nt, Mycobacterium avium subsp. paratuberculosis
cggggccgcggcucg

SEQ ID NO: 914117 - RNA, 22 nt, Mycobacterium avium subsp. paratuberculosis
cggggccgcggcucgcgacgcg

SEQ ID NO: 914118 - RNA, 21 nt, Mycobacterium avium subsp. paratuberculosis
cggggcgccacuucuccacgc

SEQ ID NO: 914119 - RNA, 11 nt, Mycobacterium avium subsp. paratuberculosis
cggggcgcccc

SEQ ID NO: 914120 - RNA, 14 nt, Mycobacterium avium subsp. paratuberculosis
cggggcgccgacag

SEQ ID NO: 914121 - RNA, 15 nt, Mycobacterium avium subsp. paratuberculosis
cggggcgccgacagu

SEQ ID NO: 914122 - RNA, 20 nt, Mycobacterium avium subsp. paratuberculosis
cggggcgccgacagucgcgg

SEQ ID NO: 914123 - RNA, 15 nt, Mycobacterium avium subsp. paratuberculosis
cggggcgccgccgaa

SEQ ID NO: 914124 - RNA, 14 nt, Mycobacterium avium subsp. paratuberculosis
cggggcgccgcugc

SEQ ID NO: 914125 - RNA, 22 nt, Mycobacterium avium subsp. paratuberculosis
cggggcgccuaccggguggcca

SEQ ID NO: 914126 - RNA, 24 nt, Mycobacterium avium subsp. paratuberculosis
cggggcgccuaccggguggccagc

SEQ ID NO: 914127 - RNA, 14 nt, Mycobacterium avium subsp. paratuberculosis
cggggcgcgaggcg

SEQ ID NO: 914128 - RNA, 15 nt, Mycobacterium avium subsp. paratuberculosis
cgggcuaagucguug

SEQ ID NO: 914129 - RNA, 23 nt, Mycobacterium avium subsp. paratuberculosis
cgggcuaaugcaucgaugccggc

SEQ ID NO: 914130 - RNA, 14 nt, Mycobacterium avium subsp. paratuberculosis
cgggcuagacgcgc

SEQ ID NO: 914131 - RNA, 21 nt, Mycobacterium avium subsp. paratuberculosis
cgggcguuggcuuccucgcug

SEQ ID NO: 914132 - RNA, 13 nt, Mycobacterium avium subsp. paratuberculosis
cgggcucggcgua

SEQ ID NO: 914133 - RNA, 14 nt, Mycobacterium avium subsp. paratuberculosis
cgggcucggccgcc

SEQ ID NO: 914134 - RNA, 16 nt, Mycobacterium avium subsp. paratuberculosis
cgggcucgcgcacccg

SEQ ID NO: 914135 - RNA, 24 nt, Mycobacterium avium subsp. paratuberculosis
cgggcucggacgacucguucgacg

SEQ ID NO: 914136 - RNA, 20 nt, Mycobacterium avium subsp. paratuberculosis
cgggcucgcgcuggcggcca

SEQ ID NO: 914137 - RNA, 19 nt, Mycobacterium avium subsp. paratuberculosis
cgggcucgcggccugcggg

SEQ ID NO: 914138 - RNA, 17 nt, Mycobacterium avium subsp. paratuberculosis
cgggcuaucgcccggcg

SEQ ID NO: 914139 - RNA, 18 nt, Mycobacterium avium subsp. paratuberculosis
cgggcuaucgcccggcgc

SEQ ID NO: 914140 - RNA, 13 nt, Mycobacterium avium subsp. paratuberculosis
cgggcucgccggc

SEQ ID NO: 914141 - RNA, 19 nt, Mycobacterium avium subsp. paratuberculosis
cgggcucgccucggggauc

SEQ ID NO: 914142 - RNA, 22 nt, Mycobacterium avium subsp. paratuberculosis
cgggcucgccucggggaucgcc

SEQ ID NO: 914143 - RNA, 15 nt, Mycobacterium avium subsp. paratuberculosis
cgggcuggccgucgg

SEQ ID NO: 914144 - RNA, 16 nt, Mycobacterium avium subsp. paratuberculosis
cgggcuggccgucggc

SEQ ID NO: 914145 - RNA, 17 nt, Mycobacterium avium subsp. paratuberculosis
cgggcuggccgucggcg

SEQ ID NO: 914146 - RNA, 19 nt, Mycobacterium avium subsp. paratuberculosis
cgggcuggccgucggcgau

SEQ ID NO: 914147 - RNA, 21 nt, Mycobacterium avium subsp. paratuberculosis
cgggcuggccgucggcgaugg

SEQ ID NO: 914148 - RNA, 16 nt, Mycobacterium avium subsp. paratuberculosis
cgggcugaccgccagg

SEQ ID NO: 914149 - RNA, 17 nt, Mycobacterium avium subsp. paratuberculosis
cgggcugaccgucgacc

SEQ ID NO: 914150 - RNA, 15 nt, Mycobacterium avium subsp. paratuberculosis
cgggcugaccucgcg

SEQ ID NO: 914151 - RNA, 22 nt, Mycobacterium avium subsp. paratuberculosis
cgggcugaccucgcgcaccggc

SEQ ID NO: 914152 - RNA, 14 nt, Mycobacterium avium subsp. paratuberculosis
cgggcugacgucga

SEQ ID NO: 914153 - RNA, 17 nt, Mycobacterium avium subsp. paratuberculosis
cgggcugacgucgaagg

SEQ ID NO: 914154 - RNA, 16 nt, Mycobacterium avium subsp. paratuberculosis
cgggcugaacucgacg

SEQ ID NO: 914155 - RNA, 23 nt, Mycobacterium avium subsp. paratuberculosis
cgggcugagcugugccgcggugc

SEQ ID NO: 914156 - RNA, 18 nt, Mycobacterium avium subsp. paratuberculosis
cgggcucggucaccccgg

SEQ ID NO: 914157 - RNA, 13 nt, Mycobacterium avium subsp. paratuberculosis
cgggccuuggcga

SEQ ID NO: 914158 - RNA, 22 nt, Mycobacterium avium subsp. paratuberculosis
cgggccugggcaauggccgcga

SEQ ID NO: 914159 - RNA, 17 nt, Mycobacterium avium subsp. paratuberculosis
cgggccuuguugcggcg

SEQ ID NO: 914160 - RNA, 15 nt, Mycobacterium avium subsp. paratuberculosis
cgggcguggcgucgg

SEQ ID NO: 914161 - RNA, 18 nt, Mycobacterium avium subsp. paratuberculosis
cgggcguggcgucgguga

SEQ ID NO: 914162 - RNA, 14 nt, Mycobacterium avium subsp. paratuberculosis
cgggcguggcuuga

SEQ ID NO: 914163 - RNA, 22 nt, Mycobacterium avium subsp. paratuberculosis
cgggcguguagccugcggccug

SEQ ID NO: 914164 - RNA, 18 nt, Mycobacterium avium subsp. paratuberculosis
cgggcguguaguccaggu

SEQ ID NO: 914165 - RNA, 23 nt, Mycobacterium avium subsp. paratuberculosis
cgggcguguaguccaggucgauc

SEQ ID NO: 914166 - RNA, 15 nt, Mycobacterium avium subsp. paratuberculosis
cgggcguugcccgcc

SEQ ID NO: 914167 - RNA, 18 nt, Mycobacterium avium subsp. paratuberculosis
cgggcguugcccgccgcg

SEQ ID NO: 914168 - RNA, 20 nt, Mycobacterium avium subsp. paratuberculosis
cgggcguugcccgccgcggc

SEQ ID NO: 914169 - RNA, 22 nt, Mycobacterium avium subsp. paratuberculosis
cgggcguugcccgccgcggcga

SEQ ID NO: 914170 - RNA, 17 nt, Mycobacterium avium subsp. paratuberculosis
cgggcguugcgccgcga

SEQ ID NO: 914171 - RNA, 19 nt, Mycobacterium avium subsp. paratuberculosis
cgggcguugcgccgcgagc

SEQ ID NO: 914172 - RNA, 13 nt, Mycobacterium avium subsp. paratuberculosis
cgggccugcucgu

SEQ ID NO: 914173 - RNA, 21 nt, Mycobacterium avium subsp. paratuberculosis
cgggccugcucgucggggcag

SEQ ID NO: 914174 - RNA, 16 nt, Mycobacterium avium subsp. paratuberculosis
cgggccugcggcgcgg

SEQ ID NO: 914175 - RNA, 17 nt, Mycobacterium avium subsp. paratuberculosis
cgggccugcggcgcggc

SEQ ID NO: 914176 - RNA, 17 nt, Mycobacterium avium subsp. paratuberculosis
cgggccugcggcggccg

SEQ ID NO: 914177 - RNA, 18 nt, Mycobacterium avium subsp. paratuberculosis
cgggccugcggcggccgc

SEQ ID NO: 914178 - RNA, 19 nt, Mycobacterium avium subsp. paratuberculosis
cgggccugcggcggccgca

SEQ ID NO: 914179 - RNA, 21 nt, Mycobacterium avium subsp. paratuberculosis
cgggccugcggcggccgcagc

SEQ ID NO: 914180 - RNA, 14 nt, Mycobacterium avium subsp. paratuberculosis
cgggccuguccagc

SEQ ID NO: 914181 - RNA, 16 nt, Mycobacterium avium subsp. paratuberculosis
cgggccuucuucucga

SEQ ID NO: 914182 - RNA, 18 nt, Mycobacterium avium subsp. paratuberculosis
cgggccuucuucucgacg

SEQ ID NO: 914183 - RNA, 21 nt, Mycobacterium avium subsp. paratuberculosis
cgggccuugacggccugggcg

SEQ ID NO: 914184 - RNA, 23 nt, Mycobacterium avium subsp. paratuberculosis
cgggccuugacggccugggcgac

SEQ ID NO: 914185 - RNA, 15 nt, Mycobacterium avium subsp. paratuberculosis
cgggccuugagcacc

SEQ ID NO: 914186 - RNA, 17 nt, Mycobacterium avium subsp. paratuberculosis
cgggccuugagcaccgc

SEQ ID NO: 914187 - RNA, 19 nt, Mycobacterium avium subsp. paratuberculosis
cgggccuugagcaccgcgu

SEQ ID NO: 914188 - RNA, 22 nt, Mycobacterium avium subsp. paratuberculosis
cgggccuugagcaccgcgucgu

SEQ ID NO: 914189 - RNA, 16 nt, Mycobacterium avium subsp. paratuberculosis
cgggcugucccggccg

SEQ ID NO: 914190 - RNA, 20 nt, Mycobacterium avium subsp. paratuberculosis
cgggcugucccggccgcgac

SEQ ID NO: 914191 - RNA, 16 nt, Mycobacterium avium subsp. paratuberculosis
cgggcugugccggcgg

SEQ ID NO: 914192 - RNA, 17 nt, Mycobacterium avium subsp. paratuberculosis
cgggcugugccggcggg

SEQ ID NO: 914193 - RNA, 18 nt, Mycobacterium avium subsp. paratuberculosis
cgggcugugccggcgggu

SEQ ID NO: 914194 - RNA, 13 nt, Mycobacterium avium subsp. paratuberculosis
cgggcuucggcgu

SEQ ID NO: 914195 - RNA, 18 nt, Mycobacterium avium subsp. paratuberculosis
cgggcuguugaccacggc

SEQ ID NO: 914196 - RNA, 22 nt, Mycobacterium avium subsp. paratuberculosis
cgggcuuccccaaccuggacgg

SEQ ID NO: 914197 - RNA, 21 nt, Mycobacterium avium subsp. paratuberculosis
cgggcuugcgcaacagcgugc

SEQ ID NO: 914198 - RNA, 13 nt, Mycobacterium avium subsp. paratuberculosis
cgggcuguccgcg

SEQ ID NO: 914199 - RNA, 15 nt, Mycobacterium avium subsp. paratuberculosis
cgggcugucggcgcc

SEQ ID NO: 914200 - RNA, 14 nt, Mycobacterium avium subsp. paratuberculosis
cgggcugucgggca

SEQ ID NO: 914201 - RNA, 16 nt, Mycobacterium avium subsp. paratuberculosis
cgggcugucgggcagg

SEQ ID NO: 914202 - RNA, 19 nt, Mycobacterium avium subsp. paratuberculosis
cgggcugucgggcaggccg

SEQ ID NO: 914203 - RNA, 20 nt, Mycobacterium avium subsp. paratuberculosis
cgggcuggugucccgcgugg

SEQ ID NO: 914204 - RNA, 18 nt, Mycobacterium avium subsp. paratuberculosis
cgggcuggguccgauugc

SEQ ID NO: 914205 - RNA, 16 nt, Mycobacterium avium subsp. paratuberculosis
cgggcugguccggaac

SEQ ID NO: 914206 - RNA, 18 nt, Mycobacterium avium subsp. paratuberculosis
cgggcuggugcgcagccg

SEQ ID NO: 914207 - RNA, 19 nt, Mycobacterium avium subsp. paratuberculosis
cgggcuggugcgcagccgu

SEQ ID NO: 914208 - RNA, 20 nt, Mycobacterium avium subsp. paratuberculosis
cgggcuggugcgcagccguc

SEQ ID NO: 914209 - RNA, 21 nt, Mycobacterium avium subsp. paratuberculosis
cgggcuggugcgcagccgucg

SEQ ID NO: 914210 - RNA, 22 nt, Mycobacterium avium subsp. paratuberculosis
cgggcucggaguugcgcagccg

SEQ ID NO: 914211 - RNA, 15 nt, Mycobacterium avium subsp. paratuberculosis
cgggcuggcgcugga

SEQ ID NO: 914212 - RNA, 17 nt, Mycobacterium avium subsp. paratuberculosis
cgggcuggcgcuggauc

SEQ ID NO: 914213 - RNA, 20 nt, Mycobacterium avium subsp. paratuberculosis
cgggcuggcguaggacagca

SEQ ID NO: 914214 - RNA, 21 nt, Mycobacterium avium subsp. paratuberculosis
cgggcuggcguaggacagcag

SEQ ID NO: 914215 - RNA, 16 nt, Mycobacterium avium subsp. paratuberculosis
cggggaacaccggcga

SEQ ID NO: 914216 - RNA, 16 nt, Mycobacterium avium subsp. paratuberculosis
cggggacccgcaccgg

SEQ ID NO: 914217 - RNA, 13 nt, Mycobacterium avium subsp. paratuberculosis
cggggaccguccc

SEQ ID NO: 914218 - RNA, 19 nt, Mycobacterium avium subsp. paratuberculosis
cggggaccguccccguccg

SEQ ID NO: 914219 - RNA, 15 nt, Mycobacterium avium subsp. paratuberculosis
cggggacgacggcgg

SEQ ID NO: 914220 - RNA, 18 nt, Mycobacterium avium subsp. paratuberculosis
cggggaacuccugcagga

SEQ ID NO: 914221 - RNA, 22 nt, Mycobacterium avium subsp. paratuberculosis
cggggaagggcuccccggacag

SEQ ID NO: 914222 - RNA, 18 nt, Mycobacterium avium subsp. paratuberculosis
cggggaaggugcgggcgg

SEQ ID NO: 914223 - RNA, 19 nt, Mycobacterium avium subsp. paratuberculosis
cggggaaggugcgggcggg

SEQ ID NO: 914224 - RNA, 19 nt, Mycobacterium avium subsp. paratuberculosis
cggggaaguaguaccccgg

SEQ ID NO: 914225 - RNA, 17 nt, Mycobacterium avium subsp. paratuberculosis
cggggaauccuggccga

SEQ ID NO: 914226 - RNA, 18 nt, Mycobacterium avium subsp. paratuberculosis
cggggacacccucggggu

SEQ ID NO: 914227 - RNA, 20 nt, Mycobacterium avium subsp. paratuberculosis
cggggacaccgggcaccgac

SEQ ID NO: 914228 - RNA, 13 nt, Mycobacterium avium subsp. paratuberculosis
cggcgucacucug

SEQ ID NO: 914229 - RNA, 24 nt, Mycobacterium avium subsp. paratuberculosis
cggcgucacucuggcgugacgcuc

SEQ ID NO: 914230 - RNA, 19 nt, Mycobacterium avium subsp. paratuberculosis
cggcgucagagguuggcga

SEQ ID NO: 914231 - RNA, 14 nt, Mycobacterium avium subsp. paratuberculosis
cggcgucaccgcgg

SEQ ID NO: 914232 - RNA, 20 nt, Mycobacterium avium subsp. paratuberculosis
cggcgucggggggucagacc

SEQ ID NO: 914233 - RNA, 21 nt, Mycobacterium avium subsp. paratuberculosis
cggcgucggguagggcgccgu

SEQ ID NO: 914234 - RNA, 22 nt, Mycobacterium avium subsp. paratuberculosis
cggcgucggguagggcgccguc

SEQ ID NO: 914235 - RNA, 13 nt, Mycobacterium avium subsp. paratuberculosis
cggcgucgguguc

SEQ ID NO: 914236 - RNA, 19 nt, Mycobacterium avium subsp. paratuberculosis
cggcgucggugucccgcgc

SEQ ID NO: 914237 - RNA, 15 nt, Mycobacterium avium subsp. paratuberculosis
cggcgucguacagca

SEQ ID NO: 914238 - RNA, 18 nt, Mycobacterium avium subsp. paratuberculosis
cggcgucguacagcagcc

SEQ ID NO: 914239 - RNA, 20 nt, Mycobacterium avium subsp. paratuberculosis
cggcgucguagacgcugccg

SEQ ID NO: 914240 - RNA, 21 nt, Mycobacterium avium subsp. paratuberculosis
cggcgucguagacgcugccgc

SEQ ID NO: 914241 - RNA, 23 nt, Mycobacterium avium subsp. paratuberculosis
cggcgucguagacgcugccgcug

SEQ ID NO: 914242 - RNA, 19 nt, Mycobacterium avium subsp. paratuberculosis
cggcgucguaguugcggcc

SEQ ID NO: 914243 - RNA, 20 nt, Mycobacterium avium subsp. paratuberculosis
cggcgucguaguugcggccg

SEQ ID NO: 914244 - RNA, 23 nt, Mycobacterium avium subsp. paratuberculosis
cggcgucguaguugcggccggcg

SEQ ID NO: 914245 - RNA, 18 nt, Mycobacterium avium subsp. paratuberculosis
cggcgucucagucggcca

SEQ ID NO: 914246 - RNA, 22 nt, Mycobacterium avium subsp. paratuberculosis
cggcgucucagucggccaccgc

SEQ ID NO: 914247 - RNA, 16 nt, Mycobacterium avium subsp. paratuberculosis
cggcgucgucgucgca

SEQ ID NO: 914248 - RNA, 13 nt, Mycobacterium avium subsp. paratuberculosis
cggcgucgucgcc

SEQ ID NO: 914249 - RNA, 16 nt, Mycobacterium avium subsp. paratuberculosis
cggcgucgucgccgug

SEQ ID NO: 914250 - RNA, 15 nt, Mycobacterium avium subsp. paratuberculosis
cggcgucgucgucga

SEQ ID NO: 914251 - RNA, 16 nt, Mycobacterium avium subsp. paratuberculosis
cggcgucgucgagcac

SEQ ID NO: 914252 - RNA, 17 nt, Mycobacterium avium subsp. paratuberculosis
cggcgucgucgagcacc

SEQ ID NO: 914253 - RNA, 18 nt, Mycobacterium avium subsp. paratuberculosis
cggcgucgucgagcaccg

SEQ ID NO: 914254 - RNA, 19 nt, Mycobacterium avium subsp. paratuberculosis
cggcgucgucgagcaccgg

SEQ ID NO: 914255 - RNA, 20 nt, Mycobacterium avium subsp. paratuberculosis
cggcgucgucgagcaccggc

SEQ ID NO: 914256 - RNA, 23 nt, Mycobacterium avium subsp. paratuberculosis
cggcgucgucgagcaccggcagc

SEQ ID NO: 914257 - RNA, 12 nt, Mycobacterium avium subsp. paratuberculosis
cggcgucacccc

SEQ ID NO: 914258 - RNA, 22 nt, Mycobacterium avium subsp. paratuberculosis
cggcgucaccccaccgagcagc

SEQ ID NO: 914259 - RNA, 21 nt, Mycobacterium avium subsp. paratuberculosis
cggcguauucgucgucggccu

SEQ ID NO: 914260 - RNA, 23 nt, Mycobacterium avium subsp. paratuberculosis
cggcguauucgucgucggccucg

SEQ ID NO: 914261 - RNA, 20 nt, Mycobacterium avium subsp. paratuberculosis
cggcguaucuccaccgucga

SEQ ID NO: 914262 - RNA, 22 nt, Mycobacterium avium subsp. paratuberculosis
cggcguaucuccaccgucgaug

SEQ ID NO: 914263 - RNA, 15 nt, Mycobacterium avium subsp. paratuberculosis
cggcguaggcggcca

SEQ ID NO: 914264 - RNA, 19 nt, Mycobacterium avium subsp. paratuberculosis
cggcguaggugggcagcgc

SEQ ID NO: 914265 - RNA, 20 nt, Mycobacterium avium subsp. paratuberculosis
cggcguaggugggcagcgcg

SEQ ID NO: 914266 - RNA, 21 nt, Mycobacterium avium subsp. paratuberculosis
cggcguaggugggcagcgcgg

SEQ ID NO: 914267 - RNA, 24 nt, Mycobacterium avium subsp. paratuberculosis
cggcguaggugggcagcgcggcca

SEQ ID NO: 914268 - RNA, 15 nt, Mycobacterium avium subsp. paratuberculosis
cggcguagucgccgg

SEQ ID NO: 914269 - RNA, 21 nt, Mycobacterium avium subsp. paratuberculosis
cggcguagucggcgcagcgca

SEQ ID NO: 914270 - RNA, 13 nt, Mycobacterium avium subsp. paratuberculosis
cggcguagccgcc

SEQ ID NO: 914271 - RNA, 17 nt, Mycobacterium avium subsp. paratuberculosis
cggcguagccgccgguu

SEQ ID NO: 914272 - RNA, 20 nt, Mycobacterium avium subsp. paratuberculosis
cggcguagaggugcagcggg

SEQ ID NO: 914273 - RNA, 17 nt, Mycobacterium avium subsp. paratuberculosis
cggcguacugcgcgacc

SEQ ID NO: 914274 - RNA, 19 nt, Mycobacterium avium subsp. paratuberculosis
cggcguacugcgcgaccaa

SEQ ID NO: 914275 - RNA, 19 nt, Mycobacterium avium subsp. paratuberculosis
cggcguacugcgcgagcuc

SEQ ID NO: 914276 - RNA, 17 nt, Mycobacterium avium subsp. paratuberculosis
cggcguagaacaccgaa

SEQ ID NO: 914277 - RNA, 15 nt, Mycobacterium avium subsp. paratuberculosis
cggcguagaccagcg

SEQ ID NO: 914278 - RNA, 20 nt, Mycobacterium avium subsp. paratuberculosis
cggcguagaccagcgacgcc

SEQ ID NO: 914279 - RNA, 14 nt, Mycobacterium avium subsp. paratuberculosis
cggcgugccgcccg

SEQ ID NO: 914280 - RNA, 15 nt, Mycobacterium avium subsp. paratuberculosis
cggcgugccgcccgg

SEQ ID NO: 914281 - RNA, 15 nt, Mycobacterium avium subsp. paratuberculosis
cggcgugccggacuc

SEQ ID NO: 914282 - RNA, 14 nt, Mycobacterium avium subsp. paratuberculosis
cggcgugcuccagc

SEQ ID NO: 914283 - RNA, 15 nt, Mycobacterium avium subsp. paratuberculosis
cggcgugcuccagca

SEQ ID NO: 914284 - RNA, 17 nt, Mycobacterium avium subsp. paratuberculosis
cggcgugcuccagcagg

SEQ ID NO: 914285 - RNA, 22 nt, Mycobacterium avium subsp. paratuberculosis
cggcgugcuccagcaggcgcgc

SEQ ID NO: 914286 - RNA, 13 nt, Mycobacterium avium subsp. paratuberculosis
cggcgugcucggc

SEQ ID NO: 914287 - RNA, 15 nt, Mycobacterium avium subsp. paratuberculosis
cggcgugcucggcca

SEQ ID NO: 914288 - RNA, 17 nt, Mycobacterium avium subsp. paratuberculosis
cggcgugcucggccacg

SEQ ID NO: 914289 - RNA, 21 nt, Mycobacterium avium subsp. paratuberculosis
cggcgugcucggccacgacgc

SEQ ID NO: 914290 - RNA, 20 nt, Mycobacterium avium subsp. paratuberculosis
cggcgugcccgccgaccagg

SEQ ID NO: 914291 - RNA, 14 nt, Mycobacterium avium subsp. paratuberculosis
cggcgugcccgcuc

SEQ ID NO: 914292 - RNA, 16 nt, Mycobacterium avium subsp. paratuberculosis
cggcgugcccgcucgc

SEQ ID NO: 914293 - RNA, 17 nt, Mycobacterium avium subsp. paratuberculosis
cggcgucuugcugcgga

SEQ ID NO: 914294 - RNA, 17 nt, Mycobacterium avium subsp. paratuberculosis
cggcgucuuggggaugg

SEQ ID NO: 914295 - RNA, 12 nt, Mycobacterium avium subsp. paratuberculosis
cggcgugccacc

SEQ ID NO: 914296 - RNA, 14 nt, Mycobacterium avium subsp. paratuberculosis
cggcgugccaccgc

SEQ ID NO: 914297 - RNA, 15 nt, Mycobacterium avium subsp. paratuberculosis
cggcgugccagggca

SEQ ID NO: 914298 - RNA, 24 nt, Mycobacterium avium subsp. paratuberculosis
cggcgugccagggcagcgcgacca

SEQ ID NO: 914299 - RNA, 15 nt, Mycobacterium avium subsp. paratuberculosis
cggcgucuggccgga

SEQ ID NO: 914300 - RNA, 17 nt, Mycobacterium avium subsp. paratuberculosis
cggcgucuggccggagc

SEQ ID NO: 914301 - RNA, 20 nt, Mycobacterium avium subsp. paratuberculosis
cggcgucguugagcaggcug

SEQ ID NO: 914302 - RNA, 16 nt, Mycobacterium avium subsp. paratuberculosis
cggcgucucggcccga

SEQ ID NO: 914303 - RNA, 17 nt, Mycobacterium avium subsp. paratuberculosis
cggcgucucggcccgag

SEQ ID NO: 914304 - RNA, 13 nt, Mycobacterium avium subsp. paratuberculosis
cggcgucucggcg

SEQ ID NO: 914305 - RNA, 17 nt, Mycobacterium avium subsp. paratuberculosis
cggcgucuucggggaug

SEQ ID NO: 914306 - RNA, 20 nt, Mycobacterium avium subsp. paratuberculosis
cggcgucuugaucucggcgg

SEQ ID NO: 914307 - RNA, 22 nt, Mycobacterium avium subsp. paratuberculosis
cggcgucuugaucucggcggcg

SEQ ID NO: 914308 - RNA, 23 nt, Mycobacterium avium subsp. paratuberculosis
cggcgucuugaucucggcggcga

SEQ ID NO: 914309 - RNA, 23 nt, Mycobacterium avium subsp. paratuberculosis
cggcguggaacacgcccagcgcc

SEQ ID NO: 914310 - RNA, 18 nt, Mycobacterium avium subsp. paratuberculosis
cggcgugcugggccacga

SEQ ID NO: 914311 - RNA, 19 nt, Mycobacterium avium subsp. paratuberculosis
cggcgugcugcgcagcagc

SEQ ID NO: 914312 - RNA, 12 nt, Mycobacterium avium subsp. paratuberculosis
cggcgugcgcca

SEQ ID NO: 914313 - RNA, 21 nt, Mycobacterium avium subsp. paratuberculosis
cggcguggcgcucagcggcag

SEQ ID NO: 914314 - RNA, 15 nt, Mycobacterium avium subsp. paratuberculosis
cggcguggccguccg

SEQ ID NO: 914315 - RNA, 14 nt, Mycobacterium avium subsp. paratuberculosis
cggcguggcaggcg

SEQ ID NO: 914316 - RNA, 15 nt, Mycobacterium avium subsp. paratuberculosis
cggcguggcaggcga

SEQ ID NO: 914317 - RNA, 20 nt, Mycobacterium avium subsp. paratuberculosis
cggcguggcaggcgauggcg

SEQ ID NO: 914318 - RNA, 17 nt, Mycobacterium avium subsp. paratuberculosis
cggcgugguagccgccg

SEQ ID NO: 914319 - RNA, 19 nt, Mycobacterium avium subsp. paratuberculosis
cggcgugguagccgccguu

SEQ ID NO: 914320 - RNA, 15 nt, Mycobacterium avium subsp. paratuberculosis
cggcguggucggcga

SEQ ID NO: 914321 - RNA, 17 nt, Mycobacterium avium subsp. paratuberculosis
cggcguggucggcgaag

SEQ ID NO: 914322 - RNA, 20 nt, Mycobacterium avium subsp. paratuberculosis
cggcgugggguucccggccg

SEQ ID NO: 914323 - RNA, 21 nt, Mycobacterium avium subsp. paratuberculosis
cggcgugggguucccggccgg

SEQ ID NO: 914324 - RNA, 22 nt, Mycobacterium avium subsp. paratuberculosis
cggcgugggguucccggccggu

SEQ ID NO: 914325 - RNA, 15 nt, Mycobacterium avium subsp. paratuberculosis
cggcgugggccgcag

SEQ ID NO: 914326 - RNA, 16 nt, Mycobacterium avium subsp. paratuberculosis
cggcgugggccgcagc

SEQ ID NO: 914327 - RNA, 19 nt, Mycobacterium avium subsp. paratuberculosis
cggcgugggccgcagcgcg

SEQ ID NO: 914328 - RNA, 21 nt, Mycobacterium avium subsp. paratuberculosis
cggcgugggccgcagcgcggc

SEQ ID NO: 914329 - RNA, 23 nt, Mycobacterium avium subsp. paratuberculosis
cggcgugggccgcagcgcggcga

SEQ ID NO: 914330 - RNA, 14 nt, Mycobacterium avium subsp. paratuberculosis
cggcguggcggugg

SEQ ID NO: 914331 - RNA, 18 nt, Mycobacterium avium subsp. paratuberculosis
cggcguggcgguggcggc

SEQ ID NO: 914332 - RNA, 20 nt, Mycobacterium avium subsp. paratuberculosis
cggcguggcgguggcggcga

SEQ ID NO: 914333 - RNA, 18 nt, Mycobacterium avium subsp. paratuberculosis
cggcguggcugaggccgc

SEQ ID NO: 914334 - RNA, 23 nt, Mycobacterium avium subsp. paratuberculosis
cggcguggggacccccucgucga

SEQ ID NO: 914335 - RNA, 14 nt, Mycobacterium avium subsp. paratuberculosis
cggcguucaucgug

SEQ ID NO: 914336 - RNA, 16 nt, Mycobacterium avium subsp. paratuberculosis
cggcguucaucgugcc

SEQ ID NO: 914337 - RNA, 17 nt, Mycobacterium avium subsp. paratuberculosis
cggcguucaucgugccg

SEQ ID NO: 914338 - RNA, 18 nt, Mycobacterium avium subsp. paratuberculosis
cggcguucaucgugccga

SEQ ID NO: 914339 - RNA, 23 nt, Mycobacterium avium subsp. paratuberculosis
cggcguucaucgugccgaacgug

SEQ ID NO: 914340 - RNA, 14 nt, Mycobacterium avium subsp. paratuberculosis
cggcguucagcagc

SEQ ID NO: 914341 - RNA, 19 nt, Mycobacterium avium subsp. paratuberculosis
cggcguucagcagcgcggu

SEQ ID NO: 914342 - RNA, 17 nt, Mycobacterium avium subsp. paratuberculosis
cggcguucagccggagc

SEQ ID NO: 914343 - RNA, 19 nt, Mycobacterium avium subsp. paratuberculosis
cggcguucagccggagccg

SEQ ID NO: 914344 - RNA, 22 nt, Mycobacterium avium subsp. paratuberculosis
cggcguucagcggcaccgucac

SEQ ID NO: 914345 - RNA, 15 nt, Mycobacterium avium subsp. paratuberculosis
cggcguucgauugcc

SEQ ID NO: 914346 - RNA, 16 nt, Mycobacterium avium subsp. paratuberculosis
cggcguucgauugccg

SEQ ID NO: 914347 - RNA, 15 nt, Mycobacterium avium subsp. paratuberculosis
cggcguucggugccc

SEQ ID NO: 914348 - RNA, 17 nt, Mycobacterium avium subsp. paratuberculosis
cggcguucuccagcacc

SEQ ID NO: 914349 - RNA, 20 nt, Mycobacterium avium subsp. paratuberculosis
cggcguucuccagcacccgc

SEQ ID NO: 914350 - RNA, 19 nt, Mycobacterium avium subsp. paratuberculosis
cggcuaagccggcgucggg

SEQ ID NO: 914351 - RNA, 19 nt, Mycobacterium avium subsp. paratuberculosis
cggcuaauucagcugcgga

SEQ ID NO: 914352 - RNA, 16 nt, Mycobacterium avium subsp. paratuberculosis
cggcuaauucgggccg

SEQ ID NO: 914353 - RNA, 17 nt, Mycobacterium avium subsp. paratuberculosis
cggcuaauucgggccgc

SEQ ID NO: 914354 - RNA, 18 nt, Mycobacterium avium subsp. paratuberculosis
cggcuaauucgggccgcc

SEQ ID NO: 914355 - RNA, 20 nt, Mycobacterium avium subsp. paratuberculosis
cggcuaauucgggccgccgc

SEQ ID NO: 914356 - RNA, 22 nt, Mycobacterium avium subsp. paratuberculosis
cggcucagggugcgcuggccga

SEQ ID NO: 914357 - RNA, 23 nt, Mycobacterium avium subsp. paratuberculosis
cggcucagcaacccgccgagcgu

SEQ ID NO: 914358 - RNA, 14 nt, Mycobacterium avium subsp. paratuberculosis
cggcucagcggcaa

SEQ ID NO: 914359 - RNA, 15 nt, Mycobacterium avium subsp. paratuberculosis
cggcucagcggcaac

SEQ ID NO: 914360 - RNA, 16 nt, Mycobacterium avium subsp. paratuberculosis
cggcucaccgaacgcg

SEQ ID NO: 914361 - RNA, 21 nt, Mycobacterium avium subsp. paratuberculosis
cggcucacgacuccuggccga

SEQ ID NO: 914362 - RNA, 17 nt, Mycobacterium avium subsp. paratuberculosis
cggcucagaaggcguca

SEQ ID NO: 914363 - RNA, 22 nt, Mycobacterium avium subsp. paratuberculosis
cggcucagaaggcgucaucgug

SEQ ID NO: 914364 - RNA, 14 nt, Mycobacterium avium subsp. paratuberculosis
cggcucagcccggc

SEQ ID NO: 914365 - RNA, 15 nt, Mycobacterium avium subsp. paratuberculosis
cggcucagcccggcg

SEQ ID NO: 914366 - RNA, 16 nt, Mycobacterium avium subsp. paratuberculosis
cggcucagcccggcgc

SEQ ID NO: 914367 - RNA, 18 nt, Mycobacterium avium subsp. paratuberculosis
cggcucagcccggcgcuc

SEQ ID NO: 914368 - RNA, 14 nt, Mycobacterium avium subsp. paratuberculosis
cggcuaccgcgcgg

SEQ ID NO: 914369 - RNA, 14 nt, Mycobacterium avium subsp. paratuberculosis
cggcuaccggcgcu

SEQ ID NO: 914370 - RNA, 17 nt, Mycobacterium avium subsp. paratuberculosis
cggcuaccggcgcugga

SEQ ID NO: 914371 - RNA, 22 nt, Mycobacterium avium subsp. paratuberculosis
cggcuaccuaggcgucgucggc

SEQ ID NO: 914372 - RNA, 22 nt, Mycobacterium avium subsp. paratuberculosis
cggcuaccugaccagcggcgcg

SEQ ID NO: 914373 - RNA, 18 nt, Mycobacterium avium subsp. paratuberculosis
cggcuacucggacgccgg

SEQ ID NO: 914374 - RNA, 20 nt, Mycobacterium avium subsp. paratuberculosis
cggcuacucggacgccggca

SEQ ID NO: 914375 - RNA, 22 nt, Mycobacterium avium subsp. paratuberculosis
cggcuacucggacgccggcagc

SEQ ID NO: 914376 - RNA, 19 nt, Mycobacterium avium subsp. paratuberculosis
cggcuagacgcgcagcacg

SEQ ID NO: 914377 - RNA, 22 nt, Mycobacterium avium subsp. paratuberculosis
cggcuagcagcuccggucggcg

SEQ ID NO: 914378 - RNA, 16 nt, Mycobacterium avium subsp. paratuberculosis
cggcucacagcgcggc

SEQ ID NO: 914379 - RNA, 21 nt, Mycobacterium avium subsp. paratuberculosis
cggcucacagcgcggcgguga

SEQ ID NO: 914380 - RNA, 18 nt, Mycobacterium avium subsp. paratuberculosis
cggcucaccgaacgcgau

SEQ ID NO: 914381 - RNA, 19 nt, Mycobacterium avium subsp. paratuberculosis
cggcucaccgaacgcgaug

SEQ ID NO: 914382 - RNA, 14 nt, Mycobacterium avium subsp. paratuberculosis
cggcuccgaucucc

SEQ ID NO: 914383 - RNA, 17 nt, Mycobacterium avium subsp. paratuberculosis
cggcuccgaucuccugg

SEQ ID NO: 914384 - RNA, 22 nt, Mycobacterium avium subsp. paratuberculosis
cggcuccgcaugcccgggcgac

SEQ ID NO: 914385 - RNA, 20 nt, Mycobacterium avium subsp. paratuberculosis
cggcuccuaugucggugcgg

SEQ ID NO: 914386 - RNA, 12 nt, Mycobacterium avium subsp. paratuberculosis
cggcuccggccg

SEQ ID NO: 914387 - RNA, 17 nt, Mycobacterium avium subsp. paratuberculosis
cggcuccggccgcgccg

SEQ ID NO: 914388 - RNA, 18 nt, Mycobacterium avium subsp. paratuberculosis
cggcuccggccgcgccgg

SEQ ID NO: 914389 - RNA, 17 nt, Mycobacterium avium subsp. paratuberculosis
cggcucgauggacgcca

SEQ ID NO: 914390 - RNA, 20 nt, Mycobacterium avium subsp. paratuberculosis
cggcucgauggacgccagca

SEQ ID NO: 914391 - RNA, 16 nt, Mycobacterium avium subsp. paratuberculosis
cggcucgccaccucgg

SEQ ID NO: 914392 - RNA, 12 nt, Mycobacterium avium subsp. paratuberculosis
cggcucgaucgc

SEQ ID NO: 914393 - RNA, 17 nt, Mycobacterium avium subsp. paratuberculosis
cggcucgaucgcgguca

SEQ ID NO: 914394 - RNA, 19 nt, Mycobacterium avium subsp. paratuberculosis
cggcucgaucgcggucacc

SEQ ID NO: 914395 - RNA, 15 nt, Mycobacterium avium subsp. paratuberculosis
cggcucgaccucacc

SEQ ID NO: 914396 - RNA, 18 nt, Mycobacterium avium subsp. paratuberculosis
cggcucgaccucaccccg

SEQ ID NO: 914397 - RNA, 17 nt, Mycobacterium avium subsp. paratuberculosis
cggcucgaaguggcagc

SEQ ID NO: 914398 - RNA, 12 nt, Mycobacterium avium subsp. paratuberculosis
cggcuccugccg

SEQ ID NO: 914399 - RNA, 21 nt, Mycobacterium avium subsp. paratuberculosis
cggcuccugccguucggccag

SEQ ID NO: 914400 - RNA, 23 nt, Mycobacterium avium subsp. paratuberculosis
cggcuccugccguucggccagcg

SEQ ID NO: 914401 - RNA, 15 nt, Mycobacterium avium subsp. paratuberculosis
cggcuccuugcgccg

SEQ ID NO: 914402 - RNA, 13 nt, Mycobacterium avium subsp. paratuberculosis
cggcucggcccgg

SEQ ID NO: 914403 - RNA, 15 nt, Mycobacterium avium subsp. paratuberculosis
cggcucggcccggaa

SEQ ID NO: 914404 - RNA, 12 nt, Mycobacterium avium subsp. paratuberculosis
cggcucggccgg

SEQ ID NO: 914405 - RNA, 11 nt, Mycobacterium avium subsp. paratuberculosis
cggcucggccc

SEQ ID NO: 914406 - RNA, 13 nt, Mycobacterium avium subsp. paratuberculosis
cggcucggccggc

SEQ ID NO: 914407 - RNA, 15 nt, Mycobacterium avium subsp. paratuberculosis
cggcucggccggccg

SEQ ID NO: 914408 - RNA, 13 nt, Mycobacterium avium subsp. paratuberculosis
cggcucggcgaca

SEQ ID NO: 914409 - RNA, 16 nt, Mycobacterium avium subsp. paratuberculosis
cggcucggcgacaaca

SEQ ID NO: 914410 - RNA, 19 nt, Mycobacterium avium subsp. paratuberculosis
cggcucggcgacaacagcg

SEQ ID NO: 914411 - RNA, 17 nt, Mycobacterium avium subsp. paratuberculosis
cggcucgccugcgagcg

SEQ ID NO: 914412 - RNA, 15 nt, Mycobacterium avium subsp. paratuberculosis
cggcucgcgcggugu

SEQ ID NO: 914413 - RNA, 12 nt, Mycobacterium avium subsp. paratuberculosis
cggcucgcgggg

SEQ ID NO: 914414 - RNA, 14 nt, Mycobacterium avium subsp. paratuberculosis
cggcucgcgacgcg

SEQ ID NO: 914415 - RNA, 16 nt, Mycobacterium avium subsp. paratuberculosis
cggcucgcgacgcggc

SEQ ID NO: 914416 - RNA, 17 nt, Mycobacterium avium subsp. paratuberculosis
cggcucgcgacgcggcu

SEQ ID NO: 914417 - RNA, 18 nt, Mycobacterium avium subsp. paratuberculosis
cggcucgcgggugcggcg

SEQ ID NO: 914418 - RNA, 22 nt, Mycobacterium avium subsp. paratuberculosis
cggcucgcugaucugcggcacc

SEQ ID NO: 914419 - RNA, 23 nt, Mycobacterium avium subsp. paratuberculosis
cggcucgcugaucugcggcacca

SEQ ID NO: 914420 - RNA, 12 nt, Mycobacterium avium subsp. paratuberculosis
cggcucgccgcg

SEQ ID NO: 914421 - RNA, 15 nt, Mycobacterium avium subsp. paratuberculosis
cggcucgccgggcug

SEQ ID NO: 914422 - RNA, 16 nt, Mycobacterium avium subsp. paratuberculosis
cggcucgccgggcugc

SEQ ID NO: 914423 - RNA, 21 nt, Mycobacterium avium subsp. paratuberculosis
cggcucgccgggcugcacgcu

SEQ ID NO: 914424 - RNA, 23 nt, Mycobacterium avium subsp. paratuberculosis
cggcucgccguugcgggucggcg

SEQ ID NO: 914425 - RNA, 14 nt, Mycobacterium avium subsp. paratuberculosis
cggcucgccggcgc

SEQ ID NO: 914426 - RNA, 16 nt, Mycobacterium avium subsp. paratuberculosis
cggcucgccggcgcgc

SEQ ID NO: 914427 - RNA, 22 nt, Mycobacterium avium subsp. paratuberculosis
cggcucgccggcgcgcaccccg

SEQ ID NO: 914428 - RNA, 13 nt, Mycobacterium avium subsp. paratuberculosis
cggcucgccgcgc

SEQ ID NO: 914429 - RNA, 22 nt, Mycobacterium avium subsp. paratuberculosis
cggcucgccgcgcaucaucgcc

SEQ ID NO: 914430 - RNA, 23 nt, Mycobacterium avium subsp. paratuberculosis
cggcucgccgcgcaucaucgccc

SEQ ID NO: 914431 - RNA, 15 nt, Mycobacterium avium subsp. paratuberculosis
cggcucgccgcucgu

SEQ ID NO: 914432 - RNA, 12 nt, Mycobacterium avium subsp. paratuberculosis
cggcucgccggc

SEQ ID NO: 914433 - RNA, 12 nt, Mycobacterium avium subsp. paratuberculosis
cggcucgccgau

SEQ ID NO: 914434 - RNA, 14 nt, Mycobacterium avium subsp. paratuberculosis
cggcucgccgaucc

SEQ ID NO: 914435 - RNA, 13 nt, Mycobacterium avium subsp. paratuberculosis
cggcucgcccgcg

SEQ ID NO: 914436 - RNA, 14 nt, Mycobacterium avium subsp. paratuberculosis
cggcucgcccgcga

SEQ ID NO: 914437 - RNA, 21 nt, Mycobacterium avium subsp. paratuberculosis
cggcucgcccgcgacugucgg

SEQ ID NO: 914438 - RNA, 18 nt, Mycobacterium avium subsp. paratuberculosis
cggcggguugcugagccg

SEQ ID NO: 914439 - RNA, 20 nt, Mycobacterium avium subsp. paratuberculosis
cggcggguugcugagccgcc

SEQ ID NO: 914440 - RNA, 21 nt, Mycobacterium avium subsp. paratuberculosis
cggcggguugcugagccgccg

SEQ ID NO: 914441 - RNA, 23 nt, Mycobacterium avium subsp. paratuberculosis
cggcggguugcugagccgccgag

SEQ ID NO: 914442 - RNA, 17 nt, Mycobacterium avium subsp. paratuberculosis
cggcggguuggccgucg

SEQ ID NO: 914443 - RNA, 18 nt, Mycobacterium avium subsp. paratuberculosis
cggcggguuggucccgau

SEQ ID NO: 914444 - RNA, 18 nt, Mycobacterium avium subsp. paratuberculosis
cggcgggugcgacggcaa

SEQ ID NO: 914445 - RNA, 13 nt, Mycobacterium avium subsp. paratuberculosis
cggcgggacccgc

SEQ ID NO: 914446 - RNA, 14 nt, Mycobacterium avium subsp. paratuberculosis
cggcgggccggcgc

SEQ ID NO: 914447 - RNA, 14 nt, Mycobacterium avium subsp. paratuberculosis
cggcgggccgcccg

SEQ ID NO: 914448 - RNA, 18 nt, Mycobacterium avium subsp. paratuberculosis
cggcgggccgcccggcgc

SEQ ID NO: 914449 - RNA, 19 nt, Mycobacterium avium subsp. paratuberculosis
cggcgggccgcccggcgcg

SEQ ID NO: 914450 - RNA, 20 nt, Mycobacterium avium subsp. paratuberculosis
cggcgggccgcccggcgcgc

SEQ ID NO: 914451 - RNA, 23 nt, Mycobacterium avium subsp. paratuberculosis
cggcgggccgcccggcgcgccgc

SEQ ID NO: 914452 - RNA, 14 nt, Mycobacterium avium subsp. paratuberculosis
cggcgggccggucc

SEQ ID NO: 914453 - RNA, 15 nt, Mycobacterium avium subsp. paratuberculosis
cggcgggccucgccg

SEQ ID NO: 914454 - RNA, 22 nt, Mycobacterium avium subsp. paratuberculosis
cggcgggccuucuucucgacgu

SEQ ID NO: 914455 - RNA, 23 nt, Mycobacterium avium subsp. paratuberculosis
cggcgggccuugagcaccgcguc

SEQ ID NO: 914456 - RNA, 17 nt, Mycobacterium avium subsp. paratuberculosis
cggcgggagccggcggc

SEQ ID NO: 914457 - RNA, 19 nt, Mycobacterium avium subsp. paratuberculosis
cggcgggagccggcggcgg

SEQ ID NO: 914458 - RNA, 23 nt, Mycobacterium avium subsp. paratuberculosis
cggcgggagcuaggcggccgggc

SEQ ID NO: 914459 - RNA, 20 nt, Mycobacterium avium subsp. paratuberculosis
cggcgggaucggaccgcacc

SEQ ID NO: 914460 - RNA, 22 nt, Mycobacterium avium subsp. paratuberculosis
cggcgggaucggaccgcaccac

SEQ ID NO: 914461 - RNA, 23 nt, Mycobacterium avium subsp. paratuberculosis
cggcgggaucggaccgcaccacc

SEQ ID NO: 914462 - RNA, 23 nt, Mycobacterium avium subsp. paratuberculosis
cggcgggauguggcaucaccgcc

SEQ ID NO: 914463 - RNA, 20 nt, Mycobacterium avium subsp. paratuberculosis
cggcgggcaccucggccagg

SEQ ID NO: 914464 - RNA, 21 nt, Mycobacterium avium subsp. paratuberculosis
cggcgggcaccucggccaggu

SEQ ID NO: 914465 - RNA, 13 nt, Mycobacterium avium subsp. paratuberculosis
cggcgggcagcga

SEQ ID NO: 914466 - RNA, 14 nt, Mycobacterium avium subsp. paratuberculosis
cggcgggcaggccg

SEQ ID NO: 914467 - RNA, 13 nt, Mycobacterium avium subsp. paratuberculosis
cggcgggcccggc

SEQ ID NO: 914468 - RNA, 18 nt, Mycobacterium avium subsp. paratuberculosis
cggcgggcccggcgaugc

SEQ ID NO: 914469 - RNA, 16 nt, Mycobacterium avium subsp. paratuberculosis
cggcgggcccgucgcc

SEQ ID NO: 914470 - RNA, 21 nt, Mycobacterium avium subsp. paratuberculosis
cggcgggcccgucgccggcgc

SEQ ID NO: 914471 - RNA, 13 nt, Mycobacterium avium subsp. paratuberculosis
cggcgggccagcu

SEQ ID NO: 914472 - RNA, 19 nt, Mycobacterium avium subsp. paratuberculosis
cggcgggccagggcgagga

SEQ ID NO: 914473 - RNA, 21 nt, Mycobacterium avium subsp. paratuberculosis
cggcgggccagggcgaggacg

SEQ ID NO: 914474 - RNA, 22 nt, Mycobacterium avium subsp. paratuberculosis
cggcgggccagggcgaggacgg

SEQ ID NO: 914475 - RNA, 15 nt, Mycobacterium avium subsp. paratuberculosis
cggcgggcccagcag

SEQ ID NO: 914476 - RNA, 15 nt, Mycobacterium avium subsp. paratuberculosis
cggcgggcauacugc

SEQ ID NO: 914477 - RNA, 17 nt, Mycobacterium avium subsp. paratuberculosis
cggcggcguacgcgaug

SEQ ID NO: 914478 - RNA, 21 nt, Mycobacterium avium subsp. paratuberculosis
cggcggcguacgcgauggcgg

SEQ ID NO: 914479 - RNA, 14 nt, Mycobacterium avium subsp. paratuberculosis
cggcggcgggcucg

SEQ ID NO: 914480 - RNA, 15 nt, Mycobacterium avium subsp. paratuberculosis
cggcggcgggcucgg

SEQ ID NO: 914481 - RNA, 14 nt, Mycobacterium avium subsp. paratuberculosis
cggcggcggggugg

SEQ ID NO: 914482 - RNA, 16 nt, Mycobacterium avium subsp. paratuberculosis
cggcggcguccgcggc

SEQ ID NO: 914483 - RNA, 13 nt, Mycobacterium avium subsp. paratuberculosis
cggcggcggcgcg

SEQ ID NO: 914484 - RNA, 16 nt, Mycobacterium avium subsp. paratuberculosis
cggcggcggcgcgccg

SEQ ID NO: 914485 - RNA, 14 nt, Mycobacterium avium subsp. paratuberculosis
cggcggcggcgcgg

SEQ ID NO: 914486 - RNA, 14 nt, Mycobacterium avium subsp. paratuberculosis
cggcggcggcggca

SEQ ID NO: 914487 - RNA, 17 nt, Mycobacterium avium subsp. paratuberculosis
cggcggcggcggcaggu

SEQ ID NO: 914488 - RNA, 15 nt, Mycobacterium avium subsp. paratuberculosis
cggcggcggcggccg

SEQ ID NO: 914489 - RNA, 12 nt, Mycobacterium avium subsp. paratuberculosis
cggcggcgggca

SEQ ID NO: 914490 - RNA, 13 nt, Mycobacterium avium subsp. paratuberculosis
cggcggcgggcag

SEQ ID NO: 914491 - RNA, 13 nt, Mycobacterium avium subsp. paratuberculosis
cggcggcgggcca

SEQ ID NO: 914492 - RNA, 14 nt, Mycobacterium avium subsp. paratuberculosis
cggcggcgggccag

SEQ ID NO: 914493 - RNA, 13 nt, Mycobacterium avium subsp. paratuberculosis
cggcggcgguccg

SEQ ID NO: 914494 - RNA, 19 nt, Mycobacterium avium subsp. paratuberculosis
cggcggcgguccgcccgga

SEQ ID NO: 914495 - RNA, 15 nt, Mycobacterium avium subsp. paratuberculosis
cggcggcggucggca

SEQ ID NO: 914496 - RNA, 18 nt, Mycobacterium avium subsp. paratuberculosis
cggcggcggucggcauag

SEQ ID NO: 914497 - RNA, 14 nt, Mycobacterium avium subsp. paratuberculosis
cggcggcggugccg

SEQ ID NO: 914498 - RNA, 19 nt, Mycobacterium avium subsp. paratuberculosis
cggcggcggugccgcaggc

SEQ ID NO: 914499 - RNA, 21 nt, Mycobacterium avium subsp. paratuberculosis
cggcggcggugccgcaggcga

SEQ ID NO: 914500 - RNA, 21 nt, Mycobacterium avium subsp. paratuberculosis
cggcgggacggaaucacgcac

SEQ ID NO: 914501 - RNA, 20 nt, Mycobacterium avium subsp. paratuberculosis
cggcgggaaaccaccugccg

SEQ ID NO: 914502 - RNA, 13 nt, Mycobacterium avium subsp. paratuberculosis
cggcgcggcggug

SEQ ID NO: 914503 - RNA, 15 nt, Mycobacterium avium subsp. paratuberculosis
cggcgcggccggugc

SEQ ID NO: 914504 - RNA, 20 nt, Mycobacterium avium subsp. paratuberculosis
cggcggcgaguucggcggcc

SEQ ID NO: 914505 - RNA, 14 nt, Mycobacterium avium subsp. paratuberculosis
cggcggcgaggacg

SEQ ID NO: 914506 - RNA, 20 nt, Mycobacterium avium subsp. paratuberculosis
cggcggcgaggacgucgucg

SEQ ID NO: 914507 - RNA, 14 nt, Mycobacterium avium subsp. paratuberculosis
cggcggcgaugauc

SEQ ID NO: 914508 - RNA, 16 nt, Mycobacterium avium subsp. paratuberculosis
cggcggcgaugaucgg

SEQ ID NO: 914509 - RNA, 11 nt, Mycobacterium avium subsp. paratuberculosis
cggcggcgcag

SEQ ID NO: 914510 - RNA, 12 nt, Mycobacterium avium subsp. paratuberculosis
cggcggcgauga

SEQ ID NO: 914511 - RNA, 13 nt, Mycobacterium avium subsp. paratuberculosis
cggcggcgauccg

SEQ ID NO: 914512 - RNA, 18 nt, Mycobacterium avium subsp. paratuberculosis
cggcggcgauccggccgg

SEQ ID NO: 914513 - RNA, 15 nt, Mycobacterium avium subsp. paratuberculosis
cggcggcgaucggcg

SEQ ID NO: 914514 - RNA, 13 nt, Mycobacterium avium subsp. paratuberculosis
cggcggcgcccag

SEQ ID NO: 914515 - RNA, 15 nt, Mycobacterium avium subsp. paratuberculosis
cggcggcgcccgcgg

SEQ ID NO: 914516 - RNA, 12 nt, Mycobacterium avium subsp. paratuberculosis
cggcggcgcccu

SEQ ID NO: 914517 - RNA, 14 nt, Mycobacterium avium subsp. paratuberculosis
cggcggcgcccugc

SEQ ID NO: 914518 - RNA, 15 nt, Mycobacterium avium subsp. paratuberculosis
cggcggcgccgcagc

SEQ ID NO: 914519 - RNA, 15 nt, Mycobacterium avium subsp. paratuberculosis
cggcggcgccgcggu

SEQ ID NO: 914520 - RNA, 16 nt, Mycobacterium avium subsp. paratuberculosis
cggcggcggccagcga

SEQ ID NO: 914521 - RNA, 12 nt, Mycobacterium avium subsp. paratuberculosis
cggcggcggccc

SEQ ID NO: 914522 - RNA, 13 nt, Mycobacterium avium subsp. paratuberculosis
cggcggcggccug

SEQ ID NO: 914523 - RNA, 14 nt, Mycobacterium avium subsp. paratuberculosis
cggcggcggccugc

SEQ ID NO: 914524 - RNA, 15 nt, Mycobacterium avium subsp. paratuberculosis
cggcggcgccggggc

SEQ ID NO: 914525 - RNA, 13 nt, Mycobacterium avium subsp. paratuberculosis
cggcggcgccguc

SEQ ID NO: 914526 - RNA, 14 nt, Mycobacterium avium subsp. paratuberculosis
cggcggcggcaggu

SEQ ID NO: 914527 - RNA, 14 nt, Mycobacterium avium subsp. paratuberculosis
cggcgcgcugcggc

SEQ ID NO: 914528 - RNA, 19 nt, Mycobacterium avium subsp. paratuberculosis
cggcgcgcugcggcgucgu

SEQ ID NO: 914529 - RNA, 14 nt, Mycobacterium avium subsp. paratuberculosis
cggcgcggacagcg

SEQ ID NO: 914530 - RNA, 16 nt, Mycobacterium avium subsp. paratuberculosis
cggcgcggacagcgcg

SEQ ID NO: 914531 - RNA, 23 nt, Mycobacterium avium subsp. paratuberculosis
cggcgcggacagcgcggugaugu

SEQ ID NO: 914532 - RNA, 22 nt, Mycobacterium avium subsp. paratuberculosis
cggcgcggaccccagugcaggc

SEQ ID NO: 914533 - RNA, 21 nt, Mycobacterium avium subsp. paratuberculosis
cggcgcggacggaucgagucc

SEQ ID NO: 914534 - RNA, 21 nt, Mycobacterium avium subsp. paratuberculosis
cggcgcggagccggccgccga

SEQ ID NO: 914535 - RNA, 12 nt, Mycobacterium avium subsp. paratuberculosis
cggcgcggagcg

SEQ ID NO: 914536 - RNA, 17 nt, Mycobacterium avium subsp. paratuberculosis
cggcgcggagcgucgcg

SEQ ID NO: 914537 - RNA, 20 nt, Mycobacterium avium subsp. paratuberculosis
cggcgcggagcgucgcgaug

SEQ ID NO: 914538 - RNA, 14 nt, Mycobacterium avium subsp. paratuberculosis
cggcgcggccgauu

SEQ ID NO: 914539 - RNA, 16 nt, Mycobacterium avium subsp. paratuberculosis
cggcgcggcaguccgc

SEQ ID NO: 914540 - RNA, 14 nt, Mycobacterium avium subsp. paratuberculosis
cggcgcggccaccc

SEQ ID NO: 914541 - RNA, 16 nt, Mycobacterium avium subsp. paratuberculosis
cggcgcggccaccccg

SEQ ID NO: 914542 - RNA, 16 nt, Mycobacterium avium subsp. paratuberculosis
cggcgcggaucgucac

SEQ ID NO: 914543 - RNA, 24 nt, Mycobacterium avium subsp. paratuberculosis
cggcgcggaucucgcgcagguccg

SEQ ID NO: 914544 - RNA, 20 nt, Mycobacterium avium subsp. paratuberculosis
cggcgcggaugacgugcacc

SEQ ID NO: 914545 - RNA, 21 nt, Mycobacterium avium subsp. paratuberculosis
cggcgcggaugacgugcacca

SEQ ID NO: 914546 - RNA, 20 nt, Mycobacterium avium subsp. paratuberculosis
cggcgcggcccggcccgcug

SEQ ID NO: 914547 - RNA, 13 nt, Mycobacterium avium subsp. paratuberculosis
cggcgcggcggcg

SEQ ID NO: 914548 - RNA, 15 nt, Mycobacterium avium subsp. paratuberculosis
cggcgcggcggcgac

SEQ ID NO: 914549 - RNA, 18 nt, Mycobacterium avium subsp. paratuberculosis
cggcgcggcggcgacguc

SEQ ID NO: 914550 - RNA, 21 nt, Mycobacterium avium subsp. paratuberculosis
cggcgcggcggcgacgucgac

SEQ ID NO: 914551 - RNA, 14 nt, Mycobacterium avium subsp. paratuberculosis
cggcgcggcggcgc

SEQ ID NO: 914552 - RNA, 13 nt, Mycobacterium avium subsp. paratuberculosis
cggcgcggcgcag

SEQ ID NO: 914553 - RNA, 18 nt, Mycobacterium avium subsp. paratuberculosis
cggcgcggcgcagcgcga

SEQ ID NO: 914554 - RNA, 17 nt, Mycobacterium avium subsp. paratuberculosis
cggcgcggccgcccagc

SEQ ID NO: 914555 - RNA, 18 nt, Mycobacterium avium subsp. paratuberculosis
cggcgcggccgcccagcc

SEQ ID NO: 914556 - RNA, 20 nt, Mycobacterium avium subsp. paratuberculosis
cggcgcggccgcccagcccg

SEQ ID NO: 914557 - RNA, 12 nt, Mycobacterium avium subsp. paratuberculosis
cggcgcggccgg

SEQ ID NO: 914558 - RNA, 22 nt, Mycobacterium avium subsp. paratuberculosis
cggcguacccgcccaugcacga

SEQ ID NO: 914559 - RNA, 18 nt, Mycobacterium avium subsp. paratuberculosis
cggcguacaggccgucgg

SEQ ID NO: 914560 - RNA, 21 nt, Mycobacterium avium subsp. paratuberculosis
cggcguacaggccgucgggga

SEQ ID NO: 914561 - RNA, 14 nt, Mycobacterium avium subsp. paratuberculosis
cggcguaccgcggc

SEQ ID NO: 914562 - RNA, 16 nt, Mycobacterium avium subsp. paratuberculosis
cggcguaccgcggcgg

SEQ ID NO: 914563 - RNA, 17 nt, Mycobacterium avium subsp. paratuberculosis
cggcguaccgcggcggc

SEQ ID NO: 914564 - RNA, 19 nt, Mycobacterium avium subsp. paratuberculosis
cggcguaccgcggcggcgu

SEQ ID NO: 914565 - RNA, 21 nt, Mycobacterium avium subsp. paratuberculosis
cggcguaccgcggcggcgucg

SEQ ID NO: 914566 - RNA, 21 nt, Mycobacterium avium subsp. paratuberculosis
cggcguacgacaucucgacgg

SEQ ID NO: 914567 - RNA, 19 nt, Mycobacterium avium subsp. paratuberculosis
cggcgguuucuuugaucuc

SEQ ID NO: 914568 - RNA, 18 nt, Mycobacterium avium subsp. paratuberculosis
cggcgguuuuggucggca

SEQ ID NO: 914569 - RNA, 20 nt, Mycobacterium avium subsp. paratuberculosis
cggcgguuuuggucggcacc

SEQ ID NO: 914570 - RNA, 21 nt, Mycobacterium avium subsp. paratuberculosis
cggcgguuuuggucggcaccu

SEQ ID NO: 914571 - RNA, 18 nt, Mycobacterium avium subsp. paratuberculosis
cggcgguuucggugccgg

SEQ ID NO: 914572 - RNA, 19 nt, Mycobacterium avium subsp. paratuberculosis
cggcgguuucggugccggc

SEQ ID NO: 914573 - RNA, 22 nt, Mycobacterium avium subsp. paratuberculosis
cggcgguuucggugccggccca

SEQ ID NO: 914574 - RNA, 20 nt, Mycobacterium avium subsp. paratuberculosis
cggcgguugcucgucggccg

SEQ ID NO: 914575 - RNA, 21 nt, Mycobacterium avium subsp. paratuberculosis
cggcgguucgaagcgcagcgu

SEQ ID NO: 914576 - RNA, 20 nt, Mycobacterium avium subsp. paratuberculosis
cggcgguucgauaccguccg

SEQ ID NO: 914577 - RNA, 18 nt, Mycobacterium avium subsp. paratuberculosis
cggcggugucgcccagcu

SEQ ID NO: 914578 - RNA, 24 nt, Mycobacterium avium subsp. paratuberculosis
cggcggugucgcccagcugggcca

SEQ ID NO: 914579 - RNA, 16 nt, Mycobacterium avium subsp. paratuberculosis
cggcggugucggcgcc

SEQ ID NO: 914580 - RNA, 18 nt, Mycobacterium avium subsp. paratuberculosis
cggcggugucggugccga

SEQ ID NO: 914581 - RNA, 21 nt, Mycobacterium avium subsp. paratuberculosis
cggcggugucggugccgagca

SEQ ID NO: 914582 - RNA, 22 nt, Mycobacterium avium subsp. paratuberculosis
cggcggugucggugccgagcac

SEQ ID NO: 914583 - RNA, 17 nt, Mycobacterium avium subsp. paratuberculosis
cggcggugccggccaga

SEQ ID NO: 914584 - RNA, 15 nt, Mycobacterium avium subsp. paratuberculosis
cggcggugccguccu

SEQ ID NO: 914585 - RNA, 21 nt, Mycobacterium avium subsp. paratuberculosis
cggcggugccguccucggccg

SEQ ID NO: 914586 - RNA, 17 nt, Mycobacterium avium subsp. paratuberculosis
cggcggugccugguuga

SEQ ID NO: 914587 - RNA, 20 nt, Mycobacterium avium subsp. paratuberculosis
cggcggugcgcagccgcugc

SEQ ID NO: 914588 - RNA, 16 nt, Mycobacterium avium subsp. paratuberculosis
cggcggugcaggguca

SEQ ID NO: 914589 - RNA, 15 nt, Mycobacterium avium subsp. paratuberculosis
cggcggugccgagcc

SEQ ID NO: 914590 - RNA, 20 nt, Mycobacterium avium subsp. paratuberculosis
cggcggugccgagcccgccg

SEQ ID NO: 914591 - RNA, 21 nt, Mycobacterium avium subsp. paratuberculosis
cggcggugccgagcccgccgg

SEQ ID NO: 914592 - RNA, 22 nt, Mycobacterium avium subsp. paratuberculosis
cggcggugccgagcccgccggc

SEQ ID NO: 914593 - RNA, 14 nt, Mycobacterium avium subsp. paratuberculosis
cggcggugccgcag

SEQ ID NO: 914594 - RNA, 18 nt, Mycobacterium avium subsp. paratuberculosis
cggcggugccgcaggcga

SEQ ID NO: 914595 - RNA, 21 nt, Mycobacterium avium subsp. paratuberculosis
cggcggugccgcaggcgaaca

SEQ ID NO: 914596 - RNA, 13 nt, Mycobacterium avium subsp. paratuberculosis
cggcggugcggac

SEQ ID NO: 914597 - RNA, 16 nt, Mycobacterium avium subsp. paratuberculosis
cggcggugcggacccg

SEQ ID NO: 914598 - RNA, 12 nt, Mycobacterium avium subsp. paratuberculosis
cggcggugcggg

SEQ ID NO: 914599 - RNA, 20 nt, Mycobacterium avium subsp. paratuberculosis
cggcggugcgucgggcgccg

SEQ ID NO: 914600 - RNA, 21 nt, Mycobacterium avium subsp. paratuberculosis
cggcggugcgucgggcgccgg

SEQ ID NO: 914601 - RNA, 17 nt, Mycobacterium avium subsp. paratuberculosis
cggcggugcucgcgccg

SEQ ID NO: 914602 - RNA, 17 nt, Mycobacterium avium subsp. paratuberculosis
cggcggugcucucgucg

SEQ ID NO: 914603 - RNA, 19 nt, Mycobacterium avium subsp. paratuberculosis
cggcggugcucucgucguc

SEQ ID NO: 914604 - RNA, 20 nt, Mycobacterium avium subsp. paratuberculosis
cggcggugcucucgucgucg

SEQ ID NO: 914605 - RNA, 18 nt, Mycobacterium avium subsp. paratuberculosis
cggcgguggccaugcgcg

SEQ ID NO: 914606 - RNA, 22 nt, Mycobacterium avium subsp. paratuberculosis
cggcgguggccaugcgcgaguc

SEQ ID NO: 914607 - RNA, 19 nt, Mycobacterium avium subsp. paratuberculosis
cggcgguggccugcccggc

SEQ ID NO: 914608 - RNA, 22 nt, Mycobacterium avium subsp. paratuberculosis
cggcgguggccuggucgaacag

SEQ ID NO: 914609 - RNA, 13 nt, Mycobacterium avium subsp. paratuberculosis
cggcgguggcgua

SEQ ID NO: 914610 - RNA, 19 nt, Mycobacterium avium subsp. paratuberculosis
cggcgguggcguagcggug

SEQ ID NO: 914611 - RNA, 16 nt, Mycobacterium avium subsp. paratuberculosis
cggcggugggcugggc

SEQ ID NO: 914612 - RNA, 18 nt, Mycobacterium avium subsp. paratuberculosis
cggcggugggcugggcga

SEQ ID NO: 914613 - RNA, 23 nt, Mycobacterium avium subsp. paratuberculosis
cggcggugggcugggcgaagccg

SEQ ID NO: 914614 - RNA, 13 nt, Mycobacterium avium subsp. paratuberculosis
cggcggugguccg

SEQ ID NO: 914615 - RNA, 17 nt, Mycobacterium avium subsp. paratuberculosis
cggcggugguccgcgcg

SEQ ID NO: 914616 - RNA, 17 nt, Mycobacterium avium subsp. paratuberculosis
cggcgguggugccgccg

SEQ ID NO: 914617 - RNA, 15 nt, Mycobacterium avium subsp. paratuberculosis
cggcggugaccggau

SEQ ID NO: 914618 - RNA, 20 nt, Mycobacterium avium subsp. paratuberculosis
cggcggugaccggaucggcc

SEQ ID NO: 914619 - RNA, 16 nt, Mycobacterium avium subsp. paratuberculosis
cggcggugacgaaccc

SEQ ID NO: 914620 - RNA, 20 nt, Mycobacterium avium subsp. paratuberculosis
cggcggugacgaacccgccg

SEQ ID NO: 914621 - RNA, 16 nt, Mycobacterium avium subsp. paratuberculosis
cggcggucugucgcgc

SEQ ID NO: 914622 - RNA, 23 nt, Mycobacterium avium subsp. paratuberculosis
cggcggucugucgcgcgaacagc

SEQ ID NO: 914623 - RNA, 20 nt, Mycobacterium avium subsp. paratuberculosis
cggcggucuucuuggccgcg

SEQ ID NO: 914624 - RNA, 23 nt, Mycobacterium avium subsp. paratuberculosis
cggcggucuucuuggccgcgccg

SEQ ID NO: 914625 - RNA, 22 nt, Mycobacterium avium subsp. paratuberculosis
cggcggucuuggcggccagcgc

SEQ ID NO: 914626 - RNA, 23 nt, Mycobacterium avium subsp. paratuberculosis
cggcggucuuggcggccagcgcc

SEQ ID NO: 914627 - RNA, 20 nt, Mycobacterium avium subsp. paratuberculosis
cggcggugacguuccagccg

SEQ ID NO: 914628 - RNA, 21 nt, Mycobacterium avium subsp. paratuberculosis
cggcggugacguuccagccgu

SEQ ID NO: 914629 - RNA, 14 nt, Mycobacterium avium subsp. paratuberculosis
cggcggugagccgc

SEQ ID NO: 914630 - RNA, 16 nt, Mycobacterium avium subsp. paratuberculosis
cggcggugagccgcca

SEQ ID NO: 914631 - RNA, 20 nt, Mycobacterium avium subsp. paratuberculosis
cggcggugagcgcgucgagc

SEQ ID NO: 914632 - RNA, 22 nt, Mycobacterium avium subsp. paratuberculosis
cggcggugagcgcgucgagcac

SEQ ID NO: 914633 - RNA, 15 nt, Mycobacterium avium subsp. paratuberculosis
cggcggugaucgccg

SEQ ID NO: 914634 - RNA, 19 nt, Mycobacterium avium subsp. paratuberculosis
cggcggugaucucgucggc

SEQ ID NO: 914635 - RNA, 20 nt, Mycobacterium avium subsp. paratuberculosis
cggcggugaucucgucggcg

SEQ ID NO: 914636 - RNA, 21 nt, Mycobacterium avium subsp. paratuberculosis
cggcggugaugcgcgccgacg

SEQ ID NO: 914637 - RNA, 23 nt, Mycobacterium avium subsp. paratuberculosis
cggcggugaugcgcgccgacgac

SEQ ID NO: 914638 - RNA, 21 nt, Mycobacterium avium subsp. paratuberculosis
cggcggucgcggugcccagcc

SEQ ID NO: 914639 - RNA, 16 nt, Mycobacterium avium subsp. paratuberculosis
cggcggucgcugcagc

SEQ ID NO: 914640 - RNA, 12 nt, Mycobacterium avium subsp. paratuberculosis
cggcggucggcg

SEQ ID NO: 914641 - RNA, 14 nt, Mycobacterium avium subsp. paratuberculosis
cggcggucggcgcc

SEQ ID NO: 914642 - RNA, 16 nt, Mycobacterium avium subsp. paratuberculosis
cggcggucggcgccga

SEQ ID NO: 914643 - RNA, 16 nt, Mycobacterium avium subsp. paratuberculosis
cggcgguccgccgcag

SEQ ID NO: 914644 - RNA, 18 nt, Mycobacterium avium subsp. paratuberculosis
cggcgguccugcggcgac

SEQ ID NO: 914645 - RNA, 20 nt, Mycobacterium avium subsp. paratuberculosis
cggcgguccugcggcgacaa

SEQ ID NO: 914646 - RNA, 21 nt, Mycobacterium avium subsp. paratuberculosis
cggcgguccugcggcgacaac

SEQ ID NO: 914647 - RNA, 12 nt, Mycobacterium avium subsp. paratuberculosis
cggcggucgaca

SEQ ID NO: 914648 - RNA, 11 nt, Mycobacterium avium subsp. paratuberculosis
cggcggucgcc

SEQ ID NO: 914649 - RNA, 21 nt, Mycobacterium avium subsp. paratuberculosis
cggcggucgccacucgggcgg

SEQ ID NO: 914650 - RNA, 17 nt, Mycobacterium avium subsp. paratuberculosis
cggcggucgccagcgcc

SEQ ID NO: 914651 - RNA, 15 nt, Mycobacterium avium subsp. paratuberculosis
cggcggucgugcggc

SEQ ID NO: 914652 - RNA, 17 nt, Mycobacterium avium subsp. paratuberculosis
cggcggucgcgcgccgg

SEQ ID NO: 914653 - RNA, 22 nt, Mycobacterium avium subsp. paratuberculosis
cggcggucgcgcgccggcgcag

SEQ ID NO: 914654 - RNA, 19 nt, Mycobacterium avium subsp. paratuberculosis
cggcggucccgugcgccgc

SEQ ID NO: 914655 - RNA, 20 nt, Mycobacterium avium subsp. paratuberculosis
cggcggucccgugcgccgcc

SEQ ID NO: 914656 - RNA, 22 nt, Mycobacterium avium subsp. paratuberculosis
cggcggucccgugcgccgccca

SEQ ID NO: 914657 - RNA, 16 nt, Mycobacterium avium subsp. paratuberculosis
cggcgguccgcccgga

SEQ ID NO: 914658 - RNA, 21 nt, Mycobacterium avium subsp. paratuberculosis
cggcgguccgcccggaccagg

SEQ ID NO: 914659 - RNA, 22 nt, Mycobacterium avium subsp. paratuberculosis
cggcgguccgcccggaccaggg

SEQ ID NO: 914660 - RNA, 16 nt, Mycobacterium avium subsp. paratuberculosis
cggcgguccagcgagc

SEQ ID NO: 914661 - RNA, 22 nt, Mycobacterium avium subsp. paratuberculosis
cggcggucauugaucuccgcgg

SEQ ID NO: 914662 - RNA, 23 nt, Mycobacterium avium subsp. paratuberculosis
cggcggucauugaucuccgcggc

SEQ ID NO: 914663 - RNA, 20 nt, Mycobacterium avium subsp. paratuberculosis
cggcggucagguucgccacg

SEQ ID NO: 914664 - RNA, 18 nt, Mycobacterium avium subsp. paratuberculosis
cggcggucaccaaggcga

SEQ ID NO: 914665 - RNA, 22 nt, Mycobacterium avium subsp. paratuberculosis
cggcggucaccaaggcgauuuc

SEQ ID NO: 914666 - RNA, 16 nt, Mycobacterium avium subsp. paratuberculosis
cggcggucacgcccgg

SEQ ID NO: 914667 - RNA, 17 nt, Mycobacterium avium subsp. paratuberculosis
cggcggucacgcccggg

SEQ ID NO: 914668 - RNA, 14 nt, Mycobacterium avium subsp. paratuberculosis
cggcggucagcacc

SEQ ID NO: 914669 - RNA, 16 nt, Mycobacterium avium subsp. paratuberculosis
cggcggucagcaccgu

SEQ ID NO: 914670 - RNA, 20 nt, Mycobacterium avium subsp. paratuberculosis
cggcggucagcaccgucacc

SEQ ID NO: 914671 - RNA, 23 nt, Mycobacterium avium subsp. paratuberculosis
cggcgguaugcccgggccgucau

SEQ ID NO: 914672 - RNA, 21 nt, Mycobacterium avium subsp. paratuberculosis
cgggccaucgacuccagcacc

SEQ ID NO: 914673 - RNA, 16 nt, Mycobacterium avium subsp. paratuberculosis
cgggccauguccccga

SEQ ID NO: 914674 - RNA, 24 nt, Mycobacterium avium subsp. paratuberculosis
cgggccauauuucgugaagccggu

SEQ ID NO: 914675 - RNA, 11 nt, Mycobacterium avium subsp. paratuberculosis
cgggcccggcc

SEQ ID NO: 914676 - RNA, 12 nt, Mycobacterium avium subsp. paratuberculosis
cgggcccaccag

SEQ ID NO: 914677 - RNA, 22 nt, Mycobacterium avium subsp. paratuberculosis
cgggcccgcguaaccggcggcg

SEQ ID NO: 914678 - RNA, 20 nt, Mycobacterium avium subsp. paratuberculosis
cgggcccgcugcagcgccga

SEQ ID NO: 914679 - RNA, 21 nt, Mycobacterium avium subsp. paratuberculosis
cgggcccgcugcagcgccgag

SEQ ID NO: 914680 - RNA, 12 nt, Mycobacterium avium subsp. paratuberculosis
cgggccaggcgc

SEQ ID NO: 914681 - RNA, 21 nt, Mycobacterium avium subsp. paratuberculosis
cgggccaggcgcgcgcuggug

SEQ ID NO: 914682 - RNA, 16 nt, Mycobacterium avium subsp. paratuberculosis
cgggccagggcgagga

SEQ ID NO: 914683 - RNA, 15 nt, Mycobacterium avium subsp. paratuberculosis
cgggccagucgccgc

SEQ ID NO: 914684 - RNA, 16 nt, Mycobacterium avium subsp. paratuberculosis
cgggccagucgccgcg

SEQ ID NO: 914685 - RNA, 22 nt, Mycobacterium avium subsp. paratuberculosis
cgggccaggucccaggcguggu

SEQ ID NO: 914686 - RNA, 17 nt, Mycobacterium avium subsp. paratuberculosis
cgggccaggucggugac

SEQ ID NO: 914687 - RNA, 16 nt, Mycobacterium avium subsp. paratuberculosis
cgggccagguucgcgc

SEQ ID NO: 914688 - RNA, 18 nt, Mycobacterium avium subsp. paratuberculosis
cgggccagguucgcgccg

SEQ ID NO: 914689 - RNA, 19 nt, Mycobacterium avium subsp. paratuberculosis
cgggccagguucgcgccga

SEQ ID NO: 914690 - RNA, 20 nt, Mycobacterium avium subsp. paratuberculosis
cgggccagguucgcgccgau

SEQ ID NO: 914691 - RNA, 14 nt, Mycobacterium avium subsp. paratuberculosis
cgggccaggaugac

SEQ ID NO: 914692 - RNA, 22 nt, Mycobacterium avium subsp. paratuberculosis
cgggccaggaugucggacucgc

SEQ ID NO: 914693 - RNA, 23 nt, Mycobacterium avium subsp. paratuberculosis
cgggccaggauguucaccccggc

SEQ ID NO: 914694 - RNA, 18 nt, Mycobacterium avium subsp. paratuberculosis
cgggccaggcacggcccg

SEQ ID NO: 914695 - RNA, 14 nt, Mycobacterium avium subsp. paratuberculosis
cgggccaggcccac

SEQ ID NO: 914696 - RNA, 22 nt, Mycobacterium avium subsp. paratuberculosis
cgggccaggcccaccgucgcca

SEQ ID NO: 914697 - RNA, 12 nt, Mycobacterium avium subsp. paratuberculosis
cgggccagcgca

SEQ ID NO: 914698 - RNA, 16 nt, Mycobacterium avium subsp. paratuberculosis
cgggccagcgcaucgg

SEQ ID NO: 914699 - RNA, 19 nt, Mycobacterium avium subsp. paratuberculosis
cgggccagcucgaacaccg

SEQ ID NO: 914700 - RNA, 22 nt, Mycobacterium avium subsp. paratuberculosis
cgggccagcucgaacaccgucg

SEQ ID NO: 914701 - RNA, 23 nt, Mycobacterium avium subsp. paratuberculosis
cgggccagcucgaacaccgucga

SEQ ID NO: 914702 - RNA, 20 nt, Mycobacterium avium subsp. paratuberculosis
cgggccagcucgucgagccg

SEQ ID NO: 914703 - RNA, 16 nt, Mycobacterium avium subsp. paratuberculosis
cgggccagcuuguucg

SEQ ID NO: 914704 - RNA, 21 nt, Mycobacterium avium subsp. paratuberculosis
cgggccagcuuguucgagagu

SEQ ID NO: 914705 - RNA, 17 nt, Mycobacterium avium subsp. paratuberculosis
cgggccacgcagucguc

SEQ ID NO: 914706 - RNA, 21 nt, Mycobacterium avium subsp. paratuberculosis
cgggccacgcagucgucgaug

SEQ ID NO: 914707 - RNA, 15 nt, Mycobacterium avium subsp. paratuberculosis
cgggccacgccgacu

SEQ ID NO: 914708 - RNA, 22 nt, Mycobacterium avium subsp. paratuberculosis
cgggccagcagcuugacgucgg

SEQ ID NO: 914709 - RNA, 14 nt, Mycobacterium avium subsp. paratuberculosis
cgggccagcgccga

SEQ ID NO: 914710 - RNA, 15 nt, Mycobacterium avium subsp. paratuberculosis
cgggccagcgccgag

SEQ ID NO: 914711 - RNA, 16 nt, Mycobacterium avium subsp. paratuberculosis
cgggccagcgccgagc

SEQ ID NO: 914712 - RNA, 17 nt, Mycobacterium avium subsp. paratuberculosis
cgggccagcgccgagcc

SEQ ID NO: 914713 - RNA, 13 nt, Mycobacterium avium subsp. paratuberculosis
cgggccagcgccu

SEQ ID NO: 914714 - RNA, 19 nt, Mycobacterium avium subsp. paratuberculosis
cgggccagcgccuucggcg

SEQ ID NO: 914715 - RNA, 20 nt, Mycobacterium avium subsp. paratuberculosis
cgggccagcgccuucggcgc

SEQ ID NO: 914716 - RNA, 21 nt, Mycobacterium avium subsp. paratuberculosis
cgggccagcgccuucggcgcc

SEQ ID NO: 914717 - RNA, 19 nt, Mycobacterium avium subsp. paratuberculosis
cgggcagugcacgacgacc

SEQ ID NO: 914718 - RNA, 18 nt, Mycobacterium avium subsp. paratuberculosis
cgggcagucugccggugg

SEQ ID NO: 914719 - RNA, 17 nt, Mycobacterium avium subsp. paratuberculosis
cgggcagguggucggcg

SEQ ID NO: 914720 - RNA, 18 nt, Mycobacterium avium subsp. paratuberculosis
cgggcagguggucggcga

SEQ ID NO: 914721 - RNA, 21 nt, Mycobacterium avium subsp. paratuberculosis
cgggcagguggucggcgaacu

SEQ ID NO: 914722 - RNA, 22 nt, Mycobacterium avium subsp. paratuberculosis
cgggcagguucauccccgcggc

SEQ ID NO: 914723 - RNA, 19 nt, Mycobacterium avium subsp. paratuberculosis
cgggcaguugccggccauc

SEQ ID NO: 914724 - RNA, 16 nt, Mycobacterium avium subsp. paratuberculosis
cgggcaguuccuugcg

SEQ ID NO: 914725 - RNA, 19 nt, Mycobacterium avium subsp. paratuberculosis
cgggcaguuccuugcgcag

SEQ ID NO: 914726 - RNA, 23 nt, Mycobacterium avium subsp. paratuberculosis
cgggcaguuccuugcgcagcacc

SEQ ID NO: 914727 - RNA, 16 nt, Mycobacterium avium subsp. paratuberculosis
cgggcagugcgcggcg

SEQ ID NO: 914728 - RNA, 13 nt, Mycobacterium avium subsp. paratuberculosis
cgggccagcagca

SEQ ID NO: 914729 - RNA, 15 nt, Mycobacterium avium subsp. paratuberculosis
cgggccagcagcagc

SEQ ID NO: 914730 - RNA, 13 nt, Mycobacterium avium subsp. paratuberculosis
cgggccagcagcc

SEQ ID NO: 914731 - RNA, 19 nt, Mycobacterium avium subsp. paratuberculosis
cgggccagcagccgcgcga

SEQ ID NO: 914732 - RNA, 15 nt, Mycobacterium avium subsp. paratuberculosis
cgggccagcagccgg

SEQ ID NO: 914733 - RNA, 17 nt, Mycobacterium avium subsp. paratuberculosis
cgggccagcagccgggu

SEQ ID NO: 914734 - RNA, 20 nt, Mycobacterium avium subsp. paratuberculosis
cgggccagacugcgcaccgc

SEQ ID NO: 914735 - RNA, 23 nt, Mycobacterium avium subsp. paratuberculosis
cgggccagacugcgcaccgccag

SEQ ID NO: 914736 - RNA, 18 nt, Mycobacterium avium subsp. paratuberculosis
cgggccagauggucgagg

SEQ ID NO: 914737 - RNA, 17 nt, Mycobacterium avium subsp. paratuberculosis
cgggccagcaacagcag

SEQ ID NO: 914738 - RNA, 18 nt, Mycobacterium avium subsp. paratuberculosis
cgggccacccgcgaucgg

SEQ ID NO: 914739 - RNA, 14 nt, Mycobacterium avium subsp. paratuberculosis
cgggcaucaucgcu

SEQ ID NO: 914740 - RNA, 17 nt, Mycobacterium avium subsp. paratuberculosis
cgggccaccgucccggu

SEQ ID NO: 914741 - RNA, 22 nt, Mycobacterium avium subsp. paratuberculosis
cgggccaccgucccggugucgc

SEQ ID NO: 914742 - RNA, 16 nt, Mycobacterium avium subsp. paratuberculosis
cgggccaccgucuucg

SEQ ID NO: 914743 - RNA, 13 nt, Mycobacterium avium subsp. paratuberculosis
cgggccgaacugc

SEQ ID NO: 914744 - RNA, 14 nt, Mycobacterium avium subsp. paratuberculosis
cgggccgaacugcc

SEQ ID NO: 914745 - RNA, 17 nt, Mycobacterium avium subsp. paratuberculosis
cgggccgaacugccgau

SEQ ID NO: 914746 - RNA, 19 nt, Mycobacterium avium subsp. paratuberculosis
cgggccgaacugccgaugc

SEQ ID NO: 914747 - RNA, 23 nt, Mycobacterium avium subsp. paratuberculosis
cgggccgaagaccgggccgauga

SEQ ID NO: 914748 - RNA, 13 nt, Mycobacterium avium subsp. paratuberculosis
cgggcccucggac

SEQ ID NO: 914749 - RNA, 18 nt, Mycobacterium avium subsp. paratuberculosis
cgggcccucggacgggag

SEQ ID NO: 914750 - RNA, 19 nt, Mycobacterium avium subsp. paratuberculosis
cgggcccucguccgacagc

SEQ ID NO: 914751 - RNA, 23 nt, Mycobacterium avium subsp. paratuberculosis
cgggcccucguccgacagcgccu

SEQ ID NO: 914752 - RNA, 17 nt, Mycobacterium avium subsp. paratuberculosis
cgggcccggucgucgcc

SEQ ID NO: 914753 - RNA, 18 nt, Mycobacterium avium subsp. paratuberculosis
cgggcccggucgucgccg

SEQ ID NO: 914754 - RNA, 20 nt, Mycobacterium avium subsp. paratuberculosis
cgggcccggucgucgccgga

SEQ ID NO: 914755 - RNA, 13 nt, Mycobacterium avium subsp. paratuberculosis
cgggcccggccgc

SEQ ID NO: 914756 - RNA, 13 nt, Mycobacterium avium subsp. paratuberculosis
cgggcccggcgau

SEQ ID NO: 914757 - RNA, 12 nt, Mycobacterium avium subsp. paratuberculosis
cgggcccggcgc

SEQ ID NO: 914758 - RNA, 19 nt, Mycobacterium avium subsp. paratuberculosis
cgggcccguagcucgcgcc

SEQ ID NO: 914759 - RNA, 20 nt, Mycobacterium avium subsp. paratuberculosis
cgggcccguagcucgcgccg

SEQ ID NO: 914760 - RNA, 23 nt, Mycobacterium avium subsp. paratuberculosis
cgggcccguagcucgcgccgacc

SEQ ID NO: 914761 - RNA, 20 nt, Mycobacterium avium subsp. paratuberculosis
cgggcccguagguugcccca

SEQ ID NO: 914762 - RNA, 21 nt, Mycobacterium avium subsp. paratuberculosis
cgggcccguagguugccccac

SEQ ID NO: 914763 - RNA, 14 nt, Mycobacterium avium subsp. paratuberculosis
cgggcccguccgcg

SEQ ID NO: 914764 - RNA, 16 nt, Mycobacterium avium subsp. paratuberculosis
cgggcccguccgcgaa

SEQ ID NO: 914765 - RNA, 16 nt, Mycobacterium avium subsp. paratuberculosis
cgggcccgucgccggc

SEQ ID NO: 914766 - RNA, 17 nt, Mycobacterium avium subsp. paratuberculosis
cgggcccgucgccggcg

SEQ ID NO: 914767 - RNA, 20 nt, Mycobacterium avium subsp. paratuberculosis
cgggcccgucgccggcgcgc

SEQ ID NO: 914768 - RNA, 21 nt, Mycobacterium avium subsp. paratuberculosis
cgggccgcagcgcgcggguga

SEQ ID NO: 914769 - RNA, 23 nt, Mycobacterium avium subsp. paratuberculosis
cgggccgcagcucgcccagcacc

SEQ ID NO: 914770 - RNA, 16 nt, Mycobacterium avium subsp. paratuberculosis
cgggccgcaggguggc

SEQ ID NO: 914771 - RNA, 18 nt, Mycobacterium avium subsp. paratuberculosis
cgggccgcaggguggcca

SEQ ID NO: 914772 - RNA, 22 nt, Mycobacterium avium subsp. paratuberculosis
cgggccgcaggguggccagcac

SEQ ID NO: 914773 - RNA, 14 nt, Mycobacterium avium subsp. paratuberculosis
cgggccgcauccag

SEQ ID NO: 914774 - RNA, 17 nt, Mycobacterium avium subsp. paratuberculosis
cgggccgcauccagcgc

SEQ ID NO: 914775 - RNA, 18 nt, Mycobacterium avium subsp. paratuberculosis
cgggccgcauccagcgcc

SEQ ID NO: 914776 - RNA, 20 nt, Mycobacterium avium subsp. paratuberculosis
cgggccgcauccagcgccgc

SEQ ID NO: 914777 - RNA, 13 nt, Mycobacterium avium subsp. paratuberculosis
cgggccgcauccg

SEQ ID NO: 914778 - RNA, 15 nt, Mycobacterium avium subsp. paratuberculosis
cgggccgccaucacc

SEQ ID NO: 914779 - RNA, 17 nt, Mycobacterium avium subsp. paratuberculosis
cgggccgccaucaccgc

SEQ ID NO: 914780 - RNA, 13 nt, Mycobacterium avium subsp. paratuberculosis
cgggccgcccgcg

SEQ ID NO: 914781 - RNA, 14 nt, Mycobacterium avium subsp. paratuberculosis
cgggccgcccggcg

SEQ ID NO: 914782 - RNA, 15 nt, Mycobacterium avium subsp. paratuberculosis
cgggccgcccggcgc

SEQ ID NO: 914783 - RNA, 14 nt, Mycobacterium avium subsp. paratuberculosis
cgggccgccgacgu

SEQ ID NO: 914784 - RNA, 23 nt, Mycobacterium avium subsp. paratuberculosis
cgggccgccgaugcgcccgcugc

SEQ ID NO: 914785 - RNA, 16 nt, Mycobacterium avium subsp. paratuberculosis
cgggccgccgcgcggg

SEQ ID NO: 914786 - RNA, 13 nt, Mycobacterium avium subsp. paratuberculosis
cgggccgccgcgg

SEQ ID NO: 914787 - RNA, 15 nt, Mycobacterium avium subsp. paratuberculosis
cgggccgccgcggcc

SEQ ID NO: 914788 - RNA, 16 nt, Mycobacterium avium subsp. paratuberculosis
cgggccgccgcggcca

SEQ ID NO: 914789 - RNA, 22 nt, Mycobacterium avium subsp. paratuberculosis
cgggccgccggccgcggcgugc

SEQ ID NO: 914790 - RNA, 13 nt, Mycobacterium avium subsp. paratuberculosis
cgggccucgccgc

SEQ ID NO: 914791 - RNA, 22 nt, Mycobacterium avium subsp. paratuberculosis
cgggccuccuguuggcccugcu

SEQ ID NO: 914792 - RNA, 17 nt, Mycobacterium avium subsp. paratuberculosis
cgggccuaggaccccgg

SEQ ID NO: 914793 - RNA, 20 nt, Mycobacterium avium subsp. paratuberculosis
cgggccuaggaccccggcug

SEQ ID NO: 914794 - RNA, 22 nt, Mycobacterium avium subsp. paratuberculosis
cgggccuaggaccccggcugcu

SEQ ID NO: 914795 - RNA, 16 nt, Mycobacterium avium subsp. paratuberculosis
cgggccguucagcggg

SEQ ID NO: 914796 - RNA, 17 nt, Mycobacterium avium subsp. paratuberculosis
cgggccguucagcgggc

SEQ ID NO: 914797 - RNA, 20 nt, Mycobacterium avium subsp. paratuberculosis
cgggccguucagcgggcggu

SEQ ID NO: 914798 - RNA, 22 nt, Mycobacterium avium subsp. paratuberculosis
cgggccguucagcgggcgguug

SEQ ID NO: 914799 - RNA, 15 nt, Mycobacterium avium subsp. paratuberculosis
cgggccgugccgcca

SEQ ID NO: 914800 - RNA, 19 nt, Mycobacterium avium subsp. paratuberculosis
cgggccguggcaccgggug

SEQ ID NO: 914801 - RNA, 18 nt, Mycobacterium avium subsp. paratuberculosis
cgggccguccgccggcug

SEQ ID NO: 914802 - RNA, 13 nt, Mycobacterium avium subsp. paratuberculosis
cgggccguccggg

SEQ ID NO: 914803 - RNA, 16 nt, Mycobacterium avium subsp. paratuberculosis
cgggccguccgggugc

SEQ ID NO: 914804 - RNA, 13 nt, Mycobacterium avium subsp. paratuberculosis
cgggccgcgccga

SEQ ID NO: 914805 - RNA, 14 nt, Mycobacterium avium subsp. paratuberculosis
cgggccgccgggug

SEQ ID NO: 914806 - RNA, 18 nt, Mycobacterium avium subsp. paratuberculosis
cgggcacgaauucggugg

SEQ ID NO: 914807 - RNA, 16 nt, Mycobacterium avium subsp. paratuberculosis
cgggcacgacggucag

SEQ ID NO: 914808 - RNA, 18 nt, Mycobacterium avium subsp. paratuberculosis
cgggcagcaccagcggca

SEQ ID NO: 914809 - RNA, 14 nt, Mycobacterium avium subsp. paratuberculosis
cgggcagcagcacc

SEQ ID NO: 914810 - RNA, 15 nt, Mycobacterium avium subsp. paratuberculosis
cgggcagcagcacca

SEQ ID NO: 914811 - RNA, 18 nt, Mycobacterium avium subsp. paratuberculosis
cgggcagcagcaccagcg

SEQ ID NO: 914812 - RNA, 20 nt, Mycobacterium avium subsp. paratuberculosis
cgggcagcagcaccagcgcc

SEQ ID NO: 914813 - RNA, 23 nt, Mycobacterium avium subsp. paratuberculosis
cgggcagguacugcuugccgccg

SEQ ID NO: 914814 - RNA, 18 nt, Mycobacterium avium subsp. paratuberculosis
cgggcagggggacgaacc

SEQ ID NO: 914815 - RNA, 12 nt, Mycobacterium avium subsp. paratuberculosis
cgggcaggguga

SEQ ID NO: 914816 - RNA, 13 nt, Mycobacterium avium subsp. paratuberculosis
cgggcagggugac

SEQ ID NO: 914817 - RNA, 14 nt, Mycobacterium avium subsp. paratuberculosis
cgggcagggugacc

SEQ ID NO: 914818 - RNA, 16 nt, Mycobacterium avium subsp. paratuberculosis
cgggcagggugaccga

SEQ ID NO: 914819 - RNA, 21 nt, Mycobacterium avium subsp. paratuberculosis
cgggcagggugaccgaggccg

SEQ ID NO: 914820 - RNA, 12 nt, Mycobacterium avium subsp. paratuberculosis
cgggcagcgcga

SEQ ID NO: 914821 - RNA, 13 nt, Mycobacterium avium subsp. paratuberculosis
cgggcagcgcgac

SEQ ID NO: 914822 - RNA, 16 nt, Mycobacterium avium subsp. paratuberculosis
cgggcagcgcgacacc

SEQ ID NO: 914823 - RNA, 12 nt, Mycobacterium avium subsp. paratuberculosis
cgggcagcgcgc

SEQ ID NO: 914824 - RNA, 17 nt, Mycobacterium avium subsp. paratuberculosis
cgggcagcgcgcgagac

SEQ ID NO: 914825 - RNA, 21 nt, Mycobacterium avium subsp. paratuberculosis
cgggcagccgcacaccgcggc

SEQ ID NO: 914826 - RNA, 13 nt, Mycobacterium avium subsp. paratuberculosis
cgggcagccggcg

SEQ ID NO: 914827 - RNA, 15 nt, Mycobacterium avium subsp. paratuberculosis
cgggcagccggcgcc

SEQ ID NO: 914828 - RNA, 20 nt, Mycobacterium avium subsp. paratuberculosis
cgggcagccggcgcccgcag

SEQ ID NO: 914829 - RNA, 21 nt, Mycobacterium avium subsp. paratuberculosis
cgggcagccggcgcccgcagg

SEQ ID NO: 914830 - RNA, 17 nt, Mycobacterium avium subsp. paratuberculosis
cgggcagcgagcacagc

SEQ ID NO: 914831 - RNA, 15 nt, Mycobacterium avium subsp. paratuberculosis
cgggcagcgagucga

SEQ ID NO: 914832 - RNA, 23 nt, Mycobacterium avium subsp. paratuberculosis
cgggcagcgagucgaaggcgcgg

SEQ ID NO: 914833 - RNA, 15 nt, Mycobacterium avium subsp. paratuberculosis
cgggcagcccaggua

SEQ ID NO: 914834 - RNA, 20 nt, Mycobacterium avium subsp. paratuberculosis
cgggcagcccagguaaucga

SEQ ID NO: 914835 - RNA, 18 nt, Mycobacterium avium subsp. paratuberculosis
cgggcagcccgccgacca

SEQ ID NO: 914836 - RNA, 15 nt, Mycobacterium avium subsp. paratuberculosis
cgggcagcccgccgc

SEQ ID NO: 914837 - RNA, 18 nt, Mycobacterium avium subsp. paratuberculosis
cgggcagcccgccgcgga

SEQ ID NO: 914838 - RNA, 21 nt, Mycobacterium avium subsp. paratuberculosis
cgggcaagggcaaagacgacg

SEQ ID NO: 914839 - RNA, 23 nt, Mycobacterium avium subsp. paratuberculosis
cgggcaagggcaaagacgacggc

SEQ ID NO: 914840 - RNA, 22 nt, Mycobacterium avium subsp. paratuberculosis
cgggcaaucgcugcgcccgccg

SEQ ID NO: 914841 - RNA, 14 nt, Mycobacterium avium subsp. paratuberculosis
cgggcaaucggacc

SEQ ID NO: 914842 - RNA, 15 nt, Mycobacterium avium subsp. paratuberculosis
cgggcaacgcgccgg

SEQ ID NO: 914843 - RNA, 16 nt, Mycobacterium avium subsp. paratuberculosis
cgggcaacgcgccggc

SEQ ID NO: 914844 - RNA, 19 nt, Mycobacterium avium subsp. paratuberculosis
cgggcaacgcgccggcggu

SEQ ID NO: 914845 - RNA, 18 nt, Mycobacterium avium subsp. paratuberculosis
cgggcaccgcgcccgccc

SEQ ID NO: 914846 - RNA, 13 nt, Mycobacterium avium subsp. paratuberculosis
cgggcaccgucgu

SEQ ID NO: 914847 - RNA, 16 nt, Mycobacterium avium subsp. paratuberculosis
cgggcaccgucgucgc

SEQ ID NO: 914848 - RNA, 22 nt, Mycobacterium avium subsp. paratuberculosis
cgggcaccgucgucgcaccggc

SEQ ID NO: 914849 - RNA, 19 nt, Mycobacterium avium subsp. paratuberculosis
cgggcaccucgaugccgug

SEQ ID NO: 914850 - RNA, 17 nt, Mycobacterium avium subsp. paratuberculosis
cgggcaccucggccagg

SEQ ID NO: 914851 - RNA, 17 nt, Mycobacterium avium subsp. paratuberculosis
cgggcaccucggcgucg

SEQ ID NO: 914852 - RNA, 23 nt, Mycobacterium avium subsp. paratuberculosis
cgggcaccugauaggggucggcg

SEQ ID NO: 914853 - RNA, 15 nt, Mycobacterium avium subsp. paratuberculosis
cgggcacccccgggg

SEQ ID NO: 914854 - RNA, 12 nt, Mycobacterium avium subsp. paratuberculosis
cgggcaccccgg

SEQ ID NO: 914855 - RNA, 16 nt, Mycobacterium avium subsp. paratuberculosis
cgggcaccccggucac

SEQ ID NO: 914856 - RNA, 21 nt, Mycobacterium avium subsp. paratuberculosis
cgggcaccccggucaccgguc

SEQ ID NO: 914857 - RNA, 17 nt, Mycobacterium avium subsp. paratuberculosis
cgggcaccccugccgcc

SEQ ID NO: 914858 - RNA, 22 nt, Mycobacterium avium subsp. paratuberculosis
cgggcacccgacgucgacgcgg

SEQ ID NO: 914859 - RNA, 13 nt, Mycobacterium avium subsp. paratuberculosis
cgggcacccgcgc

SEQ ID NO: 914860 - RNA, 14 nt, Mycobacterium avium subsp. paratuberculosis
cgggcacccgcgcg

SEQ ID NO: 914861 - RNA, 17 nt, Mycobacterium avium subsp. paratuberculosis
cgggcacccgcgcgucg

SEQ ID NO: 914862 - RNA, 19 nt, Mycobacterium avium subsp. paratuberculosis
cgggcacccgcgcgucgcg

SEQ ID NO: 914863 - RNA, 12 nt, Mycobacterium avium subsp. paratuberculosis
cgggcacccggc

SEQ ID NO: 914864 - RNA, 14 nt, Mycobacterium avium subsp. paratuberculosis
cgggcacccggcgc

SEQ ID NO: 914865 - RNA, 15 nt, Mycobacterium avium subsp. paratuberculosis
cgggcacccggcgcg

SEQ ID NO: 914866 - RNA, 19 nt, Mycobacterium avium subsp. paratuberculosis
cgggcacccggcgcggccg

SEQ ID NO: 914867 - RNA, 23 nt, Mycobacterium avium subsp. paratuberculosis
cgggcacccggcgcggccgccca

SEQ ID NO: 914868 - RNA, 16 nt, Mycobacterium avium subsp. paratuberculosis
cgggauuggacagcgg

SEQ ID NO: 914869 - RNA, 12 nt, Mycobacterium avium subsp. paratuberculosis
cgggauuggcgc

SEQ ID NO: 914870 - RNA, 14 nt, Mycobacterium avium subsp. paratuberculosis
cgggauuggcgcca

SEQ ID NO: 914871 - RNA, 21 nt, Mycobacterium avium subsp. paratuberculosis
cgggauuggcgccacugccgc

SEQ ID NO: 914872 - RNA, 23 nt, Mycobacterium avium subsp. paratuberculosis
cgggauuggcgccacugccgccg

SEQ ID NO: 914873 - RNA, 17 nt, Mycobacterium avium subsp. paratuberculosis
cgggauuggcggccaac

SEQ ID NO: 914874 - RNA, 22 nt, Mycobacterium avium subsp. paratuberculosis
cgggaugucgugggcgugccgg

SEQ ID NO: 914875 - RNA, 15 nt, Mycobacterium avium subsp. paratuberculosis
cgggauguagccggu

SEQ ID NO: 914876 - RNA, 21 nt, Mycobacterium avium subsp. paratuberculosis
cgggauguagccgguccuggc

SEQ ID NO: 914877 - RNA, 15 nt, Mycobacterium avium subsp. paratuberculosis
cgggaugugcguggu

SEQ ID NO: 914878 - RNA, 19 nt, Mycobacterium avium subsp. paratuberculosis
cgggauggguggucaccgu

SEQ ID NO: 914879 - RNA, 20 nt, Mycobacterium avium subsp. paratuberculosis
cgggauggguggucaccgug

SEQ ID NO: 914880 - RNA, 15 nt, Mycobacterium avium subsp. paratuberculosis
cgggauggucgaucc

SEQ ID NO: 914881 - RNA, 17 nt, Mycobacterium avium subsp. paratuberculosis
cgggauggugaccagcg

SEQ ID NO: 914882 - RNA, 20 nt, Mycobacterium avium subsp. paratuberculosis
cgggauggugaccagcgccc

SEQ ID NO: 914883 - RNA, 23 nt, Mycobacterium avium subsp. paratuberculosis
cgggauggugaccagcgcccccg

SEQ ID NO: 914884 - RNA, 14 nt, Mycobacterium avium subsp. paratuberculosis
cgggauggugagcc

SEQ ID NO: 914885 - RNA, 18 nt, Mycobacterium avium subsp. paratuberculosis
cgggauggugagcccgau

SEQ ID NO: 914886 - RNA, 17 nt, Mycobacterium avium subsp. paratuberculosis
cgggcaacagcgcgccg

SEQ ID NO: 914887 - RNA, 19 nt, Mycobacterium avium subsp. paratuberculosis
cgggcaacagcgcgccggc

SEQ ID NO: 914888 - RNA, 20 nt, Mycobacterium avium subsp. paratuberculosis
cgggcaacagcgcgccggcc

SEQ ID NO: 914889 - RNA, 23 nt, Mycobacterium avium subsp. paratuberculosis
cgggauuucccgggcgaucagcc

SEQ ID NO: 914890 - RNA, 14 nt, Mycobacterium avium subsp. paratuberculosis
cgggaugcggucga

SEQ ID NO: 914891 - RNA, 21 nt, Mycobacterium avium subsp. paratuberculosis
cgggaugccugcccgcgcagg

SEQ ID NO: 914892 - RNA, 16 nt, Mycobacterium avium subsp. paratuberculosis
cgggaugcgccaccga

SEQ ID NO: 914893 - RNA, 22 nt, Mycobacterium avium subsp. paratuberculosis
cgggaugccgagcagcucggcg

SEQ ID NO: 914894 - RNA, 14 nt, Mycobacterium avium subsp. paratuberculosis
cgggaugccgaggu

SEQ ID NO: 914895 - RNA, 12 nt, Mycobacterium avium subsp. paratuberculosis
cgggaugccgcc

SEQ ID NO: 914896 - RNA, 20 nt, Mycobacterium avium subsp. paratuberculosis
cgggaugcuuggucgcggcg

SEQ ID NO: 914897 - RNA, 22 nt, Mycobacterium avium subsp. paratuberculosis
cgggaugcuuggucgcggcguu

SEQ ID NO: 914898 - RNA, 15 nt, Mycobacterium avium subsp. paratuberculosis
cgggauggacgacgu

SEQ ID NO: 914899 - RNA, 17 nt, Mycobacterium avium subsp. paratuberculosis
cgggauggagccgccca

SEQ ID NO: 914900 - RNA, 19 nt, Mycobacterium avium subsp. paratuberculosis
cgggauggcucagcgcacc

SEQ ID NO: 914901 - RNA, 21 nt, Mycobacterium avium subsp. paratuberculosis
cgggauggcucagcgcaccgc

SEQ ID NO: 914902 - RNA, 23 nt, Mycobacterium avium subsp. paratuberculosis
cgggaugggcauugcccaucgcc

SEQ ID NO: 914903 - RNA, 21 nt, Mycobacterium avium subsp. paratuberculosis
cgggaucggcuuggugggcgc

SEQ ID NO: 914904 - RNA, 14 nt, Mycobacterium avium subsp. paratuberculosis
cgggaucggggugc

SEQ ID NO: 914905 - RNA, 14 nt, Mycobacterium avium subsp. paratuberculosis
cgggaucggugccg

SEQ ID NO: 914906 - RNA, 21 nt, Mycobacterium avium subsp. paratuberculosis
cgggaucggugccgacggugc

SEQ ID NO: 914907 - RNA, 14 nt, Mycobacterium avium subsp. paratuberculosis
cgggaucgucgccg

SEQ ID NO: 914908 - RNA, 15 nt, Mycobacterium avium subsp. paratuberculosis
cgggaucgucgccgg

SEQ ID NO: 914909 - RNA, 16 nt, Mycobacterium avium subsp. paratuberculosis
cgggaucgucgccggg

SEQ ID NO: 914910 - RNA, 16 nt, Mycobacterium avium subsp. paratuberculosis
cgggaucguguggccg

SEQ ID NO: 914911 - RNA, 17 nt, Mycobacterium avium subsp. paratuberculosis
cgggaucguguggccgc

SEQ ID NO: 914912 - RNA, 15 nt, Mycobacterium avium subsp. paratuberculosis
cgggaucugcgccgc

SEQ ID NO: 914913 - RNA, 17 nt, Mycobacterium avium subsp. paratuberculosis
cgggaucugcgccgccu

SEQ ID NO: 914914 - RNA, 19 nt, Mycobacterium avium subsp. paratuberculosis
cgggaugaacucgugcggc

SEQ ID NO: 914915 - RNA, 20 nt, Mycobacterium avium subsp. paratuberculosis
cgggaugacaccgcggacca

SEQ ID NO: 914916 - RNA, 14 nt, Mycobacterium avium subsp. paratuberculosis
cgggaucuggccgg

SEQ ID NO: 914917 - RNA, 18 nt, Mycobacterium avium subsp. paratuberculosis
cgggaugaucggcgccuu

SEQ ID NO: 914918 - RNA, 13 nt, Mycobacterium avium subsp. paratuberculosis
cgggagacgcugu

SEQ ID NO: 914919 - RNA, 14 nt, Mycobacterium avium subsp. paratuberculosis
cgggagacguccug

SEQ ID NO: 914920 - RNA, 16 nt, Mycobacterium avium subsp. paratuberculosis
cgggagaacucgacga

SEQ ID NO: 914921 - RNA, 19 nt, Mycobacterium avium subsp. paratuberculosis
cgggagaacucgacgaucu

SEQ ID NO: 914922 - RNA, 23 nt, Mycobacterium avium subsp. paratuberculosis
cgggagaacagguaggacaccga

SEQ ID NO: 914923 - RNA, 19 nt, Mycobacterium avium subsp. paratuberculosis
cgggagaaccucaacguga

SEQ ID NO: 914924 - RNA, 20 nt, Mycobacterium avium subsp. paratuberculosis
cgggacugggcgauugcguu

SEQ ID NO: 914925 - RNA, 21 nt, Mycobacterium avium subsp. paratuberculosis
cgggagauacggucgcaccgc

SEQ ID NO: 914926 - RNA, 22 nt, Mycobacterium avium subsp. paratuberculosis
cgggagauacggucgcaccgcg

SEQ ID NO: 914927 - RNA, 16 nt, Mycobacterium avium subsp. paratuberculosis
cgggagagcgcgggca

SEQ ID NO: 914928 - RNA, 18 nt, Mycobacterium avium subsp. paratuberculosis
cgggagagcgcgggcacc

SEQ ID NO: 914929 - RNA, 18 nt, Mycobacterium avium subsp. paratuberculosis
cgggagcaaggucgucgc

SEQ ID NO: 914930 - RNA, 21 nt, Mycobacterium avium subsp. paratuberculosis
cgggagcaaggucgucgcggc

SEQ ID NO: 914931 - RNA, 22 nt, Mycobacterium avium subsp. paratuberculosis
cgggagcaaggucgucgcggcc

SEQ ID NO: 914932 - RNA, 23 nt, Mycobacterium avium subsp. paratuberculosis
cgggagcgcuggucggcgaaccg

SEQ ID NO: 914933 - RNA, 12 nt, Mycobacterium avium subsp. paratuberculosis
cgggagccggcc

SEQ ID NO: 914934 - RNA, 13 nt, Mycobacterium avium subsp. paratuberculosis
cgggagccggcca

SEQ ID NO: 914935 - RNA, 18 nt, Mycobacterium avium subsp. paratuberculosis
cgggagccggccagguug

SEQ ID NO: 914936 - RNA, 19 nt, Mycobacterium avium subsp. paratuberculosis
cgggagccggcggcggugc

SEQ ID NO: 914937 - RNA, 13 nt, Mycobacterium avium subsp. paratuberculosis
cgggacggcggcg

SEQ ID NO: 914938 - RNA, 14 nt, Mycobacterium avium subsp. paratuberculosis
cgggacggcggcga

SEQ ID NO: 914939 - RNA, 13 nt, Mycobacterium avium subsp. paratuberculosis
cgggacggccagc

SEQ ID NO: 914940 - RNA, 16 nt, Mycobacterium avium subsp. paratuberculosis
cgggacggccagcagg

SEQ ID NO: 914941 - RNA, 20 nt, Mycobacterium avium subsp. paratuberculosis
cgggacgcgcagaucgucga

SEQ ID NO: 914942 - RNA, 21 nt, Mycobacterium avium subsp. paratuberculosis
cgggacgcgcagaucgucgaa

SEQ ID NO: 914943 - RNA, 14 nt, Mycobacterium avium subsp. paratuberculosis
cgggacgcggcagg

SEQ ID NO: 914944 - RNA, 18 nt, Mycobacterium avium subsp. paratuberculosis
cgggacgcggcaggcgcc

SEQ ID NO: 914945 - RNA, 19 nt, Mycobacterium avium subsp. paratuberculosis
cgggacgcggcaggcgccc

SEQ ID NO: 914946 - RNA, 13 nt, Mycobacterium avium subsp. paratuberculosis
cgggacgcggucc

SEQ ID NO: 914947 - RNA, 19 nt, Mycobacterium avium subsp. paratuberculosis
cgggacgggggugccgacc

SEQ ID NO: 914948 - RNA, 21 nt, Mycobacterium avium subsp. paratuberculosis
cgggacgggggugccgaccgc

SEQ ID NO: 914949 - RNA, 19 nt, Mycobacterium avium subsp. paratuberculosis
cgggacggguugcaggcca

SEQ ID NO: 914950 - RNA, 14 nt, Mycobacterium avium subsp. paratuberculosis
cgggacguccgcgc

SEQ ID NO: 914951 - RNA, 15 nt, Mycobacterium avium subsp. paratuberculosis
cgggacguccgcgcg

SEQ ID NO: 914952 - RNA, 14 nt, Mycobacterium avium subsp. paratuberculosis
cgggacgucggcgc

SEQ ID NO: 914953 - RNA, 15 nt, Mycobacterium avium subsp. paratuberculosis
cgggacgucggcgcg

SEQ ID NO: 914954 - RNA, 16 nt, Mycobacterium avium subsp. paratuberculosis
cgggacgucggcgcgc

SEQ ID NO: 914955 - RNA, 23 nt, Mycobacterium avium subsp. paratuberculosis
cgggacgucggcgcgcucggugc

SEQ ID NO: 914956 - RNA, 13 nt, Mycobacterium avium subsp. paratuberculosis
cgggacguggcuc

SEQ ID NO: 914957 - RNA, 20 nt, Mycobacterium avium subsp. paratuberculosis
cgggacguggcucagcggca

SEQ ID NO: 914958 - RNA, 12 nt, Mycobacterium avium subsp. paratuberculosis
cgggacguuguc

SEQ ID NO: 914959 - RNA, 22 nt, Mycobacterium avium subsp. paratuberculosis
cgggacgaaggugcgcacgaac

SEQ ID NO: 914960 - RNA, 12 nt, Mycobacterium avium subsp. paratuberculosis
cgggacgacggc

SEQ ID NO: 914961 - RNA, 16 nt, Mycobacterium avium subsp. paratuberculosis
cgggacgacggcgccg

SEQ ID NO: 914962 - RNA, 17 nt, Mycobacterium avium subsp. paratuberculosis
cgggacgacggcgccgc

SEQ ID NO: 914963 - RNA, 20 nt, Mycobacterium avium subsp. paratuberculosis
cgggacgacggcgccgcccg

SEQ ID NO: 914964 - RNA, 19 nt, Mycobacterium avium subsp. paratuberculosis
cgggacgaggggcagcagc

SEQ ID NO: 914965 - RNA, 22 nt, Mycobacterium avium subsp. paratuberculosis
cgggacgaggggcagcagcgcc

SEQ ID NO: 914966 - RNA, 23 nt, Mycobacterium avium subsp. paratuberculosis
cgggacgaggggcagcagcgccc

SEQ ID NO: 914967 - RNA, 13 nt, Mycobacterium avium subsp. paratuberculosis
cgggacgccacgg

SEQ ID NO: 914968 - RNA, 14 nt, Mycobacterium avium subsp. paratuberculosis
cgggacgccacggc

SEQ ID NO: 914969 - RNA, 15 nt, Mycobacterium avium subsp. paratuberculosis
cgggacgccacggcg

SEQ ID NO: 914970 - RNA, 18 nt, Mycobacterium avium subsp. paratuberculosis
cgggacgaucugcgucau

SEQ ID NO: 914971 - RNA, 21 nt, Mycobacterium avium subsp. paratuberculosis
cgggacgaucugcgucaugga

SEQ ID NO: 914972 - RNA, 11 nt, Mycobacterium avium subsp. paratuberculosis
cgggacgccgu

SEQ ID NO: 914973 - RNA, 15 nt, Mycobacterium avium subsp. paratuberculosis
cgggacgccugccgc

SEQ ID NO: 914974 - RNA, 16 nt, Mycobacterium avium subsp. paratuberculosis
cgggacgccugccgcc

SEQ ID NO: 914975 - RNA, 15 nt, Mycobacterium avium subsp. paratuberculosis
cgggagugcggccca

SEQ ID NO: 914976 - RNA, 20 nt, Mycobacterium avium subsp. paratuberculosis
cgggagugcggcccacccgg

SEQ ID NO: 914977 - RNA, 15 nt, Mycobacterium avium subsp. paratuberculosis
cgggaguggccggcg

SEQ ID NO: 914978 - RNA, 15 nt, Mycobacterium avium subsp. paratuberculosis
cgggaguccacgccg

SEQ ID NO: 914979 - RNA, 17 nt, Mycobacterium avium subsp. paratuberculosis
cgggaguccacgccgug

SEQ ID NO: 914980 - RNA, 17 nt, Mycobacterium avium subsp. paratuberculosis
cgggagcuaggcggccg

SEQ ID NO: 914981 - RNA, 18 nt, Mycobacterium avium subsp. paratuberculosis
cgggagcuaggcggccgg

SEQ ID NO: 914982 - RNA, 14 nt, Mycobacterium avium subsp. paratuberculosis
cgggaggacagcgc

SEQ ID NO: 914983 - RNA, 15 nt, Mycobacterium avium subsp. paratuberculosis
cgggaggcagcgcgg

SEQ ID NO: 914984 - RNA, 16 nt, Mycobacterium avium subsp. paratuberculosis
cgggauaguucgccgc

SEQ ID NO: 914985 - RNA, 17 nt, Mycobacterium avium subsp. paratuberculosis
cgggauaguucgccgcc

SEQ ID NO: 914986 - RNA, 19 nt, Mycobacterium avium subsp. paratuberculosis
cgggauaguucgccgccgc

SEQ ID NO: 914987 - RNA, 23 nt, Mycobacterium avium subsp. paratuberculosis
cgggauaguucgccgccgccagc

SEQ ID NO: 914988 - RNA, 17 nt, Mycobacterium avium subsp. paratuberculosis
cgggauagggcgcgucg

SEQ ID NO: 914989 - RNA, 22 nt, Mycobacterium avium subsp. paratuberculosis
cgggauagggcgcgucgaucgc

SEQ ID NO: 914990 - RNA, 18 nt, Mycobacterium avium subsp. paratuberculosis
cgggauagccgagcggcg

SEQ ID NO: 914991 - RNA, 20 nt, Mycobacterium avium subsp. paratuberculosis
cgggauagccgagcggcgcc

SEQ ID NO: 914992 - RNA, 16 nt, Mycobacterium avium subsp. paratuberculosis
cgggauagagcaccgc

SEQ ID NO: 914993 - RNA, 18 nt, Mycobacterium avium subsp. paratuberculosis
cgggauagagcaccgcgc

SEQ ID NO: 914994 - RNA, 19 nt, Mycobacterium avium subsp. paratuberculosis
cgggauacccaugaucgcc

SEQ ID NO: 914995 - RNA, 22 nt, Mycobacterium avium subsp. paratuberculosis
cgggauacccaugaucgccagu

SEQ ID NO: 914996 - RNA, 19 nt, Mycobacterium avium subsp. paratuberculosis
cgggauaccgcgaccgccu

SEQ ID NO: 914997 - RNA, 19 nt, Mycobacterium avium subsp. paratuberculosis
cgggauacucguccucccg

SEQ ID NO: 914998 - RNA, 17 nt, Mycobacterium avium subsp. paratuberculosis
cgggaucggaccgcacc

SEQ ID NO: 914999 - RNA, 19 nt, Mycobacterium avium subsp. paratuberculosis
cgggaucggaccgcaccac

SEQ ID NO: 915000 - RNA, 14 nt, Mycobacterium avium subsp. paratuberculosis
cgggaucggccggc

SEQ ID NO: 915001 - RNA, 15 nt, Mycobacterium avium subsp. paratuberculosis
cgggaucggccggcg

SEQ ID NO: 915002 - RNA, 20 nt, Mycobacterium avium subsp. paratuberculosis
cgggaucggccggcgaggug

SEQ ID NO: 915003 - RNA, 13 nt, Mycobacterium avium subsp. paratuberculosis
cgggaucggcgcc

SEQ ID NO: 915004 - RNA, 22 nt, Mycobacterium avium subsp. paratuberculosis
cgggaucggcgcccaccgcggc

SEQ ID NO: 915005 - RNA, 14 nt, Mycobacterium avium subsp. paratuberculosis
cgggaucggcgcgu

SEQ ID NO: 915006 - RNA, 16 nt, Mycobacterium avium subsp. paratuberculosis
cgggaucggcgcgucg

SEQ ID NO: 915007 - RNA, 15 nt, Mycobacterium avium subsp. paratuberculosis
cgggaucggcggcgg

SEQ ID NO: 915008 - RNA, 18 nt, Mycobacterium avium subsp. paratuberculosis
cgggaucggcggcggggu

SEQ ID NO: 915009 - RNA, 16 nt, Mycobacterium avium subsp. paratuberculosis
cgggaucggcggggcg

SEQ ID NO: 915010 - RNA, 14 nt, Mycobacterium avium subsp. paratuberculosis
cgggauccggcgcg

SEQ ID NO: 915011 - RNA, 19 nt, Mycobacterium avium subsp. paratuberculosis
cgggauccggcgcgccgcg

SEQ ID NO: 915012 - RNA, 16 nt, Mycobacterium avium subsp. paratuberculosis
cgggaucgaucccguc

SEQ ID NO: 915013 - RNA, 15 nt, Mycobacterium avium subsp. paratuberculosis
cgggauccucgccgc

SEQ ID NO: 915014 - RNA, 16 nt, Mycobacterium avium subsp. paratuberculosis
cgggauccucgccgcg

SEQ ID NO: 915015 - RNA, 17 nt, Mycobacterium avium subsp. paratuberculosis
cgggauccucgccgcgg

SEQ ID NO: 915016 - RNA, 19 nt, Mycobacterium avium subsp. paratuberculosis
cgggauccucgccgcgggc

SEQ ID NO: 915017 - RNA, 15 nt, Mycobacterium avium subsp. paratuberculosis
cgggauauucgccca

SEQ ID NO: 915018 - RNA, 20 nt, Mycobacterium avium subsp. paratuberculosis
cgggauauucgcccagcggc

SEQ ID NO: 915019 - RNA, 13 nt, Mycobacterium avium subsp. paratuberculosis
cgggaucacacgc

SEQ ID NO: 915020 - RNA, 18 nt, Mycobacterium avium subsp. paratuberculosis
cgggaucacacgcgcgcc

SEQ ID NO: 915021 - RNA, 19 nt, Mycobacterium avium subsp. paratuberculosis
cgggaucacacgcgcgccc

SEQ ID NO: 915022 - RNA, 19 nt, Mycobacterium avium subsp. paratuberculosis
cgggaucacccucggcguc

SEQ ID NO: 915023 - RNA, 21 nt, Mycobacterium avium subsp. paratuberculosis
cgggauccaggaacggcaccc

SEQ ID NO: 915024 - RNA, 22 nt, Mycobacterium avium subsp. paratuberculosis
cgggauccaggaauucgggcac

SEQ ID NO: 915025 - RNA, 14 nt, Mycobacterium avium subsp. paratuberculosis
cgggaucagcggga

SEQ ID NO: 915026 - RNA, 19 nt, Mycobacterium avium subsp. paratuberculosis
cgggauccccaccgugacg

SEQ ID NO: 915027 - RNA, 23 nt, Mycobacterium avium subsp. paratuberculosis
cgggauccggauugccgggcagc

SEQ ID NO: 915028 - RNA, 13 nt, Mycobacterium avium subsp. paratuberculosis
cgggaucccgcag

SEQ ID NO: 915029 - RNA, 14 nt, Mycobacterium avium subsp. paratuberculosis
cgggaucccgcagc

SEQ ID NO: 915030 - RNA, 15 nt, Mycobacterium avium subsp. paratuberculosis
cgggaucccgcagcc

SEQ ID NO: 915031 - RNA, 17 nt, Mycobacterium avium subsp. paratuberculosis
cgggaucccgcagccgc

SEQ ID NO: 915032 - RNA, 19 nt, Mycobacterium avium subsp. paratuberculosis
cgggaucccgcagccgcga

SEQ ID NO: 915033 - RNA, 20 nt, Mycobacterium avium subsp. paratuberculosis
cgggaucccgcagccgcgac

SEQ ID NO: 915034 - RNA, 14 nt, Mycobacterium avium subsp. paratuberculosis
cgggauccgaggcg

SEQ ID NO: 915035 - RNA, 22 nt, Mycobacterium avium subsp. paratuberculosis
cgggaagaucgcagcggugaca

SEQ ID NO: 915036 - RNA, 17 nt, Mycobacterium avium subsp. paratuberculosis
cgggaacucgaugcggc

SEQ ID NO: 915037 - RNA, 20 nt, Mycobacterium avium subsp. paratuberculosis
cgggaacucgaugcggcagc

SEQ ID NO: 915038 - RNA, 15 nt, Mycobacterium avium subsp. paratuberculosis
cgggaacgcggcgaa

SEQ ID NO: 915039 - RNA, 20 nt, Mycobacterium avium subsp. paratuberculosis
cgggaacggguagugcacgg

SEQ ID NO: 915040 - RNA, 17 nt, Mycobacterium avium subsp. paratuberculosis
cgggaacggucagccgc

SEQ ID NO: 915041 - RNA, 14 nt, Mycobacterium avium subsp. paratuberculosis
cgggaacgucaugg

SEQ ID NO: 915042 - RNA, 23 nt, Mycobacterium avium subsp. paratuberculosis
cgggaacgucauggccagcucgu

SEQ ID NO: 915043 - RNA, 16 nt, Mycobacterium avium subsp. paratuberculosis
cgggaacgacggugcg

SEQ ID NO: 915044 - RNA, 14 nt, Mycobacterium avium subsp. paratuberculosis
cgggaacgaucggc

SEQ ID NO: 915045 - RNA, 15 nt, Mycobacterium avium subsp. paratuberculosis
cgggaacgccgauca

SEQ ID NO: 915046 - RNA, 17 nt, Mycobacterium avium subsp. paratuberculosis
cgggaacgccgaucacc

SEQ ID NO: 915047 - RNA, 12 nt, Mycobacterium avium subsp. paratuberculosis
cgggaacagcga

SEQ ID NO: 915048 - RNA, 16 nt, Mycobacterium avium subsp. paratuberculosis
cgggaacagcgacgcc

SEQ ID NO: 915049 - RNA, 14 nt, Mycobacterium avium subsp. paratuberculosis
cgggaacagcgacu

SEQ ID NO: 915050 - RNA, 14 nt, Mycobacterium avium subsp. paratuberculosis
cgggaacagcggga

SEQ ID NO: 915051 - RNA, 16 nt, Mycobacterium avium subsp. paratuberculosis
cgggaacagccaggcg

SEQ ID NO: 915052 - RNA, 17 nt, Mycobacterium avium subsp. paratuberculosis
cgggaacagccaggcga

SEQ ID NO: 915053 - RNA, 22 nt, Mycobacterium avium subsp. paratuberculosis
cgggaacagcccgcccuggcug

SEQ ID NO: 915054 - RNA, 23 nt, Mycobacterium avium subsp. paratuberculosis
cggcuugcgcagguugucggcca

SEQ ID NO: 915055 - RNA, 15 nt, Mycobacterium avium subsp. paratuberculosis
cggcuuggccgugca

SEQ ID NO: 915056 - RNA, 14 nt, Mycobacterium avium subsp. paratuberculosis
cggcuuggcgguga

SEQ ID NO: 915057 - RNA, 16 nt, Mycobacterium avium subsp. paratuberculosis
cgggaccgggcccggc

SEQ ID NO: 915058 - RNA, 20 nt, Mycobacterium avium subsp. paratuberculosis
cgggaccgggcccggcgcca

SEQ ID NO: 915059 - RNA, 19 nt, Mycobacterium avium subsp. paratuberculosis
cgggaccgucaccguggcg

SEQ ID NO: 915060 - RNA, 13 nt, Mycobacterium avium subsp. paratuberculosis
cgggaccgaugcc

SEQ ID NO: 915061 - RNA, 18 nt, Mycobacterium avium subsp. paratuberculosis
cgggaccgaugccgcuga

SEQ ID NO: 915062 - RNA, 15 nt, Mycobacterium avium subsp. paratuberculosis
cgggaccugcugcuc

SEQ ID NO: 915063 - RNA, 23 nt, Mycobacterium avium subsp. paratuberculosis
cgggaccugcugcucgucgcggg

SEQ ID NO: 915064 - RNA, 22 nt, Mycobacterium avium subsp. paratuberculosis
cgggaccugggucugcggccgg

SEQ ID NO: 915065 - RNA, 13 nt, Mycobacterium avium subsp. paratuberculosis
cgggacaucgucg

SEQ ID NO: 915066 - RNA, 14 nt, Mycobacterium avium subsp. paratuberculosis
cgggacaucgucgc

SEQ ID NO: 915067 - RNA, 17 nt, Mycobacterium avium subsp. paratuberculosis
cgggacaucgucgcgcc

SEQ ID NO: 915068 - RNA, 23 nt, Mycobacterium avium subsp. paratuberculosis
cgggacaucgucgcgcccaggaa

SEQ ID NO: 915069 - RNA, 15 nt, Mycobacterium avium subsp. paratuberculosis
cgggaccacccgcag

SEQ ID NO: 915070 - RNA, 16 nt, Mycobacterium avium subsp. paratuberculosis
cgggaccacccgcagc

SEQ ID NO: 915071 - RNA, 17 nt, Mycobacterium avium subsp. paratuberculosis
cgggaccacccgcagcg

SEQ ID NO: 915072 - RNA, 20 nt, Mycobacterium avium subsp. paratuberculosis
cgggaccacccgcagcgcgg

SEQ ID NO: 915073 - RNA, 13 nt, Mycobacterium avium subsp. paratuberculosis
cgggaccagcgcc

SEQ ID NO: 915074 - RNA, 20 nt, Mycobacterium avium subsp. paratuberculosis
cgggaccagcgccucggccu

SEQ ID NO: 915075 - RNA, 14 nt, Mycobacterium avium subsp. paratuberculosis
cgggaccagcgcgg

SEQ ID NO: 915076 - RNA, 16 nt, Mycobacterium avium subsp. paratuberculosis
cgggaauggccgcgcc

SEQ ID NO: 915077 - RNA, 17 nt, Mycobacterium avium subsp. paratuberculosis
cgggaaugucgcgcagc

SEQ ID NO: 915078 - RNA, 20 nt, Mycobacterium avium subsp. paratuberculosis
cgggaaugucgcgcagcauc

SEQ ID NO: 915079 - RNA, 17 nt, Mycobacterium avium subsp. paratuberculosis
cgggaagagcggcguga

SEQ ID NO: 915080 - RNA, 18 nt, Mycobacterium avium subsp. paratuberculosis
cgggacaccgcuggccga

SEQ ID NO: 915081 - RNA, 12 nt, Mycobacterium avium subsp. paratuberculosis
cgggacacggcg

SEQ ID NO: 915082 - RNA, 15 nt, Mycobacterium avium subsp. paratuberculosis
cgggacacggcggcg

SEQ ID NO: 915083 - RNA, 17 nt, Mycobacterium avium subsp. paratuberculosis
cgggacacggcggcgcg

SEQ ID NO: 915084 - RNA, 20 nt, Mycobacterium avium subsp. paratuberculosis
cgggacacggcggcgcgggc

SEQ ID NO: 915085 - RNA, 21 nt, Mycobacterium avium subsp. paratuberculosis
cgggacacggcggcgcgggcg

SEQ ID NO: 915086 - RNA, 13 nt, Mycobacterium avium subsp. paratuberculosis
cgggacagcccga

SEQ ID NO: 915087 - RNA, 16 nt, Mycobacterium avium subsp. paratuberculosis
cgggacagccgcgccg

SEQ ID NO: 915088 - RNA, 18 nt, Mycobacterium avium subsp. paratuberculosis
cgggacagccgcgccgac

SEQ ID NO: 915089 - RNA, 19 nt, Mycobacterium avium subsp. paratuberculosis
cgggacagccgcgccgaca

SEQ ID NO: 915090 - RNA, 20 nt, Mycobacterium avium subsp. paratuberculosis
cgggacagccgcgccgacag

SEQ ID NO: 915091 - RNA, 16 nt, Mycobacterium avium subsp. paratuberculosis
cggcugacugccggcg

SEQ ID NO: 915092 - RNA, 19 nt, Mycobacterium avium subsp. paratuberculosis
cggcugacugccggcgacg

SEQ ID NO: 915093 - RNA, 15 nt, Mycobacterium avium subsp. paratuberculosis
cggcucgggcggugg

SEQ ID NO: 915094 - RNA, 20 nt, Mycobacterium avium subsp. paratuberculosis
cggcucgggcgguggcgccg

SEQ ID NO: 915095 - RNA, 17 nt, Mycobacterium avium subsp. paratuberculosis
cggcucgggggccgcuc

SEQ ID NO: 915096 - RNA, 19 nt, Mycobacterium avium subsp. paratuberculosis
cggcucgggggccgcucca

SEQ ID NO: 915097 - RNA, 16 nt, Mycobacterium avium subsp. paratuberculosis
cggcucgggggugucg

SEQ ID NO: 915098 - RNA, 21 nt, Mycobacterium avium subsp. paratuberculosis
cggcucggcgccccacgccug

SEQ ID NO: 915099 - RNA, 13 nt, Mycobacterium avium subsp. paratuberculosis
cggcucggcgcug

SEQ ID NO: 915100 - RNA, 14 nt, Mycobacterium avium subsp. paratuberculosis
cggcucggcggcgu

SEQ ID NO: 915101 - RNA, 17 nt, Mycobacterium avium subsp. paratuberculosis
cggcucggcggcgucgu

SEQ ID NO: 915102 - RNA, 13 nt, Mycobacterium avium subsp. paratuberculosis
cggcucggcggcu

SEQ ID NO: 915103 - RNA, 18 nt, Mycobacterium avium subsp. paratuberculosis
cggcugagcagccagucg

SEQ ID NO: 915104 - RNA, 23 nt, Mycobacterium avium subsp. paratuberculosis
cggcugagcagcucgcggauccg

SEQ ID NO: 915105 - RNA, 13 nt, Mycobacterium avium subsp. paratuberculosis
cggcugagcgucg

SEQ ID NO: 915106 - RNA, 14 nt, Mycobacterium avium subsp. paratuberculosis
cggcugagcgucgg

SEQ ID NO: 915107 - RNA, 20 nt, Mycobacterium avium subsp. paratuberculosis
cggcuucgggaucagcggga

SEQ ID NO: 915108 - RNA, 17 nt, Mycobacterium avium subsp. paratuberculosis
cggcuugaccggcucgc

SEQ ID NO: 915109 - RNA, 20 nt, Mycobacterium avium subsp. paratuberculosis
cggcuugaccggcucgccgg

SEQ ID NO: 915110 - RNA, 17 nt, Mycobacterium avium subsp. paratuberculosis
cggcuugacuucgucgg

SEQ ID NO: 915111 - RNA, 15 nt, Mycobacterium avium subsp. paratuberculosis
cggcuugagccggau

SEQ ID NO: 915112 - RNA, 17 nt, Mycobacterium avium subsp. paratuberculosis
cggcuugagccggaucg

SEQ ID NO: 915113 - RNA, 14 nt, Mycobacterium avium subsp. paratuberculosis
cggcuugagcgcca

SEQ ID NO: 915114 - RNA, 17 nt, Mycobacterium avium subsp. paratuberculosis
cggcuugagcgccagcg

SEQ ID NO: 915115 - RNA, 20 nt, Mycobacterium avium subsp. paratuberculosis
cggcuucguaacacccucgg

SEQ ID NO: 915116 - RNA, 17 nt, Mycobacterium avium subsp. paratuberculosis
cggcuucguacggcccg

SEQ ID NO: 915117 - RNA, 14 nt, Mycobacterium avium subsp. paratuberculosis
cggcuucucggcgu

SEQ ID NO: 915118 - RNA, 16 nt, Mycobacterium avium subsp. paratuberculosis
cggcuuggccaccacc

SEQ ID NO: 915119 - RNA, 17 nt, Mycobacterium avium subsp. paratuberculosis
cggcuuggccacgauga

SEQ ID NO: 915120 - RNA, 17 nt, Mycobacterium avium subsp. paratuberculosis
cggcuugcgcucggccg

SEQ ID NO: 915121 - RNA, 18 nt, Mycobacterium avium subsp. paratuberculosis
cggcuugcgcucggccgg

SEQ ID NO: 915122 - RNA, 17 nt, Mycobacterium avium subsp. paratuberculosis
cggcuugcgucgcuguc

SEQ ID NO: 915123 - RNA, 15 nt, Mycobacterium avium subsp. paratuberculosis
cggcuugccccgguc

SEQ ID NO: 915124 - RNA, 17 nt, Mycobacterium avium subsp. paratuberculosis
cggcuugccgccgcagc

SEQ ID NO: 915125 - RNA, 24 nt, Mycobacterium avium subsp. paratuberculosis
cggcuugccgccgcagcgcagcgu

SEQ ID NO: 915126 - RNA, 15 nt, Mycobacterium avium subsp. paratuberculosis
cggaaaaccccaccc

SEQ ID NO: 915127 - RNA, 21 nt, Mycobacterium avium subsp. paratuberculosis
cggaaaaagcguugcgccagc

SEQ ID NO: 915128 - RNA, 15 nt, Mycobacterium avium subsp. paratuberculosis
cggaaagcgcgggca

SEQ ID NO: 915129 - RNA, 19 nt, Mycobacterium avium subsp. paratuberculosis
cggaaacgacgucgccacc

SEQ ID NO: 915130 - RNA, 22 nt, Mycobacterium avium subsp. paratuberculosis
cggaacagcgucgccgacgggc

SEQ ID NO: 915131 - RNA, 14 nt, Mycobacterium avium subsp. paratuberculosis
cggaacagcugguc

SEQ ID NO: 915132 - RNA, 15 nt, Mycobacterium avium subsp. paratuberculosis
cggaacagcuggucc

SEQ ID NO: 915133 - RNA, 22 nt, Mycobacterium avium subsp. paratuberculosis
cggaacagcuuggcgcagccgg

SEQ ID NO: 915134 - RNA, 18 nt, Mycobacterium avium subsp. paratuberculosis
cggaacccacgugcggcg

SEQ ID NO: 915135 - RNA, 19 nt, Mycobacterium avium subsp. paratuberculosis
cggaacccacgugcggcgc

SEQ ID NO: 915136 - RNA, 15 nt, Mycobacterium avium subsp. paratuberculosis
cggaacccggguggc

SEQ ID NO: 915137 - RNA, 23 nt, Mycobacterium avium subsp. paratuberculosis
cggaaccgcgccuucgacccggu

SEQ ID NO: 915138 - RNA, 13 nt, Mycobacterium avium subsp. paratuberculosis
cggaaccggccgg

SEQ ID NO: 915139 - RNA, 23 nt, Mycobacterium avium subsp. paratuberculosis
cggaaaucgccuguccgaccagc

SEQ ID NO: 915140 - RNA, 16 nt, Mycobacterium avium subsp. paratuberculosis
cggaacagccggcuca

SEQ ID NO: 915141 - RNA, 16 nt, Mycobacterium avium subsp. paratuberculosis
cggaaguucucgccgu

SEQ ID NO: 915142 - RNA, 17 nt, Mycobacterium avium subsp. paratuberculosis
cggaaguucucgccgug

SEQ ID NO: 915143 - RNA, 15 nt, Mycobacterium avium subsp. paratuberculosis
cggaauacagcagcu

SEQ ID NO: 915144 - RNA, 17 nt, Mycobacterium avium subsp. paratuberculosis
cggaaggucuuucgucg

SEQ ID NO: 915145 - RNA, 15 nt, Mycobacterium avium subsp. paratuberculosis
cggaaguagcccgga

SEQ ID NO: 915146 - RNA, 18 nt, Mycobacterium avium subsp. paratuberculosis
cggaaggcccccggcucg

SEQ ID NO: 915147 - RNA, 13 nt, Mycobacterium avium subsp. paratuberculosis
cggaagcgggguu

SEQ ID NO: 915148 - RNA, 13 nt, Mycobacterium avium subsp. paratuberculosis
cggaagcgguuga

SEQ ID NO: 915149 - RNA, 15 nt, Mycobacterium avium subsp. paratuberculosis
cggaagcucaucgag

SEQ ID NO: 915150 - RNA, 14 nt, Mycobacterium avium subsp. paratuberculosis
cggaaggccgcgcg

SEQ ID NO: 915151 - RNA, 17 nt, Mycobacterium avium subsp. paratuberculosis
cggaagcgcgcaucgcg

SEQ ID NO: 915152 - RNA, 22 nt, Mycobacterium avium subsp. paratuberculosis
cggaagcccuugcagcacaccg

SEQ ID NO: 915153 - RNA, 18 nt, Mycobacterium avium subsp. paratuberculosis
cggaagccgagcggucca

SEQ ID NO: 915154 - RNA, 15 nt, Mycobacterium avium subsp. paratuberculosis
cggaagaucagcagg

SEQ ID NO: 915155 - RNA, 18 nt, Mycobacterium avium subsp. paratuberculosis
cggaagaucagcaggcug

SEQ ID NO: 915156 - RNA, 15 nt, Mycobacterium avium subsp. paratuberculosis
cggaagccgucggug

SEQ ID NO: 915157 - RNA, 15 nt, Mycobacterium avium subsp. paratuberculosis
cggaacgcccgaucu

SEQ ID NO: 915158 - RNA, 20 nt, Mycobacterium avium subsp. paratuberculosis
cggaaccguugcagcacagc

SEQ ID NO: 915159 - RNA, 23 nt, Mycobacterium avium subsp. paratuberculosis
cggaaccguugcagcacagcggg

SEQ ID NO: 915160 - RNA, 15 nt, Mycobacterium avium subsp. paratuberculosis
cggaacggucggggc

SEQ ID NO: 915161 - RNA, 20 nt, Mycobacterium avium subsp. paratuberculosis
cggaacggucggggcggcgg

SEQ ID NO: 915162 - RNA, 23 nt, Mycobacterium avium subsp. paratuberculosis
cggaacgcgccgggcaacagcgc

SEQ ID NO: 915163 - RNA, 13 nt, Mycobacterium avium subsp. paratuberculosis
cggaacgcgucgc

SEQ ID NO: 915164 - RNA, 21 nt, Mycobacterium avium subsp. paratuberculosis
cggaacgggucgaucucggcg

SEQ ID NO: 915165 - RNA, 13 nt, Mycobacterium avium subsp. paratuberculosis
cggaacucggccg

SEQ ID NO: 915166 - RNA, 14 nt, Mycobacterium avium subsp. paratuberculosis
cggaacucggccgg

SEQ ID NO: 915167 - RNA, 17 nt, Mycobacterium avium subsp. paratuberculosis
cggaacucggccggcac

SEQ ID NO: 915168 - RNA, 14 nt, Mycobacterium avium subsp. paratuberculosis
cgcuuucggugacc

SEQ ID NO: 915169 - RNA, 20 nt, Mycobacterium avium subsp. paratuberculosis
cgcuuucgucgaccgucacg

SEQ ID NO: 915170 - RNA, 19 nt, Mycobacterium avium subsp. paratuberculosis
cgcuuucgaagugacgccg

SEQ ID NO: 915171 - RNA, 14 nt, Mycobacterium avium subsp. paratuberculosis
cgcuuucgccgggc

SEQ ID NO: 915172 - RNA, 22 nt, Mycobacterium avium subsp. paratuberculosis
cgcuuuccaaccaggcgcucgu

SEQ ID NO: 915173 - RNA, 22 nt, Mycobacterium avium subsp. paratuberculosis
cgcuugucggcguggccguccg

SEQ ID NO: 915174 - RNA, 18 nt, Mycobacterium avium subsp. paratuberculosis
cgcuugugccggaagcgg

SEQ ID NO: 915175 - RNA, 18 nt, Mycobacterium avium subsp. paratuberculosis
cgcuugucagcggccucg

SEQ ID NO: 915176 - RNA, 15 nt, Mycobacterium avium subsp. paratuberculosis
cgcuuggccgggcgg

SEQ ID NO: 915177 - RNA, 18 nt, Mycobacterium avium subsp. paratuberculosis
cgcuuggcgcgccgcacc

SEQ ID NO: 915178 - RNA, 18 nt, Mycobacterium avium subsp. paratuberculosis
cgcuuggcggagagcggu

SEQ ID NO: 915179 - RNA, 21 nt, Mycobacterium avium subsp. paratuberculosis
cgcuugggguuuggcgacguc

SEQ ID NO: 915180 - RNA, 15 nt, Mycobacterium avium subsp. paratuberculosis
cgcuugggucgccgg

SEQ ID NO: 915181 - RNA, 16 nt, Mycobacterium avium subsp. paratuberculosis
cgcuugggucgccggg

SEQ ID NO: 915182 - RNA, 17 nt, Mycobacterium avium subsp. paratuberculosis
cgcuugggucgccgggu

SEQ ID NO: 915183 - RNA, 16 nt, Mycobacterium avium subsp. paratuberculosis
cgcuuuccaccucgag

SEQ ID NO: 915184 - RNA, 13 nt, Mycobacterium avium subsp. paratuberculosis
cgcuugacgccgc

SEQ ID NO: 915185 - RNA, 15 nt, Mycobacterium avium subsp. paratuberculosis
cgcuugacgccgccg

SEQ ID NO: 915186 - RNA, 13 nt, Mycobacterium avium subsp. paratuberculosis
cgcuucugcgccg

SEQ ID NO: 915187 - RNA, 14 nt, Mycobacterium avium subsp. paratuberculosis
cgcuucugcgccgg

SEQ ID NO: 915188 - RNA, 19 nt, Mycobacterium avium subsp. paratuberculosis
cgcuucgggagcaaggucg

SEQ ID NO: 915189 - RNA, 23 nt, Mycobacterium avium subsp. paratuberculosis
cgcuucgggugcgggugcggccg

SEQ ID NO: 915190 - RNA, 16 nt, Mycobacterium avium subsp. paratuberculosis
cgcuugcgaccgccgc

SEQ ID NO: 915191 - RNA, 19 nt, Mycobacterium avium subsp. paratuberculosis
cgcuugcguucccagcccg

SEQ ID NO: 915192 - RNA, 16 nt, Mycobacterium avium subsp. paratuberculosis
cgcuugcgcucggucg

SEQ ID NO: 915193 - RNA, 18 nt, Mycobacterium avium subsp. paratuberculosis
cgcuugcgcagcgucgug

SEQ ID NO: 915194 - RNA, 15 nt, Mycobacterium avium subsp. paratuberculosis
cgcuugcgccgcagc

SEQ ID NO: 915195 - RNA, 18 nt, Mycobacterium avium subsp. paratuberculosis
cgcuugcgccgcagcggu

SEQ ID NO: 915196 - RNA, 14 nt, Mycobacterium avium subsp. paratuberculosis
cgcuugccagccgg

SEQ ID NO: 915197 - RNA, 16 nt, Mycobacterium avium subsp. paratuberculosis
cgcuugccagccgggc

SEQ ID NO: 915198 - RNA, 18 nt, Mycobacterium avium subsp. paratuberculosis
cgcuugccagccgggccg

SEQ ID NO: 915199 - RNA, 17 nt, Mycobacterium avium subsp. paratuberculosis
cgcuugcccagccccuu

SEQ ID NO: 915200 - RNA, 16 nt, Mycobacterium avium subsp. paratuberculosis
cgcuugcagcuuggcg

SEQ ID NO: 915201 - RNA, 15 nt, Mycobacterium avium subsp. paratuberculosis
cgcuugauggcggcg

SEQ ID NO: 915202 - RNA, 20 nt, Mycobacterium avium subsp. paratuberculosis
cgcuugccgcgacccgggcc

SEQ ID NO: 915203 - RNA, 21 nt, Mycobacterium avium subsp. paratuberculosis
cgcuugccgcgacccgggccg

SEQ ID NO: 915204 - RNA, 22 nt, Mycobacterium avium subsp. paratuberculosis
cgcuguugcccaauucgacugc

SEQ ID NO: 915205 - RNA, 14 nt, Mycobacterium avium subsp. paratuberculosis
cgcuguuggcgacg

SEQ ID NO: 915206 - RNA, 17 nt, Mycobacterium avium subsp. paratuberculosis
cgcuguuggcgacggug

SEQ ID NO: 915207 - RNA, 16 nt, Mycobacterium avium subsp. paratuberculosis
cgcuuacugcgaggcg

SEQ ID NO: 915208 - RNA, 13 nt, Mycobacterium avium subsp. paratuberculosis
cgcugucggugug

SEQ ID NO: 915209 - RNA, 15 nt, Mycobacterium avium subsp. paratuberculosis
cgcugugauagcggc

SEQ ID NO: 915210 - RNA, 20 nt, Mycobacterium avium subsp. paratuberculosis
cgcugugaugggugagcggg

SEQ ID NO: 915211 - RNA, 22 nt, Mycobacterium avium subsp. paratuberculosis
cgcugugaugggugagcgggaa

SEQ ID NO: 915212 - RNA, 19 nt, Mycobacterium avium subsp. paratuberculosis
cgcugugcgaacuccggug

SEQ ID NO: 915213 - RNA, 24 nt, Mycobacterium avium subsp. paratuberculosis
cgcugugcgccauguccggcaggc

SEQ ID NO: 915214 - RNA, 15 nt, Mycobacterium avium subsp. paratuberculosis
cgcugugcgccuugc

SEQ ID NO: 915215 - RNA, 17 nt, Mycobacterium avium subsp. paratuberculosis
cgcugugcgccuugccg

SEQ ID NO: 915216 - RNA, 16 nt, Mycobacterium avium subsp. paratuberculosis
cgcugugcggcccggc

SEQ ID NO: 915217 - RNA, 13 nt, Mycobacterium avium subsp. paratuberculosis
cgcugugcucgac

SEQ ID NO: 915218 - RNA, 14 nt, Mycobacterium avium subsp. paratuberculosis
cgcugugcucgacg

SEQ ID NO: 915219 - RNA, 18 nt, Mycobacterium avium subsp. paratuberculosis
cgcugugcucgacgaaga

SEQ ID NO: 915220 - RNA, 19 nt, Mycobacterium avium subsp. paratuberculosis
cgcuguuggaaccggccac

SEQ ID NO: 915221 - RNA, 22 nt, Mycobacterium avium subsp. paratuberculosis
cgcugugguccucgucaccgug

SEQ ID NO: 915222 - RNA, 17 nt, Mycobacterium avium subsp. paratuberculosis
cgcuguuagccucgcca

SEQ ID NO: 915223 - RNA, 15 nt, Mycobacterium avium subsp. paratuberculosis
cgcuucaggcagcgc

SEQ ID NO: 915224 - RNA, 19 nt, Mycobacterium avium subsp. paratuberculosis
cgcuucccacagucgcugg

SEQ ID NO: 915225 - RNA, 19 nt, Mycobacterium avium subsp. paratuberculosis
cgcuuccagcgcggcgauc

SEQ ID NO: 915226 - RNA, 14 nt, Mycobacterium avium subsp. paratuberculosis
cgcuuccagcacca

SEQ ID NO: 915227 - RNA, 16 nt, Mycobacterium avium subsp. paratuberculosis
cgcuucgcccggcugc

SEQ ID NO: 915228 - RNA, 13 nt, Mycobacterium avium subsp. paratuberculosis
cgcuucgcgcugu

SEQ ID NO: 915229 - RNA, 12 nt, Mycobacterium avium subsp. paratuberculosis
cgcuucggcucg

SEQ ID NO: 915230 - RNA, 14 nt, Mycobacterium avium subsp. paratuberculosis
cgcuucggcucggg

SEQ ID NO: 915231 - RNA, 18 nt, Mycobacterium avium subsp. paratuberculosis
cgcuucggcucggggucg

SEQ ID NO: 915232 - RNA, 20 nt, Mycobacterium avium subsp. paratuberculosis
cgcuucggccagcgcgucgg

SEQ ID NO: 915233 - RNA, 23 nt, Mycobacterium avium subsp. paratuberculosis
cgcuggcggggcgugcccggcgc

SEQ ID NO: 915234 - RNA, 15 nt, Mycobacterium avium subsp. paratuberculosis
cgcuggcggcgcggu

SEQ ID NO: 915235 - RNA, 17 nt, Mycobacterium avium subsp. paratuberculosis
cgcuggcguccaggucg

SEQ ID NO: 915236 - RNA, 12 nt, Mycobacterium avium subsp. paratuberculosis
cgcuggcggugu

SEQ ID NO: 915237 - RNA, 13 nt, Mycobacterium avium subsp. paratuberculosis
cgcuggcgugacg

SEQ ID NO: 915238 - RNA, 14 nt, Mycobacterium avium subsp. paratuberculosis
cgcuggcgugacgc

SEQ ID NO: 915239 - RNA, 18 nt, Mycobacterium avium subsp. paratuberculosis
cgcuggcgugacgcucgg

SEQ ID NO: 915240 - RNA, 21 nt, Mycobacterium avium subsp. paratuberculosis
cgcuggcgugacgcucggccg

SEQ ID NO: 915241 - RNA, 20 nt, Mycobacterium avium subsp. paratuberculosis
cgcuggcgugacgcucggcg

SEQ ID NO: 915242 - RNA, 23 nt, Mycobacterium avium subsp. paratuberculosis
cgcuggcgugacgcucggcgccg

SEQ ID NO: 915243 - RNA, 24 nt, Mycobacterium avium subsp. paratuberculosis
cgcuggcgugacgcucggcgccgg

SEQ ID NO: 915244 - RNA, 19 nt, Mycobacterium avium subsp. paratuberculosis
cgcuggcgugacgcucggg

SEQ ID NO: 915245 - RNA, 18 nt, Mycobacterium avium subsp. paratuberculosis
cgcuggcgugacggucga

SEQ ID NO: 915246 - RNA, 21 nt, Mycobacterium avium subsp. paratuberculosis
cgcuggcgugacggucgaccu

SEQ ID NO: 915247 - RNA, 20 nt, Mycobacterium avium subsp. paratuberculosis
cgcuggcgugacguucguca

SEQ ID NO: 915248 - RNA, 15 nt, Mycobacterium avium subsp. paratuberculosis
cgcuggcguggcacc

SEQ ID NO: 915249 - RNA, 22 nt, Mycobacterium avium subsp. paratuberculosis
cgcuggcguggcacccgggcgc

SEQ ID NO: 915250 - RNA, 14 nt, Mycobacterium avium subsp. paratuberculosis
cgcuggcguggcgc

SEQ ID NO: 915251 - RNA, 16 nt, Mycobacterium avium subsp. paratuberculosis
cgcuggcguggcgccg

SEQ ID NO: 915252 - RNA, 20 nt, Mycobacterium avium subsp. paratuberculosis
cgcuggcguggcgccggcgc

SEQ ID NO: 915253 - RNA, 14 nt, Mycobacterium avium subsp. paratuberculosis
cgcuggcguggcuc

SEQ ID NO: 915254 - RNA, 18 nt, Mycobacterium avium subsp. paratuberculosis
cgcuggcguggcucggcc

SEQ ID NO: 915255 - RNA, 15 nt, Mycobacterium avium subsp. paratuberculosis
cgcuggcggccagcg

SEQ ID NO: 915256 - RNA, 21 nt, Mycobacterium avium subsp. paratuberculosis
cgcuggcggccaucgccgcgg

SEQ ID NO: 915257 - RNA, 22 nt, Mycobacterium avium subsp. paratuberculosis
cgcuggcggccaucgccgcggu

SEQ ID NO: 915258 - RNA, 15 nt, Mycobacterium avium subsp. paratuberculosis
cgcuggcgccggcgu

SEQ ID NO: 915259 - RNA, 16 nt, Mycobacterium avium subsp. paratuberculosis
cgcuggcgccggcguc

SEQ ID NO: 915260 - RNA, 15 nt, Mycobacterium avium subsp. paratuberculosis
cgcugcgccggcggu

SEQ ID NO: 915261 - RNA, 12 nt, Mycobacterium avium subsp. paratuberculosis
cgcugcgccggc

SEQ ID NO: 915262 - RNA, 17 nt, Mycobacterium avium subsp. paratuberculosis
cgcugcgccggcgcggc

SEQ ID NO: 915263 - RNA, 18 nt, Mycobacterium avium subsp. paratuberculosis
cgcugcgccggcgcggcc

SEQ ID NO: 915264 - RNA, 13 nt, Mycobacterium avium subsp. paratuberculosis
cgcugcgcccggu

SEQ ID NO: 915265 - RNA, 16 nt, Mycobacterium avium subsp. paratuberculosis
cgcugcgcccggucag

SEQ ID NO: 915266 - RNA, 21 nt, Mycobacterium avium subsp. paratuberculosis
cgcugcgccgacuugaucgcg

SEQ ID NO: 915267 - RNA, 23 nt, Mycobacterium avium subsp. paratuberculosis
cgcugcgccgacuugaucgcggc

SEQ ID NO: 915268 - RNA, 13 nt, Mycobacterium avium subsp. paratuberculosis
cgcugcgcccagc

SEQ ID NO: 915269 - RNA, 19 nt, Mycobacterium avium subsp. paratuberculosis
cgcugcgcccagcgcgcga

SEQ ID NO: 915270 - RNA, 15 nt, Mycobacterium avium subsp. paratuberculosis
cgcugcgcccgccgc

SEQ ID NO: 915271 - RNA, 16 nt, Mycobacterium avium subsp. paratuberculosis
cgcugcgcccgccgcc

SEQ ID NO: 915272 - RNA, 15 nt, Mycobacterium avium subsp. paratuberculosis
cgcugcgagcccggc

SEQ ID NO: 915273 - RNA, 12 nt, Mycobacterium avium subsp. paratuberculosis
cgcugcgcaccc

SEQ ID NO: 915274 - RNA, 15 nt, Mycobacterium avium subsp. paratuberculosis
cgcugcgcacccggu

SEQ ID NO: 915275 - RNA, 16 nt, Mycobacterium avium subsp. paratuberculosis
cgcugcgcacccgguc

SEQ ID NO: 915276 - RNA, 21 nt, Mycobacterium avium subsp. paratuberculosis
cgcugcgcacccgguccggcu

SEQ ID NO: 915277 - RNA, 15 nt, Mycobacterium avium subsp. paratuberculosis
cgcugccggggcgca

SEQ ID NO: 915278 - RNA, 21 nt, Mycobacterium avium subsp. paratuberculosis
cgcugccggggugcagcacca

SEQ ID NO: 915279 - RNA, 21 nt, Mycobacterium avium subsp. paratuberculosis
cgcugccgcgccccgagcagc

SEQ ID NO: 915280 - RNA, 14 nt, Mycobacterium avium subsp. paratuberculosis
cgcugccgcuggcg

SEQ ID NO: 915281 - RNA, 16 nt, Mycobacterium avium subsp. paratuberculosis
cgcugccgcuggcguc

SEQ ID NO: 915282 - RNA, 20 nt, Mycobacterium avium subsp. paratuberculosis
cgcugccgcuggcgucgauc

SEQ ID NO: 915283 - RNA, 20 nt, Mycobacterium avium subsp. paratuberculosis
cgcugguaguggcgugcggc

SEQ ID NO: 915284 - RNA, 19 nt, Mycobacterium avium subsp. paratuberculosis
cgcuggggugcccaccagc

SEQ ID NO: 915285 - RNA, 21 nt, Mycobacterium avium subsp. paratuberculosis
cgcuggucaacucgacccgca

SEQ ID NO: 915286 - RNA, 22 nt, Mycobacterium avium subsp. paratuberculosis
cgcuggucaacucgacccgcac

SEQ ID NO: 915287 - RNA, 23 nt, Mycobacterium avium subsp. paratuberculosis
cgcuggucaacucgacccgcacc

SEQ ID NO: 915288 - RNA, 14 nt, Mycobacterium avium subsp. paratuberculosis
cgcuggucaggccg

SEQ ID NO: 915289 - RNA, 18 nt, Mycobacterium avium subsp. paratuberculosis
cgcuggucgaaccgcgag

SEQ ID NO: 915290 - RNA, 21 nt, Mycobacterium avium subsp. paratuberculosis
cgcuggucgaaccgcgagcgc

SEQ ID NO: 915291 - RNA, 13 nt, Mycobacterium avium subsp. paratuberculosis
cgcuggucgaacg

SEQ ID NO: 915292 - RNA, 14 nt, Mycobacterium avium subsp. paratuberculosis
cgcuggucgaacgc

SEQ ID NO: 915293 - RNA, 22 nt, Mycobacterium avium subsp. paratuberculosis
cgcugggugaacaccccgcggg

SEQ ID NO: 915294 - RNA, 14 nt, Mycobacterium avium subsp. paratuberculosis
cgcugggugcgggc

SEQ ID NO: 915295 - RNA, 23 nt, Mycobacterium avium subsp. paratuberculosis
cgcugggugcgggcugcaccagg

SEQ ID NO: 915296 - RNA, 15 nt, Mycobacterium avium subsp. paratuberculosis
cgcuggggcccagcu

SEQ ID NO: 915297 - RNA, 14 nt, Mycobacterium avium subsp. paratuberculosis
cgcuggggcgcacc

SEQ ID NO: 915298 - RNA, 14 nt, Mycobacterium avium subsp. paratuberculosis
cgcuggcguagauc

SEQ ID NO: 915299 - RNA, 20 nt, Mycobacterium avium subsp. paratuberculosis
cgcuggcguagaucugcacg

SEQ ID NO: 915300 - RNA, 18 nt, Mycobacterium avium subsp. paratuberculosis
cgcuggcguugagcacgc

SEQ ID NO: 915301 - RNA, 19 nt, Mycobacterium avium subsp. paratuberculosis
cgcuggcguugagcacgcg

SEQ ID NO: 915302 - RNA, 15 nt, Mycobacterium avium subsp. paratuberculosis
cgcugucgcgggccc

SEQ ID NO: 915303 - RNA, 18 nt, Mycobacterium avium subsp. paratuberculosis
cgcugucgcgggcccgcg

SEQ ID NO: 915304 - RNA, 19 nt, Mycobacterium avium subsp. paratuberculosis
cgcugucgauggacaaggu

SEQ ID NO: 915305 - RNA, 21 nt, Mycobacterium avium subsp. paratuberculosis
cgcugucggcggggaaggugc

SEQ ID NO: 915306 - RNA, 12 nt, Mycobacterium avium subsp. paratuberculosis
cgcuguccacgu

SEQ ID NO: 915307 - RNA, 19 nt, Mycobacterium avium subsp. paratuberculosis
cgcuguccucgagcgcguc

SEQ ID NO: 915308 - RNA, 21 nt, Mycobacterium avium subsp. paratuberculosis
cgcuguccucgagcgcgucga

SEQ ID NO: 915309 - RNA, 23 nt, Mycobacterium avium subsp. paratuberculosis
cgcuguccucgucggaggcgucg

SEQ ID NO: 915310 - RNA, 20 nt, Mycobacterium avium subsp. paratuberculosis
cgcuguccugccgggcgucg

SEQ ID NO: 915311 - RNA, 22 nt, Mycobacterium avium subsp. paratuberculosis
cgcuguccugccgggcgucgac

SEQ ID NO: 915312 - RNA, 15 nt, Mycobacterium avium subsp. paratuberculosis
cgcugucaauccccg

SEQ ID NO: 915313 - RNA, 20 nt, Mycobacterium avium subsp. paratuberculosis
cgcugucaauccccgcgguu

SEQ ID NO: 915314 - RNA, 17 nt, Mycobacterium avium subsp. paratuberculosis
cgcuaaucgccgcgcgu

SEQ ID NO: 915315 - RNA, 22 nt, Mycobacterium avium subsp. paratuberculosis
cgcuaacucacggcgcgaucca

SEQ ID NO: 915316 - RNA, 21 nt, Mycobacterium avium subsp. paratuberculosis
cgcuaaggccgcugcccggcg

SEQ ID NO: 915317 - RNA, 14 nt, Mycobacterium avium subsp. paratuberculosis
cgcuaaagccacca

SEQ ID NO: 915318 - RNA, 16 nt, Mycobacterium avium subsp. paratuberculosis
cgcuaaagccaccagc

SEQ ID NO: 915319 - RNA, 15 nt, Mycobacterium avium subsp. paratuberculosis
cgcuaaagccgaccg

SEQ ID NO: 915320 - RNA, 18 nt, Mycobacterium avium subsp. paratuberculosis
cgcguugaaagccgcgaa

SEQ ID NO: 915321 - RNA, 20 nt, Mycobacterium avium subsp. paratuberculosis
cgcguugaacgacaucacca

SEQ ID NO: 915322 - RNA, 20 nt, Mycobacterium avium subsp. paratuberculosis
cgcguugaagaacgggcuga

SEQ ID NO: 915323 - RNA, 22 nt, Mycobacterium avium subsp. paratuberculosis
cgcguucuccucgaacaccgca

SEQ ID NO: 915324 - RNA, 16 nt, Mycobacterium avium subsp. paratuberculosis
cgcguucugcaccagc

SEQ ID NO: 915325 - RNA, 19 nt, Mycobacterium avium subsp. paratuberculosis
cgcguucugcaccagcucg

SEQ ID NO: 915326 - RNA, 20 nt, Mycobacterium avium subsp. paratuberculosis
cgcguucgcuuucgccgggc

SEQ ID NO: 915327 - RNA, 21 nt, Mycobacterium avium subsp. paratuberculosis
cgcguucggacaccucggcca

SEQ ID NO: 915328 - RNA, 22 nt, Mycobacterium avium subsp. paratuberculosis
cgcguucggacaccucggccag

SEQ ID NO: 915329 - RNA, 12 nt, Mycobacterium avium subsp. paratuberculosis
cgcguucgaccu

SEQ ID NO: 915330 - RNA, 18 nt, Mycobacterium avium subsp. paratuberculosis
cgcguucccgggcccgcu

SEQ ID NO: 915331 - RNA, 15 nt, Mycobacterium avium subsp. paratuberculosis
cgcguuccgccacgg

SEQ ID NO: 915332 - RNA, 16 nt, Mycobacterium avium subsp. paratuberculosis
cgcguuccgccacggc

SEQ ID NO: 915333 - RNA, 18 nt, Mycobacterium avium subsp. paratuberculosis
cgcguuccgccacggcgg

SEQ ID NO: 915334 - RNA, 19 nt, Mycobacterium avium subsp. paratuberculosis
cgcguuccgccacggcggg

SEQ ID NO: 915335 - RNA, 15 nt, Mycobacterium avium subsp. paratuberculosis
cgcgugggcaccccg

SEQ ID NO: 915336 - RNA, 15 nt, Mycobacterium avium subsp. paratuberculosis
cgcguucgucggcgc

SEQ ID NO: 915337 - RNA, 17 nt, Mycobacterium avium subsp. paratuberculosis
cgcguggggcgucgccg

SEQ ID NO: 915338 - RNA, 20 nt, Mycobacterium avium subsp. paratuberculosis
cgcguggggcgucgccgccc

SEQ ID NO: 915339 - RNA, 17 nt, Mycobacterium avium subsp. paratuberculosis
cgcguucggcgccaccc

SEQ ID NO: 915340 - RNA, 24 nt, Mycobacterium avium subsp. paratuberculosis
cgcguucggcggcgcgcugcaggc

SEQ ID NO: 915341 - RNA, 13 nt, Mycobacterium avium subsp. paratuberculosis
cgcguucgggcag

SEQ ID NO: 915342 - RNA, 16 nt, Mycobacterium avium subsp. paratuberculosis
cgcguucgggcagcgc

SEQ ID NO: 915343 - RNA, 15 nt, Mycobacterium avium subsp. paratuberculosis
cgcguucgggcccgg

SEQ ID NO: 915344 - RNA, 19 nt, Mycobacterium avium subsp. paratuberculosis
cgcguucgggcccggccgc

SEQ ID NO: 915345 - RNA, 21 nt, Mycobacterium avium subsp. paratuberculosis
cgcguucgggcccggccgcca

SEQ ID NO: 915346 - RNA, 16 nt, Mycobacterium avium subsp. paratuberculosis
cgcgugggccaacgcg

SEQ ID NO: 915347 - RNA, 15 nt, Mycobacterium avium subsp. paratuberculosis
cgcguggccucccgg

SEQ ID NO: 915348 - RNA, 14 nt, Mycobacterium avium subsp. paratuberculosis
cgcguggccugggc

SEQ ID NO: 915349 - RNA, 19 nt, Mycobacterium avium subsp. paratuberculosis
cgcguggccugggcgacca

SEQ ID NO: 915350 - RNA, 19 nt, Mycobacterium avium subsp. paratuberculosis
cgcgugcuguugcaggugc

SEQ ID NO: 915351 - RNA, 19 nt, Mycobacterium avium subsp. paratuberculosis
cgcguggccgaggaugggg

SEQ ID NO: 915352 - RNA, 14 nt, Mycobacterium avium subsp. paratuberculosis
cgcgguguacagcg

SEQ ID NO: 915353 - RNA, 15 nt, Mycobacterium avium subsp. paratuberculosis
cgcgguguacagcgc

SEQ ID NO: 915354 - RNA, 19 nt, Mycobacterium avium subsp. paratuberculosis
cgcgguguagucgcugacc

SEQ ID NO: 915355 - RNA, 17 nt, Mycobacterium avium subsp. paratuberculosis
cgcggugucgacgucgg

SEQ ID NO: 915356 - RNA, 20 nt, Mycobacterium avium subsp. paratuberculosis
cgcggugucgacgucggugg

SEQ ID NO: 915357 - RNA, 13 nt, Mycobacterium avium subsp. paratuberculosis
cgcgguggugaua

SEQ ID NO: 915358 - RNA, 20 nt, Mycobacterium avium subsp. paratuberculosis
cgcgguggugggcgcggugg

SEQ ID NO: 915359 - RNA, 21 nt, Mycobacterium avium subsp. paratuberculosis
cgcgguggugggcgcgguggu

SEQ ID NO: 915360 - RNA, 16 nt, Mycobacterium avium subsp. paratuberculosis
cgcgguggguccgccg

SEQ ID NO: 915361 - RNA, 20 nt, Mycobacterium avium subsp. paratuberculosis
cgcgguggguccgccgggcg

SEQ ID NO: 915362 - RNA, 23 nt, Mycobacterium avium subsp. paratuberculosis
cgcgguggucagcaccggcgugg

SEQ ID NO: 915363 - RNA, 21 nt, Mycobacterium avium subsp. paratuberculosis
cgcgguggucagcggcgccac

SEQ ID NO: 915364 - RNA, 23 nt, Mycobacterium avium subsp. paratuberculosis
cgcgguggucagcggcgccaccg

SEQ ID NO: 915365 - RNA, 14 nt, Mycobacterium avium subsp. paratuberculosis
cgcggugucggcgu

SEQ ID NO: 915366 - RNA, 15 nt, Mycobacterium avium subsp. paratuberculosis
cgcggugucggcguc

SEQ ID NO: 915367 - RNA, 16 nt, Mycobacterium avium subsp. paratuberculosis
cgcggugucggcgucg

SEQ ID NO: 915368 - RNA, 18 nt, Mycobacterium avium subsp. paratuberculosis
cgcggugucggcgucgau

SEQ ID NO: 915369 - RNA, 17 nt, Mycobacterium avium subsp. paratuberculosis
cgcggugugcccggcgu

SEQ ID NO: 915370 - RNA, 13 nt, Mycobacterium avium subsp. paratuberculosis
cgcggugugcggc

SEQ ID NO: 915371 - RNA, 16 nt, Mycobacterium avium subsp. paratuberculosis
cgcggugugcggcagc

SEQ ID NO: 915372 - RNA, 15 nt, Mycobacterium avium subsp. paratuberculosis
cgcggugugcggcgg

SEQ ID NO: 915373 - RNA, 19 nt, Mycobacterium avium subsp. paratuberculosis
cgcggugugcggcggcucg

SEQ ID NO: 915374 - RNA, 16 nt, Mycobacterium avium subsp. paratuberculosis
cgcggugugcuggcca

SEQ ID NO: 915375 - RNA, 18 nt, Mycobacterium avium subsp. paratuberculosis
cgcggugugcuggccagc

SEQ ID NO: 915376 - RNA, 18 nt, Mycobacterium avium subsp. paratuberculosis
cgcggugugggcgauggc

SEQ ID NO: 915377 - RNA, 23 nt, Mycobacterium avium subsp. paratuberculosis
cgcggugugggcgauggcggcgu

SEQ ID NO: 915378 - RNA, 19 nt, Mycobacterium avium subsp. paratuberculosis
cgcgguguuggcggcgucg

SEQ ID NO: 915379 - RNA, 16 nt, Mycobacterium avium subsp. paratuberculosis
cgcgguguuuggccgc

SEQ ID NO: 915380 - RNA, 20 nt, Mycobacterium avium subsp. paratuberculosis
cgcgguguuuggccgcgcag

SEQ ID NO: 915381 - RNA, 22 nt, Mycobacterium avium subsp. paratuberculosis
cgcgguguuuggccgcgcagcu

SEQ ID NO: 915382 - RNA, 19 nt, Mycobacterium avium subsp. paratuberculosis
cgcgguuccggcgugcagc

SEQ ID NO: 915383 - RNA, 20 nt, Mycobacterium avium subsp. paratuberculosis
cgcgguucgaggugcucgcg

SEQ ID NO: 915384 - RNA, 15 nt, Mycobacterium avium subsp. paratuberculosis
cgcgguucgaucucc

SEQ ID NO: 915385 - RNA, 21 nt, Mycobacterium avium subsp. paratuberculosis
cgcgguucgaucuccucggcg

SEQ ID NO: 915386 - RNA, 22 nt, Mycobacterium avium subsp. paratuberculosis
cgcgguucgaucuccucggcgu

SEQ ID NO: 915387 - RNA, 21 nt, Mycobacterium avium subsp. paratuberculosis
cgcgugcuggggguggcgucg

SEQ ID NO: 915388 - RNA, 21 nt, Mycobacterium avium subsp. paratuberculosis
cgcguggcaauucgaccgucu

SEQ ID NO: 915389 - RNA, 14 nt, Mycobacterium avium subsp. paratuberculosis
cgcgugcgcgacga

SEQ ID NO: 915390 - RNA, 17 nt, Mycobacterium avium subsp. paratuberculosis
cgcgugcgagccgagca

SEQ ID NO: 915391 - RNA, 12 nt, Mycobacterium avium subsp. paratuberculosis
cgcgugcgccgc

SEQ ID NO: 915392 - RNA, 15 nt, Mycobacterium avium subsp. paratuberculosis
cgcgugcgccgcggc

SEQ ID NO: 915393 - RNA, 22 nt, Mycobacterium avium subsp. paratuberculosis
cgcgugcagccgggcggcgccg

SEQ ID NO: 915394 - RNA, 23 nt, Mycobacterium avium subsp. paratuberculosis
cgcgugcagccgggcggcgccga

SEQ ID NO: 915395 - RNA, 15 nt, Mycobacterium avium subsp. paratuberculosis
cgcgugcacgaacgc

SEQ ID NO: 915396 - RNA, 16 nt, Mycobacterium avium subsp. paratuberculosis
cgcgugcacgaacgcg

SEQ ID NO: 915397 - RNA, 16 nt, Mycobacterium avium subsp. paratuberculosis
cgcgguucggcgucgg

SEQ ID NO: 915398 - RNA, 12 nt, Mycobacterium avium subsp. paratuberculosis
cgcgugaucggu

SEQ ID NO: 915399 - RNA, 22 nt, Mycobacterium avium subsp. paratuberculosis
cgcgugaugggugggcagcucg

SEQ ID NO: 915400 - RNA, 17 nt, Mycobacterium avium subsp. paratuberculosis
cgcgugcaacacauggu

SEQ ID NO: 915401 - RNA, 16 nt, Mycobacterium avium subsp. paratuberculosis
cgcgugcacaccggcc

SEQ ID NO: 915402 - RNA, 21 nt, Mycobacterium avium subsp. paratuberculosis
cgcuauuggccgagccgggcg

SEQ ID NO: 915403 - RNA, 15 nt, Mycobacterium avium subsp. paratuberculosis
cgcucaacccgggcc

SEQ ID NO: 915404 - RNA, 16 nt, Mycobacterium avium subsp. paratuberculosis
cgcucaacccgucgcg

SEQ ID NO: 915405 - RNA, 13 nt, Mycobacterium avium subsp. paratuberculosis
cgcucaaaggcgg

SEQ ID NO: 915406 - RNA, 16 nt, Mycobacterium avium subsp. paratuberculosis
cgcucaaccgcccagc

SEQ ID NO: 915407 - RNA, 21 nt, Mycobacterium avium subsp. paratuberculosis
cgcucaaccgcccagcggcuu

SEQ ID NO: 915408 - RNA, 21 nt, Mycobacterium avium subsp. paratuberculosis
cgcucaacgugauacgccgac

SEQ ID NO: 915409 - RNA, 22 nt, Mycobacterium avium subsp. paratuberculosis
cgcucaacuugaucagcucgcg

SEQ ID NO: 915410 - RNA, 24 nt, Mycobacterium avium subsp. paratuberculosis
cgcucaacuugaucagcucgcgga

SEQ ID NO: 915411 - RNA, 14 nt, Mycobacterium avium subsp. paratuberculosis
cgcucacacagccg

SEQ ID NO: 915412 - RNA, 21 nt, Mycobacterium avium subsp. paratuberculosis
cgcucacccaaaaaggcgcgg

SEQ ID NO: 915413 - RNA, 19 nt, Mycobacterium avium subsp. paratuberculosis
cgcucacccagcgagaccg

SEQ ID NO: 915414 - RNA, 14 nt, Mycobacterium avium subsp. paratuberculosis
cgcucaccgcaucg

SEQ ID NO: 915415 - RNA, 17 nt, Mycobacterium avium subsp. paratuberculosis
cgcucaccgcaucgaac

SEQ ID NO: 915416 - RNA, 15 nt, Mycobacterium avium subsp. paratuberculosis
cgcucaccgucgcgg

SEQ ID NO: 915417 - RNA, 23 nt, Mycobacterium avium subsp. paratuberculosis
cgcucaccgcggggugcccggcg

SEQ ID NO: 915418 - RNA, 14 nt, Mycobacterium avium subsp. paratuberculosis
cgcucaccggcgug

SEQ ID NO: 915419 - RNA, 15 nt, Mycobacterium avium subsp. paratuberculosis
cgcucaccggcgugg

SEQ ID NO: 915420 - RNA, 18 nt, Mycobacterium avium subsp. paratuberculosis
cgcucaccggcguggugg

SEQ ID NO: 915421 - RNA, 20 nt, Mycobacterium avium subsp. paratuberculosis
cgcucaccggcguggugggc

SEQ ID NO: 915422 - RNA, 15 nt, Mycobacterium avium subsp. paratuberculosis
cgcucagcacgcgga

SEQ ID NO: 915423 - RNA, 17 nt, Mycobacterium avium subsp. paratuberculosis
cgcucaccugcggcccg

SEQ ID NO: 915424 - RNA, 18 nt, Mycobacterium avium subsp. paratuberculosis
cgcucaccugcggcccgu

SEQ ID NO: 915425 - RNA, 17 nt, Mycobacterium avium subsp. paratuberculosis
cgcucagagcugcaccg

SEQ ID NO: 915426 - RNA, 17 nt, Mycobacterium avium subsp. paratuberculosis
cgcucagaggcgggcac

SEQ ID NO: 915427 - RNA, 20 nt, Mycobacterium avium subsp. paratuberculosis
cgcucagcgcggccacaccg

SEQ ID NO: 915428 - RNA, 19 nt, Mycobacterium avium subsp. paratuberculosis
cgcucagcgcggcgggcca

SEQ ID NO: 915429 - RNA, 14 nt, Mycobacterium avium subsp. paratuberculosis
cgcucagcggcagc

SEQ ID NO: 915430 - RNA, 17 nt, Mycobacterium avium subsp. paratuberculosis
cgcucagcggcagcguc

SEQ ID NO: 915431 - RNA, 16 nt, Mycobacterium avium subsp. paratuberculosis
cgcucagcgcggccac

SEQ ID NO: 915432 - RNA, 18 nt, Mycobacterium avium subsp. paratuberculosis
cgcucagcgauugcggcc

SEQ ID NO: 915433 - RNA, 19 nt, Mycobacterium avium subsp. paratuberculosis
cgcucagcgauugcggccg

SEQ ID NO: 915434 - RNA, 20 nt, Mycobacterium avium subsp. paratuberculosis
cgcucagcgauugcggccgc

SEQ ID NO: 915435 - RNA, 22 nt, Mycobacterium avium subsp. paratuberculosis
cgcucagcgauugcggccgccg

SEQ ID NO: 915436 - RNA, 18 nt, Mycobacterium avium subsp. paratuberculosis
cgcucagccguucgcugc

SEQ ID NO: 915437 - RNA, 14 nt, Mycobacterium avium subsp. paratuberculosis
cgcucagccccagc

SEQ ID NO: 915438 - RNA, 13 nt, Mycobacterium avium subsp. paratuberculosis
cgcucagcccgga

SEQ ID NO: 915439 - RNA, 16 nt, Mycobacterium avium subsp. paratuberculosis
cgcuacgccgaggcgc

SEQ ID NO: 915440 - RNA, 17 nt, Mycobacterium avium subsp. paratuberculosis
cgcuaccucaccacgug

SEQ ID NO: 915441 - RNA, 16 nt, Mycobacterium avium subsp. paratuberculosis
cgcuacgccggcucgg

SEQ ID NO: 915442 - RNA, 20 nt, Mycobacterium avium subsp. paratuberculosis
cgcuagaccgauggcggcgg

SEQ ID NO: 915443 - RNA, 21 nt, Mycobacterium avium subsp. paratuberculosis
cgcuagaccgauggcggcggc

SEQ ID NO: 915444 - RNA, 19 nt, Mycobacterium avium subsp. paratuberculosis
cgcuagcgugacgcucgcg

SEQ ID NO: 915445 - RNA, 15 nt, Mycobacterium avium subsp. paratuberculosis
cgcuagcugcgccgg

SEQ ID NO: 915446 - RNA, 18 nt, Mycobacterium avium subsp. paratuberculosis
cgcuaggacgcgggccug

SEQ ID NO: 915447 - RNA, 17 nt, Mycobacterium avium subsp. paratuberculosis
cgcugaucucgacggug

SEQ ID NO: 915448 - RNA, 21 nt, Mycobacterium avium subsp. paratuberculosis
cgcugaucucgacgguggccu

SEQ ID NO: 915449 - RNA, 22 nt, Mycobacterium avium subsp. paratuberculosis
cgcugagcgggaagcugcuggc

SEQ ID NO: 915450 - RNA, 24 nt, Mycobacterium avium subsp. paratuberculosis
cgcugagcggguaaccgcagccgg

SEQ ID NO: 915451 - RNA, 16 nt, Mycobacterium avium subsp. paratuberculosis
cgcugaucugcggcac

SEQ ID NO: 915452 - RNA, 18 nt, Mycobacterium avium subsp. paratuberculosis
cgcugaucugcggcacca

SEQ ID NO: 915453 - RNA, 19 nt, Mycobacterium avium subsp. paratuberculosis
cgcugagcuucugcccggc

SEQ ID NO: 915454 - RNA, 21 nt, Mycobacterium avium subsp. paratuberculosis
cgcugagcuucugcccggcca

SEQ ID NO: 915455 - RNA, 22 nt, Mycobacterium avium subsp. paratuberculosis
cgcugagcuucugcccggccag

SEQ ID NO: 915456 - RNA, 14 nt, Mycobacterium avium subsp. paratuberculosis
cgcugagcgccagg

SEQ ID NO: 915457 - RNA, 15 nt, Mycobacterium avium subsp. paratuberculosis
cgcugagcgccaggc

SEQ ID NO: 915458 - RNA, 23 nt, Mycobacterium avium subsp. paratuberculosis
cgcugagcgccaggccauggcgc

SEQ ID NO: 915459 - RNA, 12 nt, Mycobacterium avium subsp. paratuberculosis
cgcugauggcga

SEQ ID NO: 915460 - RNA, 15 nt, Mycobacterium avium subsp. paratuberculosis
cgcugaugccgccga

SEQ ID NO: 915461 - RNA, 16 nt, Mycobacterium avium subsp. paratuberculosis
cgcugaugccgccgaa

SEQ ID NO: 915462 - RNA, 18 nt, Mycobacterium avium subsp. paratuberculosis
cgcugaugccgccgaagc

SEQ ID NO: 915463 - RNA, 18 nt, Mycobacterium avium subsp. paratuberculosis
cgcugaugcgcaacagca

SEQ ID NO: 915464 - RNA, 13 nt, Mycobacterium avium subsp. paratuberculosis
cgcugaugcggcc

SEQ ID NO: 915465 - RNA, 16 nt, Mycobacterium avium subsp. paratuberculosis
cgcugaugcggccgga

SEQ ID NO: 915466 - RNA, 20 nt, Mycobacterium avium subsp. paratuberculosis
cgcugcaaccgguccgccgu

SEQ ID NO: 915467 - RNA, 22 nt, Mycobacterium avium subsp. paratuberculosis
cgcugcaaccgguccgccgucg

SEQ ID NO: 915468 - RNA, 18 nt, Mycobacterium avium subsp. paratuberculosis
cgcugagcaaccgccgaa

SEQ ID NO: 915469 - RNA, 23 nt, Mycobacterium avium subsp. paratuberculosis
cgcugagcaauucggugacggcg

SEQ ID NO: 915470 - RNA, 12 nt, Mycobacterium avium subsp. paratuberculosis
cgcugagcaccc

SEQ ID NO: 915471 - RNA, 14 nt, Mycobacterium avium subsp. paratuberculosis
cgcugagcacccgc

SEQ ID NO: 915472 - RNA, 17 nt, Mycobacterium avium subsp. paratuberculosis
cgcugagccgcucgucg

SEQ ID NO: 915473 - RNA, 21 nt, Mycobacterium avium subsp. paratuberculosis
cgcugagccgcucgucgaguc

SEQ ID NO: 915474 - RNA, 20 nt, Mycobacterium avium subsp. paratuberculosis
cgcugagcagguccucgauc

SEQ ID NO: 915475 - RNA, 15 nt, Mycobacterium avium subsp. paratuberculosis
cgcugaccgcaggaa

SEQ ID NO: 915476 - RNA, 20 nt, Mycobacterium avium subsp. paratuberculosis
cgcugaccgccgcgcucggc

SEQ ID NO: 915477 - RNA, 21 nt, Mycobacterium avium subsp. paratuberculosis
cgcugaccgccgcgcucggcc

SEQ ID NO: 915478 - RNA, 14 nt, Mycobacterium avium subsp. paratuberculosis
cgcugaccccgcuc

SEQ ID NO: 915479 - RNA, 17 nt, Mycobacterium avium subsp. paratuberculosis
cgcugaccccgcucggc

SEQ ID NO: 915480 - RNA, 18 nt, Mycobacterium avium subsp. paratuberculosis
cgcugaccccgcucggcg

SEQ ID NO: 915481 - RNA, 13 nt, Mycobacterium avium subsp. paratuberculosis
cgcugacccgccg

SEQ ID NO: 915482 - RNA, 20 nt, Mycobacterium avium subsp. paratuberculosis
cgcugacccgccgcaacagc

SEQ ID NO: 915483 - RNA, 15 nt, Mycobacterium avium subsp. paratuberculosis
cgcugacccgggcgg

SEQ ID NO: 915484 - RNA, 23 nt, Mycobacterium avium subsp. paratuberculosis
cgcugacccgggcggccugcugc

SEQ ID NO: 915485 - RNA, 21 nt, Mycobacterium avium subsp. paratuberculosis
cgcugaccagcgugaccucga

SEQ ID NO: 915486 - RNA, 18 nt, Mycobacterium avium subsp. paratuberculosis
cgcugaccaggccgauga

SEQ ID NO: 915487 - RNA, 23 nt, Mycobacterium avium subsp. paratuberculosis
cgcugaccaggccguccaccaga

SEQ ID NO: 915488 - RNA, 13 nt, Mycobacterium avium subsp. paratuberculosis
cgcugccggccgg

SEQ ID NO: 915489 - RNA, 14 nt, Mycobacterium avium subsp. paratuberculosis
cgcugccggccggg

SEQ ID NO: 915490 - RNA, 15 nt, Mycobacterium avium subsp. paratuberculosis
cgcugccggccgggg

SEQ ID NO: 915491 - RNA, 16 nt, Mycobacterium avium subsp. paratuberculosis
cgcugccggccggggc

SEQ ID NO: 915492 - RNA, 12 nt, Mycobacterium avium subsp. paratuberculosis
cgcugccggcgc

SEQ ID NO: 915493 - RNA, 13 nt, Mycobacterium avium subsp. paratuberculosis
cgcugccggcgca

SEQ ID NO: 915494 - RNA, 14 nt, Mycobacterium avium subsp. paratuberculosis
cgcugccggcgcac

SEQ ID NO: 915495 - RNA, 17 nt, Mycobacterium avium subsp. paratuberculosis
cgcugccggcgcacccg

SEQ ID NO: 915496 - RNA, 19 nt, Mycobacterium avium subsp. paratuberculosis
cgcugccggcgcacccgca

SEQ ID NO: 915497 - RNA, 20 nt, Mycobacterium avium subsp. paratuberculosis
cgcugccggcgcacccgcac

SEQ ID NO: 915498 - RNA, 16 nt, Mycobacterium avium subsp. paratuberculosis
cgcugccgcgcgccga

SEQ ID NO: 915499 - RNA, 17 nt, Mycobacterium avium subsp. paratuberculosis
cgcugccgcgcgccgac

SEQ ID NO: 915500 - RNA, 13 nt, Mycobacterium avium subsp. paratuberculosis
cgcugccgccggc

SEQ ID NO: 915501 - RNA, 17 nt, Mycobacterium avium subsp. paratuberculosis
cgcugcccagcgcgguc

SEQ ID NO: 915502 - RNA, 15 nt, Mycobacterium avium subsp. paratuberculosis
cgcugccgccgccgc

SEQ ID NO: 915503 - RNA, 15 nt, Mycobacterium avium subsp. paratuberculosis
cgcugccaggcggug

SEQ ID NO: 915504 - RNA, 18 nt, Mycobacterium avium subsp. paratuberculosis
cgcugccagggccgggcg

SEQ ID NO: 915505 - RNA, 19 nt, Mycobacterium avium subsp. paratuberculosis
cgcugccagggccgggcgu

SEQ ID NO: 915506 - RNA, 18 nt, Mycobacterium avium subsp. paratuberculosis
cgcugcccaacgucgacu

SEQ ID NO: 915507 - RNA, 20 nt, Mycobacterium avium subsp. paratuberculosis
cgcugccacguacaccggga

SEQ ID NO: 915508 - RNA, 15 nt, Mycobacterium avium subsp. paratuberculosis
cgcugcaugccggug

SEQ ID NO: 915509 - RNA, 22 nt, Mycobacterium avium subsp. paratuberculosis
cgcugccaaaguuggcaucccg

SEQ ID NO: 915510 - RNA, 19 nt, Mycobacterium avium subsp. paratuberculosis
cgcugcagcauccaggugg

SEQ ID NO: 915511 - RNA, 17 nt, Mycobacterium avium subsp. paratuberculosis
cgcugcauagucggccc

SEQ ID NO: 915512 - RNA, 16 nt, Mycobacterium avium subsp. paratuberculosis
cgcugcauccgcagca

SEQ ID NO: 915513 - RNA, 18 nt, Mycobacterium avium subsp. paratuberculosis
cgcugcauccgcagcacc

SEQ ID NO: 915514 - RNA, 19 nt, Mycobacterium avium subsp. paratuberculosis
cgcugcauccgcagcacca

SEQ ID NO: 915515 - RNA, 21 nt, Mycobacterium avium subsp. paratuberculosis
cgcugcauccgcagcaccagg

SEQ ID NO: 915516 - RNA, 16 nt, Mycobacterium avium subsp. paratuberculosis
cgcugcaggcccgggu

SEQ ID NO: 915517 - RNA, 14 nt, Mycobacterium avium subsp. paratuberculosis
cgcugcagcugcuc

SEQ ID NO: 915518 - RNA, 12 nt, Mycobacterium avium subsp. paratuberculosis
cgcugcagcgcc

SEQ ID NO: 915519 - RNA, 16 nt, Mycobacterium avium subsp. paratuberculosis
cgcugcagcgccgagg

SEQ ID NO: 915520 - RNA, 19 nt, Mycobacterium avium subsp. paratuberculosis
cgcugcagcgccgcccgca

SEQ ID NO: 915521 - RNA, 15 nt, Mycobacterium avium subsp. paratuberculosis
cgcugcagcagcccg

SEQ ID NO: 915522 - RNA, 23 nt, Mycobacterium avium subsp. paratuberculosis
cgcugcagcagcccgaucacccc

SEQ ID NO: 915523 - RNA, 12 nt, Mycobacterium avium subsp. paratuberculosis
cgcugcaccagc

SEQ ID NO: 915524 - RNA, 16 nt, Mycobacterium avium subsp. paratuberculosis
cgcugcaccagcccgu

SEQ ID NO: 915525 - RNA, 13 nt, Mycobacterium avium subsp. paratuberculosis
cgcugcaccgcag

SEQ ID NO: 915526 - RNA, 18 nt, Mycobacterium avium subsp. paratuberculosis
cgcucaggucggccgcgg

SEQ ID NO: 915527 - RNA, 15 nt, Mycobacterium avium subsp. paratuberculosis
cgcucaggcguccag

SEQ ID NO: 915528 - RNA, 17 nt, Mycobacterium avium subsp. paratuberculosis
cgcucagcgggcggcca

SEQ ID NO: 915529 - RNA, 14 nt, Mycobacterium avium subsp. paratuberculosis
cgcucgccgcgcgg

SEQ ID NO: 915530 - RNA, 22 nt, Mycobacterium avium subsp. paratuberculosis
cgcucgccgcgggugucgcccu

SEQ ID NO: 915531 - RNA, 13 nt, Mycobacterium avium subsp. paratuberculosis
cgcucgccggcgg

SEQ ID NO: 915532 - RNA, 14 nt, Mycobacterium avium subsp. paratuberculosis
cgcucgccggcggc

SEQ ID NO: 915533 - RNA, 17 nt, Mycobacterium avium subsp. paratuberculosis
cgcucgccggcggccgc

SEQ ID NO: 915534 - RNA, 21 nt, Mycobacterium avium subsp. paratuberculosis
cgcucgccggggacgacggcg

SEQ ID NO: 915535 - RNA, 13 nt, Mycobacterium avium subsp. paratuberculosis
cgcucgccgucgg

SEQ ID NO: 915536 - RNA, 14 nt, Mycobacterium avium subsp. paratuberculosis
cgcucgccgucggc

SEQ ID NO: 915537 - RNA, 17 nt, Mycobacterium avium subsp. paratuberculosis
cgcucgccgucggccag

SEQ ID NO: 915538 - RNA, 21 nt, Mycobacterium avium subsp. paratuberculosis
cgcucgccgucggccagcagc

SEQ ID NO: 915539 - RNA, 15 nt, Mycobacterium avium subsp. paratuberculosis
cgcucgccgucggug

SEQ ID NO: 915540 - RNA, 17 nt, Mycobacterium avium subsp. paratuberculosis
cgcucgccgucggugau

SEQ ID NO: 915541 - RNA, 19 nt, Mycobacterium avium subsp. paratuberculosis
cgcucgccgucggugauga

SEQ ID NO: 915542 - RNA, 17 nt, Mycobacterium avium subsp. paratuberculosis
cgcucgcgggccacagc

SEQ ID NO: 915543 - RNA, 13 nt, Mycobacterium avium subsp. paratuberculosis
cgcucgcgggccc

SEQ ID NO: 915544 - RNA, 14 nt, Mycobacterium avium subsp. paratuberculosis
cgcucgcgggcccg

SEQ ID NO: 915545 - RNA, 15 nt, Mycobacterium avium subsp. paratuberculosis
cgcucgcgggcccgc

SEQ ID NO: 915546 - RNA, 19 nt, Mycobacterium avium subsp. paratuberculosis
cgcucgcgggcccgcgccg

SEQ ID NO: 915547 - RNA, 22 nt, Mycobacterium avium subsp. paratuberculosis
cgcucgcgggcccgcgccgcgu

SEQ ID NO: 915548 - RNA, 13 nt, Mycobacterium avium subsp. paratuberculosis
cgcucgcggugcg

SEQ ID NO: 915549 - RNA, 21 nt, Mycobacterium avium subsp. paratuberculosis
cgcucgcggugcgcgcgcgcu

SEQ ID NO: 915550 - RNA, 15 nt, Mycobacterium avium subsp. paratuberculosis
cgcucggccagcgca

SEQ ID NO: 915551 - RNA, 20 nt, Mycobacterium avium subsp. paratuberculosis
cgcucggccagcgcgccgca

SEQ ID NO: 915552 - RNA, 13 nt, Mycobacterium avium subsp. paratuberculosis
cgcucggccagca

SEQ ID NO: 915553 - RNA, 15 nt, Mycobacterium avium subsp. paratuberculosis
cgcucggccagcagc

SEQ ID NO: 915554 - RNA, 16 nt, Mycobacterium avium subsp. paratuberculosis
cgcucggccagcagca

SEQ ID NO: 915555 - RNA, 18 nt, Mycobacterium avium subsp. paratuberculosis
cgcucggccagcagcacc

SEQ ID NO: 915556 - RNA, 18 nt, Mycobacterium avium subsp. paratuberculosis
cgcucggccagcagugcc

SEQ ID NO: 915557 - RNA, 19 nt, Mycobacterium avium subsp. paratuberculosis
cgcucggccagcagugcca

SEQ ID NO: 915558 - RNA, 16 nt, Mycobacterium avium subsp. paratuberculosis
cgcucggccaggguga

SEQ ID NO: 915559 - RNA, 20 nt, Mycobacterium avium subsp. paratuberculosis
cgcucggaaugaacugccgc

SEQ ID NO: 915560 - RNA, 19 nt, Mycobacterium avium subsp. paratuberculosis
cgcucggccauccgggcgg

SEQ ID NO: 915561 - RNA, 21 nt, Mycobacterium avium subsp. paratuberculosis
cgcucggccauccgggcggca

SEQ ID NO: 915562 - RNA, 13 nt, Mycobacterium avium subsp. paratuberculosis
cgcucggccgggu

SEQ ID NO: 915563 - RNA, 20 nt, Mycobacterium avium subsp. paratuberculosis
cgcucggccguggccgucac

SEQ ID NO: 915564 - RNA, 21 nt, Mycobacterium avium subsp. paratuberculosis
cgcucggccguggccgucacg

SEQ ID NO: 915565 - RNA, 19 nt, Mycobacterium avium subsp. paratuberculosis
cgcucggccucaggcgucg

SEQ ID NO: 915566 - RNA, 22 nt, Mycobacterium avium subsp. paratuberculosis
cgcucggccucaggcgucgguc

SEQ ID NO: 915567 - RNA, 23 nt, Mycobacterium avium subsp. paratuberculosis
cgcucggccucaggcgucgguca

SEQ ID NO: 915568 - RNA, 21 nt, Mycobacterium avium subsp. paratuberculosis
cgcucggaguucgcccgcagc

SEQ ID NO: 915569 - RNA, 18 nt, Mycobacterium avium subsp. paratuberculosis
cgcucggcaggcggggaa

SEQ ID NO: 915570 - RNA, 20 nt, Mycobacterium avium subsp. paratuberculosis
cgcucgcgggugcgcugcag

SEQ ID NO: 915571 - RNA, 18 nt, Mycobacterium avium subsp. paratuberculosis
cgcucgcgguugggccgc

SEQ ID NO: 915572 - RNA, 22 nt, Mycobacterium avium subsp. paratuberculosis
cgcucgcgguugggccgccggc

SEQ ID NO: 915573 - RNA, 20 nt, Mycobacterium avium subsp. paratuberculosis
cgcucgcgguugggccggcg

SEQ ID NO: 915574 - RNA, 21 nt, Mycobacterium avium subsp. paratuberculosis
cgcucgcgguugggccggcgc

SEQ ID NO: 915575 - RNA, 16 nt, Mycobacterium avium subsp. paratuberculosis
cgcucgcuagcacacg

SEQ ID NO: 915576 - RNA, 19 nt, Mycobacterium avium subsp. paratuberculosis
cgcucgcuauaucgcaccg

SEQ ID NO: 915577 - RNA, 20 nt, Mycobacterium avium subsp. paratuberculosis
cgcucgcuauaucgcaccgg

SEQ ID NO: 915578 - RNA, 22 nt, Mycobacterium avium subsp. paratuberculosis
cgcucgcuauaucgcaccggcg

SEQ ID NO: 915579 - RNA, 14 nt, Mycobacterium avium subsp. paratuberculosis
cgcugaagccgcug

SEQ ID NO: 915580 - RNA, 15 nt, Mycobacterium avium subsp. paratuberculosis
cgcugaagccgcugg

SEQ ID NO: 915581 - RNA, 21 nt, Mycobacterium avium subsp. paratuberculosis
cgcugaauucuguugucggcu

SEQ ID NO: 915582 - RNA, 18 nt, Mycobacterium avium subsp. paratuberculosis
cgcugaacugcucgacca

SEQ ID NO: 915583 - RNA, 21 nt, Mycobacterium avium subsp. paratuberculosis
cgcugaaccgguagucgucga

SEQ ID NO: 915584 - RNA, 23 nt, Mycobacterium avium subsp. paratuberculosis
cgcugaagaucgaaaugaccgcg

SEQ ID NO: 915585 - RNA, 13 nt, Mycobacterium avium subsp. paratuberculosis
cgcugaagcccac

SEQ ID NO: 915586 - RNA, 18 nt, Mycobacterium avium subsp. paratuberculosis
cgcugaagcccaccgccg

SEQ ID NO: 915587 - RNA, 14 nt, Mycobacterium avium subsp. paratuberculosis
cgcugaacgcgauc

SEQ ID NO: 915588 - RNA, 13 nt, Mycobacterium avium subsp. paratuberculosis
cgcugaacgcggu

SEQ ID NO: 915589 - RNA, 14 nt, Mycobacterium avium subsp. paratuberculosis
cgcugaacgcggug

SEQ ID NO: 915590 - RNA, 14 nt, Mycobacterium avium subsp. paratuberculosis
cgcugaacggugcc

SEQ ID NO: 915591 - RNA, 18 nt, Mycobacterium avium subsp. paratuberculosis
cgcugaacggugccguca

SEQ ID NO: 915592 - RNA, 19 nt, Mycobacterium avium subsp. paratuberculosis
cgcugaacggugccgucac

SEQ ID NO: 915593 - RNA, 20 nt, Mycobacterium avium subsp. paratuberculosis
cgcugaacggugccgucacg

SEQ ID NO: 915594 - RNA, 16 nt, Mycobacterium avium subsp. paratuberculosis
cgcugaacagcagcag

SEQ ID NO: 915595 - RNA, 17 nt, Mycobacterium avium subsp. paratuberculosis
cgcugaacagcagcagc

SEQ ID NO: 915596 - RNA, 17 nt, Mycobacterium avium subsp. paratuberculosis
cgcugaacagcccgagc

SEQ ID NO: 915597 - RNA, 15 nt, Mycobacterium avium subsp. paratuberculosis
cgcugaaagcucgcg

SEQ ID NO: 915598 - RNA, 19 nt, Mycobacterium avium subsp. paratuberculosis
cgcugaaagcucgcgucga

SEQ ID NO: 915599 - RNA, 20 nt, Mycobacterium avium subsp. paratuberculosis
cgcugaaagcucgcgucgac

SEQ ID NO: 915600 - RNA, 22 nt, Mycobacterium avium subsp. paratuberculosis
cgcucuaacuccgcucgggccc

SEQ ID NO: 915601 - RNA, 16 nt, Mycobacterium avium subsp. paratuberculosis
cgcucucgccggucag

SEQ ID NO: 915602 - RNA, 12 nt, Mycobacterium avium subsp. paratuberculosis
cgcucggcgcgc

SEQ ID NO: 915603 - RNA, 16 nt, Mycobacterium avium subsp. paratuberculosis
cgcucggcgccgagcg

SEQ ID NO: 915604 - RNA, 13 nt, Mycobacterium avium subsp. paratuberculosis
cgcucggcgccgg

SEQ ID NO: 915605 - RNA, 23 nt, Mycobacterium avium subsp. paratuberculosis
cgcucggcgccggccgucacgcu

SEQ ID NO: 915606 - RNA, 13 nt, Mycobacterium avium subsp. paratuberculosis
cgcucgucgucgg

SEQ ID NO: 915607 - RNA, 15 nt, Mycobacterium avium subsp. paratuberculosis
cgcucgucgucggug

SEQ ID NO: 915608 - RNA, 15 nt, Mycobacterium avium subsp. paratuberculosis
cgcucgugaccggcg

SEQ ID NO: 915609 - RNA, 16 nt, Mycobacterium avium subsp. paratuberculosis
cgcucgugaccggcgg

SEQ ID NO: 915610 - RNA, 19 nt, Mycobacterium avium subsp. paratuberculosis
cgcucggcgaccgccggug

SEQ ID NO: 915611 - RNA, 20 nt, Mycobacterium avium subsp. paratuberculosis
cgcucggcgaccgccggugg

SEQ ID NO: 915612 - RNA, 14 nt, Mycobacterium avium subsp. paratuberculosis
cgcucggcgagcaa

SEQ ID NO: 915613 - RNA, 20 nt, Mycobacterium avium subsp. paratuberculosis
cgcucggcgagcaaggcgag

SEQ ID NO: 915614 - RNA, 13 nt, Mycobacterium avium subsp. paratuberculosis
cgcucggcgagcu

SEQ ID NO: 915615 - RNA, 21 nt, Mycobacterium avium subsp. paratuberculosis
cgcucggcgagcugcgggugc

SEQ ID NO: 915616 - RNA, 12 nt, Mycobacterium avium subsp. paratuberculosis
cgcucggcgauc

SEQ ID NO: 915617 - RNA, 17 nt, Mycobacterium avium subsp. paratuberculosis
cgcucggcgaucuggcg

SEQ ID NO: 915618 - RNA, 12 nt, Mycobacterium avium subsp. paratuberculosis
cgcucggcgccg

SEQ ID NO: 915619 - RNA, 13 nt, Mycobacterium avium subsp. paratuberculosis
cgcggcgauggug

SEQ ID NO: 915620 - RNA, 22 nt, Mycobacterium avium subsp. paratuberculosis
cgcggcgauggugggcagccgg

SEQ ID NO: 915621 - RNA, 16 nt, Mycobacterium avium subsp. paratuberculosis
cgcggcgauggccgac

SEQ ID NO: 915622 - RNA, 19 nt, Mycobacterium avium subsp. paratuberculosis
cgcggcgaucuugucccgc

SEQ ID NO: 915623 - RNA, 22 nt, Mycobacterium avium subsp. paratuberculosis
cgcggcgaucuuugcggccgug

SEQ ID NO: 915624 - RNA, 17 nt, Mycobacterium avium subsp. paratuberculosis
cgcggcgaugaccgccu

SEQ ID NO: 915625 - RNA, 17 nt, Mycobacterium avium subsp. paratuberculosis
cgcggcgaugaccggac

SEQ ID NO: 915626 - RNA, 16 nt, Mycobacterium avium subsp. paratuberculosis
cgcggcgaugaucacg

SEQ ID NO: 915627 - RNA, 11 nt, Mycobacterium avium subsp. paratuberculosis
cgcggcgaugc

SEQ ID NO: 915628 - RNA, 14 nt, Mycobacterium avium subsp. paratuberculosis
cgcggcgaucggcg

SEQ ID NO: 915629 - RNA, 16 nt, Mycobacterium avium subsp. paratuberculosis
cgcggcgaucggguca

SEQ ID NO: 915630 - RNA, 13 nt, Mycobacterium avium subsp. paratuberculosis
cgcggcgaucgcc

SEQ ID NO: 915631 - RNA, 16 nt, Mycobacterium avium subsp. paratuberculosis
cgcggcgaucgccgug

SEQ ID NO: 915632 - RNA, 17 nt, Mycobacterium avium subsp. paratuberculosis
cgcggcgaucgccgugg

SEQ ID NO: 915633 - RNA, 18 nt, Mycobacterium avium subsp. paratuberculosis
cgcggcgaucgccguggu

SEQ ID NO: 915634 - RNA, 14 nt, Mycobacterium avium subsp. paratuberculosis
cgcggcgaucgcga

SEQ ID NO: 915635 - RNA, 13 nt, Mycobacterium avium subsp. paratuberculosis
cgcggcgaucagc

SEQ ID NO: 915636 - RNA, 15 nt, Mycobacterium avium subsp. paratuberculosis
cgcggcgaucagcag

SEQ ID NO: 915637 - RNA, 19 nt, Mycobacterium avium subsp. paratuberculosis
cgcggcgaucagcagcacc

SEQ ID NO: 915638 - RNA, 23 nt, Mycobacterium avium subsp. paratuberculosis
cgcggcgaucagcagcacccggg

SEQ ID NO: 915639 - RNA, 15 nt, Mycobacterium avium subsp. paratuberculosis
cgcggcgaucagccc

SEQ ID NO: 915640 - RNA, 16 nt, Mycobacterium avium subsp. paratuberculosis
cgcggcgagcgcguuc

SEQ ID NO: 915641 - RNA, 13 nt, Mycobacterium avium subsp. paratuberculosis
cgcggcgagcggc

SEQ ID NO: 915642 - RNA, 18 nt, Mycobacterium avium subsp. paratuberculosis
cgcggccuccgagcggcg

SEQ ID NO: 915643 - RNA, 21 nt, Mycobacterium avium subsp. paratuberculosis
cgcggccgucgucgugcacca

SEQ ID NO: 915644 - RNA, 13 nt, Mycobacterium avium subsp. paratuberculosis
cgcggcgagccgg

SEQ ID NO: 915645 - RNA, 14 nt, Mycobacterium avium subsp. paratuberculosis
cgcggccucggcgu

SEQ ID NO: 915646 - RNA, 17 nt, Mycobacterium avium subsp. paratuberculosis
cgcggccucggcgucga

SEQ ID NO: 915647 - RNA, 14 nt, Mycobacterium avium subsp. paratuberculosis
cgcggccucaccgc

SEQ ID NO: 915648 - RNA, 15 nt, Mycobacterium avium subsp. paratuberculosis
cgcggccucaccgcg

SEQ ID NO: 915649 - RNA, 15 nt, Mycobacterium avium subsp. paratuberculosis
cgcggccuccagccg

SEQ ID NO: 915650 - RNA, 23 nt, Mycobacterium avium subsp. paratuberculosis
cgcggccuccagccgcgcggccg

SEQ ID NO: 915651 - RNA, 21 nt, Mycobacterium avium subsp. paratuberculosis
cgcggccuccagccgcuccgc

SEQ ID NO: 915652 - RNA, 22 nt, Mycobacterium avium subsp. paratuberculosis
cgcggccuccagccgcuccgcg

SEQ ID NO: 915653 - RNA, 16 nt, Mycobacterium avium subsp. paratuberculosis
cgcggccgucgcggcg

SEQ ID NO: 915654 - RNA, 20 nt, Mycobacterium avium subsp. paratuberculosis
cgcggccgucgcggcgaucg

SEQ ID NO: 915655 - RNA, 18 nt, Mycobacterium avium subsp. paratuberculosis
cgcggccguagccggacc

SEQ ID NO: 915656 - RNA, 19 nt, Mycobacterium avium subsp. paratuberculosis
cgcggccguagccggaccg

SEQ ID NO: 915657 - RNA, 17 nt, Mycobacterium avium subsp. paratuberculosis
cgcggcgcgaagcccuc

SEQ ID NO: 915658 - RNA, 23 nt, Mycobacterium avium subsp. paratuberculosis
cgcggcgccguuucggacgagcc

SEQ ID NO: 915659 - RNA, 18 nt, Mycobacterium avium subsp. paratuberculosis
cgcggcgccugcacgcag

SEQ ID NO: 915660 - RNA, 14 nt, Mycobacterium avium subsp. paratuberculosis
cgcggcgcgacacc

SEQ ID NO: 915661 - RNA, 19 nt, Mycobacterium avium subsp. paratuberculosis
cgcggcgcgaggcgcgggg

SEQ ID NO: 915662 - RNA, 17 nt, Mycobacterium avium subsp. paratuberculosis
cgcggcgccgucgaaca

SEQ ID NO: 915663 - RNA, 22 nt, Mycobacterium avium subsp. paratuberculosis
cgcggcgcagggcggccggcca

SEQ ID NO: 915664 - RNA, 23 nt, Mycobacterium avium subsp. paratuberculosis
cgcggcgcagggcggccggccag

SEQ ID NO: 915665 - RNA, 14 nt, Mycobacterium avium subsp. paratuberculosis
cgcggcgcaggucc

SEQ ID NO: 915666 - RNA, 18 nt, Mycobacterium avium subsp. paratuberculosis
cgcggcgcagguccggca

SEQ ID NO: 915667 - RNA, 19 nt, Mycobacterium avium subsp. paratuberculosis
cgcggcgcagguccggcag

SEQ ID NO: 915668 - RNA, 13 nt, Mycobacterium avium subsp. paratuberculosis
cgcggcgcagcuc

SEQ ID NO: 915669 - RNA, 14 nt, Mycobacterium avium subsp. paratuberculosis
cgcggcgccagcgg

SEQ ID NO: 915670 - RNA, 15 nt, Mycobacterium avium subsp. paratuberculosis
cgcggcgccagcggc

SEQ ID NO: 915671 - RNA, 14 nt, Mycobacterium avium subsp. paratuberculosis
cgcggcgccggugc

SEQ ID NO: 915672 - RNA, 15 nt, Mycobacterium avium subsp. paratuberculosis
cgcggcgccguaggu

SEQ ID NO: 915673 - RNA, 15 nt, Mycobacterium avium subsp. paratuberculosis
cgcggcgcagcgcga

SEQ ID NO: 915674 - RNA, 14 nt, Mycobacterium avium subsp. paratuberculosis
cgcggcgcagcacg

SEQ ID NO: 915675 - RNA, 18 nt, Mycobacterium avium subsp. paratuberculosis
cgcggcgcagcacggcca

SEQ ID NO: 915676 - RNA, 15 nt, Mycobacterium avium subsp. paratuberculosis
cgcggcgcaccccga

SEQ ID NO: 915677 - RNA, 18 nt, Mycobacterium avium subsp. paratuberculosis
cgcggcgcacccgggcag

SEQ ID NO: 915678 - RNA, 19 nt, Mycobacterium avium subsp. paratuberculosis
cgcggcgcacccgggcagc

SEQ ID NO: 915679 - RNA, 20 nt, Mycobacterium avium subsp. paratuberculosis
cgcggcgcacccgggcagcu

SEQ ID NO: 915680 - RNA, 13 nt, Mycobacterium avium subsp. paratuberculosis
cgcggcgcaccga

SEQ ID NO: 915681 - RNA, 13 nt, Mycobacterium avium subsp. paratuberculosis
cgcggcgcaccgc

SEQ ID NO: 915682 - RNA, 14 nt, Mycobacterium avium subsp. paratuberculosis
cgcggcgcaccgcc

SEQ ID NO: 915683 - RNA, 21 nt, Mycobacterium avium subsp. paratuberculosis
cgcggcgcaccgcccgcggug

SEQ ID NO: 915684 - RNA, 14 nt, Mycobacterium avium subsp. paratuberculosis
cgcggcgcacggug

SEQ ID NO: 915685 - RNA, 15 nt, Mycobacterium avium subsp. paratuberculosis
cgcggcgcacggugc

SEQ ID NO: 915686 - RNA, 16 nt, Mycobacterium avium subsp. paratuberculosis
cgcggcgcacggugcc

SEQ ID NO: 915687 - RNA, 12 nt, Mycobacterium avium subsp. paratuberculosis
cgcggcgcacgu

SEQ ID NO: 915688 - RNA, 21 nt, Mycobacterium avium subsp. paratuberculosis
cgcggccgggcgccccgacau

SEQ ID NO: 915689 - RNA, 14 nt, Mycobacterium avium subsp. paratuberculosis
cgcggccgggcucc

SEQ ID NO: 915690 - RNA, 14 nt, Mycobacterium avium subsp. paratuberculosis
cgcggccggcgugu

SEQ ID NO: 915691 - RNA, 14 nt, Mycobacterium avium subsp. paratuberculosis
cgcggccggcggca

SEQ ID NO: 915692 - RNA, 22 nt, Mycobacterium avium subsp. paratuberculosis
cgcggccggcggcaguccggcg

SEQ ID NO: 915693 - RNA, 18 nt, Mycobacterium avium subsp. paratuberculosis
cgcggccggccggccugg

SEQ ID NO: 915694 - RNA, 17 nt, Mycobacterium avium subsp. paratuberculosis
cgcggccggcgagucgc

SEQ ID NO: 915695 - RNA, 16 nt, Mycobacterium avium subsp. paratuberculosis
cgcggccggccgacac

SEQ ID NO: 915696 - RNA, 14 nt, Mycobacterium avium subsp. paratuberculosis
cgcggccgcuggcg

SEQ ID NO: 915697 - RNA, 19 nt, Mycobacterium avium subsp. paratuberculosis
cgcggccggcccagcgcgc

SEQ ID NO: 915698 - RNA, 14 nt, Mycobacterium avium subsp. paratuberculosis
cgcggccggcacua

SEQ ID NO: 915699 - RNA, 20 nt, Mycobacterium avium subsp. paratuberculosis
cgcggccggcacuaccgccu

SEQ ID NO: 915700 - RNA, 15 nt, Mycobacterium avium subsp. paratuberculosis
cgcggccgcugcgcc

SEQ ID NO: 915701 - RNA, 17 nt, Mycobacterium avium subsp. paratuberculosis
cgcggccgcugcgccca

SEQ ID NO: 915702 - RNA, 21 nt, Mycobacterium avium subsp. paratuberculosis
cgcggccgcugcgcccagcgc

SEQ ID NO: 915703 - RNA, 22 nt, Mycobacterium avium subsp. paratuberculosis
cgcggccgcugcgcccagcgcg

SEQ ID NO: 915704 - RNA, 12 nt, Mycobacterium avium subsp. paratuberculosis
cgcggccgcugg

SEQ ID NO: 915705 - RNA, 14 nt, Mycobacterium avium subsp. paratuberculosis
cgcggccgcgucgg

SEQ ID NO: 915706 - RNA, 15 nt, Mycobacterium avium subsp. paratuberculosis
cgcggccgcgucggc

SEQ ID NO: 915707 - RNA, 12 nt, Mycobacterium avium subsp. paratuberculosis
cgcggccggcca

SEQ ID NO: 915708 - RNA, 19 nt, Mycobacterium avium subsp. paratuberculosis
cgcggccgcgucggcggcg

SEQ ID NO: 915709 - RNA, 16 nt, Mycobacterium avium subsp. paratuberculosis
cgcggccgcggcgcgc

SEQ ID NO: 915710 - RNA, 15 nt, Mycobacterium avium subsp. paratuberculosis
cgcggccgcggcggg

SEQ ID NO: 915711 - RNA, 17 nt, Mycobacterium avium subsp. paratuberculosis
cgcggccgcggcgggcg

SEQ ID NO: 915712 - RNA, 16 nt, Mycobacterium avium subsp. paratuberculosis
cgcggccgccuucacg

SEQ ID NO: 915713 - RNA, 14 nt, Mycobacterium avium subsp. paratuberculosis
cgcggccgcgacgg

SEQ ID NO: 915714 - RNA, 13 nt, Mycobacterium avium subsp. paratuberculosis
cgcggccgcgcgc

SEQ ID NO: 915715 - RNA, 14 nt, Mycobacterium avium subsp. paratuberculosis
cgcggccgcgcgcc

SEQ ID NO: 915716 - RNA, 22 nt, Mycobacterium avium subsp. paratuberculosis
cgcggccgccgcgacggccgcc

SEQ ID NO: 915717 - RNA, 12 nt, Mycobacterium avium subsp. paratuberculosis
cgcggccgccgg

SEQ ID NO: 915718 - RNA, 13 nt, Mycobacterium avium subsp. paratuberculosis
cgcggccgccggg

SEQ ID NO: 915719 - RNA, 14 nt, Mycobacterium avium subsp. paratuberculosis
cgcggccgccgggg

SEQ ID NO: 915720 - RNA, 15 nt, Mycobacterium avium subsp. paratuberculosis
cgcggccgccggggc

SEQ ID NO: 915721 - RNA, 14 nt, Mycobacterium avium subsp. paratuberculosis
cgcggccgccuccg

SEQ ID NO: 915722 - RNA, 20 nt, Mycobacterium avium subsp. paratuberculosis
cgcggcccguugagcaccgc

SEQ ID NO: 915723 - RNA, 14 nt, Mycobacterium avium subsp. paratuberculosis
cgcggcccugcagc

SEQ ID NO: 915724 - RNA, 18 nt, Mycobacterium avium subsp. paratuberculosis
cgcggcccgccgaacgcc

SEQ ID NO: 915725 - RNA, 16 nt, Mycobacterium avium subsp. paratuberculosis
cgcggcccgccgcuca

SEQ ID NO: 915726 - RNA, 15 nt, Mycobacterium avium subsp. paratuberculosis
cgcggcccgcgacgu

SEQ ID NO: 915727 - RNA, 17 nt, Mycobacterium avium subsp. paratuberculosis
cgcggcccgcggcguca

SEQ ID NO: 915728 - RNA, 13 nt, Mycobacterium avium subsp. paratuberculosis
cgcggcccgcggg

SEQ ID NO: 915729 - RNA, 22 nt, Mycobacterium avium subsp. paratuberculosis
cgcggcccgcggggcguacgcg

SEQ ID NO: 915730 - RNA, 17 nt, Mycobacterium avium subsp. paratuberculosis
cgcggcccggccaccag

SEQ ID NO: 915731 - RNA, 13 nt, Mycobacterium avium subsp. paratuberculosis
cgcggcccggccc

SEQ ID NO: 915732 - RNA, 15 nt, Mycobacterium avium subsp. paratuberculosis
cgcggcccggcccgc

SEQ ID NO: 915733 - RNA, 19 nt, Mycobacterium avium subsp. paratuberculosis
cgcggcccggcccgcuggc

SEQ ID NO: 915734 - RNA, 19 nt, Mycobacterium avium subsp. paratuberculosis
cgcggcccguacucgggug

SEQ ID NO: 915735 - RNA, 16 nt, Mycobacterium avium subsp. paratuberculosis
cgcggcccccacgcag

SEQ ID NO: 915736 - RNA, 22 nt, Mycobacterium avium subsp. paratuberculosis
cgcggcccccacgcagcggugc

SEQ ID NO: 915737 - RNA, 17 nt, Mycobacterium avium subsp. paratuberculosis
cgcggcccccugaucgg

SEQ ID NO: 915738 - RNA, 22 nt, Mycobacterium avium subsp. paratuberculosis
cgcggcccccugaucggccgca

SEQ ID NO: 915739 - RNA, 13 nt, Mycobacterium avium subsp. paratuberculosis
cgcggcccagcac

SEQ ID NO: 915740 - RNA, 14 nt, Mycobacterium avium subsp. paratuberculosis
cgcggcccagcacc

SEQ ID NO: 915741 - RNA, 19 nt, Mycobacterium avium subsp. paratuberculosis
cgcggcccaguucgcaccc

SEQ ID NO: 915742 - RNA, 21 nt, Mycobacterium avium subsp. paratuberculosis
cgcggauuucucagcggcgcu

SEQ ID NO: 915743 - RNA, 16 nt, Mycobacterium avium subsp. paratuberculosis
cgcggauguccgaccg

SEQ ID NO: 915744 - RNA, 20 nt, Mycobacterium avium subsp. paratuberculosis
cgcggauguggaggcgagca

SEQ ID NO: 915745 - RNA, 14 nt, Mycobacterium avium subsp. paratuberculosis
cgcggcuccagcag

SEQ ID NO: 915746 - RNA, 22 nt, Mycobacterium avium subsp. paratuberculosis
cgcggcuccagcagcggcucgg

SEQ ID NO: 915747 - RNA, 13 nt, Mycobacterium avium subsp. paratuberculosis
cgcggcucacagc

SEQ ID NO: 915748 - RNA, 17 nt, Mycobacterium avium subsp. paratuberculosis
cgcggcucacagcgcgg

SEQ ID NO: 915749 - RNA, 19 nt, Mycobacterium avium subsp. paratuberculosis
cgcggcucacagcgcggcg

SEQ ID NO: 915750 - RNA, 20 nt, Mycobacterium avium subsp. paratuberculosis
cgcggcucacagcgcggcgg

SEQ ID NO: 915751 - RNA, 14 nt, Mycobacterium avium subsp. paratuberculosis
cgcggcuccggccg

SEQ ID NO: 915752 - RNA, 17 nt, Mycobacterium avium subsp. paratuberculosis
cgcggcuccggccgcgc

SEQ ID NO: 915753 - RNA, 20 nt, Mycobacterium avium subsp. paratuberculosis
cgcggcuccggccgcgccgg

SEQ ID NO: 915754 - RNA, 21 nt, Mycobacterium avium subsp. paratuberculosis
cgcggcuccggccgcgccggc

SEQ ID NO: 915755 - RNA, 23 nt, Mycobacterium avium subsp. paratuberculosis
cgcggcuccggccgcgccggccu

SEQ ID NO: 915756 - RNA, 17 nt, Mycobacterium avium subsp. paratuberculosis
cgcggcucgcgacgcgg

SEQ ID NO: 915757 - RNA, 15 nt, Mycobacterium avium subsp. paratuberculosis
cgcggcucgcgcggu

SEQ ID NO: 915758 - RNA, 16 nt, Mycobacterium avium subsp. paratuberculosis
cgcggcucgcgcggug

SEQ ID NO: 915759 - RNA, 20 nt, Mycobacterium avium subsp. paratuberculosis
cgcggcugaucagccggcga

SEQ ID NO: 915760 - RNA, 21 nt, Mycobacterium avium subsp. paratuberculosis
cgcggcugaucagccggcgag

SEQ ID NO: 915761 - RNA, 19 nt, Mycobacterium avium subsp. paratuberculosis
cgcggcguucuccagcacc

SEQ ID NO: 915762 - RNA, 21 nt, Mycobacterium avium subsp. paratuberculosis
cgcggcguucuccagcacccg

SEQ ID NO: 915763 - RNA, 23 nt, Mycobacterium avium subsp. paratuberculosis
cgcggcguucuccagcacccgca

SEQ ID NO: 915764 - RNA, 24 nt, Mycobacterium avium subsp. paratuberculosis
cgcggcguucuccagcacccgcaa

SEQ ID NO: 915765 - RNA, 19 nt, Mycobacterium avium subsp. paratuberculosis
cgcggcguugcccgggucc

SEQ ID NO: 915766 - RNA, 23 nt, Mycobacterium avium subsp. paratuberculosis
cgcggcggcucggcggcgucgua

SEQ ID NO: 915767 - RNA, 16 nt, Mycobacterium avium subsp. paratuberculosis
cgcggcguucagcagc

SEQ ID NO: 915768 - RNA, 12 nt, Mycobacterium avium subsp. paratuberculosis
cgcggcgucggc

SEQ ID NO: 915769 - RNA, 14 nt, Mycobacterium avium subsp. paratuberculosis
cgcggcgucggccg

SEQ ID NO: 915770 - RNA, 20 nt, Mycobacterium avium subsp. paratuberculosis
cgcggcgucggccgggcugc

SEQ ID NO: 915771 - RNA, 17 nt, Mycobacterium avium subsp. paratuberculosis
cgcggcgucggccugcc

SEQ ID NO: 915772 - RNA, 14 nt, Mycobacterium avium subsp. paratuberculosis
cgcggcgucgggau

SEQ ID NO: 915773 - RNA, 15 nt, Mycobacterium avium subsp. paratuberculosis
cgcggcgucgggcgg

SEQ ID NO: 915774 - RNA, 19 nt, Mycobacterium avium subsp. paratuberculosis
cgcggcgucgggcgggugg

SEQ ID NO: 915775 - RNA, 17 nt, Mycobacterium avium subsp. paratuberculosis
cgcggcgucacccugga

SEQ ID NO: 915776 - RNA, 12 nt, Mycobacterium avium subsp. paratuberculosis
cgcggcguccac

SEQ ID NO: 915777 - RNA, 13 nt, Mycobacterium avium subsp. paratuberculosis
cgcggcguccacc

SEQ ID NO: 915778 - RNA, 20 nt, Mycobacterium avium subsp. paratuberculosis
cgcggcguccaccagcacgc

SEQ ID NO: 915779 - RNA, 22 nt, Mycobacterium avium subsp. paratuberculosis
cgcggcguccaccagcacgccg

SEQ ID NO: 915780 - RNA, 16 nt, Mycobacterium avium subsp. paratuberculosis
cgcggcguggacgucg

SEQ ID NO: 915781 - RNA, 17 nt, Mycobacterium avium subsp. paratuberculosis
cgcggcguaggcggcca

SEQ ID NO: 915782 - RNA, 15 nt, Mycobacterium avium subsp. paratuberculosis
cgcggcgugguagcc

SEQ ID NO: 915783 - RNA, 18 nt, Mycobacterium avium subsp. paratuberculosis
cgcggcgugguagccgcc

SEQ ID NO: 915784 - RNA, 13 nt, Mycobacterium avium subsp. paratuberculosis
cgcggcguagccg

SEQ ID NO: 915785 - RNA, 16 nt, Mycobacterium avium subsp. paratuberculosis
cgcggcggugucggcg

SEQ ID NO: 915786 - RNA, 14 nt, Mycobacterium avium subsp. paratuberculosis
cgcggcggugccgg

SEQ ID NO: 915787 - RNA, 16 nt, Mycobacterium avium subsp. paratuberculosis
cgcggcggugccggug

SEQ ID NO: 915788 - RNA, 17 nt, Mycobacterium avium subsp. paratuberculosis
cgcggcggugcgcagcc

SEQ ID NO: 915789 - RNA, 19 nt, Mycobacterium avium subsp. paratuberculosis
cgcggcggugcgcagccgc

SEQ ID NO: 915790 - RNA, 22 nt, Mycobacterium avium subsp. paratuberculosis
cgcggcggugcgcagccgcugc

SEQ ID NO: 915791 - RNA, 19 nt, Mycobacterium avium subsp. paratuberculosis
cgcggcggugcucgcgccg

SEQ ID NO: 915792 - RNA, 17 nt, Mycobacterium avium subsp. paratuberculosis
cgcggcgguggccugcc

SEQ ID NO: 915793 - RNA, 22 nt, Mycobacterium avium subsp. paratuberculosis
cgcggcgguggccugcccggcg

SEQ ID NO: 915794 - RNA, 12 nt, Mycobacterium avium subsp. paratuberculosis
cgcggcggucgc

SEQ ID NO: 915795 - RNA, 22 nt, Mycobacterium avium subsp. paratuberculosis
cgcggcggucgcgcgccggcgc

SEQ ID NO: 915796 - RNA, 19 nt, Mycobacterium avium subsp. paratuberculosis
cgcggcggugaccggaucg

SEQ ID NO: 915797 - RNA, 18 nt, Mycobacterium avium subsp. paratuberculosis
cgcggcggugagccgcca

SEQ ID NO: 915798 - RNA, 19 nt, Mycobacterium avium subsp. paratuberculosis
cgcggcggucacgcccggg

SEQ ID NO: 915799 - RNA, 12 nt, Mycobacterium avium subsp. paratuberculosis
cgcggcggucag

SEQ ID NO: 915800 - RNA, 23 nt, Mycobacterium avium subsp. paratuberculosis
cgcggcggucagguucgccacga

SEQ ID NO: 915801 - RNA, 13 nt, Mycobacterium avium subsp. paratuberculosis
cgcggcgguccag

SEQ ID NO: 915802 - RNA, 15 nt, Mycobacterium avium subsp. paratuberculosis
cgcggcgguccagcg

SEQ ID NO: 915803 - RNA, 19 nt, Mycobacterium avium subsp. paratuberculosis
cgcggcgguccagcgagcc

SEQ ID NO: 915804 - RNA, 15 nt, Mycobacterium avium subsp. paratuberculosis
cgcggcgggcgcguc

SEQ ID NO: 915805 - RNA, 19 nt, Mycobacterium avium subsp. paratuberculosis
cgcggcgggcgcgucgagg

SEQ ID NO: 915806 - RNA, 21 nt, Mycobacterium avium subsp. paratuberculosis
cgcggcgggccuugagcaccg

SEQ ID NO: 915807 - RNA, 22 nt, Mycobacterium avium subsp. paratuberculosis
cgcggcgggccuugagcaccgc

SEQ ID NO: 915808 - RNA, 15 nt, Mycobacterium avium subsp. paratuberculosis
cgcggcgggcgagcc

SEQ ID NO: 915809 - RNA, 15 nt, Mycobacterium avium subsp. paratuberculosis
cgcggcgggggucgg

SEQ ID NO: 915810 - RNA, 16 nt, Mycobacterium avium subsp. paratuberculosis
cgcggcggcgucgacc

SEQ ID NO: 915811 - RNA, 16 nt, Mycobacterium avium subsp. paratuberculosis
cgcggcggcgucggcg

SEQ ID NO: 915812 - RNA, 13 nt, Mycobacterium avium subsp. paratuberculosis
cgcggcgggcagg

SEQ ID NO: 915813 - RNA, 18 nt, Mycobacterium avium subsp. paratuberculosis
cgcggcgggccagucgcc

SEQ ID NO: 915814 - RNA, 20 nt, Mycobacterium avium subsp. paratuberculosis
cgcggcgggccagucgccgc

SEQ ID NO: 915815 - RNA, 16 nt, Mycobacterium avium subsp. paratuberculosis
cgcggcggcggcgcgg

SEQ ID NO: 915816 - RNA, 13 nt, Mycobacterium avium subsp. paratuberculosis
cgcggcggcggug

SEQ ID NO: 915817 - RNA, 12 nt, Mycobacterium avium subsp. paratuberculosis
cgcggcggcgua

SEQ ID NO: 915818 - RNA, 16 nt, Mycobacterium avium subsp. paratuberculosis
cgcggcggcguacgcg

SEQ ID NO: 915819 - RNA, 14 nt, Mycobacterium avium subsp. paratuberculosis
cgcggcggcguccg

SEQ ID NO: 915820 - RNA, 13 nt, Mycobacterium avium subsp. paratuberculosis
cgcggcggcgucg

SEQ ID NO: 915821 - RNA, 12 nt, Mycobacterium avium subsp. paratuberculosis
cgcggcggcgcc

SEQ ID NO: 915822 - RNA, 13 nt, Mycobacterium avium subsp. paratuberculosis
cgcggcggcgcca

SEQ ID NO: 915823 - RNA, 13 nt, Mycobacterium avium subsp. paratuberculosis
cgcggcggcgccg

SEQ ID NO: 915824 - RNA, 14 nt, Mycobacterium avium subsp. paratuberculosis
cgcggcggcgccga

SEQ ID NO: 915825 - RNA, 15 nt, Mycobacterium avium subsp. paratuberculosis
cgcggcggcgccgac

SEQ ID NO: 915826 - RNA, 15 nt, Mycobacterium avium subsp. paratuberculosis
cgcggcggcgccgca

SEQ ID NO: 915827 - RNA, 20 nt, Mycobacterium avium subsp. paratuberculosis
cgcggcggcgccgcagcacg

SEQ ID NO: 915828 - RNA, 21 nt, Mycobacterium avium subsp. paratuberculosis
cgcggcggcgccgcagcacgc

SEQ ID NO: 915829 - RNA, 16 nt, Mycobacterium avium subsp. paratuberculosis
cgcggcggcgccgcgg

SEQ ID NO: 915830 - RNA, 14 nt, Mycobacterium avium subsp. paratuberculosis
cgcggcggcgccgu

SEQ ID NO: 915831 - RNA, 15 nt, Mycobacterium avium subsp. paratuberculosis
cgcggcggcgccguc

SEQ ID NO: 915832 - RNA, 20 nt, Mycobacterium avium subsp. paratuberculosis
cgcggcggcgcuggucggcg

SEQ ID NO: 915833 - RNA, 20 nt, Mycobacterium avium subsp. paratuberculosis
cgcggcggccuggccgucgc

SEQ ID NO: 915834 - RNA, 23 nt, Mycobacterium avium subsp. paratuberculosis
cgcggcggccuggccgucgcggc

SEQ ID NO: 915835 - RNA, 12 nt, Mycobacterium avium subsp. paratuberculosis
cgcggcggccau

SEQ ID NO: 915836 - RNA, 14 nt, Mycobacterium avium subsp. paratuberculosis
cgcggcggcccggc

SEQ ID NO: 915837 - RNA, 22 nt, Mycobacterium avium subsp. paratuberculosis
cgcggcggccgacgcgccgucg

SEQ ID NO: 915838 - RNA, 12 nt, Mycobacterium avium subsp. paratuberculosis
cgcggcggccgg

SEQ ID NO: 915839 - RNA, 13 nt, Mycobacterium avium subsp. paratuberculosis
cgcggcggccggc

SEQ ID NO: 915840 - RNA, 15 nt, Mycobacterium avium subsp. paratuberculosis
cgcggcggccggcca

SEQ ID NO: 915841 - RNA, 14 nt, Mycobacterium avium subsp. paratuberculosis
cgcggcggccggcg

SEQ ID NO: 915842 - RNA, 15 nt, Mycobacterium avium subsp. paratuberculosis
cgcggcggccggcgc

SEQ ID NO: 915843 - RNA, 18 nt, Mycobacterium avium subsp. paratuberculosis
cgcggcggccugcgcguc

SEQ ID NO: 915844 - RNA, 16 nt, Mycobacterium avium subsp. paratuberculosis
cgcggcgcggacccca

SEQ ID NO: 915845 - RNA, 15 nt, Mycobacterium avium subsp. paratuberculosis
cgcggcgcggagccg

SEQ ID NO: 915846 - RNA, 16 nt, Mycobacterium avium subsp. paratuberculosis
cgcggcgcggagccgg

SEQ ID NO: 915847 - RNA, 16 nt, Mycobacterium avium subsp. paratuberculosis
cgcggcggcagcaccc

SEQ ID NO: 915848 - RNA, 17 nt, Mycobacterium avium subsp. paratuberculosis
cgcggcggcagcacccg

SEQ ID NO: 915849 - RNA, 18 nt, Mycobacterium avium subsp. paratuberculosis
cgcggcggcagcacccgc

SEQ ID NO: 915850 - RNA, 11 nt, Mycobacterium avium subsp. paratuberculosis
cgcggcggcca

SEQ ID NO: 915851 - RNA, 20 nt, Mycobacterium avium subsp. paratuberculosis
cgcggcggccaacgcgacga

SEQ ID NO: 915852 - RNA, 20 nt, Mycobacterium avium subsp. paratuberculosis
cgcggcggccaaucgcugug

SEQ ID NO: 915853 - RNA, 13 nt, Mycobacterium avium subsp. paratuberculosis
cgcggcggccacc

SEQ ID NO: 915854 - RNA, 15 nt, Mycobacterium avium subsp. paratuberculosis
cgcggcggccaccgc

SEQ ID NO: 915855 - RNA, 19 nt, Mycobacterium avium subsp. paratuberculosis
cgcggcggccaccgcgccg

SEQ ID NO: 915856 - RNA, 21 nt, Mycobacterium avium subsp. paratuberculosis
cgcggcggccaccgcgccgug

SEQ ID NO: 915857 - RNA, 17 nt, Mycobacterium avium subsp. paratuberculosis
cgcggcggccaccucgg

SEQ ID NO: 915858 - RNA, 18 nt, Mycobacterium avium subsp. paratuberculosis
cgcggcggccaccucggc

SEQ ID NO: 915859 - RNA, 14 nt, Mycobacterium avium subsp. paratuberculosis
cgcggcggcaccca

SEQ ID NO: 915860 - RNA, 12 nt, Mycobacterium avium subsp. paratuberculosis
cgcggcgcgcga

SEQ ID NO: 915861 - RNA, 16 nt, Mycobacterium avium subsp. paratuberculosis
cgcggcgcgcgaugga

SEQ ID NO: 915862 - RNA, 23 nt, Mycobacterium avium subsp. paratuberculosis
cgcggcgcgcgauggacagcagc

SEQ ID NO: 915863 - RNA, 15 nt, Mycobacterium avium subsp. paratuberculosis
cgcggcgcggcccgg

SEQ ID NO: 915864 - RNA, 13 nt, Mycobacterium avium subsp. paratuberculosis
cgcggcgcgcggc

SEQ ID NO: 915865 - RNA, 15 nt, Mycobacterium avium subsp. paratuberculosis
cgcggcgcgcggccg

SEQ ID NO: 915866 - RNA, 14 nt, Mycobacterium avium subsp. paratuberculosis
cgcggcgcgaugau

SEQ ID NO: 915867 - RNA, 13 nt, Mycobacterium avium subsp. paratuberculosis
cgcggcgcgcagg

SEQ ID NO: 915868 - RNA, 13 nt, Mycobacterium avium subsp. paratuberculosis
cgcggcgcgcauc

SEQ ID NO: 915869 - RNA, 14 nt, Mycobacterium avium subsp. paratuberculosis
cgcggcgcgcaucg

SEQ ID NO: 915870 - RNA, 15 nt, Mycobacterium avium subsp. paratuberculosis
cgcggcgcgcaucgc

SEQ ID NO: 915871 - RNA, 20 nt, Mycobacterium avium subsp. paratuberculosis
cgcggcgcgcaucgccgucc

SEQ ID NO: 915872 - RNA, 15 nt, Mycobacterium avium subsp. paratuberculosis
cgcggcgcgcaucgu

SEQ ID NO: 915873 - RNA, 22 nt, Mycobacterium avium subsp. paratuberculosis
cgcgguaaagucuucggcgaug

SEQ ID NO: 915874 - RNA, 23 nt, Mycobacterium avium subsp. paratuberculosis
cgcgguaaagucuucggcgaugc

SEQ ID NO: 915875 - RNA, 15 nt, Mycobacterium avium subsp. paratuberculosis
cgcgguaccgaugac

SEQ ID NO: 915876 - RNA, 20 nt, Mycobacterium avium subsp. paratuberculosis
cgcggucgaacaacgcggug

SEQ ID NO: 915877 - RNA, 14 nt, Mycobacterium avium subsp. paratuberculosis
cgcggucgaagggu

SEQ ID NO: 915878 - RNA, 17 nt, Mycobacterium avium subsp. paratuberculosis
cgcggucgaagggugcg

SEQ ID NO: 915879 - RNA, 13 nt, Mycobacterium avium subsp. paratuberculosis
cgcggucgacgga

SEQ ID NO: 915880 - RNA, 23 nt, Mycobacterium avium subsp. paratuberculosis
cgcggucgacggaagccgagcgg

SEQ ID NO: 915881 - RNA, 20 nt, Mycobacterium avium subsp. paratuberculosis
cgcggucgccccggccgcgg

SEQ ID NO: 915882 - RNA, 22 nt, Mycobacterium avium subsp. paratuberculosis
cgcggucgccccggccgcggug

SEQ ID NO: 915883 - RNA, 20 nt, Mycobacterium avium subsp. paratuberculosis
cgcggucgccaccaccagcg

SEQ ID NO: 915884 - RNA, 21 nt, Mycobacterium avium subsp. paratuberculosis
cgcggucgccaccaccagcgg

SEQ ID NO: 915885 - RNA, 13 nt, Mycobacterium avium subsp. paratuberculosis
cgcggucgcaggc

SEQ ID NO: 915886 - RNA, 19 nt, Mycobacterium avium subsp. paratuberculosis
cgcggucgcaggcgagccg

SEQ ID NO: 915887 - RNA, 22 nt, Mycobacterium avium subsp. paratuberculosis
cgcggguggccuucaucaccgc

SEQ ID NO: 915888 - RNA, 20 nt, Mycobacterium avium subsp. paratuberculosis
cgcggguggcgccacagccg

SEQ ID NO: 915889 - RNA, 19 nt, Mycobacterium avium subsp. paratuberculosis
cgcgggugucgagccacca

SEQ ID NO: 915890 - RNA, 20 nt, Mycobacterium avium subsp. paratuberculosis
cgcgggugucgagccaccac

SEQ ID NO: 915891 - RNA, 19 nt, Mycobacterium avium subsp. paratuberculosis
cgcggguucacccuggcga

SEQ ID NO: 915892 - RNA, 22 nt, Mycobacterium avium subsp. paratuberculosis
cgcggguucacccuggcgaacc

SEQ ID NO: 915893 - RNA, 14 nt, Mycobacterium avium subsp. paratuberculosis
cgcggggucggcca

SEQ ID NO: 915894 - RNA, 15 nt, Mycobacterium avium subsp. paratuberculosis
cgcggggucgggccg

SEQ ID NO: 915895 - RNA, 22 nt, Mycobacterium avium subsp. paratuberculosis
cgcggggucgggccggacagcg

SEQ ID NO: 915896 - RNA, 14 nt, Mycobacterium avium subsp. paratuberculosis
cgcgggggcggccg

SEQ ID NO: 915897 - RNA, 15 nt, Mycobacterium avium subsp. paratuberculosis
cgcgggguggcgccg

SEQ ID NO: 915898 - RNA, 17 nt, Mycobacterium avium subsp. paratuberculosis
cgcgggguggcgccggc

SEQ ID NO: 915899 - RNA, 19 nt, Mycobacterium avium subsp. paratuberculosis
cgcgggguggcgccggcca

SEQ ID NO: 915900 - RNA, 20 nt, Mycobacterium avium subsp. paratuberculosis
cgcgggguggcgccggccag

SEQ ID NO: 915901 - RNA, 14 nt, Mycobacterium avium subsp. paratuberculosis
cgcggggcugggcg

SEQ ID NO: 915902 - RNA, 18 nt, Mycobacterium avium subsp. paratuberculosis
cgcggggcggcggcgccg

SEQ ID NO: 915903 - RNA, 21 nt, Mycobacterium avium subsp. paratuberculosis
cgcggggcguacgcgcugccg

SEQ ID NO: 915904 - RNA, 13 nt, Mycobacterium avium subsp. paratuberculosis
cgcgggggccgcc

SEQ ID NO: 915905 - RNA, 14 nt, Mycobacterium avium subsp. paratuberculosis
cgcgggggccgccg

SEQ ID NO: 915906 - RNA, 20 nt, Mycobacterium avium subsp. paratuberculosis
cgcgggggcggccgggccgc

SEQ ID NO: 915907 - RNA, 22 nt, Mycobacterium avium subsp. paratuberculosis
cgcgggggcggccgggccgcgg

SEQ ID NO: 915908 - RNA, 23 nt, Mycobacterium avium subsp. paratuberculosis
cgcgggggcggccgggccgcggc

SEQ ID NO: 915909 - RNA, 23 nt, Mycobacterium avium subsp. paratuberculosis
cgcgggggcggccugagccgccg

SEQ ID NO: 915910 - RNA, 14 nt, Mycobacterium avium subsp. paratuberculosis
cgcggggggagggu

SEQ ID NO: 915911 - RNA, 17 nt, Mycobacterium avium subsp. paratuberculosis
cgcggggggagggucgg

SEQ ID NO: 915912 - RNA, 14 nt, Mycobacterium avium subsp. paratuberculosis
cgcgggcggcgucg

SEQ ID NO: 915913 - RNA, 15 nt, Mycobacterium avium subsp. paratuberculosis
cgcgggcggcgucgg

SEQ ID NO: 915914 - RNA, 16 nt, Mycobacterium avium subsp. paratuberculosis
cgcgggcggcgucggc

SEQ ID NO: 915915 - RNA, 15 nt, Mycobacterium avium subsp. paratuberculosis
cgcgggcggcgucgu

SEQ ID NO: 915916 - RNA, 15 nt, Mycobacterium avium subsp. paratuberculosis
cgcggggccggcgcg

SEQ ID NO: 915917 - RNA, 21 nt, Mycobacterium avium subsp. paratuberculosis
cgcggggcgcgaggcgcgaaa

SEQ ID NO: 915918 - RNA, 13 nt, Mycobacterium avium subsp. paratuberculosis
cgcggggcggccg

SEQ ID NO: 915919 - RNA, 16 nt, Mycobacterium avium subsp. paratuberculosis
cgcggggcggccgccg

SEQ ID NO: 915920 - RNA, 18 nt, Mycobacterium avium subsp. paratuberculosis
cgcggggcggccgccggg

SEQ ID NO: 915921 - RNA, 19 nt, Mycobacterium avium subsp. paratuberculosis
cgcggggcggccgccgggc

SEQ ID NO: 915922 - RNA, 13 nt, Mycobacterium avium subsp. paratuberculosis
cgcggugggcucg

SEQ ID NO: 915923 - RNA, 15 nt, Mycobacterium avium subsp. paratuberculosis
cgcggugggcucggc

SEQ ID NO: 915924 - RNA, 16 nt, Mycobacterium avium subsp. paratuberculosis
cgcggugggcucggcg

SEQ ID NO: 915925 - RNA, 17 nt, Mycobacterium avium subsp. paratuberculosis
cgcggugggcucggcgc

SEQ ID NO: 915926 - RNA, 20 nt, Mycobacterium avium subsp. paratuberculosis
cgcggugggcucggcgccga

SEQ ID NO: 915927 - RNA, 22 nt, Mycobacterium avium subsp. paratuberculosis
cgcggugggcucggcgccgacc

SEQ ID NO: 915928 - RNA, 19 nt, Mycobacterium avium subsp. paratuberculosis
cgcggugggcucgucgaac

SEQ ID NO: 915929 - RNA, 14 nt, Mycobacterium avium subsp. paratuberculosis
cgcgguggccggga

SEQ ID NO: 915930 - RNA, 15 nt, Mycobacterium avium subsp. paratuberculosis
cgcgguggccgggau

SEQ ID NO: 915931 - RNA, 14 nt, Mycobacterium avium subsp. paratuberculosis
cgcgguggcgcccg

SEQ ID NO: 915932 - RNA, 20 nt, Mycobacterium avium subsp. paratuberculosis
cgcgguggcgccgcgggcgg

SEQ ID NO: 915933 - RNA, 14 nt, Mycobacterium avium subsp. paratuberculosis
cgcgguggcggugc

SEQ ID NO: 915934 - RNA, 16 nt, Mycobacterium avium subsp. paratuberculosis
cgcgguggcggugcgg

SEQ ID NO: 915935 - RNA, 16 nt, Mycobacterium avium subsp. paratuberculosis
cgcgguggcgugcagc

SEQ ID NO: 915936 - RNA, 19 nt, Mycobacterium avium subsp. paratuberculosis
cgcgguggcgugcagcgcg

SEQ ID NO: 915937 - RNA, 19 nt, Mycobacterium avium subsp. paratuberculosis
cgcgguggcuuccagcccg

SEQ ID NO: 915938 - RNA, 15 nt, Mycobacterium avium subsp. paratuberculosis
cgcggugggcaccag

SEQ ID NO: 915939 - RNA, 19 nt, Mycobacterium avium subsp. paratuberculosis
cgcggugggcaccagcagc

SEQ ID NO: 915940 - RNA, 21 nt, Mycobacterium avium subsp. paratuberculosis
cgcggugggcaccagcagcgc

SEQ ID NO: 915941 - RNA, 23 nt, Mycobacterium avium subsp. paratuberculosis
cgcggugggcaccagcagcgcga

SEQ ID NO: 915942 - RNA, 12 nt, Mycobacterium avium subsp. paratuberculosis
cgcggugcggcc

SEQ ID NO: 915943 - RNA, 17 nt, Mycobacterium avium subsp. paratuberculosis
cgcggugcucgcccugg

SEQ ID NO: 915944 - RNA, 13 nt, Mycobacterium avium subsp. paratuberculosis
cgcggugcucggc

SEQ ID NO: 915945 - RNA, 13 nt, Mycobacterium avium subsp. paratuberculosis
cgcgguggagcac

SEQ ID NO: 915946 - RNA, 15 nt, Mycobacterium avium subsp. paratuberculosis
cgcgguggagcacag

SEQ ID NO: 915947 - RNA, 23 nt, Mycobacterium avium subsp. paratuberculosis
cgcgguggagcacagcacggcau

SEQ ID NO: 915948 - RNA, 14 nt, Mycobacterium avium subsp. paratuberculosis
cgcggugcucggcg

SEQ ID NO: 915949 - RNA, 15 nt, Mycobacterium avium subsp. paratuberculosis
cgcggugcucggcgc

SEQ ID NO: 915950 - RNA, 16 nt, Mycobacterium avium subsp. paratuberculosis
cgcggugcucggcgcg

SEQ ID NO: 915951 - RNA, 17 nt, Mycobacterium avium subsp. paratuberculosis
cgcggugcucggcgcgc

SEQ ID NO: 915952 - RNA, 18 nt, Mycobacterium avium subsp. paratuberculosis
cgcggugcucggcgcgcg

SEQ ID NO: 915953 - RNA, 22 nt, Mycobacterium avium subsp. paratuberculosis
cgcggugcugcagauccgcucg

SEQ ID NO: 915954 - RNA, 14 nt, Mycobacterium avium subsp. paratuberculosis
cgcggugcugcagc

SEQ ID NO: 915955 - RNA, 18 nt, Mycobacterium avium subsp. paratuberculosis
cgcggugcugcagcgcga

SEQ ID NO: 915956 - RNA, 18 nt, Mycobacterium avium subsp. paratuberculosis
cgcgguggaacccagcac

SEQ ID NO: 915957 - RNA, 20 nt, Mycobacterium avium subsp. paratuberculosis
cgcggugcggcccgcggcau

SEQ ID NO: 915958 - RNA, 22 nt, Mycobacterium avium subsp. paratuberculosis
cgcggugcggcccgcggcaucg

SEQ ID NO: 915959 - RNA, 17 nt, Mycobacterium avium subsp. paratuberculosis
cgcggugcggggccgcg

SEQ ID NO: 915960 - RNA, 19 nt, Mycobacterium avium subsp. paratuberculosis
cgcggugcggggccgcggc

SEQ ID NO: 915961 - RNA, 21 nt, Mycobacterium avium subsp. paratuberculosis
cgcggugcggggccgcggccg

SEQ ID NO: 915962 - RNA, 23 nt, Mycobacterium avium subsp. paratuberculosis
cgcggugcggggccgcggccggc

SEQ ID NO: 915963 - RNA, 21 nt, Mycobacterium avium subsp. paratuberculosis
cgcggugcgccagcgccgggu

SEQ ID NO: 915964 - RNA, 13 nt, Mycobacterium avium subsp. paratuberculosis
cgcggugcgccga

SEQ ID NO: 915965 - RNA, 17 nt, Mycobacterium avium subsp. paratuberculosis
cgcggugcgccgacagc

SEQ ID NO: 915966 - RNA, 21 nt, Mycobacterium avium subsp. paratuberculosis
cgcggugcgcgcgcgcucggc

SEQ ID NO: 915967 - RNA, 22 nt, Mycobacterium avium subsp. paratuberculosis
cgcggugcgcgcgcgcucggcg

SEQ ID NO: 915968 - RNA, 14 nt, Mycobacterium avium subsp. paratuberculosis
cgcggugccgaccu

SEQ ID NO: 915969 - RNA, 17 nt, Mycobacterium avium subsp. paratuberculosis
cgcggugccgcagcucg

SEQ ID NO: 915970 - RNA, 21 nt, Mycobacterium avium subsp. paratuberculosis
cgcggugauguugucgaacag

SEQ ID NO: 915971 - RNA, 20 nt, Mycobacterium avium subsp. paratuberculosis
cgcggugcaacgccgccgac

SEQ ID NO: 915972 - RNA, 13 nt, Mycobacterium avium subsp. paratuberculosis
cgcggugcaccag

SEQ ID NO: 915973 - RNA, 14 nt, Mycobacterium avium subsp. paratuberculosis
cgcggugcaccagg

SEQ ID NO: 915974 - RNA, 20 nt, Mycobacterium avium subsp. paratuberculosis
cgcggugcaccaggacgcga

SEQ ID NO: 915975 - RNA, 23 nt, Mycobacterium avium subsp. paratuberculosis
cgcggugcacggucagcucgcgc

SEQ ID NO: 915976 - RNA, 14 nt, Mycobacterium avium subsp. paratuberculosis
cgcggugcagacgu

SEQ ID NO: 915977 - RNA, 19 nt, Mycobacterium avium subsp. paratuberculosis
cgcggugcagacgugacgu

SEQ ID NO: 915978 - RNA, 14 nt, Mycobacterium avium subsp. paratuberculosis
cgcggugcccagcc

SEQ ID NO: 915979 - RNA, 17 nt, Mycobacterium avium subsp. paratuberculosis
cgcggugcccagccagg

SEQ ID NO: 915980 - RNA, 19 nt, Mycobacterium avium subsp. paratuberculosis
cgcggugcccagccaggcc

SEQ ID NO: 915981 - RNA, 21 nt, Mycobacterium avium subsp. paratuberculosis
cgcggugcccagccgcaggug

SEQ ID NO: 915982 - RNA, 19 nt, Mycobacterium avium subsp. paratuberculosis
cgcggugcccggaacggcg

SEQ ID NO: 915983 - RNA, 14 nt, Mycobacterium avium subsp. paratuberculosis
cgcggucgccgccc

SEQ ID NO: 915984 - RNA, 16 nt, Mycobacterium avium subsp. paratuberculosis
cgcggucgcggcgccg

SEQ ID NO: 915985 - RNA, 18 nt, Mycobacterium avium subsp. paratuberculosis
cgcggucgcggcgccggu

SEQ ID NO: 915986 - RNA, 13 nt, Mycobacterium avium subsp. paratuberculosis
cgcggucgcugac

SEQ ID NO: 915987 - RNA, 18 nt, Mycobacterium avium subsp. paratuberculosis
cgcggucgcugacccgcc

SEQ ID NO: 915988 - RNA, 19 nt, Mycobacterium avium subsp. paratuberculosis
cgcgggcgauuucgucggc

SEQ ID NO: 915989 - RNA, 23 nt, Mycobacterium avium subsp. paratuberculosis
cgcgggcgauuucgucggcggug

SEQ ID NO: 915990 - RNA, 21 nt, Mycobacterium avium subsp. paratuberculosis
cgcgggcgaucuccagcggcc

SEQ ID NO: 915991 - RNA, 22 nt, Mycobacterium avium subsp. paratuberculosis
cgcgggcgaucuccagcggccg

SEQ ID NO: 915992 - RNA, 19 nt, Mycobacterium avium subsp. paratuberculosis
cgcgggcgaugcggcccgg

SEQ ID NO: 915993 - RNA, 13 nt, Mycobacterium avium subsp. paratuberculosis
cgcgggcgcccgu

SEQ ID NO: 915994 - RNA, 13 nt, Mycobacterium avium subsp. paratuberculosis
cgcgggcgccgag

SEQ ID NO: 915995 - RNA, 15 nt, Mycobacterium avium subsp. paratuberculosis
cgcgggcgaaaucuc

SEQ ID NO: 915996 - RNA, 19 nt, Mycobacterium avium subsp. paratuberculosis
cgcgggcgacccgcuggaa

SEQ ID NO: 915997 - RNA, 15 nt, Mycobacterium avium subsp. paratuberculosis
cgcgggcgaccuggu

SEQ ID NO: 915998 - RNA, 13 nt, Mycobacterium avium subsp. paratuberculosis
cgcgggcgagcag

SEQ ID NO: 915999 - RNA, 14 nt, Mycobacterium avium subsp. paratuberculosis
cgcgggcgagcagc

SEQ ID NO: 916000 - RNA, 20 nt, Mycobacterium avium subsp. paratuberculosis
cgcgggcgagcagcgcccgg

SEQ ID NO: 916001 - RNA, 22 nt, Mycobacterium avium subsp. paratuberculosis
cgcgggcgagcagcgcccgggu

SEQ ID NO: 916002 - RNA, 13 nt, Mycobacterium avium subsp. paratuberculosis
cgcgggcgagccg

SEQ ID NO: 916003 - RNA, 15 nt, Mycobacterium avium subsp. paratuberculosis
cgcgggcgcgcgccg

SEQ ID NO: 916004 - RNA, 17 nt, Mycobacterium avium subsp. paratuberculosis
cgcgggcgcgcgccgcc

SEQ ID NO: 916005 - RNA, 13 nt, Mycobacterium avium subsp. paratuberculosis
cgcgggcgcggac

SEQ ID NO: 916006 - RNA, 16 nt, Mycobacterium avium subsp. paratuberculosis
cgcgggcgcggacagc

SEQ ID NO: 916007 - RNA, 13 nt, Mycobacterium avium subsp. paratuberculosis
cgcgggcgcgccg

SEQ ID NO: 916008 - RNA, 14 nt, Mycobacterium avium subsp. paratuberculosis
cgcgggcgcgccgu

SEQ ID NO: 916009 - RNA, 16 nt, Mycobacterium avium subsp. paratuberculosis
cgcgggcgcgccgucc

SEQ ID NO: 916010 - RNA, 17 nt, Mycobacterium avium subsp. paratuberculosis
cgcgggcgcgccguccc

SEQ ID NO: 916011 - RNA, 22 nt, Mycobacterium avium subsp. paratuberculosis
cgcgggcgcgccgucccagccg

SEQ ID NO: 916012 - RNA, 12 nt, Mycobacterium avium subsp. paratuberculosis
cgcgggcgcgcg

SEQ ID NO: 916013 - RNA, 14 nt, Mycobacterium avium subsp. paratuberculosis
cgcgggcggcaggu

SEQ ID NO: 916014 - RNA, 21 nt, Mycobacterium avium subsp. paratuberculosis
cgcgggcggcaggucggcggg

SEQ ID NO: 916015 - RNA, 14 nt, Mycobacterium avium subsp. paratuberculosis
cgcgggcggcgcag

SEQ ID NO: 916016 - RNA, 22 nt, Mycobacterium avium subsp. paratuberculosis
cgcgggcggcgcagucggccgg

SEQ ID NO: 916017 - RNA, 22 nt, Mycobacterium avium subsp. paratuberculosis
cgcgggccugggcaauggccgc

SEQ ID NO: 916018 - RNA, 17 nt, Mycobacterium avium subsp. paratuberculosis
cgcgggccugcucgucg

SEQ ID NO: 916019 - RNA, 15 nt, Mycobacterium avium subsp. paratuberculosis
cgcgggccggcaccc

SEQ ID NO: 916020 - RNA, 14 nt, Mycobacterium avium subsp. paratuberculosis
cgcgggccgcagcg

SEQ ID NO: 916021 - RNA, 21 nt, Mycobacterium avium subsp. paratuberculosis
cgcgggccgcagcgcgcgggu

SEQ ID NO: 916022 - RNA, 12 nt, Mycobacterium avium subsp. paratuberculosis
cgcgggccgcgu

SEQ ID NO: 916023 - RNA, 15 nt, Mycobacterium avium subsp. paratuberculosis
cgcgggcccgggcca

SEQ ID NO: 916024 - RNA, 13 nt, Mycobacterium avium subsp. paratuberculosis
cgcgggccacagc

SEQ ID NO: 916025 - RNA, 20 nt, Mycobacterium avium subsp. paratuberculosis
cgcgggccacagcggcgaca

SEQ ID NO: 916026 - RNA, 23 nt, Mycobacterium avium subsp. paratuberculosis
cgcgggccacagcggcgacagcg

SEQ ID NO: 916027 - RNA, 20 nt, Mycobacterium avium subsp. paratuberculosis
cgcgggccaccgcggcguug

SEQ ID NO: 916028 - RNA, 20 nt, Mycobacterium avium subsp. paratuberculosis
cgcgggcccgcgcggcggug

SEQ ID NO: 916029 - RNA, 14 nt, Mycobacterium avium subsp. paratuberculosis
cgcgggcccaccgc

SEQ ID NO: 916030 - RNA, 19 nt, Mycobacterium avium subsp. paratuberculosis
cgcgggcccaccgccacca

SEQ ID NO: 916031 - RNA, 20 nt, Mycobacterium avium subsp. paratuberculosis
cgcgggcccaccgccaccag

SEQ ID NO: 916032 - RNA, 22 nt, Mycobacterium avium subsp. paratuberculosis
cgcgggcccgccguagcgccgg

SEQ ID NO: 916033 - RNA, 14 nt, Mycobacterium avium subsp. paratuberculosis
cgcgggcccgcgcg

SEQ ID NO: 916034 - RNA, 16 nt, Mycobacterium avium subsp. paratuberculosis
cgcgggcccgcgcggc

SEQ ID NO: 916035 - RNA, 17 nt, Mycobacterium avium subsp. paratuberculosis
cgcgggcccgcgcggcg

SEQ ID NO: 916036 - RNA, 12 nt, Mycobacterium avium subsp. paratuberculosis
cgcgggccagac

SEQ ID NO: 916037 - RNA, 21 nt, Mycobacterium avium subsp. paratuberculosis
cgcgggccagacugcgcaccg

SEQ ID NO: 916038 - RNA, 13 nt, Mycobacterium avium subsp. paratuberculosis
cgcgggccagcag

SEQ ID NO: 916039 - RNA, 14 nt, Mycobacterium avium subsp. paratuberculosis
cgcgggccagcagc

SEQ ID NO: 916040 - RNA, 16 nt, Mycobacterium avium subsp. paratuberculosis
cgcgggccagcagccg

SEQ ID NO: 916041 - RNA, 13 nt, Mycobacterium avium subsp. paratuberculosis
cgcgggccagcca

SEQ ID NO: 916042 - RNA, 14 nt, Mycobacterium avium subsp. paratuberculosis
cgcgggccagcgcc

SEQ ID NO: 916043 - RNA, 13 nt, Mycobacterium avium subsp. paratuberculosis
cgcgggccagcgu

SEQ ID NO: 916044 - RNA, 21 nt, Mycobacterium avium subsp. paratuberculosis
cgcgggcaugaaccaggccgc

SEQ ID NO: 916045 - RNA, 23 nt, Mycobacterium avium subsp. paratuberculosis
cgcgggcagggggacgaaccagu

SEQ ID NO: 916046 - RNA, 16 nt, Mycobacterium avium subsp. paratuberculosis
cgcgggcaucgccguc

SEQ ID NO: 916047 - RNA, 22 nt, Mycobacterium avium subsp. paratuberculosis
cgcgggcaucgccgucauggug

SEQ ID NO: 916048 - RNA, 13 nt, Mycobacterium avium subsp. paratuberculosis
cgcgggcagccgg

SEQ ID NO: 916049 - RNA, 14 nt, Mycobacterium avium subsp. paratuberculosis
cgcgggcagcgagc

SEQ ID NO: 916050 - RNA, 12 nt, Mycobacterium avium subsp. paratuberculosis
cgcgggcagcag

SEQ ID NO: 916051 - RNA, 19 nt, Mycobacterium avium subsp. paratuberculosis
cgcgggcagcagcuuggcg

SEQ ID NO: 916052 - RNA, 14 nt, Mycobacterium avium subsp. paratuberculosis
cgcgggcaccgucg

SEQ ID NO: 916053 - RNA, 15 nt, Mycobacterium avium subsp. paratuberculosis
cgcgggcaccgucgu

SEQ ID NO: 916054 - RNA, 18 nt, Mycobacterium avium subsp. paratuberculosis
cgcgggcaccgucgucgc

SEQ ID NO: 916055 - RNA, 20 nt, Mycobacterium avium subsp. paratuberculosis
cgcgggcaccgucgucgcac

SEQ ID NO: 916056 - RNA, 23 nt, Mycobacterium avium subsp. paratuberculosis
cgcgggcaccgucgucgcaccgg

SEQ ID NO: 916057 - RNA, 16 nt, Mycobacterium avium subsp. paratuberculosis
cgcgggcaaucgcugc

SEQ ID NO: 916058 - RNA, 18 nt, Mycobacterium avium subsp. paratuberculosis
cgcgggcaaucgcugcgc

SEQ ID NO: 916059 - RNA, 21 nt, Mycobacterium avium subsp. paratuberculosis
cgcgggcaaucgcugcgcccg

SEQ ID NO: 916060 - RNA, 13 nt, Mycobacterium avium subsp. paratuberculosis
cgcgggacggcgg

SEQ ID NO: 916061 - RNA, 15 nt, Mycobacterium avium subsp. paratuberculosis
cgcgggacggcggcg

SEQ ID NO: 916062 - RNA, 16 nt, Mycobacterium avium subsp. paratuberculosis
cgcgggacggcggcga

SEQ ID NO: 916063 - RNA, 18 nt, Mycobacterium avium subsp. paratuberculosis
cgcgggaguccacgccgu

SEQ ID NO: 916064 - RNA, 16 nt, Mycobacterium avium subsp. paratuberculosis
cgcgggaguggccggc

SEQ ID NO: 916065 - RNA, 19 nt, Mycobacterium avium subsp. paratuberculosis
cgcgggaguggccggcguc

SEQ ID NO: 916066 - RNA, 23 nt, Mycobacterium avium subsp. paratuberculosis
cgcgggaguggccggcguccagg

SEQ ID NO: 916067 - RNA, 17 nt, Mycobacterium avium subsp. paratuberculosis
cgcgggaucggccggcg

SEQ ID NO: 916068 - RNA, 23 nt, Mycobacterium avium subsp. paratuberculosis
cgcgggaucggugccgacggugc

SEQ ID NO: 916069 - RNA, 16 nt, Mycobacterium avium subsp. paratuberculosis
cgcgggauugccgagc

SEQ ID NO: 916070 - RNA, 17 nt, Mycobacterium avium subsp. paratuberculosis
cgcgggauugccgagca

SEQ ID NO: 916071 - RNA, 15 nt, Mycobacterium avium subsp. paratuberculosis
cgcgggaacgaucgg

SEQ ID NO: 916072 - RNA, 16 nt, Mycobacterium avium subsp. paratuberculosis
cgcgggaaucccaccc

SEQ ID NO: 916073 - RNA, 17 nt, Mycobacterium avium subsp. paratuberculosis
cgcgggaauggccgcgc

SEQ ID NO: 916074 - RNA, 22 nt, Mycobacterium avium subsp. paratuberculosis
cgcgggaauggccgcgccguag

SEQ ID NO: 916075 - RNA, 19 nt, Mycobacterium avium subsp. paratuberculosis
cgcgggaauuggcaccgga

SEQ ID NO: 916076 - RNA, 12 nt, Mycobacterium avium subsp. paratuberculosis
cgcgggacacgg

SEQ ID NO: 916077 - RNA, 13 nt, Mycobacterium avium subsp. paratuberculosis
cgcgggacacggc

SEQ ID NO: 916078 - RNA, 18 nt, Mycobacterium avium subsp. paratuberculosis
cgcgggacacggcggcgc

SEQ ID NO: 916079 - RNA, 16 nt, Mycobacterium avium subsp. paratuberculosis
cgcgggaccgggcccg

SEQ ID NO: 916080 - RNA, 19 nt, Mycobacterium avium subsp. paratuberculosis
cgcgggaccgggcccggcg

SEQ ID NO: 916081 - RNA, 15 nt, Mycobacterium avium subsp. paratuberculosis
cgcgggaagccgccg

SEQ ID NO: 916082 - RNA, 13 nt, Mycobacterium avium subsp. paratuberculosis
cgcgggagcgcug

SEQ ID NO: 916083 - RNA, 14 nt, Mycobacterium avium subsp. paratuberculosis
cgcgggagcgcugg

SEQ ID NO: 916084 - RNA, 17 nt, Mycobacterium avium subsp. paratuberculosis
cgcgggagcgcuggucg

SEQ ID NO: 916085 - RNA, 20 nt, Mycobacterium avium subsp. paratuberculosis
cgcgggagcgcuggucggcg

SEQ ID NO: 916086 - RNA, 21 nt, Mycobacterium avium subsp. paratuberculosis
cgcgggagcgcuggucggcga

SEQ ID NO: 916087 - RNA, 19 nt, Mycobacterium avium subsp. paratuberculosis
cgcgggaggacagcgcggu

SEQ ID NO: 916088 - RNA, 19 nt, Mycobacterium avium subsp. paratuberculosis
cgcggcuugcugcgguagg

SEQ ID NO: 916089 - RNA, 15 nt, Mycobacterium avium subsp. paratuberculosis
cgcggcuuggccacc

SEQ ID NO: 916090 - RNA, 18 nt, Mycobacterium avium subsp. paratuberculosis
cgcggcuuggccaccacc

SEQ ID NO: 916091 - RNA, 22 nt, Mycobacterium avium subsp. paratuberculosis
cgcggcuuggccaccaccacgg

SEQ ID NO: 916092 - RNA, 20 nt, Mycobacterium avium subsp. paratuberculosis
cgcggcuucauaugacgccg

SEQ ID NO: 916093 - RNA, 21 nt, Mycobacterium avium subsp. paratuberculosis
cgcggcuggugccgccggcga

SEQ ID NO: 916094 - RNA, 22 nt, Mycobacterium avium subsp. paratuberculosis
cgcggcuggugccgccggcgau

SEQ ID NO: 916095 - RNA, 23 nt, Mycobacterium avium subsp. paratuberculosis
cgcggcuggugccgccggcgauc

SEQ ID NO: 916096 - RNA, 20 nt, Mycobacterium avium subsp. paratuberculosis
cgcggcucgauggacgccag

SEQ ID NO: 916097 - RNA, 16 nt, Mycobacterium avium subsp. paratuberculosis
cgcggcuggcccggcg

SEQ ID NO: 916098 - RNA, 17 nt, Mycobacterium avium subsp. paratuberculosis
cgcggcuggcccggcgc

SEQ ID NO: 916099 - RNA, 12 nt, Mycobacterium avium subsp. paratuberculosis
cgcggcuggccg

SEQ ID NO: 916100 - RNA, 13 nt, Mycobacterium avium subsp. paratuberculosis
cgcggcuggccgc

SEQ ID NO: 916101 - RNA, 15 nt, Mycobacterium avium subsp. paratuberculosis
cgcggcuggccgcgg

SEQ ID NO: 916102 - RNA, 18 nt, Mycobacterium avium subsp. paratuberculosis
cgcggcuggccgcggcga

SEQ ID NO: 916103 - RNA, 14 nt, Mycobacterium avium subsp. paratuberculosis
cgcggcuggccguc

SEQ ID NO: 916104 - RNA, 17 nt, Mycobacterium avium subsp. paratuberculosis
cgcggcugcucgaaccg

SEQ ID NO: 916105 - RNA, 15 nt, Mycobacterium avium subsp. paratuberculosis
cgcggcugcgcacgu

SEQ ID NO: 916106 - RNA, 17 nt, Mycobacterium avium subsp. paratuberculosis
cgcggcugcgcacguag

SEQ ID NO: 916107 - RNA, 13 nt, Mycobacterium avium subsp. paratuberculosis
cgcggcugccggu

SEQ ID NO: 916108 - RNA, 14 nt, Mycobacterium avium subsp. paratuberculosis
cgcggcugccggug

SEQ ID NO: 916109 - RNA, 14 nt, Mycobacterium avium subsp. paratuberculosis
cgcgcccggcaccg

SEQ ID NO: 916110 - RNA, 15 nt, Mycobacterium avium subsp. paratuberculosis
cgcgcccggcaccgc

SEQ ID NO: 916111 - RNA, 16 nt, Mycobacterium avium subsp. paratuberculosis
cgcgcccggcaccgcg

SEQ ID NO: 916112 - RNA, 22 nt, Mycobacterium avium subsp. paratuberculosis
cgcgcccggcaccgcggcggug

SEQ ID NO: 916113 - RNA, 11 nt, Mycobacterium avium subsp. paratuberculosis
cgcgcccggcg

SEQ ID NO: 916114 - RNA, 13 nt, Mycobacterium avium subsp. paratuberculosis
cgcgcccggcgac

SEQ ID NO: 916115 - RNA, 15 nt, Mycobacterium avium subsp. paratuberculosis
cgcgcccggcgacgc

SEQ ID NO: 916116 - RNA, 16 nt, Mycobacterium avium subsp. paratuberculosis
cgcgcccggcgacgcg

SEQ ID NO: 916117 - RNA, 17 nt, Mycobacterium avium subsp. paratuberculosis
cgcgcccggcgacgcgg

SEQ ID NO: 916118 - RNA, 19 nt, Mycobacterium avium subsp. paratuberculosis
cgcgcccggcgacgcggcg

SEQ ID NO: 916119 - RNA, 21 nt, Mycobacterium avium subsp. paratuberculosis
cgcgcccggcgacgcggcggg

SEQ ID NO: 916120 - RNA, 21 nt, Mycobacterium avium subsp. paratuberculosis
cgcgccgacgcccacagcgcc

SEQ ID NO: 916121 - RNA, 22 nt, Mycobacterium avium subsp. paratuberculosis
cgcgccgacgcccacagcgcca

SEQ ID NO: 916122 - RNA, 13 nt, Mycobacterium avium subsp. paratuberculosis
cgcgccgacccgc

SEQ ID NO: 916123 - RNA, 19 nt, Mycobacterium avium subsp. paratuberculosis
cgcgccgacccgcccgccg

SEQ ID NO: 916124 - RNA, 13 nt, Mycobacterium avium subsp. paratuberculosis
cgcgccgaccgcg

SEQ ID NO: 916125 - RNA, 14 nt, Mycobacterium avium subsp. paratuberculosis
cgcgccgaccgcga

SEQ ID NO: 916126 - RNA, 15 nt, Mycobacterium avium subsp. paratuberculosis
cgcgccgaccgcgag

SEQ ID NO: 916127 - RNA, 20 nt, Mycobacterium avium subsp. paratuberculosis
cgcgccgaccgcgagcacga

SEQ ID NO: 916128 - RNA, 22 nt, Mycobacterium avium subsp. paratuberculosis
cgcgccgaccucgucggcggug

SEQ ID NO: 916129 - RNA, 13 nt, Mycobacterium avium subsp. paratuberculosis
cgcgccgaccagc

SEQ ID NO: 916130 - RNA, 14 nt, Mycobacterium avium subsp. paratuberculosis
cgcgccgaccagcg

SEQ ID NO: 916131 - RNA, 16 nt, Mycobacterium avium subsp. paratuberculosis
cgcgccgaccagcgcg

SEQ ID NO: 916132 - RNA, 17 nt, Mycobacterium avium subsp. paratuberculosis
cgcgccgaccagcgcgu

SEQ ID NO: 916133 - RNA, 23 nt, Mycobacterium avium subsp. paratuberculosis
cgcgcccggaaagcgcgggcagc

SEQ ID NO: 916134 - RNA, 13 nt, Mycobacterium avium subsp. paratuberculosis
cgcgcccgcggcc

SEQ ID NO: 916135 - RNA, 16 nt, Mycobacterium avium subsp. paratuberculosis
cgcgcccgcggccauc

SEQ ID NO: 916136 - RNA, 18 nt, Mycobacterium avium subsp. paratuberculosis
cgcgcccgcggccaucgc

SEQ ID NO: 916137 - RNA, 15 nt, Mycobacterium avium subsp. paratuberculosis
cgcgcccgccaucug

SEQ ID NO: 916138 - RNA, 13 nt, Mycobacterium avium subsp. paratuberculosis
cgcgcccgccgcg

SEQ ID NO: 916139 - RNA, 23 nt, Mycobacterium avium subsp. paratuberculosis
cgcgcccgagucacccggcuggc

SEQ ID NO: 916140 - RNA, 14 nt, Mycobacterium avium subsp. paratuberculosis
cgcgcccgacgaug

SEQ ID NO: 916141 - RNA, 18 nt, Mycobacterium avium subsp. paratuberculosis
cgcgcccgacggucgcca

SEQ ID NO: 916142 - RNA, 15 nt, Mycobacterium avium subsp. paratuberculosis
cgcgccccggcgcag

SEQ ID NO: 916143 - RNA, 19 nt, Mycobacterium avium subsp. paratuberculosis
cgcgccccggcgcagcgcc

SEQ ID NO: 916144 - RNA, 17 nt, Mycobacterium avium subsp. paratuberculosis
cgcgccccggcgcgccu

SEQ ID NO: 916145 - RNA, 13 nt, Mycobacterium avium subsp. paratuberculosis
cgcgccccggcgg

SEQ ID NO: 916146 - RNA, 14 nt, Mycobacterium avium subsp. paratuberculosis
cgcgccccggcggc

SEQ ID NO: 916147 - RNA, 15 nt, Mycobacterium avium subsp. paratuberculosis
cgcgccccggcggcc

SEQ ID NO: 916148 - RNA, 21 nt, Mycobacterium avium subsp. paratuberculosis
cgcgccccggucccgccggug

SEQ ID NO: 916149 - RNA, 22 nt, Mycobacterium avium subsp. paratuberculosis
cgcgccccggucccgccgguga

SEQ ID NO: 916150 - RNA, 23 nt, Mycobacterium avium subsp. paratuberculosis
cgcgccccggcccguccagaucg

SEQ ID NO: 916151 - RNA, 15 nt, Mycobacterium avium subsp. paratuberculosis
cgcgcccccugggac

SEQ ID NO: 916152 - RNA, 22 nt, Mycobacterium avium subsp. paratuberculosis
cgcgcccccugggacagcgaga

SEQ ID NO: 916153 - RNA, 19 nt, Mycobacterium avium subsp. paratuberculosis
cgcgccccgagcagcgggu

SEQ ID NO: 916154 - RNA, 19 nt, Mycobacterium avium subsp. paratuberculosis
cgcgcaacucguccaccag

SEQ ID NO: 916155 - RNA, 18 nt, Mycobacterium avium subsp. paratuberculosis
cgcgcccaucgcggccgc

SEQ ID NO: 916156 - RNA, 16 nt, Mycobacterium avium subsp. paratuberculosis
cgcgcaaccgggccgc

SEQ ID NO: 916157 - RNA, 19 nt, Mycobacterium avium subsp. paratuberculosis
cgcgcaaccgggccgcacc

SEQ ID NO: 916158 - RNA, 19 nt, Mycobacterium avium subsp. paratuberculosis
cgcgcaacgaggcgguggu

SEQ ID NO: 916159 - RNA, 13 nt, Mycobacterium avium subsp. paratuberculosis
cgcgccgacgacc

SEQ ID NO: 916160 - RNA, 15 nt, Mycobacterium avium subsp. paratuberculosis
cgcgccgacggccgc

SEQ ID NO: 916161 - RNA, 17 nt, Mycobacterium avium subsp. paratuberculosis
cgcgccgacggccgcgc

SEQ ID NO: 916162 - RNA, 17 nt, Mycobacterium avium subsp. paratuberculosis
cgcgccgaggcgcucgg

SEQ ID NO: 916163 - RNA, 20 nt, Mycobacterium avium subsp. paratuberculosis
cgcgccgagguggcccgcca

SEQ ID NO: 916164 - RNA, 15 nt, Mycobacterium avium subsp. paratuberculosis
cgcgccgagcaaccg

SEQ ID NO: 916165 - RNA, 17 nt, Mycobacterium avium subsp. paratuberculosis
cgcgccgagcaaccggg

SEQ ID NO: 916166 - RNA, 13 nt, Mycobacterium avium subsp. paratuberculosis
cgcgccgcccgga

SEQ ID NO: 916167 - RNA, 14 nt, Mycobacterium avium subsp. paratuberculosis
cgcgccgcccggag

SEQ ID NO: 916168 - RNA, 13 nt, Mycobacterium avium subsp. paratuberculosis
cgcgccgcccggc

SEQ ID NO: 916169 - RNA, 14 nt, Mycobacterium avium subsp. paratuberculosis
cgcgccgcccggcg

SEQ ID NO: 916170 - RNA, 14 nt, Mycobacterium avium subsp. paratuberculosis
cgcgccgaucacga

SEQ ID NO: 916171 - RNA, 17 nt, Mycobacterium avium subsp. paratuberculosis
cgcgccgaucacgaaca

SEQ ID NO: 916172 - RNA, 23 nt, Mycobacterium avium subsp. paratuberculosis
cgcgccgaggaacugcagcgacu

SEQ ID NO: 916173 - RNA, 21 nt, Mycobacterium avium subsp. paratuberculosis
cgcgccgaucugaccgagcag

SEQ ID NO: 916174 - RNA, 23 nt, Mycobacterium avium subsp. paratuberculosis
cgcgccgaucgagacgaugcggu

SEQ ID NO: 916175 - RNA, 15 nt, Mycobacterium avium subsp. paratuberculosis
cgcgccgaucgccca

SEQ ID NO: 916176 - RNA, 15 nt, Mycobacterium avium subsp. paratuberculosis
cgcgccgcgacgucg

SEQ ID NO: 916177 - RNA, 20 nt, Mycobacterium avium subsp. paratuberculosis
cgcgccgcgaucucggcgga

SEQ ID NO: 916178 - RNA, 15 nt, Mycobacterium avium subsp. paratuberculosis
cgcgccgcgaugcaa

SEQ ID NO: 916179 - RNA, 21 nt, Mycobacterium avium subsp. paratuberculosis
cgcgccgccgcccuggcccca

SEQ ID NO: 916180 - RNA, 13 nt, Mycobacterium avium subsp. paratuberculosis
cgcgccgccgccg

SEQ ID NO: 916181 - RNA, 21 nt, Mycobacterium avium subsp. paratuberculosis
cgcgccgccgccgcccacgcc

SEQ ID NO: 916182 - RNA, 14 nt, Mycobacterium avium subsp. paratuberculosis
cgcgccgccgacca

SEQ ID NO: 916183 - RNA, 12 nt, Mycobacterium avium subsp. paratuberculosis
cgcgccgccgcc

SEQ ID NO: 916184 - RNA, 15 nt, Mycobacterium avium subsp. paratuberculosis
cgcgccggucccgcg

SEQ ID NO: 916185 - RNA, 16 nt, Mycobacterium avium subsp. paratuberculosis
cgcgccggucccgcgg

SEQ ID NO: 916186 - RNA, 19 nt, Mycobacterium avium subsp. paratuberculosis
cgcgccggucccgcggcgg

SEQ ID NO: 916187 - RNA, 15 nt, Mycobacterium avium subsp. paratuberculosis
cgcgccgguccggcc

SEQ ID NO: 916188 - RNA, 18 nt, Mycobacterium avium subsp. paratuberculosis
cgcgccgguaaugggcga

SEQ ID NO: 916189 - RNA, 22 nt, Mycobacterium avium subsp. paratuberculosis
cgcgccgguaaugggcgaucga

SEQ ID NO: 916190 - RNA, 18 nt, Mycobacterium avium subsp. paratuberculosis
cgcgccgguaggcggcca

SEQ ID NO: 916191 - RNA, 20 nt, Mycobacterium avium subsp. paratuberculosis
cgcgccgguaggcggccagc

SEQ ID NO: 916192 - RNA, 22 nt, Mycobacterium avium subsp. paratuberculosis
cgcgccgguaggcggccagcgc

SEQ ID NO: 916193 - RNA, 23 nt, Mycobacterium avium subsp. paratuberculosis
cgcgccgguaggcggccagcgcc

SEQ ID NO: 916194 - RNA, 22 nt, Mycobacterium avium subsp. paratuberculosis
cgcgccgggguccucucggcgc

SEQ ID NO: 916195 - RNA, 12 nt, Mycobacterium avium subsp. paratuberculosis
cgcgccggggug

SEQ ID NO: 916196 - RNA, 18 nt, Mycobacterium avium subsp. paratuberculosis
cgcgccggggugggccau

SEQ ID NO: 916197 - RNA, 21 nt, Mycobacterium avium subsp. paratuberculosis
cgcgccgggaucacacgcgcg

SEQ ID NO: 916198 - RNA, 21 nt, Mycobacterium avium subsp. paratuberculosis
cgcgccgggcaacagcgcgcc

SEQ ID NO: 916199 - RNA, 17 nt, Mycobacterium avium subsp. paratuberculosis
cgcgccgggcaccacca

SEQ ID NO: 916200 - RNA, 18 nt, Mycobacterium avium subsp. paratuberculosis
cgcgccgggcaccaccac

SEQ ID NO: 916201 - RNA, 12 nt, Mycobacterium avium subsp. paratuberculosis
cgcgccgggcag

SEQ ID NO: 916202 - RNA, 19 nt, Mycobacterium avium subsp. paratuberculosis
cgcgccgggcagcccgccg

SEQ ID NO: 916203 - RNA, 13 nt, Mycobacterium avium subsp. paratuberculosis
cgcgccgggcgga

SEQ ID NO: 916204 - RNA, 15 nt, Mycobacterium avium subsp. paratuberculosis
cgcgccgggcggccu

SEQ ID NO: 916205 - RNA, 21 nt, Mycobacterium avium subsp. paratuberculosis
cgcgccgggcggccucggcgu

SEQ ID NO: 916206 - RNA, 21 nt, Mycobacterium avium subsp. paratuberculosis
cgcgccgggcguugcccgccg

SEQ ID NO: 916207 - RNA, 14 nt, Mycobacterium avium subsp. paratuberculosis
cgcgccggcgucgg

SEQ ID NO: 916208 - RNA, 12 nt, Mycobacterium avium subsp. paratuberculosis
cgcgccggcgug

SEQ ID NO: 916209 - RNA, 14 nt, Mycobacterium avium subsp. paratuberculosis
cgcgccggcguguc

SEQ ID NO: 916210 - RNA, 14 nt, Mycobacterium avium subsp. paratuberculosis
cgcgccgcgcgccc

SEQ ID NO: 916211 - RNA, 15 nt, Mycobacterium avium subsp. paratuberculosis
cgcgccgcgcgcccu

SEQ ID NO: 916212 - RNA, 15 nt, Mycobacterium avium subsp. paratuberculosis
cgcgccuugggccau

SEQ ID NO: 916213 - RNA, 19 nt, Mycobacterium avium subsp. paratuberculosis
cgcgccuugggccaucccg

SEQ ID NO: 916214 - RNA, 17 nt, Mycobacterium avium subsp. paratuberculosis
cgcgccuucuugcugcc

SEQ ID NO: 916215 - RNA, 22 nt, Mycobacterium avium subsp. paratuberculosis
cgcgccuucuugcugcccgcgg

SEQ ID NO: 916216 - RNA, 12 nt, Mycobacterium avium subsp. paratuberculosis
cgcgccuggcgc

SEQ ID NO: 916217 - RNA, 15 nt, Mycobacterium avium subsp. paratuberculosis
cgcgccugcgcggcg

SEQ ID NO: 916218 - RNA, 16 nt, Mycobacterium avium subsp. paratuberculosis
cgcgccugcgcggcgg

SEQ ID NO: 916219 - RNA, 19 nt, Mycobacterium avium subsp. paratuberculosis
cgcgccugcgcggcggcgu

SEQ ID NO: 916220 - RNA, 21 nt, Mycobacterium avium subsp. paratuberculosis
cgcgccugcgcggcggcgucc

SEQ ID NO: 916221 - RNA, 19 nt, Mycobacterium avium subsp. paratuberculosis
cgcgccucgcguacccggg

SEQ ID NO: 916222 - RNA, 20 nt, Mycobacterium avium subsp. paratuberculosis
cgcgccucgcguacccgggc

SEQ ID NO: 916223 - RNA, 22 nt, Mycobacterium avium subsp. paratuberculosis
cgcgccucgguucugcagcgag

SEQ ID NO: 916224 - RNA, 23 nt, Mycobacterium avium subsp. paratuberculosis
cgcgccucgguucugcagcgaga

SEQ ID NO: 916225 - RNA, 22 nt, Mycobacterium avium subsp. paratuberculosis
cgcgccgucggcguucagcggc

SEQ ID NO: 916226 - RNA, 23 nt, Mycobacterium avium subsp. paratuberculosis
cgcgccgucggcguucagcggca

SEQ ID NO: 916227 - RNA, 14 nt, Mycobacterium avium subsp. paratuberculosis
cgcgccgucgucga

SEQ ID NO: 916228 - RNA, 15 nt, Mycobacterium avium subsp. paratuberculosis
cgcgccgucgucgag

SEQ ID NO: 916229 - RNA, 14 nt, Mycobacterium avium subsp. paratuberculosis
cgcgccgucgucgg

SEQ ID NO: 916230 - RNA, 15 nt, Mycobacterium avium subsp. paratuberculosis
cgcgccgucgucgga

SEQ ID NO: 916231 - RNA, 15 nt, Mycobacterium avium subsp. paratuberculosis
cgcgccgucggccca

SEQ ID NO: 916232 - RNA, 16 nt, Mycobacterium avium subsp. paratuberculosis
cgcgccgucggcgaug

SEQ ID NO: 916233 - RNA, 17 nt, Mycobacterium avium subsp. paratuberculosis
cgcgccgucggcgaugc

SEQ ID NO: 916234 - RNA, 22 nt, Mycobacterium avium subsp. paratuberculosis
cgcgccgucggcgaugcggugg

SEQ ID NO: 916235 - RNA, 16 nt, Mycobacterium avium subsp. paratuberculosis
cgcgccguagcggccc

SEQ ID NO: 916236 - RNA, 18 nt, Mycobacterium avium subsp. paratuberculosis
cgcgccguagcggcccag

SEQ ID NO: 916237 - RNA, 19 nt, Mycobacterium avium subsp. paratuberculosis
cgcgccguagcggcccagg

SEQ ID NO: 916238 - RNA, 14 nt, Mycobacterium avium subsp. paratuberculosis
cgcgccgucccagc

SEQ ID NO: 916239 - RNA, 16 nt, Mycobacterium avium subsp. paratuberculosis
cgcgccgucccagccg

SEQ ID NO: 916240 - RNA, 20 nt, Mycobacterium avium subsp. paratuberculosis
cgcgccgguguucggcgcca

SEQ ID NO: 916241 - RNA, 21 nt, Mycobacterium avium subsp. paratuberculosis
cgcgccgguguucggcgccag

SEQ ID NO: 916242 - RNA, 16 nt, Mycobacterium avium subsp. paratuberculosis
cgcgccggugaccccg

SEQ ID NO: 916243 - RNA, 19 nt, Mycobacterium avium subsp. paratuberculosis
cgcgccggugaccccgucg

SEQ ID NO: 916244 - RNA, 13 nt, Mycobacterium avium subsp. paratuberculosis
cgcgcgcagcgcu

SEQ ID NO: 916245 - RNA, 12 nt, Mycobacterium avium subsp. paratuberculosis
cgcgcgcaggcc

SEQ ID NO: 916246 - RNA, 13 nt, Mycobacterium avium subsp. paratuberculosis
cgcgcgcaggccc

SEQ ID NO: 916247 - RNA, 21 nt, Mycobacterium avium subsp. paratuberculosis
cgcgcgcaggccccggcgcgc

SEQ ID NO: 916248 - RNA, 18 nt, Mycobacterium avium subsp. paratuberculosis
cgcgcgcaccacgugcgc

SEQ ID NO: 916249 - RNA, 23 nt, Mycobacterium avium subsp. paratuberculosis
cgcgcgcaccacgugcgcgaagc

SEQ ID NO: 916250 - RNA, 16 nt, Mycobacterium avium subsp. paratuberculosis
cgcgcgaugcgggcgc

SEQ ID NO: 916251 - RNA, 21 nt, Mycobacterium avium subsp. paratuberculosis
cgcgcgaugcgggcgccgaac

SEQ ID NO: 916252 - RNA, 12 nt, Mycobacterium avium subsp. paratuberculosis
cgcgcgaucgcc

SEQ ID NO: 916253 - RNA, 14 nt, Mycobacterium avium subsp. paratuberculosis
cgcgcgaucgccgg

SEQ ID NO: 916254 - RNA, 14 nt, Mycobacterium avium subsp. paratuberculosis
cgcgcgaucggcga

SEQ ID NO: 916255 - RNA, 16 nt, Mycobacterium avium subsp. paratuberculosis
cgcgcgaucggcgagc

SEQ ID NO: 916256 - RNA, 19 nt, Mycobacterium avium subsp. paratuberculosis
cgcgcgaucggcgagccgg

SEQ ID NO: 916257 - RNA, 20 nt, Mycobacterium avium subsp. paratuberculosis
cgcgcgaucggcgagccggg

SEQ ID NO: 916258 - RNA, 23 nt, Mycobacterium avium subsp. paratuberculosis
cgcgcgaucggcgagccgggacc

SEQ ID NO: 916259 - RNA, 15 nt, Mycobacterium avium subsp. paratuberculosis
cgcgcgaucgguguc

SEQ ID NO: 916260 - RNA, 18 nt, Mycobacterium avium subsp. paratuberculosis
cgcgcgaucuccgucacc

SEQ ID NO: 916261 - RNA, 22 nt, Mycobacterium avium subsp. paratuberculosis
cgcgcgaucuccgucaccgugg

SEQ ID NO: 916262 - RNA, 15 nt, Mycobacterium avium subsp. paratuberculosis
cgcgcgaucagcgcc

SEQ ID NO: 916263 - RNA, 16 nt, Mycobacterium avium subsp. paratuberculosis
cgcgcgaucagcgccg

SEQ ID NO: 916264 - RNA, 19 nt, Mycobacterium avium subsp. paratuberculosis
cgcgcgaucagcgccgucu

SEQ ID NO: 916265 - RNA, 14 nt, Mycobacterium avium subsp. paratuberculosis
cgcgcgaucaggcc

SEQ ID NO: 916266 - RNA, 17 nt, Mycobacterium avium subsp. paratuberculosis
cgcgcgaucaggccggc

SEQ ID NO: 916267 - RNA, 20 nt, Mycobacterium avium subsp. paratuberculosis
cgcgcgaucaggccggccac

SEQ ID NO: 916268 - RNA, 21 nt, Mycobacterium avium subsp. paratuberculosis
cgcgcgaucaggccggccacc

SEQ ID NO: 916269 - RNA, 22 nt, Mycobacterium avium subsp. paratuberculosis
cgcgcgaucaggccggccacca

SEQ ID NO: 916270 - RNA, 20 nt, Mycobacterium avium subsp. paratuberculosis
cgcgcgagccgaaacggugc

SEQ ID NO: 916271 - RNA, 20 nt, Mycobacterium avium subsp. paratuberculosis
cgcgcgagacaccucgucga

SEQ ID NO: 916272 - RNA, 20 nt, Mycobacterium avium subsp. paratuberculosis
cgcgcgagaguaucgccacg

SEQ ID NO: 916273 - RNA, 21 nt, Mycobacterium avium subsp. paratuberculosis
cgcgcgagaguaucgccacgc

SEQ ID NO: 916274 - RNA, 23 nt, Mycobacterium avium subsp. paratuberculosis
cgcgcgagaguaucgccacgccg

SEQ ID NO: 916275 - RNA, 15 nt, Mycobacterium avium subsp. paratuberculosis
cgcgcgagcagacgc

SEQ ID NO: 916276 - RNA, 15 nt, Mycobacterium avium subsp. paratuberculosis
cgcgcgacugggcgc

SEQ ID NO: 916277 - RNA, 21 nt, Mycobacterium avium subsp. paratuberculosis
cgcgcgacugggcgcccaccc

SEQ ID NO: 916278 - RNA, 13 nt, Mycobacterium avium subsp. paratuberculosis
cgcgcgacggcgc

SEQ ID NO: 916279 - RNA, 15 nt, Mycobacterium avium subsp. paratuberculosis
cgcgcgacaucaccg

SEQ ID NO: 916280 - RNA, 17 nt, Mycobacterium avium subsp. paratuberculosis
cgcgcgacaucaccgcg

SEQ ID NO: 916281 - RNA, 13 nt, Mycobacterium avium subsp. paratuberculosis
cgcgcgaccgcga

SEQ ID NO: 916282 - RNA, 15 nt, Mycobacterium avium subsp. paratuberculosis
cgcgcgaccgcgaug

SEQ ID NO: 916283 - RNA, 22 nt, Mycobacterium avium subsp. paratuberculosis
cgcgcgaccgcgaugcgacacc

SEQ ID NO: 916284 - RNA, 18 nt, Mycobacterium avium subsp. paratuberculosis
cgcgcgaccaucagcccg

SEQ ID NO: 916285 - RNA, 16 nt, Mycobacterium avium subsp. paratuberculosis
cgcgcgaacagccgac

SEQ ID NO: 916286 - RNA, 18 nt, Mycobacterium avium subsp. paratuberculosis
cgcgcgaacagccgaccg

SEQ ID NO: 916287 - RNA, 16 nt, Mycobacterium avium subsp. paratuberculosis
cgcgcgaaacccccgg

SEQ ID NO: 916288 - RNA, 18 nt, Mycobacterium avium subsp. paratuberculosis
cgcgcgaaacccccggga

SEQ ID NO: 916289 - RNA, 20 nt, Mycobacterium avium subsp. paratuberculosis
cgcgcgaaacccccgggaug

SEQ ID NO: 916290 - RNA, 20 nt, Mycobacterium avium subsp. paratuberculosis
cgcgcgaaggcucgccacgc

SEQ ID NO: 916291 - RNA, 12 nt, Mycobacterium avium subsp. paratuberculosis
cgcggacacgcg

SEQ ID NO: 916292 - RNA, 14 nt, Mycobacterium avium subsp. paratuberculosis
cgcggacacgcgga

SEQ ID NO: 916293 - RNA, 14 nt, Mycobacterium avium subsp. paratuberculosis
cgcggacacggccg

SEQ ID NO: 916294 - RNA, 23 nt, Mycobacterium avium subsp. paratuberculosis
cgcggacacgaacgacgcggcac

SEQ ID NO: 916295 - RNA, 24 nt, Mycobacterium avium subsp. paratuberculosis
cgcggacacgaacgacgcggcacg

SEQ ID NO: 916296 - RNA, 18 nt, Mycobacterium avium subsp. paratuberculosis
cgcggaaguggaccgcgu

SEQ ID NO: 916297 - RNA, 14 nt, Mycobacterium avium subsp. paratuberculosis
cgcgcuggccgcgu

SEQ ID NO: 916298 - RNA, 20 nt, Mycobacterium avium subsp. paratuberculosis
cgcggaaugcucgacacgau

SEQ ID NO: 916299 - RNA, 22 nt, Mycobacterium avium subsp. paratuberculosis
cgcggaaugcucgacacgaugu

SEQ ID NO: 916300 - RNA, 23 nt, Mycobacterium avium subsp. paratuberculosis
cgcggaauugcuuuuugaccacc

SEQ ID NO: 916301 - RNA, 18 nt, Mycobacterium avium subsp. paratuberculosis
cgcggacuggccaccgcg

SEQ ID NO: 916302 - RNA, 23 nt, Mycobacterium avium subsp. paratuberculosis
cgcggacuggccaccgcgaucuc

SEQ ID NO: 916303 - RNA, 20 nt, Mycobacterium avium subsp. paratuberculosis
cgcggacuggugggcgucgu

SEQ ID NO: 916304 - RNA, 21 nt, Mycobacterium avium subsp. paratuberculosis
cgcggacuggugggcgucgug

SEQ ID NO: 916305 - RNA, 22 nt, Mycobacterium avium subsp. paratuberculosis
cgcggacuggugggcgucgugg

SEQ ID NO: 916306 - RNA, 23 nt, Mycobacterium avium subsp. paratuberculosis
cgcggacuggugggcgucguggu

SEQ ID NO: 916307 - RNA, 12 nt, Mycobacterium avium subsp. paratuberculosis
cgcggacggcga

SEQ ID NO: 916308 - RNA, 20 nt, Mycobacterium avium subsp. paratuberculosis
cgcggacggguugggcgcca

SEQ ID NO: 916309 - RNA, 20 nt, Mycobacterium avium subsp. paratuberculosis
cgcggaccuuggugucggcg

SEQ ID NO: 916310 - RNA, 23 nt, Mycobacterium avium subsp. paratuberculosis
cgcggaccuuggugucggcgagc

SEQ ID NO: 916311 - RNA, 14 nt, Mycobacterium avium subsp. paratuberculosis
cgcggacgcggcgg

SEQ ID NO: 916312 - RNA, 13 nt, Mycobacterium avium subsp. paratuberculosis
cgcggacggaucg

SEQ ID NO: 916313 - RNA, 17 nt, Mycobacterium avium subsp. paratuberculosis
cgcggaaccggccgggg

SEQ ID NO: 916314 - RNA, 17 nt, Mycobacterium avium subsp. paratuberculosis
cgcggaaccguugcagc

SEQ ID NO: 916315 - RNA, 14 nt, Mycobacterium avium subsp. paratuberculosis
cgcggaacgcgccg

SEQ ID NO: 916316 - RNA, 16 nt, Mycobacterium avium subsp. paratuberculosis
cgcggaacgcgccggg

SEQ ID NO: 916317 - RNA, 17 nt, Mycobacterium avium subsp. paratuberculosis
cgcggaacgcgccgggc

SEQ ID NO: 916318 - RNA, 19 nt, Mycobacterium avium subsp. paratuberculosis
cgcggaacgcgccgggcaa

SEQ ID NO: 916319 - RNA, 15 nt, Mycobacterium avium subsp. paratuberculosis
cgcggaacgggucga

SEQ ID NO: 916320 - RNA, 23 nt, Mycobacterium avium subsp. paratuberculosis
cgcggaacgggucgaucucggcg

SEQ ID NO: 916321 - RNA, 21 nt, Mycobacterium avium subsp. paratuberculosis
cgcggaacugcucccaggcgu

SEQ ID NO: 916322 - RNA, 18 nt, Mycobacterium avium subsp. paratuberculosis
cgcgcugggcuggccguc

SEQ ID NO: 916323 - RNA, 12 nt, Mycobacterium avium subsp. paratuberculosis
cgcgcuggugcg

SEQ ID NO: 916324 - RNA, 17 nt, Mycobacterium avium subsp. paratuberculosis
cgcgcuggugcgggcca

SEQ ID NO: 916325 - RNA, 19 nt, Mycobacterium avium subsp. paratuberculosis
cgcgcuggugcgggccagc

SEQ ID NO: 916326 - RNA, 20 nt, Mycobacterium avium subsp. paratuberculosis
cgcgcuggugcgggccagca

SEQ ID NO: 916327 - RNA, 18 nt, Mycobacterium avium subsp. paratuberculosis
cgcgcuggugcugccgaa

SEQ ID NO: 916328 - RNA, 20 nt, Mycobacterium avium subsp. paratuberculosis
cgcgcuggugcugccgaaca

SEQ ID NO: 916329 - RNA, 19 nt, Mycobacterium avium subsp. paratuberculosis
cgcgcuggcggccaucgcc

SEQ ID NO: 916330 - RNA, 22 nt, Mycobacterium avium subsp. paratuberculosis
cgcgcuggcggccaucgccgcg

SEQ ID NO: 916331 - RNA, 12 nt, Mycobacterium avium subsp. paratuberculosis
cgcgcuggccga

SEQ ID NO: 916332 - RNA, 21 nt, Mycobacterium avium subsp. paratuberculosis
cgcgcuggccgaucccggcca

SEQ ID NO: 916333 - RNA, 15 nt, Mycobacterium avium subsp. paratuberculosis
cgcgcugaagcgcga

SEQ ID NO: 916334 - RNA, 20 nt, Mycobacterium avium subsp. paratuberculosis
cgcggauacgcccggccacc

SEQ ID NO: 916335 - RNA, 15 nt, Mycobacterium avium subsp. paratuberculosis
cgcggauagcccagc

SEQ ID NO: 916336 - RNA, 20 nt, Mycobacterium avium subsp. paratuberculosis
cgcggauagcccagcguggu

SEQ ID NO: 916337 - RNA, 23 nt, Mycobacterium avium subsp. paratuberculosis
cgcggaucaugauccggaagccg

SEQ ID NO: 916338 - RNA, 22 nt, Mycobacterium avium subsp. paratuberculosis
cgcggagaaggugucgcacugc

SEQ ID NO: 916339 - RNA, 16 nt, Mycobacterium avium subsp. paratuberculosis
cgcggagccggccgcc

SEQ ID NO: 916340 - RNA, 17 nt, Mycobacterium avium subsp. paratuberculosis
cgcggagccggccgccg

SEQ ID NO: 916341 - RNA, 19 nt, Mycobacterium avium subsp. paratuberculosis
cgcggagccggccgccgaa

SEQ ID NO: 916342 - RNA, 17 nt, Mycobacterium avium subsp. paratuberculosis
cgcggagcggcggucac

SEQ ID NO: 916343 - RNA, 22 nt, Mycobacterium avium subsp. paratuberculosis
cgcggaggaguuuuucggggug

SEQ ID NO: 916344 - RNA, 14 nt, Mycobacterium avium subsp. paratuberculosis
cgcggaggaugccg

SEQ ID NO: 916345 - RNA, 18 nt, Mycobacterium avium subsp. paratuberculosis
cgcggaggaugccggcca

SEQ ID NO: 916346 - RNA, 19 nt, Mycobacterium avium subsp. paratuberculosis
cgcggaggaugccggccag

SEQ ID NO: 916347 - RNA, 20 nt, Mycobacterium avium subsp. paratuberculosis
cgcggaggaugccggccagc

SEQ ID NO: 916348 - RNA, 15 nt, Mycobacterium avium subsp. paratuberculosis
cgcggaggcgagcag

SEQ ID NO: 916349 - RNA, 22 nt, Mycobacterium avium subsp. paratuberculosis
cgcggaggcgagcagccgggug

SEQ ID NO: 916350 - RNA, 14 nt, Mycobacterium avium subsp. paratuberculosis
cgcggaguaggcgc

SEQ ID NO: 916351 - RNA, 21 nt, Mycobacterium avium subsp. paratuberculosis
cgcggaguaggcgccgccgcg

SEQ ID NO: 916352 - RNA, 16 nt, Mycobacterium avium subsp. paratuberculosis
cgcggaugcgggcgcu

SEQ ID NO: 916353 - RNA, 20 nt, Mycobacterium avium subsp. paratuberculosis
cgcggaugcgggcgcugccg

SEQ ID NO: 916354 - RNA, 23 nt, Mycobacterium avium subsp. paratuberculosis
cgcggaugcgggcgcugccgucc

SEQ ID NO: 916355 - RNA, 18 nt, Mycobacterium avium subsp. paratuberculosis
cgcggaugcccaggccgg

SEQ ID NO: 916356 - RNA, 20 nt, Mycobacterium avium subsp. paratuberculosis
cgcggaugcccaggccggcg

SEQ ID NO: 916357 - RNA, 22 nt, Mycobacterium avium subsp. paratuberculosis
cgcggaugcccaggccggcgag

SEQ ID NO: 916358 - RNA, 16 nt, Mycobacterium avium subsp. paratuberculosis
cgcggaugacgggugc

SEQ ID NO: 916359 - RNA, 19 nt, Mycobacterium avium subsp. paratuberculosis
cgcggaugacgugcaccac

SEQ ID NO: 916360 - RNA, 16 nt, Mycobacterium avium subsp. paratuberculosis
cgcggauggccucggc

SEQ ID NO: 916361 - RNA, 17 nt, Mycobacterium avium subsp. paratuberculosis
cgcggauggccucggcg

SEQ ID NO: 916362 - RNA, 20 nt, Mycobacterium avium subsp. paratuberculosis
cgcggauggguggcgaucac

SEQ ID NO: 916363 - RNA, 17 nt, Mycobacterium avium subsp. paratuberculosis
cgcggauggugacggcc

SEQ ID NO: 916364 - RNA, 22 nt, Mycobacterium avium subsp. paratuberculosis
cgcggauggugacggccgugau

SEQ ID NO: 916365 - RNA, 20 nt, Mycobacterium avium subsp. paratuberculosis
cgcggauggccucggcgaug

SEQ ID NO: 916366 - RNA, 21 nt, Mycobacterium avium subsp. paratuberculosis
cgcggauggccucggcgaugc

SEQ ID NO: 916367 - RNA, 16 nt, Mycobacterium avium subsp. paratuberculosis
cgcggauuccagcgcg

SEQ ID NO: 916368 - RNA, 18 nt, Mycobacterium avium subsp. paratuberculosis
cgcggauuccagcgcgac

SEQ ID NO: 916369 - RNA, 19 nt, Mycobacterium avium subsp. paratuberculosis
cgcggauuccagcgcgacc

SEQ ID NO: 916370 - RNA, 20 nt, Mycobacterium avium subsp. paratuberculosis
cgcggauuccagcgcguagu

SEQ ID NO: 916371 - RNA, 18 nt, Mycobacterium avium subsp. paratuberculosis
cgcggauuccggcaucgg

SEQ ID NO: 916372 - RNA, 23 nt, Mycobacterium avium subsp. paratuberculosis
cgcggaucgguggacgcggucgc

SEQ ID NO: 916373 - RNA, 14 nt, Mycobacterium avium subsp. paratuberculosis
cgcggaucgucacc

SEQ ID NO: 916374 - RNA, 20 nt, Mycobacterium avium subsp. paratuberculosis
cgcggaucuucuccgccaca

SEQ ID NO: 916375 - RNA, 14 nt, Mycobacterium avium subsp. paratuberculosis
cgcggaugaccagg

SEQ ID NO: 916376 - RNA, 15 nt, Mycobacterium avium subsp. paratuberculosis
cgcggaucgcgcuga

SEQ ID NO: 916377 - RNA, 17 nt, Mycobacterium avium subsp. paratuberculosis
cgcggaucgcgcugacc

SEQ ID NO: 916378 - RNA, 18 nt, Mycobacterium avium subsp. paratuberculosis
cgcggaucgcgcugacca

SEQ ID NO: 916379 - RNA, 16 nt, Mycobacterium avium subsp. paratuberculosis
cgcggaucgcguaguc

SEQ ID NO: 916380 - RNA, 23 nt, Mycobacterium avium subsp. paratuberculosis
cgcggaucgcguaguccagcacg

SEQ ID NO: 916381 - RNA, 22 nt, Mycobacterium avium subsp. paratuberculosis
cgcggauccgcagcugaucggg

SEQ ID NO: 916382 - RNA, 16 nt, Mycobacterium avium subsp. paratuberculosis
cgcggauccgggccgg

SEQ ID NO: 916383 - RNA, 22 nt, Mycobacterium avium subsp. paratuberculosis
cgcggaucgaacagggcggcgg

SEQ ID NO: 916384 - RNA, 18 nt, Mycobacterium avium subsp. paratuberculosis
cgcgcguuccagcacgcc

SEQ ID NO: 916385 - RNA, 20 nt, Mycobacterium avium subsp. paratuberculosis
cgcgcguuccagcacgccca

SEQ ID NO: 916386 - RNA, 22 nt, Mycobacterium avium subsp. paratuberculosis
cgcgcguuccagcacgcccaga

SEQ ID NO: 916387 - RNA, 22 nt, Mycobacterium avium subsp. paratuberculosis
cgcgcguucgaguucgucgacc

SEQ ID NO: 916388 - RNA, 23 nt, Mycobacterium avium subsp. paratuberculosis
cgcgcguucgaguucgucgacca

SEQ ID NO: 916389 - RNA, 22 nt, Mycobacterium avium subsp. paratuberculosis
cgcgcgugcagccgggcggcgc

SEQ ID NO: 916390 - RNA, 16 nt, Mycobacterium avium subsp. paratuberculosis
cgcgcgugggccaacg

SEQ ID NO: 916391 - RNA, 18 nt, Mycobacterium avium subsp. paratuberculosis
cgcgcgugggccaacgcg

SEQ ID NO: 916392 - RNA, 16 nt, Mycobacterium avium subsp. paratuberculosis
cgcgcuaggacgcggg

SEQ ID NO: 916393 - RNA, 19 nt, Mycobacterium avium subsp. paratuberculosis
cgcgcucaacccgggccgg

SEQ ID NO: 916394 - RNA, 20 nt, Mycobacterium avium subsp. paratuberculosis
cgcgcucaacccgggccgga

SEQ ID NO: 916395 - RNA, 13 nt, Mycobacterium avium subsp. paratuberculosis
cgcgcucaaccgc

SEQ ID NO: 916396 - RNA, 19 nt, Mycobacterium avium subsp. paratuberculosis
cgcgcguuguccagcagcg

SEQ ID NO: 916397 - RNA, 23 nt, Mycobacterium avium subsp. paratuberculosis
cgcgcguuguccagcagcgccgg

SEQ ID NO: 916398 - RNA, 14 nt, Mycobacterium avium subsp. paratuberculosis
cgcgcucguccagg

SEQ ID NO: 916399 - RNA, 21 nt, Mycobacterium avium subsp. paratuberculosis
cgcgcucguccaggguggcca

SEQ ID NO: 916400 - RNA, 15 nt, Mycobacterium avium subsp. paratuberculosis
cgcgcucgucgauca

SEQ ID NO: 916401 - RNA, 14 nt, Mycobacterium avium subsp. paratuberculosis
cgcgcucgucgucg

SEQ ID NO: 916402 - RNA, 15 nt, Mycobacterium avium subsp. paratuberculosis
cgcgcucgucgucgg

SEQ ID NO: 916403 - RNA, 20 nt, Mycobacterium avium subsp. paratuberculosis
cgcgcucgucgucggugaac

SEQ ID NO: 916404 - RNA, 23 nt, Mycobacterium avium subsp. paratuberculosis
cgcgcucgucgucggugaacgcc

SEQ ID NO: 916405 - RNA, 24 nt, Mycobacterium avium subsp. paratuberculosis
cgcgcucgucgucggugaacgccg

SEQ ID NO: 916406 - RNA, 21 nt, Mycobacterium avium subsp. paratuberculosis
cgcgcucggccauccgggcgg

SEQ ID NO: 916407 - RNA, 14 nt, Mycobacterium avium subsp. paratuberculosis
cgcgcucggcguug

SEQ ID NO: 916408 - RNA, 20 nt, Mycobacterium avium subsp. paratuberculosis
cgcgcucgggggugcccggc

SEQ ID NO: 916409 - RNA, 18 nt, Mycobacterium avium subsp. paratuberculosis
cgcgcucggucagcaccg

SEQ ID NO: 916410 - RNA, 14 nt, Mycobacterium avium subsp. paratuberculosis
cgcgcucggcgacg

SEQ ID NO: 916411 - RNA, 18 nt, Mycobacterium avium subsp. paratuberculosis
cgcgcucuugggcggccg

SEQ ID NO: 916412 - RNA, 19 nt, Mycobacterium avium subsp. paratuberculosis
cgcgcucuugggcggccgg

SEQ ID NO: 916413 - RNA, 20 nt, Mycobacterium avium subsp. paratuberculosis
cgcgcucuugggcggccggc

SEQ ID NO: 916414 - RNA, 16 nt, Mycobacterium avium subsp. paratuberculosis
cgcgcucaccgucgcg

SEQ ID NO: 916415 - RNA, 17 nt, Mycobacterium avium subsp. paratuberculosis
cgcgcucaccgucgcgg

SEQ ID NO: 916416 - RNA, 16 nt, Mycobacterium avium subsp. paratuberculosis
cgcgcucagugcacgc

SEQ ID NO: 916417 - RNA, 19 nt, Mycobacterium avium subsp. paratuberculosis
cgcgcucagugcacgcucg

SEQ ID NO: 916418 - RNA, 14 nt, Mycobacterium avium subsp. paratuberculosis
cgcgcucagcgcgg

SEQ ID NO: 916419 - RNA, 17 nt, Mycobacterium avium subsp. paratuberculosis
cgcgcucagcgcggcca

SEQ ID NO: 916420 - RNA, 17 nt, Mycobacterium avium subsp. paratuberculosis
cgcgcgcgaacaggucc

SEQ ID NO: 916421 - RNA, 12 nt, Mycobacterium avium subsp. paratuberculosis
cgcgcgcgacgg

SEQ ID NO: 916422 - RNA, 14 nt, Mycobacterium avium subsp. paratuberculosis
cgcgcgcgacggcg

SEQ ID NO: 916423 - RNA, 22 nt, Mycobacterium avium subsp. paratuberculosis
cgcgcgggccuaggaccccggc

SEQ ID NO: 916424 - RNA, 16 nt, Mycobacterium avium subsp. paratuberculosis
cgcgcgggcgcgcgcc

SEQ ID NO: 916425 - RNA, 20 nt, Mycobacterium avium subsp. paratuberculosis
cgcgcgggcgcgcgccgccc

SEQ ID NO: 916426 - RNA, 13 nt, Mycobacterium avium subsp. paratuberculosis
cgcgcgggcgacc

SEQ ID NO: 916427 - RNA, 14 nt, Mycobacterium avium subsp. paratuberculosis
cgcgcgggcgaccu

SEQ ID NO: 916428 - RNA, 22 nt, Mycobacterium avium subsp. paratuberculosis
cgcgcgggcgaccugcgggccc

SEQ ID NO: 916429 - RNA, 23 nt, Mycobacterium avium subsp. paratuberculosis
cgcgcgggcgaccugcgggccca

SEQ ID NO: 916430 - RNA, 18 nt, Mycobacterium avium subsp. paratuberculosis
cgcgcggggucgggccgg

SEQ ID NO: 916431 - RNA, 22 nt, Mycobacterium avium subsp. paratuberculosis
cgcgcggggucgggccggacag

SEQ ID NO: 916432 - RNA, 19 nt, Mycobacterium avium subsp. paratuberculosis
cgcgcgggggccgccgcga

SEQ ID NO: 916433 - RNA, 21 nt, Mycobacterium avium subsp. paratuberculosis
cgcgcgggggccgccgcgaua

SEQ ID NO: 916434 - RNA, 17 nt, Mycobacterium avium subsp. paratuberculosis
cgcgcggggugacgccc

SEQ ID NO: 916435 - RNA, 15 nt, Mycobacterium avium subsp. paratuberculosis
cgcgcggggccggcg

SEQ ID NO: 916436 - RNA, 16 nt, Mycobacterium avium subsp. paratuberculosis
cgcgcggggccggcgc

SEQ ID NO: 916437 - RNA, 17 nt, Mycobacterium avium subsp. paratuberculosis
cgcgcggggccggcgcg

SEQ ID NO: 916438 - RNA, 20 nt, Mycobacterium avium subsp. paratuberculosis
cgcgcggggccggcgcggug

SEQ ID NO: 916439 - RNA, 21 nt, Mycobacterium avium subsp. paratuberculosis
cgcgcggggccggcgcggugc

SEQ ID NO: 916440 - RNA, 16 nt, Mycobacterium avium subsp. paratuberculosis
cgcgcgggcggcgucg

SEQ ID NO: 916441 - RNA, 20 nt, Mycobacterium avium subsp. paratuberculosis
cgcgcgggcguccucgucgg

SEQ ID NO: 916442 - RNA, 23 nt, Mycobacterium avium subsp. paratuberculosis
cgcgcgggcguccucgucggcga

SEQ ID NO: 916443 - RNA, 16 nt, Mycobacterium avium subsp. paratuberculosis
cgcgcgggugcgggcg

SEQ ID NO: 916444 - RNA, 15 nt, Mycobacterium avium subsp. paratuberculosis
cgcgcgucgggcucg

SEQ ID NO: 916445 - RNA, 19 nt, Mycobacterium avium subsp. paratuberculosis
cgcgcgucucccccgauca

SEQ ID NO: 916446 - RNA, 16 nt, Mycobacterium avium subsp. paratuberculosis
cgcgcgugacggcggg

SEQ ID NO: 916447 - RNA, 22 nt, Mycobacterium avium subsp. paratuberculosis
cgcgcgggucgagcagcagccg

SEQ ID NO: 916448 - RNA, 14 nt, Mycobacterium avium subsp. paratuberculosis
cgcgcggggugucg

SEQ ID NO: 916449 - RNA, 18 nt, Mycobacterium avium subsp. paratuberculosis
cgcgcggggugucgcggc

SEQ ID NO: 916450 - RNA, 21 nt, Mycobacterium avium subsp. paratuberculosis
cgcgcggggugucgcggcugc

SEQ ID NO: 916451 - RNA, 18 nt, Mycobacterium avium subsp. paratuberculosis
cgcgcggguacggcggcc

SEQ ID NO: 916452 - RNA, 15 nt, Mycobacterium avium subsp. paratuberculosis
cgcgcgggucgucgg

SEQ ID NO: 916453 - RNA, 21 nt, Mycobacterium avium subsp. paratuberculosis
cgcgcgggucgucggccuguc

SEQ ID NO: 916454 - RNA, 13 nt, Mycobacterium avium subsp. paratuberculosis
cgcgcgccccggu

SEQ ID NO: 916455 - RNA, 20 nt, Mycobacterium avium subsp. paratuberculosis
cgcgcgccccggucccgccg

SEQ ID NO: 916456 - RNA, 23 nt, Mycobacterium avium subsp. paratuberculosis
cgcgcgccccggucccgccggug

SEQ ID NO: 916457 - RNA, 14 nt, Mycobacterium avium subsp. paratuberculosis
cgcgcgccagcgcg

SEQ ID NO: 916458 - RNA, 22 nt, Mycobacterium avium subsp. paratuberculosis
cgcgcgcaguugcgcggcgggc

SEQ ID NO: 916459 - RNA, 20 nt, Mycobacterium avium subsp. paratuberculosis
cgcgcgcaucaccgagguca

SEQ ID NO: 916460 - RNA, 12 nt, Mycobacterium avium subsp. paratuberculosis
cgcgcgccggga

SEQ ID NO: 916461 - RNA, 13 nt, Mycobacterium avium subsp. paratuberculosis
cgcgcgccggcgc

SEQ ID NO: 916462 - RNA, 19 nt, Mycobacterium avium subsp. paratuberculosis
cgcgcgccgacagacccga

SEQ ID NO: 916463 - RNA, 21 nt, Mycobacterium avium subsp. paratuberculosis
cgcgcgccgagagcgcgucga

SEQ ID NO: 916464 - RNA, 23 nt, Mycobacterium avium subsp. paratuberculosis
cgcgcgccccagccccucgccgg

SEQ ID NO: 916465 - RNA, 16 nt, Mycobacterium avium subsp. paratuberculosis
cgcgcgcccggcaccg

SEQ ID NO: 916466 - RNA, 12 nt, Mycobacterium avium subsp. paratuberculosis
cgcgcgcccguc

SEQ ID NO: 916467 - RNA, 14 nt, Mycobacterium avium subsp. paratuberculosis
cgcgcgcccgucgu

SEQ ID NO: 916468 - RNA, 18 nt, Mycobacterium avium subsp. paratuberculosis
cgcgcgcccgucgucggu

SEQ ID NO: 916469 - RNA, 22 nt, Mycobacterium avium subsp. paratuberculosis
cgcgcgcccgucgucggucagc

SEQ ID NO: 916470 - RNA, 16 nt, Mycobacterium avium subsp. paratuberculosis
cgcgcgcccuagucga

SEQ ID NO: 916471 - RNA, 20 nt, Mycobacterium avium subsp. paratuberculosis
cgcgcgcccuagucgacgcc

SEQ ID NO: 916472 - RNA, 17 nt, Mycobacterium avium subsp. paratuberculosis
cgccgguuuucggcgug

SEQ ID NO: 916473 - RNA, 16 nt, Mycobacterium avium subsp. paratuberculosis
cgccgguuucgucggu

SEQ ID NO: 916474 - RNA, 18 nt, Mycobacterium avium subsp. paratuberculosis
cgccgguuucgucggucu

SEQ ID NO: 916475 - RNA, 20 nt, Mycobacterium avium subsp. paratuberculosis
cgccgguuucgucggucugc

SEQ ID NO: 916476 - RNA, 19 nt, Mycobacterium avium subsp. paratuberculosis
cgccgguuuccaggacgau

SEQ ID NO: 916477 - RNA, 14 nt, Mycobacterium avium subsp. paratuberculosis
cgccgguugaucac

SEQ ID NO: 916478 - RNA, 23 nt, Mycobacterium avium subsp. paratuberculosis
cgccgguugaucacccgggucga

SEQ ID NO: 916479 - RNA, 13 nt, Mycobacterium avium subsp. paratuberculosis
cgccguacccgaa

SEQ ID NO: 916480 - RNA, 15 nt, Mycobacterium avium subsp. paratuberculosis
cgccguacagcuggu

SEQ ID NO: 916481 - RNA, 18 nt, Mycobacterium avium subsp. paratuberculosis
cgccguacagcugguccg

SEQ ID NO: 916482 - RNA, 17 nt, Mycobacterium avium subsp. paratuberculosis
cgccggugagcacgacc

SEQ ID NO: 916483 - RNA, 19 nt, Mycobacterium avium subsp. paratuberculosis
cgccggugagcacgaccgc

SEQ ID NO: 916484 - RNA, 21 nt, Mycobacterium avium subsp. paratuberculosis
cgccggugagcacgaccgcca

SEQ ID NO: 916485 - RNA, 21 nt, Mycobacterium avium subsp. paratuberculosis
cgccggugaccugcagcgccu

SEQ ID NO: 916486 - RNA, 22 nt, Mycobacterium avium subsp. paratuberculosis
cgccggugaagaucagcgcguc

SEQ ID NO: 916487 - RNA, 23 nt, Mycobacterium avium subsp. paratuberculosis
cgccggugaagaucagcgcgucg

SEQ ID NO: 916488 - RNA, 21 nt, Mycobacterium avium subsp. paratuberculosis
cgccggugaagaucgcccgcc

SEQ ID NO: 916489 - RNA, 22 nt, Mycobacterium avium subsp. paratuberculosis
cgccggugaagaucgcccgccg

SEQ ID NO: 916490 - RNA, 15 nt, Mycobacterium avium subsp. paratuberculosis
cgccggugaagcggg

SEQ ID NO: 916491 - RNA, 20 nt, Mycobacterium avium subsp. paratuberculosis
cgccggugaaaccggcgccg

SEQ ID NO: 916492 - RNA, 15 nt, Mycobacterium avium subsp. paratuberculosis
cgccggugaccccgu

SEQ ID NO: 916493 - RNA, 20 nt, Mycobacterium avium subsp. paratuberculosis
cgccgguucgcuggcggcca

SEQ ID NO: 916494 - RNA, 22 nt, Mycobacterium avium subsp. paratuberculosis
cgccgguucgcuggcggccagc

SEQ ID NO: 916495 - RNA, 16 nt, Mycobacterium avium subsp. paratuberculosis
cgccggugcccacgcc

SEQ ID NO: 916496 - RNA, 22 nt, Mycobacterium avium subsp. paratuberculosis
cgccggugcaguacgcaucggc

SEQ ID NO: 916497 - RNA, 23 nt, Mycobacterium avium subsp. paratuberculosis
cgccggugcaguacgcaucggcg

SEQ ID NO: 916498 - RNA, 17 nt, Mycobacterium avium subsp. paratuberculosis
cgccguaucccugccag

SEQ ID NO: 916499 - RNA, 14 nt, Mycobacterium avium subsp. paratuberculosis
cgccguagguggcc

SEQ ID NO: 916500 - RNA, 15 nt, Mycobacterium avium subsp. paratuberculosis
cgccguagguggcca

SEQ ID NO: 916501 - RNA, 19 nt, Mycobacterium avium subsp. paratuberculosis
cgccguagguggccaugaa

SEQ ID NO: 916502 - RNA, 15 nt, Mycobacterium avium subsp. paratuberculosis
cgccguauucgccga

SEQ ID NO: 916503 - RNA, 21 nt, Mycobacterium avium subsp. paratuberculosis
cgccguauucgccgacggucu

SEQ ID NO: 916504 - RNA, 20 nt, Mycobacterium avium subsp. paratuberculosis
cgccguauuggcaggcgaug

SEQ ID NO: 916505 - RNA, 22 nt, Mycobacterium avium subsp. paratuberculosis
cgccguauuggcaggcgaugug

SEQ ID NO: 916506 - RNA, 17 nt, Mycobacterium avium subsp. paratuberculosis
cgccgucacaccgcggc

SEQ ID NO: 916507 - RNA, 19 nt, Mycobacterium avium subsp. paratuberculosis
cgccgucacaccgcggcca

SEQ ID NO: 916508 - RNA, 14 nt, Mycobacterium avium subsp. paratuberculosis
cgccgucaccgcca

SEQ ID NO: 916509 - RNA, 23 nt, Mycobacterium avium subsp. paratuberculosis
cgccgucaccgccaggaccaccc

SEQ ID NO: 916510 - RNA, 17 nt, Mycobacterium avium subsp. paratuberculosis
cgccguagcgccggcaa

SEQ ID NO: 916511 - RNA, 16 nt, Mycobacterium avium subsp. paratuberculosis
cgccguaggccgcgcu

SEQ ID NO: 916512 - RNA, 17 nt, Mycobacterium avium subsp. paratuberculosis
cgccguagccggcggug

SEQ ID NO: 916513 - RNA, 21 nt, Mycobacterium avium subsp. paratuberculosis
cgccguagccggcgguggcca

SEQ ID NO: 916514 - RNA, 19 nt, Mycobacterium avium subsp. paratuberculosis
cgccguacuugacgugcga

SEQ ID NO: 916515 - RNA, 22 nt, Mycobacterium avium subsp. paratuberculosis
cgccguacuugacgugcgacac

SEQ ID NO: 916516 - RNA, 14 nt, Mycobacterium avium subsp. paratuberculosis
cgccguacgcgccg

SEQ ID NO: 916517 - RNA, 15 nt, Mycobacterium avium subsp. paratuberculosis
cgccguacgcgccgg

SEQ ID NO: 916518 - RNA, 18 nt, Mycobacterium avium subsp. paratuberculosis
cgccguacgcgccggcca

SEQ ID NO: 916519 - RNA, 18 nt, Mycobacterium avium subsp. paratuberculosis
cgccguagaucacgccgg

SEQ ID NO: 916520 - RNA, 14 nt, Mycobacterium avium subsp. paratuberculosis
cgccgucccaccgg

SEQ ID NO: 916521 - RNA, 18 nt, Mycobacterium avium subsp. paratuberculosis
cgccgucccaccggcgau

SEQ ID NO: 916522 - RNA, 23 nt, Mycobacterium avium subsp. paratuberculosis
cgccgucccaccggcgauguggc

SEQ ID NO: 916523 - RNA, 16 nt, Mycobacterium avium subsp. paratuberculosis
cgccgucccagccgga

SEQ ID NO: 916524 - RNA, 19 nt, Mycobacterium avium subsp. paratuberculosis
cgccgucccagccggacag

SEQ ID NO: 916525 - RNA, 15 nt, Mycobacterium avium subsp. paratuberculosis
cgccguccccaccga

SEQ ID NO: 916526 - RNA, 20 nt, Mycobacterium avium subsp. paratuberculosis
cgccguccccaccgaucagg

SEQ ID NO: 916527 - RNA, 20 nt, Mycobacterium avium subsp. paratuberculosis
cgccguccccgcgcggcucg

SEQ ID NO: 916528 - RNA, 21 nt, Mycobacterium avium subsp. paratuberculosis
cgccguccagcucgcguucgg

SEQ ID NO: 916529 - RNA, 14 nt, Mycobacterium avium subsp. paratuberculosis
cgccguccacgggu

SEQ ID NO: 916530 - RNA, 16 nt, Mycobacterium avium subsp. paratuberculosis
cgccgucaucaccgcc

SEQ ID NO: 916531 - RNA, 17 nt, Mycobacterium avium subsp. paratuberculosis
cgccgucaucaccgccg

SEQ ID NO: 916532 - RNA, 18 nt, Mycobacterium avium subsp. paratuberculosis
cgccgucaucaccgccga

SEQ ID NO: 916533 - RNA, 19 nt, Mycobacterium avium subsp. paratuberculosis
cgccgucaucaccgccgag

SEQ ID NO: 916534 - RNA, 19 nt, Mycobacterium avium subsp. paratuberculosis
cgccgucauccccaucucg

SEQ ID NO: 916535 - RNA, 16 nt, Mycobacterium avium subsp. paratuberculosis
cgccgucaucgacacc

SEQ ID NO: 916536 - RNA, 17 nt, Mycobacterium avium subsp. paratuberculosis
cgccgucaucgacaccg

SEQ ID NO: 916537 - RNA, 13 nt, Mycobacterium avium subsp. paratuberculosis
cgccgucaccggc

SEQ ID NO: 916538 - RNA, 14 nt, Mycobacterium avium subsp. paratuberculosis
cgccgucaccggcu

SEQ ID NO: 916539 - RNA, 15 nt, Mycobacterium avium subsp. paratuberculosis
cgccgucaccggcug

SEQ ID NO: 916540 - RNA, 23 nt, Mycobacterium avium subsp. paratuberculosis
cgccgucaccggcugcccgaccc

SEQ ID NO: 916541 - RNA, 13 nt, Mycobacterium avium subsp. paratuberculosis
cgccgucaccgcc

SEQ ID NO: 916542 - RNA, 14 nt, Mycobacterium avium subsp. paratuberculosis
cgccgucacgccgu

SEQ ID NO: 916543 - RNA, 17 nt, Mycobacterium avium subsp. paratuberculosis
cgccgucacggaucgcc

SEQ ID NO: 916544 - RNA, 19 nt, Mycobacterium avium subsp. paratuberculosis
cgccgucacggaucgccca

SEQ ID NO: 916545 - RNA, 18 nt, Mycobacterium avium subsp. paratuberculosis
cgccgucacugcacgcac

SEQ ID NO: 916546 - RNA, 21 nt, Mycobacterium avium subsp. paratuberculosis
cgccgucacugcacgcacggc

SEQ ID NO: 916547 - RNA, 14 nt, Mycobacterium avium subsp. paratuberculosis
cgccgggaucggca

SEQ ID NO: 916548 - RNA, 19 nt, Mycobacterium avium subsp. paratuberculosis
cgccgggaucggcagcgcg

SEQ ID NO: 916549 - RNA, 20 nt, Mycobacterium avium subsp. paratuberculosis
cgccgggaucggcagcgcgc

SEQ ID NO: 916550 - RNA, 22 nt, Mycobacterium avium subsp. paratuberculosis
cgccgggaucggcagcgcgccc

SEQ ID NO: 916551 - RNA, 14 nt, Mycobacterium avium subsp. paratuberculosis
cgccgggaucggcg

SEQ ID NO: 916552 - RNA, 17 nt, Mycobacterium avium subsp. paratuberculosis
cgccgggaucggcgggg

SEQ ID NO: 916553 - RNA, 15 nt, Mycobacterium avium subsp. paratuberculosis
cgccgggaugcgcca

SEQ ID NO: 916554 - RNA, 23 nt, Mycobacterium avium subsp. paratuberculosis
cgccgggauauucgcccagcggc

SEQ ID NO: 916555 - RNA, 13 nt, Mycobacterium avium subsp. paratuberculosis
cgccgggaucaca

SEQ ID NO: 916556 - RNA, 19 nt, Mycobacterium avium subsp. paratuberculosis
cgccgggaucacacgcgcg

SEQ ID NO: 916557 - RNA, 20 nt, Mycobacterium avium subsp. paratuberculosis
cgccgggaucacacgcgcgc

SEQ ID NO: 916558 - RNA, 14 nt, Mycobacterium avium subsp. paratuberculosis
cgccgggaugguga

SEQ ID NO: 916559 - RNA, 18 nt, Mycobacterium avium subsp. paratuberculosis
cgccgggcaccaccaccg

SEQ ID NO: 916560 - RNA, 14 nt, Mycobacterium avium subsp. paratuberculosis
cgccgggcacccgg

SEQ ID NO: 916561 - RNA, 15 nt, Mycobacterium avium subsp. paratuberculosis
cgccgggcacccggg

SEQ ID NO: 916562 - RNA, 16 nt, Mycobacterium avium subsp. paratuberculosis
cgccgggcaccucggc

SEQ ID NO: 916563 - RNA, 17 nt, Mycobacterium avium subsp. paratuberculosis
cgccgggcaccucggcg

SEQ ID NO: 916564 - RNA, 18 nt, Mycobacterium avium subsp. paratuberculosis
cgccgggcaccucggcgu

SEQ ID NO: 916565 - RNA, 17 nt, Mycobacterium avium subsp. paratuberculosis
cgccggcaucagcgaga

SEQ ID NO: 916566 - RNA, 16 nt, Mycobacterium avium subsp. paratuberculosis
cgccggcauccagcac

SEQ ID NO: 916567 - RNA, 13 nt, Mycobacterium avium subsp. paratuberculosis
cgccggcaucgac

SEQ ID NO: 916568 - RNA, 17 nt, Mycobacterium avium subsp. paratuberculosis
cgccggcaucgaccgcc

SEQ ID NO: 916569 - RNA, 13 nt, Mycobacterium avium subsp. paratuberculosis
cgccggcagcggc

SEQ ID NO: 916570 - RNA, 15 nt, Mycobacterium avium subsp. paratuberculosis
cgccggcagcggccg

SEQ ID NO: 916571 - RNA, 16 nt, Mycobacterium avium subsp. paratuberculosis
cgccggcagcggccgc

SEQ ID NO: 916572 - RNA, 12 nt, Mycobacterium avium subsp. paratuberculosis
cgccggcagccg

SEQ ID NO: 916573 - RNA, 16 nt, Mycobacterium avium subsp. paratuberculosis
cgccggcagccgcucg

SEQ ID NO: 916574 - RNA, 17 nt, Mycobacterium avium subsp. paratuberculosis
cgccggcagccgcucgg

SEQ ID NO: 916575 - RNA, 15 nt, Mycobacterium avium subsp. paratuberculosis
cgccggcacucgucg

SEQ ID NO: 916576 - RNA, 18 nt, Mycobacterium avium subsp. paratuberculosis
cgccggcacucgucgugg

SEQ ID NO: 916577 - RNA, 23 nt, Mycobacterium avium subsp. paratuberculosis
cgccggcacucgucguggcggug

SEQ ID NO: 916578 - RNA, 15 nt, Mycobacterium avium subsp. paratuberculosis
cgccggcacugcugc

SEQ ID NO: 916579 - RNA, 20 nt, Mycobacterium avium subsp. paratuberculosis
cgccggcacugcugcccgcg

SEQ ID NO: 916580 - RNA, 18 nt, Mycobacterium avium subsp. paratuberculosis
cgccgggccggcggccag

SEQ ID NO: 916581 - RNA, 22 nt, Mycobacterium avium subsp. paratuberculosis
cgccgggccaggugugcccgcc

SEQ ID NO: 916582 - RNA, 15 nt, Mycobacterium avium subsp. paratuberculosis
cgccgggccggaucg

SEQ ID NO: 916583 - RNA, 14 nt, Mycobacterium avium subsp. paratuberculosis
cgccgggccggccg

SEQ ID NO: 916584 - RNA, 13 nt, Mycobacterium avium subsp. paratuberculosis
cgccgggccggcg

SEQ ID NO: 916585 - RNA, 14 nt, Mycobacterium avium subsp. paratuberculosis
cgccgggcccgguc

SEQ ID NO: 916586 - RNA, 12 nt, Mycobacterium avium subsp. paratuberculosis
cgccgggccgcc

SEQ ID NO: 916587 - RNA, 18 nt, Mycobacterium avium subsp. paratuberculosis
cgccgggccgccgaugcg

SEQ ID NO: 916588 - RNA, 14 nt, Mycobacterium avium subsp. paratuberculosis
cgccgggccgccgc

SEQ ID NO: 916589 - RNA, 16 nt, Mycobacterium avium subsp. paratuberculosis
cgccgggccgccgcgg

SEQ ID NO: 916590 - RNA, 19 nt, Mycobacterium avium subsp. paratuberculosis
cgccgggccgccgcggcca

SEQ ID NO: 916591 - RNA, 13 nt, Mycobacterium avium subsp. paratuberculosis
cgccgggccacgc

SEQ ID NO: 916592 - RNA, 14 nt, Mycobacterium avium subsp. paratuberculosis
cgccgggccacgcc

SEQ ID NO: 916593 - RNA, 17 nt, Mycobacterium avium subsp. paratuberculosis
cgccgggccacgccgac

SEQ ID NO: 916594 - RNA, 21 nt, Mycobacterium avium subsp. paratuberculosis
cgccgggcaucucguugucgu

SEQ ID NO: 916595 - RNA, 14 nt, Mycobacterium avium subsp. paratuberculosis
cgccgggcaugccg

SEQ ID NO: 916596 - RNA, 18 nt, Mycobacterium avium subsp. paratuberculosis
cgccgggcaugccguuca

SEQ ID NO: 916597 - RNA, 15 nt, Mycobacterium avium subsp. paratuberculosis
cgccgggcauuucgg

SEQ ID NO: 916598 - RNA, 19 nt, Mycobacterium avium subsp. paratuberculosis
cgccgggcagcccgggucu

SEQ ID NO: 916599 - RNA, 20 nt, Mycobacterium avium subsp. paratuberculosis
cgccgggcagcccgggucua

SEQ ID NO: 916600 - RNA, 16 nt, Mycobacterium avium subsp. paratuberculosis
cgccgggcagcgcgcg

SEQ ID NO: 916601 - RNA, 16 nt, Mycobacterium avium subsp. paratuberculosis
cgccgggcauccgccc

SEQ ID NO: 916602 - RNA, 18 nt, Mycobacterium avium subsp. paratuberculosis
cgccgggcauccgcccgu

SEQ ID NO: 916603 - RNA, 19 nt, Mycobacterium avium subsp. paratuberculosis
cgccgggcauccgggccgc

SEQ ID NO: 916604 - RNA, 21 nt, Mycobacterium avium subsp. paratuberculosis
cgccgggcauccgggccgccg

SEQ ID NO: 916605 - RNA, 15 nt, Mycobacterium avium subsp. paratuberculosis
cgccgggcagcccgc

SEQ ID NO: 916606 - RNA, 17 nt, Mycobacterium avium subsp. paratuberculosis
cgccgggcagcccgccg

SEQ ID NO: 916607 - RNA, 20 nt, Mycobacterium avium subsp. paratuberculosis
cgccgggcagcccgccgcgg

SEQ ID NO: 916608 - RNA, 14 nt, Mycobacterium avium subsp. paratuberculosis
cgccgggcagcccg

SEQ ID NO: 916609 - RNA, 18 nt, Mycobacterium avium subsp. paratuberculosis
cgccgggcaacagcgcgc

SEQ ID NO: 916610 - RNA, 22 nt, Mycobacterium avium subsp. paratuberculosis
cgccgggcaacagcgcgccggc

SEQ ID NO: 916611 - RNA, 18 nt, Mycobacterium avium subsp. paratuberculosis
cgccgggcagguggucgg

SEQ ID NO: 916612 - RNA, 19 nt, Mycobacterium avium subsp. paratuberculosis
cgccgggcagguggucggc

SEQ ID NO: 916613 - RNA, 21 nt, Mycobacterium avium subsp. paratuberculosis
cgccgggcagguggucggcga

SEQ ID NO: 916614 - RNA, 22 nt, Mycobacterium avium subsp. paratuberculosis
cgccgggcagguggucggcgaa

SEQ ID NO: 916615 - RNA, 21 nt, Mycobacterium avium subsp. paratuberculosis
cgccggguuuguccggccagg

SEQ ID NO: 916616 - RNA, 14 nt, Mycobacterium avium subsp. paratuberculosis
cgccgguaccgccg

SEQ ID NO: 916617 - RNA, 15 nt, Mycobacterium avium subsp. paratuberculosis
cgccgguaccgccgg

SEQ ID NO: 916618 - RNA, 16 nt, Mycobacterium avium subsp. paratuberculosis
cgccgguaccgccggc

SEQ ID NO: 916619 - RNA, 17 nt, Mycobacterium avium subsp. paratuberculosis
cgccgguaccgccggcc

SEQ ID NO: 916620 - RNA, 18 nt, Mycobacterium avium subsp. paratuberculosis
cgccgguaccgccggcca

SEQ ID NO: 916621 - RNA, 19 nt, Mycobacterium avium subsp. paratuberculosis
cgccgguaccgccggccag

SEQ ID NO: 916622 - RNA, 14 nt, Mycobacterium avium subsp. paratuberculosis
cgccgguagagcgc

SEQ ID NO: 916623 - RNA, 20 nt, Mycobacterium avium subsp. paratuberculosis
cgccgguagagcgccagggu

SEQ ID NO: 916624 - RNA, 19 nt, Mycobacterium avium subsp. paratuberculosis
cgccgguccagugccggcg

SEQ ID NO: 916625 - RNA, 21 nt, Mycobacterium avium subsp. paratuberculosis
cgccgguccagugccggcgag

SEQ ID NO: 916626 - RNA, 18 nt, Mycobacterium avium subsp. paratuberculosis
cgccgguaaugggcgauc

SEQ ID NO: 916627 - RNA, 19 nt, Mycobacterium avium subsp. paratuberculosis
cgccgguaaugggcgaucg

SEQ ID NO: 916628 - RNA, 13 nt, Mycobacterium avium subsp. paratuberculosis
cgccggucccgcg

SEQ ID NO: 916629 - RNA, 17 nt, Mycobacterium avium subsp. paratuberculosis
cgccggucccgcggcgg

SEQ ID NO: 916630 - RNA, 18 nt, Mycobacterium avium subsp. paratuberculosis
cgccggucccgcggcggc

SEQ ID NO: 916631 - RNA, 19 nt, Mycobacterium avium subsp. paratuberculosis
cgccggucccgcggcggcg

SEQ ID NO: 916632 - RNA, 22 nt, Mycobacterium avium subsp. paratuberculosis
cgccggucccgcggcggcgcca

SEQ ID NO: 916633 - RNA, 13 nt, Mycobacterium avium subsp. paratuberculosis
cgccggucgcugc

SEQ ID NO: 916634 - RNA, 15 nt, Mycobacterium avium subsp. paratuberculosis
cgccggucgacgcgg

SEQ ID NO: 916635 - RNA, 19 nt, Mycobacterium avium subsp. paratuberculosis
cgccggucgcccccucggc

SEQ ID NO: 916636 - RNA, 21 nt, Mycobacterium avium subsp. paratuberculosis
cgccggucgcccccucggccg

SEQ ID NO: 916637 - RNA, 22 nt, Mycobacterium avium subsp. paratuberculosis
cgccggucgcccccucggccgg

SEQ ID NO: 916638 - RNA, 15 nt, Mycobacterium avium subsp. paratuberculosis
cgccggucugguacc

SEQ ID NO: 916639 - RNA, 13 nt, Mycobacterium avium subsp. paratuberculosis
cgccggucguagc

SEQ ID NO: 916640 - RNA, 19 nt, Mycobacterium avium subsp. paratuberculosis
cgccggucguagcgucggg

SEQ ID NO: 916641 - RNA, 23 nt, Mycobacterium avium subsp. paratuberculosis
cgccggucguagcgucgggggcg

SEQ ID NO: 916642 - RNA, 15 nt, Mycobacterium avium subsp. paratuberculosis
cgccggucguggggc

SEQ ID NO: 916643 - RNA, 17 nt, Mycobacterium avium subsp. paratuberculosis
cgccggucuccaugucg

SEQ ID NO: 916644 - RNA, 22 nt, Mycobacterium avium subsp. paratuberculosis
cgccggucuccaugucgucggc

SEQ ID NO: 916645 - RNA, 23 nt, Mycobacterium avium subsp. paratuberculosis
cgccggucuccaugucgucggcg

SEQ ID NO: 916646 - RNA, 24 nt, Mycobacterium avium subsp. paratuberculosis
cgccggucucgaacacgccgucgu

SEQ ID NO: 916647 - RNA, 13 nt, Mycobacterium avium subsp. paratuberculosis
cgccggggccggc

SEQ ID NO: 916648 - RNA, 14 nt, Mycobacterium avium subsp. paratuberculosis
cgccggggccggcg

SEQ ID NO: 916649 - RNA, 15 nt, Mycobacterium avium subsp. paratuberculosis
cgccggggccggcga

SEQ ID NO: 916650 - RNA, 17 nt, Mycobacterium avium subsp. paratuberculosis
cgccggggccggcgaug

SEQ ID NO: 916651 - RNA, 15 nt, Mycobacterium avium subsp. paratuberculosis
cgccggggccgcggc

SEQ ID NO: 916652 - RNA, 17 nt, Mycobacterium avium subsp. paratuberculosis
cgccggggccgcggcuc

SEQ ID NO: 916653 - RNA, 18 nt, Mycobacterium avium subsp. paratuberculosis
cgccggggccgcggcucg

SEQ ID NO: 916654 - RNA, 21 nt, Mycobacterium avium subsp. paratuberculosis
cgccgggcccgcucaccugcg

SEQ ID NO: 916655 - RNA, 16 nt, Mycobacterium avium subsp. paratuberculosis
cgccggggcgggcggc

SEQ ID NO: 916656 - RNA, 20 nt, Mycobacterium avium subsp. paratuberculosis
cgccggggcgggcggcggcu

SEQ ID NO: 916657 - RNA, 15 nt, Mycobacterium avium subsp. paratuberculosis
cgccggggcgucgga

SEQ ID NO: 916658 - RNA, 23 nt, Mycobacterium avium subsp. paratuberculosis
cgccggggcgucggacgccagug

SEQ ID NO: 916659 - RNA, 14 nt, Mycobacterium avium subsp. paratuberculosis
cgccggggcgggca

SEQ ID NO: 916660 - RNA, 12 nt, Mycobacterium avium subsp. paratuberculosis
cgccggggcgcc

SEQ ID NO: 916661 - RNA, 16 nt, Mycobacterium avium subsp. paratuberculosis
cgccggggcgccgccg

SEQ ID NO: 916662 - RNA, 17 nt, Mycobacterium avium subsp. paratuberculosis
cgccggggcgccgccga

SEQ ID NO: 916663 - RNA, 20 nt, Mycobacterium avium subsp. paratuberculosis
cgccggggcgccgccgaaca

SEQ ID NO: 916664 - RNA, 22 nt, Mycobacterium avium subsp. paratuberculosis
cgccggggcggauccccgcgcu

SEQ ID NO: 916665 - RNA, 17 nt, Mycobacterium avium subsp. paratuberculosis
cgccggguugggcggcg

SEQ ID NO: 916666 - RNA, 22 nt, Mycobacterium avium subsp. paratuberculosis
cgccggguugggcggcggccac

SEQ ID NO: 916667 - RNA, 23 nt, Mycobacterium avium subsp. paratuberculosis
cgccggguugggcggcggccacc

SEQ ID NO: 916668 - RNA, 22 nt, Mycobacterium avium subsp. paratuberculosis
cgccggguugcaggcgcccagg

SEQ ID NO: 916669 - RNA, 16 nt, Mycobacterium avium subsp. paratuberculosis
cgccggguggccgcca

SEQ ID NO: 916670 - RNA, 21 nt, Mycobacterium avium subsp. paratuberculosis
cgccggguggccgccacgucc

SEQ ID NO: 916671 - RNA, 14 nt, Mycobacterium avium subsp. paratuberculosis
cgccggguggccgg

SEQ ID NO: 916672 - RNA, 17 nt, Mycobacterium avium subsp. paratuberculosis
cgccggguggcggggcg

SEQ ID NO: 916673 - RNA, 20 nt, Mycobacterium avium subsp. paratuberculosis
cgccggguggcggggcguug

SEQ ID NO: 916674 - RNA, 17 nt, Mycobacterium avium subsp. paratuberculosis
cgccgggguccgcaacg

SEQ ID NO: 916675 - RNA, 18 nt, Mycobacterium avium subsp. paratuberculosis
cgccgggguccgcaacgc

SEQ ID NO: 916676 - RNA, 21 nt, Mycobacterium avium subsp. paratuberculosis
cgccgggguccgcaacgccgg

SEQ ID NO: 916677 - RNA, 23 nt, Mycobacterium avium subsp. paratuberculosis
cgccgggguccgcaacgccggcg

SEQ ID NO: 916678 - RNA, 19 nt, Mycobacterium avium subsp. paratuberculosis
cgccgggguccucucggcg

SEQ ID NO: 916679 - RNA, 20 nt, Mycobacterium avium subsp. paratuberculosis
cgccgggguccucucggcgc

SEQ ID NO: 916680 - RNA, 22 nt, Mycobacterium avium subsp. paratuberculosis
cgccgggguccucucggcgccg

SEQ ID NO: 916681 - RNA, 22 nt, Mycobacterium avium subsp. paratuberculosis
cgccuaauucguuguuggcggu

SEQ ID NO: 916682 - RNA, 23 nt, Mycobacterium avium subsp. paratuberculosis
cgccuaauucguuguuggcggug

SEQ ID NO: 916683 - RNA, 15 nt, Mycobacterium avium subsp. paratuberculosis
cgccguucgccggcg

SEQ ID NO: 916684 - RNA, 19 nt, Mycobacterium avium subsp. paratuberculosis
cgccguucgccggcgacgg

SEQ ID NO: 916685 - RNA, 21 nt, Mycobacterium avium subsp. paratuberculosis
cgccucaacgguugucgcuca

SEQ ID NO: 916686 - RNA, 14 nt, Mycobacterium avium subsp. paratuberculosis
cgccuacugcgcca

SEQ ID NO: 916687 - RNA, 13 nt, Mycobacterium avium subsp. paratuberculosis
cgccuaccgggug

SEQ ID NO: 916688 - RNA, 20 nt, Mycobacterium avium subsp. paratuberculosis
cgccuaccggguggccagca

SEQ ID NO: 916689 - RNA, 21 nt, Mycobacterium avium subsp. paratuberculosis
cgccuaccggguggccagcac

SEQ ID NO: 916690 - RNA, 23 nt, Mycobacterium avium subsp. paratuberculosis
cgccuaccggguggccagcacca

SEQ ID NO: 916691 - RNA, 16 nt, Mycobacterium avium subsp. paratuberculosis
cgccguugacaccggg

SEQ ID NO: 916692 - RNA, 19 nt, Mycobacterium avium subsp. paratuberculosis
cgccguugacaccgggugc

SEQ ID NO: 916693 - RNA, 14 nt, Mycobacterium avium subsp. paratuberculosis
cgccguugaccccg

SEQ ID NO: 916694 - RNA, 17 nt, Mycobacterium avium subsp. paratuberculosis
cgccguugaccgcggcg

SEQ ID NO: 916695 - RNA, 20 nt, Mycobacterium avium subsp. paratuberculosis
cgccguugaccgcggcgaug

SEQ ID NO: 916696 - RNA, 21 nt, Mycobacterium avium subsp. paratuberculosis
cgccguugaccgcggcgaugg

SEQ ID NO: 916697 - RNA, 17 nt, Mycobacterium avium subsp. paratuberculosis
cgccguugaccggccgg

SEQ ID NO: 916698 - RNA, 15 nt, Mycobacterium avium subsp. paratuberculosis
cgccguugaccggug

SEQ ID NO: 916699 - RNA, 17 nt, Mycobacterium avium subsp. paratuberculosis
cgccguugaccggugcg

SEQ ID NO: 916700 - RNA, 22 nt, Mycobacterium avium subsp. paratuberculosis
cgccguguugacguaacacccu

SEQ ID NO: 916701 - RNA, 15 nt, Mycobacterium avium subsp. paratuberculosis
cgccgugcggcguuc

SEQ ID NO: 916702 - RNA, 15 nt, Mycobacterium avium subsp. paratuberculosis
cgccgugcgccucga

SEQ ID NO: 916703 - RNA, 14 nt, Mycobacterium avium subsp. paratuberculosis
cgccgugcgcggcg

SEQ ID NO: 916704 - RNA, 17 nt, Mycobacterium avium subsp. paratuberculosis
cgccgugcgcggcgacc

SEQ ID NO: 916705 - RNA, 19 nt, Mycobacterium avium subsp. paratuberculosis
cgccgugcgccagcgaccg

SEQ ID NO: 916706 - RNA, 15 nt, Mycobacterium avium subsp. paratuberculosis
cgccgugcgccccgc

SEQ ID NO: 916707 - RNA, 12 nt, Mycobacterium avium subsp. paratuberculosis
cgccgugacgcc

SEQ ID NO: 916708 - RNA, 14 nt, Mycobacterium avium subsp. paratuberculosis
cgccgugacgccga

SEQ ID NO: 916709 - RNA, 16 nt, Mycobacterium avium subsp. paratuberculosis
cgccgugacgccgauc

SEQ ID NO: 916710 - RNA, 16 nt, Mycobacterium avium subsp. paratuberculosis
cgccgugaacugugcg

SEQ ID NO: 916711 - RNA, 23 nt, Mycobacterium avium subsp. paratuberculosis
cgccgugaacugugcggugcggc

SEQ ID NO: 916712 - RNA, 18 nt, Mycobacterium avium subsp. paratuberculosis
cgccgugaagggcccgcc

SEQ ID NO: 916713 - RNA, 16 nt, Mycobacterium avium subsp. paratuberculosis
cgccgugaccggcgau

SEQ ID NO: 916714 - RNA, 19 nt, Mycobacterium avium subsp. paratuberculosis
cgccgugcagaacagcacg

SEQ ID NO: 916715 - RNA, 13 nt, Mycobacterium avium subsp. paratuberculosis
cgccgugcccggc

SEQ ID NO: 916716 - RNA, 21 nt, Mycobacterium avium subsp. paratuberculosis
cgccgugcauccagccgucca

SEQ ID NO: 916717 - RNA, 22 nt, Mycobacterium avium subsp. paratuberculosis
cgccgugcauccagccguccag

SEQ ID NO: 916718 - RNA, 23 nt, Mycobacterium avium subsp. paratuberculosis
cgccgugcauccagccguccagc

SEQ ID NO: 916719 - RNA, 16 nt, Mycobacterium avium subsp. paratuberculosis
cgccgugccgcgcggc

SEQ ID NO: 916720 - RNA, 17 nt, Mycobacterium avium subsp. paratuberculosis
cgccgugccgcgcggcg

SEQ ID NO: 916721 - RNA, 20 nt, Mycobacterium avium subsp. paratuberculosis
cgccgugccgcgcggcgaug

SEQ ID NO: 916722 - RNA, 13 nt, Mycobacterium avium subsp. paratuberculosis
cgccgugccggac

SEQ ID NO: 916723 - RNA, 16 nt, Mycobacterium avium subsp. paratuberculosis
cgccgugccggaccgc

SEQ ID NO: 916724 - RNA, 20 nt, Mycobacterium avium subsp. paratuberculosis
cgccgugccggaccgcgcgg

SEQ ID NO: 916725 - RNA, 14 nt, Mycobacterium avium subsp. paratuberculosis
cgccgugcagcacg

SEQ ID NO: 916726 - RNA, 19 nt, Mycobacterium avium subsp. paratuberculosis
cgccgugcagcacgccgcg

SEQ ID NO: 916727 - RNA, 21 nt, Mycobacterium avium subsp. paratuberculosis
cgccgugcagcacgccgcgga

SEQ ID NO: 916728 - RNA, 12 nt, Mycobacterium avium subsp. paratuberculosis
cgccgugcagga

SEQ ID NO: 916729 - RNA, 22 nt, Mycobacterium avium subsp. paratuberculosis
cgccgucuucccagugccgcag

SEQ ID NO: 916730 - RNA, 14 nt, Mycobacterium avium subsp. paratuberculosis
cgccgucuuccggg

SEQ ID NO: 916731 - RNA, 22 nt, Mycobacterium avium subsp. paratuberculosis
cgccgucugguccaccgggcag

SEQ ID NO: 916732 - RNA, 18 nt, Mycobacterium avium subsp. paratuberculosis
cgccgucgacgcgugcgu

SEQ ID NO: 916733 - RNA, 15 nt, Mycobacterium avium subsp. paratuberculosis
cgccgucgacgguga

SEQ ID NO: 916734 - RNA, 20 nt, Mycobacterium avium subsp. paratuberculosis
cgccgucgacggugaucagg

SEQ ID NO: 916735 - RNA, 14 nt, Mycobacterium avium subsp. paratuberculosis
cgccgucgacgacg

SEQ ID NO: 916736 - RNA, 14 nt, Mycobacterium avium subsp. paratuberculosis
cgccgucgaccacg

SEQ ID NO: 916737 - RNA, 14 nt, Mycobacterium avium subsp. paratuberculosis
cgccgucgaccagc

SEQ ID NO: 916738 - RNA, 15 nt, Mycobacterium avium subsp. paratuberculosis
cgccgucgaccagcu

SEQ ID NO: 916739 - RNA, 17 nt, Mycobacterium avium subsp. paratuberculosis
cgccgucgaccagcuug

SEQ ID NO: 916740 - RNA, 13 nt, Mycobacterium avium subsp. paratuberculosis
cgccgucgaccac

SEQ ID NO: 916741 - RNA, 20 nt, Mycobacterium avium subsp. paratuberculosis
cgccgucgaaggccgggcug

SEQ ID NO: 916742 - RNA, 21 nt, Mycobacterium avium subsp. paratuberculosis
cgccgucgaaggccgggcugg

SEQ ID NO: 916743 - RNA, 19 nt, Mycobacterium avium subsp. paratuberculosis
cgccguccuccucgucggc

SEQ ID NO: 916744 - RNA, 19 nt, Mycobacterium avium subsp. paratuberculosis
cgccguccucgcgucgcgc

SEQ ID NO: 916745 - RNA, 22 nt, Mycobacterium avium subsp. paratuberculosis
cgccguccucgcgucgcgcggu

SEQ ID NO: 916746 - RNA, 23 nt, Mycobacterium avium subsp. paratuberculosis
cgccguccugagguauucgucga

SEQ ID NO: 916747 - RNA, 14 nt, Mycobacterium avium subsp. paratuberculosis
cgccguccuugacg

SEQ ID NO: 916748 - RNA, 19 nt, Mycobacterium avium subsp. paratuberculosis
cgccguccuugacgaacga

SEQ ID NO: 916749 - RNA, 15 nt, Mycobacterium avium subsp. paratuberculosis
cgccguccuuggccg

SEQ ID NO: 916750 - RNA, 20 nt, Mycobacterium avium subsp. paratuberculosis
cgccguccuuggccgccagc

SEQ ID NO: 916751 - RNA, 22 nt, Mycobacterium avium subsp. paratuberculosis
cgccguccuuggccgccagcac

SEQ ID NO: 916752 - RNA, 23 nt, Mycobacterium avium subsp. paratuberculosis
cgccguccuuggccgccagcacc

SEQ ID NO: 916753 - RNA, 17 nt, Mycobacterium avium subsp. paratuberculosis
cgccguccuuggucaca

SEQ ID NO: 916754 - RNA, 16 nt, Mycobacterium avium subsp. paratuberculosis
cgccguccgcggcggc

SEQ ID NO: 916755 - RNA, 17 nt, Mycobacterium avium subsp. paratuberculosis
cgccguccgcggcggcc

SEQ ID NO: 916756 - RNA, 12 nt, Mycobacterium avium subsp. paratuberculosis
cgccguccggcc

SEQ ID NO: 916757 - RNA, 14 nt, Mycobacterium avium subsp. paratuberculosis
cgccguccggccac

SEQ ID NO: 916758 - RNA, 17 nt, Mycobacterium avium subsp. paratuberculosis
cgccguccggccacgac

SEQ ID NO: 916759 - RNA, 22 nt, Mycobacterium avium subsp. paratuberculosis
cgccguccggccacgaccucgg

SEQ ID NO: 916760 - RNA, 18 nt, Mycobacterium avium subsp. paratuberculosis
cgccguccgggcacccga

SEQ ID NO: 916761 - RNA, 20 nt, Mycobacterium avium subsp. paratuberculosis
cgccguccgggcacccgacg

SEQ ID NO: 916762 - RNA, 24 nt, Mycobacterium avium subsp. paratuberculosis
cgccguccgggcacccgacgucga

SEQ ID NO: 916763 - RNA, 15 nt, Mycobacterium avium subsp. paratuberculosis
cgccguccggggccg

SEQ ID NO: 916764 - RNA, 17 nt, Mycobacterium avium subsp. paratuberculosis
cgccguccggggccggu

SEQ ID NO: 916765 - RNA, 17 nt, Mycobacterium avium subsp. paratuberculosis
cgccgucccgucacggc

SEQ ID NO: 916766 - RNA, 21 nt, Mycobacterium avium subsp. paratuberculosis
cgccgucccgucacggcugcc

SEQ ID NO: 916767 - RNA, 17 nt, Mycobacterium avium subsp. paratuberculosis
cgccgucccguccgacg

SEQ ID NO: 916768 - RNA, 21 nt, Mycobacterium avium subsp. paratuberculosis
cgccgucccguccgacggcua

SEQ ID NO: 916769 - RNA, 21 nt, Mycobacterium avium subsp. paratuberculosis
cgccgucccggacgcugcggu

SEQ ID NO: 916770 - RNA, 12 nt, Mycobacterium avium subsp. paratuberculosis
cgccguccgcac

SEQ ID NO: 916771 - RNA, 22 nt, Mycobacterium avium subsp. paratuberculosis
cgccguccgcaccgcgacgaga

SEQ ID NO: 916772 - RNA, 21 nt, Mycobacterium avium subsp. paratuberculosis
cgccugccuggccacgugguc

SEQ ID NO: 916773 - RNA, 22 nt, Mycobacterium avium subsp. paratuberculosis
cgccugcccggagaaaccgucg

SEQ ID NO: 916774 - RNA, 14 nt, Mycobacterium avium subsp. paratuberculosis
cgccugcccgggcg

SEQ ID NO: 916775 - RNA, 18 nt, Mycobacterium avium subsp. paratuberculosis
cgccugcccgggcgccga

SEQ ID NO: 916776 - RNA, 12 nt, Mycobacterium avium subsp. paratuberculosis
cgccugccggcg

SEQ ID NO: 916777 - RNA, 14 nt, Mycobacterium avium subsp. paratuberculosis
cgccugccggcgcc

SEQ ID NO: 916778 - RNA, 15 nt, Mycobacterium avium subsp. paratuberculosis
cgccugccggcgccg

SEQ ID NO: 916779 - RNA, 17 nt, Mycobacterium avium subsp. paratuberculosis
cgccugccggcgccgga

SEQ ID NO: 916780 - RNA, 19 nt, Mycobacterium avium subsp. paratuberculosis
cgccugauacgacguccgg

SEQ ID NO: 916781 - RNA, 20 nt, Mycobacterium avium subsp. paratuberculosis
cgccugauacgacguccggg

SEQ ID NO: 916782 - RNA, 21 nt, Mycobacterium avium subsp. paratuberculosis
cgccugauacgacguccgggc

SEQ ID NO: 916783 - RNA, 23 nt, Mycobacterium avium subsp. paratuberculosis
cgccugauacgacguccgggccg

SEQ ID NO: 916784 - RNA, 18 nt, Mycobacterium avium subsp. paratuberculosis
cgccugauccgcggucag

SEQ ID NO: 916785 - RNA, 22 nt, Mycobacterium avium subsp. paratuberculosis
cgccucguucgaguaggcgacc

SEQ ID NO: 916786 - RNA, 21 nt, Mycobacterium avium subsp. paratuberculosis
cgccucgugcaugugcucggc

SEQ ID NO: 916787 - RNA, 21 nt, Mycobacterium avium subsp. paratuberculosis
cgccucguuggccagcucggc

SEQ ID NO: 916788 - RNA, 15 nt, Mycobacterium avium subsp. paratuberculosis
cgccucgccgggccc

SEQ ID NO: 916789 - RNA, 18 nt, Mycobacterium avium subsp. paratuberculosis
cgccucgccgggcccgcu

SEQ ID NO: 916790 - RNA, 16 nt, Mycobacterium avium subsp. paratuberculosis
cgccucgccggucacc

SEQ ID NO: 916791 - RNA, 14 nt, Mycobacterium avium subsp. paratuberculosis
cgccucgcgcagcg

SEQ ID NO: 916792 - RNA, 17 nt, Mycobacterium avium subsp. paratuberculosis
cgccucaggcgagcacc

SEQ ID NO: 916793 - RNA, 19 nt, Mycobacterium avium subsp. paratuberculosis
cgccucaggcgagcacccg

SEQ ID NO: 916794 - RNA, 21 nt, Mycobacterium avium subsp. paratuberculosis
cgccucaggcgagcacccgga

SEQ ID NO: 916795 - RNA, 21 nt, Mycobacterium avium subsp. paratuberculosis
cgccucaggcugacgccacgc

SEQ ID NO: 916796 - RNA, 13 nt, Mycobacterium avium subsp. paratuberculosis
cgccucaugccag

SEQ ID NO: 916797 - RNA, 21 nt, Mycobacterium avium subsp. paratuberculosis
cgccuccacauacgcggcggc

SEQ ID NO: 916798 - RNA, 19 nt, Mycobacterium avium subsp. paratuberculosis
cgccuccugcuggcgcugc

SEQ ID NO: 916799 - RNA, 20 nt, Mycobacterium avium subsp. paratuberculosis
cgccuccgguuugcgccggc

SEQ ID NO: 916800 - RNA, 23 nt, Mycobacterium avium subsp. paratuberculosis
cgccuccgguuugcgccggcucc

SEQ ID NO: 916801 - RNA, 13 nt, Mycobacterium avium subsp. paratuberculosis
cgccuccagcacg

SEQ ID NO: 916802 - RNA, 16 nt, Mycobacterium avium subsp. paratuberculosis
cgccuccagcacgucg

SEQ ID NO: 916803 - RNA, 23 nt, Mycobacterium avium subsp. paratuberculosis
cgccucagcagcugcuggcguga

SEQ ID NO: 916804 - RNA, 18 nt, Mycobacterium avium subsp. paratuberculosis
cgccucacgcagggccaa

SEQ ID NO: 916805 - RNA, 18 nt, Mycobacterium avium subsp. paratuberculosis
cgccucaccccagcgcga

SEQ ID NO: 916806 - RNA, 20 nt, Mycobacterium avium subsp. paratuberculosis
cgccucaccccagcgcgacc

SEQ ID NO: 916807 - RNA, 16 nt, Mycobacterium avium subsp. paratuberculosis
cgccucgaugcgggug

SEQ ID NO: 916808 - RNA, 17 nt, Mycobacterium avium subsp. paratuberculosis
cgccucgauggcccgcu

SEQ ID NO: 916809 - RNA, 18 nt, Mycobacterium avium subsp. paratuberculosis
cgccucgcagcgacaauc

SEQ ID NO: 916810 - RNA, 23 nt, Mycobacterium avium subsp. paratuberculosis
cgccucgaucugguucaccgcca

SEQ ID NO: 916811 - RNA, 14 nt, Mycobacterium avium subsp. paratuberculosis
cgccucgccagccc

SEQ ID NO: 916812 - RNA, 15 nt, Mycobacterium avium subsp. paratuberculosis
cgccucgccagcccc

SEQ ID NO: 916813 - RNA, 23 nt, Mycobacterium avium subsp. paratuberculosis
cgccucgccgaccuuggcguugu

SEQ ID NO: 916814 - RNA, 14 nt, Mycobacterium avium subsp. paratuberculosis
cgccucgcccucgg

SEQ ID NO: 916815 - RNA, 17 nt, Mycobacterium avium subsp. paratuberculosis
cgccucgaucagagcgg

SEQ ID NO: 916816 - RNA, 21 nt, Mycobacterium avium subsp. paratuberculosis
cgccucgaucagagcgggccg

SEQ ID NO: 916817 - RNA, 19 nt, Mycobacterium avium subsp. paratuberculosis
cgccucgaucagcgcgaaa

SEQ ID NO: 916818 - RNA, 14 nt, Mycobacterium avium subsp. paratuberculosis
cgccucgacgguga

SEQ ID NO: 916819 - RNA, 18 nt, Mycobacterium avium subsp. paratuberculosis
cgccucgagcaccacggc

SEQ ID NO: 916820 - RNA, 21 nt, Mycobacterium avium subsp. paratuberculosis
cgccucgagcaccacggcccg

SEQ ID NO: 916821 - RNA, 18 nt, Mycobacterium avium subsp. paratuberculosis
cgccucgagcgcccgggc

SEQ ID NO: 916822 - RNA, 19 nt, Mycobacterium avium subsp. paratuberculosis
cgccucgagcgcccgggcg

SEQ ID NO: 916823 - RNA, 17 nt, Mycobacterium avium subsp. paratuberculosis
cgccucgaaggcgccga

SEQ ID NO: 916824 - RNA, 14 nt, Mycobacterium avium subsp. paratuberculosis
cgccucgaagucgc

SEQ ID NO: 916825 - RNA, 17 nt, Mycobacterium avium subsp. paratuberculosis
cgccucgaagucgccgg

SEQ ID NO: 916826 - RNA, 18 nt, Mycobacterium avium subsp. paratuberculosis
cgccucgaagucgccggc

SEQ ID NO: 916827 - RNA, 19 nt, Mycobacterium avium subsp. paratuberculosis
cgccucgaagucgccggcc

SEQ ID NO: 916828 - RNA, 14 nt, Mycobacterium avium subsp. paratuberculosis
cgccucgaccagca

SEQ ID NO: 916829 - RNA, 13 nt, Mycobacterium avium subsp. paratuberculosis
cgccucgaccagg

SEQ ID NO: 916830 - RNA, 14 nt, Mycobacterium avium subsp. paratuberculosis
cgccuugucgaugg

SEQ ID NO: 916831 - RNA, 17 nt, Mycobacterium avium subsp. paratuberculosis
cgccuuggugccguuga

SEQ ID NO: 916832 - RNA, 22 nt, Mycobacterium avium subsp. paratuberculosis
cgccuugggucccaucgcugcc

SEQ ID NO: 916833 - RNA, 14 nt, Mycobacterium avium subsp. paratuberculosis
cgccuuggccucgg

SEQ ID NO: 916834 - RNA, 18 nt, Mycobacterium avium subsp. paratuberculosis
cgccugcuucuggaugcg

SEQ ID NO: 916835 - RNA, 20 nt, Mycobacterium avium subsp. paratuberculosis
cgccugcuucuggaugcggu

SEQ ID NO: 916836 - RNA, 24 nt, Mycobacterium avium subsp. paratuberculosis
cgccugcuucuggaugcggucguc

SEQ ID NO: 916837 - RNA, 18 nt, Mycobacterium avium subsp. paratuberculosis
cgccugcuggacguuggg

SEQ ID NO: 916838 - RNA, 16 nt, Mycobacterium avium subsp. paratuberculosis
cgcgaaaaccagcacc

SEQ ID NO: 916839 - RNA, 19 nt, Mycobacterium avium subsp. paratuberculosis
cgcgaaaaccagcaccggc

SEQ ID NO: 916840 - RNA, 17 nt, Mycobacterium avium subsp. paratuberculosis
cgcgaaaauaccgccgg

SEQ ID NO: 916841 - RNA, 19 nt, Mycobacterium avium subsp. paratuberculosis
cgcgaaaauaccgccggcc

SEQ ID NO: 916842 - RNA, 22 nt, Mycobacterium avium subsp. paratuberculosis
cgccuuuugcacccgccauggc

SEQ ID NO: 916843 - RNA, 18 nt, Mycobacterium avium subsp. paratuberculosis
cgcgaaacgcaacagcga

SEQ ID NO: 916844 - RNA, 23 nt, Mycobacterium avium subsp. paratuberculosis
cgcgaaacgcaacagcgagucgg

SEQ ID NO: 916845 - RNA, 18 nt, Mycobacterium avium subsp. paratuberculosis
cgcgaaagcacccgacac

SEQ ID NO: 916846 - RNA, 19 nt, Mycobacterium avium subsp. paratuberculosis
cgcgaaaucuucgccguca

SEQ ID NO: 916847 - RNA, 15 nt, Mycobacterium avium subsp. paratuberculosis
cgcgaacgcagucca

SEQ ID NO: 916848 - RNA, 17 nt, Mycobacterium avium subsp. paratuberculosis
cgcgaacgccucggcga

SEQ ID NO: 916849 - RNA, 18 nt, Mycobacterium avium subsp. paratuberculosis
cgcgaacgccucggcgag

SEQ ID NO: 916850 - RNA, 20 nt, Mycobacterium avium subsp. paratuberculosis
cgcgaacgccucggcgagcc

SEQ ID NO: 916851 - RNA, 21 nt, Mycobacterium avium subsp. paratuberculosis
cgcgaaagugcuacugccgac

SEQ ID NO: 916852 - RNA, 16 nt, Mycobacterium avium subsp. paratuberculosis
cgcgaaaggcccaccg

SEQ ID NO: 916853 - RNA, 18 nt, Mycobacterium avium subsp. paratuberculosis
cgcgaaucccggccucgu

SEQ ID NO: 916854 - RNA, 15 nt, Mycobacterium avium subsp. paratuberculosis
cgcgaaucgauaacg

SEQ ID NO: 916855 - RNA, 20 nt, Mycobacterium avium subsp. paratuberculosis
cgcgaaucgauaacgcgcgc

SEQ ID NO: 916856 - RNA, 21 nt, Mycobacterium avium subsp. paratuberculosis
cgcgaaugucgaccaccgggu

SEQ ID NO: 916857 - RNA, 19 nt, Mycobacterium avium subsp. paratuberculosis
cgcgacagccgcccggcgc

SEQ ID NO: 916858 - RNA, 14 nt, Mycobacterium avium subsp. paratuberculosis
cgcgacaucaccgc

SEQ ID NO: 916859 - RNA, 15 nt, Mycobacterium avium subsp. paratuberculosis
cgcgacaucaccgcg

SEQ ID NO: 916860 - RNA, 19 nt, Mycobacterium avium subsp. paratuberculosis
cgcgacaucaccgcgggcg

SEQ ID NO: 916861 - RNA, 12 nt, Mycobacterium avium subsp. paratuberculosis
cgcgacaucgcc

SEQ ID NO: 916862 - RNA, 16 nt, Mycobacterium avium subsp. paratuberculosis
cgcgacaucgccggcg

SEQ ID NO: 916863 - RNA, 19 nt, Mycobacterium avium subsp. paratuberculosis
cgcgacaucgccggcgacc

SEQ ID NO: 916864 - RNA, 15 nt, Mycobacterium avium subsp. paratuberculosis
cgcgacaucggcgcc

SEQ ID NO: 916865 - RNA, 19 nt, Mycobacterium avium subsp. paratuberculosis
cgcgacaucggcgccgacg

SEQ ID NO: 916866 - RNA, 23 nt, Mycobacterium avium subsp. paratuberculosis
cgcgacaucggcgccgacggggu

SEQ ID NO: 916867 - RNA, 17 nt, Mycobacterium avium subsp. paratuberculosis
cgcgacaucggugaccg

SEQ ID NO: 916868 - RNA, 22 nt, Mycobacterium avium subsp. paratuberculosis
cgcgacaucggugaccgucgcc

SEQ ID NO: 916869 - RNA, 16 nt, Mycobacterium avium subsp. paratuberculosis
cgcgaagucgccgccc

SEQ ID NO: 916870 - RNA, 16 nt, Mycobacterium avium subsp. paratuberculosis
cgcgaacuucaggccc

SEQ ID NO: 916871 - RNA, 18 nt, Mycobacterium avium subsp. paratuberculosis
cgcgaacucgucgacgcc

SEQ ID NO: 916872 - RNA, 17 nt, Mycobacterium avium subsp. paratuberculosis
cgcgaacucgucgaugc

SEQ ID NO: 916873 - RNA, 22 nt, Mycobacterium avium subsp. paratuberculosis
cgcgaacucgucgaugcacgcc

SEQ ID NO: 916874 - RNA, 16 nt, Mycobacterium avium subsp. paratuberculosis
cgcgaagguggcgccg

SEQ ID NO: 916875 - RNA, 19 nt, Mycobacterium avium subsp. paratuberculosis
cgcgaagguggcgccggua

SEQ ID NO: 916876 - RNA, 23 nt, Mycobacterium avium subsp. paratuberculosis
cgcgaaguagacgagcucaccgc

SEQ ID NO: 916877 - RNA, 17 nt, Mycobacterium avium subsp. paratuberculosis
cgcgaagucccacugcc

SEQ ID NO: 916878 - RNA, 23 nt, Mycobacterium avium subsp. paratuberculosis
cgcgaacuacuucgucagcagcg

SEQ ID NO: 916879 - RNA, 19 nt, Mycobacterium avium subsp. paratuberculosis
cgcgaacgggucgggggug

SEQ ID NO: 916880 - RNA, 21 nt, Mycobacterium avium subsp. paratuberculosis
cgcgaacgggugaccggcggc

SEQ ID NO: 916881 - RNA, 23 nt, Mycobacterium avium subsp. paratuberculosis
cgcgaacgggugaccggcggcca

SEQ ID NO: 916882 - RNA, 14 nt, Mycobacterium avium subsp. paratuberculosis
cgcgaacgggugcg

SEQ ID NO: 916883 - RNA, 16 nt, Mycobacterium avium subsp. paratuberculosis
cgcgaacgggugcggc

SEQ ID NO: 916884 - RNA, 17 nt, Mycobacterium avium subsp. paratuberculosis
cgcgaacgggugcggcg

SEQ ID NO: 916885 - RNA, 24 nt, Mycobacterium avium subsp. paratuberculosis
cgcgaacgggugcggcgcucggug

SEQ ID NO: 916886 - RNA, 16 nt, Mycobacterium avium subsp. paratuberculosis
cgcgaacgcgccggug

SEQ ID NO: 916887 - RNA, 14 nt, Mycobacterium avium subsp. paratuberculosis
cgcgaacgcgccgg

SEQ ID NO: 916888 - RNA, 16 nt, Mycobacterium avium subsp. paratuberculosis
cgcgaacgcgccccgc

SEQ ID NO: 916889 - RNA, 19 nt, Mycobacterium avium subsp. paratuberculosis
cgcgaacgcgccccgccgg

SEQ ID NO: 916890 - RNA, 14 nt, Mycobacterium avium subsp. paratuberculosis
cgcgaacggcccgc

SEQ ID NO: 916891 - RNA, 16 nt, Mycobacterium avium subsp. paratuberculosis
cgcgaacggcccgccg

SEQ ID NO: 916892 - RNA, 17 nt, Mycobacterium avium subsp. paratuberculosis
cgcgaacggcccgccgc

SEQ ID NO: 916893 - RNA, 18 nt, Mycobacterium avium subsp. paratuberculosis
cgcgaacggcccgccgcc

SEQ ID NO: 916894 - RNA, 20 nt, Mycobacterium avium subsp. paratuberculosis
cgcgaacggcccgccgccgg

SEQ ID NO: 916895 - RNA, 22 nt, Mycobacterium avium subsp. paratuberculosis
cgcgaacggcccgccgccggcg

SEQ ID NO: 916896 - RNA, 15 nt, Mycobacterium avium subsp. paratuberculosis
cgcgaacggguagcc

SEQ ID NO: 916897 - RNA, 21 nt, Mycobacterium avium subsp. paratuberculosis
cgcgacgguuguucagcccgg

SEQ ID NO: 916898 - RNA, 22 nt, Mycobacterium avium subsp. paratuberculosis
cgcgacgguuguucagcccggu

SEQ ID NO: 916899 - RNA, 20 nt, Mycobacterium avium subsp. paratuberculosis
cgcgacggccggggccagca

SEQ ID NO: 916900 - RNA, 17 nt, Mycobacterium avium subsp. paratuberculosis
cgcgacgguggacccga

SEQ ID NO: 916901 - RNA, 22 nt, Mycobacterium avium subsp. paratuberculosis
cgcgacgguguaggacgccgug

SEQ ID NO: 916902 - RNA, 14 nt, Mycobacterium avium subsp. paratuberculosis
cgcgacggucgugc

SEQ ID NO: 916903 - RNA, 22 nt, Mycobacterium avium subsp. paratuberculosis
cgcgacggugagcaacaccggc

SEQ ID NO: 916904 - RNA, 23 nt, Mycobacterium avium subsp. paratuberculosis
cgcgacggugagcaacaccggca

SEQ ID NO: 916905 - RNA, 16 nt, Mycobacterium avium subsp. paratuberculosis
cgcgacgggcacccgc

SEQ ID NO: 916906 - RNA, 18 nt, Mycobacterium avium subsp. paratuberculosis
cgcgacgggcacccgcgc

SEQ ID NO: 916907 - RNA, 21 nt, Mycobacterium avium subsp. paratuberculosis
cgcgacgggcacccgcgcguc

SEQ ID NO: 916908 - RNA, 20 nt, Mycobacterium avium subsp. paratuberculosis
cgcgacgggcaugccgucgg

SEQ ID NO: 916909 - RNA, 23 nt, Mycobacterium avium subsp. paratuberculosis
cgcgacgggcaugccgucggcgc

SEQ ID NO: 916910 - RNA, 19 nt, Mycobacterium avium subsp. paratuberculosis
cgcgacgggcguccgagaa

SEQ ID NO: 916911 - RNA, 13 nt, Mycobacterium avium subsp. paratuberculosis
cgcgacgggcucg

SEQ ID NO: 916912 - RNA, 22 nt, Mycobacterium avium subsp. paratuberculosis
cgcgacgggcugcugcacgucg

SEQ ID NO: 916913 - RNA, 21 nt, Mycobacterium avium subsp. paratuberculosis
cgcgacgggcugucccggccg

SEQ ID NO: 916914 - RNA, 21 nt, Mycobacterium avium subsp. paratuberculosis
cgcgacggguugcggaucggu

SEQ ID NO: 916915 - RNA, 12 nt, Mycobacterium avium subsp. paratuberculosis
cgcgacggucac

SEQ ID NO: 916916 - RNA, 15 nt, Mycobacterium avium subsp. paratuberculosis
cgcgacggucacgcu

SEQ ID NO: 916917 - RNA, 19 nt, Mycobacterium avium subsp. paratuberculosis
cgcgacggucacgcuggcg

SEQ ID NO: 916918 - RNA, 20 nt, Mycobacterium avium subsp. paratuberculosis
cgcgacggucacgcuggcgu

SEQ ID NO: 916919 - RNA, 19 nt, Mycobacterium avium subsp. paratuberculosis
cgcgacggucaguccgggu

SEQ ID NO: 916920 - RNA, 21 nt, Mycobacterium avium subsp. paratuberculosis
cgcgacggucaguccggguug

SEQ ID NO: 916921 - RNA, 21 nt, Mycobacterium avium subsp. paratuberculosis
cgcgacggcgcccgccccgac

SEQ ID NO: 916922 - RNA, 17 nt, Mycobacterium avium subsp. paratuberculosis
cgcgacggcggcgaaga

SEQ ID NO: 916923 - RNA, 23 nt, Mycobacterium avium subsp. paratuberculosis
cgcgacggcggcgaagacgucgg

SEQ ID NO: 916924 - RNA, 13 nt, Mycobacterium avium subsp. paratuberculosis
cgcgacggcgggu

SEQ ID NO: 916925 - RNA, 16 nt, Mycobacterium avium subsp. paratuberculosis
cgcgacggcgggucga

SEQ ID NO: 916926 - RNA, 13 nt, Mycobacterium avium subsp. paratuberculosis
cgcgacggccucg

SEQ ID NO: 916927 - RNA, 14 nt, Mycobacterium avium subsp. paratuberculosis
cgcgacggccucgc

SEQ ID NO: 916928 - RNA, 19 nt, Mycobacterium avium subsp. paratuberculosis
cgcgacggccucgccgucg

SEQ ID NO: 916929 - RNA, 13 nt, Mycobacterium avium subsp. paratuberculosis
cgcgacggcccgg

SEQ ID NO: 916930 - RNA, 16 nt, Mycobacterium avium subsp. paratuberculosis
cgcgacggcccggucc

SEQ ID NO: 916931 - RNA, 12 nt, Mycobacterium avium subsp. paratuberculosis
cgcgacggccgc

SEQ ID NO: 916932 - RNA, 13 nt, Mycobacterium avium subsp. paratuberculosis
cgcgacgugccgg

SEQ ID NO: 916933 - RNA, 17 nt, Mycobacterium avium subsp. paratuberculosis
cgcgacucugcacucag

SEQ ID NO: 916934 - RNA, 16 nt, Mycobacterium avium subsp. paratuberculosis
cgcgacguccaucggg

SEQ ID NO: 916935 - RNA, 19 nt, Mycobacterium avium subsp. paratuberculosis
cgcgacguccaucgggacc

SEQ ID NO: 916936 - RNA, 19 nt, Mycobacterium avium subsp. paratuberculosis
cgcgacgucgaccgcgacg

SEQ ID NO: 916937 - RNA, 20 nt, Mycobacterium avium subsp. paratuberculosis
cgcgacgucgaccgcgacga

SEQ ID NO: 916938 - RNA, 13 nt, Mycobacterium avium subsp. paratuberculosis
cgcgacgucggug

SEQ ID NO: 916939 - RNA, 22 nt, Mycobacterium avium subsp. paratuberculosis
cgcgacgucgguguagucggcg

SEQ ID NO: 916940 - RNA, 23 nt, Mycobacterium avium subsp. paratuberculosis
cgcgacgucgguguagucggcga

SEQ ID NO: 916941 - RNA, 21 nt, Mycobacterium avium subsp. paratuberculosis
cgcgacugggcgcccacccgu

SEQ ID NO: 916942 - RNA, 14 nt, Mycobacterium avium subsp. paratuberculosis
cgcgacugucggcg

SEQ ID NO: 916943 - RNA, 15 nt, Mycobacterium avium subsp. paratuberculosis
cgcgacugucggcgc

SEQ ID NO: 916944 - RNA, 18 nt, Mycobacterium avium subsp. paratuberculosis
cgcgacugucggcgcccc

SEQ ID NO: 916945 - RNA, 17 nt, Mycobacterium avium subsp. paratuberculosis
cgcgacugucggcucgc

SEQ ID NO: 916946 - RNA, 13 nt, Mycobacterium avium subsp. paratuberculosis
cgcgagacccggu

SEQ ID NO: 916947 - RNA, 14 nt, Mycobacterium avium subsp. paratuberculosis
cgcgagacccgguc

SEQ ID NO: 916948 - RNA, 20 nt, Mycobacterium avium subsp. paratuberculosis
cgcgagacgagccgccgcgg

SEQ ID NO: 916949 - RNA, 15 nt, Mycobacterium avium subsp. paratuberculosis
cgcgagaucagcgcc

SEQ ID NO: 916950 - RNA, 18 nt, Mycobacterium avium subsp. paratuberculosis
cgcgagaucagcgccaug

SEQ ID NO: 916951 - RNA, 16 nt, Mycobacterium avium subsp. paratuberculosis
cgcgaccggcccgaac

SEQ ID NO: 916952 - RNA, 16 nt, Mycobacterium avium subsp. paratuberculosis
cgcgaccgucgggacg

SEQ ID NO: 916953 - RNA, 22 nt, Mycobacterium avium subsp. paratuberculosis
cgcgaccgucgggacggccagc

SEQ ID NO: 916954 - RNA, 23 nt, Mycobacterium avium subsp. paratuberculosis
cgcgaccgucgggacggccagca

SEQ ID NO: 916955 - RNA, 13 nt, Mycobacterium avium subsp. paratuberculosis
cgcgaccgucagc

SEQ ID NO: 916956 - RNA, 22 nt, Mycobacterium avium subsp. paratuberculosis
cgcgaccgucagcagggccucg

SEQ ID NO: 916957 - RNA, 23 nt, Mycobacterium avium subsp. paratuberculosis
cgcgaccgucagcagggccucgc

SEQ ID NO: 916958 - RNA, 19 nt, Mycobacterium avium subsp. paratuberculosis
cgcgacgaacagcaccgcc

SEQ ID NO: 916959 - RNA, 23 nt, Mycobacterium avium subsp. paratuberculosis
cgcgacgaacagcaccgccacgg

SEQ ID NO: 916960 - RNA, 19 nt, Mycobacterium avium subsp. paratuberculosis
cgcgacgaaccgccacacg

SEQ ID NO: 916961 - RNA, 14 nt, Mycobacterium avium subsp. paratuberculosis
cgcgacgaagccgg

SEQ ID NO: 916962 - RNA, 16 nt, Mycobacterium avium subsp. paratuberculosis
cgcgacgaagccggug

SEQ ID NO: 916963 - RNA, 17 nt, Mycobacterium avium subsp. paratuberculosis
cgcgacgaagccggugc

SEQ ID NO: 916964 - RNA, 19 nt, Mycobacterium avium subsp. paratuberculosis
cgcgacgaagccggugccc

SEQ ID NO: 916965 - RNA, 17 nt, Mycobacterium avium subsp. paratuberculosis
cgcgacgaagcggucgc

SEQ ID NO: 916966 - RNA, 16 nt, Mycobacterium avium subsp. paratuberculosis
cgcgacgacaccaccg

SEQ ID NO: 916967 - RNA, 19 nt, Mycobacterium avium subsp. paratuberculosis
cgcgacgacaccaccgugc

SEQ ID NO: 916968 - RNA, 20 nt, Mycobacterium avium subsp. paratuberculosis
cgcgacgacaccaccgugcu

SEQ ID NO: 916969 - RNA, 16 nt, Mycobacterium avium subsp. paratuberculosis
cgcgacgacaccgugu

SEQ ID NO: 916970 - RNA, 19 nt, Mycobacterium avium subsp. paratuberculosis
cgcgaccugcaucucgacc

SEQ ID NO: 916971 - RNA, 20 nt, Mycobacterium avium subsp. paratuberculosis
cgcgaccugcaucucgaccc

SEQ ID NO: 916972 - RNA, 22 nt, Mycobacterium avium subsp. paratuberculosis
cgcgaccugcaucucgacccgg

SEQ ID NO: 916973 - RNA, 23 nt, Mycobacterium avium subsp. paratuberculosis
cgcgaccugcaucucgacccggg

SEQ ID NO: 916974 - RNA, 17 nt, Mycobacterium avium subsp. paratuberculosis
cgcgaccucgguggugc

SEQ ID NO: 916975 - RNA, 17 nt, Mycobacterium avium subsp. paratuberculosis
cgcgacgcugagcgcca

SEQ ID NO: 916976 - RNA, 22 nt, Mycobacterium avium subsp. paratuberculosis
cgcgacgcugagcgccaggcca

SEQ ID NO: 916977 - RNA, 20 nt, Mycobacterium avium subsp. paratuberculosis
cgcgacgcugccggggcgca

SEQ ID NO: 916978 - RNA, 22 nt, Mycobacterium avium subsp. paratuberculosis
cgcgacgcugccggggcgcagc

SEQ ID NO: 916979 - RNA, 15 nt, Mycobacterium avium subsp. paratuberculosis
cgcgacgcugccggu

SEQ ID NO: 916980 - RNA, 16 nt, Mycobacterium avium subsp. paratuberculosis
cgcgacgcugccggug

SEQ ID NO: 916981 - RNA, 12 nt, Mycobacterium avium subsp. paratuberculosis
cgcgacgcgcgg

SEQ ID NO: 916982 - RNA, 14 nt, Mycobacterium avium subsp. paratuberculosis
cgcgacgcgcucgg

SEQ ID NO: 916983 - RNA, 16 nt, Mycobacterium avium subsp. paratuberculosis
cgcgacgcgcucggcg

SEQ ID NO: 916984 - RNA, 17 nt, Mycobacterium avium subsp. paratuberculosis
cgcgacgcgcucggcga

SEQ ID NO: 916985 - RNA, 19 nt, Mycobacterium avium subsp. paratuberculosis
cgcgacgcgcucggcgacc

SEQ ID NO: 916986 - RNA, 13 nt, Mycobacterium avium subsp. paratuberculosis
cgcgacgcgggau

SEQ ID NO: 916987 - RNA, 14 nt, Mycobacterium avium subsp. paratuberculosis
cgcgacgcgaucga

SEQ ID NO: 916988 - RNA, 15 nt, Mycobacterium avium subsp. paratuberculosis
cgcgacgcgaucgag

SEQ ID NO: 916989 - RNA, 18 nt, Mycobacterium avium subsp. paratuberculosis
cgcgacgcgcaugcccug

SEQ ID NO: 916990 - RNA, 12 nt, Mycobacterium avium subsp. paratuberculosis
cgcgacgccgac

SEQ ID NO: 916991 - RNA, 13 nt, Mycobacterium avium subsp. paratuberculosis
cgcgacgccgccg

SEQ ID NO: 916992 - RNA, 14 nt, Mycobacterium avium subsp. paratuberculosis
cgcgacgccgccgc

SEQ ID NO: 916993 - RNA, 13 nt, Mycobacterium avium subsp. paratuberculosis
cgcgacgccguca

SEQ ID NO: 916994 - RNA, 19 nt, Mycobacterium avium subsp. paratuberculosis
cgcgacgaugucgacccgc

SEQ ID NO: 916995 - RNA, 20 nt, Mycobacterium avium subsp. paratuberculosis
cgcgacgaugucgacccgcg

SEQ ID NO: 916996 - RNA, 12 nt, Mycobacterium avium subsp. paratuberculosis
cgcgacgccgug

SEQ ID NO: 916997 - RNA, 13 nt, Mycobacterium avium subsp. paratuberculosis
cgcgacgccgugc

SEQ ID NO: 916998 - RNA, 17 nt, Mycobacterium avium subsp. paratuberculosis
cgcgacgcacgccggcg

SEQ ID NO: 916999 - RNA, 18 nt, Mycobacterium avium subsp. paratuberculosis
cgcgacgccagcaccuuc

SEQ ID NO: 917000 - RNA, 19 nt, Mycobacterium avium subsp. paratuberculosis
cgcgacgccagcaccuucg

SEQ ID NO: 917001 - RNA, 12 nt, Mycobacterium avium subsp. paratuberculosis
cgcgacgcccag

SEQ ID NO: 917002 - RNA, 23 nt, Mycobacterium avium subsp. paratuberculosis
cgcgacgacgaaaaugaugccga

SEQ ID NO: 917003 - RNA, 14 nt, Mycobacterium avium subsp. paratuberculosis
cgcgacgagcgggc

SEQ ID NO: 917004 - RNA, 16 nt, Mycobacterium avium subsp. paratuberculosis
cgcgacgagcgggccg

SEQ ID NO: 917005 - RNA, 20 nt, Mycobacterium avium subsp. paratuberculosis
cgcgacgagcgggccgauca

SEQ ID NO: 917006 - RNA, 17 nt, Mycobacterium avium subsp. paratuberculosis
cgcgacgaucagcagcc

SEQ ID NO: 917007 - RNA, 19 nt, Mycobacterium avium subsp. paratuberculosis
cgcgacgaucgcgacggcc

SEQ ID NO: 917008 - RNA, 21 nt, Mycobacterium avium subsp. paratuberculosis
cgcgacgaucgcgacggccgg

SEQ ID NO: 917009 - RNA, 14 nt, Mycobacterium avium subsp. paratuberculosis
cgcgacgaugccgg

SEQ ID NO: 917010 - RNA, 16 nt, Mycobacterium avium subsp. paratuberculosis
cgcgacgaugccggcg

SEQ ID NO: 917011 - RNA, 23 nt, Mycobacterium avium subsp. paratuberculosis
cgcgacgaugccggcgucgucgu

SEQ ID NO: 917012 - RNA, 22 nt, Mycobacterium avium subsp. paratuberculosis
cgcgagaguaucgccacgccga

SEQ ID NO: 917013 - RNA, 23 nt, Mycobacterium avium subsp. paratuberculosis
cgcgagaguaucgccacgccgac

SEQ ID NO: 917014 - RNA, 20 nt, Mycobacterium avium subsp. paratuberculosis
cgcgagagugcaacuaccga

SEQ ID NO: 917015 - RNA, 18 nt, Mycobacterium avium subsp. paratuberculosis
cgcgagcaccgcgaucgc

SEQ ID NO: 917016 - RNA, 23 nt, Mycobacterium avium subsp. paratuberculosis
cgcgagcaccgcgaucgccgacg

SEQ ID NO: 917017 - RNA, 23 nt, Mycobacterium avium subsp. paratuberculosis
cgcgagcacgaaguacagcguca

SEQ ID NO: 917018 - RNA, 15 nt, Mycobacterium avium subsp. paratuberculosis
cgcgagcacgacguc

SEQ ID NO: 917019 - RNA, 19 nt, Mycobacterium avium subsp. paratuberculosis
cgcgagcagcucgacaucg

SEQ ID NO: 917020 - RNA, 17 nt, Mycobacterium avium subsp. paratuberculosis
cgcgagcagggcgggca

SEQ ID NO: 917021 - RNA, 21 nt, Mycobacterium avium subsp. paratuberculosis
cgcgagcagggcgggcaggcc

SEQ ID NO: 917022 - RNA, 22 nt, Mycobacterium avium subsp. paratuberculosis
cgcgagcagggcgggcaggccc

SEQ ID NO: 917023 - RNA, 23 nt, Mycobacterium avium subsp. paratuberculosis
cgcgagcagggcgggcaggcccg

SEQ ID NO: 917024 - RNA, 14 nt, Mycobacterium avium subsp. paratuberculosis
cgcgagcaucaccg

SEQ ID NO: 917025 - RNA, 17 nt, Mycobacterium avium subsp. paratuberculosis
cgcgagcaucaccguca

SEQ ID NO: 917026 - RNA, 14 nt, Mycobacterium avium subsp. paratuberculosis
cgcgagcgcagcgc

SEQ ID NO: 917027 - RNA, 21 nt, Mycobacterium avium subsp. paratuberculosis
cgcgagcgcagcgccaggcag

SEQ ID NO: 917028 - RNA, 18 nt, Mycobacterium avium subsp. paratuberculosis
cgcgagccgcccaggcgg

SEQ ID NO: 917029 - RNA, 23 nt, Mycobacterium avium subsp. paratuberculosis
cgcgagcccgcaaaucagccgag

SEQ ID NO: 917030 - RNA, 15 nt, Mycobacterium avium subsp. paratuberculosis
cgcgagcccggcgac

SEQ ID NO: 917031 - RNA, 23 nt, Mycobacterium avium subsp. paratuberculosis
cgcgagcccggcgacgucgucga

SEQ ID NO: 917032 - RNA, 15 nt, Mycobacterium avium subsp. paratuberculosis
cgcgagccgagccgg

SEQ ID NO: 917033 - RNA, 19 nt, Mycobacterium avium subsp. paratuberculosis
cgcgagccgagccgguccg

SEQ ID NO: 917034 - RNA, 23 nt, Mycobacterium avium subsp. paratuberculosis
cgcgagccgagccgguccgacca

SEQ ID NO: 917035 - RNA, 19 nt, Mycobacterium avium subsp. paratuberculosis
cgcgagcgcuaccgcgcuc

SEQ ID NO: 917036 - RNA, 13 nt, Mycobacterium avium subsp. paratuberculosis
cgcgagcggacgg

SEQ ID NO: 917037 - RNA, 12 nt, Mycobacterium avium subsp. paratuberculosis
cgcgagcgggug

SEQ ID NO: 917038 - RNA, 18 nt, Mycobacterium avium subsp. paratuberculosis
cgcgagcugcuucgucgc

SEQ ID NO: 917039 - RNA, 19 nt, Mycobacterium avium subsp. paratuberculosis
cgcgagcugcuucgucgcc

SEQ ID NO: 917040 - RNA, 21 nt, Mycobacterium avium subsp. paratuberculosis
cgcgagcugcuucgucgccgg

SEQ ID NO: 917041 - RNA, 14 nt, Mycobacterium avium subsp. paratuberculosis
cgcgagcgcgcggu

SEQ ID NO: 917042 - RNA, 15 nt, Mycobacterium avium subsp. paratuberculosis
cgcgagcgcgcggug

SEQ ID NO: 917043 - RNA, 16 nt, Mycobacterium avium subsp. paratuberculosis
cgcgagcgcgcgguga

SEQ ID NO: 917044 - RNA, 13 nt, Mycobacterium avium subsp. paratuberculosis
cgcgagcgcgcug

SEQ ID NO: 917045 - RNA, 14 nt, Mycobacterium avium subsp. paratuberculosis
cgcgagcgcgcugu

SEQ ID NO: 917046 - RNA, 13 nt, Mycobacterium avium subsp. paratuberculosis
cgcgaggccgcca

SEQ ID NO: 917047 - RNA, 14 nt, Mycobacterium avium subsp. paratuberculosis
cgcgaggcgcgaaa

SEQ ID NO: 917048 - RNA, 16 nt, Mycobacterium avium subsp. paratuberculosis
cgcgaggaggggucgg

SEQ ID NO: 917049 - RNA, 17 nt, Mycobacterium avium subsp. paratuberculosis
cgcgaggaggggucggu

SEQ ID NO: 917050 - RNA, 17 nt, Mycobacterium avium subsp. paratuberculosis
cgcgagcgucacgcugg

SEQ ID NO: 917051 - RNA, 21 nt, Mycobacterium avium subsp. paratuberculosis
cgcgaggaaucgcggcaggcg

SEQ ID NO: 917052 - RNA, 14 nt, Mycobacterium avium subsp. paratuberculosis
cgcgaggacgaugg

SEQ ID NO: 917053 - RNA, 20 nt, Mycobacterium avium subsp. paratuberculosis
cgcgaguucgcgcacgcugg

SEQ ID NO: 917054 - RNA, 21 nt, Mycobacterium avium subsp. paratuberculosis
cgcgaguucgcgcacgcuggc

SEQ ID NO: 917055 - RNA, 13 nt, Mycobacterium avium subsp. paratuberculosis
cgcgagucaccgg

SEQ ID NO: 917056 - RNA, 15 nt, Mycobacterium avium subsp. paratuberculosis
cgcgagucaccggcu

SEQ ID NO: 917057 - RNA, 16 nt, Mycobacterium avium subsp. paratuberculosis
cgcgagucgagcaccg

SEQ ID NO: 917058 - RNA, 15 nt, Mycobacterium avium subsp. paratuberculosis
cgcgaggugucgacg

SEQ ID NO: 917059 - RNA, 17 nt, Mycobacterium avium subsp. paratuberculosis
cgcgaggugucgacgcu

SEQ ID NO: 917060 - RNA, 17 nt, Mycobacterium avium subsp. paratuberculosis
cgcgagguccuugcgga

SEQ ID NO: 917061 - RNA, 13 nt, Mycobacterium avium subsp. paratuberculosis
cgcgaggucgacg

SEQ ID NO: 917062 - RNA, 18 nt, Mycobacterium avium subsp. paratuberculosis
cgcgagggccguugcggc

SEQ ID NO: 917063 - RNA, 20 nt, Mycobacterium avium subsp. paratuberculosis
cgcgagggccguugcggcca

SEQ ID NO: 917064 - RNA, 15 nt, Mycobacterium avium subsp. paratuberculosis
cgcgagggcgggcca

SEQ ID NO: 917065 - RNA, 20 nt, Mycobacterium avium subsp. paratuberculosis
cgcgagggcucaacaggcga

SEQ ID NO: 917066 - RNA, 21 nt, Mycobacterium avium subsp. paratuberculosis
cgcgaucacaccaccacgcga

SEQ ID NO: 917067 - RNA, 14 nt, Mycobacterium avium subsp. paratuberculosis
cgcgaucaccaccc

SEQ ID NO: 917068 - RNA, 18 nt, Mycobacterium avium subsp. paratuberculosis
cgcgaucaccaccccggu

SEQ ID NO: 917069 - RNA, 19 nt, Mycobacterium avium subsp. paratuberculosis
cgcgaucaccaccccggug

SEQ ID NO: 917070 - RNA, 20 nt, Mycobacterium avium subsp. paratuberculosis
cgcgaucaccgcggccacca

SEQ ID NO: 917071 - RNA, 22 nt, Mycobacterium avium subsp. paratuberculosis
cgcgaucaccgcggccaccacc

SEQ ID NO: 917072 - RNA, 17 nt, Mycobacterium avium subsp. paratuberculosis
cgcgaucagcgccgucu

SEQ ID NO: 917073 - RNA, 23 nt, Mycobacterium avium subsp. paratuberculosis
cgcgaucaacaccgguccggccg

SEQ ID NO: 917074 - RNA, 18 nt, Mycobacterium avium subsp. paratuberculosis
cgcgauagggccggccgg

SEQ ID NO: 917075 - RNA, 14 nt, Mycobacterium avium subsp. paratuberculosis
cgcgauagccggug

SEQ ID NO: 917076 - RNA, 15 nt, Mycobacterium avium subsp. paratuberculosis
cgcgauagccgguga

SEQ ID NO: 917077 - RNA, 18 nt, Mycobacterium avium subsp. paratuberculosis
cgcgauagccggugaucg

SEQ ID NO: 917078 - RNA, 18 nt, Mycobacterium avium subsp. paratuberculosis
cgcgauagaccucacggu

SEQ ID NO: 917079 - RNA, 20 nt, Mycobacterium avium subsp. paratuberculosis
cgcgauagaccucacggucg

SEQ ID NO: 917080 - RNA, 17 nt, Mycobacterium avium subsp. paratuberculosis
cgcgaugcuauucgggc

SEQ ID NO: 917081 - RNA, 21 nt, Mycobacterium avium subsp. paratuberculosis
cgcgaugcuauucgggccagc

SEQ ID NO: 917082 - RNA, 21 nt, Mycobacterium avium subsp. paratuberculosis
cgcgaugcgacaccgcguccu

SEQ ID NO: 917083 - RNA, 16 nt, Mycobacterium avium subsp. paratuberculosis
cgcgauggcacacagc

SEQ ID NO: 917084 - RNA, 18 nt, Mycobacterium avium subsp. paratuberculosis
cgcgauggcacacagcgu

SEQ ID NO: 917085 - RNA, 14 nt, Mycobacterium avium subsp. paratuberculosis
cgcgaugccggcca

SEQ ID NO: 917086 - RNA, 15 nt, Mycobacterium avium subsp. paratuberculosis
cgcgaugccggccag

SEQ ID NO: 917087 - RNA, 16 nt, Mycobacterium avium subsp. paratuberculosis
cgcgaugccggccagg

SEQ ID NO: 917088 - RNA, 21 nt, Mycobacterium avium subsp. paratuberculosis
cgcgaugccggccaggcacag

SEQ ID NO: 917089 - RNA, 15 nt, Mycobacterium avium subsp. paratuberculosis
cgcgaugcccaagcc

SEQ ID NO: 917090 - RNA, 18 nt, Mycobacterium avium subsp. paratuberculosis
cgcgaugcccaagccggc

SEQ ID NO: 917091 - RNA, 22 nt, Mycobacterium avium subsp. paratuberculosis
cgcgaugcccaagccggccagg

SEQ ID NO: 917092 - RNA, 15 nt, Mycobacterium avium subsp. paratuberculosis
cgcgaugcccgccgg

SEQ ID NO: 917093 - RNA, 17 nt, Mycobacterium avium subsp. paratuberculosis
cgcgaugcccgccggcc

SEQ ID NO: 917094 - RNA, 20 nt, Mycobacterium avium subsp. paratuberculosis
cgcgauggaagcgcccgcgc

SEQ ID NO: 917095 - RNA, 17 nt, Mycobacterium avium subsp. paratuberculosis
cgcgauggacagcagcc

SEQ ID NO: 917096 - RNA, 14 nt, Mycobacterium avium subsp. paratuberculosis
cgcgauggcccgcg

SEQ ID NO: 917097 - RNA, 20 nt, Mycobacterium avium subsp. paratuberculosis
cgcgauggcccgcgcgaugc

SEQ ID NO: 917098 - RNA, 15 nt, Mycobacterium avium subsp. paratuberculosis
cgcgauggcggcgcg

SEQ ID NO: 917099 - RNA, 13 nt, Mycobacterium avium subsp. paratuberculosis
cgcgauggcgcug

SEQ ID NO: 917100 - RNA, 18 nt, Mycobacterium avium subsp. paratuberculosis
cgcgauggcgcuggccgc

SEQ ID NO: 917101 - RNA, 20 nt, Mycobacterium avium subsp. paratuberculosis
cgcgauggcgcuggccgcga

SEQ ID NO: 917102 - RNA, 13 nt, Mycobacterium avium subsp. paratuberculosis
cgcgaugguggcg

SEQ ID NO: 917103 - RNA, 20 nt, Mycobacterium avium subsp. paratuberculosis
cgcgaugguggcgucacgcu

SEQ ID NO: 917104 - RNA, 15 nt, Mycobacterium avium subsp. paratuberculosis
cgcgauguagcggac

SEQ ID NO: 917105 - RNA, 23 nt, Mycobacterium avium subsp. paratuberculosis
cgcgauguagcggacgggccgca

SEQ ID NO: 917106 - RNA, 13 nt, Mycobacterium avium subsp. paratuberculosis
cgcgauggcgugc

SEQ ID NO: 917107 - RNA, 15 nt, Mycobacterium avium subsp. paratuberculosis
cgcgauggcgugccg

SEQ ID NO: 917108 - RNA, 18 nt, Mycobacterium avium subsp. paratuberculosis
cgcgauggcgugccggcg

SEQ ID NO: 917109 - RNA, 16 nt, Mycobacterium avium subsp. paratuberculosis
cgcgcaacagcgucuc

SEQ ID NO: 917110 - RNA, 22 nt, Mycobacterium avium subsp. paratuberculosis
cgcgcaaacugacaggcggucg

SEQ ID NO: 917111 - RNA, 13 nt, Mycobacterium avium subsp. paratuberculosis
cgcgaugucgacg

SEQ ID NO: 917112 - RNA, 21 nt, Mycobacterium avium subsp. paratuberculosis
cgcgcaacaacuucgcguacg

SEQ ID NO: 917113 - RNA, 19 nt, Mycobacterium avium subsp. paratuberculosis
cgcgauucucgcugcggcg

SEQ ID NO: 917114 - RNA, 20 nt, Mycobacterium avium subsp. paratuberculosis
cgcgauucucgcugcggcgc

SEQ ID NO: 917115 - RNA, 24 nt, Mycobacterium avium subsp. paratuberculosis
cgcgaugugccacuucgacggcag

SEQ ID NO: 917116 - RNA, 15 nt, Mycobacterium avium subsp. paratuberculosis
cgcgaugugcucgau

SEQ ID NO: 917117 - RNA, 20 nt, Mycobacterium avium subsp. paratuberculosis
cgcgaugucggugggccgca

SEQ ID NO: 917118 - RNA, 22 nt, Mycobacterium avium subsp. paratuberculosis
cgcgaugucggugggccgcacc

SEQ ID NO: 917119 - RNA, 20 nt, Mycobacterium avium subsp. paratuberculosis
cgcgauccagcgcuggccgg

SEQ ID NO: 917120 - RNA, 21 nt, Mycobacterium avium subsp. paratuberculosis
cgcgauccagguguaccagug

SEQ ID NO: 917121 - RNA, 13 nt, Mycobacterium avium subsp. paratuberculosis
cgcgauccgcgcg

SEQ ID NO: 917122 - RNA, 13 nt, Mycobacterium avium subsp. paratuberculosis
cgcgaucagcucg

SEQ ID NO: 917123 - RNA, 19 nt, Mycobacterium avium subsp. paratuberculosis
cgcgaucagcucguggcgg

SEQ ID NO: 917124 - RNA, 14 nt, Mycobacterium avium subsp. paratuberculosis
cgcgauccacuccg

SEQ ID NO: 917125 - RNA, 22 nt, Mycobacterium avium subsp. paratuberculosis
cgcgauccacuccgaggucagc

SEQ ID NO: 917126 - RNA, 18 nt, Mycobacterium avium subsp. paratuberculosis
cgcgaucaggccggccac

SEQ ID NO: 917127 - RNA, 13 nt, Mycobacterium avium subsp. paratuberculosis
cgcgaucaggcug

SEQ ID NO: 917128 - RNA, 19 nt, Mycobacterium avium subsp. paratuberculosis
cgcgaucaggcugccgcug

SEQ ID NO: 917129 - RNA, 16 nt, Mycobacterium avium subsp. paratuberculosis
cgcgaucagggcccac

SEQ ID NO: 917130 - RNA, 17 nt, Mycobacterium avium subsp. paratuberculosis
cgcgaucagggccgcgg

SEQ ID NO: 917131 - RNA, 18 nt, Mycobacterium avium subsp. paratuberculosis
cgcgaucagggccgcggc

SEQ ID NO: 917132 - RNA, 21 nt, Mycobacterium avium subsp. paratuberculosis
cgcgaucagggccgcggccgc

SEQ ID NO: 917133 - RNA, 23 nt, Mycobacterium avium subsp. paratuberculosis
cgcgaucgccggaucggucucgg

SEQ ID NO: 917134 - RNA, 13 nt, Mycobacterium avium subsp. paratuberculosis
cgcgaucgccggg

SEQ ID NO: 917135 - RNA, 14 nt, Mycobacterium avium subsp. paratuberculosis
cgcgaucgccggga

SEQ ID NO: 917136 - RNA, 15 nt, Mycobacterium avium subsp. paratuberculosis
cgcgaucgccggugc

SEQ ID NO: 917137 - RNA, 16 nt, Mycobacterium avium subsp. paratuberculosis
cgcgaucgccggugcg

SEQ ID NO: 917138 - RNA, 21 nt, Mycobacterium avium subsp. paratuberculosis
cgcgaucgccggugcggccgc

SEQ ID NO: 917139 - RNA, 17 nt, Mycobacterium avium subsp. paratuberculosis
cgcgaucgccaacgcgc

SEQ ID NO: 917140 - RNA, 18 nt, Mycobacterium avium subsp. paratuberculosis
cgcgaucgccgacgucgg

SEQ ID NO: 917141 - RNA, 13 nt, Mycobacterium avium subsp. paratuberculosis
cgcgaucgccgau

SEQ ID NO: 917142 - RNA, 19 nt, Mycobacterium avium subsp. paratuberculosis
cgcgaucgccgauccggcg

SEQ ID NO: 917143 - RNA, 20 nt, Mycobacterium avium subsp. paratuberculosis
cgcgaucgcgguccaggauc

SEQ ID NO: 917144 - RNA, 19 nt, Mycobacterium avium subsp. paratuberculosis
cgcgaucgccagcgcggug

SEQ ID NO: 917145 - RNA, 20 nt, Mycobacterium avium subsp. paratuberculosis
cgcgaucgccagcgcggugu

SEQ ID NO: 917146 - RNA, 13 nt, Mycobacterium avium subsp. paratuberculosis
cgcgauccgggcg

SEQ ID NO: 917147 - RNA, 18 nt, Mycobacterium avium subsp. paratuberculosis
cgcgauccgggcgccggc

SEQ ID NO: 917148 - RNA, 20 nt, Mycobacterium avium subsp. paratuberculosis
cgcgauccgggcgccggccg

SEQ ID NO: 917149 - RNA, 22 nt, Mycobacterium avium subsp. paratuberculosis
cgcgauccgggcgccggccggc

SEQ ID NO: 917150 - RNA, 16 nt, Mycobacterium avium subsp. paratuberculosis
cgcgaucgacagcucc

SEQ ID NO: 917151 - RNA, 17 nt, Mycobacterium avium subsp. paratuberculosis
cgcgaucgacagcucca

SEQ ID NO: 917152 - RNA, 20 nt, Mycobacterium avium subsp. paratuberculosis
cgcgaucuugccgccgcgga

SEQ ID NO: 917153 - RNA, 16 nt, Mycobacterium avium subsp. paratuberculosis
cgcgaugaucagcucg

SEQ ID NO: 917154 - RNA, 23 nt, Mycobacterium avium subsp. paratuberculosis
cgcgaugaucagcucgcgcauca

SEQ ID NO: 917155 - RNA, 15 nt, Mycobacterium avium subsp. paratuberculosis
cgcgaugauggcguc

SEQ ID NO: 917156 - RNA, 17 nt, Mycobacterium avium subsp. paratuberculosis
cgcgaugauggcgucga

SEQ ID NO: 917157 - RNA, 18 nt, Mycobacterium avium subsp. paratuberculosis
cgcgaugauggcgucgac

SEQ ID NO: 917158 - RNA, 21 nt, Mycobacterium avium subsp. paratuberculosis
cgcgaugauggcgucgacgug

SEQ ID NO: 917159 - RNA, 19 nt, Mycobacterium avium subsp. paratuberculosis
cgcgaugcaacaccgaacg

SEQ ID NO: 917160 - RNA, 24 nt, Mycobacterium avium subsp. paratuberculosis
cgcgaugcagaacagccgguccga

SEQ ID NO: 917161 - RNA, 15 nt, Mycobacterium avium subsp. paratuberculosis
cgcgaugaucgccgg

SEQ ID NO: 917162 - RNA, 18 nt, Mycobacterium avium subsp. paratuberculosis
cgcgaucugcucgguguc

SEQ ID NO: 917163 - RNA, 23 nt, Mycobacterium avium subsp. paratuberculosis
cgcgaucuccuuguugacgauga

SEQ ID NO: 917164 - RNA, 14 nt, Mycobacterium avium subsp. paratuberculosis
cgcgaucucggcgg

SEQ ID NO: 917165 - RNA, 20 nt, Mycobacterium avium subsp. paratuberculosis
cgcgaucucggcggacucgg

SEQ ID NO: 917166 - RNA, 17 nt, Mycobacterium avium subsp. paratuberculosis
cgcgaucuccgucaccg

SEQ ID NO: 917167 - RNA, 19 nt, Mycobacterium avium subsp. paratuberculosis
cgcgaucggauggugccca

SEQ ID NO: 917168 - RNA, 14 nt, Mycobacterium avium subsp. paratuberculosis
cgcgaucggcaggu

SEQ ID NO: 917169 - RNA, 19 nt, Mycobacterium avium subsp. paratuberculosis
cgcgaucggcaggucgucg

SEQ ID NO: 917170 - RNA, 13 nt, Mycobacterium avium subsp. paratuberculosis
cgcgaucggccgc

SEQ ID NO: 917171 - RNA, 14 nt, Mycobacterium avium subsp. paratuberculosis
cgcgaucggccgcu

SEQ ID NO: 917172 - RNA, 16 nt, Mycobacterium avium subsp. paratuberculosis
cgcgaucggccgcugc

SEQ ID NO: 917173 - RNA, 17 nt, Mycobacterium avium subsp. paratuberculosis
cgcgaucggccgcugcc

SEQ ID NO: 917174 - RNA, 13 nt, Mycobacterium avium subsp. paratuberculosis
cgcgaucggcgag

SEQ ID NO: 917175 - RNA, 15 nt, Mycobacterium avium subsp. paratuberculosis
cgcgaucggcgagcc

SEQ ID NO: 917176 - RNA, 15 nt, Mycobacterium avium subsp. paratuberculosis
cgcgaucggcgccac

SEQ ID NO: 917177 - RNA, 12 nt, Mycobacterium avium subsp. paratuberculosis
cgcgaucggcgu

SEQ ID NO: 917178 - RNA, 13 nt, Mycobacterium avium subsp. paratuberculosis
cgcgaucggcgug

SEQ ID NO: 917179 - RNA, 18 nt, Mycobacterium avium subsp. paratuberculosis
cgcgaucgucgaccacca

SEQ ID NO: 917180 - RNA, 22 nt, Mycobacterium avium subsp. paratuberculosis
cgcgaucgucgaccaccacgac

SEQ ID NO: 917181 - RNA, 12 nt, Mycobacterium avium subsp. paratuberculosis
cgccgcggcgcc

SEQ ID NO: 917182 - RNA, 20 nt, Mycobacterium avium subsp. paratuberculosis
cgccgcggcgaaaacgccug

SEQ ID NO: 917183 - RNA, 12 nt, Mycobacterium avium subsp. paratuberculosis
cgccgcggcgac

SEQ ID NO: 917184 - RNA, 17 nt, Mycobacterium avium subsp. paratuberculosis
cgccgcggcgaccgggg

SEQ ID NO: 917185 - RNA, 12 nt, Mycobacterium avium subsp. paratuberculosis
cgccgcggcgaa

SEQ ID NO: 917186 - RNA, 13 nt, Mycobacterium avium subsp. paratuberculosis
cgccgcggccggu

SEQ ID NO: 917187 - RNA, 14 nt, Mycobacterium avium subsp. paratuberculosis
cgccgcggccggug

SEQ ID NO: 917188 - RNA, 22 nt, Mycobacterium avium subsp. paratuberculosis
cgccgcggccguugcucucggc

SEQ ID NO: 917189 - RNA, 14 nt, Mycobacterium avium subsp. paratuberculosis
cgccgcggccagcg

SEQ ID NO: 917190 - RNA, 16 nt, Mycobacterium avium subsp. paratuberculosis
cgccgcggccagcgcc

SEQ ID NO: 917191 - RNA, 13 nt, Mycobacterium avium subsp. paratuberculosis
cgccgcggccacg

SEQ ID NO: 917192 - RNA, 14 nt, Mycobacterium avium subsp. paratuberculosis
cgccgcggccgccu

SEQ ID NO: 917193 - RNA, 14 nt, Mycobacterium avium subsp. paratuberculosis
cgccgcggccgcgg

SEQ ID NO: 917194 - RNA, 22 nt, Mycobacterium avium subsp. paratuberculosis
cgccgcggccgcggcgggcgcg

SEQ ID NO: 917195 - RNA, 13 nt, Mycobacterium avium subsp. paratuberculosis
cgccgcggccgga

SEQ ID NO: 917196 - RNA, 14 nt, Mycobacterium avium subsp. paratuberculosis
cgccgcggcccugc

SEQ ID NO: 917197 - RNA, 13 nt, Mycobacterium avium subsp. paratuberculosis
cgccgcggccgaa

SEQ ID NO: 917198 - RNA, 12 nt, Mycobacterium avium subsp. paratuberculosis
cgccgcggccgc

SEQ ID NO: 917199 - RNA, 13 nt, Mycobacterium avium subsp. paratuberculosis
cgccgcggccagc

SEQ ID NO: 917200 - RNA, 12 nt, Mycobacterium avium subsp. paratuberculosis
cgccgcggccag

SEQ ID NO: 917201 - RNA, 13 nt, Mycobacterium avium subsp. paratuberculosis
cgccgcggccaca

SEQ ID NO: 917202 - RNA, 21 nt, Mycobacterium avium subsp. paratuberculosis
cgccgcggauguggaggcgag

SEQ ID NO: 917203 - RNA, 23 nt, Mycobacterium avium subsp. paratuberculosis
cgccgcggauguggaggcgagca

SEQ ID NO: 917204 - RNA, 17 nt, Mycobacterium avium subsp. paratuberculosis
cgccgcggcaacgccag

SEQ ID NO: 917205 - RNA, 20 nt, Mycobacterium avium subsp. paratuberculosis
cgccgcggcaacgccagcca

SEQ ID NO: 917206 - RNA, 21 nt, Mycobacterium avium subsp. paratuberculosis
cgccgcggcaacgccagccag

SEQ ID NO: 917207 - RNA, 20 nt, Mycobacterium avium subsp. paratuberculosis
cgccgcgcuugcgaucgccg

SEQ ID NO: 917208 - RNA, 22 nt, Mycobacterium avium subsp. paratuberculosis
cgccgcggaagccccaggcccg

SEQ ID NO: 917209 - RNA, 20 nt, Mycobacterium avium subsp. paratuberculosis
cgccgcggaaggccagcucc

SEQ ID NO: 917210 - RNA, 12 nt, Mycobacterium avium subsp. paratuberculosis
cgccgcgcuggc

SEQ ID NO: 917211 - RNA, 17 nt, Mycobacterium avium subsp. paratuberculosis
cgccgcggagcggcggu

SEQ ID NO: 917212 - RNA, 20 nt, Mycobacterium avium subsp. paratuberculosis
cgccgcgggcucccgcucgc

SEQ ID NO: 917213 - RNA, 22 nt, Mycobacterium avium subsp. paratuberculosis
cgccgcgggcucccgcucgcca

SEQ ID NO: 917214 - RNA, 13 nt, Mycobacterium avium subsp. paratuberculosis
cgccgcgggucgg

SEQ ID NO: 917215 - RNA, 16 nt, Mycobacterium avium subsp. paratuberculosis
cgccgcgggucggcga

SEQ ID NO: 917216 - RNA, 17 nt, Mycobacterium avium subsp. paratuberculosis
cgccgcgggucggcgac

SEQ ID NO: 917217 - RNA, 18 nt, Mycobacterium avium subsp. paratuberculosis
cgccgcgggucggcgacg

SEQ ID NO: 917218 - RNA, 20 nt, Mycobacterium avium subsp. paratuberculosis
cgccgcgggucggcgacggc

SEQ ID NO: 917219 - RNA, 20 nt, Mycobacterium avium subsp. paratuberculosis
cgccgcgggugacgaucugg

SEQ ID NO: 917220 - RNA, 12 nt, Mycobacterium avium subsp. paratuberculosis
cgccgcgggugc

SEQ ID NO: 917221 - RNA, 13 nt, Mycobacterium avium subsp. paratuberculosis
cgccgcgggugcg

SEQ ID NO: 917222 - RNA, 15 nt, Mycobacterium avium subsp. paratuberculosis
cgccgcgggugcggc

SEQ ID NO: 917223 - RNA, 18 nt, Mycobacterium avium subsp. paratuberculosis
cgccgcgggugcggcacg

SEQ ID NO: 917224 - RNA, 23 nt, Mycobacterium avium subsp. paratuberculosis
cgccgcgggugcggcacggcaug

SEQ ID NO: 917225 - RNA, 20 nt, Mycobacterium avium subsp. paratuberculosis
cgccgcggguggccagccag

SEQ ID NO: 917226 - RNA, 13 nt, Mycobacterium avium subsp. paratuberculosis
cgccgcgggcggu

SEQ ID NO: 917227 - RNA, 15 nt, Mycobacterium avium subsp. paratuberculosis
cgccgcgggcggucg

SEQ ID NO: 917228 - RNA, 14 nt, Mycobacterium avium subsp. paratuberculosis
cgccgcgggcgccg

SEQ ID NO: 917229 - RNA, 15 nt, Mycobacterium avium subsp. paratuberculosis
cgccgcggcuccagc

SEQ ID NO: 917230 - RNA, 17 nt, Mycobacterium avium subsp. paratuberculosis
cgccgcggcuccagcag

SEQ ID NO: 917231 - RNA, 19 nt, Mycobacterium avium subsp. paratuberculosis
cgccgcggcuccagcagcg

SEQ ID NO: 917232 - RNA, 16 nt, Mycobacterium avium subsp. paratuberculosis
cgccgcggcgguggcc

SEQ ID NO: 917233 - RNA, 19 nt, Mycobacterium avium subsp. paratuberculosis
cgccgcggcgguggccugc

SEQ ID NO: 917234 - RNA, 13 nt, Mycobacterium avium subsp. paratuberculosis
cgccgcggcggcc

SEQ ID NO: 917235 - RNA, 13 nt, Mycobacterium avium subsp. paratuberculosis
cgccgcggcggcu

SEQ ID NO: 917236 - RNA, 14 nt, Mycobacterium avium subsp. paratuberculosis
cgccgcggcggcuc

SEQ ID NO: 917237 - RNA, 15 nt, Mycobacterium avium subsp. paratuberculosis
cgccgcggcggcucg

SEQ ID NO: 917238 - RNA, 16 nt, Mycobacterium avium subsp. paratuberculosis
cgccgcggcggcucgg

SEQ ID NO: 917239 - RNA, 17 nt, Mycobacterium avium subsp. paratuberculosis
cgccgcggcggcucggc

SEQ ID NO: 917240 - RNA, 18 nt, Mycobacterium avium subsp. paratuberculosis
cgccgcggcggcucggcg

SEQ ID NO: 917241 - RNA, 22 nt, Mycobacterium avium subsp. paratuberculosis
cgccgcggcggcucggcggcgu

SEQ ID NO: 917242 - RNA, 18 nt, Mycobacterium avium subsp. paratuberculosis
cgccgcggcgcccggcgc

SEQ ID NO: 917243 - RNA, 19 nt, Mycobacterium avium subsp. paratuberculosis
cgccgcggcgcccggcgcc

SEQ ID NO: 917244 - RNA, 21 nt, Mycobacterium avium subsp. paratuberculosis
cgccgcggcgcccucgccggc

SEQ ID NO: 917245 - RNA, 13 nt, Mycobacterium avium subsp. paratuberculosis
cgccgcggcgccg

SEQ ID NO: 917246 - RNA, 14 nt, Mycobacterium avium subsp. paratuberculosis
cgccgcggcgccgc

SEQ ID NO: 917247 - RNA, 20 nt, Mycobacterium avium subsp. paratuberculosis
cgccgcggcgccgccacggc

SEQ ID NO: 917248 - RNA, 16 nt, Mycobacterium avium subsp. paratuberculosis
cgccgcggcgagccgg

SEQ ID NO: 917249 - RNA, 17 nt, Mycobacterium avium subsp. paratuberculosis
cgccgcggcgagccggc

SEQ ID NO: 917250 - RNA, 13 nt, Mycobacterium avium subsp. paratuberculosis
cgccgcggcgauc

SEQ ID NO: 917251 - RNA, 14 nt, Mycobacterium avium subsp. paratuberculosis
cgccgcggcgcccg

SEQ ID NO: 917252 - RNA, 13 nt, Mycobacterium avium subsp. paratuberculosis
cgccgcggcggca

SEQ ID NO: 917253 - RNA, 14 nt, Mycobacterium avium subsp. paratuberculosis
cgccgcggcggcaa

SEQ ID NO: 917254 - RNA, 18 nt, Mycobacterium avium subsp. paratuberculosis
cgccgcggcggcaagucc

SEQ ID NO: 917255 - RNA, 21 nt, Mycobacterium avium subsp. paratuberculosis
cgccgcggcggcacccagguc

SEQ ID NO: 917256 - RNA, 21 nt, Mycobacterium avium subsp. paratuberculosis
cgccgcgcucaacccgggccg

SEQ ID NO: 917257 - RNA, 21 nt, Mycobacterium avium subsp. paratuberculosis
cgccgcgcuugcgaucgccgc

SEQ ID NO: 917258 - RNA, 17 nt, Mycobacterium avium subsp. paratuberculosis
cgccgcgcuugacggcc

SEQ ID NO: 917259 - RNA, 19 nt, Mycobacterium avium subsp. paratuberculosis
cgccgcgcuugacggccgg

SEQ ID NO: 917260 - RNA, 15 nt, Mycobacterium avium subsp. paratuberculosis
cgccgcgcuugcgac

SEQ ID NO: 917261 - RNA, 19 nt, Mycobacterium avium subsp. paratuberculosis
cgccgcgcuugcgaccgcc

SEQ ID NO: 917262 - RNA, 20 nt, Mycobacterium avium subsp. paratuberculosis
cgccgcgcuugcgaccgccg

SEQ ID NO: 917263 - RNA, 21 nt, Mycobacterium avium subsp. paratuberculosis
cgccgcgcuugcgaccgccgc

SEQ ID NO: 917264 - RNA, 22 nt, Mycobacterium avium subsp. paratuberculosis
cgccgcgcuugcgaccgccgcu

SEQ ID NO: 917265 - RNA, 23 nt, Mycobacterium avium subsp. paratuberculosis
cgccgcgcuugcgaccgccgcua

SEQ ID NO: 917266 - RNA, 20 nt, Mycobacterium avium subsp. paratuberculosis
cgccgcgcucgcaccagcgc

SEQ ID NO: 917267 - RNA, 13 nt, Mycobacterium avium subsp. paratuberculosis
cgccgcgcucggc

SEQ ID NO: 917268 - RNA, 15 nt, Mycobacterium avium subsp. paratuberculosis
cgccgcgcucggcca

SEQ ID NO: 917269 - RNA, 18 nt, Mycobacterium avium subsp. paratuberculosis
cgccgcgcucgugcugcu

SEQ ID NO: 917270 - RNA, 20 nt, Mycobacterium avium subsp. paratuberculosis
cgccgcgcguuccagcacgc

SEQ ID NO: 917271 - RNA, 13 nt, Mycobacterium avium subsp. paratuberculosis
cgccgcgcgggua

SEQ ID NO: 917272 - RNA, 22 nt, Mycobacterium avium subsp. paratuberculosis
cgccgcgcggguacggcggccg

SEQ ID NO: 917273 - RNA, 20 nt, Mycobacterium avium subsp. paratuberculosis
cgccgcgcgcgucgacguuc

SEQ ID NO: 917274 - RNA, 14 nt, Mycobacterium avium subsp. paratuberculosis
cgccgcgcggcccg

SEQ ID NO: 917275 - RNA, 15 nt, Mycobacterium avium subsp. paratuberculosis
cgccgcgcggcccgc

SEQ ID NO: 917276 - RNA, 19 nt, Mycobacterium avium subsp. paratuberculosis
cgccgcgcggcccgcgacg

SEQ ID NO: 917277 - RNA, 13 nt, Mycobacterium avium subsp. paratuberculosis
cgccgcgcggccg

SEQ ID NO: 917278 - RNA, 15 nt, Mycobacterium avium subsp. paratuberculosis
cgccgcgcggccggg

SEQ ID NO: 917279 - RNA, 17 nt, Mycobacterium avium subsp. paratuberculosis
cgccgcgcggccgggcu

SEQ ID NO: 917280 - RNA, 15 nt, Mycobacterium avium subsp. paratuberculosis
cgccgcgcgcggcca

SEQ ID NO: 917281 - RNA, 16 nt, Mycobacterium avium subsp. paratuberculosis
cgccgcgcgcggccac

SEQ ID NO: 917282 - RNA, 17 nt, Mycobacterium avium subsp. paratuberculosis
cgccgcgcgcggccacc

SEQ ID NO: 917283 - RNA, 17 nt, Mycobacterium avium subsp. paratuberculosis
cgccgcgcgccagcgcg

SEQ ID NO: 917284 - RNA, 18 nt, Mycobacterium avium subsp. paratuberculosis
cgccgcgcgccagcgcgu

SEQ ID NO: 917285 - RNA, 14 nt, Mycobacterium avium subsp. paratuberculosis
cgccgcgccgccgg

SEQ ID NO: 917286 - RNA, 12 nt, Mycobacterium avium subsp. paratuberculosis
cgccgcgccggg

SEQ ID NO: 917287 - RNA, 14 nt, Mycobacterium avium subsp. paratuberculosis
cgccgcgccgggcg

SEQ ID NO: 917288 - RNA, 14 nt, Mycobacterium avium subsp. paratuberculosis
cgccgcgccggcac

SEQ ID NO: 917289 - RNA, 13 nt, Mycobacterium avium subsp. paratuberculosis
cgccgcgccgccg

SEQ ID NO: 917290 - RNA, 11 nt, Mycobacterium avium subsp. paratuberculosis
cgccgcgccga

SEQ ID NO: 917291 - RNA, 12 nt, Mycobacterium avium subsp. paratuberculosis
cgccgcgccgac

SEQ ID NO: 917292 - RNA, 22 nt, Mycobacterium avium subsp. paratuberculosis
cgccgcgccgaccucgucggcg

SEQ ID NO: 917293 - RNA, 16 nt, Mycobacterium avium subsp. paratuberculosis
cgccgcgccgcccggc

SEQ ID NO: 917294 - RNA, 18 nt, Mycobacterium avium subsp. paratuberculosis
cgccgcgcccgccggccc

SEQ ID NO: 917295 - RNA, 19 nt, Mycobacterium avium subsp. paratuberculosis
cgccgcgcccgccggccca

SEQ ID NO: 917296 - RNA, 20 nt, Mycobacterium avium subsp. paratuberculosis
cgccgcgcccggcuucgccg

SEQ ID NO: 917297 - RNA, 21 nt, Mycobacterium avium subsp. paratuberculosis
cgccgcgcccggcuucgccgc

SEQ ID NO: 917298 - RNA, 15 nt, Mycobacterium avium subsp. paratuberculosis
cgccgcgcccgucga

SEQ ID NO: 917299 - RNA, 21 nt, Mycobacterium avium subsp. paratuberculosis
cgccgcgcccgucgagcguca

SEQ ID NO: 917300 - RNA, 12 nt, Mycobacterium avium subsp. paratuberculosis
cgccgcgcccag

SEQ ID NO: 917301 - RNA, 20 nt, Mycobacterium avium subsp. paratuberculosis
cgccgcgccccggcgcgccu

SEQ ID NO: 917302 - RNA, 13 nt, Mycobacterium avium subsp. paratuberculosis
cgccgcgcccagc

SEQ ID NO: 917303 - RNA, 15 nt, Mycobacterium avium subsp. paratuberculosis
cgccgcgcccagcac

SEQ ID NO: 917304 - RNA, 22 nt, Mycobacterium avium subsp. paratuberculosis
cgccgcgcccagcacgucaccg

SEQ ID NO: 917305 - RNA, 14 nt, Mycobacterium avium subsp. paratuberculosis
cgccgcgccagcac

SEQ ID NO: 917306 - RNA, 17 nt, Mycobacterium avium subsp. paratuberculosis
cgccgcgccagccgccg

SEQ ID NO: 917307 - RNA, 12 nt, Mycobacterium avium subsp. paratuberculosis
cgccgcgccacc

SEQ ID NO: 917308 - RNA, 23 nt, Mycobacterium avium subsp. paratuberculosis
cgccgcgccaccgaggccagcag

SEQ ID NO: 917309 - RNA, 13 nt, Mycobacterium avium subsp. paratuberculosis
cgccgcgccagca

SEQ ID NO: 917310 - RNA, 17 nt, Mycobacterium avium subsp. paratuberculosis
cgccgcgcagcggggcg

SEQ ID NO: 917311 - RNA, 19 nt, Mycobacterium avium subsp. paratuberculosis
cgccgcgcauucaccagcu

SEQ ID NO: 917312 - RNA, 20 nt, Mycobacterium avium subsp. paratuberculosis
cgccgcgcauucaccagcug

SEQ ID NO: 917313 - RNA, 12 nt, Mycobacterium avium subsp. paratuberculosis
cgccgcucaccg

SEQ ID NO: 917314 - RNA, 17 nt, Mycobacterium avium subsp. paratuberculosis
cgccgcucaccgccgag

SEQ ID NO: 917315 - RNA, 18 nt, Mycobacterium avium subsp. paratuberculosis
cgccgcgucgucgucgac

SEQ ID NO: 917316 - RNA, 19 nt, Mycobacterium avium subsp. paratuberculosis
cgccgcgucgucgucgacc

SEQ ID NO: 917317 - RNA, 13 nt, Mycobacterium avium subsp. paratuberculosis
cgccgcgucgugc

SEQ ID NO: 917318 - RNA, 16 nt, Mycobacterium avium subsp. paratuberculosis
cgccgcgucgugccga

SEQ ID NO: 917319 - RNA, 19 nt, Mycobacterium avium subsp. paratuberculosis
cgccgcgucgugccgagcg

SEQ ID NO: 917320 - RNA, 21 nt, Mycobacterium avium subsp. paratuberculosis
cgccgcuagguuuggccagca

SEQ ID NO: 917321 - RNA, 23 nt, Mycobacterium avium subsp. paratuberculosis
cgccgcuagguuuggccagcacc

SEQ ID NO: 917322 - RNA, 21 nt, Mycobacterium avium subsp. paratuberculosis
cgccgcuagucgcccagcagc

SEQ ID NO: 917323 - RNA, 23 nt, Mycobacterium avium subsp. paratuberculosis
cgccgcguaggucuucggugaag

SEQ ID NO: 917324 - RNA, 19 nt, Mycobacterium avium subsp. paratuberculosis
cgccgcucgaccccucggc

SEQ ID NO: 917325 - RNA, 13 nt, Mycobacterium avium subsp. paratuberculosis
cgccgcugcgcgc

SEQ ID NO: 917326 - RNA, 17 nt, Mycobacterium avium subsp. paratuberculosis
cgccgcugcgcgcgcga

SEQ ID NO: 917327 - RNA, 21 nt, Mycobacterium avium subsp. paratuberculosis
cgccgcugcgcgcgcgaucgg

SEQ ID NO: 917328 - RNA, 15 nt, Mycobacterium avium subsp. paratuberculosis
cgccgcugcgggcca

SEQ ID NO: 917329 - RNA, 13 nt, Mycobacterium avium subsp. paratuberculosis
cgccgcugcgugc

SEQ ID NO: 917330 - RNA, 21 nt, Mycobacterium avium subsp. paratuberculosis
cgccgcugcgugcccggaucg

SEQ ID NO: 917331 - RNA, 13 nt, Mycobacterium avium subsp. paratuberculosis
cgccgcucggcca

SEQ ID NO: 917332 - RNA, 14 nt, Mycobacterium avium subsp. paratuberculosis
cgccgcucggccag

SEQ ID NO: 917333 - RNA, 15 nt, Mycobacterium avium subsp. paratuberculosis
cgccgcucggccagc

SEQ ID NO: 917334 - RNA, 21 nt, Mycobacterium avium subsp. paratuberculosis
cgccgcucggccagcagcacc

SEQ ID NO: 917335 - RNA, 17 nt, Mycobacterium avium subsp. paratuberculosis
cgccgcgucgucaucgu

SEQ ID NO: 917336 - RNA, 13 nt, Mycobacterium avium subsp. paratuberculosis
cgccgcgucgucg

SEQ ID NO: 917337 - RNA, 15 nt, Mycobacterium avium subsp. paratuberculosis
cgccgcgucggucag

SEQ ID NO: 917338 - RNA, 15 nt, Mycobacterium avium subsp. paratuberculosis
cgccgcgucgccgcc

SEQ ID NO: 917339 - RNA, 18 nt, Mycobacterium avium subsp. paratuberculosis
cgccgcgucgccgccggg

SEQ ID NO: 917340 - RNA, 20 nt, Mycobacterium avium subsp. paratuberculosis
cgccgcgucgccgccgggcg

SEQ ID NO: 917341 - RNA, 21 nt, Mycobacterium avium subsp. paratuberculosis
cgccgcgucgccgccgggcgc

SEQ ID NO: 917342 - RNA, 14 nt, Mycobacterium avium subsp. paratuberculosis
cgccgcgucgcgcc

SEQ ID NO: 917343 - RNA, 20 nt, Mycobacterium avium subsp. paratuberculosis
cgccgcgucgcgccgccgcg

SEQ ID NO: 917344 - RNA, 17 nt, Mycobacterium avium subsp. paratuberculosis
cgccgcguccucgucga

SEQ ID NO: 917345 - RNA, 18 nt, Mycobacterium avium subsp. paratuberculosis
cgccgcguccucgucgau

SEQ ID NO: 917346 - RNA, 12 nt, Mycobacterium avium subsp. paratuberculosis
cgccgcgucgac

SEQ ID NO: 917347 - RNA, 14 nt, Mycobacterium avium subsp. paratuberculosis
cgccgcgucgacgc

SEQ ID NO: 917348 - RNA, 19 nt, Mycobacterium avium subsp. paratuberculosis
cgccgcgucgacgccgcug

SEQ ID NO: 917349 - RNA, 16 nt, Mycobacterium avium subsp. paratuberculosis
cgccgcguccggggug

SEQ ID NO: 917350 - RNA, 12 nt, Mycobacterium avium subsp. paratuberculosis
cgccgcgucagc

SEQ ID NO: 917351 - RNA, 16 nt, Mycobacterium avium subsp. paratuberculosis
cgccgcgucagcggcg

SEQ ID NO: 917352 - RNA, 21 nt, Mycobacterium avium subsp. paratuberculosis
cgccgcgguuggucaccaggu

SEQ ID NO: 917353 - RNA, 16 nt, Mycobacterium avium subsp. paratuberculosis
cgccgcguacaccggc

SEQ ID NO: 917354 - RNA, 18 nt, Mycobacterium avium subsp. paratuberculosis
cgccgcguacaccggcug

SEQ ID NO: 917355 - RNA, 20 nt, Mycobacterium avium subsp. paratuberculosis
cgccgcguacaccggcugac

SEQ ID NO: 917356 - RNA, 16 nt, Mycobacterium avium subsp. paratuberculosis
cgccgcguacgccgcc

SEQ ID NO: 917357 - RNA, 21 nt, Mycobacterium avium subsp. paratuberculosis
cgccgcgguagcggaccugcg

SEQ ID NO: 917358 - RNA, 14 nt, Mycobacterium avium subsp. paratuberculosis
cgccgcggucaucg

SEQ ID NO: 917359 - RNA, 16 nt, Mycobacterium avium subsp. paratuberculosis
cgccgcggucaucgag

SEQ ID NO: 917360 - RNA, 21 nt, Mycobacterium avium subsp. paratuberculosis
cgccgcggucaucgagccggu

SEQ ID NO: 917361 - RNA, 21 nt, Mycobacterium avium subsp. paratuberculosis
cgccgcgguagaaccaacgcg

SEQ ID NO: 917362 - RNA, 18 nt, Mycobacterium avium subsp. paratuberculosis
cgccgcgguagacaccgc

SEQ ID NO: 917363 - RNA, 13 nt, Mycobacterium avium subsp. paratuberculosis
cgccgcggugcag

SEQ ID NO: 917364 - RNA, 14 nt, Mycobacterium avium subsp. paratuberculosis
cgccgcggugcagc

SEQ ID NO: 917365 - RNA, 15 nt, Mycobacterium avium subsp. paratuberculosis
cgccgcggugcgcca

SEQ ID NO: 917366 - RNA, 21 nt, Mycobacterium avium subsp. paratuberculosis
cgccgcggugcgccacgcccg

SEQ ID NO: 917367 - RNA, 15 nt, Mycobacterium avium subsp. paratuberculosis
cgccgcgguggccgg

SEQ ID NO: 917368 - RNA, 17 nt, Mycobacterium avium subsp. paratuberculosis
cgccgcgguggccggga

SEQ ID NO: 917369 - RNA, 21 nt, Mycobacterium avium subsp. paratuberculosis
cgccgcgguggccgggaugcc

SEQ ID NO: 917370 - RNA, 20 nt, Mycobacterium avium subsp. paratuberculosis
cgccgcgguggguccgccgg

SEQ ID NO: 917371 - RNA, 19 nt, Mycobacterium avium subsp. paratuberculosis
cgccgcgguggugggcgcg

SEQ ID NO: 917372 - RNA, 22 nt, Mycobacterium avium subsp. paratuberculosis
cgccgcgguggugggcgcggug

SEQ ID NO: 917373 - RNA, 23 nt, Mycobacterium avium subsp. paratuberculosis
cgccgcgguggugggcgcggugg

SEQ ID NO: 917374 - RNA, 15 nt, Mycobacterium avium subsp. paratuberculosis
cgccgcugucgucga

SEQ ID NO: 917375 - RNA, 23 nt, Mycobacterium avium subsp. paratuberculosis
cgccgcuggugaacucgccgauc

SEQ ID NO: 917376 - RNA, 18 nt, Mycobacterium avium subsp. paratuberculosis
cgccgcuguccucgucgg

SEQ ID NO: 917377 - RNA, 23 nt, Mycobacterium avium subsp. paratuberculosis
cgccgcuguccucgucggaggcg

SEQ ID NO: 917378 - RNA, 15 nt, Mycobacterium avium subsp. paratuberculosis
cgccgcugggcgugg

SEQ ID NO: 917379 - RNA, 16 nt, Mycobacterium avium subsp. paratuberculosis
cgccgcugggcguggu

SEQ ID NO: 917380 - RNA, 12 nt, Mycobacterium avium subsp. paratuberculosis
cgccgcugggac

SEQ ID NO: 917381 - RNA, 20 nt, Mycobacterium avium subsp. paratuberculosis
cgccggaaggucuuucgucg

SEQ ID NO: 917382 - RNA, 22 nt, Mycobacterium avium subsp. paratuberculosis
cgccggaauggcaaggccagca

SEQ ID NO: 917383 - RNA, 12 nt, Mycobacterium avium subsp. paratuberculosis
cgccggacagcc

SEQ ID NO: 917384 - RNA, 13 nt, Mycobacterium avium subsp. paratuberculosis
cgccggacagccg

SEQ ID NO: 917385 - RNA, 15 nt, Mycobacterium avium subsp. paratuberculosis
cgccggacagccggg

SEQ ID NO: 917386 - RNA, 18 nt, Mycobacterium avium subsp. paratuberculosis
cgccggacagcuggcggu

SEQ ID NO: 917387 - RNA, 22 nt, Mycobacterium avium subsp. paratuberculosis
cgccggacagcuggcggucgcu

SEQ ID NO: 917388 - RNA, 15 nt, Mycobacterium avium subsp. paratuberculosis
cgccggacagcgggc

SEQ ID NO: 917389 - RNA, 18 nt, Mycobacterium avium subsp. paratuberculosis
cgccggacagcgggccga

SEQ ID NO: 917390 - RNA, 19 nt, Mycobacterium avium subsp. paratuberculosis
cgccggacagcgggccgac

SEQ ID NO: 917391 - RNA, 20 nt, Mycobacterium avium subsp. paratuberculosis
cgccggacagcgggccgacc

SEQ ID NO: 917392 - RNA, 19 nt, Mycobacterium avium subsp. paratuberculosis
cgccggcaccagcagccgc

SEQ ID NO: 917393 - RNA, 22 nt, Mycobacterium avium subsp. paratuberculosis
cgccggcaccagcagccgcagc

SEQ ID NO: 917394 - RNA, 13 nt, Mycobacterium avium subsp. paratuberculosis
cgccggcacaccg

SEQ ID NO: 917395 - RNA, 14 nt, Mycobacterium avium subsp. paratuberculosis
cgccggcacaccga

SEQ ID NO: 917396 - RNA, 15 nt, Mycobacterium avium subsp. paratuberculosis
cgccggcacaccgag

SEQ ID NO: 917397 - RNA, 16 nt, Mycobacterium avium subsp. paratuberculosis
cgccggcacaccgagc

SEQ ID NO: 917398 - RNA, 20 nt, Mycobacterium avium subsp. paratuberculosis
cgccggcaacaacgccagcg

SEQ ID NO: 917399 - RNA, 18 nt, Mycobacterium avium subsp. paratuberculosis
cgccggacgugguccggu

SEQ ID NO: 917400 - RNA, 17 nt, Mycobacterium avium subsp. paratuberculosis
cgccggacucgaucgcc

SEQ ID NO: 917401 - RNA, 21 nt, Mycobacterium avium subsp. paratuberculosis
cgccggauucggcgcggcuca

SEQ ID NO: 917402 - RNA, 16 nt, Mycobacterium avium subsp. paratuberculosis
cgccggauuggcgucg

SEQ ID NO: 917403 - RNA, 19 nt, Mycobacterium avium subsp. paratuberculosis
cgccggauuggcgucggug

SEQ ID NO: 917404 - RNA, 16 nt, Mycobacterium avium subsp. paratuberculosis
cgccggauugucgcug

SEQ ID NO: 917405 - RNA, 13 nt, Mycobacterium avium subsp. paratuberculosis
cgccggaccccac

SEQ ID NO: 917406 - RNA, 18 nt, Mycobacterium avium subsp. paratuberculosis
cgccggaccgauccggcg

SEQ ID NO: 917407 - RNA, 20 nt, Mycobacterium avium subsp. paratuberculosis
cgccggaccgauccggcgcc

SEQ ID NO: 917408 - RNA, 22 nt, Mycobacterium avium subsp. paratuberculosis
cgccggaccgauccggcgcccg

SEQ ID NO: 917409 - RNA, 14 nt, Mycobacterium avium subsp. paratuberculosis
cgccgccaacgcga

SEQ ID NO: 917410 - RNA, 14 nt, Mycobacterium avium subsp. paratuberculosis
cgccgccaaccagg

SEQ ID NO: 917411 - RNA, 22 nt, Mycobacterium avium subsp. paratuberculosis
cgccgccaaccaggucgcggcg

SEQ ID NO: 917412 - RNA, 17 nt, Mycobacterium avium subsp. paratuberculosis
cgccgcauuggugccgg

SEQ ID NO: 917413 - RNA, 19 nt, Mycobacterium avium subsp. paratuberculosis
cgccgcauuggugccggcc

SEQ ID NO: 917414 - RNA, 23 nt, Mycobacterium avium subsp. paratuberculosis
cgccgcauuggugccggccucgu

SEQ ID NO: 917415 - RNA, 14 nt, Mycobacterium avium subsp. paratuberculosis
cgccgccaccacga

SEQ ID NO: 917416 - RNA, 22 nt, Mycobacterium avium subsp. paratuberculosis
cgccgccaaggggaacaacgcg

SEQ ID NO: 917417 - RNA, 18 nt, Mycobacterium avium subsp. paratuberculosis
cgccgccacaccucggcg

SEQ ID NO: 917418 - RNA, 19 nt, Mycobacterium avium subsp. paratuberculosis
cgccgccacaccucggcga

SEQ ID NO: 917419 - RNA, 21 nt, Mycobacterium avium subsp. paratuberculosis
cgccgccacaccucggcgacc

SEQ ID NO: 917420 - RNA, 15 nt, Mycobacterium avium subsp. paratuberculosis
cgccgccacgcggcg

SEQ ID NO: 917421 - RNA, 17 nt, Mycobacterium avium subsp. paratuberculosis
cgccgccacgcggcgcg

SEQ ID NO: 917422 - RNA, 14 nt, Mycobacterium avium subsp. paratuberculosis
cgccgccaccgucg

SEQ ID NO: 917423 - RNA, 15 nt, Mycobacterium avium subsp. paratuberculosis
cgccgccaccggccg

SEQ ID NO: 917424 - RNA, 16 nt, Mycobacterium avium subsp. paratuberculosis
cgccgccaccggccgg

SEQ ID NO: 917425 - RNA, 17 nt, Mycobacterium avium subsp. paratuberculosis
cgccgccaccggccggu

SEQ ID NO: 917426 - RNA, 15 nt, Mycobacterium avium subsp. paratuberculosis
cgccgccaccacggc

SEQ ID NO: 917427 - RNA, 20 nt, Mycobacterium avium subsp. paratuberculosis
cgccgccaccccaggcgaug

SEQ ID NO: 917428 - RNA, 17 nt, Mycobacterium avium subsp. paratuberculosis
cgccgccauccguucgg

SEQ ID NO: 917429 - RNA, 13 nt, Mycobacterium avium subsp. paratuberculosis
cgccgccaucgcc

SEQ ID NO: 917430 - RNA, 17 nt, Mycobacterium avium subsp. paratuberculosis
cgccgccauccgcgccg

SEQ ID NO: 917431 - RNA, 18 nt, Mycobacterium avium subsp. paratuberculosis
cgccgccauccgcgccga

SEQ ID NO: 917432 - RNA, 19 nt, Mycobacterium avium subsp. paratuberculosis
cgccgccauccgcgccgaa

SEQ ID NO: 917433 - RNA, 20 nt, Mycobacterium avium subsp. paratuberculosis
cgccgccaucgccucguccc

SEQ ID NO: 917434 - RNA, 17 nt, Mycobacterium avium subsp. paratuberculosis
cgccgccaucuccuccg

SEQ ID NO: 917435 - RNA, 14 nt, Mycobacterium avium subsp. paratuberculosis
cgccgcccacaccg

SEQ ID NO: 917436 - RNA, 17 nt, Mycobacterium avium subsp. paratuberculosis
cgccgcccacaccgaca

SEQ ID NO: 917437 - RNA, 20 nt, Mycobacterium avium subsp. paratuberculosis
cgccgcccacaccgacaccg

SEQ ID NO: 917438 - RNA, 15 nt, Mycobacterium avium subsp. paratuberculosis
cgccgcccaccagca

SEQ ID NO: 917439 - RNA, 16 nt, Mycobacterium avium subsp. paratuberculosis
cgccgcccaccagcac

SEQ ID NO: 917440 - RNA, 17 nt, Mycobacterium avium subsp. paratuberculosis
cgccgcccaccagcaca

SEQ ID NO: 917441 - RNA, 16 nt, Mycobacterium avium subsp. paratuberculosis
cgccgccagcagcagc

SEQ ID NO: 917442 - RNA, 13 nt, Mycobacterium avium subsp. paratuberculosis
cgccgccagcacg

SEQ ID NO: 917443 - RNA, 16 nt, Mycobacterium avium subsp. paratuberculosis
cgccgccagcacguga

SEQ ID NO: 917444 - RNA, 23 nt, Mycobacterium avium subsp. paratuberculosis
cgccgccagcaccaccgucaccg

SEQ ID NO: 917445 - RNA, 19 nt, Mycobacterium avium subsp. paratuberculosis
cgccgccacggcacgucga

SEQ ID NO: 917446 - RNA, 21 nt, Mycobacterium avium subsp. paratuberculosis
cgccgccagcaaccccgcggu

SEQ ID NO: 917447 - RNA, 22 nt, Mycobacterium avium subsp. paratuberculosis
cgccgccagcaaccccgcggug

SEQ ID NO: 917448 - RNA, 22 nt, Mycobacterium avium subsp. paratuberculosis
cgccgaucaacaggcccagcag

SEQ ID NO: 917449 - RNA, 22 nt, Mycobacterium avium subsp. paratuberculosis
cgccgauccggcgccgcgggcg

SEQ ID NO: 917450 - RNA, 14 nt, Mycobacterium avium subsp. paratuberculosis
cgccgauccggcuc

SEQ ID NO: 917451 - RNA, 17 nt, Mycobacterium avium subsp. paratuberculosis
cgccgauccgggcggca

SEQ ID NO: 917452 - RNA, 13 nt, Mycobacterium avium subsp. paratuberculosis
cgccgaucgagac

SEQ ID NO: 917453 - RNA, 20 nt, Mycobacterium avium subsp. paratuberculosis
cgccgaucgugacgccgucc

SEQ ID NO: 917454 - RNA, 23 nt, Mycobacterium avium subsp. paratuberculosis
cgccgaucucgaccagcgccgag

SEQ ID NO: 917455 - RNA, 12 nt, Mycobacterium avium subsp. paratuberculosis
cgccgaucucgg

SEQ ID NO: 917456 - RNA, 15 nt, Mycobacterium avium subsp. paratuberculosis
cgccgaucucggcca

SEQ ID NO: 917457 - RNA, 16 nt, Mycobacterium avium subsp. paratuberculosis
cgccgaucucggccaa

SEQ ID NO: 917458 - RNA, 19 nt, Mycobacterium avium subsp. paratuberculosis
cgccgaucucggccaaccg

SEQ ID NO: 917459 - RNA, 20 nt, Mycobacterium avium subsp. paratuberculosis
cgccgaucucggccaaccgg

SEQ ID NO: 917460 - RNA, 22 nt, Mycobacterium avium subsp. paratuberculosis
cgccgaucucggccaaccgggc

SEQ ID NO: 917461 - RNA, 18 nt, Mycobacterium avium subsp. paratuberculosis
cgccgaucugaccgagca

SEQ ID NO: 917462 - RNA, 18 nt, Mycobacterium avium subsp. paratuberculosis
cgccgaucugcucggcug

SEQ ID NO: 917463 - RNA, 18 nt, Mycobacterium avium subsp. paratuberculosis
cgccgaucuggcgcagcg

SEQ ID NO: 917464 - RNA, 20 nt, Mycobacterium avium subsp. paratuberculosis
cgccgaucuggcgcagcguc

SEQ ID NO: 917465 - RNA, 21 nt, Mycobacterium avium subsp. paratuberculosis
cgccgaucuggcgcagcguca

SEQ ID NO: 917466 - RNA, 16 nt, Mycobacterium avium subsp. paratuberculosis
cgccgaucugucgcgc

SEQ ID NO: 917467 - RNA, 17 nt, Mycobacterium avium subsp. paratuberculosis
cgccgaucuugagccgg

SEQ ID NO: 917468 - RNA, 17 nt, Mycobacterium avium subsp. paratuberculosis
cgccgaucgcgcgcagg

SEQ ID NO: 917469 - RNA, 20 nt, Mycobacterium avium subsp. paratuberculosis
cgccgaucgaucagccgcga

SEQ ID NO: 917470 - RNA, 23 nt, Mycobacterium avium subsp. paratuberculosis
cgccgaucgaucagccgcgacag

SEQ ID NO: 917471 - RNA, 15 nt, Mycobacterium avium subsp. paratuberculosis
cgccgaucgcccggu

SEQ ID NO: 917472 - RNA, 16 nt, Mycobacterium avium subsp. paratuberculosis
cgccgaucgagacgau

SEQ ID NO: 917473 - RNA, 15 nt, Mycobacterium avium subsp. paratuberculosis
cgccgaucgggaccg

SEQ ID NO: 917474 - RNA, 23 nt, Mycobacterium avium subsp. paratuberculosis
cgccgaucgggaccgucaccgug

SEQ ID NO: 917475 - RNA, 21 nt, Mycobacterium avium subsp. paratuberculosis
cgccgaucuugagccggaugc

SEQ ID NO: 917476 - RNA, 16 nt, Mycobacterium avium subsp. paratuberculosis
cgccgcauaccgcccg

SEQ ID NO: 917477 - RNA, 23 nt, Mycobacterium avium subsp. paratuberculosis
cgccgcauaccgcccgcgcuggu

SEQ ID NO: 917478 - RNA, 13 nt, Mycobacterium avium subsp. paratuberculosis
cgccgcauuggca

SEQ ID NO: 917479 - RNA, 16 nt, Mycobacterium avium subsp. paratuberculosis
cgccgcauuggcaccg

SEQ ID NO: 917480 - RNA, 21 nt, Mycobacterium avium subsp. paratuberculosis
cgccgcauuggcaccgucgac

SEQ ID NO: 917481 - RNA, 22 nt, Mycobacterium avium subsp. paratuberculosis
cgccgcauuggcaccgucgacc

SEQ ID NO: 917482 - RNA, 18 nt, Mycobacterium avium subsp. paratuberculosis
cgccgcauuccucggcca

SEQ ID NO: 917483 - RNA, 18 nt, Mycobacterium avium subsp. paratuberculosis
cgccgcaugaugcggcca

SEQ ID NO: 917484 - RNA, 22 nt, Mycobacterium avium subsp. paratuberculosis
cgccgcaugcccuugucgcugg

SEQ ID NO: 917485 - RNA, 22 nt, Mycobacterium avium subsp. paratuberculosis
cgccgccccgaguuccagcucc

SEQ ID NO: 917486 - RNA, 23 nt, Mycobacterium avium subsp. paratuberculosis
cgccgccccgaguuccagcuccg

SEQ ID NO: 917487 - RNA, 15 nt, Mycobacterium avium subsp. paratuberculosis
cgccgcccgcgcggc

SEQ ID NO: 917488 - RNA, 21 nt, Mycobacterium avium subsp. paratuberculosis
cgccgcccgcgcggcggccaa

SEQ ID NO: 917489 - RNA, 18 nt, Mycobacterium avium subsp. paratuberculosis
cgccgcccggagguucgc

SEQ ID NO: 917490 - RNA, 20 nt, Mycobacterium avium subsp. paratuberculosis
cgccgcccgcccgagcguca

SEQ ID NO: 917491 - RNA, 13 nt, Mycobacterium avium subsp. paratuberculosis
cgccgcccgcacc

SEQ ID NO: 917492 - RNA, 20 nt, Mycobacterium avium subsp. paratuberculosis
cgccgcccgcaguucggccg

SEQ ID NO: 917493 - RNA, 14 nt, Mycobacterium avium subsp. paratuberculosis
cgccgccggcggcg

SEQ ID NO: 917494 - RNA, 13 nt, Mycobacterium avium subsp. paratuberculosis
cgccgccggcgga

SEQ ID NO: 917495 - RNA, 13 nt, Mycobacterium avium subsp. paratuberculosis
cgccgccggcgcu

SEQ ID NO: 917496 - RNA, 18 nt, Mycobacterium avium subsp. paratuberculosis
cgccgccggcgcuggcgc

SEQ ID NO: 917497 - RNA, 20 nt, Mycobacterium avium subsp. paratuberculosis
cgccgcccgggcccggggug

SEQ ID NO: 917498 - RNA, 13 nt, Mycobacterium avium subsp. paratuberculosis
cgccgcccgggcg

SEQ ID NO: 917499 - RNA, 14 nt, Mycobacterium avium subsp. paratuberculosis
cgccgcccgucagc

SEQ ID NO: 917500 - RNA, 13 nt, Mycobacterium avium subsp. paratuberculosis
cgccgcccgucca

SEQ ID NO: 917501 - RNA, 17 nt, Mycobacterium avium subsp. paratuberculosis
cgccgcccguccagcgc

SEQ ID NO: 917502 - RNA, 22 nt, Mycobacterium avium subsp. paratuberculosis
cgccgccggugaccacgcugag

SEQ ID NO: 917503 - RNA, 17 nt, Mycobacterium avium subsp. paratuberculosis
cgccgccuccgacagcc

SEQ ID NO: 917504 - RNA, 22 nt, Mycobacterium avium subsp. paratuberculosis
cgccgccuccgacagccgcacc

SEQ ID NO: 917505 - RNA, 20 nt, Mycobacterium avium subsp. paratuberculosis
cgccgccggggcgucggacg

SEQ ID NO: 917506 - RNA, 21 nt, Mycobacterium avium subsp. paratuberculosis
cgccgccggggcgucggacgc

SEQ ID NO: 917507 - RNA, 23 nt, Mycobacterium avium subsp. paratuberculosis
cgccgccgggauaacccagcacc

SEQ ID NO: 917508 - RNA, 22 nt, Mycobacterium avium subsp. paratuberculosis
cgccgccgggccuguccagccg

SEQ ID NO: 917509 - RNA, 14 nt, Mycobacterium avium subsp. paratuberculosis
cgccgccggcggug

SEQ ID NO: 917510 - RNA, 12 nt, Mycobacterium avium subsp. paratuberculosis
cgccgccggcgu

SEQ ID NO: 917511 - RNA, 14 nt, Mycobacterium avium subsp. paratuberculosis
cgccgccggcgucg

SEQ ID NO: 917512 - RNA, 18 nt, Mycobacterium avium subsp. paratuberculosis
cgccgccggcgucgacgu

SEQ ID NO: 917513 - RNA, 20 nt, Mycobacterium avium subsp. paratuberculosis
cgccgccggcgucgacgucg

SEQ ID NO: 917514 - RNA, 20 nt, Mycobacterium avium subsp. paratuberculosis
cgccgccggcgucgccgcuc

SEQ ID NO: 917515 - RNA, 13 nt, Mycobacterium avium subsp. paratuberculosis
cgccgcgaccccg

SEQ ID NO: 917516 - RNA, 15 nt, Mycobacterium avium subsp. paratuberculosis
cgccgcgaccccgga

SEQ ID NO: 917517 - RNA, 14 nt, Mycobacterium avium subsp. paratuberculosis
cgccgcgaccgcga

SEQ ID NO: 917518 - RNA, 16 nt, Mycobacterium avium subsp. paratuberculosis
cgccgcgaccgcgauc

SEQ ID NO: 917519 - RNA, 17 nt, Mycobacterium avium subsp. paratuberculosis
cgccgcgaccgcgauca

SEQ ID NO: 917520 - RNA, 18 nt, Mycobacterium avium subsp. paratuberculosis
cgccgcgacacccgcgac

SEQ ID NO: 917521 - RNA, 22 nt, Mycobacterium avium subsp. paratuberculosis
cgccgcgacgaugucgacccgc

SEQ ID NO: 917522 - RNA, 23 nt, Mycobacterium avium subsp. paratuberculosis
cgccgcgacgaugucgacccgcg

SEQ ID NO: 917523 - RNA, 14 nt, Mycobacterium avium subsp. paratuberculosis
cgccgcgacgccgu

SEQ ID NO: 917524 - RNA, 15 nt, Mycobacterium avium subsp. paratuberculosis
cgccgcgacgccgug

SEQ ID NO: 917525 - RNA, 18 nt, Mycobacterium avium subsp. paratuberculosis
cgccgcgaccgucagcag

SEQ ID NO: 917526 - RNA, 22 nt, Mycobacterium avium subsp. paratuberculosis
cgccgcgaccgucagcagggcc

SEQ ID NO: 917527 - RNA, 14 nt, Mycobacterium avium subsp. paratuberculosis
cgccgcgacggccg

SEQ ID NO: 917528 - RNA, 15 nt, Mycobacterium avium subsp. paratuberculosis
cgccgcgacggccgc

SEQ ID NO: 917529 - RNA, 23 nt, Mycobacterium avium subsp. paratuberculosis
cgccgcgacggguugcggaucgg

SEQ ID NO: 917530 - RNA, 16 nt, Mycobacterium avium subsp. paratuberculosis
cgccgcgacgucggug

SEQ ID NO: 917531 - RNA, 19 nt, Mycobacterium avium subsp. paratuberculosis
cgccgcgacgucgguguag

SEQ ID NO: 917532 - RNA, 12 nt, Mycobacterium avium subsp. paratuberculosis
cgccgcgaacga

SEQ ID NO: 917533 - RNA, 17 nt, Mycobacterium avium subsp. paratuberculosis
cgccgcgaacgacgacc

SEQ ID NO: 917534 - RNA, 20 nt, Mycobacterium avium subsp. paratuberculosis
cgccgcgaacaauuccucug

SEQ ID NO: 917535 - RNA, 16 nt, Mycobacterium avium subsp. paratuberculosis
cgccgccgggcgccac

SEQ ID NO: 917536 - RNA, 21 nt, Mycobacterium avium subsp. paratuberculosis
cgccgccuucuugcgcggcgc

SEQ ID NO: 917537 - RNA, 22 nt, Mycobacterium avium subsp. paratuberculosis
cgccgccuucuugcgcggcgcg

SEQ ID NO: 917538 - RNA, 15 nt, Mycobacterium avium subsp. paratuberculosis
cgccgccuugacgcc

SEQ ID NO: 917539 - RNA, 17 nt, Mycobacterium avium subsp. paratuberculosis
cgccgccuugacgccgg

SEQ ID NO: 917540 - RNA, 19 nt, Mycobacterium avium subsp. paratuberculosis
cgccgccuugacgccgggc

SEQ ID NO: 917541 - RNA, 19 nt, Mycobacterium avium subsp. paratuberculosis
cgccgcgcaggccgccgac

SEQ ID NO: 917542 - RNA, 20 nt, Mycobacterium avium subsp. paratuberculosis
cgccgcgcaggccgccgacg

SEQ ID NO: 917543 - RNA, 17 nt, Mycobacterium avium subsp. paratuberculosis
cgccgcgcauccgcacc

SEQ ID NO: 917544 - RNA, 18 nt, Mycobacterium avium subsp. paratuberculosis
cgccgcgcauccgcaccg

SEQ ID NO: 917545 - RNA, 14 nt, Mycobacterium avium subsp. paratuberculosis
cgccgcgcagcacc

SEQ ID NO: 917546 - RNA, 17 nt, Mycobacterium avium subsp. paratuberculosis
cgccgcgcagcaccgcg

SEQ ID NO: 917547 - RNA, 18 nt, Mycobacterium avium subsp. paratuberculosis
cgccgcgcagcaccgcgu

SEQ ID NO: 917548 - RNA, 20 nt, Mycobacterium avium subsp. paratuberculosis
cgccgcgcagcaccgcgucg

SEQ ID NO: 917549 - RNA, 14 nt, Mycobacterium avium subsp. paratuberculosis
cgccgcgcacgacg

SEQ ID NO: 917550 - RNA, 17 nt, Mycobacterium avium subsp. paratuberculosis
cgccgcgcacgacgugg

SEQ ID NO: 917551 - RNA, 16 nt, Mycobacterium avium subsp. paratuberculosis
cgccgcgcacccggcc

SEQ ID NO: 917552 - RNA, 18 nt, Mycobacterium avium subsp. paratuberculosis
cgccgcgcacccggccac

SEQ ID NO: 917553 - RNA, 20 nt, Mycobacterium avium subsp. paratuberculosis
cgccgcgaucagggcccaca

SEQ ID NO: 917554 - RNA, 16 nt, Mycobacterium avium subsp. paratuberculosis
cgccgcgaucucggcg

SEQ ID NO: 917555 - RNA, 17 nt, Mycobacterium avium subsp. paratuberculosis
cgccgcgaucucggcgg

SEQ ID NO: 917556 - RNA, 23 nt, Mycobacterium avium subsp. paratuberculosis
cgccgcgaucuugccgccgcgga

SEQ ID NO: 917557 - RNA, 15 nt, Mycobacterium avium subsp. paratuberculosis
cgccgcgaugaucac

SEQ ID NO: 917558 - RNA, 18 nt, Mycobacterium avium subsp. paratuberculosis
cgccgcgaugcaacaccg

SEQ ID NO: 917559 - RNA, 15 nt, Mycobacterium avium subsp. paratuberculosis
cgccgcgacgaugcc

SEQ ID NO: 917560 - RNA, 13 nt, Mycobacterium avium subsp. paratuberculosis
cgccgcgagcgca

SEQ ID NO: 917561 - RNA, 17 nt, Mycobacterium avium subsp. paratuberculosis
cgccgcgagcgcagcag

SEQ ID NO: 917562 - RNA, 10 nt, Mycobacterium avium subsp. paratuberculosis
cgccgcgaua

SEQ ID NO: 917563 - RNA, 16 nt, Mycobacterium avium subsp. paratuberculosis
cgcccugcagccgggu

SEQ ID NO: 917564 - RNA, 17 nt, Mycobacterium avium subsp. paratuberculosis
cgcccugcagcgcgaac

SEQ ID NO: 917565 - RNA, 22 nt, Mycobacterium avium subsp. paratuberculosis
cgcccuggccgccggccgcgca

SEQ ID NO: 917566 - RNA, 14 nt, Mycobacterium avium subsp. paratuberculosis
cgcccugccacagc

SEQ ID NO: 917567 - RNA, 18 nt, Mycobacterium avium subsp. paratuberculosis
cgcccugccacagcgaca

SEQ ID NO: 917568 - RNA, 18 nt, Mycobacterium avium subsp. paratuberculosis
cgcccugacacagcaccg

SEQ ID NO: 917569 - RNA, 20 nt, Mycobacterium avium subsp. paratuberculosis
cgcccugacacagcaccggc

SEQ ID NO: 917570 - RNA, 19 nt, Mycobacterium avium subsp. paratuberculosis
cgcccucgucuuccgcggc

SEQ ID NO: 917571 - RNA, 22 nt, Mycobacterium avium subsp. paratuberculosis
cgcccucgucuuccgcggcggc

SEQ ID NO: 917572 - RNA, 18 nt, Mycobacterium avium subsp. paratuberculosis
cgcccugguugauccagc

SEQ ID NO: 917573 - RNA, 15 nt, Mycobacterium avium subsp. paratuberculosis
cgcccuggccgcguu

SEQ ID NO: 917574 - RNA, 14 nt, Mycobacterium avium subsp. paratuberculosis
cgcccugggggucg

SEQ ID NO: 917575 - RNA, 17 nt, Mycobacterium avium subsp. paratuberculosis
cgcccuggugcaacacc

SEQ ID NO: 917576 - RNA, 18 nt, Mycobacterium avium subsp. paratuberculosis
cgccgaacaccggcagcg

SEQ ID NO: 917577 - RNA, 21 nt, Mycobacterium avium subsp. paratuberculosis
cgccgaacaccggcagcgcca

SEQ ID NO: 917578 - RNA, 22 nt, Mycobacterium avium subsp. paratuberculosis
cgccgaacaccggcagcgccac

SEQ ID NO: 917579 - RNA, 13 nt, Mycobacterium avium subsp. paratuberculosis
cgccgaacaccug

SEQ ID NO: 917580 - RNA, 22 nt, Mycobacterium avium subsp. paratuberculosis
cgccgaacaccugcggcggcag

SEQ ID NO: 917581 - RNA, 20 nt, Mycobacterium avium subsp. paratuberculosis
cgccgaacagcagcgcgccg

SEQ ID NO: 917582 - RNA, 22 nt, Mycobacterium avium subsp. paratuberculosis
cgccgaacagcagcgcgccgac

SEQ ID NO: 917583 - RNA, 23 nt, Mycobacterium avium subsp. paratuberculosis
cgccgaacagcagcgcgccgacc

SEQ ID NO: 917584 - RNA, 24 nt, Mycobacterium avium subsp. paratuberculosis
cgccgaacagcagcgcgccgacca

SEQ ID NO: 917585 - RNA, 15 nt, Mycobacterium avium subsp. paratuberculosis
cgccgaaccagaucg

SEQ ID NO: 917586 - RNA, 18 nt, Mycobacterium avium subsp. paratuberculosis
cgccgaaccagaucggcg

SEQ ID NO: 917587 - RNA, 21 nt, Mycobacterium avium subsp. paratuberculosis
cgccgaaccagaucggcgggu

SEQ ID NO: 917588 - RNA, 21 nt, Mycobacterium avium subsp. paratuberculosis
cgccgaaguugucggguucuc

SEQ ID NO: 917589 - RNA, 17 nt, Mycobacterium avium subsp. paratuberculosis
cgccgaaguuccagccg

SEQ ID NO: 917590 - RNA, 20 nt, Mycobacterium avium subsp. paratuberculosis
cgccgaaguuccagccgauc

SEQ ID NO: 917591 - RNA, 21 nt, Mycobacterium avium subsp. paratuberculosis
cgccgaaguuccagccgaucg

SEQ ID NO: 917592 - RNA, 15 nt, Mycobacterium avium subsp. paratuberculosis
cgccgaaugccacgc

SEQ ID NO: 917593 - RNA, 17 nt, Mycobacterium avium subsp. paratuberculosis
cgccgaaugccacgccg

SEQ ID NO: 917594 - RNA, 20 nt, Mycobacterium avium subsp. paratuberculosis
cgccgaaugccacgccgaug

SEQ ID NO: 917595 - RNA, 21 nt, Mycobacterium avium subsp. paratuberculosis
cgccgaaugccacgccgaugg

SEQ ID NO: 917596 - RNA, 15 nt, Mycobacterium avium subsp. paratuberculosis
cgccgacagucgcgg

SEQ ID NO: 917597 - RNA, 19 nt, Mycobacterium avium subsp. paratuberculosis
cgccgacagucgcgggcag

SEQ ID NO: 917598 - RNA, 13 nt, Mycobacterium avium subsp. paratuberculosis
cgccgacaucgcc

SEQ ID NO: 917599 - RNA, 18 nt, Mycobacterium avium subsp. paratuberculosis
cgccgacaucgcggcgau

SEQ ID NO: 917600 - RNA, 19 nt, Mycobacterium avium subsp. paratuberculosis
cgccgacaucgcggcgauc

SEQ ID NO: 917601 - RNA, 20 nt, Mycobacterium avium subsp. paratuberculosis
cgccgacaucgcggcgaucu

SEQ ID NO: 917602 - RNA, 16 nt, Mycobacterium avium subsp. paratuberculosis
cgccgaauccggcggg

SEQ ID NO: 917603 - RNA, 18 nt, Mycobacterium avium subsp. paratuberculosis
cgccgaauccggcgggga

SEQ ID NO: 917604 - RNA, 18 nt, Mycobacterium avium subsp. paratuberculosis
cgccgaaucggcuguggc

SEQ ID NO: 917605 - RNA, 16 nt, Mycobacterium avium subsp. paratuberculosis
cgccgacaucucccgg

SEQ ID NO: 917606 - RNA, 20 nt, Mycobacterium avium subsp. paratuberculosis
cgccgacaucucccggucga

SEQ ID NO: 917607 - RNA, 19 nt, Mycobacterium avium subsp. paratuberculosis
cgccgaccacccccagccc

SEQ ID NO: 917608 - RNA, 20 nt, Mycobacterium avium subsp. paratuberculosis
cgccgaccacccccagcccg

SEQ ID NO: 917609 - RNA, 22 nt, Mycobacterium avium subsp. paratuberculosis
cgccgaccaccuugcgcagcag

SEQ ID NO: 917610 - RNA, 23 nt, Mycobacterium avium subsp. paratuberculosis
cgccgaccaccuugcgcagcagc

SEQ ID NO: 917611 - RNA, 17 nt, Mycobacterium avium subsp. paratuberculosis
cgccgaccacggcccca

SEQ ID NO: 917612 - RNA, 24 nt, Mycobacterium avium subsp. paratuberculosis
cgccgaccacggccccagccgccg

SEQ ID NO: 917613 - RNA, 14 nt, Mycobacterium avium subsp. paratuberculosis
cgccgaccagccga

SEQ ID NO: 917614 - RNA, 17 nt, Mycobacterium avium subsp. paratuberculosis
cgccgaccagccgaggc

SEQ ID NO: 917615 - RNA, 18 nt, Mycobacterium avium subsp. paratuberculosis
cgccgaccagccgaggcg

SEQ ID NO: 917616 - RNA, 14 nt, Mycobacterium avium subsp. paratuberculosis
cgccgaccagcgcg

SEQ ID NO: 917617 - RNA, 15 nt, Mycobacterium avium subsp. paratuberculosis
cgccgaccagcgcgu

SEQ ID NO: 917618 - RNA, 21 nt, Mycobacterium avium subsp. paratuberculosis
cgccgaacugccggaccaggu

SEQ ID NO: 917619 - RNA, 14 nt, Mycobacterium avium subsp. paratuberculosis
cgccgaacucggcg

SEQ ID NO: 917620 - RNA, 15 nt, Mycobacterium avium subsp. paratuberculosis
cgccgaacucggcgc

SEQ ID NO: 917621 - RNA, 19 nt, Mycobacterium avium subsp. paratuberculosis
cgccgaacucggcgccgcc

SEQ ID NO: 917622 - RNA, 18 nt, Mycobacterium avium subsp. paratuberculosis
cgccgaacgugcgcggcg

SEQ ID NO: 917623 - RNA, 21 nt, Mycobacterium avium subsp. paratuberculosis
cgccgaacgugcgcggcgcgc

SEQ ID NO: 917624 - RNA, 16 nt, Mycobacterium avium subsp. paratuberculosis
cgccgaacgucgagcg

SEQ ID NO: 917625 - RNA, 17 nt, Mycobacterium avium subsp. paratuberculosis
cgccgaacgucgagcgc

SEQ ID NO: 917626 - RNA, 22 nt, Mycobacterium avium subsp. paratuberculosis
cgccgaacgucgagcgcggccc

SEQ ID NO: 917627 - RNA, 18 nt, Mycobacterium avium subsp. paratuberculosis
cgccgaacgccaccaccu

SEQ ID NO: 917628 - RNA, 13 nt, Mycobacterium avium subsp. paratuberculosis
cgccgaacgccgg

SEQ ID NO: 917629 - RNA, 23 nt, Mycobacterium avium subsp. paratuberculosis
cgccgaacgccggauuggcgucg

SEQ ID NO: 917630 - RNA, 21 nt, Mycobacterium avium subsp. paratuberculosis
cgccgaacgccuccgccgccc

SEQ ID NO: 917631 - RNA, 18 nt, Mycobacterium avium subsp. paratuberculosis
cgccgaaccccagcuccg

SEQ ID NO: 917632 - RNA, 23 nt, Mycobacterium avium subsp. paratuberculosis
cgccgaaccccagcuccggguag

SEQ ID NO: 917633 - RNA, 12 nt, Mycobacterium avium subsp. paratuberculosis
cgccgaacccgc

SEQ ID NO: 917634 - RNA, 21 nt, Mycobacterium avium subsp. paratuberculosis
cgccgaacccgcccucgcccc

SEQ ID NO: 917635 - RNA, 23 nt, Mycobacterium avium subsp. paratuberculosis
cgccgaacccgcccucgccccgg

SEQ ID NO: 917636 - RNA, 16 nt, Mycobacterium avium subsp. paratuberculosis
cgccgaaccgaucacc

SEQ ID NO: 917637 - RNA, 21 nt, Mycobacterium avium subsp. paratuberculosis
cgccgaaccgaucaccggcag

SEQ ID NO: 917638 - RNA, 14 nt, Mycobacterium avium subsp. paratuberculosis
cgccgaaccgggcg

SEQ ID NO: 917639 - RNA, 18 nt, Mycobacterium avium subsp. paratuberculosis
cgccgaaccgggcgcgca

SEQ ID NO: 917640 - RNA, 19 nt, Mycobacterium avium subsp. paratuberculosis
cgccgaaccgggcgcgcag

SEQ ID NO: 917641 - RNA, 16 nt, Mycobacterium avium subsp. paratuberculosis
cgccgaaccggggccg

SEQ ID NO: 917642 - RNA, 18 nt, Mycobacterium avium subsp. paratuberculosis
cgccgaaccggggccgca

SEQ ID NO: 917643 - RNA, 19 nt, Mycobacterium avium subsp. paratuberculosis
cgccgaaccggggccgcac

SEQ ID NO: 917644 - RNA, 14 nt, Mycobacterium avium subsp. paratuberculosis
cgccgaaccgggug

SEQ ID NO: 917645 - RNA, 16 nt, Mycobacterium avium subsp. paratuberculosis
cgccgagauccaccgc

SEQ ID NO: 917646 - RNA, 17 nt, Mycobacterium avium subsp. paratuberculosis
cgccgagauccaccgcg

SEQ ID NO: 917647 - RNA, 20 nt, Mycobacterium avium subsp. paratuberculosis
cgccgagauccaccgcgcgg

SEQ ID NO: 917648 - RNA, 21 nt, Mycobacterium avium subsp. paratuberculosis
cgccgagauccaccgcgcggc

SEQ ID NO: 917649 - RNA, 24 nt, Mycobacterium avium subsp. paratuberculosis
cgccgagauccaccgcgcggccag

SEQ ID NO: 917650 - RNA, 21 nt, Mycobacterium avium subsp. paratuberculosis
cgccgaccagguagcgcugca

SEQ ID NO: 917651 - RNA, 13 nt, Mycobacterium avium subsp. paratuberculosis
cgccgagaucgcg

SEQ ID NO: 917652 - RNA, 17 nt, Mycobacterium avium subsp. paratuberculosis
cgccgagaucgcggugg

SEQ ID NO: 917653 - RNA, 21 nt, Mycobacterium avium subsp. paratuberculosis
cgccgagaucgcgguggcgcc

SEQ ID NO: 917654 - RNA, 22 nt, Mycobacterium avium subsp. paratuberculosis
cgccgacgucgugggcgauccg

SEQ ID NO: 917655 - RNA, 14 nt, Mycobacterium avium subsp. paratuberculosis
cgccgacgucuggu

SEQ ID NO: 917656 - RNA, 20 nt, Mycobacterium avium subsp. paratuberculosis
cgccgacguuguugucgaug

SEQ ID NO: 917657 - RNA, 14 nt, Mycobacterium avium subsp. paratuberculosis
cgccgacuccccgc

SEQ ID NO: 917658 - RNA, 17 nt, Mycobacterium avium subsp. paratuberculosis
cgccgacuccccgcccg

SEQ ID NO: 917659 - RNA, 16 nt, Mycobacterium avium subsp. paratuberculosis
cgccgacucgcaggug

SEQ ID NO: 917660 - RNA, 21 nt, Mycobacterium avium subsp. paratuberculosis
cgccgacucgcaggugccggu

SEQ ID NO: 917661 - RNA, 20 nt, Mycobacterium avium subsp. paratuberculosis
cgccgagagcgcgucgacgc

SEQ ID NO: 917662 - RNA, 22 nt, Mycobacterium avium subsp. paratuberculosis
cgccgagagcgcgucgacgcgg

SEQ ID NO: 917663 - RNA, 23 nt, Mycobacterium avium subsp. paratuberculosis
cgccgagagcgcgucgacgcggu

SEQ ID NO: 917664 - RNA, 20 nt, Mycobacterium avium subsp. paratuberculosis
cgccgacggucugcggugug

SEQ ID NO: 917665 - RNA, 19 nt, Mycobacterium avium subsp. paratuberculosis
cgccgacggugagcaccgc

SEQ ID NO: 917666 - RNA, 16 nt, Mycobacterium avium subsp. paratuberculosis
cgccgacgucaggggu

SEQ ID NO: 917667 - RNA, 23 nt, Mycobacterium avium subsp. paratuberculosis
cgccgacgucaggguggccucgu

SEQ ID NO: 917668 - RNA, 14 nt, Mycobacterium avium subsp. paratuberculosis
cgccgacguccugg

SEQ ID NO: 917669 - RNA, 17 nt, Mycobacterium avium subsp. paratuberculosis
cgccgacguccugguug

SEQ ID NO: 917670 - RNA, 14 nt, Mycobacterium avium subsp. paratuberculosis
cgccgacgguggcc

SEQ ID NO: 917671 - RNA, 21 nt, Mycobacterium avium subsp. paratuberculosis
cgccgacgguggcccccacca

SEQ ID NO: 917672 - RNA, 22 nt, Mycobacterium avium subsp. paratuberculosis
cgccgacgguggcccccaccac

SEQ ID NO: 917673 - RNA, 19 nt, Mycobacterium avium subsp. paratuberculosis
cgccgacgguggcgaagca

SEQ ID NO: 917674 - RNA, 18 nt, Mycobacterium avium subsp. paratuberculosis
cgccgacgguguccgcgg

SEQ ID NO: 917675 - RNA, 21 nt, Mycobacterium avium subsp. paratuberculosis
cgccgacgguguccgcgggca

SEQ ID NO: 917676 - RNA, 21 nt, Mycobacterium avium subsp. paratuberculosis
cgccgacguaggacagcacca

SEQ ID NO: 917677 - RNA, 22 nt, Mycobacterium avium subsp. paratuberculosis
cgccgacggcugcccggcccgc

SEQ ID NO: 917678 - RNA, 16 nt, Mycobacterium avium subsp. paratuberculosis
cgccgacgggcccagc

SEQ ID NO: 917679 - RNA, 18 nt, Mycobacterium avium subsp. paratuberculosis
cgccgacgggcccagcgc

SEQ ID NO: 917680 - RNA, 19 nt, Mycobacterium avium subsp. paratuberculosis
cgccgacgggcccagcgcg

SEQ ID NO: 917681 - RNA, 20 nt, Mycobacterium avium subsp. paratuberculosis
cgccgacgggcccagcgcga

SEQ ID NO: 917682 - RNA, 21 nt, Mycobacterium avium subsp. paratuberculosis
cgccgacgggcccagcgcgac

SEQ ID NO: 917683 - RNA, 15 nt, Mycobacterium avium subsp. paratuberculosis
cgccgacgggcccgc

SEQ ID NO: 917684 - RNA, 17 nt, Mycobacterium avium subsp. paratuberculosis
cgccgacgggcccgcgc

SEQ ID NO: 917685 - RNA, 22 nt, Mycobacterium avium subsp. paratuberculosis
cgccgacgauacgugcucccgc

SEQ ID NO: 917686 - RNA, 13 nt, Mycobacterium avium subsp. paratuberculosis
cgccgacgauccc

SEQ ID NO: 917687 - RNA, 15 nt, Mycobacterium avium subsp. paratuberculosis
cgccgacggccgcgc

SEQ ID NO: 917688 - RNA, 22 nt, Mycobacterium avium subsp. paratuberculosis
cgccgacgaagaugcgcccggu

SEQ ID NO: 917689 - RNA, 14 nt, Mycobacterium avium subsp. paratuberculosis
cgccgacgaccagu

SEQ ID NO: 917690 - RNA, 12 nt, Mycobacterium avium subsp. paratuberculosis
cgccgacgacga

SEQ ID NO: 917691 - RNA, 21 nt, Mycobacterium avium subsp. paratuberculosis
cgccgacgacgaagacguacg

SEQ ID NO: 917692 - RNA, 15 nt, Mycobacterium avium subsp. paratuberculosis
cgccgacgacggcga

SEQ ID NO: 917693 - RNA, 14 nt, Mycobacterium avium subsp. paratuberculosis
cgccgacgacgucg

SEQ ID NO: 917694 - RNA, 15 nt, Mycobacterium avium subsp. paratuberculosis
cgccgacgacgucgc

SEQ ID NO: 917695 - RNA, 13 nt, Mycobacterium avium subsp. paratuberculosis
cgccgaccuuggc

SEQ ID NO: 917696 - RNA, 14 nt, Mycobacterium avium subsp. paratuberculosis
cgccgaccuggucg

SEQ ID NO: 917697 - RNA, 15 nt, Mycobacterium avium subsp. paratuberculosis
cgccgaccuggucgc

SEQ ID NO: 917698 - RNA, 14 nt, Mycobacterium avium subsp. paratuberculosis
cgccgaccucgucg

SEQ ID NO: 917699 - RNA, 16 nt, Mycobacterium avium subsp. paratuberculosis
cgccgaccucgucggc

SEQ ID NO: 917700 - RNA, 16 nt, Mycobacterium avium subsp. paratuberculosis
cgccgaccucggccag

SEQ ID NO: 917701 - RNA, 17 nt, Mycobacterium avium subsp. paratuberculosis
cgccgaccucggccagc

SEQ ID NO: 917702 - RNA, 20 nt, Mycobacterium avium subsp. paratuberculosis
cgccgaccucggccagcgug

SEQ ID NO: 917703 - RNA, 21 nt, Mycobacterium avium subsp. paratuberculosis
cgccgaccaggaucgggaucg

SEQ ID NO: 917704 - RNA, 17 nt, Mycobacterium avium subsp. paratuberculosis
cgccgaccaguucggcc

SEQ ID NO: 917705 - RNA, 21 nt, Mycobacterium avium subsp. paratuberculosis
cgccgaccaguucggccaccg

SEQ ID NO: 917706 - RNA, 22 nt, Mycobacterium avium subsp. paratuberculosis
cgccgaccaguucggccaccgc

SEQ ID NO: 917707 - RNA, 23 nt, Mycobacterium avium subsp. paratuberculosis
cgccgaccaguucggccaccgcg

SEQ ID NO: 917708 - RNA, 15 nt, Mycobacterium avium subsp. paratuberculosis
cgccgacccccgccg

SEQ ID NO: 917709 - RNA, 17 nt, Mycobacterium avium subsp. paratuberculosis
cgccgacccccgccgcg

SEQ ID NO: 917710 - RNA, 19 nt, Mycobacterium avium subsp. paratuberculosis
cgccgaccgguccgccgcc

SEQ ID NO: 917711 - RNA, 21 nt, Mycobacterium avium subsp. paratuberculosis
cgccgaccgguccgccgccgg

SEQ ID NO: 917712 - RNA, 23 nt, Mycobacterium avium subsp. paratuberculosis
cgccgaccgguccgccgccggcg

SEQ ID NO: 917713 - RNA, 20 nt, Mycobacterium avium subsp. paratuberculosis
cgccgaccagguccgguucg

SEQ ID NO: 917714 - RNA, 21 nt, Mycobacterium avium subsp. paratuberculosis
cgccgaccagguccgguucga

SEQ ID NO: 917715 - RNA, 18 nt, Mycobacterium avium subsp. paratuberculosis
cgccgaggaaccggcagc

SEQ ID NO: 917716 - RNA, 13 nt, Mycobacterium avium subsp. paratuberculosis
cgccgaggcgugc

SEQ ID NO: 917717 - RNA, 18 nt, Mycobacterium avium subsp. paratuberculosis
cgccgaggcgugccgcug

SEQ ID NO: 917718 - RNA, 19 nt, Mycobacterium avium subsp. paratuberculosis
cgccgagcgggcgaucucg

SEQ ID NO: 917719 - RNA, 13 nt, Mycobacterium avium subsp. paratuberculosis
cgccgagcgucac

SEQ ID NO: 917720 - RNA, 20 nt, Mycobacterium avium subsp. paratuberculosis
cgccgagcgucacgcuggcg

SEQ ID NO: 917721 - RNA, 15 nt, Mycobacterium avium subsp. paratuberculosis
cgccgagcgugaacu

SEQ ID NO: 917722 - RNA, 17 nt, Mycobacterium avium subsp. paratuberculosis
cgccgagcucgaugucc

SEQ ID NO: 917723 - RNA, 16 nt, Mycobacterium avium subsp. paratuberculosis
cgccgagcucggccac

SEQ ID NO: 917724 - RNA, 18 nt, Mycobacterium avium subsp. paratuberculosis
cgccgagcucggccacca

SEQ ID NO: 917725 - RNA, 12 nt, Mycobacterium avium subsp. paratuberculosis
cgccgagcgggu

SEQ ID NO: 917726 - RNA, 17 nt, Mycobacterium avium subsp. paratuberculosis
cgccgagcgggucgucg

SEQ ID NO: 917727 - RNA, 13 nt, Mycobacterium avium subsp. paratuberculosis
cgccgagcaccug

SEQ ID NO: 917728 - RNA, 23 nt, Mycobacterium avium subsp. paratuberculosis
cgccgagcaccuggccguucagg

SEQ ID NO: 917729 - RNA, 21 nt, Mycobacterium avium subsp. paratuberculosis
cgccgagcacgaacgcggccg

SEQ ID NO: 917730 - RNA, 20 nt, Mycobacterium avium subsp. paratuberculosis
cgccgagauuggacgacacc

SEQ ID NO: 917731 - RNA, 14 nt, Mycobacterium avium subsp. paratuberculosis
cgccgagcaacagc

SEQ ID NO: 917732 - RNA, 15 nt, Mycobacterium avium subsp. paratuberculosis
cgccgagcaaccggg

SEQ ID NO: 917733 - RNA, 12 nt, Mycobacterium avium subsp. paratuberculosis
cgccgagcacac

SEQ ID NO: 917734 - RNA, 17 nt, Mycobacterium avium subsp. paratuberculosis
cgccgagcacaccgucg

SEQ ID NO: 917735 - RNA, 22 nt, Mycobacterium avium subsp. paratuberculosis
cgccgagcacaccgucgcccgc

SEQ ID NO: 917736 - RNA, 19 nt, Mycobacterium avium subsp. paratuberculosis
cgccgaguccgggccgccg

SEQ ID NO: 917737 - RNA, 20 nt, Mycobacterium avium subsp. paratuberculosis
cgccgaguccgggccgccgg

SEQ ID NO: 917738 - RNA, 21 nt, Mycobacterium avium subsp. paratuberculosis
cgccgaguccgggccgccggc

SEQ ID NO: 917739 - RNA, 22 nt, Mycobacterium avium subsp. paratuberculosis
cgccgaguccgggccgccggcc

SEQ ID NO: 917740 - RNA, 19 nt, Mycobacterium avium subsp. paratuberculosis
cgccgagucgaucgccagc

SEQ ID NO: 917741 - RNA, 15 nt, Mycobacterium avium subsp. paratuberculosis
cgccgagucgcgccg

SEQ ID NO: 917742 - RNA, 18 nt, Mycobacterium avium subsp. paratuberculosis
cgccgagucgcgccgcgu

SEQ ID NO: 917743 - RNA, 19 nt, Mycobacterium avium subsp. paratuberculosis
cgccgagucgcgccgcguc

SEQ ID NO: 917744 - RNA, 20 nt, Mycobacterium avium subsp. paratuberculosis
cgccgagucgcgccgcgucg

SEQ ID NO: 917745 - RNA, 19 nt, Mycobacterium avium subsp. paratuberculosis
cgccgagggccagcagcca

SEQ ID NO: 917746 - RNA, 18 nt, Mycobacterium avium subsp. paratuberculosis
cgccgagggcccgggcag

SEQ ID NO: 917747 - RNA, 23 nt, Mycobacterium avium subsp. paratuberculosis
cgccgagggggaagucgaccggg

SEQ ID NO: 917748 - RNA, 21 nt, Mycobacterium avium subsp. paratuberculosis
cgccgagggugccggccaccg

SEQ ID NO: 917749 - RNA, 23 nt, Mycobacterium avium subsp. paratuberculosis
cgccgagggugccggccaccggc

SEQ ID NO: 917750 - RNA, 14 nt, Mycobacterium avium subsp. paratuberculosis
cgccgagguagccg

SEQ ID NO: 917751 - RNA, 16 nt, Mycobacterium avium subsp. paratuberculosis
cgccgagguagccgcg

SEQ ID NO: 917752 - RNA, 19 nt, Mycobacterium avium subsp. paratuberculosis
cgccgagguagccgcgcac

SEQ ID NO: 917753 - RNA, 20 nt, Mycobacterium avium subsp. paratuberculosis
cgccgagguagccgcgcacc

SEQ ID NO: 917754 - RNA, 22 nt, Mycobacterium avium subsp. paratuberculosis
cgccgagguagccgcgcaccac

SEQ ID NO: 917755 - RNA, 15 nt, Mycobacterium avium subsp. paratuberculosis
cgccgagggcggcgg

SEQ ID NO: 917756 - RNA, 16 nt, Mycobacterium avium subsp. paratuberculosis
cgccgagguggcccgc

SEQ ID NO: 917757 - RNA, 18 nt, Mycobacterium avium subsp. paratuberculosis
cgccgagguggcccgcca

SEQ ID NO: 917758 - RNA, 19 nt, Mycobacterium avium subsp. paratuberculosis
cgccgagguggcccgccac

SEQ ID NO: 917759 - RNA, 23 nt, Mycobacterium avium subsp. paratuberculosis
cgccgagguggcccgccacgugc

SEQ ID NO: 917760 - RNA, 17 nt, Mycobacterium avium subsp. paratuberculosis
cgccgagguggccgcca

SEQ ID NO: 917761 - RNA, 21 nt, Mycobacterium avium subsp. paratuberculosis
cgccgagguggccgccagcac

SEQ ID NO: 917762 - RNA, 20 nt, Mycobacterium avium subsp. paratuberculosis
cgcccggaaagcgcgggcag

SEQ ID NO: 917763 - RNA, 19 nt, Mycobacterium avium subsp. paratuberculosis
cgcccgcggccuccagccg

SEQ ID NO: 917764 - RNA, 22 nt, Mycobacterium avium subsp. paratuberculosis
cgcccgcuugauggcggcgcgg

SEQ ID NO: 917765 - RNA, 23 nt, Mycobacterium avium subsp. paratuberculosis
cgcccgcuugauggcggcgcgga

SEQ ID NO: 917766 - RNA, 14 nt, Mycobacterium avium subsp. paratuberculosis
cgcccggaccggcu

SEQ ID NO: 917767 - RNA, 15 nt, Mycobacterium avium subsp. paratuberculosis
cgcccggaccggcuc

SEQ ID NO: 917768 - RNA, 22 nt, Mycobacterium avium subsp. paratuberculosis
cgcccggaucagcugaccggcg

SEQ ID NO: 917769 - RNA, 23 nt, Mycobacterium avium subsp. paratuberculosis
cgcccggaucagcugaccggcga

SEQ ID NO: 917770 - RNA, 17 nt, Mycobacterium avium subsp. paratuberculosis
cgcccggaugccggcgc

SEQ ID NO: 917771 - RNA, 18 nt, Mycobacterium avium subsp. paratuberculosis
cgcccggaugccggcgcc

SEQ ID NO: 917772 - RNA, 15 nt, Mycobacterium avium subsp. paratuberculosis
cgcccggacaccccg

SEQ ID NO: 917773 - RNA, 18 nt, Mycobacterium avium subsp. paratuberculosis
cgcccggaccaggguggc

SEQ ID NO: 917774 - RNA, 13 nt, Mycobacterium avium subsp. paratuberculosis
cgcccggacccgc

SEQ ID NO: 917775 - RNA, 14 nt, Mycobacterium avium subsp. paratuberculosis
cgcccggacccgcu

SEQ ID NO: 917776 - RNA, 16 nt, Mycobacterium avium subsp. paratuberculosis
cgcccggacgcgcaca

SEQ ID NO: 917777 - RNA, 21 nt, Mycobacterium avium subsp. paratuberculosis
cgcccggacgcgcacacggcc

SEQ ID NO: 917778 - RNA, 14 nt, Mycobacterium avium subsp. paratuberculosis
cgcccggagaacuc

SEQ ID NO: 917779 - RNA, 18 nt, Mycobacterium avium subsp. paratuberculosis
cgcccgcguugcggcgca

SEQ ID NO: 917780 - RNA, 13 nt, Mycobacterium avium subsp. paratuberculosis
cgcccgcgggugc

SEQ ID NO: 917781 - RNA, 16 nt, Mycobacterium avium subsp. paratuberculosis
cgcccgcgggugcagc

SEQ ID NO: 917782 - RNA, 12 nt, Mycobacterium avium subsp. paratuberculosis
cgcccgcggugg

SEQ ID NO: 917783 - RNA, 23 nt, Mycobacterium avium subsp. paratuberculosis
cgcccgcgguggaacccagcacc

SEQ ID NO: 917784 - RNA, 21 nt, Mycobacterium avium subsp. paratuberculosis
cgcccgcggugugcuggccag

SEQ ID NO: 917785 - RNA, 13 nt, Mycobacterium avium subsp. paratuberculosis
cgcccgcgcuggu

SEQ ID NO: 917786 - RNA, 13 nt, Mycobacterium avium subsp. paratuberculosis
cgcccgcggcgcg

SEQ ID NO: 917787 - RNA, 17 nt, Mycobacterium avium subsp. paratuberculosis
cgcccgcggccaucgcc

SEQ ID NO: 917788 - RNA, 14 nt, Mycobacterium avium subsp. paratuberculosis
cgcccggcaccgcg

SEQ ID NO: 917789 - RNA, 17 nt, Mycobacterium avium subsp. paratuberculosis
cgcccggcaccgcggcg

SEQ ID NO: 917790 - RNA, 20 nt, Mycobacterium avium subsp. paratuberculosis
cgcccggcaccgcggcggug

SEQ ID NO: 917791 - RNA, 22 nt, Mycobacterium avium subsp. paratuberculosis
cgcccggcaccgcggcgguguc

SEQ ID NO: 917792 - RNA, 14 nt, Mycobacterium avium subsp. paratuberculosis
cgcccggaugucgg

SEQ ID NO: 917793 - RNA, 22 nt, Mycobacterium avium subsp. paratuberculosis
cgcccggaugucgggcgaggug

SEQ ID NO: 917794 - RNA, 20 nt, Mycobacterium avium subsp. paratuberculosis
cgcccggauucgcggcggcg

SEQ ID NO: 917795 - RNA, 14 nt, Mycobacterium avium subsp. paratuberculosis
cgcccggcaacacg

SEQ ID NO: 917796 - RNA, 18 nt, Mycobacterium avium subsp. paratuberculosis
cgcccggcuucgccgccg

SEQ ID NO: 917797 - RNA, 23 nt, Mycobacterium avium subsp. paratuberculosis
cgcccgggaaaauuuccuggccg

SEQ ID NO: 917798 - RNA, 17 nt, Mycobacterium avium subsp. paratuberculosis
cgcccgggaagcuggug

SEQ ID NO: 917799 - RNA, 18 nt, Mycobacterium avium subsp. paratuberculosis
cgcccgggcgcgugcaca

SEQ ID NO: 917800 - RNA, 21 nt, Mycobacterium avium subsp. paratuberculosis
cgcccgggcgcgugcacaccg

SEQ ID NO: 917801 - RNA, 23 nt, Mycobacterium avium subsp. paratuberculosis
cgcccgggcgcgugcacaccggc

SEQ ID NO: 917802 - RNA, 15 nt, Mycobacterium avium subsp. paratuberculosis
cgcccgggcggcccg

SEQ ID NO: 917803 - RNA, 16 nt, Mycobacterium avium subsp. paratuberculosis
cgcccgggcggcccgc

SEQ ID NO: 917804 - RNA, 21 nt, Mycobacterium avium subsp. paratuberculosis
cgcccgggcggcccgggugga

SEQ ID NO: 917805 - RNA, 18 nt, Mycobacterium avium subsp. paratuberculosis
cgcccgggcuaucgcccg

SEQ ID NO: 917806 - RNA, 18 nt, Mycobacterium avium subsp. paratuberculosis
cgcccggggcgcggaccg

SEQ ID NO: 917807 - RNA, 22 nt, Mycobacterium avium subsp. paratuberculosis
cgcccgggccguaucggccccg

SEQ ID NO: 917808 - RNA, 14 nt, Mycobacterium avium subsp. paratuberculosis
cgcccgggccgcgc

SEQ ID NO: 917809 - RNA, 15 nt, Mycobacterium avium subsp. paratuberculosis
cgcccgggccgcgcc

SEQ ID NO: 917810 - RNA, 15 nt, Mycobacterium avium subsp. paratuberculosis
cgcccgggcacgacg

SEQ ID NO: 917811 - RNA, 16 nt, Mycobacterium avium subsp. paratuberculosis
cgcccgggcacgacgg

SEQ ID NO: 917812 - RNA, 12 nt, Mycobacterium avium subsp. paratuberculosis
cgcccgggccag

SEQ ID NO: 917813 - RNA, 14 nt, Mycobacterium avium subsp. paratuberculosis
cgcccgggccaggc

SEQ ID NO: 917814 - RNA, 18 nt, Mycobacterium avium subsp. paratuberculosis
cgcccucgaucgcgacca

SEQ ID NO: 917815 - RNA, 15 nt, Mycobacterium avium subsp. paratuberculosis
cgcccucgccccgga

SEQ ID NO: 917816 - RNA, 16 nt, Mycobacterium avium subsp. paratuberculosis
cgcccucgccgaaccg

SEQ ID NO: 917817 - RNA, 13 nt, Mycobacterium avium subsp. paratuberculosis
cgcccucgccgac

SEQ ID NO: 917818 - RNA, 13 nt, Mycobacterium avium subsp. paratuberculosis
cgcccucgccggc

SEQ ID NO: 917819 - RNA, 15 nt, Mycobacterium avium subsp. paratuberculosis
cgcccucgccggcgg

SEQ ID NO: 917820 - RNA, 16 nt, Mycobacterium avium subsp. paratuberculosis
cgcccucgccggcggc

SEQ ID NO: 917821 - RNA, 14 nt, Mycobacterium avium subsp. paratuberculosis
cgcccucgcugccg

SEQ ID NO: 917822 - RNA, 15 nt, Mycobacterium avium subsp. paratuberculosis
cgcccucgcugccgc

SEQ ID NO: 917823 - RNA, 20 nt, Mycobacterium avium subsp. paratuberculosis
cgcccucgcugccgcccccg

SEQ ID NO: 917824 - RNA, 12 nt, Mycobacterium avium subsp. paratuberculosis
cgcccucggccg

SEQ ID NO: 917825 - RNA, 17 nt, Mycobacterium avium subsp. paratuberculosis
cgcccucggccguaccg

SEQ ID NO: 917826 - RNA, 19 nt, Mycobacterium avium subsp. paratuberculosis
cgcccucggccguaccggc

SEQ ID NO: 917827 - RNA, 21 nt, Mycobacterium avium subsp. paratuberculosis
cgcccucggccguaccggcgu

SEQ ID NO: 917828 - RNA, 13 nt, Mycobacterium avium subsp. paratuberculosis
cgcccucggcgau

SEQ ID NO: 917829 - RNA, 15 nt, Mycobacterium avium subsp. paratuberculosis
cgcccucggcgaucu

SEQ ID NO: 917830 - RNA, 18 nt, Mycobacterium avium subsp. paratuberculosis
cgcccucggcuuccgagc

SEQ ID NO: 917831 - RNA, 21 nt, Mycobacterium avium subsp. paratuberculosis
cgcccucgguguucgggucgg

SEQ ID NO: 917832 - RNA, 22 nt, Mycobacterium avium subsp. paratuberculosis
cgcccucgguguucgggucggu

SEQ ID NO: 917833 - RNA, 17 nt, Mycobacterium avium subsp. paratuberculosis
cgcccuccacgucgucg

SEQ ID NO: 917834 - RNA, 18 nt, Mycobacterium avium subsp. paratuberculosis
cgcccuccacgucgucgg

SEQ ID NO: 917835 - RNA, 15 nt, Mycobacterium avium subsp. paratuberculosis
cgcccucaggcgucc

SEQ ID NO: 917836 - RNA, 13 nt, Mycobacterium avium subsp. paratuberculosis
cgcccuccccggc

SEQ ID NO: 917837 - RNA, 16 nt, Mycobacterium avium subsp. paratuberculosis
cgcccuccccggccag

SEQ ID NO: 917838 - RNA, 17 nt, Mycobacterium avium subsp. paratuberculosis
cgcccuccccggccagc

SEQ ID NO: 917839 - RNA, 19 nt, Mycobacterium avium subsp. paratuberculosis
cgcccuccccggccagcac

SEQ ID NO: 917840 - RNA, 22 nt, Mycobacterium avium subsp. paratuberculosis
cgcccucgauaauggcggccgc

SEQ ID NO: 917841 - RNA, 15 nt, Mycobacterium avium subsp. paratuberculosis
cgcccguccagcgca

SEQ ID NO: 917842 - RNA, 13 nt, Mycobacterium avium subsp. paratuberculosis
cgcccgucccgcc

SEQ ID NO: 917843 - RNA, 17 nt, Mycobacterium avium subsp. paratuberculosis
cgcccgucccgccgacg

SEQ ID NO: 917844 - RNA, 18 nt, Mycobacterium avium subsp. paratuberculosis
cgcccgucccgccgacgg

SEQ ID NO: 917845 - RNA, 22 nt, Mycobacterium avium subsp. paratuberculosis
cgcccguagaacaguucgacgu

SEQ ID NO: 917846 - RNA, 22 nt, Mycobacterium avium subsp. paratuberculosis
cgcccguagacccacagcugcc

SEQ ID NO: 917847 - RNA, 16 nt, Mycobacterium avium subsp. paratuberculosis
cgcccguagcggcgga

SEQ ID NO: 917848 - RNA, 19 nt, Mycobacterium avium subsp. paratuberculosis
cgcccguagcggugggcgc

SEQ ID NO: 917849 - RNA, 20 nt, Mycobacterium avium subsp. paratuberculosis
cgcccguagcggugggcgcg

SEQ ID NO: 917850 - RNA, 20 nt, Mycobacterium avium subsp. paratuberculosis
cgcccgucacgcuggcguga

SEQ ID NO: 917851 - RNA, 20 nt, Mycobacterium avium subsp. paratuberculosis
cgcccguccgggccggccag

SEQ ID NO: 917852 - RNA, 23 nt, Mycobacterium avium subsp. paratuberculosis
cgcccgucgagcgucacgccgcg

SEQ ID NO: 917853 - RNA, 17 nt, Mycobacterium avium subsp. paratuberculosis
cgcccgucggggcccgg

SEQ ID NO: 917854 - RNA, 18 nt, Mycobacterium avium subsp. paratuberculosis
cgcccgucggugggguga

SEQ ID NO: 917855 - RNA, 15 nt, Mycobacterium avium subsp. paratuberculosis
cgcccgucgucgccg

SEQ ID NO: 917856 - RNA, 14 nt, Mycobacterium avium subsp. paratuberculosis
cgcccgucgucggu

SEQ ID NO: 917857 - RNA, 18 nt, Mycobacterium avium subsp. paratuberculosis
cgcccguugacgcccaug

SEQ ID NO: 917858 - RNA, 15 nt, Mycobacterium avium subsp. paratuberculosis
cgcccgucucggcgu

SEQ ID NO: 917859 - RNA, 15 nt, Mycobacterium avium subsp. paratuberculosis
cgcccuagcgggcca

SEQ ID NO: 917860 - RNA, 16 nt, Mycobacterium avium subsp. paratuberculosis
cgcccuagcgggccag

SEQ ID NO: 917861 - RNA, 20 nt, Mycobacterium avium subsp. paratuberculosis
cgcccuagucgacgccgaug

SEQ ID NO: 917862 - RNA, 22 nt, Mycobacterium avium subsp. paratuberculosis
cgcccuagucgacgccgauggu

SEQ ID NO: 917863 - RNA, 18 nt, Mycobacterium avium subsp. paratuberculosis
cgcccguggcccacggga

SEQ ID NO: 917864 - RNA, 16 nt, Mycobacterium avium subsp. paratuberculosis
cgcccgcaacuccaca

SEQ ID NO: 917865 - RNA, 12 nt, Mycobacterium avium subsp. paratuberculosis
cgcccgcccgga

SEQ ID NO: 917866 - RNA, 15 nt, Mycobacterium avium subsp. paratuberculosis
cgcccgcccggacac

SEQ ID NO: 917867 - RNA, 12 nt, Mycobacterium avium subsp. paratuberculosis
cgcccgcccggc

SEQ ID NO: 917868 - RNA, 14 nt, Mycobacterium avium subsp. paratuberculosis
cgcccgcccggcac

SEQ ID NO: 917869 - RNA, 14 nt, Mycobacterium avium subsp. paratuberculosis
cgcccgcaccacga

SEQ ID NO: 917870 - RNA, 14 nt, Mycobacterium avium subsp. paratuberculosis
cgcccgcaccagca

SEQ ID NO: 917871 - RNA, 15 nt, Mycobacterium avium subsp. paratuberculosis
cgcccgcaccagcag

SEQ ID NO: 917872 - RNA, 23 nt, Mycobacterium avium subsp. paratuberculosis
cgcccgcaccagcagguccaugg

SEQ ID NO: 917873 - RNA, 13 nt, Mycobacterium avium subsp. paratuberculosis
cgcccgccgcaac

SEQ ID NO: 917874 - RNA, 14 nt, Mycobacterium avium subsp. paratuberculosis
cgcccgccgccacc

SEQ ID NO: 917875 - RNA, 15 nt, Mycobacterium avium subsp. paratuberculosis
cgcccgccgccacca

SEQ ID NO: 917876 - RNA, 14 nt, Mycobacterium avium subsp. paratuberculosis
cgcccgccgacggc

SEQ ID NO: 917877 - RNA, 17 nt, Mycobacterium avium subsp. paratuberculosis
cgcccgccgacggcugc

SEQ ID NO: 917878 - RNA, 22 nt, Mycobacterium avium subsp. paratuberculosis
cgcccgccgacggcugcccggc

SEQ ID NO: 917879 - RNA, 15 nt, Mycobacterium avium subsp. paratuberculosis
cgcccgcccggcacg

SEQ ID NO: 917880 - RNA, 16 nt, Mycobacterium avium subsp. paratuberculosis
cgcccgcccggcacga

SEQ ID NO: 917881 - RNA, 15 nt, Mycobacterium avium subsp. paratuberculosis
cgcccgcccggcccg

SEQ ID NO: 917882 - RNA, 18 nt, Mycobacterium avium subsp. paratuberculosis
cgcccgcccggcccggcg

SEQ ID NO: 917883 - RNA, 12 nt, Mycobacterium avium subsp. paratuberculosis
cgcccgcaccac

SEQ ID NO: 917884 - RNA, 14 nt, Mycobacterium avium subsp. paratuberculosis
cgcccgccgcgacg

SEQ ID NO: 917885 - RNA, 15 nt, Mycobacterium avium subsp. paratuberculosis
cgcccgccgcgacgg

SEQ ID NO: 917886 - RNA, 16 nt, Mycobacterium avium subsp. paratuberculosis
cgcccgccgguggccg

SEQ ID NO: 917887 - RNA, 20 nt, Mycobacterium avium subsp. paratuberculosis
cgcccgccggcccagcucca

SEQ ID NO: 917888 - RNA, 12 nt, Mycobacterium avium subsp. paratuberculosis
cgcccgccgcgu

SEQ ID NO: 917889 - RNA, 14 nt, Mycobacterium avium subsp. paratuberculosis
cgcccgccgcguac

SEQ ID NO: 917890 - RNA, 15 nt, Mycobacterium avium subsp. paratuberculosis
cgcccgcgcggcggc

SEQ ID NO: 917891 - RNA, 17 nt, Mycobacterium avium subsp. paratuberculosis
cgcccgcgcggcggcca

SEQ ID NO: 917892 - RNA, 22 nt, Mycobacterium avium subsp. paratuberculosis
cgcccgcgcggcggccaacgcg

SEQ ID NO: 917893 - RNA, 15 nt, Mycobacterium avium subsp. paratuberculosis
cgcccgcgcgggcug

SEQ ID NO: 917894 - RNA, 17 nt, Mycobacterium avium subsp. paratuberculosis
cgcccgcgcgugggcca

SEQ ID NO: 917895 - RNA, 20 nt, Mycobacterium avium subsp. paratuberculosis
cgcccgcgcgugggccaacg

SEQ ID NO: 917896 - RNA, 22 nt, Mycobacterium avium subsp. paratuberculosis
cgcccgcgcgugggccaacgcg

SEQ ID NO: 917897 - RNA, 21 nt, Mycobacterium avium subsp. paratuberculosis
cgcccgagucacccggcuggc

SEQ ID NO: 917898 - RNA, 14 nt, Mycobacterium avium subsp. paratuberculosis
cgcccgagcgucau

SEQ ID NO: 917899 - RNA, 20 nt, Mycobacterium avium subsp. paratuberculosis
cgccccggcgcgccugcgcg

SEQ ID NO: 917900 - RNA, 15 nt, Mycobacterium avium subsp. paratuberculosis
cgcccgagccgcaca

SEQ ID NO: 917901 - RNA, 19 nt, Mycobacterium avium subsp. paratuberculosis
cgcccgagaguccgccgcc

SEQ ID NO: 917902 - RNA, 22 nt, Mycobacterium avium subsp. paratuberculosis
cgcccgagaguccgccgccggg

SEQ ID NO: 917903 - RNA, 23 nt, Mycobacterium avium subsp. paratuberculosis
cgcccgagaguccgccgccgggc

SEQ ID NO: 917904 - RNA, 13 nt, Mycobacterium avium subsp. paratuberculosis
cgcccgacggucg

SEQ ID NO: 917905 - RNA, 21 nt, Mycobacterium avium subsp. paratuberculosis
cgcccgaucaucucaccgacg

SEQ ID NO: 917906 - RNA, 15 nt, Mycobacterium avium subsp. paratuberculosis
cgcccgaucccgggc

SEQ ID NO: 917907 - RNA, 21 nt, Mycobacterium avium subsp. paratuberculosis
cgcccgaucccgggccguuca

SEQ ID NO: 917908 - RNA, 18 nt, Mycobacterium avium subsp. paratuberculosis
cgcccgaucccgucgucg

SEQ ID NO: 917909 - RNA, 20 nt, Mycobacterium avium subsp. paratuberculosis
cgcccgaucccgucgucggc

SEQ ID NO: 917910 - RNA, 16 nt, Mycobacterium avium subsp. paratuberculosis
cgcccgauuccccggc

SEQ ID NO: 917911 - RNA, 14 nt, Mycobacterium avium subsp. paratuberculosis
cgcccgauucgcgg

SEQ ID NO: 917912 - RNA, 17 nt, Mycobacterium avium subsp. paratuberculosis
cgcccgauucgcggcca

SEQ ID NO: 917913 - RNA, 13 nt, Mycobacterium avium subsp. paratuberculosis
cgcccgaucggca

SEQ ID NO: 917914 - RNA, 18 nt, Mycobacterium avium subsp. paratuberculosis
cgcccgaucggcacccgc

SEQ ID NO: 917915 - RNA, 22 nt, Mycobacterium avium subsp. paratuberculosis
cgcccgaucggcacccgcaaca

SEQ ID NO: 917916 - RNA, 16 nt, Mycobacterium avium subsp. paratuberculosis
cgcccgaucggcguga

SEQ ID NO: 917917 - RNA, 18 nt, Mycobacterium avium subsp. paratuberculosis
cgcccgaucugggaucgg

SEQ ID NO: 917918 - RNA, 20 nt, Mycobacterium avium subsp. paratuberculosis
cgcccgaugaaguacccggu

SEQ ID NO: 917919 - RNA, 13 nt, Mycobacterium avium subsp. paratuberculosis
cgccccggagaug

SEQ ID NO: 917920 - RNA, 13 nt, Mycobacterium avium subsp. paratuberculosis
cgccccggaugac

SEQ ID NO: 917921 - RNA, 22 nt, Mycobacterium avium subsp. paratuberculosis
cgccccgcgcgaucaggccggc

SEQ ID NO: 917922 - RNA, 13 nt, Mycobacterium avium subsp. paratuberculosis
cgccccgcugccg

SEQ ID NO: 917923 - RNA, 13 nt, Mycobacterium avium subsp. paratuberculosis
cgccccgccggug

SEQ ID NO: 917924 - RNA, 22 nt, Mycobacterium avium subsp. paratuberculosis
cgccccgccggugucggcgacc

SEQ ID NO: 917925 - RNA, 13 nt, Mycobacterium avium subsp. paratuberculosis
cgccccgcccggc

SEQ ID NO: 917926 - RNA, 21 nt, Mycobacterium avium subsp. paratuberculosis
cgccccgccgcgccgggcgcc

SEQ ID NO: 917927 - RNA, 13 nt, Mycobacterium avium subsp. paratuberculosis
cgccccgccgcgg

SEQ ID NO: 917928 - RNA, 16 nt, Mycobacterium avium subsp. paratuberculosis
cgccccgccgcggcca

SEQ ID NO: 917929 - RNA, 17 nt, Mycobacterium avium subsp. paratuberculosis
cgccccgccgcggccag

SEQ ID NO: 917930 - RNA, 22 nt, Mycobacterium avium subsp. paratuberculosis
cgccccgccgcggccaggucga

SEQ ID NO: 917931 - RNA, 13 nt, Mycobacterium avium subsp. paratuberculosis
cgccccggcgcag

SEQ ID NO: 917932 - RNA, 17 nt, Mycobacterium avium subsp. paratuberculosis
cgccccggcgccgucgu

SEQ ID NO: 917933 - RNA, 17 nt, Mycobacterium avium subsp. paratuberculosis
cgccccggcgacgucgc

SEQ ID NO: 917934 - RNA, 14 nt, Mycobacterium avium subsp. paratuberculosis
cgccccggcccggc

SEQ ID NO: 917935 - RNA, 20 nt, Mycobacterium avium subsp. paratuberculosis
cgccccggcccggcgaauca

SEQ ID NO: 917936 - RNA, 13 nt, Mycobacterium avium subsp. paratuberculosis
cgccccggcccgu

SEQ ID NO: 917937 - RNA, 13 nt, Mycobacterium avium subsp. paratuberculosis
cgccccggccgcg

SEQ ID NO: 917938 - RNA, 14 nt, Mycobacterium avium subsp. paratuberculosis
cgcccgacgaugcg

SEQ ID NO: 917939 - RNA, 19 nt, Mycobacterium avium subsp. paratuberculosis
cgcccgacgaugcggggcg

SEQ ID NO: 917940 - RNA, 13 nt, Mycobacterium avium subsp. paratuberculosis
cgcccgacgccgg

SEQ ID NO: 917941 - RNA, 15 nt, Mycobacterium avium subsp. paratuberculosis
cgcccgacccgucca

SEQ ID NO: 917942 - RNA, 16 nt, Mycobacterium avium subsp. paratuberculosis
cgcccgacccguccag

SEQ ID NO: 917943 - RNA, 17 nt, Mycobacterium avium subsp. paratuberculosis
cgcccgacccguccagc

SEQ ID NO: 917944 - RNA, 12 nt, Mycobacterium avium subsp. paratuberculosis
cgccccggcgcu

SEQ ID NO: 917945 - RNA, 17 nt, Mycobacterium avium subsp. paratuberculosis
cgccaugccgccgaccg

SEQ ID NO: 917946 - RNA, 14 nt, Mycobacterium avium subsp. paratuberculosis
cgcccccgcgacgu

SEQ ID NO: 917947 - RNA, 21 nt, Mycobacterium avium subsp. paratuberculosis
cgcccccgcgacguccaucgg

SEQ ID NO: 917948 - RNA, 16 nt, Mycobacterium avium subsp. paratuberculosis
cgcccccgcggcgucc

SEQ ID NO: 917949 - RNA, 17 nt, Mycobacterium avium subsp. paratuberculosis
cgccaugcgaccacgac

SEQ ID NO: 917950 - RNA, 23 nt, Mycobacterium avium subsp. paratuberculosis
cgccaugcgaccacgaccggguc

SEQ ID NO: 917951 - RNA, 16 nt, Mycobacterium avium subsp. paratuberculosis
cgccaugccgucgcgc

SEQ ID NO: 917952 - RNA, 18 nt, Mycobacterium avium subsp. paratuberculosis
cgccaugccgucgcgcac

SEQ ID NO: 917953 - RNA, 16 nt, Mycobacterium avium subsp. paratuberculosis
cgccccgaacagcgcc

SEQ ID NO: 917954 - RNA, 18 nt, Mycobacterium avium subsp. paratuberculosis
cgccccgacagcaacgcc

SEQ ID NO: 917955 - RNA, 19 nt, Mycobacterium avium subsp. paratuberculosis
cgccccgacagcaacgcca

SEQ ID NO: 917956 - RNA, 20 nt, Mycobacterium avium subsp. paratuberculosis
cgccccgacaucgccaucag

SEQ ID NO: 917957 - RNA, 20 nt, Mycobacterium avium subsp. paratuberculosis
cgccccgacgaucgcgccgg

SEQ ID NO: 917958 - RNA, 23 nt, Mycobacterium avium subsp. paratuberculosis
cgccccgacgaucgcgccggccg

SEQ ID NO: 917959 - RNA, 12 nt, Mycobacterium avium subsp. paratuberculosis
cgccccgacgug

SEQ ID NO: 917960 - RNA, 15 nt, Mycobacterium avium subsp. paratuberculosis
cgccccgacgugcag

SEQ ID NO: 917961 - RNA, 22 nt, Mycobacterium avium subsp. paratuberculosis
cgccccgacgugcagcgccagc

SEQ ID NO: 917962 - RNA, 13 nt, Mycobacterium avium subsp. paratuberculosis
cgcccccucggcc

SEQ ID NO: 917963 - RNA, 19 nt, Mycobacterium avium subsp. paratuberculosis
cgccccgaguuccagcucc

SEQ ID NO: 917964 - RNA, 20 nt, Mycobacterium avium subsp. paratuberculosis
cgccccgaguuccagcuccg

SEQ ID NO: 917965 - RNA, 13 nt, Mycobacterium avium subsp. paratuberculosis
cgccccgcaccga

SEQ ID NO: 917966 - RNA, 19 nt, Mycobacterium avium subsp. paratuberculosis
cgccccgagaucccagcgg

SEQ ID NO: 917967 - RNA, 21 nt, Mycobacterium avium subsp. paratuberculosis
cgccccgagaucccagcggga

SEQ ID NO: 917968 - RNA, 14 nt, Mycobacterium avium subsp. paratuberculosis
cgccccgagcagcg

SEQ ID NO: 917969 - RNA, 23 nt, Mycobacterium avium subsp. paratuberculosis
cgccccgagcagcgggucgucgg

SEQ ID NO: 917970 - RNA, 19 nt, Mycobacterium avium subsp. paratuberculosis
ccucacagcgacaacgggc

SEQ ID NO: 917971 - RNA, 22 nt, Mycobacterium avium subsp. paratuberculosis
ccucacagcgacaacgggccgc

SEQ ID NO: 917972 - RNA, 23 nt, Mycobacterium avium subsp. paratuberculosis
ccucacagcgacaacgggccgcc

SEQ ID NO: 917973 - RNA, 17 nt, Mycobacterium avium subsp. paratuberculosis
ccucacaccucgcuacg

SEQ ID NO: 917974 - RNA, 24 nt, Mycobacterium avium subsp. paratuberculosis
ccucacaccucgcuacgcgagcug

SEQ ID NO: 917975 - RNA, 15 nt, Mycobacterium avium subsp. paratuberculosis
ccucaccccagcgcg

SEQ ID NO: 917976 - RNA, 17 nt, Mycobacterium avium subsp. paratuberculosis
ccucaccccgcccagcg

SEQ ID NO: 917977 - RNA, 18 nt, Mycobacterium avium subsp. paratuberculosis
ccuaugucggugcggcgg

SEQ ID NO: 917978 - RNA, 14 nt, Mycobacterium avium subsp. paratuberculosis
ccucaccgcgggcc

SEQ ID NO: 917979 - RNA, 20 nt, Mycobacterium avium subsp. paratuberculosis
ccucagaccauggcgcggcg

SEQ ID NO: 917980 - RNA, 23 nt, Mycobacterium avium subsp. paratuberculosis
ccucagaccauggcgcggcggcc

SEQ ID NO: 917981 - RNA, 13 nt, Mycobacterium avium subsp. paratuberculosis
ccucacggucggc

SEQ ID NO: 917982 - RNA, 17 nt, Mycobacterium avium subsp. paratuberculosis
ccucacggucggcgucc

SEQ ID NO: 917983 - RNA, 15 nt, Mycobacterium avium subsp. paratuberculosis
ccucagcacggccgc

SEQ ID NO: 917984 - RNA, 19 nt, Mycobacterium avium subsp. paratuberculosis
ccucagcagggcggcaccg

SEQ ID NO: 917985 - RNA, 18 nt, Mycobacterium avium subsp. paratuberculosis
ccuccacgucaccgacgc

SEQ ID NO: 917986 - RNA, 17 nt, Mycobacterium avium subsp. paratuberculosis
ccucacuccagcggcgg

SEQ ID NO: 917987 - RNA, 18 nt, Mycobacterium avium subsp. paratuberculosis
ccuccagcggcaggugga

SEQ ID NO: 917988 - RNA, 17 nt, Mycobacterium avium subsp. paratuberculosis
ccuccaggaaacggccc

SEQ ID NO: 917989 - RNA, 23 nt, Mycobacterium avium subsp. paratuberculosis
ccuccaggaagaacccggcgugc

SEQ ID NO: 917990 - RNA, 20 nt, Mycobacterium avium subsp. paratuberculosis
ccuccagcacgucggggugg

SEQ ID NO: 917991 - RNA, 15 nt, Mycobacterium avium subsp. paratuberculosis
ccuccagccagcgcg

SEQ ID NO: 917992 - RNA, 22 nt, Mycobacterium avium subsp. paratuberculosis
ccuccagcccggaaucgucggc

SEQ ID NO: 917993 - RNA, 15 nt, Mycobacterium avium subsp. paratuberculosis
ccuccagcccggcga

SEQ ID NO: 917994 - RNA, 14 nt, Mycobacterium avium subsp. paratuberculosis
ccuccagccgccgg

SEQ ID NO: 917995 - RNA, 14 nt, Mycobacterium avium subsp. paratuberculosis
ccuccagccgcgcg

SEQ ID NO: 917996 - RNA, 16 nt, Mycobacterium avium subsp. paratuberculosis
ccuccagccgcgcggc

SEQ ID NO: 917997 - RNA, 20 nt, Mycobacterium avium subsp. paratuberculosis
ccuccagccgcgcggccgcc

SEQ ID NO: 917998 - RNA, 13 nt, Mycobacterium avium subsp. paratuberculosis
ccuccagccgcuc

SEQ ID NO: 917999 - RNA, 13 nt, Mycobacterium avium subsp. paratuberculosis
ccucccggccgac

SEQ ID NO: 918000 - RNA, 11 nt, Mycobacterium avium subsp. paratuberculosis
ccucccggcgc

SEQ ID NO: 918001 - RNA, 20 nt, Mycobacterium avium subsp. paratuberculosis
ccuccgaauccagcgcgccg

SEQ ID NO: 918002 - RNA, 19 nt, Mycobacterium avium subsp. paratuberculosis
ccuccgacagccgcaccgg

SEQ ID NO: 918003 - RNA, 17 nt, Mycobacterium avium subsp. paratuberculosis
ccucgaacaccgcaccg

SEQ ID NO: 918004 - RNA, 12 nt, Mycobacterium avium subsp. paratuberculosis
ccucgaacaggc

SEQ ID NO: 918005 - RNA, 23 nt, Mycobacterium avium subsp. paratuberculosis
ccucgaacaggcuggccagcucg

SEQ ID NO: 918006 - RNA, 17 nt, Mycobacterium avium subsp. paratuberculosis
ccucgaaccucgcggcg

SEQ ID NO: 918007 - RNA, 23 nt, Mycobacterium avium subsp. paratuberculosis
ccuccaguugcgaccccgccguc

SEQ ID NO: 918008 - RNA, 20 nt, Mycobacterium avium subsp. paratuberculosis
ccuccaggcaugggaucagc

SEQ ID NO: 918009 - RNA, 17 nt, Mycobacterium avium subsp. paratuberculosis
ccuccagguucgccgcc

SEQ ID NO: 918010 - RNA, 21 nt, Mycobacterium avium subsp. paratuberculosis
ccuccaugucgcaacggucgg

SEQ ID NO: 918011 - RNA, 19 nt, Mycobacterium avium subsp. paratuberculosis
ccuccauucgggccagcgc

SEQ ID NO: 918012 - RNA, 23 nt, Mycobacterium avium subsp. paratuberculosis
ccuccauucgggccagcgccgag

SEQ ID NO: 918013 - RNA, 16 nt, Mycobacterium avium subsp. paratuberculosis
ccucccaccacggccg

SEQ ID NO: 918014 - RNA, 16 nt, Mycobacterium avium subsp. paratuberculosis
ccguuuucggcgcgca

SEQ ID NO: 918015 - RNA, 17 nt, Mycobacterium avium subsp. paratuberculosis
ccguuuggcgccgccca

SEQ ID NO: 918016 - RNA, 21 nt, Mycobacterium avium subsp. paratuberculosis
ccguuuccggugcucccccgg

SEQ ID NO: 918017 - RNA, 14 nt, Mycobacterium avium subsp. paratuberculosis
ccguuucggacgag

SEQ ID NO: 918018 - RNA, 14 nt, Mycobacterium avium subsp. paratuberculosis
ccguugguggucug

SEQ ID NO: 918019 - RNA, 21 nt, Mycobacterium avium subsp. paratuberculosis
ccguuguaggccgcgcggugc

SEQ ID NO: 918020 - RNA, 18 nt, Mycobacterium avium subsp. paratuberculosis
ccguuguaguagaccuug

SEQ ID NO: 918021 - RNA, 13 nt, Mycobacterium avium subsp. paratuberculosis
ccguugugacccg

SEQ ID NO: 918022 - RNA, 16 nt, Mycobacterium avium subsp. paratuberculosis
ccguugugccaccgcc

SEQ ID NO: 918023 - RNA, 18 nt, Mycobacterium avium subsp. paratuberculosis
ccguugugccaccgccga

SEQ ID NO: 918024 - RNA, 22 nt, Mycobacterium avium subsp. paratuberculosis
ccguuguugagcguggcagcgg

SEQ ID NO: 918025 - RNA, 18 nt, Mycobacterium avium subsp. paratuberculosis
ccguuguugucguggucg

SEQ ID NO: 918026 - RNA, 22 nt, Mycobacterium avium subsp. paratuberculosis
ccguugcucucggccucccggu

SEQ ID NO: 918027 - RNA, 20 nt, Mycobacterium avium subsp. paratuberculosis
ccguugcugcguucggcgau

SEQ ID NO: 918028 - RNA, 18 nt, Mycobacterium avium subsp. paratuberculosis
ccguugcgggucggcguc

SEQ ID NO: 918029 - RNA, 12 nt, Mycobacterium avium subsp. paratuberculosis
ccguugcggugc

SEQ ID NO: 918030 - RNA, 13 nt, Mycobacterium avium subsp. paratuberculosis
ccguugccggccc

SEQ ID NO: 918031 - RNA, 13 nt, Mycobacterium avium subsp. paratuberculosis
ccguugccgccgc

SEQ ID NO: 918032 - RNA, 16 nt, Mycobacterium avium subsp. paratuberculosis
ccguugccgccggcgc

SEQ ID NO: 918033 - RNA, 21 nt, Mycobacterium avium subsp. paratuberculosis
ccguugccggucccguugauc

SEQ ID NO: 918034 - RNA, 20 nt, Mycobacterium avium subsp. paratuberculosis
ccguugcgagucaucgccac

SEQ ID NO: 918035 - RNA, 16 nt, Mycobacterium avium subsp. paratuberculosis
ccguugggcagcucgg

SEQ ID NO: 918036 - RNA, 16 nt, Mycobacterium avium subsp. paratuberculosis
ccguugggccagaacg

SEQ ID NO: 918037 - RNA, 17 nt, Mycobacterium avium subsp. paratuberculosis
ccguugggccagaacga

SEQ ID NO: 918038 - RNA, 19 nt, Mycobacterium avium subsp. paratuberculosis
ccguugggggcgccgcggc

SEQ ID NO: 918039 - RNA, 20 nt, Mycobacterium avium subsp. paratuberculosis
ccguugggggcgccgcggcg

SEQ ID NO: 918040 - RNA, 23 nt, Mycobacterium avium subsp. paratuberculosis
ccguugggguccucgauggcggc

SEQ ID NO: 918041 - RNA, 15 nt, Mycobacterium avium subsp. paratuberculosis
ccguuggcguggaug

SEQ ID NO: 918042 - RNA, 21 nt, Mycobacterium avium subsp. paratuberculosis
ccguuggcguggauggccggc

SEQ ID NO: 918043 - RNA, 19 nt, Mycobacterium avium subsp. paratuberculosis
ccguuggaggugaucgcca

SEQ ID NO: 918044 - RNA, 18 nt, Mycobacterium avium subsp. paratuberculosis
ccguuggcaggcccggua

SEQ ID NO: 918045 - RNA, 15 nt, Mycobacterium avium subsp. paratuberculosis
ccguguagccgaccg

SEQ ID NO: 918046 - RNA, 22 nt, Mycobacterium avium subsp. paratuberculosis
ccguguagccgaccgacccggc

SEQ ID NO: 918047 - RNA, 15 nt, Mycobacterium avium subsp. paratuberculosis
ccguggucgaugaac

SEQ ID NO: 918048 - RNA, 13 nt, Mycobacterium avium subsp. paratuberculosis
ccgugguuggcga

SEQ ID NO: 918049 - RNA, 20 nt, Mycobacterium avium subsp. paratuberculosis
ccgugguuggcgaucagggc

SEQ ID NO: 918050 - RNA, 21 nt, Mycobacterium avium subsp. paratuberculosis
ccguguccaauucucagacga

SEQ ID NO: 918051 - RNA, 13 nt, Mycobacterium avium subsp. paratuberculosis
ccguucgguggcc

SEQ ID NO: 918052 - RNA, 19 nt, Mycobacterium avium subsp. paratuberculosis
ccguucgguggccaccgcg

SEQ ID NO: 918053 - RNA, 22 nt, Mycobacterium avium subsp. paratuberculosis
ccguucgguggccaccgcgacg

SEQ ID NO: 918054 - RNA, 18 nt, Mycobacterium avium subsp. paratuberculosis
ccguucucgcgcagguca

SEQ ID NO: 918055 - RNA, 13 nt, Mycobacterium avium subsp. paratuberculosis
ccguucucgggaa

SEQ ID NO: 918056 - RNA, 17 nt, Mycobacterium avium subsp. paratuberculosis
ccguugacaccgggugc

SEQ ID NO: 918057 - RNA, 13 nt, Mycobacterium avium subsp. paratuberculosis
ccguugacgccca

SEQ ID NO: 918058 - RNA, 14 nt, Mycobacterium avium subsp. paratuberculosis
ccguugacgaccuu

SEQ ID NO: 918059 - RNA, 22 nt, Mycobacterium avium subsp. paratuberculosis
ccguugacgaccuugucgcgca

SEQ ID NO: 918060 - RNA, 15 nt, Mycobacterium avium subsp. paratuberculosis
ccguugaccccgacg

SEQ ID NO: 918061 - RNA, 15 nt, Mycobacterium avium subsp. paratuberculosis
ccguugaccgacgcc

SEQ ID NO: 918062 - RNA, 13 nt, Mycobacterium avium subsp. paratuberculosis
ccguugacggugu

SEQ ID NO: 918063 - RNA, 19 nt, Mycobacterium avium subsp. paratuberculosis
ccguugaucagggcggcgc

SEQ ID NO: 918064 - RNA, 14 nt, Mycobacterium avium subsp. paratuberculosis
ccguugaucgagca

SEQ ID NO: 918065 - RNA, 19 nt, Mycobacterium avium subsp. paratuberculosis
ccguugaucuugaccgucg

SEQ ID NO: 918066 - RNA, 22 nt, Mycobacterium avium subsp. paratuberculosis
ccguugaugaagaccuggccgg

SEQ ID NO: 918067 - RNA, 15 nt, Mycobacterium avium subsp. paratuberculosis
ccguugauggaagcg

SEQ ID NO: 918068 - RNA, 17 nt, Mycobacterium avium subsp. paratuberculosis
ccguugauugcgcccgc

SEQ ID NO: 918069 - RNA, 22 nt, Mycobacterium avium subsp. paratuberculosis
ccguugcagcacaacggccuuc

SEQ ID NO: 918070 - RNA, 14 nt, Mycobacterium avium subsp. paratuberculosis
ccguugcagcacag

SEQ ID NO: 918071 - RNA, 12 nt, Mycobacterium avium subsp. paratuberculosis
ccguugccgccg

SEQ ID NO: 918072 - RNA, 19 nt, Mycobacterium avium subsp. paratuberculosis
ccguugccgccggcgcccu

SEQ ID NO: 918073 - RNA, 17 nt, Mycobacterium avium subsp. paratuberculosis
ccguugccaggccgcga

SEQ ID NO: 918074 - RNA, 20 nt, Mycobacterium avium subsp. paratuberculosis
ccguugccaggccgcgagca

SEQ ID NO: 918075 - RNA, 18 nt, Mycobacterium avium subsp. paratuberculosis
ccguugcccgaucagccg

SEQ ID NO: 918076 - RNA, 18 nt, Mycobacterium avium subsp. paratuberculosis
ccgugaucuggugggcgg

SEQ ID NO: 918077 - RNA, 22 nt, Mycobacterium avium subsp. paratuberculosis
ccgugaucuggugggcgggcac

SEQ ID NO: 918078 - RNA, 14 nt, Mycobacterium avium subsp. paratuberculosis
ccgugcacggccaa

SEQ ID NO: 918079 - RNA, 17 nt, Mycobacterium avium subsp. paratuberculosis
ccgugcaccgucgccgg

SEQ ID NO: 918080 - RNA, 18 nt, Mycobacterium avium subsp. paratuberculosis
ccgugcaccgucgccggc

SEQ ID NO: 918081 - RNA, 20 nt, Mycobacterium avium subsp. paratuberculosis
ccgugaguucgcugaccgcc

SEQ ID NO: 918082 - RNA, 13 nt, Mycobacterium avium subsp. paratuberculosis
ccgugaucgccac

SEQ ID NO: 918083 - RNA, 15 nt, Mycobacterium avium subsp. paratuberculosis
ccgugaucgccacca

SEQ ID NO: 918084 - RNA, 18 nt, Mycobacterium avium subsp. paratuberculosis
ccgugaucgccacggcgg

SEQ ID NO: 918085 - RNA, 23 nt, Mycobacterium avium subsp. paratuberculosis
ccgugaucgccacggcggugucg

SEQ ID NO: 918086 - RNA, 11 nt, Mycobacterium avium subsp. paratuberculosis
ccgugaucggc

SEQ ID NO: 918087 - RNA, 20 nt, Mycobacterium avium subsp. paratuberculosis
ccgucguucuccauccgggc

SEQ ID NO: 918088 - RNA, 12 nt, Mycobacterium avium subsp. paratuberculosis
ccgugacguugu

SEQ ID NO: 918089 - RNA, 14 nt, Mycobacterium avium subsp. paratuberculosis
ccgugaggcccggc

SEQ ID NO: 918090 - RNA, 16 nt, Mycobacterium avium subsp. paratuberculosis
ccgugaggcccggcgu

SEQ ID NO: 918091 - RNA, 20 nt, Mycobacterium avium subsp. paratuberculosis
ccgugaggcccggcgugggc

SEQ ID NO: 918092 - RNA, 17 nt, Mycobacterium avium subsp. paratuberculosis
ccgucgugguggccgcg

SEQ ID NO: 918093 - RNA, 18 nt, Mycobacterium avium subsp. paratuberculosis
ccgucgugguggccgcga

SEQ ID NO: 918094 - RNA, 21 nt, Mycobacterium avium subsp. paratuberculosis
ccgucgugguggccgcgaaaa

SEQ ID NO: 918095 - RNA, 13 nt, Mycobacterium avium subsp. paratuberculosis
ccgucgugcucgg

SEQ ID NO: 918096 - RNA, 16 nt, Mycobacterium avium subsp. paratuberculosis
ccgucgugcucggcga

SEQ ID NO: 918097 - RNA, 18 nt, Mycobacterium avium subsp. paratuberculosis
ccgucgugcucggcgagc

SEQ ID NO: 918098 - RNA, 21 nt, Mycobacterium avium subsp. paratuberculosis
ccgucgugcucggcgagcacc

SEQ ID NO: 918099 - RNA, 17 nt, Mycobacterium avium subsp. paratuberculosis
ccgucgugccagcgcag

SEQ ID NO: 918100 - RNA, 23 nt, Mycobacterium avium subsp. paratuberculosis
ccgucgguguagcgagugccggc

SEQ ID NO: 918101 - RNA, 16 nt, Mycobacterium avium subsp. paratuberculosis
ccgucgguguccaggu

SEQ ID NO: 918102 - RNA, 24 nt, Mycobacterium avium subsp. paratuberculosis
ccgucgguuucggucgcggugauc

SEQ ID NO: 918103 - RNA, 20 nt, Mycobacterium avium subsp. paratuberculosis
ccgucguacucgaccgcgac

SEQ ID NO: 918104 - RNA, 14 nt, Mycobacterium avium subsp. paratuberculosis
ccgucguagccgcg

SEQ ID NO: 918105 - RNA, 13 nt, Mycobacterium avium subsp. paratuberculosis
ccgugacggugcg

SEQ ID NO: 918106 - RNA, 14 nt, Mycobacterium avium subsp. paratuberculosis
ccgugacggcaucg

SEQ ID NO: 918107 - RNA, 16 nt, Mycobacterium avium subsp. paratuberculosis
ccgugacggcaucggc

SEQ ID NO: 918108 - RNA, 18 nt, Mycobacterium avium subsp. paratuberculosis
ccgugacggcaucggcgc

SEQ ID NO: 918109 - RNA, 14 nt, Mycobacterium avium subsp. paratuberculosis
ccgugacgccgauc

SEQ ID NO: 918110 - RNA, 20 nt, Mycobacterium avium subsp. paratuberculosis
ccgucucgaccacccggcgg

SEQ ID NO: 918111 - RNA, 14 nt, Mycobacterium avium subsp. paratuberculosis
ccgucucgacccgg

SEQ ID NO: 918112 - RNA, 14 nt, Mycobacterium avium subsp. paratuberculosis
ccgucucgagccgg

SEQ ID NO: 918113 - RNA, 15 nt, Mycobacterium avium subsp. paratuberculosis
ccgucucgagccggc

SEQ ID NO: 918114 - RNA, 22 nt, Mycobacterium avium subsp. paratuberculosis
ccgucuccucgaccagcgcgcc

SEQ ID NO: 918115 - RNA, 14 nt, Mycobacterium avium subsp. paratuberculosis
ccgucuccaacugc

SEQ ID NO: 918116 - RNA, 20 nt, Mycobacterium avium subsp. paratuberculosis
ccgucguugcgggcggcgcg

SEQ ID NO: 918117 - RNA, 21 nt, Mycobacterium avium subsp. paratuberculosis
ccgucguugcgggcggcgcgg

SEQ ID NO: 918118 - RNA, 22 nt, Mycobacterium avium subsp. paratuberculosis
ccgucucaggaauuugcggccc

SEQ ID NO: 918119 - RNA, 23 nt, Mycobacterium avium subsp. paratuberculosis
ccgucucaggaauuugcggcccg

SEQ ID NO: 918120 - RNA, 20 nt, Mycobacterium avium subsp. paratuberculosis
ccgugccuuacgccgggguc

SEQ ID NO: 918121 - RNA, 22 nt, Mycobacterium avium subsp. paratuberculosis
ccgugcgacuugguggccagca

SEQ ID NO: 918122 - RNA, 16 nt, Mycobacterium avium subsp. paratuberculosis
ccgugcagaacagcac

SEQ ID NO: 918123 - RNA, 14 nt, Mycobacterium avium subsp. paratuberculosis
ccgugccucgccac

SEQ ID NO: 918124 - RNA, 17 nt, Mycobacterium avium subsp. paratuberculosis
ccgugccucgccacugg

SEQ ID NO: 918125 - RNA, 16 nt, Mycobacterium avium subsp. paratuberculosis
ccgugcagcaccucga

SEQ ID NO: 918126 - RNA, 14 nt, Mycobacterium avium subsp. paratuberculosis
ccgugcagccgggc

SEQ ID NO: 918127 - RNA, 17 nt, Mycobacterium avium subsp. paratuberculosis
ccgugcagccgggccug

SEQ ID NO: 918128 - RNA, 16 nt, Mycobacterium avium subsp. paratuberculosis
ccgugcagcgcccagc

SEQ ID NO: 918129 - RNA, 22 nt, Mycobacterium avium subsp. paratuberculosis
ccgugcaggaugaccgcgucgg

SEQ ID NO: 918130 - RNA, 20 nt, Mycobacterium avium subsp. paratuberculosis
ccgugcagggggcgcagccg

SEQ ID NO: 918131 - RNA, 15 nt, Mycobacterium avium subsp. paratuberculosis
ccgugccacggccgc

SEQ ID NO: 918132 - RNA, 16 nt, Mycobacterium avium subsp. paratuberculosis
ccgugccacggccgcg

SEQ ID NO: 918133 - RNA, 17 nt, Mycobacterium avium subsp. paratuberculosis
ccgugccacggccgcgg

SEQ ID NO: 918134 - RNA, 22 nt, Mycobacterium avium subsp. paratuberculosis
ccgugcggggccucgucgccgc

SEQ ID NO: 918135 - RNA, 23 nt, Mycobacterium avium subsp. paratuberculosis
ccgugcggggccucgucgccgcg

SEQ ID NO: 918136 - RNA, 19 nt, Mycobacterium avium subsp. paratuberculosis
ccgugcggcggggccucga

SEQ ID NO: 918137 - RNA, 22 nt, Mycobacterium avium subsp. paratuberculosis
ccgugcggcguucggugcccgg

SEQ ID NO: 918138 - RNA, 16 nt, Mycobacterium avium subsp. paratuberculosis
ccgugcgcgcgcaccu

SEQ ID NO: 918139 - RNA, 13 nt, Mycobacterium avium subsp. paratuberculosis
ccgugcgccucga

SEQ ID NO: 918140 - RNA, 15 nt, Mycobacterium avium subsp. paratuberculosis
ccgugcgccucgauc

SEQ ID NO: 918141 - RNA, 20 nt, Mycobacterium avium subsp. paratuberculosis
ccgugcggcacgccgcagcg

SEQ ID NO: 918142 - RNA, 15 nt, Mycobacterium avium subsp. paratuberculosis
ccgugcgcgucgaca

SEQ ID NO: 918143 - RNA, 15 nt, Mycobacterium avium subsp. paratuberculosis
ccgugcgccagcgac

SEQ ID NO: 918144 - RNA, 18 nt, Mycobacterium avium subsp. paratuberculosis
ccgugcgccagcgaccgc

SEQ ID NO: 918145 - RNA, 20 nt, Mycobacterium avium subsp. paratuberculosis
ccgugcgccagcgaccgcag

SEQ ID NO: 918146 - RNA, 18 nt, Mycobacterium avium subsp. paratuberculosis
ccguggugacccggaccg

SEQ ID NO: 918147 - RNA, 19 nt, Mycobacterium avium subsp. paratuberculosis
ccguggugacccggaccgg

SEQ ID NO: 918148 - RNA, 16 nt, Mycobacterium avium subsp. paratuberculosis
ccguggugaucgccgc

SEQ ID NO: 918149 - RNA, 13 nt, Mycobacterium avium subsp. paratuberculosis
ccgugguggcggc

SEQ ID NO: 918150 - RNA, 16 nt, Mycobacterium avium subsp. paratuberculosis
ccgugguggcggcgaa

SEQ ID NO: 918151 - RNA, 17 nt, Mycobacterium avium subsp. paratuberculosis
ccgugguggcggcgaau

SEQ ID NO: 918152 - RNA, 14 nt, Mycobacterium avium subsp. paratuberculosis
ccguggugggcgaa

SEQ ID NO: 918153 - RNA, 18 nt, Mycobacterium avium subsp. paratuberculosis
ccguggugggcgaacagc

SEQ ID NO: 918154 - RNA, 12 nt, Mycobacterium avium subsp. paratuberculosis
ccguggugucgg

SEQ ID NO: 918155 - RNA, 19 nt, Mycobacterium avium subsp. paratuberculosis
ccguggucaacggcaccga

SEQ ID NO: 918156 - RNA, 22 nt, Mycobacterium avium subsp. paratuberculosis
ccguggucaggggugggcgacg

SEQ ID NO: 918157 - RNA, 19 nt, Mycobacterium avium subsp. paratuberculosis
ccgugguccagccggucgc

SEQ ID NO: 918158 - RNA, 14 nt, Mycobacterium avium subsp. paratuberculosis
ccguggucggcagc

SEQ ID NO: 918159 - RNA, 18 nt, Mycobacterium avium subsp. paratuberculosis
ccguggucggcagcaccg

SEQ ID NO: 918160 - RNA, 15 nt, Mycobacterium avium subsp. paratuberculosis
ccguggucggcgaug

SEQ ID NO: 918161 - RNA, 22 nt, Mycobacterium avium subsp. paratuberculosis
ccguggucggcgaugcgcacca

SEQ ID NO: 918162 - RNA, 13 nt, Mycobacterium avium subsp. paratuberculosis
ccguggucggugc

SEQ ID NO: 918163 - RNA, 15 nt, Mycobacterium avium subsp. paratuberculosis
ccgugguagacgccg

SEQ ID NO: 918164 - RNA, 23 nt, Mycobacterium avium subsp. paratuberculosis
ccgugggcgucacgcaucagggc

SEQ ID NO: 918165 - RNA, 14 nt, Mycobacterium avium subsp. paratuberculosis
ccgugggccgaccg

SEQ ID NO: 918166 - RNA, 15 nt, Mycobacterium avium subsp. paratuberculosis
ccgugggccgaccgg

SEQ ID NO: 918167 - RNA, 16 nt, Mycobacterium avium subsp. paratuberculosis
ccgugggccgaccggc

SEQ ID NO: 918168 - RNA, 19 nt, Mycobacterium avium subsp. paratuberculosis
ccgugggccgaccggccgg

SEQ ID NO: 918169 - RNA, 23 nt, Mycobacterium avium subsp. paratuberculosis
ccguggcggcggugucgcccagc

SEQ ID NO: 918170 - RNA, 22 nt, Mycobacterium avium subsp. paratuberculosis
ccguggcgggggagccgugcag

SEQ ID NO: 918171 - RNA, 23 nt, Mycobacterium avium subsp. paratuberculosis
ccguggcgggggagccgugcagc

SEQ ID NO: 918172 - RNA, 22 nt, Mycobacterium avium subsp. paratuberculosis
ccgucgcggcuucagucccgcg

SEQ ID NO: 918173 - RNA, 22 nt, Mycobacterium avium subsp. paratuberculosis
ccgucgcgggaaucccacccgc

SEQ ID NO: 918174 - RNA, 23 nt, Mycobacterium avium subsp. paratuberculosis
ccgucgcgggaaucccacccgca

SEQ ID NO: 918175 - RNA, 21 nt, Mycobacterium avium subsp. paratuberculosis
ccgucgcgggagagcgcgggc

SEQ ID NO: 918176 - RNA, 23 nt, Mycobacterium avium subsp. paratuberculosis
ccgucgcgggagagcgcgggcac

SEQ ID NO: 918177 - RNA, 14 nt, Mycobacterium avium subsp. paratuberculosis
ccgucgcgggcguc

SEQ ID NO: 918178 - RNA, 15 nt, Mycobacterium avium subsp. paratuberculosis
ccgucgcgggucagc

SEQ ID NO: 918179 - RNA, 20 nt, Mycobacterium avium subsp. paratuberculosis
ccgucgcgggucagcgucgc

SEQ ID NO: 918180 - RNA, 13 nt, Mycobacterium avium subsp. paratuberculosis
ccgucgcgggugg

SEQ ID NO: 918181 - RNA, 18 nt, Mycobacterium avium subsp. paratuberculosis
ccgucgcggucagcucga

SEQ ID NO: 918182 - RNA, 23 nt, Mycobacterium avium subsp. paratuberculosis
ccgucgcggucagcucgaucgcc

SEQ ID NO: 918183 - RNA, 23 nt, Mycobacterium avium subsp. paratuberculosis
ccgucgcuguuggcgacggcgcu

SEQ ID NO: 918184 - RNA, 18 nt, Mycobacterium avium subsp. paratuberculosis
ccgucggaggacaacgcg

SEQ ID NO: 918185 - RNA, 22 nt, Mycobacterium avium subsp. paratuberculosis
ccgucggaggacaacgcgucga

SEQ ID NO: 918186 - RNA, 14 nt, Mycobacterium avium subsp. paratuberculosis
ccgucggcaacgcc

SEQ ID NO: 918187 - RNA, 19 nt, Mycobacterium avium subsp. paratuberculosis
ccgucggcaacgccggguc

SEQ ID NO: 918188 - RNA, 13 nt, Mycobacterium avium subsp. paratuberculosis
ccgucggcggccg

SEQ ID NO: 918189 - RNA, 12 nt, Mycobacterium avium subsp. paratuberculosis
ccgucggcgggg

SEQ ID NO: 918190 - RNA, 15 nt, Mycobacterium avium subsp. paratuberculosis
ccgucggcgucgacg

SEQ ID NO: 918191 - RNA, 16 nt, Mycobacterium avium subsp. paratuberculosis
ccgucggcgucgacga

SEQ ID NO: 918192 - RNA, 17 nt, Mycobacterium avium subsp. paratuberculosis
ccgucggcgucgacgac

SEQ ID NO: 918193 - RNA, 22 nt, Mycobacterium avium subsp. paratuberculosis
ccgucgggguggggacgacgcc

SEQ ID NO: 918194 - RNA, 18 nt, Mycobacterium avium subsp. paratuberculosis
ccgucgguaucgaggucc

SEQ ID NO: 918195 - RNA, 15 nt, Mycobacterium avium subsp. paratuberculosis
ccgucggucccgacg

SEQ ID NO: 918196 - RNA, 23 nt, Mycobacterium avium subsp. paratuberculosis
ccgucggugcgguaggugccggc

SEQ ID NO: 918197 - RNA, 22 nt, Mycobacterium avium subsp. paratuberculosis
ccgucggugaaguuggcggcgg

SEQ ID NO: 918198 - RNA, 15 nt, Mycobacterium avium subsp. paratuberculosis
ccgucggggcccggc

SEQ ID NO: 918199 - RNA, 17 nt, Mycobacterium avium subsp. paratuberculosis
ccgucggggcccggccc

SEQ ID NO: 918200 - RNA, 14 nt, Mycobacterium avium subsp. paratuberculosis
ccgucggggcugag

SEQ ID NO: 918201 - RNA, 17 nt, Mycobacterium avium subsp. paratuberculosis
ccgucggggucgcgccg

SEQ ID NO: 918202 - RNA, 19 nt, Mycobacterium avium subsp. paratuberculosis
ccgucggggucgcgccggu

SEQ ID NO: 918203 - RNA, 14 nt, Mycobacterium avium subsp. paratuberculosis
ccgucggggugcgc

SEQ ID NO: 918204 - RNA, 15 nt, Mycobacterium avium subsp. paratuberculosis
ccgucggggugcgcc

SEQ ID NO: 918205 - RNA, 16 nt, Mycobacterium avium subsp. paratuberculosis
ccgucggggugcgcca

SEQ ID NO: 918206 - RNA, 18 nt, Mycobacterium avium subsp. paratuberculosis
ccgucggggugcgccagg

SEQ ID NO: 918207 - RNA, 19 nt, Mycobacterium avium subsp. paratuberculosis
ccgucggggugcgccaggc

SEQ ID NO: 918208 - RNA, 23 nt, Mycobacterium avium subsp. paratuberculosis
ccgucggggugcggucggcgacg

SEQ ID NO: 918209 - RNA, 15 nt, Mycobacterium avium subsp. paratuberculosis
ccgucgggucggcga

SEQ ID NO: 918210 - RNA, 17 nt, Mycobacterium avium subsp. paratuberculosis
ccgucgggucggcgagc

SEQ ID NO: 918211 - RNA, 15 nt, Mycobacterium avium subsp. paratuberculosis
ccgucgggcgcggcg

SEQ ID NO: 918212 - RNA, 16 nt, Mycobacterium avium subsp. paratuberculosis
ccgucgggcgcggcgg

SEQ ID NO: 918213 - RNA, 17 nt, Mycobacterium avium subsp. paratuberculosis
ccgucgggcgcggcggc

SEQ ID NO: 918214 - RNA, 16 nt, Mycobacterium avium subsp. paratuberculosis
ccgucgggcggggugg

SEQ ID NO: 918215 - RNA, 19 nt, Mycobacterium avium subsp. paratuberculosis
ccgucgggcgggguggcca

SEQ ID NO: 918216 - RNA, 16 nt, Mycobacterium avium subsp. paratuberculosis
ccgucgggccguccgc

SEQ ID NO: 918217 - RNA, 19 nt, Mycobacterium avium subsp. paratuberculosis
ccgucgggccguccgccgg

SEQ ID NO: 918218 - RNA, 20 nt, Mycobacterium avium subsp. paratuberculosis
ccgucgggccguccgccggc

SEQ ID NO: 918219 - RNA, 23 nt, Mycobacterium avium subsp. paratuberculosis
ccgucgggccguccgccggcugg

SEQ ID NO: 918220 - RNA, 19 nt, Mycobacterium avium subsp. paratuberculosis
ccgucggcguucagcggca

SEQ ID NO: 918221 - RNA, 20 nt, Mycobacterium avium subsp. paratuberculosis
ccgucggcguucagcggcac

SEQ ID NO: 918222 - RNA, 20 nt, Mycobacterium avium subsp. paratuberculosis
ccgucggcuuccuccucggc

SEQ ID NO: 918223 - RNA, 17 nt, Mycobacterium avium subsp. paratuberculosis
ccgucgggacgcggcag

SEQ ID NO: 918224 - RNA, 19 nt, Mycobacterium avium subsp. paratuberculosis
ccgucgggacgcggcaggc

SEQ ID NO: 918225 - RNA, 15 nt, Mycobacterium avium subsp. paratuberculosis
ccgucgggacggcca

SEQ ID NO: 918226 - RNA, 18 nt, Mycobacterium avium subsp. paratuberculosis
ccgucgcaucagcucggc

SEQ ID NO: 918227 - RNA, 19 nt, Mycobacterium avium subsp. paratuberculosis
ccgucgccccgcaccgagc

SEQ ID NO: 918228 - RNA, 21 nt, Mycobacterium avium subsp. paratuberculosis
ccgucgcccgcccaggccgcc

SEQ ID NO: 918229 - RNA, 15 nt, Mycobacterium avium subsp. paratuberculosis
ccgucgccgaccagc

SEQ ID NO: 918230 - RNA, 18 nt, Mycobacterium avium subsp. paratuberculosis
ccgucgccgaccagccga

SEQ ID NO: 918231 - RNA, 12 nt, Mycobacterium avium subsp. paratuberculosis
ccgucgccgcac

SEQ ID NO: 918232 - RNA, 18 nt, Mycobacterium avium subsp. paratuberculosis
ccgucgccgcacgcccac

SEQ ID NO: 918233 - RNA, 16 nt, Mycobacterium avium subsp. paratuberculosis
ccgucgccgaucaccu

SEQ ID NO: 918234 - RNA, 15 nt, Mycobacterium avium subsp. paratuberculosis
ccgucgccgcgcccg

SEQ ID NO: 918235 - RNA, 18 nt, Mycobacterium avium subsp. paratuberculosis
ccgucgccgcgcccgccg

SEQ ID NO: 918236 - RNA, 19 nt, Mycobacterium avium subsp. paratuberculosis
ccgucgccgcgcccgccgg

SEQ ID NO: 918237 - RNA, 12 nt, Mycobacterium avium subsp. paratuberculosis
ccgucgccggag

SEQ ID NO: 918238 - RNA, 16 nt, Mycobacterium avium subsp. paratuberculosis
ccgucgccggaggcga

SEQ ID NO: 918239 - RNA, 17 nt, Mycobacterium avium subsp. paratuberculosis
ccgucgccggaggcgau

SEQ ID NO: 918240 - RNA, 16 nt, Mycobacterium avium subsp. paratuberculosis
ccgucgcgcucgacga

SEQ ID NO: 918241 - RNA, 18 nt, Mycobacterium avium subsp. paratuberculosis
ccgucgcgaucacaccac

SEQ ID NO: 918242 - RNA, 16 nt, Mycobacterium avium subsp. paratuberculosis
ccgucgcgaucgcggu

SEQ ID NO: 918243 - RNA, 17 nt, Mycobacterium avium subsp. paratuberculosis
ccgucgcgaucgcgguc

SEQ ID NO: 918244 - RNA, 18 nt, Mycobacterium avium subsp. paratuberculosis
ccgucgcgaucgcggucc

SEQ ID NO: 918245 - RNA, 23 nt, Mycobacterium avium subsp. paratuberculosis
ccgucgcgcaaacugacaggcgg

SEQ ID NO: 918246 - RNA, 14 nt, Mycobacterium avium subsp. paratuberculosis
ccgucgcgcaccac

SEQ ID NO: 918247 - RNA, 16 nt, Mycobacterium avium subsp. paratuberculosis
ccgucgcgcacccaga

SEQ ID NO: 918248 - RNA, 14 nt, Mycobacterium avium subsp. paratuberculosis
ccgucgcgcagccc

SEQ ID NO: 918249 - RNA, 14 nt, Mycobacterium avium subsp. paratuberculosis
ccgucgcgcagccu

SEQ ID NO: 918250 - RNA, 16 nt, Mycobacterium avium subsp. paratuberculosis
ccgucgccggcgcgca

SEQ ID NO: 918251 - RNA, 14 nt, Mycobacterium avium subsp. paratuberculosis
ccgucgccggcuga

SEQ ID NO: 918252 - RNA, 14 nt, Mycobacterium avium subsp. paratuberculosis
ccgucgccgggcgg

SEQ ID NO: 918253 - RNA, 15 nt, Mycobacterium avium subsp. paratuberculosis
ccgucgccgggcggg

SEQ ID NO: 918254 - RNA, 17 nt, Mycobacterium avium subsp. paratuberculosis
ccgucgccgugcgucca

SEQ ID NO: 918255 - RNA, 17 nt, Mycobacterium avium subsp. paratuberculosis
ccgucgccuccgagaug

SEQ ID NO: 918256 - RNA, 14 nt, Mycobacterium avium subsp. paratuberculosis
ccgucgaucccgga

SEQ ID NO: 918257 - RNA, 22 nt, Mycobacterium avium subsp. paratuberculosis
ccgucgaucccggacuccucgg

SEQ ID NO: 918258 - RNA, 12 nt, Mycobacterium avium subsp. paratuberculosis
ccgucgaucgcc

SEQ ID NO: 918259 - RNA, 17 nt, Mycobacterium avium subsp. paratuberculosis
ccgucgaucgcccgcuc

SEQ ID NO: 918260 - RNA, 21 nt, Mycobacterium avium subsp. paratuberculosis
ccgucgaggacugggucaccg

SEQ ID NO: 918261 - RNA, 14 nt, Mycobacterium avium subsp. paratuberculosis
ccguccuuggccgc

SEQ ID NO: 918262 - RNA, 15 nt, Mycobacterium avium subsp. paratuberculosis
ccguccuuggccgcc

SEQ ID NO: 918263 - RNA, 17 nt, Mycobacterium avium subsp. paratuberculosis
ccgucgaguccgugguc

SEQ ID NO: 918264 - RNA, 19 nt, Mycobacterium avium subsp. paratuberculosis
ccgucgaguccguggucag

SEQ ID NO: 918265 - RNA, 13 nt, Mycobacterium avium subsp. paratuberculosis
ccgucgcaccgcc

SEQ ID NO: 918266 - RNA, 12 nt, Mycobacterium avium subsp. paratuberculosis
ccgucgccacca

SEQ ID NO: 918267 - RNA, 15 nt, Mycobacterium avium subsp. paratuberculosis
ccgucgccaccaccg

SEQ ID NO: 918268 - RNA, 18 nt, Mycobacterium avium subsp. paratuberculosis
ccgucgccaccaccgcgc

SEQ ID NO: 918269 - RNA, 16 nt, Mycobacterium avium subsp. paratuberculosis
ccgucgccaccacggc

SEQ ID NO: 918270 - RNA, 18 nt, Mycobacterium avium subsp. paratuberculosis
ccgucgccaccacggcgc

SEQ ID NO: 918271 - RNA, 13 nt, Mycobacterium avium subsp. paratuberculosis
ccgucgccaccga

SEQ ID NO: 918272 - RNA, 23 nt, Mycobacterium avium subsp. paratuberculosis
ccgucgccaccgagucgcgcgac

SEQ ID NO: 918273 - RNA, 12 nt, Mycobacterium avium subsp. paratuberculosis
ccgucgccacga

SEQ ID NO: 918274 - RNA, 17 nt, Mycobacterium avium subsp. paratuberculosis
ccgucgccacgaucacc

SEQ ID NO: 918275 - RNA, 20 nt, Mycobacterium avium subsp. paratuberculosis
ccgucgauggacagggcgac

SEQ ID NO: 918276 - RNA, 23 nt, Mycobacterium avium subsp. paratuberculosis
ccgucgauuucaaggggccgggc

SEQ ID NO: 918277 - RNA, 18 nt, Mycobacterium avium subsp. paratuberculosis
ccugcuucucgccgucgu

SEQ ID NO: 918278 - RNA, 18 nt, Mycobacterium avium subsp. paratuberculosis
ccugcuucuggaugcggu

SEQ ID NO: 918279 - RNA, 21 nt, Mycobacterium avium subsp. paratuberculosis
ccugcuucuggaugcggucgu

SEQ ID NO: 918280 - RNA, 22 nt, Mycobacterium avium subsp. paratuberculosis
ccugcuucuggaugcggucguc

SEQ ID NO: 918281 - RNA, 19 nt, Mycobacterium avium subsp. paratuberculosis
ccugcuuggcggccugcgc

SEQ ID NO: 918282 - RNA, 15 nt, Mycobacterium avium subsp. paratuberculosis
ccugcuugaccgcga

SEQ ID NO: 918283 - RNA, 16 nt, Mycobacterium avium subsp. paratuberculosis
ccugcuugagcccguc

SEQ ID NO: 918284 - RNA, 17 nt, Mycobacterium avium subsp. paratuberculosis
ccugcuugagcccgucg

SEQ ID NO: 918285 - RNA, 23 nt, Mycobacterium avium subsp. paratuberculosis
ccugcuugaugaugccggccgcg

SEQ ID NO: 918286 - RNA, 19 nt, Mycobacterium avium subsp. paratuberculosis
ccuggaagcgcaucgccgg

SEQ ID NO: 918287 - RNA, 20 nt, Mycobacterium avium subsp. paratuberculosis
ccuggaagcgcaucgccggc

SEQ ID NO: 918288 - RNA, 16 nt, Mycobacterium avium subsp. paratuberculosis
ccuggaaggcgaucac

SEQ ID NO: 918289 - RNA, 19 nt, Mycobacterium avium subsp. paratuberculosis
ccuggaacuuguugacgaa

SEQ ID NO: 918290 - RNA, 20 nt, Mycobacterium avium subsp. paratuberculosis
ccuggaagaagucggugucg

SEQ ID NO: 918291 - RNA, 17 nt, Mycobacterium avium subsp. paratuberculosis
ccugcuuggucgccugc

SEQ ID NO: 918292 - RNA, 20 nt, Mycobacterium avium subsp. paratuberculosis
ccugcuuggucuccggcccc

SEQ ID NO: 918293 - RNA, 20 nt, Mycobacterium avium subsp. paratuberculosis
ccugcuuguugagggugacg

SEQ ID NO: 918294 - RNA, 17 nt, Mycobacterium avium subsp. paratuberculosis
ccugcuuuucggccgag

SEQ ID NO: 918295 - RNA, 17 nt, Mycobacterium avium subsp. paratuberculosis
ccuggacgaguggucgg

SEQ ID NO: 918296 - RNA, 18 nt, Mycobacterium avium subsp. paratuberculosis
ccuggacgaguggucggc

SEQ ID NO: 918297 - RNA, 15 nt, Mycobacterium avium subsp. paratuberculosis
ccuggacgccgcacg

SEQ ID NO: 918298 - RNA, 20 nt, Mycobacterium avium subsp. paratuberculosis
ccuggacgguuucaccgccg

SEQ ID NO: 918299 - RNA, 21 nt, Mycobacterium avium subsp. paratuberculosis
ccuggaucccgaacugccgcg

SEQ ID NO: 918300 - RNA, 22 nt, Mycobacterium avium subsp. paratuberculosis
ccuggaucccgaacugccgcgc

SEQ ID NO: 918301 - RNA, 17 nt, Mycobacterium avium subsp. paratuberculosis
ccuggaucgcgcaggug

SEQ ID NO: 918302 - RNA, 20 nt, Mycobacterium avium subsp. paratuberculosis
ccuggagcggguccgccccg

SEQ ID NO: 918303 - RNA, 14 nt, Mycobacterium avium subsp. paratuberculosis
ccugcucggcgacg

SEQ ID NO: 918304 - RNA, 17 nt, Mycobacterium avium subsp. paratuberculosis
ccugcucggcgacgcug

SEQ ID NO: 918305 - RNA, 16 nt, Mycobacterium avium subsp. paratuberculosis
ccugcucgcgggccac

SEQ ID NO: 918306 - RNA, 20 nt, Mycobacterium avium subsp. paratuberculosis
ccugcucgcgggccaccgcg

SEQ ID NO: 918307 - RNA, 19 nt, Mycobacterium avium subsp. paratuberculosis
ccugcucgcuugccagccg

SEQ ID NO: 918308 - RNA, 22 nt, Mycobacterium avium subsp. paratuberculosis
ccugcucgcuugccagccgggc

SEQ ID NO: 918309 - RNA, 21 nt, Mycobacterium avium subsp. paratuberculosis
ccugcucagcggccaucgccg

SEQ ID NO: 918310 - RNA, 13 nt, Mycobacterium avium subsp. paratuberculosis
ccugcuggcgcug

SEQ ID NO: 918311 - RNA, 15 nt, Mycobacterium avium subsp. paratuberculosis
ccugcugggcggcac

SEQ ID NO: 918312 - RNA, 14 nt, Mycobacterium avium subsp. paratuberculosis
ccugcugccaggac

SEQ ID NO: 918313 - RNA, 22 nt, Mycobacterium avium subsp. paratuberculosis
ccugcugcucgucgcgggcgcc

SEQ ID NO: 918314 - RNA, 12 nt, Mycobacterium avium subsp. paratuberculosis
ccugcugcagcg

SEQ ID NO: 918315 - RNA, 17 nt, Mycobacterium avium subsp. paratuberculosis
ccugcucgucgacgcug

SEQ ID NO: 918316 - RNA, 19 nt, Mycobacterium avium subsp. paratuberculosis
ccugcucgucgacgcugac

SEQ ID NO: 918317 - RNA, 22 nt, Mycobacterium avium subsp. paratuberculosis
ccugcucgucgacgcugaccgu

SEQ ID NO: 918318 - RNA, 12 nt, Mycobacterium avium subsp. paratuberculosis
ccugcucgucgg

SEQ ID NO: 918319 - RNA, 14 nt, Mycobacterium avium subsp. paratuberculosis
ccugcucgucggug

SEQ ID NO: 918320 - RNA, 17 nt, Mycobacterium avium subsp. paratuberculosis
ccugcucgucggugacg

SEQ ID NO: 918321 - RNA, 20 nt, Mycobacterium avium subsp. paratuberculosis
ccugcucuucgcgcgcggcg

SEQ ID NO: 918322 - RNA, 16 nt, Mycobacterium avium subsp. paratuberculosis
ccugcucggugaugcc

SEQ ID NO: 918323 - RNA, 18 nt, Mycobacterium avium subsp. paratuberculosis
ccugcgcgcccugcuggg

SEQ ID NO: 918324 - RNA, 14 nt, Mycobacterium avium subsp. paratuberculosis
ccugcgcgccgaug

SEQ ID NO: 918325 - RNA, 21 nt, Mycobacterium avium subsp. paratuberculosis
ccugcgcgccgauguggccgg

SEQ ID NO: 918326 - RNA, 14 nt, Mycobacterium avium subsp. paratuberculosis
ccugcgcggcggcg

SEQ ID NO: 918327 - RNA, 18 nt, Mycobacterium avium subsp. paratuberculosis
ccugcgcgggcgcggaca

SEQ ID NO: 918328 - RNA, 16 nt, Mycobacterium avium subsp. paratuberculosis
ccugcgcucagcacgc

SEQ ID NO: 918329 - RNA, 18 nt, Mycobacterium avium subsp. paratuberculosis
ccugcgcucagcacgcgg

SEQ ID NO: 918330 - RNA, 17 nt, Mycobacterium avium subsp. paratuberculosis
ccugcggcaacagcacc

SEQ ID NO: 918331 - RNA, 14 nt, Mycobacterium avium subsp. paratuberculosis
ccugcggcaccucg

SEQ ID NO: 918332 - RNA, 23 nt, Mycobacterium avium subsp. paratuberculosis
ccugcggcaccucggccuugacc

SEQ ID NO: 918333 - RNA, 21 nt, Mycobacterium avium subsp. paratuberculosis
ccugcggcagguaggcgccgc

SEQ ID NO: 918334 - RNA, 23 nt, Mycobacterium avium subsp. paratuberculosis
ccugcggcaggucggccagcgcc

SEQ ID NO: 918335 - RNA, 19 nt, Mycobacterium avium subsp. paratuberculosis
ccugcggccagugccgggc

SEQ ID NO: 918336 - RNA, 20 nt, Mycobacterium avium subsp. paratuberculosis
ccugcggccagugccgggcc

SEQ ID NO: 918337 - RNA, 13 nt, Mycobacterium avium subsp. paratuberculosis
ccugcggccccug

SEQ ID NO: 918338 - RNA, 17 nt, Mycobacterium avium subsp. paratuberculosis
ccugcggcccgucgccg

SEQ ID NO: 918339 - RNA, 18 nt, Mycobacterium avium subsp. paratuberculosis
ccugcggcccgucgccgu

SEQ ID NO: 918340 - RNA, 19 nt, Mycobacterium avium subsp. paratuberculosis
ccugcggggugucgaccca

SEQ ID NO: 918341 - RNA, 21 nt, Mycobacterium avium subsp. paratuberculosis
ccugcggggugucgacccagg

SEQ ID NO: 918342 - RNA, 19 nt, Mycobacterium avium subsp. paratuberculosis
ccugcgggcgccggcugcc

SEQ ID NO: 918343 - RNA, 17 nt, Mycobacterium avium subsp. paratuberculosis
ccugcgggacgccguug

SEQ ID NO: 918344 - RNA, 22 nt, Mycobacterium avium subsp. paratuberculosis
ccugcggcggcagucgcagcag

SEQ ID NO: 918345 - RNA, 14 nt, Mycobacterium avium subsp. paratuberculosis
ccugcggcggccgc

SEQ ID NO: 918346 - RNA, 18 nt, Mycobacterium avium subsp. paratuberculosis
ccugcggcggccgcagcg

SEQ ID NO: 918347 - RNA, 13 nt, Mycobacterium avium subsp. paratuberculosis
ccugcggcggcag

SEQ ID NO: 918348 - RNA, 21 nt, Mycobacterium avium subsp. paratuberculosis
ccugcggcgcggccaccccgg

SEQ ID NO: 918349 - RNA, 22 nt, Mycobacterium avium subsp. paratuberculosis
ccugcggcgcggccaccccggu

SEQ ID NO: 918350 - RNA, 13 nt, Mycobacterium avium subsp. paratuberculosis
ccugcggcgcggc

SEQ ID NO: 918351 - RNA, 12 nt, Mycobacterium avium subsp. paratuberculosis
ccugcggcgaca

SEQ ID NO: 918352 - RNA, 16 nt, Mycobacterium avium subsp. paratuberculosis
ccugcguccggcccgg

SEQ ID NO: 918353 - RNA, 18 nt, Mycobacterium avium subsp. paratuberculosis
ccugcguccggcccggcg

SEQ ID NO: 918354 - RNA, 17 nt, Mycobacterium avium subsp. paratuberculosis
ccugcgucacuccucga

SEQ ID NO: 918355 - RNA, 18 nt, Mycobacterium avium subsp. paratuberculosis
ccugcggguucuggccgu

SEQ ID NO: 918356 - RNA, 19 nt, Mycobacterium avium subsp. paratuberculosis
ccugcggguucuggccgug

SEQ ID NO: 918357 - RNA, 20 nt, Mycobacterium avium subsp. paratuberculosis
ccugcggugagcugaucgcg

SEQ ID NO: 918358 - RNA, 15 nt, Mycobacterium avium subsp. paratuberculosis
ccugcggugaugcgc

SEQ ID NO: 918359 - RNA, 19 nt, Mycobacterium avium subsp. paratuberculosis
ccugcggugaugcgcggcg

SEQ ID NO: 918360 - RNA, 22 nt, Mycobacterium avium subsp. paratuberculosis
ccugcggugaugcgcggcgacg

SEQ ID NO: 918361 - RNA, 17 nt, Mycobacterium avium subsp. paratuberculosis
ccugcaguucgaucacc

SEQ ID NO: 918362 - RNA, 13 nt, Mycobacterium avium subsp. paratuberculosis
ccugcgaccgccg

SEQ ID NO: 918363 - RNA, 14 nt, Mycobacterium avium subsp. paratuberculosis
ccugcgaccgccgc

SEQ ID NO: 918364 - RNA, 13 nt, Mycobacterium avium subsp. paratuberculosis
ccugcgacggcag

SEQ ID NO: 918365 - RNA, 20 nt, Mycobacterium avium subsp. paratuberculosis
ccugcgacuucuacggcggg

SEQ ID NO: 918366 - RNA, 21 nt, Mycobacterium avium subsp. paratuberculosis
ccugcgacuucuacggcgggc

SEQ ID NO: 918367 - RNA, 16 nt, Mycobacterium avium subsp. paratuberculosis
ccugcaggucgcggug

SEQ ID NO: 918368 - RNA, 23 nt, Mycobacterium avium subsp. paratuberculosis
ccugcagguucugcacgugguga

SEQ ID NO: 918369 - RNA, 15 nt, Mycobacterium avium subsp. paratuberculosis
ccugcaggcaggccg

SEQ ID NO: 918370 - RNA, 20 nt, Mycobacterium avium subsp. paratuberculosis
ccugcaggcaggccggcagc

SEQ ID NO: 918371 - RNA, 17 nt, Mycobacterium avium subsp. paratuberculosis
ccugcgcccacaggucc

SEQ ID NO: 918372 - RNA, 14 nt, Mycobacterium avium subsp. paratuberculosis
ccugcgccaggauc

SEQ ID NO: 918373 - RNA, 19 nt, Mycobacterium avium subsp. paratuberculosis
ccugcgccagcagcagcgc

SEQ ID NO: 918374 - RNA, 21 nt, Mycobacterium avium subsp. paratuberculosis
ccugcgccagcagcagcgcgg

SEQ ID NO: 918375 - RNA, 15 nt, Mycobacterium avium subsp. paratuberculosis
ccugcgccgcggugc

SEQ ID NO: 918376 - RNA, 20 nt, Mycobacterium avium subsp. paratuberculosis
ccugcgccgcggugcgccac

SEQ ID NO: 918377 - RNA, 23 nt, Mycobacterium avium subsp. paratuberculosis
ccugcgccuuggccucgguggcg

SEQ ID NO: 918378 - RNA, 20 nt, Mycobacterium avium subsp. paratuberculosis
ccugcgcgaaaggcccaccg

SEQ ID NO: 918379 - RNA, 21 nt, Mycobacterium avium subsp. paratuberculosis
ccugcgcgaaaggcccaccgc

SEQ ID NO: 918380 - RNA, 15 nt, Mycobacterium avium subsp. paratuberculosis
ccugcgcgaucgccg

SEQ ID NO: 918381 - RNA, 21 nt, Mycobacterium avium subsp. paratuberculosis
ccugcgcgaucgccggaucgg

SEQ ID NO: 918382 - RNA, 21 nt, Mycobacterium avium subsp. paratuberculosis
ccugagucugggucacgcuga

SEQ ID NO: 918383 - RNA, 19 nt, Mycobacterium avium subsp. paratuberculosis
ccugagggugucggcgauc

SEQ ID NO: 918384 - RNA, 17 nt, Mycobacterium avium subsp. paratuberculosis
ccugagcuuuucgucgg

SEQ ID NO: 918385 - RNA, 19 nt, Mycobacterium avium subsp. paratuberculosis
ccugagcuuuucgucggug

SEQ ID NO: 918386 - RNA, 20 nt, Mycobacterium avium subsp. paratuberculosis
ccugagcuuuucgucggugc

SEQ ID NO: 918387 - RNA, 13 nt, Mycobacterium avium subsp. paratuberculosis
ccugcaccaccac

SEQ ID NO: 918388 - RNA, 21 nt, Mycobacterium avium subsp. paratuberculosis
ccugcaccaccacacccagcg

SEQ ID NO: 918389 - RNA, 13 nt, Mycobacterium avium subsp. paratuberculosis
ccugcaccacgaa

SEQ ID NO: 918390 - RNA, 14 nt, Mycobacterium avium subsp. paratuberculosis
ccugcaccugcggc

SEQ ID NO: 918391 - RNA, 14 nt, Mycobacterium avium subsp. paratuberculosis
ccugcacccagguc

SEQ ID NO: 918392 - RNA, 13 nt, Mycobacterium avium subsp. paratuberculosis
ccugcagcuggcg

SEQ ID NO: 918393 - RNA, 22 nt, Mycobacterium avium subsp. paratuberculosis
ccugcagcuggcgaauccgggc

SEQ ID NO: 918394 - RNA, 20 nt, Mycobacterium avium subsp. paratuberculosis
ccugcacggugcgccggcag

SEQ ID NO: 918395 - RNA, 21 nt, Mycobacterium avium subsp. paratuberculosis
ccugcacggugcgccggcagc

SEQ ID NO: 918396 - RNA, 14 nt, Mycobacterium avium subsp. paratuberculosis
ccugcacgucggcg

SEQ ID NO: 918397 - RNA, 21 nt, Mycobacterium avium subsp. paratuberculosis
ccugcacgcugaagcacaccg

SEQ ID NO: 918398 - RNA, 14 nt, Mycobacterium avium subsp. paratuberculosis
ccugcaccggcgac

SEQ ID NO: 918399 - RNA, 15 nt, Mycobacterium avium subsp. paratuberculosis
ccugcaccggcgacg

SEQ ID NO: 918400 - RNA, 15 nt, Mycobacterium avium subsp. paratuberculosis
ccugcacgcuguccg

SEQ ID NO: 918401 - RNA, 17 nt, Mycobacterium avium subsp. paratuberculosis
ccugcacgaagucgacc

SEQ ID NO: 918402 - RNA, 21 nt, Mycobacterium avium subsp. paratuberculosis
ccugcacgaagucgaccgcgg

SEQ ID NO: 918403 - RNA, 22 nt, Mycobacterium avium subsp. paratuberculosis
ccugcacgaagucgaccgcggc

SEQ ID NO: 918404 - RNA, 18 nt, Mycobacterium avium subsp. paratuberculosis
ccugcacgaucucggcgg

SEQ ID NO: 918405 - RNA, 20 nt, Mycobacterium avium subsp. paratuberculosis
ccugcacgaucucggcgguc

SEQ ID NO: 918406 - RNA, 15 nt, Mycobacterium avium subsp. paratuberculosis
ccugacgcucggucg

SEQ ID NO: 918407 - RNA, 17 nt, Mycobacterium avium subsp. paratuberculosis
ccugacgcucggucgcc

SEQ ID NO: 918408 - RNA, 11 nt, Mycobacterium avium subsp. paratuberculosis
ccugaccgcgg

SEQ ID NO: 918409 - RNA, 15 nt, Mycobacterium avium subsp. paratuberculosis
ccugaccgcgggccc

SEQ ID NO: 918410 - RNA, 19 nt, Mycobacterium avium subsp. paratuberculosis
ccugaccgcgggcccgccg

SEQ ID NO: 918411 - RNA, 15 nt, Mycobacterium avium subsp. paratuberculosis
ccugaccgucggcca

SEQ ID NO: 918412 - RNA, 15 nt, Mycobacterium avium subsp. paratuberculosis
ccugacgcaccucgc

SEQ ID NO: 918413 - RNA, 15 nt, Mycobacterium avium subsp. paratuberculosis
ccugacgcaucacca

SEQ ID NO: 918414 - RNA, 18 nt, Mycobacterium avium subsp. paratuberculosis
ccugacgcaucaccacgc

SEQ ID NO: 918415 - RNA, 18 nt, Mycobacterium avium subsp. paratuberculosis
ccugagacgacgccacca

SEQ ID NO: 918416 - RNA, 22 nt, Mycobacterium avium subsp. paratuberculosis
ccugagagguuagguacgcggc

SEQ ID NO: 918417 - RNA, 12 nt, Mycobacterium avium subsp. paratuberculosis
ccugagccgccg

SEQ ID NO: 918418 - RNA, 17 nt, Mycobacterium avium subsp. paratuberculosis
ccugagccgccggggcg

SEQ ID NO: 918419 - RNA, 18 nt, Mycobacterium avium subsp. paratuberculosis
ccugagccgccggggcgc

SEQ ID NO: 918420 - RNA, 20 nt, Mycobacterium avium subsp. paratuberculosis
ccugacugagucaagccggc

SEQ ID NO: 918421 - RNA, 20 nt, Mycobacterium avium subsp. paratuberculosis
ccucguugaccgggucgccg

SEQ ID NO: 918422 - RNA, 17 nt, Mycobacterium avium subsp. paratuberculosis
ccucguuggccagcucg

SEQ ID NO: 918423 - RNA, 18 nt, Mycobacterium avium subsp. paratuberculosis
ccucguuggccagcucgg

SEQ ID NO: 918424 - RNA, 18 nt, Mycobacterium avium subsp. paratuberculosis
ccucgucgguccaggugg

SEQ ID NO: 918425 - RNA, 23 nt, Mycobacterium avium subsp. paratuberculosis
ccucgugcaugugcucggcgagg

SEQ ID NO: 918426 - RNA, 19 nt, Mycobacterium avium subsp. paratuberculosis
ccucguggaaaucgagcgc

SEQ ID NO: 918427 - RNA, 20 nt, Mycobacterium avium subsp. paratuberculosis
ccucgugguggacggucagc

SEQ ID NO: 918428 - RNA, 21 nt, Mycobacterium avium subsp. paratuberculosis
ccucgucgcuaccucaccacg

SEQ ID NO: 918429 - RNA, 13 nt, Mycobacterium avium subsp. paratuberculosis
ccucgucggcgaa

SEQ ID NO: 918430 - RNA, 13 nt, Mycobacterium avium subsp. paratuberculosis
ccucgucgccguc

SEQ ID NO: 918431 - RNA, 18 nt, Mycobacterium avium subsp. paratuberculosis
ccucgucgccgucggggu

SEQ ID NO: 918432 - RNA, 13 nt, Mycobacterium avium subsp. paratuberculosis
ccucgucggcgag

SEQ ID NO: 918433 - RNA, 23 nt, Mycobacterium avium subsp. paratuberculosis
ccucgucggcgagcagcagcgcg

SEQ ID NO: 918434 - RNA, 12 nt, Mycobacterium avium subsp. paratuberculosis
ccucgucggcgc

SEQ ID NO: 918435 - RNA, 16 nt, Mycobacterium avium subsp. paratuberculosis
ccucgucggcgccguc

SEQ ID NO: 918436 - RNA, 17 nt, Mycobacterium avium subsp. paratuberculosis
ccucgucggcggugccg

SEQ ID NO: 918437 - RNA, 13 nt, Mycobacterium avium subsp. paratuberculosis
ccucgucggcucc

SEQ ID NO: 918438 - RNA, 19 nt, Mycobacterium avium subsp. paratuberculosis
ccucgucgggaacgcgaac

SEQ ID NO: 918439 - RNA, 12 nt, Mycobacterium avium subsp. paratuberculosis
ccucgucgagcu

SEQ ID NO: 918440 - RNA, 11 nt, Mycobacterium avium subsp. paratuberculosis
ccucgucgaug

SEQ ID NO: 918441 - RNA, 14 nt, Mycobacterium avium subsp. paratuberculosis
ccucgucgaugacg

SEQ ID NO: 918442 - RNA, 15 nt, Mycobacterium avium subsp. paratuberculosis
ccucgucgccaucgu

SEQ ID NO: 918443 - RNA, 14 nt, Mycobacterium avium subsp. paratuberculosis
ccucgucgcccggc

SEQ ID NO: 918444 - RNA, 15 nt, Mycobacterium avium subsp. paratuberculosis
ccucgucgcccggcg

SEQ ID NO: 918445 - RNA, 15 nt, Mycobacterium avium subsp. paratuberculosis
ccucggacucgucgc

SEQ ID NO: 918446 - RNA, 17 nt, Mycobacterium avium subsp. paratuberculosis
ccucgcuggcgaucacc

SEQ ID NO: 918447 - RNA, 18 nt, Mycobacterium avium subsp. paratuberculosis
ccucgcuggcgaucaccu

SEQ ID NO: 918448 - RNA, 12 nt, Mycobacterium avium subsp. paratuberculosis
ccucgcuguccu

SEQ ID NO: 918449 - RNA, 20 nt, Mycobacterium avium subsp. paratuberculosis
ccucgcuguccugccgggcg

SEQ ID NO: 918450 - RNA, 13 nt, Mycobacterium avium subsp. paratuberculosis
ccucggaggccac

SEQ ID NO: 918451 - RNA, 22 nt, Mycobacterium avium subsp. paratuberculosis
ccucggaggccaccgcgccguc

SEQ ID NO: 918452 - RNA, 15 nt, Mycobacterium avium subsp. paratuberculosis
ccucggaggugccgc

SEQ ID NO: 918453 - RNA, 22 nt, Mycobacterium avium subsp. paratuberculosis
ccucggaggugccgcgcggcag

SEQ ID NO: 918454 - RNA, 24 nt, Mycobacterium avium subsp. paratuberculosis
ccucggacccgaugaucgagcacg

SEQ ID NO: 918455 - RNA, 18 nt, Mycobacterium avium subsp. paratuberculosis
ccucggcaccgugccgcg

SEQ ID NO: 918456 - RNA, 15 nt, Mycobacterium avium subsp. paratuberculosis
ccucgcugccggccg

SEQ ID NO: 918457 - RNA, 16 nt, Mycobacterium avium subsp. paratuberculosis
ccucgcugccggccgg

SEQ ID NO: 918458 - RNA, 17 nt, Mycobacterium avium subsp. paratuberculosis
ccucgacggugcugccg

SEQ ID NO: 918459 - RNA, 23 nt, Mycobacterium avium subsp. paratuberculosis
ccucgacggugcugccguugggc

SEQ ID NO: 918460 - RNA, 15 nt, Mycobacterium avium subsp. paratuberculosis
ccucgacggcguggu

SEQ ID NO: 918461 - RNA, 13 nt, Mycobacterium avium subsp. paratuberculosis
ccucgcugaccuc

SEQ ID NO: 918462 - RNA, 14 nt, Mycobacterium avium subsp. paratuberculosis
ccucgcugaccucg

SEQ ID NO: 918463 - RNA, 19 nt, Mycobacterium avium subsp. paratuberculosis
ccucgcugaccucgacacg

SEQ ID NO: 918464 - RNA, 14 nt, Mycobacterium avium subsp. paratuberculosis
ccucgcugacgucg

SEQ ID NO: 918465 - RNA, 14 nt, Mycobacterium avium subsp. paratuberculosis
ccucgacggugacc

SEQ ID NO: 918466 - RNA, 18 nt, Mycobacterium avium subsp. paratuberculosis
ccucgacggugaccucgu

SEQ ID NO: 918467 - RNA, 12 nt, Mycobacterium avium subsp. paratuberculosis
ccucgacggcga

SEQ ID NO: 918468 - RNA, 16 nt, Mycobacterium avium subsp. paratuberculosis
ccucgacgccgcgcac

SEQ ID NO: 918469 - RNA, 20 nt, Mycobacterium avium subsp. paratuberculosis
ccucgaagucgccggccucc

SEQ ID NO: 918470 - RNA, 17 nt, Mycobacterium avium subsp. paratuberculosis
ccucgaagccgaucgcg

SEQ ID NO: 918471 - RNA, 12 nt, Mycobacterium avium subsp. paratuberculosis
ccucgaacuuga

SEQ ID NO: 918472 - RNA, 15 nt, Mycobacterium avium subsp. paratuberculosis
ccucgaagaacgcgu

SEQ ID NO: 918473 - RNA, 18 nt, Mycobacterium avium subsp. paratuberculosis
ccucgaagaagagggcgu

SEQ ID NO: 918474 - RNA, 19 nt, Mycobacterium avium subsp. paratuberculosis
ccucgaagauggucgcgcc

SEQ ID NO: 918475 - RNA, 13 nt, Mycobacterium avium subsp. paratuberculosis
ccucgaccagccg

SEQ ID NO: 918476 - RNA, 18 nt, Mycobacterium avium subsp. paratuberculosis
ccucgaccaccucuucgc

SEQ ID NO: 918477 - RNA, 21 nt, Mycobacterium avium subsp. paratuberculosis
ccucgaccaccucuucgcggu

SEQ ID NO: 918478 - RNA, 22 nt, Mycobacterium avium subsp. paratuberculosis
ccucgaccaccucuucgcgguc

SEQ ID NO: 918479 - RNA, 15 nt, Mycobacterium avium subsp. paratuberculosis
ccucgaccacgcaca

SEQ ID NO: 918480 - RNA, 17 nt, Mycobacterium avium subsp. paratuberculosis
ccucgaccacgcacacc

SEQ ID NO: 918481 - RNA, 17 nt, Mycobacterium avium subsp. paratuberculosis
ccucgaccagcaccgca

SEQ ID NO: 918482 - RNA, 16 nt, Mycobacterium avium subsp. paratuberculosis
ccucgacccgaagcca

SEQ ID NO: 918483 - RNA, 17 nt, Mycobacterium avium subsp. paratuberculosis
ccucgacccguuccggc

SEQ ID NO: 918484 - RNA, 20 nt, Mycobacterium avium subsp. paratuberculosis
ccucgacccguuccggcgag

SEQ ID NO: 918485 - RNA, 19 nt, Mycobacterium avium subsp. paratuberculosis
ccucgaccagcgcgccgcc

SEQ ID NO: 918486 - RNA, 18 nt, Mycobacterium avium subsp. paratuberculosis
ccucgacgaacgcggcgg

SEQ ID NO: 918487 - RNA, 19 nt, Mycobacterium avium subsp. paratuberculosis
ccucgacgaacgcggcgga

SEQ ID NO: 918488 - RNA, 16 nt, Mycobacterium avium subsp. paratuberculosis
ccucgaccucuucggc

SEQ ID NO: 918489 - RNA, 19 nt, Mycobacterium avium subsp. paratuberculosis
ccucgaccucuucggcgcc

SEQ ID NO: 918490 - RNA, 20 nt, Mycobacterium avium subsp. paratuberculosis
ccucgaccucuucggcgccg

SEQ ID NO: 918491 - RNA, 14 nt, Mycobacterium avium subsp. paratuberculosis
ccucgucgagcagc

SEQ ID NO: 918492 - RNA, 12 nt, Mycobacterium avium subsp. paratuberculosis
ccucgucgagcc

SEQ ID NO: 918493 - RNA, 15 nt, Mycobacterium avium subsp. paratuberculosis
ccucgucgagccggg

SEQ ID NO: 918494 - RNA, 14 nt, Mycobacterium avium subsp. paratuberculosis
ccucgucgaccgcg

SEQ ID NO: 918495 - RNA, 15 nt, Mycobacterium avium subsp. paratuberculosis
ccucgucgaccgcgg

SEQ ID NO: 918496 - RNA, 18 nt, Mycobacterium avium subsp. paratuberculosis
ccucgucgaccgcggccu

SEQ ID NO: 918497 - RNA, 19 nt, Mycobacterium avium subsp. paratuberculosis
ccucgucgaccgcggccug

SEQ ID NO: 918498 - RNA, 20 nt, Mycobacterium avium subsp. paratuberculosis
ccucgucgaccgcggccugg

SEQ ID NO: 918499 - RNA, 15 nt, Mycobacterium avium subsp. paratuberculosis
ccucgucgacggcgg

SEQ ID NO: 918500 - RNA, 16 nt, Mycobacterium avium subsp. paratuberculosis
ccucguccgacagcgc

SEQ ID NO: 918501 - RNA, 14 nt, Mycobacterium avium subsp. paratuberculosis
ccucgucaccgugg

SEQ ID NO: 918502 - RNA, 16 nt, Mycobacterium avium subsp. paratuberculosis
ccucggggcucaccac

SEQ ID NO: 918503 - RNA, 19 nt, Mycobacterium avium subsp. paratuberculosis
ccucggggcugcgcggcuu

SEQ ID NO: 918504 - RNA, 24 nt, Mycobacterium avium subsp. paratuberculosis
ccucgggggugaaggcggccaccg

SEQ ID NO: 918505 - RNA, 19 nt, Mycobacterium avium subsp. paratuberculosis
ccucgggguagccggcccg

SEQ ID NO: 918506 - RNA, 16 nt, Mycobacterium avium subsp. paratuberculosis
ccucggggucggccgg

SEQ ID NO: 918507 - RNA, 11 nt, Mycobacterium avium subsp. paratuberculosis
ccucgggcacg

SEQ ID NO: 918508 - RNA, 15 nt, Mycobacterium avium subsp. paratuberculosis
ccucggggaucgcca

SEQ ID NO: 918509 - RNA, 16 nt, Mycobacterium avium subsp. paratuberculosis
ccucggggaucgccag

SEQ ID NO: 918510 - RNA, 23 nt, Mycobacterium avium subsp. paratuberculosis
ccucggggaugugcugcagguug

SEQ ID NO: 918511 - RNA, 18 nt, Mycobacterium avium subsp. paratuberculosis
ccucgggcauuggcagcu

SEQ ID NO: 918512 - RNA, 18 nt, Mycobacterium avium subsp. paratuberculosis
ccucgggccggcagccgg

SEQ ID NO: 918513 - RNA, 14 nt, Mycobacterium avium subsp. paratuberculosis
ccucgggccgggcg

SEQ ID NO: 918514 - RNA, 15 nt, Mycobacterium avium subsp. paratuberculosis
ccucgggccgggcgg

SEQ ID NO: 918515 - RNA, 20 nt, Mycobacterium avium subsp. paratuberculosis
ccucgggauagccgagcggc

SEQ ID NO: 918516 - RNA, 17 nt, Mycobacterium avium subsp. paratuberculosis
ccucggcgggccgcccg

SEQ ID NO: 918517 - RNA, 23 nt, Mycobacterium avium subsp. paratuberculosis
ccucggcgggccgcccggcgcgc

SEQ ID NO: 918518 - RNA, 19 nt, Mycobacterium avium subsp. paratuberculosis
ccucggccguaccggcgua

SEQ ID NO: 918519 - RNA, 16 nt, Mycobacterium avium subsp. paratuberculosis
ccucggcgucaccgcg

SEQ ID NO: 918520 - RNA, 19 nt, Mycobacterium avium subsp. paratuberculosis
ccucggcguccgcggcgga

SEQ ID NO: 918521 - RNA, 17 nt, Mycobacterium avium subsp. paratuberculosis
ccucggcgucggcgcgu

SEQ ID NO: 918522 - RNA, 18 nt, Mycobacterium avium subsp. paratuberculosis
ccucggcguggcaggcga

SEQ ID NO: 918523 - RNA, 22 nt, Mycobacterium avium subsp. paratuberculosis
ccucggcguguuccuugcggcc

SEQ ID NO: 918524 - RNA, 17 nt, Mycobacterium avium subsp. paratuberculosis
ccucggccuugaccacg

SEQ ID NO: 918525 - RNA, 17 nt, Mycobacterium avium subsp. paratuberculosis
ccucggccugcgcccgg

SEQ ID NO: 918526 - RNA, 15 nt, Mycobacterium avium subsp. paratuberculosis
ccucggccgccaccg

SEQ ID NO: 918527 - RNA, 21 nt, Mycobacterium avium subsp. paratuberculosis
ccucggccgccaccgccaucu

SEQ ID NO: 918528 - RNA, 14 nt, Mycobacterium avium subsp. paratuberculosis
ccucggccagcacc

SEQ ID NO: 918529 - RNA, 15 nt, Mycobacterium avium subsp. paratuberculosis
ccucggccagcacca

SEQ ID NO: 918530 - RNA, 20 nt, Mycobacterium avium subsp. paratuberculosis
ccucggccagcaccagcagc

SEQ ID NO: 918531 - RNA, 13 nt, Mycobacterium avium subsp. paratuberculosis
ccucggccagcca

SEQ ID NO: 918532 - RNA, 15 nt, Mycobacterium avium subsp. paratuberculosis
ccucggccagcgccg

SEQ ID NO: 918533 - RNA, 18 nt, Mycobacterium avium subsp. paratuberculosis
ccucggccagcguguugc

SEQ ID NO: 918534 - RNA, 20 nt, Mycobacterium avium subsp. paratuberculosis
ccucggccagcucaccggcc

SEQ ID NO: 918535 - RNA, 14 nt, Mycobacterium avium subsp. paratuberculosis
ccucggccagcgcc

SEQ ID NO: 918536 - RNA, 23 nt, Mycobacterium avium subsp. paratuberculosis
ccucggccagguacugaucaccg

SEQ ID NO: 918537 - RNA, 17 nt, Mycobacterium avium subsp. paratuberculosis
ccggcuuaccgaccucg

SEQ ID NO: 918538 - RNA, 18 nt, Mycobacterium avium subsp. paratuberculosis
ccggcuuaccgaccucga

SEQ ID NO: 918539 - RNA, 14 nt, Mycobacterium avium subsp. paratuberculosis
ccggcuggucggcg

SEQ ID NO: 918540 - RNA, 15 nt, Mycobacterium avium subsp. paratuberculosis
ccggcuggucggcgg

SEQ ID NO: 918541 - RNA, 15 nt, Mycobacterium avium subsp. paratuberculosis
ccggcuggugcagca

SEQ ID NO: 918542 - RNA, 17 nt, Mycobacterium avium subsp. paratuberculosis
ccggcuggugcagcagc

SEQ ID NO: 918543 - RNA, 14 nt, Mycobacterium avium subsp. paratuberculosis
ccggcugggcgcgc

SEQ ID NO: 918544 - RNA, 21 nt, Mycobacterium avium subsp. paratuberculosis
ccggcugaaccugcugggcgg

SEQ ID NO: 918545 - RNA, 14 nt, Mycobacterium avium subsp. paratuberculosis
ccggcugaacgcca

SEQ ID NO: 918546 - RNA, 20 nt, Mycobacterium avium subsp. paratuberculosis
ccggcugaacgccagcagcc

SEQ ID NO: 918547 - RNA, 21 nt, Mycobacterium avium subsp. paratuberculosis
ccggcugaacgccagcagccg

SEQ ID NO: 918548 - RNA, 18 nt, Mycobacterium avium subsp. paratuberculosis
ccggcugacugccggcga

SEQ ID NO: 918549 - RNA, 16 nt, Mycobacterium avium subsp. paratuberculosis
ccggcugaccggcggu

SEQ ID NO: 918550 - RNA, 14 nt, Mycobacterium avium subsp. paratuberculosis
ccggcuggccgagc

SEQ ID NO: 918551 - RNA, 15 nt, Mycobacterium avium subsp. paratuberculosis
ccggcuggccgagcg

SEQ ID NO: 918552 - RNA, 17 nt, Mycobacterium avium subsp. paratuberculosis
ccggcuggccgagcggc

SEQ ID NO: 918553 - RNA, 14 nt, Mycobacterium avium subsp. paratuberculosis
ccggcuggccgcac

SEQ ID NO: 918554 - RNA, 22 nt, Mycobacterium avium subsp. paratuberculosis
ccggcuggccggaaaggcguga

SEQ ID NO: 918555 - RNA, 15 nt, Mycobacterium avium subsp. paratuberculosis
ccgggaaggcggccg

SEQ ID NO: 918556 - RNA, 16 nt, Mycobacterium avium subsp. paratuberculosis
ccgggaaggcggccgc

SEQ ID NO: 918557 - RNA, 15 nt, Mycobacterium avium subsp. paratuberculosis
ccgggaagccgagcu

SEQ ID NO: 918558 - RNA, 23 nt, Mycobacterium avium subsp. paratuberculosis
ccgggaaccagcccaggucggga

SEQ ID NO: 918559 - RNA, 17 nt, Mycobacterium avium subsp. paratuberculosis
ccgggaacgacggugcg

SEQ ID NO: 918560 - RNA, 23 nt, Mycobacterium avium subsp. paratuberculosis
ccgggaacgacggugcgcccguc

SEQ ID NO: 918561 - RNA, 14 nt, Mycobacterium avium subsp. paratuberculosis
ccgggaacgcggcg

SEQ ID NO: 918562 - RNA, 16 nt, Mycobacterium avium subsp. paratuberculosis
ccgggaagcugguggu

SEQ ID NO: 918563 - RNA, 18 nt, Mycobacterium avium subsp. paratuberculosis
ccgggaaugucgcgcagc

SEQ ID NO: 918564 - RNA, 21 nt, Mycobacterium avium subsp. paratuberculosis
ccgggauauucgcccagcggc

SEQ ID NO: 918565 - RNA, 19 nt, Mycobacterium avium subsp. paratuberculosis
ccgggaucacacgcgcgcc

SEQ ID NO: 918566 - RNA, 18 nt, Mycobacterium avium subsp. paratuberculosis
ccgggauccggcgcgccg

SEQ ID NO: 918567 - RNA, 13 nt, Mycobacterium avium subsp. paratuberculosis
ccgggaucggcag

SEQ ID NO: 918568 - RNA, 15 nt, Mycobacterium avium subsp. paratuberculosis
ccgggaucggcagcg

SEQ ID NO: 918569 - RNA, 14 nt, Mycobacterium avium subsp. paratuberculosis
ccgggaucggcggc

SEQ ID NO: 918570 - RNA, 14 nt, Mycobacterium avium subsp. paratuberculosis
ccgggacagguagc

SEQ ID NO: 918571 - RNA, 18 nt, Mycobacterium avium subsp. paratuberculosis
ccgggacaucgucgcgcc

SEQ ID NO: 918572 - RNA, 18 nt, Mycobacterium avium subsp. paratuberculosis
ccgggacaccgcuggccg

SEQ ID NO: 918573 - RNA, 19 nt, Mycobacterium avium subsp. paratuberculosis
ccgggacagcccgaacagc

SEQ ID NO: 918574 - RNA, 23 nt, Mycobacterium avium subsp. paratuberculosis
ccgggacagcccgaacagcuugc

SEQ ID NO: 918575 - RNA, 17 nt, Mycobacterium avium subsp. paratuberculosis
ccgggacagccgcgccg

SEQ ID NO: 918576 - RNA, 15 nt, Mycobacterium avium subsp. paratuberculosis
ccgggaccagcgcgg

SEQ ID NO: 918577 - RNA, 13 nt, Mycobacterium avium subsp. paratuberculosis
ccgggauaccgcg

SEQ ID NO: 918578 - RNA, 18 nt, Mycobacterium avium subsp. paratuberculosis
ccgggauaccgcgaccgc

SEQ ID NO: 918579 - RNA, 16 nt, Mycobacterium avium subsp. paratuberculosis
ccgggauaguucgccg

SEQ ID NO: 918580 - RNA, 19 nt, Mycobacterium avium subsp. paratuberculosis
ccgggauaguucgccgccg

SEQ ID NO: 918581 - RNA, 23 nt, Mycobacterium avium subsp. paratuberculosis
ccgggauaguucgccgccgccag

SEQ ID NO: 918582 - RNA, 18 nt, Mycobacterium avium subsp. paratuberculosis
ccggcuccauguccggag

SEQ ID NO: 918583 - RNA, 13 nt, Mycobacterium avium subsp. paratuberculosis
ccggcuccccgac

SEQ ID NO: 918584 - RNA, 16 nt, Mycobacterium avium subsp. paratuberculosis
ccggcuccccgaccac

SEQ ID NO: 918585 - RNA, 16 nt, Mycobacterium avium subsp. paratuberculosis
ccggcuccaccgcgcc

SEQ ID NO: 918586 - RNA, 17 nt, Mycobacterium avium subsp. paratuberculosis
ccggcuccaccgcgccg

SEQ ID NO: 918587 - RNA, 20 nt, Mycobacterium avium subsp. paratuberculosis
ccggcuccaccgcgccggcg

SEQ ID NO: 918588 - RNA, 20 nt, Mycobacterium avium subsp. paratuberculosis
ccggcucagggugcgcuggc

SEQ ID NO: 918589 - RNA, 23 nt, Mycobacterium avium subsp. paratuberculosis
ccggcucagggugcgcuggccga

SEQ ID NO: 918590 - RNA, 17 nt, Mycobacterium avium subsp. paratuberculosis
ccggcgucuugaucucg

SEQ ID NO: 918591 - RNA, 22 nt, Mycobacterium avium subsp. paratuberculosis
ccggcucaaugccuuugccgug

SEQ ID NO: 918592 - RNA, 16 nt, Mycobacterium avium subsp. paratuberculosis
ccggcucagcccggcg

SEQ ID NO: 918593 - RNA, 23 nt, Mycobacterium avium subsp. paratuberculosis
ccggcucagcgcgacgugccggc

SEQ ID NO: 918594 - RNA, 24 nt, Mycobacterium avium subsp. paratuberculosis
ccggcucagcgcgacgugccggcg

SEQ ID NO: 918595 - RNA, 23 nt, Mycobacterium avium subsp. paratuberculosis
ccggcucagcggcaacugcagga

SEQ ID NO: 918596 - RNA, 19 nt, Mycobacterium avium subsp. paratuberculosis
ccggcucggcggcucagca

SEQ ID NO: 918597 - RNA, 21 nt, Mycobacterium avium subsp. paratuberculosis
ccggcucgggaacggucagcc

SEQ ID NO: 918598 - RNA, 20 nt, Mycobacterium avium subsp. paratuberculosis
ccggcucgguaugcggcgac

SEQ ID NO: 918599 - RNA, 14 nt, Mycobacterium avium subsp. paratuberculosis
ccggcucggugccg

SEQ ID NO: 918600 - RNA, 15 nt, Mycobacterium avium subsp. paratuberculosis
ccggcucggugccgc

SEQ ID NO: 918601 - RNA, 13 nt, Mycobacterium avium subsp. paratuberculosis
ccggcucggugcg

SEQ ID NO: 918602 - RNA, 14 nt, Mycobacterium avium subsp. paratuberculosis
ccggcucucagccg

SEQ ID NO: 918603 - RNA, 17 nt, Mycobacterium avium subsp. paratuberculosis
ccggcucuccaucuucg

SEQ ID NO: 918604 - RNA, 17 nt, Mycobacterium avium subsp. paratuberculosis
ccggcucugccugcagg

SEQ ID NO: 918605 - RNA, 18 nt, Mycobacterium avium subsp. paratuberculosis
ccggcucugccugcagga

SEQ ID NO: 918606 - RNA, 15 nt, Mycobacterium avium subsp. paratuberculosis
ccggcucuuggcgac

SEQ ID NO: 918607 - RNA, 19 nt, Mycobacterium avium subsp. paratuberculosis
ccggcucuuggcgaccucg

SEQ ID NO: 918608 - RNA, 13 nt, Mycobacterium avium subsp. paratuberculosis
ccggcgugagcga

SEQ ID NO: 918609 - RNA, 16 nt, Mycobacterium avium subsp. paratuberculosis
ccggcgugagcgagcc

SEQ ID NO: 918610 - RNA, 19 nt, Mycobacterium avium subsp. paratuberculosis
ccggcgugagcgagccggc

SEQ ID NO: 918611 - RNA, 23 nt, Mycobacterium avium subsp. paratuberculosis
ccggcgugagcgagccggcacgc

SEQ ID NO: 918612 - RNA, 15 nt, Mycobacterium avium subsp. paratuberculosis
ccggcgucucggcgu

SEQ ID NO: 918613 - RNA, 18 nt, Mycobacterium avium subsp. paratuberculosis
ccggcgucugcauccgga

SEQ ID NO: 918614 - RNA, 20 nt, Mycobacterium avium subsp. paratuberculosis
ccggcgucugcauccggaac

SEQ ID NO: 918615 - RNA, 23 nt, Mycobacterium avium subsp. paratuberculosis
ccggcgucugcauccggaaccgg

SEQ ID NO: 918616 - RNA, 19 nt, Mycobacterium avium subsp. paratuberculosis
ccggcgucauggugcgcgg

SEQ ID NO: 918617 - RNA, 20 nt, Mycobacterium avium subsp. paratuberculosis
ccggcguccaccggucgacg

SEQ ID NO: 918618 - RNA, 14 nt, Mycobacterium avium subsp. paratuberculosis
ccggcguccacgcc

SEQ ID NO: 918619 - RNA, 16 nt, Mycobacterium avium subsp. paratuberculosis
ccggcguccacgccgu

SEQ ID NO: 918620 - RNA, 21 nt, Mycobacterium avium subsp. paratuberculosis
ccggcgucacauacgccucac

SEQ ID NO: 918621 - RNA, 19 nt, Mycobacterium avium subsp. paratuberculosis
ccggcgucacucuggcgug

SEQ ID NO: 918622 - RNA, 20 nt, Mycobacterium avium subsp. paratuberculosis
ccggcgucacucuggcguga

SEQ ID NO: 918623 - RNA, 15 nt, Mycobacterium avium subsp. paratuberculosis
ccggcguccagcgcc

SEQ ID NO: 918624 - RNA, 19 nt, Mycobacterium avium subsp. paratuberculosis
ccggcgucggugucccgcg

SEQ ID NO: 918625 - RNA, 21 nt, Mycobacterium avium subsp. paratuberculosis
ccggcgucggugucccgcgcc

SEQ ID NO: 918626 - RNA, 15 nt, Mycobacterium avium subsp. paratuberculosis
ccggcgucgucgagc

SEQ ID NO: 918627 - RNA, 19 nt, Mycobacterium avium subsp. paratuberculosis
ccggcgucgucgagcaccg

SEQ ID NO: 918628 - RNA, 21 nt, Mycobacterium avium subsp. paratuberculosis
ccggcgucgucgagcaccggc

SEQ ID NO: 918629 - RNA, 16 nt, Mycobacterium avium subsp. paratuberculosis
ccggcgucgucgucgc

SEQ ID NO: 918630 - RNA, 16 nt, Mycobacterium avium subsp. paratuberculosis
ccggcgucucagucgg

SEQ ID NO: 918631 - RNA, 20 nt, Mycobacterium avium subsp. paratuberculosis
ccggcgucucagucggccac

SEQ ID NO: 918632 - RNA, 16 nt, Mycobacterium avium subsp. paratuberculosis
ccgggcaugcccguag

SEQ ID NO: 918633 - RNA, 20 nt, Mycobacterium avium subsp. paratuberculosis
ccgggcaugccguucagcgc

SEQ ID NO: 918634 - RNA, 21 nt, Mycobacterium avium subsp. paratuberculosis
ccgggcaugccguucagcgcg

SEQ ID NO: 918635 - RNA, 19 nt, Mycobacterium avium subsp. paratuberculosis
ccgggcaucccgccgaacc

SEQ ID NO: 918636 - RNA, 18 nt, Mycobacterium avium subsp. paratuberculosis
ccgggcauccgcccguag

SEQ ID NO: 918637 - RNA, 16 nt, Mycobacterium avium subsp. paratuberculosis
ccgggcauccgggccg

SEQ ID NO: 918638 - RNA, 16 nt, Mycobacterium avium subsp. paratuberculosis
ccgggcaggccgggau

SEQ ID NO: 918639 - RNA, 17 nt, Mycobacterium avium subsp. paratuberculosis
ccgggcagugcgcggcg

SEQ ID NO: 918640 - RNA, 20 nt, Mycobacterium avium subsp. paratuberculosis
ccgggcagcuuccgccucgg

SEQ ID NO: 918641 - RNA, 22 nt, Mycobacterium avium subsp. paratuberculosis
ccgggcagcuuccgccucggcg

SEQ ID NO: 918642 - RNA, 17 nt, Mycobacterium avium subsp. paratuberculosis
ccgggcaggcacggugu

SEQ ID NO: 918643 - RNA, 14 nt, Mycobacterium avium subsp. paratuberculosis
ccgggcagcgcgcg

SEQ ID NO: 918644 - RNA, 23 nt, Mycobacterium avium subsp. paratuberculosis
ccgggcagcgcgcgagacaccuc

SEQ ID NO: 918645 - RNA, 13 nt, Mycobacterium avium subsp. paratuberculosis
ccgggcagcggcc

SEQ ID NO: 918646 - RNA, 19 nt, Mycobacterium avium subsp. paratuberculosis
ccgggcagcggccccacgu

SEQ ID NO: 918647 - RNA, 13 nt, Mycobacterium avium subsp. paratuberculosis
ccgggccaggcgc

SEQ ID NO: 918648 - RNA, 20 nt, Mycobacterium avium subsp. paratuberculosis
ccgggccaggcgcgcguagc

SEQ ID NO: 918649 - RNA, 22 nt, Mycobacterium avium subsp. paratuberculosis
ccgggccaggucccaggcgugg

SEQ ID NO: 918650 - RNA, 22 nt, Mycobacterium avium subsp. paratuberculosis
ccgggccaggucgaagcgcagc

SEQ ID NO: 918651 - RNA, 23 nt, Mycobacterium avium subsp. paratuberculosis
ccgggccaggugugcccgcccuu

SEQ ID NO: 918652 - RNA, 14 nt, Mycobacterium avium subsp. paratuberculosis
ccgggccagguucg

SEQ ID NO: 918653 - RNA, 14 nt, Mycobacterium avium subsp. paratuberculosis
ccgggccacgccga

SEQ ID NO: 918654 - RNA, 19 nt, Mycobacterium avium subsp. paratuberculosis
ccgggcauuucggcuucca

SEQ ID NO: 918655 - RNA, 16 nt, Mycobacterium avium subsp. paratuberculosis
ccgggccaccaccacg

SEQ ID NO: 918656 - RNA, 22 nt, Mycobacterium avium subsp. paratuberculosis
ccgggccaccaccacggccgcc

SEQ ID NO: 918657 - RNA, 23 nt, Mycobacterium avium subsp. paratuberculosis
ccgggccaccaccacggccgccg

SEQ ID NO: 918658 - RNA, 19 nt, Mycobacterium avium subsp. paratuberculosis
ccgggccagcaacagcagc

SEQ ID NO: 918659 - RNA, 22 nt, Mycobacterium avium subsp. paratuberculosis
ccgggccagcaacagcagcggc

SEQ ID NO: 918660 - RNA, 13 nt, Mycobacterium avium subsp. paratuberculosis
ccgggccagcagc

SEQ ID NO: 918661 - RNA, 17 nt, Mycobacterium avium subsp. paratuberculosis
ccgggccagcagcuuga

SEQ ID NO: 918662 - RNA, 22 nt, Mycobacterium avium subsp. paratuberculosis
ccgggccagcaggaucuggugc

SEQ ID NO: 918663 - RNA, 15 nt, Mycobacterium avium subsp. paratuberculosis
ccgggccaggaccgg

SEQ ID NO: 918664 - RNA, 16 nt, Mycobacterium avium subsp. paratuberculosis
ccgggccaggaccgga

SEQ ID NO: 918665 - RNA, 23 nt, Mycobacterium avium subsp. paratuberculosis
ccgggccaggaccggauccacca

SEQ ID NO: 918666 - RNA, 13 nt, Mycobacterium avium subsp. paratuberculosis
ccgggccaggaug

SEQ ID NO: 918667 - RNA, 17 nt, Mycobacterium avium subsp. paratuberculosis
ccgggccaggaugaccg

SEQ ID NO: 918668 - RNA, 19 nt, Mycobacterium avium subsp. paratuberculosis
ccgggccaggaugaccgcc

SEQ ID NO: 918669 - RNA, 15 nt, Mycobacterium avium subsp. paratuberculosis
ccgggcagcccgccg

SEQ ID NO: 918670 - RNA, 16 nt, Mycobacterium avium subsp. paratuberculosis
ccgggcagcccgccgc

SEQ ID NO: 918671 - RNA, 13 nt, Mycobacterium avium subsp. paratuberculosis
ccgggcagccgca

SEQ ID NO: 918672 - RNA, 20 nt, Mycobacterium avium subsp. paratuberculosis
ccgggcagccgcacaccgcg

SEQ ID NO: 918673 - RNA, 23 nt, Mycobacterium avium subsp. paratuberculosis
ccgggcagccgcacaccgcggcg

SEQ ID NO: 918674 - RNA, 12 nt, Mycobacterium avium subsp. paratuberculosis
ccgggcacgcag

SEQ ID NO: 918675 - RNA, 20 nt, Mycobacterium avium subsp. paratuberculosis
ccgggcacgcagcggcguca

SEQ ID NO: 918676 - RNA, 22 nt, Mycobacterium avium subsp. paratuberculosis
ccgggcacgcgagacgagccgc

SEQ ID NO: 918677 - RNA, 18 nt, Mycobacterium avium subsp. paratuberculosis
ccgggaugccugcccgcg

SEQ ID NO: 918678 - RNA, 18 nt, Mycobacterium avium subsp. paratuberculosis
ccgggcaccaccaccgac

SEQ ID NO: 918679 - RNA, 21 nt, Mycobacterium avium subsp. paratuberculosis
ccgggcaccaccaccgacacc

SEQ ID NO: 918680 - RNA, 16 nt, Mycobacterium avium subsp. paratuberculosis
ccgggcaccagcgcga

SEQ ID NO: 918681 - RNA, 18 nt, Mycobacterium avium subsp. paratuberculosis
ccgggcaccagcgcgacg

SEQ ID NO: 918682 - RNA, 16 nt, Mycobacterium avium subsp. paratuberculosis
ccgggcacccggcgcg

SEQ ID NO: 918683 - RNA, 20 nt, Mycobacterium avium subsp. paratuberculosis
ccgggcacccggcgcggccg

SEQ ID NO: 918684 - RNA, 21 nt, Mycobacterium avium subsp. paratuberculosis
ccgggcaccgcgcccgccccg

SEQ ID NO: 918685 - RNA, 15 nt, Mycobacterium avium subsp. paratuberculosis
ccgggcaccucggcg

SEQ ID NO: 918686 - RNA, 17 nt, Mycobacterium avium subsp. paratuberculosis
ccgggcacgacggucag

SEQ ID NO: 918687 - RNA, 18 nt, Mycobacterium avium subsp. paratuberculosis
ccgggcacgacggucagc

SEQ ID NO: 918688 - RNA, 13 nt, Mycobacterium avium subsp. paratuberculosis
ccgggaucgugug

SEQ ID NO: 918689 - RNA, 18 nt, Mycobacterium avium subsp. paratuberculosis
ccgggaucguguggccgc

SEQ ID NO: 918690 - RNA, 21 nt, Mycobacterium avium subsp. paratuberculosis
ccgggaucggggugccgccgg

SEQ ID NO: 918691 - RNA, 16 nt, Mycobacterium avium subsp. paratuberculosis
ccgggaucuggccggu

SEQ ID NO: 918692 - RNA, 21 nt, Mycobacterium avium subsp. paratuberculosis
ccgggaugacaccgcggacca

SEQ ID NO: 918693 - RNA, 14 nt, Mycobacterium avium subsp. paratuberculosis
ccgggaugccgccg

SEQ ID NO: 918694 - RNA, 19 nt, Mycobacterium avium subsp. paratuberculosis
ccgggaugccgccggucac

SEQ ID NO: 918695 - RNA, 20 nt, Mycobacterium avium subsp. paratuberculosis
ccgggaugccgccggucacg

SEQ ID NO: 918696 - RNA, 16 nt, Mycobacterium avium subsp. paratuberculosis
ccgggcgugcccggcg

SEQ ID NO: 918697 - RNA, 18 nt, Mycobacterium avium subsp. paratuberculosis
ccgggcgugccggacacc

SEQ ID NO: 918698 - RNA, 15 nt, Mycobacterium avium subsp. paratuberculosis
ccgggcggcaggugg

SEQ ID NO: 918699 - RNA, 16 nt, Mycobacterium avium subsp. paratuberculosis
ccgggcggcaucgcgc

SEQ ID NO: 918700 - RNA, 18 nt, Mycobacterium avium subsp. paratuberculosis
ccgggcggcaucgcgcgc

SEQ ID NO: 918701 - RNA, 19 nt, Mycobacterium avium subsp. paratuberculosis
ccgggcggcaucgcgcgcg

SEQ ID NO: 918702 - RNA, 16 nt, Mycobacterium avium subsp. paratuberculosis
ccgggcgucacgccag

SEQ ID NO: 918703 - RNA, 21 nt, Mycobacterium avium subsp. paratuberculosis
ccgggcgucacgccagcguga

SEQ ID NO: 918704 - RNA, 16 nt, Mycobacterium avium subsp. paratuberculosis
ccgggcgucacucugg

SEQ ID NO: 918705 - RNA, 20 nt, Mycobacterium avium subsp. paratuberculosis
ccgggcgucacucuggcgug

SEQ ID NO: 918706 - RNA, 19 nt, Mycobacterium avium subsp. paratuberculosis
ccgggcggcaccgcugccg

SEQ ID NO: 918707 - RNA, 13 nt, Mycobacterium avium subsp. paratuberculosis
ccgggcggcagca

SEQ ID NO: 918708 - RNA, 18 nt, Mycobacterium avium subsp. paratuberculosis
ccgggcggcagcagcugc

SEQ ID NO: 918709 - RNA, 13 nt, Mycobacterium avium subsp. paratuberculosis
ccgggcggccagc

SEQ ID NO: 918710 - RNA, 17 nt, Mycobacterium avium subsp. paratuberculosis
ccgggcggccagccgcg

SEQ ID NO: 918711 - RNA, 18 nt, Mycobacterium avium subsp. paratuberculosis
ccgggcggccagccgcgc

SEQ ID NO: 918712 - RNA, 18 nt, Mycobacterium avium subsp. paratuberculosis
ccgggcggcccgccucgg

SEQ ID NO: 918713 - RNA, 20 nt, Mycobacterium avium subsp. paratuberculosis
ccgggcggcccgccucggcg

SEQ ID NO: 918714 - RNA, 14 nt, Mycobacterium avium subsp. paratuberculosis
ccgggcggccgggc

SEQ ID NO: 918715 - RNA, 18 nt, Mycobacterium avium subsp. paratuberculosis
ccgggcggccgggccgga

SEQ ID NO: 918716 - RNA, 16 nt, Mycobacterium avium subsp. paratuberculosis
ccgggcggccgugguc

SEQ ID NO: 918717 - RNA, 23 nt, Mycobacterium avium subsp. paratuberculosis
ccgggcggccguggucgaugaac

SEQ ID NO: 918718 - RNA, 21 nt, Mycobacterium avium subsp. paratuberculosis
ccgggcgguuuccacgaugac

SEQ ID NO: 918719 - RNA, 12 nt, Mycobacterium avium subsp. paratuberculosis
ccgggcgcgugc

SEQ ID NO: 918720 - RNA, 18 nt, Mycobacterium avium subsp. paratuberculosis
ccgggcgcgugcacaccg

SEQ ID NO: 918721 - RNA, 22 nt, Mycobacterium avium subsp. paratuberculosis
ccgggcgcucuucgggcugcgc

SEQ ID NO: 918722 - RNA, 18 nt, Mycobacterium avium subsp. paratuberculosis
ccgggcgcgggcgccguc

SEQ ID NO: 918723 - RNA, 17 nt, Mycobacterium avium subsp. paratuberculosis
ccgggcgccggccggcg

SEQ ID NO: 918724 - RNA, 22 nt, Mycobacterium avium subsp. paratuberculosis
ccgggcgcgaauuccucagcgc

SEQ ID NO: 918725 - RNA, 14 nt, Mycobacterium avium subsp. paratuberculosis
ccgggcgcgacggu

SEQ ID NO: 918726 - RNA, 19 nt, Mycobacterium avium subsp. paratuberculosis
ccgggcgcgcagaucgucg

SEQ ID NO: 918727 - RNA, 20 nt, Mycobacterium avium subsp. paratuberculosis
ccgggcgcgcagaucgucga

SEQ ID NO: 918728 - RNA, 20 nt, Mycobacterium avium subsp. paratuberculosis
ccgggccugcggcgcggcca

SEQ ID NO: 918729 - RNA, 20 nt, Mycobacterium avium subsp. paratuberculosis
ccgggccugcggcggccgca

SEQ ID NO: 918730 - RNA, 24 nt, Mycobacterium avium subsp. paratuberculosis
ccgggccugcggcggccgcagcgu

SEQ ID NO: 918731 - RNA, 18 nt, Mycobacterium avium subsp. paratuberculosis
ccgggccuugacggccug

SEQ ID NO: 918732 - RNA, 13 nt, Mycobacterium avium subsp. paratuberculosis
ccgggccggccag

SEQ ID NO: 918733 - RNA, 23 nt, Mycobacterium avium subsp. paratuberculosis
ccgggccguccgggugcgggcug

SEQ ID NO: 918734 - RNA, 14 nt, Mycobacterium avium subsp. paratuberculosis
ccgggccguucagc

SEQ ID NO: 918735 - RNA, 21 nt, Mycobacterium avium subsp. paratuberculosis
ccgggccguucagcgggcggu

SEQ ID NO: 918736 - RNA, 17 nt, Mycobacterium avium subsp. paratuberculosis
ccgggccggucggucag

SEQ ID NO: 918737 - RNA, 21 nt, Mycobacterium avium subsp. paratuberculosis
ccgggccguaucggccccggc

SEQ ID NO: 918738 - RNA, 18 nt, Mycobacterium avium subsp. paratuberculosis
ccgggccgucaucgccga

SEQ ID NO: 918739 - RNA, 13 nt, Mycobacterium avium subsp. paratuberculosis
ccgggccggcggu

SEQ ID NO: 918740 - RNA, 15 nt, Mycobacterium avium subsp. paratuberculosis
ccgggccggcgucgc

SEQ ID NO: 918741 - RNA, 14 nt, Mycobacterium avium subsp. paratuberculosis
ccgggccgggucca

SEQ ID NO: 918742 - RNA, 20 nt, Mycobacterium avium subsp. paratuberculosis
ccgggccgguaaaacuggcc

SEQ ID NO: 918743 - RNA, 15 nt, Mycobacterium avium subsp. paratuberculosis
ccgggccggcggcca

SEQ ID NO: 918744 - RNA, 12 nt, Mycobacterium avium subsp. paratuberculosis
ccgggcccgcuc

SEQ ID NO: 918745 - RNA, 13 nt, Mycobacterium avium subsp. paratuberculosis
ccgggccgcgccc

SEQ ID NO: 918746 - RNA, 17 nt, Mycobacterium avium subsp. paratuberculosis
ccgggccgcuggccgcc

SEQ ID NO: 918747 - RNA, 12 nt, Mycobacterium avium subsp. paratuberculosis
ccgggccggaca

SEQ ID NO: 918748 - RNA, 22 nt, Mycobacterium avium subsp. paratuberculosis
ccgggccggaggugcgggucuc

SEQ ID NO: 918749 - RNA, 20 nt, Mycobacterium avium subsp. paratuberculosis
ccgggcccgauggcggccug

SEQ ID NO: 918750 - RNA, 18 nt, Mycobacterium avium subsp. paratuberculosis
ccgggcccaccaggucga

SEQ ID NO: 918751 - RNA, 15 nt, Mycobacterium avium subsp. paratuberculosis
ccgggcccagcacca

SEQ ID NO: 918752 - RNA, 16 nt, Mycobacterium avium subsp. paratuberculosis
ccgggcccagcaccac

SEQ ID NO: 918753 - RNA, 17 nt, Mycobacterium avium subsp. paratuberculosis
ccgggcccagcaccacc

SEQ ID NO: 918754 - RNA, 18 nt, Mycobacterium avium subsp. paratuberculosis
ccgggcccagcaccacca

SEQ ID NO: 918755 - RNA, 12 nt, Mycobacterium avium subsp. paratuberculosis
ccgggcccagcu

SEQ ID NO: 918756 - RNA, 15 nt, Mycobacterium avium subsp. paratuberculosis
ccgggcccagcucgg

SEQ ID NO: 918757 - RNA, 18 nt, Mycobacterium avium subsp. paratuberculosis
ccgggcccgaacaucgcc

SEQ ID NO: 918758 - RNA, 22 nt, Mycobacterium avium subsp. paratuberculosis
ccgggcccgaacaucgccucgg

SEQ ID NO: 918759 - RNA, 23 nt, Mycobacterium avium subsp. paratuberculosis
ccgggcccgaacaucgccucggc

SEQ ID NO: 918760 - RNA, 17 nt, Mycobacterium avium subsp. paratuberculosis
ccgggcccgaagcgcuu

SEQ ID NO: 918761 - RNA, 13 nt, Mycobacterium avium subsp. paratuberculosis
ccggcgggccacg

SEQ ID NO: 918762 - RNA, 14 nt, Mycobacterium avium subsp. paratuberculosis
ccggcggcgcggca

SEQ ID NO: 918763 - RNA, 15 nt, Mycobacterium avium subsp. paratuberculosis
ccggcggcgcggcag

SEQ ID NO: 918764 - RNA, 22 nt, Mycobacterium avium subsp. paratuberculosis
ccggcggcgccggaggccagcu

SEQ ID NO: 918765 - RNA, 19 nt, Mycobacterium avium subsp. paratuberculosis
ccggcggcgccuugccggu

SEQ ID NO: 918766 - RNA, 15 nt, Mycobacterium avium subsp. paratuberculosis
ccggcggcgaugauc

SEQ ID NO: 918767 - RNA, 19 nt, Mycobacterium avium subsp. paratuberculosis
ccggcggcgaucgccgcga

SEQ ID NO: 918768 - RNA, 14 nt, Mycobacterium avium subsp. paratuberculosis
ccggcggcgaucgg

SEQ ID NO: 918769 - RNA, 22 nt, Mycobacterium avium subsp. paratuberculosis
ccggcggcgaucggcgcggcga

SEQ ID NO: 918770 - RNA, 21 nt, Mycobacterium avium subsp. paratuberculosis
ccggcggcgaugaucgggaug

SEQ ID NO: 918771 - RNA, 14 nt, Mycobacterium avium subsp. paratuberculosis
ccggcggcgcccgc

SEQ ID NO: 918772 - RNA, 18 nt, Mycobacterium avium subsp. paratuberculosis
ccggcggcgcccgcggcc

SEQ ID NO: 918773 - RNA, 19 nt, Mycobacterium avium subsp. paratuberculosis
ccggcggcgcccgcggccu

SEQ ID NO: 918774 - RNA, 14 nt, Mycobacterium avium subsp. paratuberculosis
ccggcggcagguga

SEQ ID NO: 918775 - RNA, 23 nt, Mycobacterium avium subsp. paratuberculosis
ccggcggcagguggucggugaag

SEQ ID NO: 918776 - RNA, 18 nt, Mycobacterium avium subsp. paratuberculosis
ccggcggcaguccggcga

SEQ ID NO: 918777 - RNA, 17 nt, Mycobacterium avium subsp. paratuberculosis
ccggcggcagugcgccg

SEQ ID NO: 918778 - RNA, 18 nt, Mycobacterium avium subsp. paratuberculosis
ccggcggcagugcgccgu

SEQ ID NO: 918779 - RNA, 15 nt, Mycobacterium avium subsp. paratuberculosis
ccggcggccaccaug

SEQ ID NO: 918780 - RNA, 20 nt, Mycobacterium avium subsp. paratuberculosis
ccggcggccacgaucgcggc

SEQ ID NO: 918781 - RNA, 22 nt, Mycobacterium avium subsp. paratuberculosis
ccggcggcagcgacucgggcag

SEQ ID NO: 918782 - RNA, 22 nt, Mycobacterium avium subsp. paratuberculosis
ccggcggcgacggcaccgccgg

SEQ ID NO: 918783 - RNA, 17 nt, Mycobacterium avium subsp. paratuberculosis
ccggcggcgaagccggc

SEQ ID NO: 918784 - RNA, 22 nt, Mycobacterium avium subsp. paratuberculosis
ccggcggcgaagccggccccgc

SEQ ID NO: 918785 - RNA, 17 nt, Mycobacterium avium subsp. paratuberculosis
ccggcggggacgugucg

SEQ ID NO: 918786 - RNA, 18 nt, Mycobacterium avium subsp. paratuberculosis
ccggcggggacgugucgg

SEQ ID NO: 918787 - RNA, 23 nt, Mycobacterium avium subsp. paratuberculosis
ccggcggggacgugucggggugg

SEQ ID NO: 918788 - RNA, 20 nt, Mycobacterium avium subsp. paratuberculosis
ccggcggggcgucgcccgcc

SEQ ID NO: 918789 - RNA, 24 nt, Mycobacterium avium subsp. paratuberculosis
ccggcggggcgucgcccgccgacg

SEQ ID NO: 918790 - RNA, 13 nt, Mycobacterium avium subsp. paratuberculosis
ccggcgggggcgc

SEQ ID NO: 918791 - RNA, 16 nt, Mycobacterium avium subsp. paratuberculosis
ccggcgggggcggcgg

SEQ ID NO: 918792 - RNA, 21 nt, Mycobacterium avium subsp. paratuberculosis
ccggcgggggcggcgggguga

SEQ ID NO: 918793 - RNA, 23 nt, Mycobacterium avium subsp. paratuberculosis
ccggcgggggcggcggggugacg

SEQ ID NO: 918794 - RNA, 18 nt, Mycobacterium avium subsp. paratuberculosis
ccggcggggguucgacgu

SEQ ID NO: 918795 - RNA, 15 nt, Mycobacterium avium subsp. paratuberculosis
ccggcgggucagcac

SEQ ID NO: 918796 - RNA, 16 nt, Mycobacterium avium subsp. paratuberculosis
ccggcgggucagcagc

SEQ ID NO: 918797 - RNA, 24 nt, Mycobacterium avium subsp. paratuberculosis
ccggcgggugagccggucgaacgc

SEQ ID NO: 918798 - RNA, 15 nt, Mycobacterium avium subsp. paratuberculosis
ccggcgggcuggugc

SEQ ID NO: 918799 - RNA, 17 nt, Mycobacterium avium subsp. paratuberculosis
ccggcgggcuggugcgc

SEQ ID NO: 918800 - RNA, 15 nt, Mycobacterium avium subsp. paratuberculosis
ccggcgggcucgccg

SEQ ID NO: 918801 - RNA, 16 nt, Mycobacterium avium subsp. paratuberculosis
ccggcgggcucgccgg

SEQ ID NO: 918802 - RNA, 14 nt, Mycobacterium avium subsp. paratuberculosis
ccggcgggccucgc

SEQ ID NO: 918803 - RNA, 17 nt, Mycobacterium avium subsp. paratuberculosis
ccggcgggccucgccgc

SEQ ID NO: 918804 - RNA, 16 nt, Mycobacterium avium subsp. paratuberculosis
ccggcgggcgccgguc

SEQ ID NO: 918805 - RNA, 13 nt, Mycobacterium avium subsp. paratuberculosis
ccggcgggcggcc

SEQ ID NO: 918806 - RNA, 17 nt, Mycobacterium avium subsp. paratuberculosis
ccggcgggcggccgauc

SEQ ID NO: 918807 - RNA, 18 nt, Mycobacterium avium subsp. paratuberculosis
ccggcgggcggccgaucc

SEQ ID NO: 918808 - RNA, 14 nt, Mycobacterium avium subsp. paratuberculosis
ccggcgggcggcgg

SEQ ID NO: 918809 - RNA, 19 nt, Mycobacterium avium subsp. paratuberculosis
ccggcgggcggcggcguug

SEQ ID NO: 918810 - RNA, 15 nt, Mycobacterium avium subsp. paratuberculosis
ccggcgucacgcugg

SEQ ID NO: 918811 - RNA, 20 nt, Mycobacterium avium subsp. paratuberculosis
ccggcgucacgcuggcguga

SEQ ID NO: 918812 - RNA, 22 nt, Mycobacterium avium subsp. paratuberculosis
ccggcgucacgcuggcgugacg

SEQ ID NO: 918813 - RNA, 20 nt, Mycobacterium avium subsp. paratuberculosis
ccggcguagaccagcgacgc

SEQ ID NO: 918814 - RNA, 21 nt, Mycobacterium avium subsp. paratuberculosis
ccggcguagaccagcgacgcc

SEQ ID NO: 918815 - RNA, 17 nt, Mycobacterium avium subsp. paratuberculosis
ccggcguagcagucggc

SEQ ID NO: 918816 - RNA, 20 nt, Mycobacterium avium subsp. paratuberculosis
ccggcguagcagucggccug

SEQ ID NO: 918817 - RNA, 16 nt, Mycobacterium avium subsp. paratuberculosis
ccggcggugcgggugg

SEQ ID NO: 918818 - RNA, 18 nt, Mycobacterium avium subsp. paratuberculosis
ccggcggugcgucgaauc

SEQ ID NO: 918819 - RNA, 22 nt, Mycobacterium avium subsp. paratuberculosis
ccggcgguggugccgccgucga

SEQ ID NO: 918820 - RNA, 18 nt, Mycobacterium avium subsp. paratuberculosis
ccggcggugucggugccg

SEQ ID NO: 918821 - RNA, 22 nt, Mycobacterium avium subsp. paratuberculosis
ccggcggugucggugccgagca

SEQ ID NO: 918822 - RNA, 16 nt, Mycobacterium avium subsp. paratuberculosis
ccggcgguucggcggg

SEQ ID NO: 918823 - RNA, 19 nt, Mycobacterium avium subsp. paratuberculosis
ccggcgguucggcgggccu

SEQ ID NO: 918824 - RNA, 14 nt, Mycobacterium avium subsp. paratuberculosis
ccggcguacccgcc

SEQ ID NO: 918825 - RNA, 19 nt, Mycobacterium avium subsp. paratuberculosis
ccggcguacgacaucucga

SEQ ID NO: 918826 - RNA, 23 nt, Mycobacterium avium subsp. paratuberculosis
ccggcguacgacaucucgacggu

SEQ ID NO: 918827 - RNA, 18 nt, Mycobacterium avium subsp. paratuberculosis
ccggcguacucgcacagc

SEQ ID NO: 918828 - RNA, 16 nt, Mycobacterium avium subsp. paratuberculosis
ccggcggcagccaggc

SEQ ID NO: 918829 - RNA, 18 nt, Mycobacterium avium subsp. paratuberculosis
ccggcggcagccaggcgu

SEQ ID NO: 918830 - RNA, 11 nt, Mycobacterium avium subsp. paratuberculosis
ccggcggcacc

SEQ ID NO: 918831 - RNA, 14 nt, Mycobacterium avium subsp. paratuberculosis
ccggcggcaccacc

SEQ ID NO: 918832 - RNA, 16 nt, Mycobacterium avium subsp. paratuberculosis
ccggcggcaccacccg

SEQ ID NO: 918833 - RNA, 22 nt, Mycobacterium avium subsp. paratuberculosis
ccggcggcaccacccgcggccg

SEQ ID NO: 918834 - RNA, 13 nt, Mycobacterium avium subsp. paratuberculosis
ccggcggcaccgc

SEQ ID NO: 918835 - RNA, 16 nt, Mycobacterium avium subsp. paratuberculosis
ccggcggcaccgccgc

SEQ ID NO: 918836 - RNA, 14 nt, Mycobacterium avium subsp. paratuberculosis
ccggcggcaccgcg

SEQ ID NO: 918837 - RNA, 15 nt, Mycobacterium avium subsp. paratuberculosis
ccggcggcaccgcgg

SEQ ID NO: 918838 - RNA, 14 nt, Mycobacterium avium subsp. paratuberculosis
ccggcggacgcggc

SEQ ID NO: 918839 - RNA, 19 nt, Mycobacterium avium subsp. paratuberculosis
ccggcggacgcggccagcg

SEQ ID NO: 918840 - RNA, 22 nt, Mycobacterium avium subsp. paratuberculosis
ccggcggacgcggccagcgccc

SEQ ID NO: 918841 - RNA, 19 nt, Mycobacterium avium subsp. paratuberculosis
ccggcggacggucccgacg

SEQ ID NO: 918842 - RNA, 18 nt, Mycobacterium avium subsp. paratuberculosis
ccggcgcugcgcccgguc

SEQ ID NO: 918843 - RNA, 16 nt, Mycobacterium avium subsp. paratuberculosis
ccggcggacagccccg

SEQ ID NO: 918844 - RNA, 14 nt, Mycobacterium avium subsp. paratuberculosis
ccggcggacccgga

SEQ ID NO: 918845 - RNA, 22 nt, Mycobacterium avium subsp. paratuberculosis
ccggcggacccggaggcggcgg

SEQ ID NO: 918846 - RNA, 15 nt, Mycobacterium avium subsp. paratuberculosis
ccggcgcuggcgcgc

SEQ ID NO: 918847 - RNA, 16 nt, Mycobacterium avium subsp. paratuberculosis
ccggcgcuggcgugcu

SEQ ID NO: 918848 - RNA, 19 nt, Mycobacterium avium subsp. paratuberculosis
ccggcgcugcccgcgaucg

SEQ ID NO: 918849 - RNA, 15 nt, Mycobacterium avium subsp. paratuberculosis
ccggcgcucgucguc

SEQ ID NO: 918850 - RNA, 19 nt, Mycobacterium avium subsp. paratuberculosis
ccggcgcucgucgucgccg

SEQ ID NO: 918851 - RNA, 21 nt, Mycobacterium avium subsp. paratuberculosis
ccggcgcugaagugcagcgca

SEQ ID NO: 918852 - RNA, 18 nt, Mycobacterium avium subsp. paratuberculosis
ccggcgcugcccgucgac

SEQ ID NO: 918853 - RNA, 19 nt, Mycobacterium avium subsp. paratuberculosis
ccggcgcugcccgucgacc

SEQ ID NO: 918854 - RNA, 21 nt, Mycobacterium avium subsp. paratuberculosis
ccggcgcugcccgucgaccuc

SEQ ID NO: 918855 - RNA, 14 nt, Mycobacterium avium subsp. paratuberculosis
ccggcgcucaccgc

SEQ ID NO: 918856 - RNA, 19 nt, Mycobacterium avium subsp. paratuberculosis
ccggcgcucaccgcgauga

SEQ ID NO: 918857 - RNA, 18 nt, Mycobacterium avium subsp. paratuberculosis
ccggcgcuacgccggcuc

SEQ ID NO: 918858 - RNA, 21 nt, Mycobacterium avium subsp. paratuberculosis
ccggcgcguuggcccgugucg

SEQ ID NO: 918859 - RNA, 22 nt, Mycobacterium avium subsp. paratuberculosis
ccggcgcguuccaucagcgccc

SEQ ID NO: 918860 - RNA, 21 nt, Mycobacterium avium subsp. paratuberculosis
ccggcgcggcggcgacgucga

SEQ ID NO: 918861 - RNA, 18 nt, Mycobacterium avium subsp. paratuberculosis
ccggcgcggcggcgccgc

SEQ ID NO: 918862 - RNA, 21 nt, Mycobacterium avium subsp. paratuberculosis
ccggcgcggcggcgccgcggu

SEQ ID NO: 918863 - RNA, 16 nt, Mycobacterium avium subsp. paratuberculosis
ccggcgcgugcgcgac

SEQ ID NO: 918864 - RNA, 17 nt, Mycobacterium avium subsp. paratuberculosis
ccggcgcgugcgcgacg

SEQ ID NO: 918865 - RNA, 13 nt, Mycobacterium avium subsp. paratuberculosis
ccggcgcgguggg

SEQ ID NO: 918866 - RNA, 21 nt, Mycobacterium avium subsp. paratuberculosis
ccggcgcgguucuugcgccau

SEQ ID NO: 918867 - RNA, 20 nt, Mycobacterium avium subsp. paratuberculosis
ccggcgcgguugcccgcacc

SEQ ID NO: 918868 - RNA, 23 nt, Mycobacterium avium subsp. paratuberculosis
ccggcgcggugauucgaagaaca

SEQ ID NO: 918869 - RNA, 12 nt, Mycobacterium avium subsp. paratuberculosis
ccggcgcggugc

SEQ ID NO: 918870 - RNA, 22 nt, Mycobacterium avium subsp. paratuberculosis
ccggcgcggugcucggcgcgcg

SEQ ID NO: 918871 - RNA, 17 nt, Mycobacterium avium subsp. paratuberculosis
ccggcgcgggccgcagc

SEQ ID NO: 918872 - RNA, 22 nt, Mycobacterium avium subsp. paratuberculosis
ccggcgcgggccgcagcgcgcg

SEQ ID NO: 918873 - RNA, 24 nt, Mycobacterium avium subsp. paratuberculosis
ccggcgcggccggugcgcgucagc

SEQ ID NO: 918874 - RNA, 13 nt, Mycobacterium avium subsp. paratuberculosis
ccggcgcggcggc

SEQ ID NO: 918875 - RNA, 20 nt, Mycobacterium avium subsp. paratuberculosis
ccggcgcggacggaucgagu

SEQ ID NO: 918876 - RNA, 14 nt, Mycobacterium avium subsp. paratuberculosis
ccggcgcggccgcc

SEQ ID NO: 918877 - RNA, 14 nt, Mycobacterium avium subsp. paratuberculosis
ccggcgcggacagc

SEQ ID NO: 918878 - RNA, 19 nt, Mycobacterium avium subsp. paratuberculosis
ccggcgcggacagcgcggu

SEQ ID NO: 918879 - RNA, 22 nt, Mycobacterium avium subsp. paratuberculosis
ccggcgcggaacagcgucgccg

SEQ ID NO: 918880 - RNA, 14 nt, Mycobacterium avium subsp. paratuberculosis
ccggcgcggaacgc

SEQ ID NO: 918881 - RNA, 19 nt, Mycobacterium avium subsp. paratuberculosis
ccggcgcggaacgcgccgg

SEQ ID NO: 918882 - RNA, 21 nt, Mycobacterium avium subsp. paratuberculosis
ccggcgcggaacgcgccgggc

SEQ ID NO: 918883 - RNA, 22 nt, Mycobacterium avium subsp. paratuberculosis
ccggcgcggaacgcgccgggca

SEQ ID NO: 918884 - RNA, 16 nt, Mycobacterium avium subsp. paratuberculosis
ccggcgcggcagggcc

SEQ ID NO: 918885 - RNA, 14 nt, Mycobacterium avium subsp. paratuberculosis
ccggcgcggcaucg

SEQ ID NO: 918886 - RNA, 15 nt, Mycobacterium avium subsp. paratuberculosis
ccggcgcggcaucgg

SEQ ID NO: 918887 - RNA, 18 nt, Mycobacterium avium subsp. paratuberculosis
ccggcgcggcaucggcga

SEQ ID NO: 918888 - RNA, 20 nt, Mycobacterium avium subsp. paratuberculosis
ccggcgcggcaucggcgacg

SEQ ID NO: 918889 - RNA, 12 nt, Mycobacterium avium subsp. paratuberculosis
ccggcgcggcca

SEQ ID NO: 918890 - RNA, 14 nt, Mycobacterium avium subsp. paratuberculosis
ccggcgcggccagc

SEQ ID NO: 918891 - RNA, 15 nt, Mycobacterium avium subsp. paratuberculosis
ccggcgcggccagcu

SEQ ID NO: 918892 - RNA, 12 nt, Mycobacterium avium subsp. paratuberculosis
ccggcgcggccg

SEQ ID NO: 918893 - RNA, 18 nt, Mycobacterium avium subsp. paratuberculosis
ccggcgcgcgagcgucac

SEQ ID NO: 918894 - RNA, 23 nt, Mycobacterium avium subsp. paratuberculosis
ccggcgcgcgagcgucacgcugg

SEQ ID NO: 918895 - RNA, 14 nt, Mycobacterium avium subsp. paratuberculosis
ccggcgcgcggugg

SEQ ID NO: 918896 - RNA, 16 nt, Mycobacterium avium subsp. paratuberculosis
ccggcgcgccugcgcg

SEQ ID NO: 918897 - RNA, 19 nt, Mycobacterium avium subsp. paratuberculosis
ccggcgcgccugcgcggcg

SEQ ID NO: 918898 - RNA, 20 nt, Mycobacterium avium subsp. paratuberculosis
ccggcgcgccugcgcggcgg

SEQ ID NO: 918899 - RNA, 13 nt, Mycobacterium avium subsp. paratuberculosis
ccggcgcgccugc

SEQ ID NO: 918900 - RNA, 13 nt, Mycobacterium avium subsp. paratuberculosis
ccggcgcgcccgg

SEQ ID NO: 918901 - RNA, 14 nt, Mycobacterium avium subsp. paratuberculosis
ccggcgcgcccgga

SEQ ID NO: 918902 - RNA, 22 nt, Mycobacterium avium subsp. paratuberculosis
ccggcgcgccguccuuggucac

SEQ ID NO: 918903 - RNA, 12 nt, Mycobacterium avium subsp. paratuberculosis
ccggcgcgccgc

SEQ ID NO: 918904 - RNA, 14 nt, Mycobacterium avium subsp. paratuberculosis
ccggcgcgccgcga

SEQ ID NO: 918905 - RNA, 19 nt, Mycobacterium avium subsp. paratuberculosis
ccggcgcgccgcguucggc

SEQ ID NO: 918906 - RNA, 22 nt, Mycobacterium avium subsp. paratuberculosis
ccggcgcgccgcguucggcggc

SEQ ID NO: 918907 - RNA, 12 nt, Mycobacterium avium subsp. paratuberculosis
ccggcgcgccac

SEQ ID NO: 918908 - RNA, 15 nt, Mycobacterium avium subsp. paratuberculosis
ccggcgcgccacgac

SEQ ID NO: 918909 - RNA, 15 nt, Mycobacterium avium subsp. paratuberculosis
ccggcgcgcacggca

SEQ ID NO: 918910 - RNA, 17 nt, Mycobacterium avium subsp. paratuberculosis
ccggcgcgcaccccggc

SEQ ID NO: 918911 - RNA, 18 nt, Mycobacterium avium subsp. paratuberculosis
ccggcgcgcaccccggca

SEQ ID NO: 918912 - RNA, 12 nt, Mycobacterium avium subsp. paratuberculosis
ccggcgcgcagc

SEQ ID NO: 918913 - RNA, 22 nt, Mycobacterium avium subsp. paratuberculosis
ccggcgcgcagcaauugacgcc

SEQ ID NO: 918914 - RNA, 19 nt, Mycobacterium avium subsp. paratuberculosis
ccggcgcgcagccagucgc

SEQ ID NO: 918915 - RNA, 21 nt, Mycobacterium avium subsp. paratuberculosis
ccggcgcgcagccagucgccg

SEQ ID NO: 918916 - RNA, 15 nt, Mycobacterium avium subsp. paratuberculosis
ccggcgcgcagcgug

SEQ ID NO: 918917 - RNA, 16 nt, Mycobacterium avium subsp. paratuberculosis
ccggcgcgcagcgugu

SEQ ID NO: 918918 - RNA, 23 nt, Mycobacterium avium subsp. paratuberculosis
ccggcgcgcagcgugugcaccug

SEQ ID NO: 918919 - RNA, 13 nt, Mycobacterium avium subsp. paratuberculosis
ccggcgcgacggc

SEQ ID NO: 918920 - RNA, 19 nt, Mycobacterium avium subsp. paratuberculosis
ccggcgcgaccagcggcag

SEQ ID NO: 918921 - RNA, 20 nt, Mycobacterium avium subsp. paratuberculosis
ccggcgcgaccagcggcagc

SEQ ID NO: 918922 - RNA, 21 nt, Mycobacterium avium subsp. paratuberculosis
ccggcgcgaccagcggcagca

SEQ ID NO: 918923 - RNA, 23 nt, Mycobacterium avium subsp. paratuberculosis
ccggcgcgaccagcggcagcagc

SEQ ID NO: 918924 - RNA, 14 nt, Mycobacterium avium subsp. paratuberculosis
ccggcgcgaccagg

SEQ ID NO: 918925 - RNA, 15 nt, Mycobacterium avium subsp. paratuberculosis
ccggcgcgaccaggu

SEQ ID NO: 918926 - RNA, 17 nt, Mycobacterium avium subsp. paratuberculosis
ccggcgcgaccagguuc

SEQ ID NO: 918927 - RNA, 16 nt, Mycobacterium avium subsp. paratuberculosis
ccggcgccgucgaucc

SEQ ID NO: 918928 - RNA, 12 nt, Mycobacterium avium subsp. paratuberculosis
ccggcgccucga

SEQ ID NO: 918929 - RNA, 20 nt, Mycobacterium avium subsp. paratuberculosis
ccggcgccucgaugcgggug

SEQ ID NO: 918930 - RNA, 23 nt, Mycobacterium avium subsp. paratuberculosis
ccggcgccucggcgccucggcgu

SEQ ID NO: 918931 - RNA, 12 nt, Mycobacterium avium subsp. paratuberculosis
ccggcgccucgu

SEQ ID NO: 918932 - RNA, 19 nt, Mycobacterium avium subsp. paratuberculosis
ccggcgccggugccgcagc

SEQ ID NO: 918933 - RNA, 15 nt, Mycobacterium avium subsp. paratuberculosis
ccggcgccggucagc

SEQ ID NO: 918934 - RNA, 18 nt, Mycobacterium avium subsp. paratuberculosis
ccggcgccggucagcggc

SEQ ID NO: 918935 - RNA, 20 nt, Mycobacterium avium subsp. paratuberculosis
ccggcgccggucagcggcaa

SEQ ID NO: 918936 - RNA, 16 nt, Mycobacterium avium subsp. paratuberculosis
ccggcgccggugccgc

SEQ ID NO: 918937 - RNA, 12 nt, Mycobacterium avium subsp. paratuberculosis
ccggcgccggcc

SEQ ID NO: 918938 - RNA, 13 nt, Mycobacterium avium subsp. paratuberculosis
ccggcgccggccc

SEQ ID NO: 918939 - RNA, 15 nt, Mycobacterium avium subsp. paratuberculosis
ccggcgccggcccgc

SEQ ID NO: 918940 - RNA, 14 nt, Mycobacterium avium subsp. paratuberculosis
ccggcgccggccgc

SEQ ID NO: 918941 - RNA, 14 nt, Mycobacterium avium subsp. paratuberculosis
ccggcgccggcggc

SEQ ID NO: 918942 - RNA, 14 nt, Mycobacterium avium subsp. paratuberculosis
ccggcgccggcggu

SEQ ID NO: 918943 - RNA, 15 nt, Mycobacterium avium subsp. paratuberculosis
ccggcgccgggcggg

SEQ ID NO: 918944 - RNA, 19 nt, Mycobacterium avium subsp. paratuberculosis
ccggcgccggacggcccgc

SEQ ID NO: 918945 - RNA, 13 nt, Mycobacterium avium subsp. paratuberculosis
ccggcgccggauc

SEQ ID NO: 918946 - RNA, 15 nt, Mycobacterium avium subsp. paratuberculosis
ccggcgccggaucau

SEQ ID NO: 918947 - RNA, 23 nt, Mycobacterium avium subsp. paratuberculosis
ccggcgccgcgggugcggcacgg

SEQ ID NO: 918948 - RNA, 21 nt, Mycobacterium avium subsp. paratuberculosis
ccggcgccgccguucgccggc

SEQ ID NO: 918949 - RNA, 22 nt, Mycobacterium avium subsp. paratuberculosis
ccggcgccgccguucgccggcg

SEQ ID NO: 918950 - RNA, 23 nt, Mycobacterium avium subsp. paratuberculosis
ccggcgccgccguucgccggcga

SEQ ID NO: 918951 - RNA, 14 nt, Mycobacterium avium subsp. paratuberculosis
ccggcgcccggccg

SEQ ID NO: 918952 - RNA, 15 nt, Mycobacterium avium subsp. paratuberculosis
ccggcgcccggccgg

SEQ ID NO: 918953 - RNA, 16 nt, Mycobacterium avium subsp. paratuberculosis
ccggcgcccggccggc

SEQ ID NO: 918954 - RNA, 18 nt, Mycobacterium avium subsp. paratuberculosis
ccggcgcccggccggugc

SEQ ID NO: 918955 - RNA, 16 nt, Mycobacterium avium subsp. paratuberculosis
ccggcgcccggcgcgc

SEQ ID NO: 918956 - RNA, 17 nt, Mycobacterium avium subsp. paratuberculosis
ccggcgcccggcgcgcc

SEQ ID NO: 918957 - RNA, 13 nt, Mycobacterium avium subsp. paratuberculosis
ccggcgcccggcu

SEQ ID NO: 918958 - RNA, 18 nt, Mycobacterium avium subsp. paratuberculosis
ccggcgcccgaucggcac

SEQ ID NO: 918959 - RNA, 17 nt, Mycobacterium avium subsp. paratuberculosis
ccggcgcccgcaggccg

SEQ ID NO: 918960 - RNA, 18 nt, Mycobacterium avium subsp. paratuberculosis
ccggcgcccgcaggccgc

SEQ ID NO: 918961 - RNA, 16 nt, Mycobacterium avium subsp. paratuberculosis
ccggcgccccgggcag

SEQ ID NO: 918962 - RNA, 16 nt, Mycobacterium avium subsp. paratuberculosis
ccggcgcccagcggcg

SEQ ID NO: 918963 - RNA, 16 nt, Mycobacterium avium subsp. paratuberculosis
ccggcgccagcccggu

SEQ ID NO: 918964 - RNA, 21 nt, Mycobacterium avium subsp. paratuberculosis
ccggcgccagcccggugaucg

SEQ ID NO: 918965 - RNA, 13 nt, Mycobacterium avium subsp. paratuberculosis
ccggccagcggcu

SEQ ID NO: 918966 - RNA, 15 nt, Mycobacterium avium subsp. paratuberculosis
ccggccagcggcuug

SEQ ID NO: 918967 - RNA, 21 nt, Mycobacterium avium subsp. paratuberculosis
ccggccagcggcuuggccgug

SEQ ID NO: 918968 - RNA, 21 nt, Mycobacterium avium subsp. paratuberculosis
ccggccagcgggucgugcauc

SEQ ID NO: 918969 - RNA, 19 nt, Mycobacterium avium subsp. paratuberculosis
ccggccagcgucgcgccgc

SEQ ID NO: 918970 - RNA, 13 nt, Mycobacterium avium subsp. paratuberculosis
ccggccagcuccg

SEQ ID NO: 918971 - RNA, 20 nt, Mycobacterium avium subsp. paratuberculosis
ccggccagcucgagcaucac

SEQ ID NO: 918972 - RNA, 23 nt, Mycobacterium avium subsp. paratuberculosis
ccggccagcucgagcaucacgaa

SEQ ID NO: 918973 - RNA, 13 nt, Mycobacterium avium subsp. paratuberculosis
ccggccagcucgc

SEQ ID NO: 918974 - RNA, 20 nt, Mycobacterium avium subsp. paratuberculosis
ccggccagcucgccgccgac

SEQ ID NO: 918975 - RNA, 12 nt, Mycobacterium avium subsp. paratuberculosis
ccggccagcggc

SEQ ID NO: 918976 - RNA, 14 nt, Mycobacterium avium subsp. paratuberculosis
ccggccagcggcag

SEQ ID NO: 918977 - RNA, 17 nt, Mycobacterium avium subsp. paratuberculosis
ccggccagcggccagcc

SEQ ID NO: 918978 - RNA, 22 nt, Mycobacterium avium subsp. paratuberculosis
ccggccagcggccagcccgcgg

SEQ ID NO: 918979 - RNA, 17 nt, Mycobacterium avium subsp. paratuberculosis
ccggccagccgcgcgac

SEQ ID NO: 918980 - RNA, 12 nt, Mycobacterium avium subsp. paratuberculosis
ccggccagccgg

SEQ ID NO: 918981 - RNA, 16 nt, Mycobacterium avium subsp. paratuberculosis
ccggccagccggccgc

SEQ ID NO: 918982 - RNA, 18 nt, Mycobacterium avium subsp. paratuberculosis
ccggccagccggccgcug

SEQ ID NO: 918983 - RNA, 19 nt, Mycobacterium avium subsp. paratuberculosis
ccggccagccggccgcuga

SEQ ID NO: 918984 - RNA, 15 nt, Mycobacterium avium subsp. paratuberculosis
ccggccagccggcuc

SEQ ID NO: 918985 - RNA, 14 nt, Mycobacterium avium subsp. paratuberculosis
ccggccagccgggc

SEQ ID NO: 918986 - RNA, 20 nt, Mycobacterium avium subsp. paratuberculosis
ccggccagccgggcggccag

SEQ ID NO: 918987 - RNA, 17 nt, Mycobacterium avium subsp. paratuberculosis
ccgguccacggugucgc

SEQ ID NO: 918988 - RNA, 17 nt, Mycobacterium avium subsp. paratuberculosis
ccgguccacucgucggc

SEQ ID NO: 918989 - RNA, 20 nt, Mycobacterium avium subsp. paratuberculosis
ccgguccagccgccgcgugg

SEQ ID NO: 918990 - RNA, 16 nt, Mycobacterium avium subsp. paratuberculosis
ccgguccaguccggcc

SEQ ID NO: 918991 - RNA, 16 nt, Mycobacterium avium subsp. paratuberculosis
ccgguccagugccggc

SEQ ID NO: 918992 - RNA, 17 nt, Mycobacterium avium subsp. paratuberculosis
ccgguccagugccggcg

SEQ ID NO: 918993 - RNA, 18 nt, Mycobacterium avium subsp. paratuberculosis
ccgguccaguugugccgc

SEQ ID NO: 918994 - RNA, 13 nt, Mycobacterium avium subsp. paratuberculosis
ccgguccaucccg

SEQ ID NO: 918995 - RNA, 18 nt, Mycobacterium avium subsp. paratuberculosis
ccggucauccgggccacc

SEQ ID NO: 918996 - RNA, 17 nt, Mycobacterium avium subsp. paratuberculosis
ccggucauccucgccgc

SEQ ID NO: 918997 - RNA, 18 nt, Mycobacterium avium subsp. paratuberculosis
ccggucauccucgccgcg

SEQ ID NO: 918998 - RNA, 22 nt, Mycobacterium avium subsp. paratuberculosis
ccggucauccucgccgcgccag

SEQ ID NO: 918999 - RNA, 23 nt, Mycobacterium avium subsp. paratuberculosis
ccggucauccucgccgcgccagc

SEQ ID NO: 919000 - RNA, 22 nt, Mycobacterium avium subsp. paratuberculosis
ccggucaggucgcugcgcucgc

SEQ ID NO: 919001 - RNA, 19 nt, Mycobacterium avium subsp. paratuberculosis
ccggucagguugacgccga

SEQ ID NO: 919002 - RNA, 16 nt, Mycobacterium avium subsp. paratuberculosis
ccggucaguucgucgg

SEQ ID NO: 919003 - RNA, 17 nt, Mycobacterium avium subsp. paratuberculosis
ccggucaguucgucggu

SEQ ID NO: 919004 - RNA, 21 nt, Mycobacterium avium subsp. paratuberculosis
ccggucaguucgucggucacg

SEQ ID NO: 919005 - RNA, 20 nt, Mycobacterium avium subsp. paratuberculosis
ccggucauaggccgcgcaga

SEQ ID NO: 919006 - RNA, 21 nt, Mycobacterium avium subsp. paratuberculosis
ccggucauaggccgcgcagau

SEQ ID NO: 919007 - RNA, 15 nt, Mycobacterium avium subsp. paratuberculosis
ccggucagggcucgc

SEQ ID NO: 919008 - RNA, 20 nt, Mycobacterium avium subsp. paratuberculosis
ccggucagcggcaacacgcc

SEQ ID NO: 919009 - RNA, 22 nt, Mycobacterium avium subsp. paratuberculosis
ccggucagcggcaacacgccgg

SEQ ID NO: 919010 - RNA, 21 nt, Mycobacterium avium subsp. paratuberculosis
ccggucagcguccaguccggc

SEQ ID NO: 919011 - RNA, 22 nt, Mycobacterium avium subsp. paratuberculosis
ccggucagcguccaguccggcg

SEQ ID NO: 919012 - RNA, 19 nt, Mycobacterium avium subsp. paratuberculosis
ccggucagcguggcgucgg

SEQ ID NO: 919013 - RNA, 13 nt, Mycobacterium avium subsp. paratuberculosis
ccggucagcgacg

SEQ ID NO: 919014 - RNA, 22 nt, Mycobacterium avium subsp. paratuberculosis
ccggucagaccccguaccagcg

SEQ ID NO: 919015 - RNA, 19 nt, Mycobacterium avium subsp. paratuberculosis
ccggucagcgccagcaugc

SEQ ID NO: 919016 - RNA, 18 nt, Mycobacterium avium subsp. paratuberculosis
ccggucagcgcgacaucg

SEQ ID NO: 919017 - RNA, 20 nt, Mycobacterium avium subsp. paratuberculosis
ccggucagcgcgacaucgcc

SEQ ID NO: 919018 - RNA, 22 nt, Mycobacterium avium subsp. paratuberculosis
ccggucagcgcgacaucgccgg

SEQ ID NO: 919019 - RNA, 13 nt, Mycobacterium avium subsp. paratuberculosis
ccggucacgcccg

SEQ ID NO: 919020 - RNA, 14 nt, Mycobacterium avium subsp. paratuberculosis
ccggucacgcccgg

SEQ ID NO: 919021 - RNA, 14 nt, Mycobacterium avium subsp. paratuberculosis
ccggucaccccggc

SEQ ID NO: 919022 - RNA, 16 nt, Mycobacterium avium subsp. paratuberculosis
ccggucaccccggcca

SEQ ID NO: 919023 - RNA, 20 nt, Mycobacterium avium subsp. paratuberculosis
ccggucacccgugggccgac

SEQ ID NO: 919024 - RNA, 13 nt, Mycobacterium avium subsp. paratuberculosis
ccggucacggcgu

SEQ ID NO: 919025 - RNA, 16 nt, Mycobacterium avium subsp. paratuberculosis
ccggucacggcgucgg

SEQ ID NO: 919026 - RNA, 12 nt, Mycobacterium avium subsp. paratuberculosis
ccggucagcacc

SEQ ID NO: 919027 - RNA, 19 nt, Mycobacterium avium subsp. paratuberculosis
ccggucagcaccgcgcggc

SEQ ID NO: 919028 - RNA, 22 nt, Mycobacterium avium subsp. paratuberculosis
ccggucaacgccgcgcgcagca

SEQ ID NO: 919029 - RNA, 19 nt, Mycobacterium avium subsp. paratuberculosis
ccgguauuggccacgcugg

SEQ ID NO: 919030 - RNA, 15 nt, Mycobacterium avium subsp. paratuberculosis
ccggucaacggcucg

SEQ ID NO: 919031 - RNA, 16 nt, Mycobacterium avium subsp. paratuberculosis
ccggucaacggcucgg

SEQ ID NO: 919032 - RNA, 22 nt, Mycobacterium avium subsp. paratuberculosis
ccggucaagaacgaaucgucgc

SEQ ID NO: 919033 - RNA, 21 nt, Mycobacterium avium subsp. paratuberculosis
ccggucaagcgcuuucgccga

SEQ ID NO: 919034 - RNA, 14 nt, Mycobacterium avium subsp. paratuberculosis
ccgguagucgucga

SEQ ID NO: 919035 - RNA, 20 nt, Mycobacterium avium subsp. paratuberculosis
ccgguaucgagcaccagcaa

SEQ ID NO: 919036 - RNA, 14 nt, Mycobacterium avium subsp. paratuberculosis
ccgguaggcggcga

SEQ ID NO: 919037 - RNA, 15 nt, Mycobacterium avium subsp. paratuberculosis
ccgguagggccgguc

SEQ ID NO: 919038 - RNA, 16 nt, Mycobacterium avium subsp. paratuberculosis
ccgguagggccgguca

SEQ ID NO: 919039 - RNA, 16 nt, Mycobacterium avium subsp. paratuberculosis
ccgguaggcgcaccgc

SEQ ID NO: 919040 - RNA, 15 nt, Mycobacterium avium subsp. paratuberculosis
ccgguaggcggccag

SEQ ID NO: 919041 - RNA, 18 nt, Mycobacterium avium subsp. paratuberculosis
ccgguaggccgccgcgac

SEQ ID NO: 919042 - RNA, 19 nt, Mycobacterium avium subsp. paratuberculosis
ccgguaggccgccgcgacc

SEQ ID NO: 919043 - RNA, 14 nt, Mycobacterium avium subsp. paratuberculosis
ccgguaggccgcgc

SEQ ID NO: 919044 - RNA, 14 nt, Mycobacterium avium subsp. paratuberculosis
ccggucgaggucgc

SEQ ID NO: 919045 - RNA, 16 nt, Mycobacterium avium subsp. paratuberculosis
ccggucgaggucgccg

SEQ ID NO: 919046 - RNA, 17 nt, Mycobacterium avium subsp. paratuberculosis
ccggucgaggucgccga

SEQ ID NO: 919047 - RNA, 18 nt, Mycobacterium avium subsp. paratuberculosis
ccggucgaggucggccag

SEQ ID NO: 919048 - RNA, 14 nt, Mycobacterium avium subsp. paratuberculosis
ccggucgacgacga

SEQ ID NO: 919049 - RNA, 18 nt, Mycobacterium avium subsp. paratuberculosis
ccggucgacgauggcccg

SEQ ID NO: 919050 - RNA, 14 nt, Mycobacterium avium subsp. paratuberculosis
ccggucgacgcggg

SEQ ID NO: 919051 - RNA, 22 nt, Mycobacterium avium subsp. paratuberculosis
ccggucgacgcggggcggcggc

SEQ ID NO: 919052 - RNA, 17 nt, Mycobacterium avium subsp. paratuberculosis
ccgguccugggccuccg

SEQ ID NO: 919053 - RNA, 19 nt, Mycobacterium avium subsp. paratuberculosis
ccgguccuucucgcacagc

SEQ ID NO: 919054 - RNA, 20 nt, Mycobacterium avium subsp. paratuberculosis
ccgguccuugagguagucgc

SEQ ID NO: 919055 - RNA, 22 nt, Mycobacterium avium subsp. paratuberculosis
ccgguccuugagguagucgcgc

SEQ ID NO: 919056 - RNA, 16 nt, Mycobacterium avium subsp. paratuberculosis
ccggucgaacgccagc

SEQ ID NO: 919057 - RNA, 21 nt, Mycobacterium avium subsp. paratuberculosis
ccggucgaacgccagcgccgc

SEQ ID NO: 919058 - RNA, 22 nt, Mycobacterium avium subsp. paratuberculosis
ccggucgaaggaggccagcugc

SEQ ID NO: 919059 - RNA, 17 nt, Mycobacterium avium subsp. paratuberculosis
ccggucgaaggccccgg

SEQ ID NO: 919060 - RNA, 14 nt, Mycobacterium avium subsp. paratuberculosis
ccgguccgggucgc

SEQ ID NO: 919061 - RNA, 20 nt, Mycobacterium avium subsp. paratuberculosis
ccgguccgggucgcugagca

SEQ ID NO: 919062 - RNA, 21 nt, Mycobacterium avium subsp. paratuberculosis
ccgguccgugccacggccgcg

SEQ ID NO: 919063 - RNA, 15 nt, Mycobacterium avium subsp. paratuberculosis
ccgguccucugcgac

SEQ ID NO: 919064 - RNA, 22 nt, Mycobacterium avium subsp. paratuberculosis
ccgguccucugcgaccacccgg

SEQ ID NO: 919065 - RNA, 19 nt, Mycobacterium avium subsp. paratuberculosis
ccgguccuggccaacucga

SEQ ID NO: 919066 - RNA, 20 nt, Mycobacterium avium subsp. paratuberculosis
ccgguccgcugugcggcccg

SEQ ID NO: 919067 - RNA, 14 nt, Mycobacterium avium subsp. paratuberculosis
ccgguccggcccgg

SEQ ID NO: 919068 - RNA, 22 nt, Mycobacterium avium subsp. paratuberculosis
ccgguccggcccuggucggcca

SEQ ID NO: 919069 - RNA, 23 nt, Mycobacterium avium subsp. paratuberculosis
ccgguccggcccuggucggccag

SEQ ID NO: 919070 - RNA, 15 nt, Mycobacterium avium subsp. paratuberculosis
ccgguccggcggcac

SEQ ID NO: 919071 - RNA, 20 nt, Mycobacterium avium subsp. paratuberculosis
ccgguccggcggcaccaccc

SEQ ID NO: 919072 - RNA, 22 nt, Mycobacterium avium subsp. paratuberculosis
ccgguccggcggcaccacccgc

SEQ ID NO: 919073 - RNA, 15 nt, Mycobacterium avium subsp. paratuberculosis
ccgguccgaccagcg

SEQ ID NO: 919074 - RNA, 13 nt, Mycobacterium avium subsp. paratuberculosis
ccgguccgaccgc

SEQ ID NO: 919075 - RNA, 18 nt, Mycobacterium avium subsp. paratuberculosis
ccgguccgaccgccacca

SEQ ID NO: 919076 - RNA, 15 nt, Mycobacterium avium subsp. paratuberculosis
ccgguccgccgccgg

SEQ ID NO: 919077 - RNA, 17 nt, Mycobacterium avium subsp. paratuberculosis
ccgguccgccgccggcg

SEQ ID NO: 919078 - RNA, 13 nt, Mycobacterium avium subsp. paratuberculosis
ccgguccagaucg

SEQ ID NO: 919079 - RNA, 16 nt, Mycobacterium avium subsp. paratuberculosis
ccgguccagaucggcg

SEQ ID NO: 919080 - RNA, 17 nt, Mycobacterium avium subsp. paratuberculosis
ccgguccagaucggcgc

SEQ ID NO: 919081 - RNA, 20 nt, Mycobacterium avium subsp. paratuberculosis
ccgguccccggagucgucga

SEQ ID NO: 919082 - RNA, 14 nt, Mycobacterium avium subsp. paratuberculosis
ccgguccccggcga

SEQ ID NO: 919083 - RNA, 16 nt, Mycobacterium avium subsp. paratuberculosis
ccgguccccggcgacc

SEQ ID NO: 919084 - RNA, 15 nt, Mycobacterium avium subsp. paratuberculosis
ccggucccggggcuc

SEQ ID NO: 919085 - RNA, 22 nt, Mycobacterium avium subsp. paratuberculosis
ccggucccggggcucgacaggc

SEQ ID NO: 919086 - RNA, 19 nt, Mycobacterium avium subsp. paratuberculosis
ccggucccguugaucucgg

SEQ ID NO: 919087 - RNA, 13 nt, Mycobacterium avium subsp. paratuberculosis
ccggucggccgcg

SEQ ID NO: 919088 - RNA, 14 nt, Mycobacterium avium subsp. paratuberculosis
ccggucggccgcgu

SEQ ID NO: 919089 - RNA, 23 nt, Mycobacterium avium subsp. paratuberculosis
ccggucggaggccuuggugaugg

SEQ ID NO: 919090 - RNA, 17 nt, Mycobacterium avium subsp. paratuberculosis
ccggucggaguccagca

SEQ ID NO: 919091 - RNA, 22 nt, Mycobacterium avium subsp. paratuberculosis
ccggucgcgucgugcggccggc

SEQ ID NO: 919092 - RNA, 13 nt, Mycobacterium avium subsp. paratuberculosis
ccggucgcggccg

SEQ ID NO: 919093 - RNA, 17 nt, Mycobacterium avium subsp. paratuberculosis
ccggucgcugggcucga

SEQ ID NO: 919094 - RNA, 22 nt, Mycobacterium avium subsp. paratuberculosis
ccggucggaaaagugggucagc

SEQ ID NO: 919095 - RNA, 20 nt, Mycobacterium avium subsp. paratuberculosis
ccggucgccugcuucuggau

SEQ ID NO: 919096 - RNA, 14 nt, Mycobacterium avium subsp. paratuberculosis
ccggucgcgcaucg

SEQ ID NO: 919097 - RNA, 15 nt, Mycobacterium avium subsp. paratuberculosis
ccggucgcgcaucgc

SEQ ID NO: 919098 - RNA, 15 nt, Mycobacterium avium subsp. paratuberculosis
ccggucgccgggccg

SEQ ID NO: 919099 - RNA, 16 nt, Mycobacterium avium subsp. paratuberculosis
ccggucgccgggccgg

SEQ ID NO: 919100 - RNA, 23 nt, Mycobacterium avium subsp. paratuberculosis
ccggucgaugaauuccggugugc

SEQ ID NO: 919101 - RNA, 19 nt, Mycobacterium avium subsp. paratuberculosis
ccggucgaugucggcgaac

SEQ ID NO: 919102 - RNA, 23 nt, Mycobacterium avium subsp. paratuberculosis
ccggucgaugucggcgaaccagg

SEQ ID NO: 919103 - RNA, 14 nt, Mycobacterium avium subsp. paratuberculosis
ccggucgcagguga

SEQ ID NO: 919104 - RNA, 15 nt, Mycobacterium avium subsp. paratuberculosis
ccgggugaacccgac

SEQ ID NO: 919105 - RNA, 16 nt, Mycobacterium avium subsp. paratuberculosis
ccgggugaacgaggcc

SEQ ID NO: 919106 - RNA, 20 nt, Mycobacterium avium subsp. paratuberculosis
ccgggugaacgaggccgcgc

SEQ ID NO: 919107 - RNA, 19 nt, Mycobacterium avium subsp. paratuberculosis
ccggguggacgcccgcgag

SEQ ID NO: 919108 - RNA, 17 nt, Mycobacterium avium subsp. paratuberculosis
ccgggucgugcggcggc

SEQ ID NO: 919109 - RNA, 20 nt, Mycobacterium avium subsp. paratuberculosis
ccgggucuagaucuccaggc

SEQ ID NO: 919110 - RNA, 24 nt, Mycobacterium avium subsp. paratuberculosis
ccgggucuagaucuccaggcucga

SEQ ID NO: 919111 - RNA, 21 nt, Mycobacterium avium subsp. paratuberculosis
ccgggucugccacgcccaccg

SEQ ID NO: 919112 - RNA, 21 nt, Mycobacterium avium subsp. paratuberculosis
ccgggucuuccacgccgguga

SEQ ID NO: 919113 - RNA, 15 nt, Mycobacterium avium subsp. paratuberculosis
ccggguggcccgccc

SEQ ID NO: 919114 - RNA, 17 nt, Mycobacterium avium subsp. paratuberculosis
ccggguggcccgcccgg

SEQ ID NO: 919115 - RNA, 22 nt, Mycobacterium avium subsp. paratuberculosis
ccggguggcccgcgcgcugacc

SEQ ID NO: 919116 - RNA, 17 nt, Mycobacterium avium subsp. paratuberculosis
ccggguggccggggcca

SEQ ID NO: 919117 - RNA, 12 nt, Mycobacterium avium subsp. paratuberculosis
ccggguggccgu

SEQ ID NO: 919118 - RNA, 21 nt, Mycobacterium avium subsp. paratuberculosis
ccggguggcguccagaugccg

SEQ ID NO: 919119 - RNA, 15 nt, Mycobacterium avium subsp. paratuberculosis
ccgggugggccgacc

SEQ ID NO: 919120 - RNA, 16 nt, Mycobacterium avium subsp. paratuberculosis
ccgggugggccgaccu

SEQ ID NO: 919121 - RNA, 18 nt, Mycobacterium avium subsp. paratuberculosis
ccgggugggccgaccugc

SEQ ID NO: 919122 - RNA, 14 nt, Mycobacterium avium subsp. paratuberculosis
ccgggugggcggca

SEQ ID NO: 919123 - RNA, 22 nt, Mycobacterium avium subsp. paratuberculosis
ccgggugggcggcacaccgcgc

SEQ ID NO: 919124 - RNA, 14 nt, Mycobacterium avium subsp. paratuberculosis
ccgggugugggcgc

SEQ ID NO: 919125 - RNA, 18 nt, Mycobacterium avium subsp. paratuberculosis
ccgggugugggcgccguc

SEQ ID NO: 919126 - RNA, 17 nt, Mycobacterium avium subsp. paratuberculosis
ccgggugucgacgccgg

SEQ ID NO: 919127 - RNA, 23 nt, Mycobacterium avium subsp. paratuberculosis
ccgggugggcagccccagcgagc

SEQ ID NO: 919128 - RNA, 15 nt, Mycobacterium avium subsp. paratuberculosis
ccgggugggcagcgc

SEQ ID NO: 919129 - RNA, 20 nt, Mycobacterium avium subsp. paratuberculosis
ccggguguuggagccguccg

SEQ ID NO: 919130 - RNA, 18 nt, Mycobacterium avium subsp. paratuberculosis
ccggguucgacgccucgg

SEQ ID NO: 919131 - RNA, 22 nt, Mycobacterium avium subsp. paratuberculosis
ccggguucgacgccucggugcg

SEQ ID NO: 919132 - RNA, 13 nt, Mycobacterium avium subsp. paratuberculosis
ccgggucgucggu

SEQ ID NO: 919133 - RNA, 23 nt, Mycobacterium avium subsp. paratuberculosis
ccgggucguagccgaagccgccg

SEQ ID NO: 919134 - RNA, 17 nt, Mycobacterium avium subsp. paratuberculosis
ccgggucguaggccgga

SEQ ID NO: 919135 - RNA, 14 nt, Mycobacterium avium subsp. paratuberculosis
ccgggucguccgcg

SEQ ID NO: 919136 - RNA, 16 nt, Mycobacterium avium subsp. paratuberculosis
ccgggucguccgcgac

SEQ ID NO: 919137 - RNA, 21 nt, Mycobacterium avium subsp. paratuberculosis
ccgggucgcggcuggugccgc

SEQ ID NO: 919138 - RNA, 23 nt, Mycobacterium avium subsp. paratuberculosis
ccgggucgcggcuggugccgccg

SEQ ID NO: 919139 - RNA, 12 nt, Mycobacterium avium subsp. paratuberculosis
ccgggucgcggu

SEQ ID NO: 919140 - RNA, 14 nt, Mycobacterium avium subsp. paratuberculosis
ccgggcucgagcac

SEQ ID NO: 919141 - RNA, 16 nt, Mycobacterium avium subsp. paratuberculosis
ccgggcucgagcaccg

SEQ ID NO: 919142 - RNA, 21 nt, Mycobacterium avium subsp. paratuberculosis
ccgggcucgagcaccgaaacc

SEQ ID NO: 919143 - RNA, 19 nt, Mycobacterium avium subsp. paratuberculosis
ccgggcucgagggcggcga

SEQ ID NO: 919144 - RNA, 23 nt, Mycobacterium avium subsp. paratuberculosis
ccgggcucccgcuccauggcggc

SEQ ID NO: 919145 - RNA, 14 nt, Mycobacterium avium subsp. paratuberculosis
ccgggcuccgcguu

SEQ ID NO: 919146 - RNA, 18 nt, Mycobacterium avium subsp. paratuberculosis
ccgggcguucccgcgcgc

SEQ ID NO: 919147 - RNA, 19 nt, Mycobacterium avium subsp. paratuberculosis
ccgggcguucccgcgcgcg

SEQ ID NO: 919148 - RNA, 22 nt, Mycobacterium avium subsp. paratuberculosis
ccgggcguugcccgccgcggcg

SEQ ID NO: 919149 - RNA, 17 nt, Mycobacterium avium subsp. paratuberculosis
ccgggcuagacgcgcac

SEQ ID NO: 919150 - RNA, 17 nt, Mycobacterium avium subsp. paratuberculosis
ccgggcuaucgcccggc

SEQ ID NO: 919151 - RNA, 18 nt, Mycobacterium avium subsp. paratuberculosis
ccgggcuaucgcccggcg

SEQ ID NO: 919152 - RNA, 22 nt, Mycobacterium avium subsp. paratuberculosis
ccgggcuaucgcccggcgcccg

SEQ ID NO: 919153 - RNA, 13 nt, Mycobacterium avium subsp. paratuberculosis
ccgggcgcuggcg

SEQ ID NO: 919154 - RNA, 20 nt, Mycobacterium avium subsp. paratuberculosis
ccgguaccacgccgucgacg

SEQ ID NO: 919155 - RNA, 13 nt, Mycobacterium avium subsp. paratuberculosis
ccgguacaggucg

SEQ ID NO: 919156 - RNA, 23 nt, Mycobacterium avium subsp. paratuberculosis
ccgguacaggucgcugcccggcg

SEQ ID NO: 919157 - RNA, 13 nt, Mycobacterium avium subsp. paratuberculosis
ccgguaccgccgg

SEQ ID NO: 919158 - RNA, 16 nt, Mycobacterium avium subsp. paratuberculosis
ccgguaccgccggcca

SEQ ID NO: 919159 - RNA, 21 nt, Mycobacterium avium subsp. paratuberculosis
ccgguaccgccggccaggcga

SEQ ID NO: 919160 - RNA, 20 nt, Mycobacterium avium subsp. paratuberculosis
ccgguagaagaccaccucgg

SEQ ID NO: 919161 - RNA, 15 nt, Mycobacterium avium subsp. paratuberculosis
ccgguagaucagcgc

SEQ ID NO: 919162 - RNA, 19 nt, Mycobacterium avium subsp. paratuberculosis
ccgguagaucgccggaucg

SEQ ID NO: 919163 - RNA, 23 nt, Mycobacterium avium subsp. paratuberculosis
ccgguagaucgccggaucgagca

SEQ ID NO: 919164 - RNA, 18 nt, Mycobacterium avium subsp. paratuberculosis
ccgguacggaucgccgga

SEQ ID NO: 919165 - RNA, 17 nt, Mycobacterium avium subsp. paratuberculosis
ccgguacggccgacgcc

SEQ ID NO: 919166 - RNA, 18 nt, Mycobacterium avium subsp. paratuberculosis
ccgguacggcucaacggc

SEQ ID NO: 919167 - RNA, 13 nt, Mycobacterium avium subsp. paratuberculosis
ccgguacggcucg

SEQ ID NO: 919168 - RNA, 22 nt, Mycobacterium avium subsp. paratuberculosis
ccgguagagcggcaccagguuc

SEQ ID NO: 919169 - RNA, 16 nt, Mycobacterium avium subsp. paratuberculosis
ccgguagccagcaccg

SEQ ID NO: 919170 - RNA, 18 nt, Mycobacterium avium subsp. paratuberculosis
ccgguagccagcaccgcc

SEQ ID NO: 919171 - RNA, 15 nt, Mycobacterium avium subsp. paratuberculosis
ccgguagccgcucgc

SEQ ID NO: 919172 - RNA, 20 nt, Mycobacterium avium subsp. paratuberculosis
ccgguagccgcucgcccagc

SEQ ID NO: 919173 - RNA, 22 nt, Mycobacterium avium subsp. paratuberculosis
ccgguagcgacacggaaaccgc

SEQ ID NO: 919174 - RNA, 19 nt, Mycobacterium avium subsp. paratuberculosis
ccggguuucgaagacgccc

SEQ ID NO: 919175 - RNA, 14 nt, Mycobacterium avium subsp. paratuberculosis
ccggguuucggccc

SEQ ID NO: 919176 - RNA, 16 nt, Mycobacterium avium subsp. paratuberculosis
ccggguuucggcccgg

SEQ ID NO: 919177 - RNA, 17 nt, Mycobacterium avium subsp. paratuberculosis
ccggguuucggcccggc

SEQ ID NO: 919178 - RNA, 19 nt, Mycobacterium avium subsp. paratuberculosis
ccggguuucggcccggcuc

SEQ ID NO: 919179 - RNA, 15 nt, Mycobacterium avium subsp. paratuberculosis
ccggguuguccuggc

SEQ ID NO: 919180 - RNA, 17 nt, Mycobacterium avium subsp. paratuberculosis
ccggguugucgacgugg

SEQ ID NO: 919181 - RNA, 17 nt, Mycobacterium avium subsp. paratuberculosis
ccggguuuucgggccgg

SEQ ID NO: 919182 - RNA, 17 nt, Mycobacterium avium subsp. paratuberculosis
ccggguugggcgccugc

SEQ ID NO: 919183 - RNA, 17 nt, Mycobacterium avium subsp. paratuberculosis
ccggguugggcggcggc

SEQ ID NO: 919184 - RNA, 19 nt, Mycobacterium avium subsp. paratuberculosis
ccggguugggcggcggcca

SEQ ID NO: 919185 - RNA, 13 nt, Mycobacterium avium subsp. paratuberculosis
ccggguugcaggc

SEQ ID NO: 919186 - RNA, 16 nt, Mycobacterium avium subsp. paratuberculosis
ccggguugcgugcagc

SEQ ID NO: 919187 - RNA, 17 nt, Mycobacterium avium subsp. paratuberculosis
ccgguacagcgccgcgg

SEQ ID NO: 919188 - RNA, 18 nt, Mycobacterium avium subsp. paratuberculosis
ccgguacagcgccgcggc

SEQ ID NO: 919189 - RNA, 20 nt, Mycobacterium avium subsp. paratuberculosis
ccgguacagcgccgcggcca

SEQ ID NO: 919190 - RNA, 13 nt, Mycobacterium avium subsp. paratuberculosis
ccggucguggggc

SEQ ID NO: 919191 - RNA, 22 nt, Mycobacterium avium subsp. paratuberculosis
ccggucgugucaugugccucgc

SEQ ID NO: 919192 - RNA, 19 nt, Mycobacterium avium subsp. paratuberculosis
ccggucguuacgacucggc

SEQ ID NO: 919193 - RNA, 21 nt, Mycobacterium avium subsp. paratuberculosis
ccggucguuguuuuggccgug

SEQ ID NO: 919194 - RNA, 19 nt, Mycobacterium avium subsp. paratuberculosis
ccggucguuucggccggcc

SEQ ID NO: 919195 - RNA, 19 nt, Mycobacterium avium subsp. paratuberculosis
ccggucuccaugucgucgg

SEQ ID NO: 919196 - RNA, 23 nt, Mycobacterium avium subsp. paratuberculosis
ccggucuccaugucgucggcgga

SEQ ID NO: 919197 - RNA, 13 nt, Mycobacterium avium subsp. paratuberculosis
ccggucucgaccg

SEQ ID NO: 919198 - RNA, 21 nt, Mycobacterium avium subsp. paratuberculosis
ccggucucgaccgcggcgccg

SEQ ID NO: 919199 - RNA, 14 nt, Mycobacterium avium subsp. paratuberculosis
ccggucucggucgc

SEQ ID NO: 919200 - RNA, 17 nt, Mycobacterium avium subsp. paratuberculosis
ccggucucggucgcggc

SEQ ID NO: 919201 - RNA, 21 nt, Mycobacterium avium subsp. paratuberculosis
ccggucucggucgcggcgucg

SEQ ID NO: 919202 - RNA, 18 nt, Mycobacterium avium subsp. paratuberculosis
ccggucugaucgcccagc

SEQ ID NO: 919203 - RNA, 22 nt, Mycobacterium avium subsp. paratuberculosis
ccggucugaucgcccagcaccg

SEQ ID NO: 919204 - RNA, 14 nt, Mycobacterium avium subsp. paratuberculosis
ccggucugcggccg

SEQ ID NO: 919205 - RNA, 19 nt, Mycobacterium avium subsp. paratuberculosis
ccggucugcggccgcgacu

SEQ ID NO: 919206 - RNA, 19 nt, Mycobacterium avium subsp. paratuberculosis
ccggucggcgcucgcgggu

SEQ ID NO: 919207 - RNA, 13 nt, Mycobacterium avium subsp. paratuberculosis
ccggucgggaucg

SEQ ID NO: 919208 - RNA, 16 nt, Mycobacterium avium subsp. paratuberculosis
ccggucgggauggcgg

SEQ ID NO: 919209 - RNA, 14 nt, Mycobacterium avium subsp. paratuberculosis
ccggucgggccaac

SEQ ID NO: 919210 - RNA, 21 nt, Mycobacterium avium subsp. paratuberculosis
ccggucggucagucgcgccgc

SEQ ID NO: 919211 - RNA, 23 nt, Mycobacterium avium subsp. paratuberculosis
ccggucggucagucgcgccgcca

SEQ ID NO: 919212 - RNA, 17 nt, Mycobacterium avium subsp. paratuberculosis
ccggucggucggccgca

SEQ ID NO: 919213 - RNA, 18 nt, Mycobacterium avium subsp. paratuberculosis
ccggucggucggccgcac

SEQ ID NO: 919214 - RNA, 20 nt, Mycobacterium avium subsp. paratuberculosis
ccggucggugagcuggccgc

SEQ ID NO: 919215 - RNA, 16 nt, Mycobacterium avium subsp. paratuberculosis
ccggucggugcccagc

SEQ ID NO: 919216 - RNA, 22 nt, Mycobacterium avium subsp. paratuberculosis
ccggucggugcccagcaccgcc

SEQ ID NO: 919217 - RNA, 14 nt, Mycobacterium avium subsp. paratuberculosis
ccggucguagucgg

SEQ ID NO: 919218 - RNA, 16 nt, Mycobacterium avium subsp. paratuberculosis
ccggucguagucggcc

SEQ ID NO: 919219 - RNA, 17 nt, Mycobacterium avium subsp. paratuberculosis
ccggucguagucggccc

SEQ ID NO: 919220 - RNA, 18 nt, Mycobacterium avium subsp. paratuberculosis
ccggucguagucggcccg

SEQ ID NO: 919221 - RNA, 14 nt, Mycobacterium avium subsp. paratuberculosis
ccggucgucgagca

SEQ ID NO: 919222 - RNA, 19 nt, Mycobacterium avium subsp. paratuberculosis
ccggucgucgagcaccggc

SEQ ID NO: 919223 - RNA, 13 nt, Mycobacterium avium subsp. paratuberculosis
ccggucgucgccg

SEQ ID NO: 919224 - RNA, 14 nt, Mycobacterium avium subsp. paratuberculosis
ccggugccgccggc

SEQ ID NO: 919225 - RNA, 23 nt, Mycobacterium avium subsp. paratuberculosis
ccggugccgcccaucgaccggau

SEQ ID NO: 919226 - RNA, 18 nt, Mycobacterium avium subsp. paratuberculosis
ccggugaccccgucgaac

SEQ ID NO: 919227 - RNA, 19 nt, Mycobacterium avium subsp. paratuberculosis
ccggugcccgagaucaccg

SEQ ID NO: 919228 - RNA, 13 nt, Mycobacterium avium subsp. paratuberculosis
ccggugccgacga

SEQ ID NO: 919229 - RNA, 18 nt, Mycobacterium avium subsp. paratuberculosis
ccggugccgagcgcgcuu

SEQ ID NO: 919230 - RNA, 17 nt, Mycobacterium avium subsp. paratuberculosis
ccggugccgcagccguc

SEQ ID NO: 919231 - RNA, 19 nt, Mycobacterium avium subsp. paratuberculosis
ccggugccgcagccguccc

SEQ ID NO: 919232 - RNA, 19 nt, Mycobacterium avium subsp. paratuberculosis
ccggugccgcagugccggc

SEQ ID NO: 919233 - RNA, 20 nt, Mycobacterium avium subsp. paratuberculosis
ccggugccgcagugccggcg

SEQ ID NO: 919234 - RNA, 13 nt, Mycobacterium avium subsp. paratuberculosis
ccggugaccgccu

SEQ ID NO: 919235 - RNA, 16 nt, Mycobacterium avium subsp. paratuberculosis
ccggugaccgccucgu

SEQ ID NO: 919236 - RNA, 19 nt, Mycobacterium avium subsp. paratuberculosis
ccggugaccgccucgucga

SEQ ID NO: 919237 - RNA, 12 nt, Mycobacterium avium subsp. paratuberculosis
ccggugaccgcg

SEQ ID NO: 919238 - RNA, 14 nt, Mycobacterium avium subsp. paratuberculosis
ccggugaccgcgac

SEQ ID NO: 919239 - RNA, 17 nt, Mycobacterium avium subsp. paratuberculosis
ccggugaagaucagcgc

SEQ ID NO: 919240 - RNA, 18 nt, Mycobacterium avium subsp. paratuberculosis
ccggugaagaucagcgcg

SEQ ID NO: 919241 - RNA, 16 nt, Mycobacterium avium subsp. paratuberculosis
ccggugaagaucgccc

SEQ ID NO: 919242 - RNA, 18 nt, Mycobacterium avium subsp. paratuberculosis
ccggugaagaucgcccgc

SEQ ID NO: 919243 - RNA, 22 nt, Mycobacterium avium subsp. paratuberculosis
ccggugaagaucgcccgccgcg

SEQ ID NO: 919244 - RNA, 19 nt, Mycobacterium avium subsp. paratuberculosis
ccggugaagcgggacagca

SEQ ID NO: 919245 - RNA, 18 nt, Mycobacterium avium subsp. paratuberculosis
ccggugaaaccggcgccg

SEQ ID NO: 919246 - RNA, 19 nt, Mycobacterium avium subsp. paratuberculosis
ccggugaaaccggcgccga

SEQ ID NO: 919247 - RNA, 19 nt, Mycobacterium avium subsp. paratuberculosis
ccggucuuggacagcagca

SEQ ID NO: 919248 - RNA, 16 nt, Mycobacterium avium subsp. paratuberculosis
ccggucuucucggcca

SEQ ID NO: 919249 - RNA, 17 nt, Mycobacterium avium subsp. paratuberculosis
ccggucuucucggccag

SEQ ID NO: 919250 - RNA, 19 nt, Mycobacterium avium subsp. paratuberculosis
ccggucuucucggccaggc

SEQ ID NO: 919251 - RNA, 16 nt, Mycobacterium avium subsp. paratuberculosis
ccggucuuggacagca

SEQ ID NO: 919252 - RNA, 15 nt, Mycobacterium avium subsp. paratuberculosis
ccggugccguugauc

SEQ ID NO: 919253 - RNA, 13 nt, Mycobacterium avium subsp. paratuberculosis
ccggugccggccg

SEQ ID NO: 919254 - RNA, 13 nt, Mycobacterium avium subsp. paratuberculosis
ccggugcgccggu

SEQ ID NO: 919255 - RNA, 21 nt, Mycobacterium avium subsp. paratuberculosis
ccggugcgcgcaccaggccga

SEQ ID NO: 919256 - RNA, 19 nt, Mycobacterium avium subsp. paratuberculosis
ccggugcgcgucagccguc

SEQ ID NO: 919257 - RNA, 13 nt, Mycobacterium avium subsp. paratuberculosis
ccggugcgagccg

SEQ ID NO: 919258 - RNA, 17 nt, Mycobacterium avium subsp. paratuberculosis
ccggugcgccagcguga

SEQ ID NO: 919259 - RNA, 13 nt, Mycobacterium avium subsp. paratuberculosis
ccggugcgccgac

SEQ ID NO: 919260 - RNA, 20 nt, Mycobacterium avium subsp. paratuberculosis
ccggugcgccgaccgcgauc

SEQ ID NO: 919261 - RNA, 22 nt, Mycobacterium avium subsp. paratuberculosis
ccgguggaauucuggccgaccg

SEQ ID NO: 919262 - RNA, 23 nt, Mycobacterium avium subsp. paratuberculosis
ccggugcuggucaugccgucgac

SEQ ID NO: 919263 - RNA, 14 nt, Mycobacterium avium subsp. paratuberculosis
ccggugcuguccac

SEQ ID NO: 919264 - RNA, 19 nt, Mycobacterium avium subsp. paratuberculosis
ccggugcugacccggucgc

SEQ ID NO: 919265 - RNA, 22 nt, Mycobacterium avium subsp. paratuberculosis
ccggugcugacccggucgcggc

SEQ ID NO: 919266 - RNA, 14 nt, Mycobacterium avium subsp. paratuberculosis
ccggugcugcucga

SEQ ID NO: 919267 - RNA, 15 nt, Mycobacterium avium subsp. paratuberculosis
ccggugcugcucgag

SEQ ID NO: 919268 - RNA, 15 nt, Mycobacterium avium subsp. paratuberculosis
ccggugcguccgccg

SEQ ID NO: 919269 - RNA, 19 nt, Mycobacterium avium subsp. paratuberculosis
ccggugcguccgccggcgg

SEQ ID NO: 919270 - RNA, 16 nt, Mycobacterium avium subsp. paratuberculosis
ccgguguugccgacgg

SEQ ID NO: 919271 - RNA, 17 nt, Mycobacterium avium subsp. paratuberculosis
ccgguggugucgacggu

SEQ ID NO: 919272 - RNA, 14 nt, Mycobacterium avium subsp. paratuberculosis
ccgguggucccggu

SEQ ID NO: 919273 - RNA, 18 nt, Mycobacterium avium subsp. paratuberculosis
ccgguggucccggucagc

SEQ ID NO: 919274 - RNA, 16 nt, Mycobacterium avium subsp. paratuberculosis
ccggugggcggcgccc

SEQ ID NO: 919275 - RNA, 15 nt, Mycobacterium avium subsp. paratuberculosis
ccgguggacaggugc

SEQ ID NO: 919276 - RNA, 21 nt, Mycobacterium avium subsp. paratuberculosis
ccgguggggugaugaggucgc

SEQ ID NO: 919277 - RNA, 15 nt, Mycobacterium avium subsp. paratuberculosis
ccgguggucaacgcg

SEQ ID NO: 919278 - RNA, 20 nt, Mycobacterium avium subsp. paratuberculosis
ccgguggucaacgcgcacau

SEQ ID NO: 919279 - RNA, 22 nt, Mycobacterium avium subsp. paratuberculosis
ccgucacgccguauucgccgac

SEQ ID NO: 919280 - RNA, 18 nt, Mycobacterium avium subsp. paratuberculosis
ccgucacggaucgcccac

SEQ ID NO: 919281 - RNA, 15 nt, Mycobacterium avium subsp. paratuberculosis
ccgucacggccgucc

SEQ ID NO: 919282 - RNA, 16 nt, Mycobacterium avium subsp. paratuberculosis
ccgucacggccgucca

SEQ ID NO: 919283 - RNA, 19 nt, Mycobacterium avium subsp. paratuberculosis
ccgucacguagcgcggccg

SEQ ID NO: 919284 - RNA, 20 nt, Mycobacterium avium subsp. paratuberculosis
ccgucacguagcgcggccgc

SEQ ID NO: 919285 - RNA, 14 nt, Mycobacterium avium subsp. paratuberculosis
ccgucacggcugcc

SEQ ID NO: 919286 - RNA, 17 nt, Mycobacterium avium subsp. paratuberculosis
ccgucacggcugccgac

SEQ ID NO: 919287 - RNA, 20 nt, Mycobacterium avium subsp. paratuberculosis
ccgucacggcugccgaccuc

SEQ ID NO: 919288 - RNA, 13 nt, Mycobacterium avium subsp. paratuberculosis
ccgucaccggcug

SEQ ID NO: 919289 - RNA, 17 nt, Mycobacterium avium subsp. paratuberculosis
ccgucaccggcugcccg

SEQ ID NO: 919290 - RNA, 23 nt, Mycobacterium avium subsp. paratuberculosis
ccgucaccgccuccuggcuggag

SEQ ID NO: 919291 - RNA, 16 nt, Mycobacterium avium subsp. paratuberculosis
ccguagcggugggcgc

SEQ ID NO: 919292 - RNA, 15 nt, Mycobacterium avium subsp. paratuberculosis
ccgucaccggccauc

SEQ ID NO: 919293 - RNA, 23 nt, Mycobacterium avium subsp. paratuberculosis
ccgucaccgccaggaccacccac

SEQ ID NO: 919294 - RNA, 16 nt, Mycobacterium avium subsp. paratuberculosis
ccgucaccgccgcacc

SEQ ID NO: 919295 - RNA, 17 nt, Mycobacterium avium subsp. paratuberculosis
ccguccagcccagcgcc

SEQ ID NO: 919296 - RNA, 12 nt, Mycobacterium avium subsp. paratuberculosis
ccguccaccggc

SEQ ID NO: 919297 - RNA, 13 nt, Mycobacterium avium subsp. paratuberculosis
ccguccaccggca

SEQ ID NO: 919298 - RNA, 20 nt, Mycobacterium avium subsp. paratuberculosis
ccguccagccgugcggcacg

SEQ ID NO: 919299 - RNA, 15 nt, Mycobacterium avium subsp. paratuberculosis
ccguccaccagaucg

SEQ ID NO: 919300 - RNA, 17 nt, Mycobacterium avium subsp. paratuberculosis
ccguccacccggcccac

SEQ ID NO: 919301 - RNA, 21 nt, Mycobacterium avium subsp. paratuberculosis
ccguccacccggcccaccacc

SEQ ID NO: 919302 - RNA, 19 nt, Mycobacterium avium subsp. paratuberculosis
ccguccagaucggccagcg

SEQ ID NO: 919303 - RNA, 19 nt, Mycobacterium avium subsp. paratuberculosis
ccguccagcaacgccgaca

SEQ ID NO: 919304 - RNA, 19 nt, Mycobacterium avium subsp. paratuberculosis
ccguccagcagcagcgcgc

SEQ ID NO: 919305 - RNA, 16 nt, Mycobacterium avium subsp. paratuberculosis
ccguccacggcggugg

SEQ ID NO: 919306 - RNA, 17 nt, Mycobacterium avium subsp. paratuberculosis
ccgucacgucauuucgg

SEQ ID NO: 919307 - RNA, 22 nt, Mycobacterium avium subsp. paratuberculosis
ccgucacgucauuucggucggc

SEQ ID NO: 919308 - RNA, 18 nt, Mycobacterium avium subsp. paratuberculosis
ccgucacguucaccaccg

SEQ ID NO: 919309 - RNA, 18 nt, Mycobacterium avium subsp. paratuberculosis
ccgucacugcacgcacgg

SEQ ID NO: 919310 - RNA, 19 nt, Mycobacterium avium subsp. paratuberculosis
ccgucacugcacgcacggc

SEQ ID NO: 919311 - RNA, 13 nt, Mycobacterium avium subsp. paratuberculosis
ccguccaggccgc

SEQ ID NO: 919312 - RNA, 15 nt, Mycobacterium avium subsp. paratuberculosis
ccguccaggccgcug

SEQ ID NO: 919313 - RNA, 14 nt, Mycobacterium avium subsp. paratuberculosis
ccguccaggcgcca

SEQ ID NO: 919314 - RNA, 22 nt, Mycobacterium avium subsp. paratuberculosis
ccguccaucgccgcgcacccgg

SEQ ID NO: 919315 - RNA, 13 nt, Mycobacterium avium subsp. paratuberculosis
ccguccggcgcca

SEQ ID NO: 919316 - RNA, 15 nt, Mycobacterium avium subsp. paratuberculosis
ccguccggcgccagc

SEQ ID NO: 919317 - RNA, 20 nt, Mycobacterium avium subsp. paratuberculosis
ccguccgguucggcggcaua

SEQ ID NO: 919318 - RNA, 17 nt, Mycobacterium avium subsp. paratuberculosis
ccguccucggccgccac

SEQ ID NO: 919319 - RNA, 21 nt, Mycobacterium avium subsp. paratuberculosis
ccguccucggccgccaccgcc

SEQ ID NO: 919320 - RNA, 14 nt, Mycobacterium avium subsp. paratuberculosis
ccguccugggccug

SEQ ID NO: 919321 - RNA, 14 nt, Mycobacterium avium subsp. paratuberculosis
ccguccuggucguc

SEQ ID NO: 919322 - RNA, 15 nt, Mycobacterium avium subsp. paratuberculosis
ccguccgggccggcc

SEQ ID NO: 919323 - RNA, 16 nt, Mycobacterium avium subsp. paratuberculosis
ccguccgggcacccga

SEQ ID NO: 919324 - RNA, 17 nt, Mycobacterium avium subsp. paratuberculosis
ccguccgggcacccgac

SEQ ID NO: 919325 - RNA, 20 nt, Mycobacterium avium subsp. paratuberculosis
ccguccggauagccgucggc

SEQ ID NO: 919326 - RNA, 22 nt, Mycobacterium avium subsp. paratuberculosis
ccguccggauagccgucggcgg

SEQ ID NO: 919327 - RNA, 23 nt, Mycobacterium avium subsp. paratuberculosis
ccguccgggguguaggcgucggc

SEQ ID NO: 919328 - RNA, 18 nt, Mycobacterium avium subsp. paratuberculosis
ccguccgggucgcacagc

SEQ ID NO: 919329 - RNA, 14 nt, Mycobacterium avium subsp. paratuberculosis
ccguccggucgcug

SEQ ID NO: 919330 - RNA, 15 nt, Mycobacterium avium subsp. paratuberculosis
ccguagaauccgccg

SEQ ID NO: 919331 - RNA, 16 nt, Mycobacterium avium subsp. paratuberculosis
ccguagaauccgccgu

SEQ ID NO: 919332 - RNA, 18 nt, Mycobacterium avium subsp. paratuberculosis
ccguagaauccgccguug

SEQ ID NO: 919333 - RNA, 18 nt, Mycobacterium avium subsp. paratuberculosis
ccguacuugacgugcgac

SEQ ID NO: 919334 - RNA, 21 nt, Mycobacterium avium subsp. paratuberculosis
ccguagaacaguucgacguag

SEQ ID NO: 919335 - RNA, 13 nt, Mycobacterium avium subsp. paratuberculosis
ccguagaccagca

SEQ ID NO: 919336 - RNA, 19 nt, Mycobacterium avium subsp. paratuberculosis
ccguagaucacgccgguga

SEQ ID NO: 919337 - RNA, 17 nt, Mycobacterium avium subsp. paratuberculosis
ccguagaucucgcgccg

SEQ ID NO: 919338 - RNA, 23 nt, Mycobacterium avium subsp. paratuberculosis
ccguagaugccgguacggccgac

SEQ ID NO: 919339 - RNA, 23 nt, Mycobacterium avium subsp. paratuberculosis
ccguagaugcggcccagcccggc

SEQ ID NO: 919340 - RNA, 18 nt, Mycobacterium avium subsp. paratuberculosis
ccguagccggcgguggcc

SEQ ID NO: 919341 - RNA, 14 nt, Mycobacterium avium subsp. paratuberculosis
ccgguuccagcggc

SEQ ID NO: 919342 - RNA, 18 nt, Mycobacterium avium subsp. paratuberculosis
ccgguuccaaccaccgug

SEQ ID NO: 919343 - RNA, 22 nt, Mycobacterium avium subsp. paratuberculosis
ccgguuccaaccaccguggccc

SEQ ID NO: 919344 - RNA, 13 nt, Mycobacterium avium subsp. paratuberculosis
ccgguuccaccgg

SEQ ID NO: 919345 - RNA, 15 nt, Mycobacterium avium subsp. paratuberculosis
ccgguuccaccgggc

SEQ ID NO: 919346 - RNA, 17 nt, Mycobacterium avium subsp. paratuberculosis
ccgguuccaccgggccg

SEQ ID NO: 919347 - RNA, 20 nt, Mycobacterium avium subsp. paratuberculosis
ccgguuccaccgggccgcca

SEQ ID NO: 919348 - RNA, 21 nt, Mycobacterium avium subsp. paratuberculosis
ccgguuccaccgggccgccau

SEQ ID NO: 919349 - RNA, 22 nt, Mycobacterium avium subsp. paratuberculosis
ccguacucgggugggggcgugg

SEQ ID NO: 919350 - RNA, 14 nt, Mycobacterium avium subsp. paratuberculosis
ccgguucgaccggc

SEQ ID NO: 919351 - RNA, 16 nt, Mycobacterium avium subsp. paratuberculosis
ccgguucccgugcugg

SEQ ID NO: 919352 - RNA, 17 nt, Mycobacterium avium subsp. paratuberculosis
ccgguucccgugcuggc

SEQ ID NO: 919353 - RNA, 13 nt, Mycobacterium avium subsp. paratuberculosis
ccgguuccgcgac

SEQ ID NO: 919354 - RNA, 14 nt, Mycobacterium avium subsp. paratuberculosis
ccgguuccgggcga

SEQ ID NO: 919355 - RNA, 17 nt, Mycobacterium avium subsp. paratuberculosis
ccguagcucgcgccgac

SEQ ID NO: 919356 - RNA, 19 nt, Mycobacterium avium subsp. paratuberculosis
ccguagcucgcgccgaccc

SEQ ID NO: 919357 - RNA, 15 nt, Mycobacterium avium subsp. paratuberculosis
ccguagcgcugggug

SEQ ID NO: 919358 - RNA, 17 nt, Mycobacterium avium subsp. paratuberculosis
ccguagcggcccaggua

SEQ ID NO: 919359 - RNA, 23 nt, Mycobacterium avium subsp. paratuberculosis
ccguagccggaccgcuugacgcc

SEQ ID NO: 919360 - RNA, 21 nt, Mycobacterium avium subsp. paratuberculosis
ccguagcgagcgcuggccuug

SEQ ID NO: 919361 - RNA, 16 nt, Mycobacterium avium subsp. paratuberculosis
ccguagcgcaacaccg

SEQ ID NO: 919362 - RNA, 16 nt, Mycobacterium avium subsp. paratuberculosis
ccgucacccccggcgc

SEQ ID NO: 919363 - RNA, 19 nt, Mycobacterium avium subsp. paratuberculosis
ccgucacccccggcgcgac

SEQ ID NO: 919364 - RNA, 22 nt, Mycobacterium avium subsp. paratuberculosis
ccgucacccccggcgcgacggc

SEQ ID NO: 919365 - RNA, 21 nt, Mycobacterium avium subsp. paratuberculosis
ccguaggccgcgcugaacgcg

SEQ ID NO: 919366 - RNA, 15 nt, Mycobacterium avium subsp. paratuberculosis
ccguagucacccggc

SEQ ID NO: 919367 - RNA, 17 nt, Mycobacterium avium subsp. paratuberculosis
ccgcagauacaucucgg

SEQ ID NO: 919368 - RNA, 17 nt, Mycobacterium avium subsp. paratuberculosis
ccgcagcaccaccucgu

SEQ ID NO: 919369 - RNA, 22 nt, Mycobacterium avium subsp. paratuberculosis
ccgcagcaccaccucgugcaca

SEQ ID NO: 919370 - RNA, 13 nt, Mycobacterium avium subsp. paratuberculosis
ccgcagcaccagg

SEQ ID NO: 919371 - RNA, 16 nt, Mycobacterium avium subsp. paratuberculosis
ccgcagccagcgcagc

SEQ ID NO: 919372 - RNA, 15 nt, Mycobacterium avium subsp. paratuberculosis
ccgcagcccaggccc

SEQ ID NO: 919373 - RNA, 18 nt, Mycobacterium avium subsp. paratuberculosis
ccgcagcccaggcccagc

SEQ ID NO: 919374 - RNA, 19 nt, Mycobacterium avium subsp. paratuberculosis
ccgcagcccaggcccagca

SEQ ID NO: 919375 - RNA, 15 nt, Mycobacterium avium subsp. paratuberculosis
ccgcagccgcgcggc

SEQ ID NO: 919376 - RNA, 20 nt, Mycobacterium avium subsp. paratuberculosis
ccgcagccgcgcggccggcc

SEQ ID NO: 919377 - RNA, 16 nt, Mycobacterium avium subsp. paratuberculosis
ccgcagccgcuggccg

SEQ ID NO: 919378 - RNA, 19 nt, Mycobacterium avium subsp. paratuberculosis
ccgcagccgcuggccgcgc

SEQ ID NO: 919379 - RNA, 20 nt, Mycobacterium avium subsp. paratuberculosis
ccgcagccgcuggccgcgcc

SEQ ID NO: 919380 - RNA, 13 nt, Mycobacterium avium subsp. paratuberculosis
ccgcagccgggug

SEQ ID NO: 919381 - RNA, 15 nt, Mycobacterium avium subsp. paratuberculosis
ccgcagccgggugcg

SEQ ID NO: 919382 - RNA, 18 nt, Mycobacterium avium subsp. paratuberculosis
ccgcagccgggugcgggc

SEQ ID NO: 919383 - RNA, 20 nt, Mycobacterium avium subsp. paratuberculosis
ccgcagccgggugcgggcca

SEQ ID NO: 919384 - RNA, 14 nt, Mycobacterium avium subsp. paratuberculosis
ccgcagccgggugg

SEQ ID NO: 919385 - RNA, 20 nt, Mycobacterium avium subsp. paratuberculosis
ccgcagcaggugcaucgcca

SEQ ID NO: 919386 - RNA, 15 nt, Mycobacterium avium subsp. paratuberculosis
ccgcagcaggugcgc

SEQ ID NO: 919387 - RNA, 12 nt, Mycobacterium avium subsp. paratuberculosis
ccgcagcacgcc

SEQ ID NO: 919388 - RNA, 14 nt, Mycobacterium avium subsp. paratuberculosis
ccgcagcacgcccg

SEQ ID NO: 919389 - RNA, 13 nt, Mycobacterium avium subsp. paratuberculosis
ccgcagcacgcug

SEQ ID NO: 919390 - RNA, 14 nt, Mycobacterium avium subsp. paratuberculosis
ccgcagcagccgcg

SEQ ID NO: 919391 - RNA, 16 nt, Mycobacterium avium subsp. paratuberculosis
ccgcagcagccgcgcc

SEQ ID NO: 919392 - RNA, 22 nt, Mycobacterium avium subsp. paratuberculosis
ccgcagcagccgcgccaccgcg

SEQ ID NO: 919393 - RNA, 17 nt, Mycobacterium avium subsp. paratuberculosis
ccgcagaacaccagcgc

SEQ ID NO: 919394 - RNA, 16 nt, Mycobacterium avium subsp. paratuberculosis
ccgcacuuggccucgg

SEQ ID NO: 919395 - RNA, 17 nt, Mycobacterium avium subsp. paratuberculosis
ccgcacuuggccucggg

SEQ ID NO: 919396 - RNA, 20 nt, Mycobacterium avium subsp. paratuberculosis
ccgcacuuggccucgggcga

SEQ ID NO: 919397 - RNA, 21 nt, Mycobacterium avium subsp. paratuberculosis
ccgcacuuggccucgggcgac

SEQ ID NO: 919398 - RNA, 18 nt, Mycobacterium avium subsp. paratuberculosis
ccgcacugcacggccucg

SEQ ID NO: 919399 - RNA, 19 nt, Mycobacterium avium subsp. paratuberculosis
ccgcacugcacggccucgg

SEQ ID NO: 919400 - RNA, 15 nt, Mycobacterium avium subsp. paratuberculosis
ccgcacgaugccgcg

SEQ ID NO: 919401 - RNA, 18 nt, Mycobacterium avium subsp. paratuberculosis
ccgcacgaugccgcgcuc

SEQ ID NO: 919402 - RNA, 19 nt, Mycobacterium avium subsp. paratuberculosis
ccgcacgugcgcgccgacc

SEQ ID NO: 919403 - RNA, 23 nt, Mycobacterium avium subsp. paratuberculosis
ccgcacgugcgcgccgaccgcga

SEQ ID NO: 919404 - RNA, 21 nt, Mycobacterium avium subsp. paratuberculosis
ccgcacguguucucacggcga

SEQ ID NO: 919405 - RNA, 12 nt, Mycobacterium avium subsp. paratuberculosis
ccgcacgagcac

SEQ ID NO: 919406 - RNA, 22 nt, Mycobacterium avium subsp. paratuberculosis
ccgcaccugguugaacggcacc

SEQ ID NO: 919407 - RNA, 20 nt, Mycobacterium avium subsp. paratuberculosis
ccgcacgaccaugucggcga

SEQ ID NO: 919408 - RNA, 16 nt, Mycobacterium avium subsp. paratuberculosis
ccgcaccugcgcgccg

SEQ ID NO: 919409 - RNA, 17 nt, Mycobacterium avium subsp. paratuberculosis
ccgcaccugcgcgccgu

SEQ ID NO: 919410 - RNA, 18 nt, Mycobacterium avium subsp. paratuberculosis
ccgcaccugcgcgccguu

SEQ ID NO: 919411 - RNA, 21 nt, Mycobacterium avium subsp. paratuberculosis
ccgcaccugcgcgccguuggu

SEQ ID NO: 919412 - RNA, 15 nt, Mycobacterium avium subsp. paratuberculosis
ccgcaccggccggcc

SEQ ID NO: 919413 - RNA, 21 nt, Mycobacterium avium subsp. paratuberculosis
ccgcaccgucgugccagcgca

SEQ ID NO: 919414 - RNA, 17 nt, Mycobacterium avium subsp. paratuberculosis
ccgcaccucgcccggcu

SEQ ID NO: 919415 - RNA, 16 nt, Mycobacterium avium subsp. paratuberculosis
ccgcaccucgccgauc

SEQ ID NO: 919416 - RNA, 15 nt, Mycobacterium avium subsp. paratuberculosis
ccgcaccucgccggc

SEQ ID NO: 919417 - RNA, 17 nt, Mycobacterium avium subsp. paratuberculosis
ccgcaccucgccggccg

SEQ ID NO: 919418 - RNA, 19 nt, Mycobacterium avium subsp. paratuberculosis
ccgcaccucgccggccgcc

SEQ ID NO: 919419 - RNA, 20 nt, Mycobacterium avium subsp. paratuberculosis
ccgcaccucgccggccgccg

SEQ ID NO: 919420 - RNA, 18 nt, Mycobacterium avium subsp. paratuberculosis
ccgcaccucggggcgugg

SEQ ID NO: 919421 - RNA, 18 nt, Mycobacterium avium subsp. paratuberculosis
ccgcaccugaucgaugcc

SEQ ID NO: 919422 - RNA, 14 nt, Mycobacterium avium subsp. paratuberculosis
ccgcaccggacgca

SEQ ID NO: 919423 - RNA, 20 nt, Mycobacterium avium subsp. paratuberculosis
ccgcaccgccaggcuggcca

SEQ ID NO: 919424 - RNA, 24 nt, Mycobacterium avium subsp. paratuberculosis
ccgcaccgccucaugccagacgcg

SEQ ID NO: 919425 - RNA, 14 nt, Mycobacterium avium subsp. paratuberculosis
ccgcaccgcgaccg

SEQ ID NO: 919426 - RNA, 17 nt, Mycobacterium avium subsp. paratuberculosis
ccgcacccgggcccggu

SEQ ID NO: 919427 - RNA, 20 nt, Mycobacterium avium subsp. paratuberculosis
ccgcacccgggcccggucgu

SEQ ID NO: 919428 - RNA, 22 nt, Mycobacterium avium subsp. paratuberculosis
ccgcacccgggcccggucgucg

SEQ ID NO: 919429 - RNA, 23 nt, Mycobacterium avium subsp. paratuberculosis
ccgcacccgggcccggucgucgc

SEQ ID NO: 919430 - RNA, 22 nt, Mycobacterium avium subsp. paratuberculosis
ccgcacccuugacuaccgcgcc

SEQ ID NO: 919431 - RNA, 17 nt, Mycobacterium avium subsp. paratuberculosis
ccgcaccgaccagcggg

SEQ ID NO: 919432 - RNA, 13 nt, Mycobacterium avium subsp. paratuberculosis
ccgcaccgacgaa

SEQ ID NO: 919433 - RNA, 22 nt, Mycobacterium avium subsp. paratuberculosis
ccgcaccgauggguuggccguc

SEQ ID NO: 919434 - RNA, 23 nt, Mycobacterium avium subsp. paratuberculosis
ccgcaccgauggguuggccgucg

SEQ ID NO: 919435 - RNA, 15 nt, Mycobacterium avium subsp. paratuberculosis
ccgcacccccagcuc

SEQ ID NO: 919436 - RNA, 21 nt, Mycobacterium avium subsp. paratuberculosis
ccgcacccccagcucgacgac

SEQ ID NO: 919437 - RNA, 17 nt, Mycobacterium avium subsp. paratuberculosis
ccgcaccccgucgcgga

SEQ ID NO: 919438 - RNA, 18 nt, Mycobacterium avium subsp. paratuberculosis
ccgcaccccgucgcggac

SEQ ID NO: 919439 - RNA, 20 nt, Mycobacterium avium subsp. paratuberculosis
ccgcacccgauccacggcga

SEQ ID NO: 919440 - RNA, 22 nt, Mycobacterium avium subsp. paratuberculosis
ccgcaaggugauucgcgcggcg

SEQ ID NO: 919441 - RNA, 16 nt, Mycobacterium avium subsp. paratuberculosis
ccgcaacggcggucgu

SEQ ID NO: 919442 - RNA, 13 nt, Mycobacterium avium subsp. paratuberculosis
ccgcaacgggccg

SEQ ID NO: 919443 - RNA, 14 nt, Mycobacterium avium subsp. paratuberculosis
ccgcaacgggccgc

SEQ ID NO: 919444 - RNA, 18 nt, Mycobacterium avium subsp. paratuberculosis
ccgcaacgggccgcagcc

SEQ ID NO: 919445 - RNA, 22 nt, Mycobacterium avium subsp. paratuberculosis
ccgcaacgggccgcagccgcgc

SEQ ID NO: 919446 - RNA, 19 nt, Mycobacterium avium subsp. paratuberculosis
ccgcaacgugcgccggccu

SEQ ID NO: 919447 - RNA, 22 nt, Mycobacterium avium subsp. paratuberculosis
ccgcaacgugcgccggccuacc

SEQ ID NO: 919448 - RNA, 17 nt, Mycobacterium avium subsp. paratuberculosis
ccgcaacuugcccgacg

SEQ ID NO: 919449 - RNA, 21 nt, Mycobacterium avium subsp. paratuberculosis
ccgcaagcgaagccgugaccc

SEQ ID NO: 919450 - RNA, 22 nt, Mycobacterium avium subsp. paratuberculosis
ccgauuggaagagggccauccg

SEQ ID NO: 919451 - RNA, 14 nt, Mycobacterium avium subsp. paratuberculosis
ccgauguccccgcg

SEQ ID NO: 919452 - RNA, 19 nt, Mycobacterium avium subsp. paratuberculosis
ccgauguccccgcggguga

SEQ ID NO: 919453 - RNA, 19 nt, Mycobacterium avium subsp. paratuberculosis
ccgaugguauccgaucgcg

SEQ ID NO: 919454 - RNA, 19 nt, Mycobacterium avium subsp. paratuberculosis
ccgauguaggacaggucgc

SEQ ID NO: 919455 - RNA, 20 nt, Mycobacterium avium subsp. paratuberculosis
ccgauguacugggccgucgc

SEQ ID NO: 919456 - RNA, 21 nt, Mycobacterium avium subsp. paratuberculosis
ccgauguacugggccgucgcc

SEQ ID NO: 919457 - RNA, 15 nt, Mycobacterium avium subsp. paratuberculosis
ccgauuucgcggccg

SEQ ID NO: 919458 - RNA, 22 nt, Mycobacterium avium subsp. paratuberculosis
ccgcaaagcaccgcgaacagca

SEQ ID NO: 919459 - RNA, 15 nt, Mycobacterium avium subsp. paratuberculosis
ccgauggccgcccgc

SEQ ID NO: 919460 - RNA, 14 nt, Mycobacterium avium subsp. paratuberculosis
ccgauggcgacggu

SEQ ID NO: 919461 - RNA, 15 nt, Mycobacterium avium subsp. paratuberculosis
ccgauggcgacgguc

SEQ ID NO: 919462 - RNA, 20 nt, Mycobacterium avium subsp. paratuberculosis
ccgauggcgacggucugccg

SEQ ID NO: 919463 - RNA, 20 nt, Mycobacterium avium subsp. paratuberculosis
ccgauggcccaggccgcggu

SEQ ID NO: 919464 - RNA, 21 nt, Mycobacterium avium subsp. paratuberculosis
ccgauggaggugccgcgcagc

SEQ ID NO: 919465 - RNA, 16 nt, Mycobacterium avium subsp. paratuberculosis
ccgauggccaccgggc

SEQ ID NO: 919466 - RNA, 13 nt, Mycobacterium avium subsp. paratuberculosis
ccgauggcgccca

SEQ ID NO: 919467 - RNA, 14 nt, Mycobacterium avium subsp. paratuberculosis
ccgauggcgcccag

SEQ ID NO: 919468 - RNA, 15 nt, Mycobacterium avium subsp. paratuberculosis
ccgauggucagcugc

SEQ ID NO: 919469 - RNA, 17 nt, Mycobacterium avium subsp. paratuberculosis
ccgauggguuggccguc

SEQ ID NO: 919470 - RNA, 18 nt, Mycobacterium avium subsp. paratuberculosis
ccgauggguuggccgucg

SEQ ID NO: 919471 - RNA, 14 nt, Mycobacterium avium subsp. paratuberculosis
ccgauggugaccuc

SEQ ID NO: 919472 - RNA, 16 nt, Mycobacterium avium subsp. paratuberculosis
ccgauggugaccucgg

SEQ ID NO: 919473 - RNA, 22 nt, Mycobacterium avium subsp. paratuberculosis
ccgauggugacgauccggucga

SEQ ID NO: 919474 - RNA, 19 nt, Mycobacterium avium subsp. paratuberculosis
ccgauggugacggugccgc

SEQ ID NO: 919475 - RNA, 22 nt, Mycobacterium avium subsp. paratuberculosis
ccgauggugacggugccgccgu

SEQ ID NO: 919476 - RNA, 19 nt, Mycobacterium avium subsp. paratuberculosis
ccgauggcucgcgggggcc

SEQ ID NO: 919477 - RNA, 21 nt, Mycobacterium avium subsp. paratuberculosis
ccgauggcucgcgggggccgc

SEQ ID NO: 919478 - RNA, 18 nt, Mycobacterium avium subsp. paratuberculosis
ccgauggcggcggcccgc

SEQ ID NO: 919479 - RNA, 21 nt, Mycobacterium avium subsp. paratuberculosis
ccgauggcggcggcccgccgc

SEQ ID NO: 919480 - RNA, 18 nt, Mycobacterium avium subsp. paratuberculosis
ccgauggcgguccaccac

SEQ ID NO: 919481 - RNA, 15 nt, Mycobacterium avium subsp. paratuberculosis
ccgaugcgcccgcgc

SEQ ID NO: 919482 - RNA, 16 nt, Mycobacterium avium subsp. paratuberculosis
ccgaugcgcccgcgcc

SEQ ID NO: 919483 - RNA, 15 nt, Mycobacterium avium subsp. paratuberculosis
ccgaugcgcccgcug

SEQ ID NO: 919484 - RNA, 15 nt, Mycobacterium avium subsp. paratuberculosis
ccgaugccgcgcagg

SEQ ID NO: 919485 - RNA, 18 nt, Mycobacterium avium subsp. paratuberculosis
ccgaugccgcgcugcgcc

SEQ ID NO: 919486 - RNA, 20 nt, Mycobacterium avium subsp. paratuberculosis
ccgaugccgcgcugcgccgg

SEQ ID NO: 919487 - RNA, 15 nt, Mycobacterium avium subsp. paratuberculosis
ccgaugccggccugg

SEQ ID NO: 919488 - RNA, 18 nt, Mycobacterium avium subsp. paratuberculosis
ccgaugccggccuggccc

SEQ ID NO: 919489 - RNA, 18 nt, Mycobacterium avium subsp. paratuberculosis
ccgaugccgaacuccgcc

SEQ ID NO: 919490 - RNA, 22 nt, Mycobacterium avium subsp. paratuberculosis
ccgaugcccgacaccgccccgc

SEQ ID NO: 919491 - RNA, 13 nt, Mycobacterium avium subsp. paratuberculosis
ccgaugcggaccg

SEQ ID NO: 919492 - RNA, 18 nt, Mycobacterium avium subsp. paratuberculosis
ccgaugcggaccggggac

SEQ ID NO: 919493 - RNA, 13 nt, Mycobacterium avium subsp. paratuberculosis
ccgaugcgcucgc

SEQ ID NO: 919494 - RNA, 17 nt, Mycobacterium avium subsp. paratuberculosis
ccgaugcgcucgccgau

SEQ ID NO: 919495 - RNA, 22 nt, Mycobacterium avium subsp. paratuberculosis
ccgaugcucgaugcgcaccugc

SEQ ID NO: 919496 - RNA, 13 nt, Mycobacterium avium subsp. paratuberculosis
ccgaugcggugcc

SEQ ID NO: 919497 - RNA, 20 nt, Mycobacterium avium subsp. paratuberculosis
ccgaugcggugccgggccag

SEQ ID NO: 919498 - RNA, 19 nt, Mycobacterium avium subsp. paratuberculosis
ccgaugcuggccaucgccg

SEQ ID NO: 919499 - RNA, 20 nt, Mycobacterium avium subsp. paratuberculosis
ccgaugcuggccaucgccga

SEQ ID NO: 919500 - RNA, 15 nt, Mycobacterium avium subsp. paratuberculosis
ccgaugcagggccga

SEQ ID NO: 919501 - RNA, 15 nt, Mycobacterium avium subsp. paratuberculosis
ccgaugcccagcagc

SEQ ID NO: 919502 - RNA, 19 nt, Mycobacterium avium subsp. paratuberculosis
ccgacgaugagggccagca

SEQ ID NO: 919503 - RNA, 18 nt, Mycobacterium avium subsp. paratuberculosis
ccgacgaugagggugaug

SEQ ID NO: 919504 - RNA, 19 nt, Mycobacterium avium subsp. paratuberculosis
ccgacgaugagggugauga

SEQ ID NO: 919505 - RNA, 14 nt, Mycobacterium avium subsp. paratuberculosis
ccgacgaucccggc

SEQ ID NO: 919506 - RNA, 16 nt, Mycobacterium avium subsp. paratuberculosis
ccgacgaucccggcga

SEQ ID NO: 919507 - RNA, 18 nt, Mycobacterium avium subsp. paratuberculosis
ccgacgaucccggcgagc

SEQ ID NO: 919508 - RNA, 14 nt, Mycobacterium avium subsp. paratuberculosis
ccgacgauccgcgc

SEQ ID NO: 919509 - RNA, 16 nt, Mycobacterium avium subsp. paratuberculosis
ccgacgauccgcgccg

SEQ ID NO: 919510 - RNA, 16 nt, Mycobacterium avium subsp. paratuberculosis
ccgacgauccgggccg

SEQ ID NO: 919511 - RNA, 19 nt, Mycobacterium avium subsp. paratuberculosis
ccgacgauccgggccgguc

SEQ ID NO: 919512 - RNA, 16 nt, Mycobacterium avium subsp. paratuberculosis
ccgacgauccgggcgc

SEQ ID NO: 919513 - RNA, 17 nt, Mycobacterium avium subsp. paratuberculosis
ccgacgauccgggcgcc

SEQ ID NO: 919514 - RNA, 20 nt, Mycobacterium avium subsp. paratuberculosis
ccgacgaucgcgccggccgc

SEQ ID NO: 919515 - RNA, 16 nt, Mycobacterium avium subsp. paratuberculosis
ccgacgaggagaccuc

SEQ ID NO: 919516 - RNA, 17 nt, Mycobacterium avium subsp. paratuberculosis
ccgacgauacgugcucc

SEQ ID NO: 919517 - RNA, 12 nt, Mycobacterium avium subsp. paratuberculosis
ccgacgacgucg

SEQ ID NO: 919518 - RNA, 13 nt, Mycobacterium avium subsp. paratuberculosis
ccgacgacgucgu

SEQ ID NO: 919519 - RNA, 20 nt, Mycobacterium avium subsp. paratuberculosis
ccgacgacgugacgaccugg

SEQ ID NO: 919520 - RNA, 13 nt, Mycobacterium avium subsp. paratuberculosis
ccgacgagcucgc

SEQ ID NO: 919521 - RNA, 16 nt, Mycobacterium avium subsp. paratuberculosis
ccgacgagaucagcac

SEQ ID NO: 919522 - RNA, 19 nt, Mycobacterium avium subsp. paratuberculosis
ccgacgagaucagcaccag

SEQ ID NO: 919523 - RNA, 20 nt, Mycobacterium avium subsp. paratuberculosis
ccgacgagaucagcaccagg

SEQ ID NO: 919524 - RNA, 17 nt, Mycobacterium avium subsp. paratuberculosis
ccgacgaccaucagcgc

SEQ ID NO: 919525 - RNA, 23 nt, Mycobacterium avium subsp. paratuberculosis
ccgacgaccaucagcgcccgggu

SEQ ID NO: 919526 - RNA, 22 nt, Mycobacterium avium subsp. paratuberculosis
ccgacgaccucgucgucgauga

SEQ ID NO: 919527 - RNA, 20 nt, Mycobacterium avium subsp. paratuberculosis
ccgacgacgacgucgacgac

SEQ ID NO: 919528 - RNA, 14 nt, Mycobacterium avium subsp. paratuberculosis
ccgacgacgccguc

SEQ ID NO: 919529 - RNA, 15 nt, Mycobacterium avium subsp. paratuberculosis
ccgacgacgccguca

SEQ ID NO: 919530 - RNA, 13 nt, Mycobacterium avium subsp. paratuberculosis
ccgacgacggcga

SEQ ID NO: 919531 - RNA, 13 nt, Mycobacterium avium subsp. paratuberculosis
ccgccaaucaccg

SEQ ID NO: 919532 - RNA, 15 nt, Mycobacterium avium subsp. paratuberculosis
ccgccaaucaccgcg

SEQ ID NO: 919533 - RNA, 16 nt, Mycobacterium avium subsp. paratuberculosis
ccgccaaucaccgcgg

SEQ ID NO: 919534 - RNA, 19 nt, Mycobacterium avium subsp. paratuberculosis
ccgccaaucaccgcggugu

SEQ ID NO: 919535 - RNA, 18 nt, Mycobacterium avium subsp. paratuberculosis
ccgccaagugcggugugg

SEQ ID NO: 919536 - RNA, 22 nt, Mycobacterium avium subsp. paratuberculosis
ccgccaaggggaacaacgcgca

SEQ ID NO: 919537 - RNA, 13 nt, Mycobacterium avium subsp. paratuberculosis
ccgccaccagcgc

SEQ ID NO: 919538 - RNA, 13 nt, Mycobacterium avium subsp. paratuberculosis
ccgccaccacggc

SEQ ID NO: 919539 - RNA, 20 nt, Mycobacterium avium subsp. paratuberculosis
ccgccaccacccggcgauua

SEQ ID NO: 919540 - RNA, 21 nt, Mycobacterium avium subsp. paratuberculosis
ccgccacagcgccucgcgguc

SEQ ID NO: 919541 - RNA, 22 nt, Mycobacterium avium subsp. paratuberculosis
ccgccacagcgccucgcggucg

SEQ ID NO: 919542 - RNA, 15 nt, Mycobacterium avium subsp. paratuberculosis
ccgccacaucgggau

SEQ ID NO: 919543 - RNA, 12 nt, Mycobacterium avium subsp. paratuberculosis
ccgccaccaaca

SEQ ID NO: 919544 - RNA, 20 nt, Mycobacterium avium subsp. paratuberculosis
ccgccaccaacaucgacgug

SEQ ID NO: 919545 - RNA, 20 nt, Mycobacterium avium subsp. paratuberculosis
ccgccagcagaugccgccca

SEQ ID NO: 919546 - RNA, 23 nt, Mycobacterium avium subsp. paratuberculosis
ccgccagcagaugccgcccaggu

SEQ ID NO: 919547 - RNA, 17 nt, Mycobacterium avium subsp. paratuberculosis
ccgccagcagcacggca

SEQ ID NO: 919548 - RNA, 18 nt, Mycobacterium avium subsp. paratuberculosis
ccgccagcagcagccgcg

SEQ ID NO: 919549 - RNA, 21 nt, Mycobacterium avium subsp. paratuberculosis
ccgccagcagcagccgcgccg

SEQ ID NO: 919550 - RNA, 23 nt, Mycobacterium avium subsp. paratuberculosis
ccgccagcagcagccgcgccgcc

SEQ ID NO: 919551 - RNA, 18 nt, Mycobacterium avium subsp. paratuberculosis
ccgccagcaccgacgcgc

SEQ ID NO: 919552 - RNA, 13 nt, Mycobacterium avium subsp. paratuberculosis
ccgccagcaccgc

SEQ ID NO: 919553 - RNA, 14 nt, Mycobacterium avium subsp. paratuberculosis
ccgccagcaccgcc

SEQ ID NO: 919554 - RNA, 15 nt, Mycobacterium avium subsp. paratuberculosis
ccgccagcaccgcca

SEQ ID NO: 919555 - RNA, 18 nt, Mycobacterium avium subsp. paratuberculosis
ccgccagcaccgccaccg

SEQ ID NO: 919556 - RNA, 12 nt, Mycobacterium avium subsp. paratuberculosis
ccgccagcaccu

SEQ ID NO: 919557 - RNA, 20 nt, Mycobacterium avium subsp. paratuberculosis
ccgccagcaccucgcggcag

SEQ ID NO: 919558 - RNA, 17 nt, Mycobacterium avium subsp. paratuberculosis
ccgccacggcacgucga

SEQ ID NO: 919559 - RNA, 14 nt, Mycobacterium avium subsp. paratuberculosis
ccgccacggccacc

SEQ ID NO: 919560 - RNA, 12 nt, Mycobacterium avium subsp. paratuberculosis
ccgccacgcugg

SEQ ID NO: 919561 - RNA, 15 nt, Mycobacterium avium subsp. paratuberculosis
ccgccacgcggcgcg

SEQ ID NO: 919562 - RNA, 16 nt, Mycobacterium avium subsp. paratuberculosis
ccgccacgcggcgcgc

SEQ ID NO: 919563 - RNA, 21 nt, Mycobacterium avium subsp. paratuberculosis
ccgccacgcggcgcgcaucgu

SEQ ID NO: 919564 - RNA, 14 nt, Mycobacterium avium subsp. paratuberculosis
ccgccacggccagc

SEQ ID NO: 919565 - RNA, 16 nt, Mycobacterium avium subsp. paratuberculosis
ccgccacggccagcac

SEQ ID NO: 919566 - RNA, 19 nt, Mycobacterium avium subsp. paratuberculosis
ccgccacggccagcaccgc

SEQ ID NO: 919567 - RNA, 23 nt, Mycobacterium avium subsp. paratuberculosis
ccgccacggccagcaccgccagc

SEQ ID NO: 919568 - RNA, 12 nt, Mycobacterium avium subsp. paratuberculosis
ccgccacggcga

SEQ ID NO: 919569 - RNA, 13 nt, Mycobacterium avium subsp. paratuberculosis
ccgccacggcgac

SEQ ID NO: 919570 - RNA, 14 nt, Mycobacterium avium subsp. paratuberculosis
ccgccacggcgacg

SEQ ID NO: 919571 - RNA, 18 nt, Mycobacterium avium subsp. paratuberculosis
ccgccacggcgacgacca

SEQ ID NO: 919572 - RNA, 22 nt, Mycobacterium avium subsp. paratuberculosis
ccgccacggcgacgaccaccag

SEQ ID NO: 919573 - RNA, 12 nt, Mycobacterium avium subsp. paratuberculosis
ccgccacggcgc

SEQ ID NO: 919574 - RNA, 23 nt, Mycobacterium avium subsp. paratuberculosis
ccgccacggcgccaugcgccgcg

SEQ ID NO: 919575 - RNA, 18 nt, Mycobacterium avium subsp. paratuberculosis
ccgccacgacgcggcgau

SEQ ID NO: 919576 - RNA, 12 nt, Mycobacterium avium subsp. paratuberculosis
ccgccaccagcg

SEQ ID NO: 919577 - RNA, 14 nt, Mycobacterium avium subsp. paratuberculosis
ccgccaccaggccg

SEQ ID NO: 919578 - RNA, 24 nt, Mycobacterium avium subsp. paratuberculosis
ccgcaugcugaucuuggcacgggc

SEQ ID NO: 919579 - RNA, 23 nt, Mycobacterium avium subsp. paratuberculosis
ccgccaaccaggucgcggcgcug

SEQ ID NO: 919580 - RNA, 18 nt, Mycobacterium avium subsp. paratuberculosis
ccgcaugaugcggccaug

SEQ ID NO: 919581 - RNA, 15 nt, Mycobacterium avium subsp. paratuberculosis
ccgcaugcaccggug

SEQ ID NO: 919582 - RNA, 18 nt, Mycobacterium avium subsp. paratuberculosis
ccgcaugcaccggugcac

SEQ ID NO: 919583 - RNA, 14 nt, Mycobacterium avium subsp. paratuberculosis
ccgcaugcccgggc

SEQ ID NO: 919584 - RNA, 15 nt, Mycobacterium avium subsp. paratuberculosis
ccgcagccgcgacgg

SEQ ID NO: 919585 - RNA, 16 nt, Mycobacterium avium subsp. paratuberculosis
ccgcagccgcgacggc

SEQ ID NO: 919586 - RNA, 13 nt, Mycobacterium avium subsp. paratuberculosis
ccgcagccgcgcg

SEQ ID NO: 919587 - RNA, 18 nt, Mycobacterium avium subsp. paratuberculosis
ccgcagccuucuucgccg

SEQ ID NO: 919588 - RNA, 19 nt, Mycobacterium avium subsp. paratuberculosis
ccgcagccuucuuggcggg

SEQ ID NO: 919589 - RNA, 20 nt, Mycobacterium avium subsp. paratuberculosis
ccgcagccuucuuggcgggc

SEQ ID NO: 919590 - RNA, 19 nt, Mycobacterium avium subsp. paratuberculosis
ccgcagcgaccgcggauga

SEQ ID NO: 919591 - RNA, 23 nt, Mycobacterium avium subsp. paratuberculosis
ccgcagcgacuccugguccucga

SEQ ID NO: 919592 - RNA, 18 nt, Mycobacterium avium subsp. paratuberculosis
ccgcagcgcagcgucggc

SEQ ID NO: 919593 - RNA, 22 nt, Mycobacterium avium subsp. paratuberculosis
ccgcagcgcaucgccggcgaug

SEQ ID NO: 919594 - RNA, 13 nt, Mycobacterium avium subsp. paratuberculosis
ccgcagcccgacc

SEQ ID NO: 919595 - RNA, 14 nt, Mycobacterium avium subsp. paratuberculosis
ccgcagcgcgacga

SEQ ID NO: 919596 - RNA, 19 nt, Mycobacterium avium subsp. paratuberculosis
ccgcagcgcgacgaacagc

SEQ ID NO: 919597 - RNA, 23 nt, Mycobacterium avium subsp. paratuberculosis
ccgcagcgcgacgaacagcaccg

SEQ ID NO: 919598 - RNA, 16 nt, Mycobacterium avium subsp. paratuberculosis
ccgcagcgcgcgaccg

SEQ ID NO: 919599 - RNA, 19 nt, Mycobacterium avium subsp. paratuberculosis
ccgcagcgcgcgaccgcga

SEQ ID NO: 919600 - RNA, 12 nt, Mycobacterium avium subsp. paratuberculosis
ccgcagcgcggc

SEQ ID NO: 919601 - RNA, 13 nt, Mycobacterium avium subsp. paratuberculosis
ccgcagcgcggcg

SEQ ID NO: 919602 - RNA, 16 nt, Mycobacterium avium subsp. paratuberculosis
ccgcagcgcggcggag

SEQ ID NO: 919603 - RNA, 15 nt, Mycobacterium avium subsp. paratuberculosis
ccgcagcggugaucg

SEQ ID NO: 919604 - RNA, 17 nt, Mycobacterium avium subsp. paratuberculosis
ccgcagcgugggcaccg

SEQ ID NO: 919605 - RNA, 19 nt, Mycobacterium avium subsp. paratuberculosis
ccgcagcgugggcaccggc

SEQ ID NO: 919606 - RNA, 22 nt, Mycobacterium avium subsp. paratuberculosis
ccgcagcgugggcaccggcacc

SEQ ID NO: 919607 - RNA, 19 nt, Mycobacterium avium subsp. paratuberculosis
ccgcagcggcaggucgucg

SEQ ID NO: 919608 - RNA, 23 nt, Mycobacterium avium subsp. paratuberculosis
ccgcagcggcaggucgucgucgc

SEQ ID NO: 919609 - RNA, 13 nt, Mycobacterium avium subsp. paratuberculosis
ccgcagcggcgcc

SEQ ID NO: 919610 - RNA, 14 nt, Mycobacterium avium subsp. paratuberculosis
ccgcagcggcgccg

SEQ ID NO: 919611 - RNA, 19 nt, Mycobacterium avium subsp. paratuberculosis
ccgcagcggcgccgcagcu

SEQ ID NO: 919612 - RNA, 22 nt, Mycobacterium avium subsp. paratuberculosis
ccgcagcggcgccgcagcucgu

SEQ ID NO: 919613 - RNA, 16 nt, Mycobacterium avium subsp. paratuberculosis
ccgcagcggcgccggg

SEQ ID NO: 919614 - RNA, 14 nt, Mycobacterium avium subsp. paratuberculosis
ccgcagcggcggca

SEQ ID NO: 919615 - RNA, 14 nt, Mycobacterium avium subsp. paratuberculosis
ccgcagcggcggcu

SEQ ID NO: 919616 - RNA, 14 nt, Mycobacterium avium subsp. paratuberculosis
ccgcagcggcgguu

SEQ ID NO: 919617 - RNA, 20 nt, Mycobacterium avium subsp. paratuberculosis
ccgccagcagcagcgccgcc

SEQ ID NO: 919618 - RNA, 13 nt, Mycobacterium avium subsp. paratuberculosis
ccgccagccacca

SEQ ID NO: 919619 - RNA, 20 nt, Mycobacterium avium subsp. paratuberculosis
ccgccagcaguguccagucg

SEQ ID NO: 919620 - RNA, 18 nt, Mycobacterium avium subsp. paratuberculosis
ccgccagcauccgcuggu

SEQ ID NO: 919621 - RNA, 22 nt, Mycobacterium avium subsp. paratuberculosis
ccgccagcauccgcuggugcgc

SEQ ID NO: 919622 - RNA, 22 nt, Mycobacterium avium subsp. paratuberculosis
ccgccagucugagcccgggcag

SEQ ID NO: 919623 - RNA, 14 nt, Mycobacterium avium subsp. paratuberculosis
ccgccagguuggcg

SEQ ID NO: 919624 - RNA, 20 nt, Mycobacterium avium subsp. paratuberculosis
ccgccagguuggcggcggcc

SEQ ID NO: 919625 - RNA, 23 nt, Mycobacterium avium subsp. paratuberculosis
ccgccagguuggcggcggcccgc

SEQ ID NO: 919626 - RNA, 22 nt, Mycobacterium avium subsp. paratuberculosis
ccgccagcaugguucguggggu

SEQ ID NO: 919627 - RNA, 19 nt, Mycobacterium avium subsp. paratuberculosis
ccgccagggucucgggcag

SEQ ID NO: 919628 - RNA, 20 nt, Mycobacterium avium subsp. paratuberculosis
ccgccagggucucgggcagc

SEQ ID NO: 919629 - RNA, 21 nt, Mycobacterium avium subsp. paratuberculosis
ccgccagggucucgggcagca

SEQ ID NO: 919630 - RNA, 14 nt, Mycobacterium avium subsp. paratuberculosis
ccgccagggugccg

SEQ ID NO: 919631 - RNA, 18 nt, Mycobacterium avium subsp. paratuberculosis
ccgccagggugccgcugc

SEQ ID NO: 919632 - RNA, 20 nt, Mycobacterium avium subsp. paratuberculosis
ccgccaguuguuggccgggc

SEQ ID NO: 919633 - RNA, 18 nt, Mycobacterium avium subsp. paratuberculosis
ccgccaguucccggccag

SEQ ID NO: 919634 - RNA, 19 nt, Mycobacterium avium subsp. paratuberculosis
ccgccaguucccggccagc

SEQ ID NO: 919635 - RNA, 18 nt, Mycobacterium avium subsp. paratuberculosis
ccgccaucggcaucgcgc

SEQ ID NO: 919636 - RNA, 14 nt, Mycobacterium avium subsp. paratuberculosis
ccgccaucgcggcg

SEQ ID NO: 919637 - RNA, 15 nt, Mycobacterium avium subsp. paratuberculosis
ccgccaucgccgccg

SEQ ID NO: 919638 - RNA, 18 nt, Mycobacterium avium subsp. paratuberculosis
ccgccaucgcccggugcg

SEQ ID NO: 919639 - RNA, 13 nt, Mycobacterium avium subsp. paratuberculosis
ccgccaucgccgc

SEQ ID NO: 919640 - RNA, 20 nt, Mycobacterium avium subsp. paratuberculosis
ccgccaucuccuccgggcug

SEQ ID NO: 919641 - RNA, 17 nt, Mycobacterium avium subsp. paratuberculosis
ccgccaugcuugccaac

SEQ ID NO: 919642 - RNA, 23 nt, Mycobacterium avium subsp. paratuberculosis
ccgccauggcggcauccccagcu

SEQ ID NO: 919643 - RNA, 14 nt, Mycobacterium avium subsp. paratuberculosis
ccgcccacaccgac

SEQ ID NO: 919644 - RNA, 18 nt, Mycobacterium avium subsp. paratuberculosis
ccgcccacagcaacgaca

SEQ ID NO: 919645 - RNA, 23 nt, Mycobacterium avium subsp. paratuberculosis
ccgcccacagcaacgacauccag

SEQ ID NO: 919646 - RNA, 12 nt, Mycobacterium avium subsp. paratuberculosis
ccgcccaacgac

SEQ ID NO: 919647 - RNA, 16 nt, Mycobacterium avium subsp. paratuberculosis
ccgcccaacgacgucg

SEQ ID NO: 919648 - RNA, 17 nt, Mycobacterium avium subsp. paratuberculosis
ccgcccaacgacgucgg

SEQ ID NO: 919649 - RNA, 20 nt, Mycobacterium avium subsp. paratuberculosis
ccgcccaacgacgucggcgu

SEQ ID NO: 919650 - RNA, 14 nt, Mycobacterium avium subsp. paratuberculosis
ccgcccagacgcgg

SEQ ID NO: 919651 - RNA, 12 nt, Mycobacterium avium subsp. paratuberculosis
ccgcccacgggu

SEQ ID NO: 919652 - RNA, 15 nt, Mycobacterium avium subsp. paratuberculosis
ccgcccacgggucgc

SEQ ID NO: 919653 - RNA, 15 nt, Mycobacterium avium subsp. paratuberculosis
ccgcccacguucagc

SEQ ID NO: 919654 - RNA, 13 nt, Mycobacterium avium subsp. paratuberculosis
ccgcccacgccgc

SEQ ID NO: 919655 - RNA, 14 nt, Mycobacterium avium subsp. paratuberculosis
ccgcccacgccgcc

SEQ ID NO: 919656 - RNA, 13 nt, Mycobacterium avium subsp. paratuberculosis
ccgcccaccaccg

SEQ ID NO: 919657 - RNA, 13 nt, Mycobacterium avium subsp. paratuberculosis
ccgcccaccacga

SEQ ID NO: 919658 - RNA, 21 nt, Mycobacterium avium subsp. paratuberculosis
ccgcccaccacgaacgcgccg

SEQ ID NO: 919659 - RNA, 20 nt, Mycobacterium avium subsp. paratuberculosis
ccgcccaccagcacaccgga

SEQ ID NO: 919660 - RNA, 23 nt, Mycobacterium avium subsp. paratuberculosis
ccgcccaugcccaugucgaucgg

SEQ ID NO: 919661 - RNA, 12 nt, Mycobacterium avium subsp. paratuberculosis
ccgccccagccc

SEQ ID NO: 919662 - RNA, 14 nt, Mycobacterium avium subsp. paratuberculosis
ccgccccagcccgg

SEQ ID NO: 919663 - RNA, 16 nt, Mycobacterium avium subsp. paratuberculosis
ccgccccagcccggcu

SEQ ID NO: 919664 - RNA, 13 nt, Mycobacterium avium subsp. paratuberculosis
ccgcccaucaccc

SEQ ID NO: 919665 - RNA, 21 nt, Mycobacterium avium subsp. paratuberculosis
ccgcccaucagcaggaccagg

SEQ ID NO: 919666 - RNA, 15 nt, Mycobacterium avium subsp. paratuberculosis
ccgcccagucgccgc

SEQ ID NO: 919667 - RNA, 16 nt, Mycobacterium avium subsp. paratuberculosis
ccgcccagucgccgcc

SEQ ID NO: 919668 - RNA, 19 nt, Mycobacterium avium subsp. paratuberculosis
ccgcccaggcgggccagcu

SEQ ID NO: 919669 - RNA, 20 nt, Mycobacterium avium subsp. paratuberculosis
ccgcccaggcgggccagcuc

SEQ ID NO: 919670 - RNA, 15 nt, Mycobacterium avium subsp. paratuberculosis
ccgcccagcggcccc

SEQ ID NO: 919671 - RNA, 23 nt, Mycobacterium avium subsp. paratuberculosis
ccgcccagcggugaauugggcga

SEQ ID NO: 919672 - RNA, 23 nt, Mycobacterium avium subsp. paratuberculosis
ccgcccagcgacucggccaggau

SEQ ID NO: 919673 - RNA, 13 nt, Mycobacterium avium subsp. paratuberculosis
ccgcccagcgcag

SEQ ID NO: 919674 - RNA, 17 nt, Mycobacterium avium subsp. paratuberculosis
ccgcccagcgcagcauc

SEQ ID NO: 919675 - RNA, 12 nt, Mycobacterium avium subsp. paratuberculosis
ccgcccaggccg

SEQ ID NO: 919676 - RNA, 17 nt, Mycobacterium avium subsp. paratuberculosis
ccgcccaggccgagcgc

SEQ ID NO: 919677 - RNA, 18 nt, Mycobacterium avium subsp. paratuberculosis
ccgcccaggccgagcgca

SEQ ID NO: 919678 - RNA, 18 nt, Mycobacterium avium subsp. paratuberculosis
ccgcccaggccgccagcu

SEQ ID NO: 919679 - RNA, 11 nt, Mycobacterium avium subsp. paratuberculosis
ccgcccagcgc

SEQ ID NO: 919680 - RNA, 12 nt, Mycobacterium avium subsp. paratuberculosis
ccgcccagcgca

SEQ ID NO: 919681 - RNA, 19 nt, Mycobacterium avium subsp. paratuberculosis
ccgcccagcaucgccgcga

SEQ ID NO: 919682 - RNA, 22 nt, Mycobacterium avium subsp. paratuberculosis
ccgcccagcagccgcgccgacg

SEQ ID NO: 919683 - RNA, 16 nt, Mycobacterium avium subsp. paratuberculosis
ccgcccagcagcgggc

SEQ ID NO: 919684 - RNA, 21 nt, Mycobacterium avium subsp. paratuberculosis
ccgcccagcagcgggcccggg

SEQ ID NO: 919685 - RNA, 20 nt, Mycobacterium avium subsp. paratuberculosis
ccgccauguacagaccccac

SEQ ID NO: 919686 - RNA, 13 nt, Mycobacterium avium subsp. paratuberculosis
ccgccccggccgc

SEQ ID NO: 919687 - RNA, 15 nt, Mycobacterium avium subsp. paratuberculosis
ccgccccggccgcgc

SEQ ID NO: 919688 - RNA, 16 nt, Mycobacterium avium subsp. paratuberculosis
ccgccccgcgcgauca

SEQ ID NO: 919689 - RNA, 14 nt, Mycobacterium avium subsp. paratuberculosis
ccgcccccgauagc

SEQ ID NO: 919690 - RNA, 15 nt, Mycobacterium avium subsp. paratuberculosis
ccgccccgcccggcg

SEQ ID NO: 919691 - RNA, 17 nt, Mycobacterium avium subsp. paratuberculosis
ccgccccgcccggcggc

SEQ ID NO: 919692 - RNA, 13 nt, Mycobacterium avium subsp. paratuberculosis
ccgccccgccgcg

SEQ ID NO: 919693 - RNA, 18 nt, Mycobacterium avium subsp. paratuberculosis
ccgccccgccgcgccggg

SEQ ID NO: 919694 - RNA, 13 nt, Mycobacterium avium subsp. paratuberculosis
ccgccccgacgau

SEQ ID NO: 919695 - RNA, 21 nt, Mycobacterium avium subsp. paratuberculosis
ccgccccgacgaucgcgccgg

SEQ ID NO: 919696 - RNA, 14 nt, Mycobacterium avium subsp. paratuberculosis
ccgccccgacgugc

SEQ ID NO: 919697 - RNA, 20 nt, Mycobacterium avium subsp. paratuberculosis
ccgccccgagaucccagcgg

SEQ ID NO: 919698 - RNA, 21 nt, Mycobacterium avium subsp. paratuberculosis
ccgccccgaguuccagcuccg

SEQ ID NO: 919699 - RNA, 17 nt, Mycobacterium avium subsp. paratuberculosis
ccgccccgcaaccguuc

SEQ ID NO: 919700 - RNA, 15 nt, Mycobacterium avium subsp. paratuberculosis
ccgcccccgcggcgg

SEQ ID NO: 919701 - RNA, 17 nt, Mycobacterium avium subsp. paratuberculosis
ccgcccccgcggcggcc

SEQ ID NO: 919702 - RNA, 15 nt, Mycobacterium avium subsp. paratuberculosis
ccgcccccgcggcgu

SEQ ID NO: 919703 - RNA, 20 nt, Mycobacterium avium subsp. paratuberculosis
ccgccccgaacagcgccagg

SEQ ID NO: 919704 - RNA, 13 nt, Mycobacterium avium subsp. paratuberculosis
ccgcccgcccgag

SEQ ID NO: 919705 - RNA, 21 nt, Mycobacterium avium subsp. paratuberculosis
ccgcccgcaguucggccgccg

SEQ ID NO: 919706 - RNA, 22 nt, Mycobacterium avium subsp. paratuberculosis
ccgcccgaucaucucaccgacg

SEQ ID NO: 919707 - RNA, 20 nt, Mycobacterium avium subsp. paratuberculosis
ccgcccgaucccgucgucgg

SEQ ID NO: 919708 - RNA, 21 nt, Mycobacterium avium subsp. paratuberculosis
ccgcccgaucccgucgucggc

SEQ ID NO: 919709 - RNA, 12 nt, Mycobacterium avium subsp. paratuberculosis
ccgcccgcacca

SEQ ID NO: 919710 - RNA, 15 nt, Mycobacterium avium subsp. paratuberculosis
ccgcccgcaccagca

SEQ ID NO: 919711 - RNA, 22 nt, Mycobacterium avium subsp. paratuberculosis
ccgcccgagcgucauuccgccg

SEQ ID NO: 919712 - RNA, 23 nt, Mycobacterium avium subsp. paratuberculosis
ccgcccgagaguccgccgccggg

SEQ ID NO: 919713 - RNA, 19 nt, Mycobacterium avium subsp. paratuberculosis
ccgcccgaaccgcguccac

SEQ ID NO: 919714 - RNA, 19 nt, Mycobacterium avium subsp. paratuberculosis
ccgcccgacccguccagca

SEQ ID NO: 919715 - RNA, 19 nt, Mycobacterium avium subsp. paratuberculosis
ccgccccggucaccccggc

SEQ ID NO: 919716 - RNA, 20 nt, Mycobacterium avium subsp. paratuberculosis
ccgccccgucggucgggcag

SEQ ID NO: 919717 - RNA, 17 nt, Mycobacterium avium subsp. paratuberculosis
ccgcccggcggcgcugc

SEQ ID NO: 919718 - RNA, 12 nt, Mycobacterium avium subsp. paratuberculosis
ccgcccgggcac

SEQ ID NO: 919719 - RNA, 13 nt, Mycobacterium avium subsp. paratuberculosis
ccgcccgggcacg

SEQ ID NO: 919720 - RNA, 23 nt, Mycobacterium avium subsp. paratuberculosis
ccgcccgggcacgacggucagca

SEQ ID NO: 919721 - RNA, 15 nt, Mycobacterium avium subsp. paratuberculosis
ccgcccgggcccggg

SEQ ID NO: 919722 - RNA, 18 nt, Mycobacterium avium subsp. paratuberculosis
ccgcccgggcccggggug

SEQ ID NO: 919723 - RNA, 12 nt, Mycobacterium avium subsp. paratuberculosis
ccgcccgggccg

SEQ ID NO: 919724 - RNA, 16 nt, Mycobacterium avium subsp. paratuberculosis
ccgcccggcgccccgc

SEQ ID NO: 919725 - RNA, 13 nt, Mycobacterium avium subsp. paratuberculosis
ccgcccggcgccg

SEQ ID NO: 919726 - RNA, 14 nt, Mycobacterium avium subsp. paratuberculosis
ccgcccggcgccgg

SEQ ID NO: 919727 - RNA, 17 nt, Mycobacterium avium subsp. paratuberculosis
ccgcccggcgccggccg

SEQ ID NO: 919728 - RNA, 12 nt, Mycobacterium avium subsp. paratuberculosis
ccgcccggcgcg

SEQ ID NO: 919729 - RNA, 13 nt, Mycobacterium avium subsp. paratuberculosis
ccgcccggcgcgc

SEQ ID NO: 919730 - RNA, 15 nt, Mycobacterium avium subsp. paratuberculosis
ccgcccggcgcgccg

SEQ ID NO: 919731 - RNA, 13 nt, Mycobacterium avium subsp. paratuberculosis
ccgcccggcggcc

SEQ ID NO: 919732 - RNA, 17 nt, Mycobacterium avium subsp. paratuberculosis
ccgcccggcccaagacc

SEQ ID NO: 919733 - RNA, 13 nt, Mycobacterium avium subsp. paratuberculosis
ccgcccggcccgg

SEQ ID NO: 919734 - RNA, 16 nt, Mycobacterium avium subsp. paratuberculosis
ccgcccggcccggcgc

SEQ ID NO: 919735 - RNA, 20 nt, Mycobacterium avium subsp. paratuberculosis
ccgcccggcccggcgcggcc

SEQ ID NO: 919736 - RNA, 21 nt, Mycobacterium avium subsp. paratuberculosis
ccgcccggcccggcgcggccg

SEQ ID NO: 919737 - RNA, 12 nt, Mycobacterium avium subsp. paratuberculosis
ccgcccggccgg

SEQ ID NO: 919738 - RNA, 16 nt, Mycobacterium avium subsp. paratuberculosis
ccgcccggccggucgc

SEQ ID NO: 919739 - RNA, 12 nt, Mycobacterium avium subsp. paratuberculosis
ccgcccggcgag

SEQ ID NO: 919740 - RNA, 13 nt, Mycobacterium avium subsp. paratuberculosis
ccgcccggcgagc

SEQ ID NO: 919741 - RNA, 21 nt, Mycobacterium avium subsp. paratuberculosis
ccgcccggcgauacccgggag

SEQ ID NO: 919742 - RNA, 23 nt, Mycobacterium avium subsp. paratuberculosis
ccgcccggcgauacccgggagca

SEQ ID NO: 919743 - RNA, 16 nt, Mycobacterium avium subsp. paratuberculosis
ccgcccggcgaucucg

SEQ ID NO: 919744 - RNA, 14 nt, Mycobacterium avium subsp. paratuberculosis
ccgcccgcggugug

SEQ ID NO: 919745 - RNA, 15 nt, Mycobacterium avium subsp. paratuberculosis
ccgcccgcggugugc

SEQ ID NO: 919746 - RNA, 17 nt, Mycobacterium avium subsp. paratuberculosis
ccgcccgcuccugcagg

SEQ ID NO: 919747 - RNA, 20 nt, Mycobacterium avium subsp. paratuberculosis
ccgcccgcucgacggccggu

SEQ ID NO: 919748 - RNA, 22 nt, Mycobacterium avium subsp. paratuberculosis
ccgcccgcugaccgccgcgcuc

SEQ ID NO: 919749 - RNA, 20 nt, Mycobacterium avium subsp. paratuberculosis
ccgcccgcuggggcgcaccg

SEQ ID NO: 919750 - RNA, 15 nt, Mycobacterium avium subsp. paratuberculosis
ccgcccgcgcguggu

SEQ ID NO: 919751 - RNA, 22 nt, Mycobacterium avium subsp. paratuberculosis
ccgcccgcgcguggucccacac

SEQ ID NO: 919752 - RNA, 16 nt, Mycobacterium avium subsp. paratuberculosis
ccgcccggaccgcggu

SEQ ID NO: 919753 - RNA, 19 nt, Mycobacterium avium subsp. paratuberculosis
ccgcccggaccgcggucgg

SEQ ID NO: 919754 - RNA, 16 nt, Mycobacterium avium subsp. paratuberculosis
ccgcccggaccggcuc

SEQ ID NO: 919755 - RNA, 23 nt, Mycobacterium avium subsp. paratuberculosis
ccgcccggagguucgccggaaug

SEQ ID NO: 919756 - RNA, 19 nt, Mycobacterium avium subsp. paratuberculosis
ccgcccggauucgcggcgg

SEQ ID NO: 919757 - RNA, 20 nt, Mycobacterium avium subsp. paratuberculosis
ccgcccggauucgcggcggc

SEQ ID NO: 919758 - RNA, 13 nt, Mycobacterium avium subsp. paratuberculosis
ccgcccgcgacug

SEQ ID NO: 919759 - RNA, 16 nt, Mycobacterium avium subsp. paratuberculosis
ccgcccgcagcggcgg

SEQ ID NO: 919760 - RNA, 22 nt, Mycobacterium avium subsp. paratuberculosis
ccgcccgccgggcacccgggug

SEQ ID NO: 919761 - RNA, 21 nt, Mycobacterium avium subsp. paratuberculosis
ccgccgaccaccuugcgcagc

SEQ ID NO: 919762 - RNA, 13 nt, Mycobacterium avium subsp. paratuberculosis
ccgccgacaccac

SEQ ID NO: 919763 - RNA, 15 nt, Mycobacterium avium subsp. paratuberculosis
ccgccgacaccaccg

SEQ ID NO: 919764 - RNA, 19 nt, Mycobacterium avium subsp. paratuberculosis
ccgccgacaccaccgcgcg

SEQ ID NO: 919765 - RNA, 20 nt, Mycobacterium avium subsp. paratuberculosis
ccgccgacaccaccgcgcgc

SEQ ID NO: 919766 - RNA, 13 nt, Mycobacterium avium subsp. paratuberculosis
ccgccgacagcac

SEQ ID NO: 919767 - RNA, 17 nt, Mycobacterium avium subsp. paratuberculosis
ccgccgacagcgggaug

SEQ ID NO: 919768 - RNA, 22 nt, Mycobacterium avium subsp. paratuberculosis
ccgccgaagcccgagcgucacg

SEQ ID NO: 919769 - RNA, 19 nt, Mycobacterium avium subsp. paratuberculosis
ccgccgaugaugguggcgg

SEQ ID NO: 919770 - RNA, 21 nt, Mycobacterium avium subsp. paratuberculosis
ccgccgaugaugguggcggcc

SEQ ID NO: 919771 - RNA, 16 nt, Mycobacterium avium subsp. paratuberculosis
ccgccgaucgugacgc

SEQ ID NO: 919772 - RNA, 17 nt, Mycobacterium avium subsp. paratuberculosis
ccgccgaucgugacgcc

SEQ ID NO: 919773 - RNA, 15 nt, Mycobacterium avium subsp. paratuberculosis
ccgccgaugacggcg

SEQ ID NO: 919774 - RNA, 16 nt, Mycobacterium avium subsp. paratuberculosis
ccgccgaccgcccgcu

SEQ ID NO: 919775 - RNA, 17 nt, Mycobacterium avium subsp. paratuberculosis
ccgccgaccgcccgcug

SEQ ID NO: 919776 - RNA, 21 nt, Mycobacterium avium subsp. paratuberculosis
ccgccgaucgaucagccgcga

SEQ ID NO: 919777 - RNA, 23 nt, Mycobacterium avium subsp. paratuberculosis
ccgccgaucgaucagccgcgaca

SEQ ID NO: 919778 - RNA, 20 nt, Mycobacterium avium subsp. paratuberculosis
ccgccgaacagcagcgcgcc

SEQ ID NO: 919779 - RNA, 18 nt, Mycobacterium avium subsp. paratuberculosis
ccgccgaacagccgggug

SEQ ID NO: 919780 - RNA, 16 nt, Mycobacterium avium subsp. paratuberculosis
ccgccgaaccagaucg

SEQ ID NO: 919781 - RNA, 18 nt, Mycobacterium avium subsp. paratuberculosis
ccgccgaaccagaucggc

SEQ ID NO: 919782 - RNA, 22 nt, Mycobacterium avium subsp. paratuberculosis
ccgccgaaccagaucggcgggu

SEQ ID NO: 919783 - RNA, 15 nt, Mycobacterium avium subsp. paratuberculosis
ccgccgaaccccagc

SEQ ID NO: 919784 - RNA, 15 nt, Mycobacterium avium subsp. paratuberculosis
ccgccgaacccgccc

SEQ ID NO: 919785 - RNA, 19 nt, Mycobacterium avium subsp. paratuberculosis
ccgccgaacccgcccucgc

SEQ ID NO: 919786 - RNA, 13 nt, Mycobacterium avium subsp. paratuberculosis
ccgccgaaccgau

SEQ ID NO: 919787 - RNA, 22 nt, Mycobacterium avium subsp. paratuberculosis
ccgccgaaccgaucaccggcag

SEQ ID NO: 919788 - RNA, 21 nt, Mycobacterium avium subsp. paratuberculosis
ccgcccuugcucgcggcguag

SEQ ID NO: 919789 - RNA, 15 nt, Mycobacterium avium subsp. paratuberculosis
ccgcccuuggccgcg

SEQ ID NO: 919790 - RNA, 14 nt, Mycobacterium avium subsp. paratuberculosis
ccgccgaaacaccg

SEQ ID NO: 919791 - RNA, 21 nt, Mycobacterium avium subsp. paratuberculosis
ccgccgaaacaccggcuucgg

SEQ ID NO: 919792 - RNA, 15 nt, Mycobacterium avium subsp. paratuberculosis
ccgccgaaacccgcu

SEQ ID NO: 919793 - RNA, 16 nt, Mycobacterium avium subsp. paratuberculosis
ccgccgaaacccgcug

SEQ ID NO: 919794 - RNA, 19 nt, Mycobacterium avium subsp. paratuberculosis
ccgccgaaacccgcuguca

SEQ ID NO: 919795 - RNA, 21 nt, Mycobacterium avium subsp. paratuberculosis
ccgccgaaagccuccgcgauc

SEQ ID NO: 919796 - RNA, 15 nt, Mycobacterium avium subsp. paratuberculosis
ccgccgaacaccggc

SEQ ID NO: 919797 - RNA, 16 nt, Mycobacterium avium subsp. paratuberculosis
ccgccgaacaccggca

SEQ ID NO: 919798 - RNA, 18 nt, Mycobacterium avium subsp. paratuberculosis
ccgccgaacaccggcagc

SEQ ID NO: 919799 - RNA, 21 nt, Mycobacterium avium subsp. paratuberculosis
ccgccgaacaccggcagcgcc

SEQ ID NO: 919800 - RNA, 23 nt, Mycobacterium avium subsp. paratuberculosis
ccgcccuuccagcaccccgucga

SEQ ID NO: 919801 - RNA, 17 nt, Mycobacterium avium subsp. paratuberculosis
ccgcccuggcuguagcg

SEQ ID NO: 919802 - RNA, 24 nt, Mycobacterium avium subsp. paratuberculosis
ccgcccuggcuguagcggucgugc

SEQ ID NO: 919803 - RNA, 20 nt, Mycobacterium avium subsp. paratuberculosis
ccgcccugcuugaacagcac

SEQ ID NO: 919804 - RNA, 13 nt, Mycobacterium avium subsp. paratuberculosis
ccgcccggggcgc

SEQ ID NO: 919805 - RNA, 17 nt, Mycobacterium avium subsp. paratuberculosis
ccgcccggggcggcgau

SEQ ID NO: 919806 - RNA, 14 nt, Mycobacterium avium subsp. paratuberculosis
ccgcccugcccguc

SEQ ID NO: 919807 - RNA, 16 nt, Mycobacterium avium subsp. paratuberculosis
ccgcccugcccgucgg

SEQ ID NO: 919808 - RNA, 12 nt, Mycobacterium avium subsp. paratuberculosis
ccgcccggguga

SEQ ID NO: 919809 - RNA, 15 nt, Mycobacterium avium subsp. paratuberculosis
ccgcccgggugaugg

SEQ ID NO: 919810 - RNA, 12 nt, Mycobacterium avium subsp. paratuberculosis
ccgcccgggugc

SEQ ID NO: 919811 - RNA, 14 nt, Mycobacterium avium subsp. paratuberculosis
ccgcccgggugugg

SEQ ID NO: 919812 - RNA, 13 nt, Mycobacterium avium subsp. paratuberculosis
ccgcccgggccgu

SEQ ID NO: 919813 - RNA, 22 nt, Mycobacterium avium subsp. paratuberculosis
ccgcccgggccguaucggcccc

SEQ ID NO: 919814 - RNA, 13 nt, Mycobacterium avium subsp. paratuberculosis
ccgcccgggcggc

SEQ ID NO: 919815 - RNA, 16 nt, Mycobacterium avium subsp. paratuberculosis
ccgcccgggcggcccg

SEQ ID NO: 919816 - RNA, 20 nt, Mycobacterium avium subsp. paratuberculosis
ccgcccgggcggcccgcauc

SEQ ID NO: 919817 - RNA, 19 nt, Mycobacterium avium subsp. paratuberculosis
ccgccgauucaaccccgcg

SEQ ID NO: 919818 - RNA, 21 nt, Mycobacterium avium subsp. paratuberculosis
ccgccgauucaaccccgcgcg

SEQ ID NO: 919819 - RNA, 16 nt, Mycobacterium avium subsp. paratuberculosis
ccgccgauuccggccg

SEQ ID NO: 919820 - RNA, 21 nt, Mycobacterium avium subsp. paratuberculosis
ccgccgcauuccucggccagc

SEQ ID NO: 919821 - RNA, 22 nt, Mycobacterium avium subsp. paratuberculosis
ccgccgcauuccucggccagcu

SEQ ID NO: 919822 - RNA, 23 nt, Mycobacterium avium subsp. paratuberculosis
ccgccgcauuccucggccagcuc

SEQ ID NO: 919823 - RNA, 12 nt, Mycobacterium avium subsp. paratuberculosis
ccgccgccaccg

SEQ ID NO: 919824 - RNA, 19 nt, Mycobacterium avium subsp. paratuberculosis
ccgccgauggacacgcugc

SEQ ID NO: 919825 - RNA, 16 nt, Mycobacterium avium subsp. paratuberculosis
ccgccgauggcgacgg

SEQ ID NO: 919826 - RNA, 21 nt, Mycobacterium avium subsp. paratuberculosis
ccgccgaugugaucggcggcc

SEQ ID NO: 919827 - RNA, 17 nt, Mycobacterium avium subsp. paratuberculosis
ccgccgaugcgcccgcu

SEQ ID NO: 919828 - RNA, 14 nt, Mycobacterium avium subsp. paratuberculosis
ccgccgccagcacc

SEQ ID NO: 919829 - RNA, 16 nt, Mycobacterium avium subsp. paratuberculosis
ccgccgccagcaccac

SEQ ID NO: 919830 - RNA, 15 nt, Mycobacterium avium subsp. paratuberculosis
ccgccgccaccgucg

SEQ ID NO: 919831 - RNA, 22 nt, Mycobacterium avium subsp. paratuberculosis
ccgccgccaccgucgccggcug

SEQ ID NO: 919832 - RNA, 14 nt, Mycobacterium avium subsp. paratuberculosis
ccgccgccagcagc

SEQ ID NO: 919833 - RNA, 20 nt, Mycobacterium avium subsp. paratuberculosis
ccgccgccagcagcagcgcc

SEQ ID NO: 919834 - RNA, 13 nt, Mycobacterium avium subsp. paratuberculosis
ccgccgccagcgc

SEQ ID NO: 919835 - RNA, 16 nt, Mycobacterium avium subsp. paratuberculosis
ccgccgccagcgccac

SEQ ID NO: 919836 - RNA, 14 nt, Mycobacterium avium subsp. paratuberculosis
ccgccgccagcgcg

SEQ ID NO: 919837 - RNA, 15 nt, Mycobacterium avium subsp. paratuberculosis
ccgccgccagcgcgg

SEQ ID NO: 919838 - RNA, 16 nt, Mycobacterium avium subsp. paratuberculosis
ccgccgcccgcccgag

SEQ ID NO: 919839 - RNA, 23 nt, Mycobacterium avium subsp. paratuberculosis
ccgccgccaucuccuccgggcug

SEQ ID NO: 919840 - RNA, 15 nt, Mycobacterium avium subsp. paratuberculosis
ccgccgccccgucgg

SEQ ID NO: 919841 - RNA, 14 nt, Mycobacterium avium subsp. paratuberculosis
ccgccgcccaggcc

SEQ ID NO: 919842 - RNA, 14 nt, Mycobacterium avium subsp. paratuberculosis
ccgccgcccacgcc

SEQ ID NO: 919843 - RNA, 16 nt, Mycobacterium avium subsp. paratuberculosis
ccgccgccauccgcgc

SEQ ID NO: 919844 - RNA, 13 nt, Mycobacterium avium subsp. paratuberculosis
ccgccgcggcgcc

SEQ ID NO: 919845 - RNA, 20 nt, Mycobacterium avium subsp. paratuberculosis
ccgccgcggcgcccggcgcc

SEQ ID NO: 919846 - RNA, 17 nt, Mycobacterium avium subsp. paratuberculosis
ccgccgcggccaggucg

SEQ ID NO: 919847 - RNA, 14 nt, Mycobacterium avium subsp. paratuberculosis
ccgccgcggccgcg

SEQ ID NO: 919848 - RNA, 18 nt, Mycobacterium avium subsp. paratuberculosis
ccgccgcggccgcggcgg

SEQ ID NO: 919849 - RNA, 15 nt, Mycobacterium avium subsp. paratuberculosis
ccgccgcggcgacca

SEQ ID NO: 919850 - RNA, 21 nt, Mycobacterium avium subsp. paratuberculosis
ccgccgcggcgaccacgaaca

SEQ ID NO: 919851 - RNA, 13 nt, Mycobacterium avium subsp. paratuberculosis
ccgccgcggcgag

SEQ ID NO: 919852 - RNA, 14 nt, Mycobacterium avium subsp. paratuberculosis
ccgccgcggcgagc

SEQ ID NO: 919853 - RNA, 15 nt, Mycobacterium avium subsp. paratuberculosis
ccgccgcggcgagcc

SEQ ID NO: 919854 - RNA, 19 nt, Mycobacterium avium subsp. paratuberculosis
ccgccgcggcgagccggcc

SEQ ID NO: 919855 - RNA, 20 nt, Mycobacterium avium subsp. paratuberculosis
ccgccgcggcgagccggccg

SEQ ID NO: 919856 - RNA, 13 nt, Mycobacterium avium subsp. paratuberculosis
ccgccgcggccac

SEQ ID NO: 919857 - RNA, 21 nt, Mycobacterium avium subsp. paratuberculosis
ccgccgcggagcggcggucac

SEQ ID NO: 919858 - RNA, 19 nt, Mycobacterium avium subsp. paratuberculosis
ccgccgcggaucuucuccg

SEQ ID NO: 919859 - RNA, 13 nt, Mycobacterium avium subsp. paratuberculosis
ccgccgcggcaac

SEQ ID NO: 919860 - RNA, 12 nt, Mycobacterium avium subsp. paratuberculosis
ccgccgcgcucg

SEQ ID NO: 919861 - RNA, 13 nt, Mycobacterium avium subsp. paratuberculosis
ccgccgcgcucgc

SEQ ID NO: 919862 - RNA, 20 nt, Mycobacterium avium subsp. paratuberculosis
ccgccgcgcucgcaccagcg

SEQ ID NO: 919863 - RNA, 21 nt, Mycobacterium avium subsp. paratuberculosis
ccgccgcgcucgcaccagcgc

SEQ ID NO: 919864 - RNA, 13 nt, Mycobacterium avium subsp. paratuberculosis
ccgccgcgcucgg

SEQ ID NO: 919865 - RNA, 13 nt, Mycobacterium avium subsp. paratuberculosis
ccgccgcgcggcc

SEQ ID NO: 919866 - RNA, 13 nt, Mycobacterium avium subsp. paratuberculosis
ccgccgcgcgggu

SEQ ID NO: 919867 - RNA, 14 nt, Mycobacterium avium subsp. paratuberculosis
ccgccgcgcgcggc

SEQ ID NO: 919868 - RNA, 17 nt, Mycobacterium avium subsp. paratuberculosis
ccgccgcgcgcggccac

SEQ ID NO: 919869 - RNA, 13 nt, Mycobacterium avium subsp. paratuberculosis
ccgccgcgccggg

SEQ ID NO: 919870 - RNA, 17 nt, Mycobacterium avium subsp. paratuberculosis
ccgccgcgccgggcgcc

SEQ ID NO: 919871 - RNA, 21 nt, Mycobacterium avium subsp. paratuberculosis
ccgccgcgccgggcgcccgag

SEQ ID NO: 919872 - RNA, 14 nt, Mycobacterium avium subsp. paratuberculosis
ccgccgcgcccguc

SEQ ID NO: 919873 - RNA, 16 nt, Mycobacterium avium subsp. paratuberculosis
ccgccgcgcccgucga

SEQ ID NO: 919874 - RNA, 17 nt, Mycobacterium avium subsp. paratuberculosis
ccgccgcgcccgucgag

SEQ ID NO: 919875 - RNA, 14 nt, Mycobacterium avium subsp. paratuberculosis
ccgccggacaccac

SEQ ID NO: 919876 - RNA, 18 nt, Mycobacterium avium subsp. paratuberculosis
ccgccggaacucggccgg

SEQ ID NO: 919877 - RNA, 20 nt, Mycobacterium avium subsp. paratuberculosis
ccgccggaacucggccggca

SEQ ID NO: 919878 - RNA, 14 nt, Mycobacterium avium subsp. paratuberculosis
ccgccggaucggca

SEQ ID NO: 919879 - RNA, 18 nt, Mycobacterium avium subsp. paratuberculosis
ccgccggaucggcagcgc

SEQ ID NO: 919880 - RNA, 22 nt, Mycobacterium avium subsp. paratuberculosis
ccgccggaucggcagcgcguug

SEQ ID NO: 919881 - RNA, 17 nt, Mycobacterium avium subsp. paratuberculosis
ccgccggagccgaucgc

SEQ ID NO: 919882 - RNA, 16 nt, Mycobacterium avium subsp. paratuberculosis
ccgccggagaccagca

SEQ ID NO: 919883 - RNA, 18 nt, Mycobacterium avium subsp. paratuberculosis
ccgccggagaccagcagc

SEQ ID NO: 919884 - RNA, 14 nt, Mycobacterium avium subsp. paratuberculosis
ccgccgcggugcug

SEQ ID NO: 919885 - RNA, 13 nt, Mycobacterium avium subsp. paratuberculosis
ccgccgcgguggg

SEQ ID NO: 919886 - RNA, 19 nt, Mycobacterium avium subsp. paratuberculosis
ccgccgcguacaccggcug

SEQ ID NO: 919887 - RNA, 12 nt, Mycobacterium avium subsp. paratuberculosis
ccgccgcgggcu

SEQ ID NO: 919888 - RNA, 13 nt, Mycobacterium avium subsp. paratuberculosis
ccgccgcgggcuc

SEQ ID NO: 919889 - RNA, 14 nt, Mycobacterium avium subsp. paratuberculosis
ccgccgcgggcucc

SEQ ID NO: 919890 - RNA, 22 nt, Mycobacterium avium subsp. paratuberculosis
ccgccgcgggucggcgacggcg

SEQ ID NO: 919891 - RNA, 23 nt, Mycobacterium avium subsp. paratuberculosis
ccgccgcgggucggcgacggcgc

SEQ ID NO: 919892 - RNA, 19 nt, Mycobacterium avium subsp. paratuberculosis
ccgccgcggguggccagcc

SEQ ID NO: 919893 - RNA, 14 nt, Mycobacterium avium subsp. paratuberculosis
ccgccgcggcggug

SEQ ID NO: 919894 - RNA, 15 nt, Mycobacterium avium subsp. paratuberculosis
ccgccgcggcggugg

SEQ ID NO: 919895 - RNA, 12 nt, Mycobacterium avium subsp. paratuberculosis
ccgccgcggcgg

SEQ ID NO: 919896 - RNA, 13 nt, Mycobacterium avium subsp. paratuberculosis
ccgccgcggcggc

SEQ ID NO: 919897 - RNA, 14 nt, Mycobacterium avium subsp. paratuberculosis
ccgccgcgggaugc

SEQ ID NO: 919898 - RNA, 17 nt, Mycobacterium avium subsp. paratuberculosis
ccgccggcgaucgacgu

SEQ ID NO: 919899 - RNA, 19 nt, Mycobacterium avium subsp. paratuberculosis
ccgccggcgaucucgucgc

SEQ ID NO: 919900 - RNA, 16 nt, Mycobacterium avium subsp. paratuberculosis
ccgccggcucagcggc

SEQ ID NO: 919901 - RNA, 21 nt, Mycobacterium avium subsp. paratuberculosis
ccgccggcggugcggguggug

SEQ ID NO: 919902 - RNA, 13 nt, Mycobacterium avium subsp. paratuberculosis
ccgccggcgucga

SEQ ID NO: 919903 - RNA, 19 nt, Mycobacterium avium subsp. paratuberculosis
ccgccggcgucgacgucgg

SEQ ID NO: 919904 - RNA, 21 nt, Mycobacterium avium subsp. paratuberculosis
ccgccggcgucgacgucggga

SEQ ID NO: 919905 - RNA, 18 nt, Mycobacterium avium subsp. paratuberculosis
ccgccggcgucgccgcuc

SEQ ID NO: 919906 - RNA, 23 nt, Mycobacterium avium subsp. paratuberculosis
ccgccggcgucgccgcucuucga

SEQ ID NO: 919907 - RNA, 14 nt, Mycobacterium avium subsp. paratuberculosis
ccgccggcgcaguc

SEQ ID NO: 919908 - RNA, 16 nt, Mycobacterium avium subsp. paratuberculosis
ccgccggcgcagucca

SEQ ID NO: 919909 - RNA, 22 nt, Mycobacterium avium subsp. paratuberculosis
ccgccggcgcaguccagggugg

SEQ ID NO: 919910 - RNA, 23 nt, Mycobacterium avium subsp. paratuberculosis
ccgccggccgguccucugcgacc

SEQ ID NO: 919911 - RNA, 21 nt, Mycobacterium avium subsp. paratuberculosis
ccgccggccucgggguugcug

SEQ ID NO: 919912 - RNA, 21 nt, Mycobacterium avium subsp. paratuberculosis
ccgccggcgaagcucgacgau

SEQ ID NO: 919913 - RNA, 23 nt, Mycobacterium avium subsp. paratuberculosis
ccgccggcgaagcucgacgauga

SEQ ID NO: 919914 - RNA, 18 nt, Mycobacterium avium subsp. paratuberculosis
ccgccggcgaacgacguc

SEQ ID NO: 919915 - RNA, 20 nt, Mycobacterium avium subsp. paratuberculosis
ccgccggcgaacgacgucga

SEQ ID NO: 919916 - RNA, 15 nt, Mycobacterium avium subsp. paratuberculosis
ccgccggccgcgcgu

SEQ ID NO: 919917 - RNA, 15 nt, Mycobacterium avium subsp. paratuberculosis
ccgccggccgcggcg

SEQ ID NO: 919918 - RNA, 17 nt, Mycobacterium avium subsp. paratuberculosis
ccgccggccgcggcgug

SEQ ID NO: 919919 - RNA, 20 nt, Mycobacterium avium subsp. paratuberculosis
ccgccggauuacucgccggc

SEQ ID NO: 919920 - RNA, 19 nt, Mycobacterium avium subsp. paratuberculosis
ccgccggcccggcguuacc

SEQ ID NO: 919921 - RNA, 13 nt, Mycobacterium avium subsp. paratuberculosis
ccgccggccgcgc

SEQ ID NO: 919922 - RNA, 16 nt, Mycobacterium avium subsp. paratuberculosis
ccgccgucgaccacga

SEQ ID NO: 919923 - RNA, 17 nt, Mycobacterium avium subsp. paratuberculosis
ccgccgucgacgcgugc

SEQ ID NO: 919924 - RNA, 14 nt, Mycobacterium avium subsp. paratuberculosis
ccgccgucaucggc

SEQ ID NO: 919925 - RNA, 18 nt, Mycobacterium avium subsp. paratuberculosis
ccgccguccagcgucacc

SEQ ID NO: 919926 - RNA, 22 nt, Mycobacterium avium subsp. paratuberculosis
ccgccgucccaccggcgaugug

SEQ ID NO: 919927 - RNA, 15 nt, Mycobacterium avium subsp. paratuberculosis
ccgccguccccgcgc

SEQ ID NO: 919928 - RNA, 17 nt, Mycobacterium avium subsp. paratuberculosis
ccgccguccccgcgcgg

SEQ ID NO: 919929 - RNA, 18 nt, Mycobacterium avium subsp. paratuberculosis
ccgccguccccgcgcggc

SEQ ID NO: 919930 - RNA, 19 nt, Mycobacterium avium subsp. paratuberculosis
ccgccguccccgcgcggcu

SEQ ID NO: 919931 - RNA, 20 nt, Mycobacterium avium subsp. paratuberculosis
ccgccguccccgcgcggcuc

SEQ ID NO: 919932 - RNA, 17 nt, Mycobacterium avium subsp. paratuberculosis
ccgccgucccgucacgg

SEQ ID NO: 919933 - RNA, 19 nt, Mycobacterium avium subsp. paratuberculosis
ccgccgucccgucacggcu

SEQ ID NO: 919934 - RNA, 16 nt, Mycobacterium avium subsp. paratuberculosis
ccgccgucccguccga

SEQ ID NO: 919935 - RNA, 20 nt, Mycobacterium avium subsp. paratuberculosis
ccgccgucccguccgacggc

SEQ ID NO: 919936 - RNA, 13 nt, Mycobacterium avium subsp. paratuberculosis
ccgccgggccgga

SEQ ID NO: 919937 - RNA, 22 nt, Mycobacterium avium subsp. paratuberculosis
ccgccgggccggaucgcgcagu

SEQ ID NO: 919938 - RNA, 15 nt, Mycobacterium avium subsp. paratuberculosis
ccgccgggccggcgg

SEQ ID NO: 919939 - RNA, 17 nt, Mycobacterium avium subsp. paratuberculosis
ccgccgggccggcggcc

SEQ ID NO: 919940 - RNA, 22 nt, Mycobacterium avium subsp. paratuberculosis
ccgccgggccaggugugcccgc

SEQ ID NO: 919941 - RNA, 14 nt, Mycobacterium avium subsp. paratuberculosis
ccgccgggccgccg

SEQ ID NO: 919942 - RNA, 15 nt, Mycobacterium avium subsp. paratuberculosis
ccgccgucacgccgu

SEQ ID NO: 919943 - RNA, 14 nt, Mycobacterium avium subsp. paratuberculosis
ccgccgggacgggc

SEQ ID NO: 919944 - RNA, 16 nt, Mycobacterium avium subsp. paratuberculosis
ccgccggcuggcgggc

SEQ ID NO: 919945 - RNA, 21 nt, Mycobacterium avium subsp. paratuberculosis
ccgccgggauaacccagcacc

SEQ ID NO: 919946 - RNA, 23 nt, Mycobacterium avium subsp. paratuberculosis
ccgccgggauaacccagcaccac

SEQ ID NO: 919947 - RNA, 14 nt, Mycobacterium avium subsp. paratuberculosis
ccgccgggaugcgc

SEQ ID NO: 919948 - RNA, 18 nt, Mycobacterium avium subsp. paratuberculosis
ccgccgggaugcgccacc

SEQ ID NO: 919949 - RNA, 19 nt, Mycobacterium avium subsp. paratuberculosis
ccgccgggaugcgccaccg

SEQ ID NO: 919950 - RNA, 22 nt, Mycobacterium avium subsp. paratuberculosis
ccgccgggaugcgccaccgaca

SEQ ID NO: 919951 - RNA, 15 nt, Mycobacterium avium subsp. paratuberculosis
ccgccgggcacccgg

SEQ ID NO: 919952 - RNA, 16 nt, Mycobacterium avium subsp. paratuberculosis
ccgccgggcaccucgg

SEQ ID NO: 919953 - RNA, 11 nt, Mycobacterium avium subsp. paratuberculosis
ccgccgggcau

SEQ ID NO: 919954 - RNA, 17 nt, Mycobacterium avium subsp. paratuberculosis
ccgccgggcauccgggc

SEQ ID NO: 919955 - RNA, 19 nt, Mycobacterium avium subsp. paratuberculosis
ccgccgggcauccgggccg

SEQ ID NO: 919956 - RNA, 20 nt, Mycobacterium avium subsp. paratuberculosis
ccgccgggcauccgggccgc

SEQ ID NO: 919957 - RNA, 15 nt, Mycobacterium avium subsp. paratuberculosis
ccgccgggccacgcc

SEQ ID NO: 919958 - RNA, 22 nt, Mycobacterium avium subsp. paratuberculosis
ccgccgggccacgccgacuagc

SEQ ID NO: 919959 - RNA, 16 nt, Mycobacterium avium subsp. paratuberculosis
ccgccguggcccacgc

SEQ ID NO: 919960 - RNA, 23 nt, Mycobacterium avium subsp. paratuberculosis
ccgccguggaagauguugccgcc

SEQ ID NO: 919961 - RNA, 13 nt, Mycobacterium avium subsp. paratuberculosis
ccgccguggacga

SEQ ID NO: 919962 - RNA, 23 nt, Mycobacterium avium subsp. paratuberculosis
ccgccguggcagggccagcagcc

SEQ ID NO: 919963 - RNA, 18 nt, Mycobacterium avium subsp. paratuberculosis
ccgccgugaccggcgauc

SEQ ID NO: 919964 - RNA, 19 nt, Mycobacterium avium subsp. paratuberculosis
ccgccgugcgcggcgacca

SEQ ID NO: 919965 - RNA, 23 nt, Mycobacterium avium subsp. paratuberculosis
ccgccgugcgcggcgaccaccuc

SEQ ID NO: 919966 - RNA, 16 nt, Mycobacterium avium subsp. paratuberculosis
ccgccguguaggccgc

SEQ ID NO: 919967 - RNA, 18 nt, Mycobacterium avium subsp. paratuberculosis
ccgccguguaggccgcgc

SEQ ID NO: 919968 - RNA, 20 nt, Mycobacterium avium subsp. paratuberculosis
ccgccguguaggccgcgcug

SEQ ID NO: 919969 - RNA, 22 nt, Mycobacterium avium subsp. paratuberculosis
ccgccguguaggccgcgcuggc

SEQ ID NO: 919970 - RNA, 21 nt, Mycobacterium avium subsp. paratuberculosis
ccgccguuccgaugaagaaca

SEQ ID NO: 919971 - RNA, 22 nt, Mycobacterium avium subsp. paratuberculosis
ccgccgugcauccagccgucca

SEQ ID NO: 919972 - RNA, 15 nt, Mycobacterium avium subsp. paratuberculosis
ccgccgucgguguag

SEQ ID NO: 919973 - RNA, 21 nt, Mycobacterium avium subsp. paratuberculosis
ccgccgucgguguagcgagug

SEQ ID NO: 919974 - RNA, 16 nt, Mycobacterium avium subsp. paratuberculosis
ccgccgucgcgccagg

SEQ ID NO: 919975 - RNA, 21 nt, Mycobacterium avium subsp. paratuberculosis
ccgccgucggggcgucggcgg

SEQ ID NO: 919976 - RNA, 22 nt, Mycobacterium avium subsp. paratuberculosis
ccgccgucggggcgucggcggc

SEQ ID NO: 919977 - RNA, 23 nt, Mycobacterium avium subsp. paratuberculosis
ccgccgucggggcgucggcggcc

SEQ ID NO: 919978 - RNA, 13 nt, Mycobacterium avium subsp. paratuberculosis
ccgccgucggggu

SEQ ID NO: 919979 - RNA, 15 nt, Mycobacterium avium subsp. paratuberculosis
ccgccgucggggugc

SEQ ID NO: 919980 - RNA, 13 nt, Mycobacterium avium subsp. paratuberculosis
ccgccucgacggu

SEQ ID NO: 919981 - RNA, 14 nt, Mycobacterium avium subsp. paratuberculosis
ccgccucggccacc

SEQ ID NO: 919982 - RNA, 13 nt, Mycobacterium avium subsp. paratuberculosis
ccgccucggcgag

SEQ ID NO: 919983 - RNA, 20 nt, Mycobacterium avium subsp. paratuberculosis
ccgccucggcgaggucgucg

SEQ ID NO: 919984 - RNA, 14 nt, Mycobacterium avium subsp. paratuberculosis
ccgccucggcggag

SEQ ID NO: 919985 - RNA, 14 nt, Mycobacterium avium subsp. paratuberculosis
ccgccucggcggcc

SEQ ID NO: 919986 - RNA, 13 nt, Mycobacterium avium subsp. paratuberculosis
ccgccucggcggc

SEQ ID NO: 919987 - RNA, 15 nt, Mycobacterium avium subsp. paratuberculosis
ccgccuggacgacgu

SEQ ID NO: 919988 - RNA, 18 nt, Mycobacterium avium subsp. paratuberculosis
ccgccuggacgacgucga

SEQ ID NO: 919989 - RNA, 20 nt, Mycobacterium avium subsp. paratuberculosis
ccgccuggacgacgucgaug

SEQ ID NO: 919990 - RNA, 23 nt, Mycobacterium avium subsp. paratuberculosis
ccgccugucaguuugcgcgacgg

SEQ ID NO: 919991 - RNA, 13 nt, Mycobacterium avium subsp. paratuberculosis
ccgccucgccggu

SEQ ID NO: 919992 - RNA, 16 nt, Mycobacterium avium subsp. paratuberculosis
ccgccucgccggucac

SEQ ID NO: 919993 - RNA, 21 nt, Mycobacterium avium subsp. paratuberculosis
ccgccuccgggcugccguaga

SEQ ID NO: 919994 - RNA, 20 nt, Mycobacterium avium subsp. paratuberculosis
ccgccuccgguuugcgccgg

SEQ ID NO: 919995 - RNA, 19 nt, Mycobacterium avium subsp. paratuberculosis
ccgccucgaagucgccggc

SEQ ID NO: 919996 - RNA, 21 nt, Mycobacterium avium subsp. paratuberculosis
ccgccucgaagucgccggccu

SEQ ID NO: 919997 - RNA, 17 nt, Mycobacterium avium subsp. paratuberculosis
ccgccguucgccggcga

SEQ ID NO: 919998 - RNA, 21 nt, Mycobacterium avium subsp. paratuberculosis
ccgccguucgccggcgacggc

SEQ ID NO: 919999 - RNA, 22 nt, Mycobacterium avium subsp. paratuberculosis
ccgccguucucgcgcaggucac

SEQ ID NO: 920000 - RNA, 15 nt, Mycobacterium avium subsp. paratuberculosis
ccgccguugaccggu

SEQ ID NO: 920001 - RNA, 17 nt, Mycobacterium avium subsp. paratuberculosis
ccgccguugaccggugc

SEQ ID NO: 920002 - RNA, 13 nt, Mycobacterium avium subsp. paratuberculosis
ccgccuccgacca

SEQ ID NO: 920003 - RNA, 15 nt, Mycobacterium avium subsp. paratuberculosis
ccgccuccgaccagc

SEQ ID NO: 920004 - RNA, 17 nt, Mycobacterium avium subsp. paratuberculosis
ccgccuccgaccagccg

SEQ ID NO: 920005 - RNA, 20 nt, Mycobacterium avium subsp. paratuberculosis
ccgccuccgaccagccgguc

SEQ ID NO: 920006 - RNA, 15 nt, Mycobacterium avium subsp. paratuberculosis
ccgcgauccagcgcu

SEQ ID NO: 920007 - RNA, 23 nt, Mycobacterium avium subsp. paratuberculosis
ccgcgagcgggugaaucgacacc

SEQ ID NO: 920008 - RNA, 17 nt, Mycobacterium avium subsp. paratuberculosis
ccgcgaggaaucgcggc

SEQ ID NO: 920009 - RNA, 20 nt, Mycobacterium avium subsp. paratuberculosis
ccgcgaggauuucgcucagc

SEQ ID NO: 920010 - RNA, 20 nt, Mycobacterium avium subsp. paratuberculosis
ccgcgauccagcgcuggccg

SEQ ID NO: 920011 - RNA, 15 nt, Mycobacterium avium subsp. paratuberculosis
ccgcgauccgggcau

SEQ ID NO: 920012 - RNA, 23 nt, Mycobacterium avium subsp. paratuberculosis
ccgcgaucgaguaguccgggaug

SEQ ID NO: 920013 - RNA, 16 nt, Mycobacterium avium subsp. paratuberculosis
ccgcgaucgccaacgc

SEQ ID NO: 920014 - RNA, 17 nt, Mycobacterium avium subsp. paratuberculosis
ccgcgaucgccaacgcg

SEQ ID NO: 920015 - RNA, 23 nt, Mycobacterium avium subsp. paratuberculosis
ccgcgaucgccagcgcggugucg

SEQ ID NO: 920016 - RNA, 17 nt, Mycobacterium avium subsp. paratuberculosis
ccgcgaucgccgacguc

SEQ ID NO: 920017 - RNA, 19 nt, Mycobacterium avium subsp. paratuberculosis
ccgcgaucgccgacgucgg

SEQ ID NO: 920018 - RNA, 20 nt, Mycobacterium avium subsp. paratuberculosis
ccgcgaucggauggugccca

SEQ ID NO: 920019 - RNA, 22 nt, Mycobacterium avium subsp. paratuberculosis
ccgcgaucggauggugcccacc

SEQ ID NO: 920020 - RNA, 14 nt, Mycobacterium avium subsp. paratuberculosis
ccgcgaucggcgcc

SEQ ID NO: 920021 - RNA, 15 nt, Mycobacterium avium subsp. paratuberculosis
ccgcgaucggcgcca

SEQ ID NO: 920022 - RNA, 16 nt, Mycobacterium avium subsp. paratuberculosis
ccgcgaucggcgccac

SEQ ID NO: 920023 - RNA, 20 nt, Mycobacterium avium subsp. paratuberculosis
ccgcgcaauacccgaccagc

SEQ ID NO: 920024 - RNA, 22 nt, Mycobacterium avium subsp. paratuberculosis
ccgcgcaauacccgaccagcac

SEQ ID NO: 920025 - RNA, 14 nt, Mycobacterium avium subsp. paratuberculosis
ccgcgcaccaccuc

SEQ ID NO: 920026 - RNA, 23 nt, Mycobacterium avium subsp. paratuberculosis
ccgcgcaccaccucuucgugcac

SEQ ID NO: 920027 - RNA, 16 nt, Mycobacterium avium subsp. paratuberculosis
ccgcgcaccacggugg

SEQ ID NO: 920028 - RNA, 18 nt, Mycobacterium avium subsp. paratuberculosis
ccgcgcaccacgguggcg

SEQ ID NO: 920029 - RNA, 13 nt, Mycobacterium avium subsp. paratuberculosis
ccgcgaugaucac

SEQ ID NO: 920030 - RNA, 23 nt, Mycobacterium avium subsp. paratuberculosis
ccgcgaugaucacacccacgaac

SEQ ID NO: 920031 - RNA, 18 nt, Mycobacterium avium subsp. paratuberculosis
ccgcgagcgcuaccgcgc

SEQ ID NO: 920032 - RNA, 22 nt, Mycobacterium avium subsp. paratuberculosis
ccgcgaucuccuuguugacgau

SEQ ID NO: 920033 - RNA, 20 nt, Mycobacterium avium subsp. paratuberculosis
ccgcgaucugcucggugucg

SEQ ID NO: 920034 - RNA, 17 nt, Mycobacterium avium subsp. paratuberculosis
ccgcgaucuugccgccg

SEQ ID NO: 920035 - RNA, 16 nt, Mycobacterium avium subsp. paratuberculosis
ccgcgaucucggcgga

SEQ ID NO: 920036 - RNA, 14 nt, Mycobacterium avium subsp. paratuberculosis
ccgcgccagcucgg

SEQ ID NO: 920037 - RNA, 16 nt, Mycobacterium avium subsp. paratuberculosis
ccgcgccagcucggcg

SEQ ID NO: 920038 - RNA, 20 nt, Mycobacterium avium subsp. paratuberculosis
ccgcgccagcucggcggccg

SEQ ID NO: 920039 - RNA, 13 nt, Mycobacterium avium subsp. paratuberculosis
ccgcgcagaucgc

SEQ ID NO: 920040 - RNA, 15 nt, Mycobacterium avium subsp. paratuberculosis
ccgcgccagccgccg

SEQ ID NO: 920041 - RNA, 19 nt, Mycobacterium avium subsp. paratuberculosis
ccgcgccagccgccgccga

SEQ ID NO: 920042 - RNA, 17 nt, Mycobacterium avium subsp. paratuberculosis
ccgcgcagaucgccagc

SEQ ID NO: 920043 - RNA, 19 nt, Mycobacterium avium subsp. paratuberculosis
ccgcgcagaucgccagcac

SEQ ID NO: 920044 - RNA, 21 nt, Mycobacterium avium subsp. paratuberculosis
ccgcgcagaucgccagcaccg

SEQ ID NO: 920045 - RNA, 13 nt, Mycobacterium avium subsp. paratuberculosis
ccgcgccagcacc

SEQ ID NO: 920046 - RNA, 14 nt, Mycobacterium avium subsp. paratuberculosis
ccgcgccagcaccu

SEQ ID NO: 920047 - RNA, 15 nt, Mycobacterium avium subsp. paratuberculosis
ccgcgccagcaccuc

SEQ ID NO: 920048 - RNA, 15 nt, Mycobacterium avium subsp. paratuberculosis
ccgcgcagaaccgca

SEQ ID NO: 920049 - RNA, 21 nt, Mycobacterium avium subsp. paratuberculosis
ccgcgcagaaccgcaccccgu

SEQ ID NO: 920050 - RNA, 17 nt, Mycobacterium avium subsp. paratuberculosis
ccgcgcacucgaacggc

SEQ ID NO: 920051 - RNA, 14 nt, Mycobacterium avium subsp. paratuberculosis
ccgcgcacgcucgc

SEQ ID NO: 920052 - RNA, 19 nt, Mycobacterium avium subsp. paratuberculosis
ccgcgcacgcucgcggugc

SEQ ID NO: 920053 - RNA, 14 nt, Mycobacterium avium subsp. paratuberculosis
ccgcgcacgacgug

SEQ ID NO: 920054 - RNA, 15 nt, Mycobacterium avium subsp. paratuberculosis
ccgcgcacgacgugg

SEQ ID NO: 920055 - RNA, 15 nt, Mycobacterium avium subsp. paratuberculosis
ccgcgcaccgccccg

SEQ ID NO: 920056 - RNA, 20 nt, Mycobacterium avium subsp. paratuberculosis
ccgcgcaccgccccgcccuu

SEQ ID NO: 920057 - RNA, 13 nt, Mycobacterium avium subsp. paratuberculosis
ccgcgcaccgcga

SEQ ID NO: 920058 - RNA, 14 nt, Mycobacterium avium subsp. paratuberculosis
ccgcgcaccggcgc

SEQ ID NO: 920059 - RNA, 18 nt, Mycobacterium avium subsp. paratuberculosis
ccgcgcaccgucaucgcg

SEQ ID NO: 920060 - RNA, 22 nt, Mycobacterium avium subsp. paratuberculosis
ccgcgcaccgucaucgcggcga

SEQ ID NO: 920061 - RNA, 16 nt, Mycobacterium avium subsp. paratuberculosis
ccgccuucgacggccg

SEQ ID NO: 920062 - RNA, 19 nt, Mycobacterium avium subsp. paratuberculosis
ccgccuucgacggccggcc

SEQ ID NO: 920063 - RNA, 13 nt, Mycobacterium avium subsp. paratuberculosis
ccgccuuccggga

SEQ ID NO: 920064 - RNA, 15 nt, Mycobacterium avium subsp. paratuberculosis
ccgccuuccgggaau

SEQ ID NO: 920065 - RNA, 17 nt, Mycobacterium avium subsp. paratuberculosis
ccgccuucacgaccggc

SEQ ID NO: 920066 - RNA, 19 nt, Mycobacterium avium subsp. paratuberculosis
ccgccuucacgaccggcag

SEQ ID NO: 920067 - RNA, 19 nt, Mycobacterium avium subsp. paratuberculosis
ccgccugugcgacggcguc

SEQ ID NO: 920068 - RNA, 20 nt, Mycobacterium avium subsp. paratuberculosis
ccgccugugcgacggcgucg

SEQ ID NO: 920069 - RNA, 22 nt, Mycobacterium avium subsp. paratuberculosis
ccgccugugcgacggcgucggc

SEQ ID NO: 920070 - RNA, 17 nt, Mycobacterium avium subsp. paratuberculosis
ccgccuggccaccucga

SEQ ID NO: 920071 - RNA, 18 nt, Mycobacterium avium subsp. paratuberculosis
ccgccuuggccacgucga

SEQ ID NO: 920072 - RNA, 17 nt, Mycobacterium avium subsp. paratuberculosis
ccgccuugcccggcucg

SEQ ID NO: 920073 - RNA, 18 nt, Mycobacterium avium subsp. paratuberculosis
ccgccuugcccggcucgg

SEQ ID NO: 920074 - RNA, 22 nt, Mycobacterium avium subsp. paratuberculosis
ccgcgacccgaacuucagcgcg

SEQ ID NO: 920075 - RNA, 14 nt, Mycobacterium avium subsp. paratuberculosis
ccgcgacccggccg

SEQ ID NO: 920076 - RNA, 15 nt, Mycobacterium avium subsp. paratuberculosis
ccgcgacccggccga

SEQ ID NO: 920077 - RNA, 19 nt, Mycobacterium avium subsp. paratuberculosis
ccgcgacccggccgagcgc

SEQ ID NO: 920078 - RNA, 15 nt, Mycobacterium avium subsp. paratuberculosis
ccgcgacccgggccg

SEQ ID NO: 920079 - RNA, 13 nt, Mycobacterium avium subsp. paratuberculosis
ccgcgaccgcagc

SEQ ID NO: 920080 - RNA, 14 nt, Mycobacterium avium subsp. paratuberculosis
ccgcgaccgcagca

SEQ ID NO: 920081 - RNA, 20 nt, Mycobacterium avium subsp. paratuberculosis
ccgcgaccgcagcaggcgga

SEQ ID NO: 920082 - RNA, 15 nt, Mycobacterium avium subsp. paratuberculosis
ccgcgaccgccucgu

SEQ ID NO: 920083 - RNA, 16 nt, Mycobacterium avium subsp. paratuberculosis
ccgcgagcgcagcagg

SEQ ID NO: 920084 - RNA, 20 nt, Mycobacterium avium subsp. paratuberculosis
ccgcgagcgcgcggugauga

SEQ ID NO: 920085 - RNA, 21 nt, Mycobacterium avium subsp. paratuberculosis
ccgcgagcgcgcggugaugac

SEQ ID NO: 920086 - RNA, 13 nt, Mycobacterium avium subsp. paratuberculosis
ccgcgagcccggc

SEQ ID NO: 920087 - RNA, 15 nt, Mycobacterium avium subsp. paratuberculosis
ccgcgagcccggcga

SEQ ID NO: 920088 - RNA, 13 nt, Mycobacterium avium subsp. paratuberculosis
ccgcgagccgagc

SEQ ID NO: 920089 - RNA, 14 nt, Mycobacterium avium subsp. paratuberculosis
ccgcgagccgagcc

SEQ ID NO: 920090 - RNA, 18 nt, Mycobacterium avium subsp. paratuberculosis
ccgcgagccgcccaggcg

SEQ ID NO: 920091 - RNA, 21 nt, Mycobacterium avium subsp. paratuberculosis
ccgcgagccgcccaggcgggc

SEQ ID NO: 920092 - RNA, 14 nt, Mycobacterium avium subsp. paratuberculosis
ccgcgagacccggu

SEQ ID NO: 920093 - RNA, 18 nt, Mycobacterium avium subsp. paratuberculosis
ccgcgagaucagcgccau

SEQ ID NO: 920094 - RNA, 15 nt, Mycobacterium avium subsp. paratuberculosis
ccgcgagcacgacgu

SEQ ID NO: 920095 - RNA, 14 nt, Mycobacterium avium subsp. paratuberculosis
ccgcgagcagacac

SEQ ID NO: 920096 - RNA, 20 nt, Mycobacterium avium subsp. paratuberculosis
ccgcgagcagacacaaaagc

SEQ ID NO: 920097 - RNA, 18 nt, Mycobacterium avium subsp. paratuberculosis
ccgcgacgcgcggucguc

SEQ ID NO: 920098 - RNA, 16 nt, Mycobacterium avium subsp. paratuberculosis
ccgcgacgccaacaac

SEQ ID NO: 920099 - RNA, 15 nt, Mycobacterium avium subsp. paratuberculosis
ccgcgacgcccaggu

SEQ ID NO: 920100 - RNA, 17 nt, Mycobacterium avium subsp. paratuberculosis
ccgcgacgcccaggugc

SEQ ID NO: 920101 - RNA, 22 nt, Mycobacterium avium subsp. paratuberculosis
ccgcgacgcccaggugcacccg

SEQ ID NO: 920102 - RNA, 12 nt, Mycobacterium avium subsp. paratuberculosis
ccgcgacgccgc

SEQ ID NO: 920103 - RNA, 13 nt, Mycobacterium avium subsp. paratuberculosis
ccgcgacgccgcc

SEQ ID NO: 920104 - RNA, 18 nt, Mycobacterium avium subsp. paratuberculosis
ccgcgacgccgccgccga

SEQ ID NO: 920105 - RNA, 15 nt, Mycobacterium avium subsp. paratuberculosis
ccgcgacgccgugcu

SEQ ID NO: 920106 - RNA, 17 nt, Mycobacterium avium subsp. paratuberculosis
ccgcgacgaccgccugc

SEQ ID NO: 920107 - RNA, 14 nt, Mycobacterium avium subsp. paratuberculosis
ccgcgacgaccucg

SEQ ID NO: 920108 - RNA, 21 nt, Mycobacterium avium subsp. paratuberculosis
ccgcgacgaccucgcccgccg

SEQ ID NO: 920109 - RNA, 22 nt, Mycobacterium avium subsp. paratuberculosis
ccgcgacgaucgcgacggccgg

SEQ ID NO: 920110 - RNA, 19 nt, Mycobacterium avium subsp. paratuberculosis
ccgcgacgaugccggcguc

SEQ ID NO: 920111 - RNA, 20 nt, Mycobacterium avium subsp. paratuberculosis
ccgcgacgaugccggcgucg

SEQ ID NO: 920112 - RNA, 23 nt, Mycobacterium avium subsp. paratuberculosis
ccgcgacgaugucgacccgcggc

SEQ ID NO: 920113 - RNA, 13 nt, Mycobacterium avium subsp. paratuberculosis
ccgcgaccgucag

SEQ ID NO: 920114 - RNA, 15 nt, Mycobacterium avium subsp. paratuberculosis
ccgccuugacgccgg

SEQ ID NO: 920115 - RNA, 16 nt, Mycobacterium avium subsp. paratuberculosis
ccgcgacgacaccacc

SEQ ID NO: 920116 - RNA, 16 nt, Mycobacterium avium subsp. paratuberculosis
ccgcuguccucgucgg

SEQ ID NO: 920117 - RNA, 14 nt, Mycobacterium avium subsp. paratuberculosis
ccgcuguggacagg

SEQ ID NO: 920118 - RNA, 18 nt, Mycobacterium avium subsp. paratuberculosis
ccgcuucaggcagcgcac

SEQ ID NO: 920119 - RNA, 19 nt, Mycobacterium avium subsp. paratuberculosis
ccgcugugguccucgucac

SEQ ID NO: 920120 - RNA, 20 nt, Mycobacterium avium subsp. paratuberculosis
ccgcugugguccucgucacc

SEQ ID NO: 920121 - RNA, 14 nt, Mycobacterium avium subsp. paratuberculosis
ccgcugucgucguc

SEQ ID NO: 920122 - RNA, 20 nt, Mycobacterium avium subsp. paratuberculosis
ccgcugugauagcggcguac

SEQ ID NO: 920123 - RNA, 22 nt, Mycobacterium avium subsp. paratuberculosis
ccgcugucggugugagcgguga

SEQ ID NO: 920124 - RNA, 19 nt, Mycobacterium avium subsp. paratuberculosis
ccgcugucaauccccgcgg

SEQ ID NO: 920125 - RNA, 14 nt, Mycobacterium avium subsp. paratuberculosis
ccgcugcgcccagc

SEQ ID NO: 920126 - RNA, 17 nt, Mycobacterium avium subsp. paratuberculosis
ccgcugcgcccagcgcg

SEQ ID NO: 920127 - RNA, 18 nt, Mycobacterium avium subsp. paratuberculosis
ccgcugcgcccagcgcgc

SEQ ID NO: 920128 - RNA, 14 nt, Mycobacterium avium subsp. paratuberculosis
ccgcugcgccgacu

SEQ ID NO: 920129 - RNA, 22 nt, Mycobacterium avium subsp. paratuberculosis
ccgcugcgccgacuugaucgcg

SEQ ID NO: 920130 - RNA, 14 nt, Mycobacterium avium subsp. paratuberculosis
ccgcugccggccga

SEQ ID NO: 920131 - RNA, 15 nt, Mycobacterium avium subsp. paratuberculosis
ccgcugcgccggcgc

SEQ ID NO: 920132 - RNA, 20 nt, Mycobacterium avium subsp. paratuberculosis
ccgcugcggcaaugccguug

SEQ ID NO: 920133 - RNA, 13 nt, Mycobacterium avium subsp. paratuberculosis
ccgcugcggcaca

SEQ ID NO: 920134 - RNA, 15 nt, Mycobacterium avium subsp. paratuberculosis
ccgcuggggcccagc

SEQ ID NO: 920135 - RNA, 17 nt, Mycobacterium avium subsp. paratuberculosis
ccgcuggggcccagcuc

SEQ ID NO: 920136 - RNA, 19 nt, Mycobacterium avium subsp. paratuberculosis
ccgcuggggcccagcucca

SEQ ID NO: 920137 - RNA, 19 nt, Mycobacterium avium subsp. paratuberculosis
ccgcuggggcgcaccgccu

SEQ ID NO: 920138 - RNA, 20 nt, Mycobacterium avium subsp. paratuberculosis
ccgcuggggcgcaccgccug

SEQ ID NO: 920139 - RNA, 20 nt, Mycobacterium avium subsp. paratuberculosis
ccgcugguagcugcugucga

SEQ ID NO: 920140 - RNA, 17 nt, Mycobacterium avium subsp. paratuberculosis
ccgcugguaggcggcgc

SEQ ID NO: 920141 - RNA, 20 nt, Mycobacterium avium subsp. paratuberculosis
ccgcugguaggcggcgcagc

SEQ ID NO: 920142 - RNA, 21 nt, Mycobacterium avium subsp. paratuberculosis
ccgcugguaggcggcgcagcc

SEQ ID NO: 920143 - RNA, 16 nt, Mycobacterium avium subsp. paratuberculosis
ccgcuggugcgcgccg

SEQ ID NO: 920144 - RNA, 21 nt, Mycobacterium avium subsp. paratuberculosis
ccgcuggugcgcgccggcguc

SEQ ID NO: 920145 - RNA, 22 nt, Mycobacterium avium subsp. paratuberculosis
ccgcuggugcgcgccggcgucg

SEQ ID NO: 920146 - RNA, 18 nt, Mycobacterium avium subsp. paratuberculosis
ccgcuggugaggucgcgc

SEQ ID NO: 920147 - RNA, 22 nt, Mycobacterium avium subsp. paratuberculosis
ccgcugguggugaucacccagc

SEQ ID NO: 920148 - RNA, 20 nt, Mycobacterium avium subsp. paratuberculosis
ccgcuucgucgccggccgcc

SEQ ID NO: 920149 - RNA, 14 nt, Mycobacterium avium subsp. paratuberculosis
ccgcuucgcccggc

SEQ ID NO: 920150 - RNA, 17 nt, Mycobacterium avium subsp. paratuberculosis
ccgcuucgcccggcugc

SEQ ID NO: 920151 - RNA, 15 nt, Mycobacterium avium subsp. paratuberculosis
ccgcuucuggcgggc

SEQ ID NO: 920152 - RNA, 15 nt, Mycobacterium avium subsp. paratuberculosis
ccgcuugacgccgcc

SEQ ID NO: 920153 - RNA, 16 nt, Mycobacterium avium subsp. paratuberculosis
ccgcuugacgccgccg

SEQ ID NO: 920154 - RNA, 18 nt, Mycobacterium avium subsp. paratuberculosis
ccgcuugacgccgccgaa

SEQ ID NO: 920155 - RNA, 14 nt, Mycobacterium avium subsp. paratuberculosis
ccgcuugauggcgg

SEQ ID NO: 920156 - RNA, 13 nt, Mycobacterium avium subsp. paratuberculosis
ccgcuugccgacg

SEQ ID NO: 920157 - RNA, 21 nt, Mycobacterium avium subsp. paratuberculosis
ccgcuugcgacuggauggcga

SEQ ID NO: 920158 - RNA, 23 nt, Mycobacterium avium subsp. paratuberculosis
ccgcuugcgacuggauggcgaug

SEQ ID NO: 920159 - RNA, 19 nt, Mycobacterium avium subsp. paratuberculosis
ccgcuuugaauugagcgcc

SEQ ID NO: 920160 - RNA, 22 nt, Mycobacterium avium subsp. paratuberculosis
ccgcuuugaauugagcgccggg

SEQ ID NO: 920161 - RNA, 16 nt, Mycobacterium avium subsp. paratuberculosis
ccgcuuuugccgucgg

SEQ ID NO: 920162 - RNA, 19 nt, Mycobacterium avium subsp. paratuberculosis
ccgcuuuccaccccggcgg

SEQ ID NO: 920163 - RNA, 17 nt, Mycobacterium avium subsp. paratuberculosis
ccgcuugguggcgccgg

SEQ ID NO: 920164 - RNA, 16 nt, Mycobacterium avium subsp. paratuberculosis
ccgcuuggccgggcgg

SEQ ID NO: 920165 - RNA, 20 nt, Mycobacterium avium subsp. paratuberculosis
ccgcuuggcgcgccgcaccu

SEQ ID NO: 920166 - RNA, 23 nt, Mycobacterium avium subsp. paratuberculosis
ccgcuuggcgcgccgcaccucgc

SEQ ID NO: 920167 - RNA, 16 nt, Mycobacterium avium subsp. paratuberculosis
ccggaaaaguucggcg

SEQ ID NO: 920168 - RNA, 14 nt, Mycobacterium avium subsp. paratuberculosis
ccggaaagcgcggg

SEQ ID NO: 920169 - RNA, 18 nt, Mycobacterium avium subsp. paratuberculosis
ccggaaagcgcgggcagc

SEQ ID NO: 920170 - RNA, 20 nt, Mycobacterium avium subsp. paratuberculosis
ccggaaccgggcacccggcg

SEQ ID NO: 920171 - RNA, 21 nt, Mycobacterium avium subsp. paratuberculosis
ccggaaccgggcacccggcgc

SEQ ID NO: 920172 - RNA, 15 nt, Mycobacterium avium subsp. paratuberculosis
ccggaacacgugauc

SEQ ID NO: 920173 - RNA, 14 nt, Mycobacterium avium subsp. paratuberculosis
ccgcgucgcgcagc

SEQ ID NO: 920174 - RNA, 17 nt, Mycobacterium avium subsp. paratuberculosis
ccgcgucgccgccgggc

SEQ ID NO: 920175 - RNA, 21 nt, Mycobacterium avium subsp. paratuberculosis
ccgcgucgaugcgggcccgca

SEQ ID NO: 920176 - RNA, 13 nt, Mycobacterium avium subsp. paratuberculosis
ccgcgucgccgac

SEQ ID NO: 920177 - RNA, 14 nt, Mycobacterium avium subsp. paratuberculosis
ccgcgucgccgacc

SEQ ID NO: 920178 - RNA, 16 nt, Mycobacterium avium subsp. paratuberculosis
ccgcgucgccgaccag

SEQ ID NO: 920179 - RNA, 18 nt, Mycobacterium avium subsp. paratuberculosis
ccgcgucgccgaccagca

SEQ ID NO: 920180 - RNA, 21 nt, Mycobacterium avium subsp. paratuberculosis
ccgcgucgccgaucgcccggu

SEQ ID NO: 920181 - RNA, 20 nt, Mycobacterium avium subsp. paratuberculosis
ccgcucagcgauugcggccg

SEQ ID NO: 920182 - RNA, 22 nt, Mycobacterium avium subsp. paratuberculosis
ccgcucagcgauugcggccgcc

SEQ ID NO: 920183 - RNA, 14 nt, Mycobacterium avium subsp. paratuberculosis
ccgcucagcgggcg

SEQ ID NO: 920184 - RNA, 23 nt, Mycobacterium avium subsp. paratuberculosis
ccgcucagcgggcggccagccgc

SEQ ID NO: 920185 - RNA, 13 nt, Mycobacterium avium subsp. paratuberculosis
ccgcucaggucgg

SEQ ID NO: 920186 - RNA, 18 nt, Mycobacterium avium subsp. paratuberculosis
ccgcucaggucggccgcg

SEQ ID NO: 920187 - RNA, 18 nt, Mycobacterium avium subsp. paratuberculosis
ccgcucaacuugaucagc

SEQ ID NO: 920188 - RNA, 20 nt, Mycobacterium avium subsp. paratuberculosis
ccgcucaacuugaucagcuc

SEQ ID NO: 920189 - RNA, 21 nt, Mycobacterium avium subsp. paratuberculosis
ccgcucaacuugaucagcucg

SEQ ID NO: 920190 - RNA, 18 nt, Mycobacterium avium subsp. paratuberculosis
ccgcucaaguccucggug

SEQ ID NO: 920191 - RNA, 16 nt, Mycobacterium avium subsp. paratuberculosis
ccgcucacacagccgc

SEQ ID NO: 920192 - RNA, 13 nt, Mycobacterium avium subsp. paratuberculosis
ccgcucaccgccg

SEQ ID NO: 920193 - RNA, 14 nt, Mycobacterium avium subsp. paratuberculosis
ccgcucaccgccga

SEQ ID NO: 920194 - RNA, 19 nt, Mycobacterium avium subsp. paratuberculosis
ccgcucaccgccgagccgc

SEQ ID NO: 920195 - RNA, 23 nt, Mycobacterium avium subsp. paratuberculosis
ccgcucaccugcggcccgucgcc

SEQ ID NO: 920196 - RNA, 17 nt, Mycobacterium avium subsp. paratuberculosis
ccgcuccgacgcggugg

SEQ ID NO: 920197 - RNA, 15 nt, Mycobacterium avium subsp. paratuberculosis
ccgcuccgcggcggg

SEQ ID NO: 920198 - RNA, 16 nt, Mycobacterium avium subsp. paratuberculosis
ccgcuccgcggcgggc

SEQ ID NO: 920199 - RNA, 15 nt, Mycobacterium avium subsp. paratuberculosis
ccgcuccgcgggcag

SEQ ID NO: 920200 - RNA, 12 nt, Mycobacterium avium subsp. paratuberculosis
ccgcuccgcggu

SEQ ID NO: 920201 - RNA, 14 nt, Mycobacterium avium subsp. paratuberculosis
ccgcuccgcggugc

SEQ ID NO: 920202 - RNA, 15 nt, Mycobacterium avium subsp. paratuberculosis
ccgcuccggcccgag

SEQ ID NO: 920203 - RNA, 14 nt, Mycobacterium avium subsp. paratuberculosis
ccgcucgcccagcg

SEQ ID NO: 920204 - RNA, 18 nt, Mycobacterium avium subsp. paratuberculosis
ccgcucgcccagcgcggc

SEQ ID NO: 920205 - RNA, 20 nt, Mycobacterium avium subsp. paratuberculosis
ccgcucgcccagcgcggcgg

SEQ ID NO: 920206 - RNA, 23 nt, Mycobacterium avium subsp. paratuberculosis
ccgcucgccgaaaugccgugcca

SEQ ID NO: 920207 - RNA, 14 nt, Mycobacterium avium subsp. paratuberculosis
ccgcucgccgcggg

SEQ ID NO: 920208 - RNA, 12 nt, Mycobacterium avium subsp. paratuberculosis
ccgcucgccggg

SEQ ID NO: 920209 - RNA, 19 nt, Mycobacterium avium subsp. paratuberculosis
ccgcucgcgcaccgggacc

SEQ ID NO: 920210 - RNA, 20 nt, Mycobacterium avium subsp. paratuberculosis
ccgcucgcgggcccgcgccg

SEQ ID NO: 920211 - RNA, 21 nt, Mycobacterium avium subsp. paratuberculosis
ccgcucgcgggcccgcgccgc

SEQ ID NO: 920212 - RNA, 21 nt, Mycobacterium avium subsp. paratuberculosis
ccgcucggaguucgcccgcag

SEQ ID NO: 920213 - RNA, 22 nt, Mycobacterium avium subsp. paratuberculosis
ccgcucggaguucgcccgcagc

SEQ ID NO: 920214 - RNA, 14 nt, Mycobacterium avium subsp. paratuberculosis
ccgcuccaccgcgu

SEQ ID NO: 920215 - RNA, 17 nt, Mycobacterium avium subsp. paratuberculosis
ccgcuccaccgcguccu

SEQ ID NO: 920216 - RNA, 15 nt, Mycobacterium avium subsp. paratuberculosis
ccgcucaucgucguu

SEQ ID NO: 920217 - RNA, 18 nt, Mycobacterium avium subsp. paratuberculosis
ccgcuccauggcggcgac

SEQ ID NO: 920218 - RNA, 16 nt, Mycobacterium avium subsp. paratuberculosis
ccgcucccauccggaa

SEQ ID NO: 920219 - RNA, 17 nt, Mycobacterium avium subsp. paratuberculosis
ccgcuccccgagcacgu

SEQ ID NO: 920220 - RNA, 17 nt, Mycobacterium avium subsp. paratuberculosis
ccgcuccccgauccggc

SEQ ID NO: 920221 - RNA, 12 nt, Mycobacterium avium subsp. paratuberculosis
ccgcucccggcg

SEQ ID NO: 920222 - RNA, 15 nt, Mycobacterium avium subsp. paratuberculosis
ccgcucccggcgcag

SEQ ID NO: 920223 - RNA, 15 nt, Mycobacterium avium subsp. paratuberculosis
ccgcugaugccgccg

SEQ ID NO: 920224 - RNA, 16 nt, Mycobacterium avium subsp. paratuberculosis
ccgcugaugccgccga

SEQ ID NO: 920225 - RNA, 13 nt, Mycobacterium avium subsp. paratuberculosis
ccgcugaugcggc

SEQ ID NO: 920226 - RNA, 15 nt, Mycobacterium avium subsp. paratuberculosis
ccgcugaugcggccg

SEQ ID NO: 920227 - RNA, 19 nt, Mycobacterium avium subsp. paratuberculosis
ccgcugaugcggccggaau

SEQ ID NO: 920228 - RNA, 14 nt, Mycobacterium avium subsp. paratuberculosis
ccgcugauccagca

SEQ ID NO: 920229 - RNA, 16 nt, Mycobacterium avium subsp. paratuberculosis
ccgcugauccagcagc

SEQ ID NO: 920230 - RNA, 19 nt, Mycobacterium avium subsp. paratuberculosis
ccgcugauccagcagcgcc

SEQ ID NO: 920231 - RNA, 23 nt, Mycobacterium avium subsp. paratuberculosis
ccgcugauccagcagcgccucgg

SEQ ID NO: 920232 - RNA, 21 nt, Mycobacterium avium subsp. paratuberculosis
ccgcugcaaccgguagcgguc

SEQ ID NO: 920233 - RNA, 12 nt, Mycobacterium avium subsp. paratuberculosis
ccgcugcaccag

SEQ ID NO: 920234 - RNA, 15 nt, Mycobacterium avium subsp. paratuberculosis
ccgcugcagccgguc

SEQ ID NO: 920235 - RNA, 18 nt, Mycobacterium avium subsp. paratuberculosis
ccgcugcagccgguccgg

SEQ ID NO: 920236 - RNA, 21 nt, Mycobacterium avium subsp. paratuberculosis
ccgcugcagccgguccggcgg

SEQ ID NO: 920237 - RNA, 13 nt, Mycobacterium avium subsp. paratuberculosis
ccgcugcagcgcc

SEQ ID NO: 920238 - RNA, 15 nt, Mycobacterium avium subsp. paratuberculosis
ccgcugcagcgccga

SEQ ID NO: 920239 - RNA, 16 nt, Mycobacterium avium subsp. paratuberculosis
ccgcugcagcgccgag

SEQ ID NO: 920240 - RNA, 16 nt, Mycobacterium avium subsp. paratuberculosis
ccgcugcagcgccgcc

SEQ ID NO: 920241 - RNA, 18 nt, Mycobacterium avium subsp. paratuberculosis
ccgcugcagcgccgcccg

SEQ ID NO: 920242 - RNA, 21 nt, Mycobacterium avium subsp. paratuberculosis
ccgcugcagcggguuuggccg

SEQ ID NO: 920243 - RNA, 18 nt, Mycobacterium avium subsp. paratuberculosis
ccgcugcagcugcucguc

SEQ ID NO: 920244 - RNA, 19 nt, Mycobacterium avium subsp. paratuberculosis
ccgcugaggaugguggugc

SEQ ID NO: 920245 - RNA, 19 nt, Mycobacterium avium subsp. paratuberculosis
ccgcugagguagucccgcg

SEQ ID NO: 920246 - RNA, 20 nt, Mycobacterium avium subsp. paratuberculosis
ccgcugagcuucugcccggc

SEQ ID NO: 920247 - RNA, 23 nt, Mycobacterium avium subsp. paratuberculosis
ccgcugagcuucugcccggccag

SEQ ID NO: 920248 - RNA, 12 nt, Mycobacterium avium subsp. paratuberculosis
ccgcucggccag

SEQ ID NO: 920249 - RNA, 16 nt, Mycobacterium avium subsp. paratuberculosis
ccgcucggccagcagc

SEQ ID NO: 920250 - RNA, 18 nt, Mycobacterium avium subsp. paratuberculosis
ccgcucggccagcagcac

SEQ ID NO: 920251 - RNA, 17 nt, Mycobacterium avium subsp. paratuberculosis
ccgcucggccagcgcag

SEQ ID NO: 920252 - RNA, 22 nt, Mycobacterium avium subsp. paratuberculosis
ccgcucggccagcgcagcgacc

SEQ ID NO: 920253 - RNA, 18 nt, Mycobacterium avium subsp. paratuberculosis
ccgcucggccagcgcgcc

SEQ ID NO: 920254 - RNA, 19 nt, Mycobacterium avium subsp. paratuberculosis
ccgcucggcggcgccgucg

SEQ ID NO: 920255 - RNA, 20 nt, Mycobacterium avium subsp. paratuberculosis
ccgcucggcggcgccgucgu

SEQ ID NO: 920256 - RNA, 12 nt, Mycobacterium avium subsp. paratuberculosis
ccgcucggcggg

SEQ ID NO: 920257 - RNA, 21 nt, Mycobacterium avium subsp. paratuberculosis
ccgcugcgacaggucggcggu

SEQ ID NO: 920258 - RNA, 22 nt, Mycobacterium avium subsp. paratuberculosis
ccgcugcgacaggucggcgguc

SEQ ID NO: 920259 - RNA, 14 nt, Mycobacterium avium subsp. paratuberculosis
ccgcugccggggug

SEQ ID NO: 920260 - RNA, 15 nt, Mycobacterium avium subsp. paratuberculosis
ccgcugccggggugc

SEQ ID NO: 920261 - RNA, 22 nt, Mycobacterium avium subsp. paratuberculosis
ccgcugccggggugcagcacca

SEQ ID NO: 920262 - RNA, 13 nt, Mycobacterium avium subsp. paratuberculosis
ccgcugccguccg

SEQ ID NO: 920263 - RNA, 18 nt, Mycobacterium avium subsp. paratuberculosis
ccgcugccguccggcggc

SEQ ID NO: 920264 - RNA, 18 nt, Mycobacterium avium subsp. paratuberculosis
ccgcugccguucgccggu

SEQ ID NO: 920265 - RNA, 23 nt, Mycobacterium avium subsp. paratuberculosis
ccgcugccguucgccgguaccgc

SEQ ID NO: 920266 - RNA, 13 nt, Mycobacterium avium subsp. paratuberculosis
ccgcugccggacc

SEQ ID NO: 920267 - RNA, 14 nt, Mycobacterium avium subsp. paratuberculosis
ccgcugcccgccgc

SEQ ID NO: 920268 - RNA, 14 nt, Mycobacterium avium subsp. paratuberculosis
ccgcugcccggcgc

SEQ ID NO: 920269 - RNA, 15 nt, Mycobacterium avium subsp. paratuberculosis
ccgcugcccggcgcu

SEQ ID NO: 920270 - RNA, 17 nt, Mycobacterium avium subsp. paratuberculosis
ccgcugcaugccgucga

SEQ ID NO: 920271 - RNA, 19 nt, Mycobacterium avium subsp. paratuberculosis
ccgcugcaugccgucgauc

SEQ ID NO: 920272 - RNA, 21 nt, Mycobacterium avium subsp. paratuberculosis
ccgcugccacgguuucgccgu

SEQ ID NO: 920273 - RNA, 20 nt, Mycobacterium avium subsp. paratuberculosis
ccgcugcauccgcagcacca

SEQ ID NO: 920274 - RNA, 18 nt, Mycobacterium avium subsp. paratuberculosis
ccgcugcaccagcccguc

SEQ ID NO: 920275 - RNA, 17 nt, Mycobacterium avium subsp. paratuberculosis
ccgcugcacgcguugca

SEQ ID NO: 920276 - RNA, 21 nt, Mycobacterium avium subsp. paratuberculosis
ccgcgguagaaccaacgcggc

SEQ ID NO: 920277 - RNA, 22 nt, Mycobacterium avium subsp. paratuberculosis
ccgcgguagaaccaacgcggcg

SEQ ID NO: 920278 - RNA, 17 nt, Mycobacterium avium subsp. paratuberculosis
ccgcgguagacaccgcc

SEQ ID NO: 920279 - RNA, 19 nt, Mycobacterium avium subsp. paratuberculosis
ccgcgguagacaccgccgu

SEQ ID NO: 920280 - RNA, 18 nt, Mycobacterium avium subsp. paratuberculosis
ccgcggucaucgagccgg

SEQ ID NO: 920281 - RNA, 19 nt, Mycobacterium avium subsp. paratuberculosis
ccgcggucaucgagccggu

SEQ ID NO: 920282 - RNA, 14 nt, Mycobacterium avium subsp. paratuberculosis
ccgcggggccggcg

SEQ ID NO: 920283 - RNA, 13 nt, Mycobacterium avium subsp. paratuberculosis
ccgcggucaccgg

SEQ ID NO: 920284 - RNA, 19 nt, Mycobacterium avium subsp. paratuberculosis
ccgcggucaccggucggug

SEQ ID NO: 920285 - RNA, 16 nt, Mycobacterium avium subsp. paratuberculosis
ccgcgggugacgauca

SEQ ID NO: 920286 - RNA, 18 nt, Mycobacterium avium subsp. paratuberculosis
ccgcgggugacgaucacc

SEQ ID NO: 920287 - RNA, 13 nt, Mycobacterium avium subsp. paratuberculosis
ccgcgggugacgc

SEQ ID NO: 920288 - RNA, 17 nt, Mycobacterium avium subsp. paratuberculosis
ccgcgggugacgcugac

SEQ ID NO: 920289 - RNA, 18 nt, Mycobacterium avium subsp. paratuberculosis
ccgcgggugcagccggau

SEQ ID NO: 920290 - RNA, 17 nt, Mycobacterium avium subsp. paratuberculosis
ccgcgggugcggcacgg

SEQ ID NO: 920291 - RNA, 19 nt, Mycobacterium avium subsp. paratuberculosis
ccgcgggugcggcacggca

SEQ ID NO: 920292 - RNA, 22 nt, Mycobacterium avium subsp. paratuberculosis
ccgcgggugcggcacggcaugg

SEQ ID NO: 920293 - RNA, 20 nt, Mycobacterium avium subsp. paratuberculosis
ccgcggguggccagccaggu

SEQ ID NO: 920294 - RNA, 15 nt, Mycobacterium avium subsp. paratuberculosis
ccgcggguggcgcca

SEQ ID NO: 920295 - RNA, 19 nt, Mycobacterium avium subsp. paratuberculosis
ccgcgggugucgcccucgg

SEQ ID NO: 920296 - RNA, 20 nt, Mycobacterium avium subsp. paratuberculosis
ccgcggguguuucggucggc

SEQ ID NO: 920297 - RNA, 15 nt, Mycobacterium avium subsp. paratuberculosis
ccgcgguucggcguc

SEQ ID NO: 920298 - RNA, 16 nt, Mycobacterium avium subsp. paratuberculosis
ccgcgguucggcgucg

SEQ ID NO: 920299 - RNA, 19 nt, Mycobacterium avium subsp. paratuberculosis
ccgcgguucggcgucgguc

SEQ ID NO: 920300 - RNA, 22 nt, Mycobacterium avium subsp. paratuberculosis
ccgcgguuggucaccaggucgc

SEQ ID NO: 920301 - RNA, 16 nt, Mycobacterium avium subsp. paratuberculosis
ccgcggugugcccggc

SEQ ID NO: 920302 - RNA, 18 nt, Mycobacterium avium subsp. paratuberculosis
ccgcggugugcuggccag

SEQ ID NO: 920303 - RNA, 23 nt, Mycobacterium avium subsp. paratuberculosis
ccgcggugugcuggccagcacca

SEQ ID NO: 920304 - RNA, 17 nt, Mycobacterium avium subsp. paratuberculosis
ccgcggucucgaccgac

SEQ ID NO: 920305 - RNA, 16 nt, Mycobacterium avium subsp. paratuberculosis
ccgcggucugcgccag

SEQ ID NO: 920306 - RNA, 13 nt, Mycobacterium avium subsp. paratuberculosis
ccgcggucgacca

SEQ ID NO: 920307 - RNA, 14 nt, Mycobacterium avium subsp. paratuberculosis
ccgcggucgaccaa

SEQ ID NO: 920308 - RNA, 14 nt, Mycobacterium avium subsp. paratuberculosis
ccgcggucgccccg

SEQ ID NO: 920309 - RNA, 19 nt, Mycobacterium avium subsp. paratuberculosis
ccgcggucgccccggccgc

SEQ ID NO: 920310 - RNA, 18 nt, Mycobacterium avium subsp. paratuberculosis
ccgcggucgcggcgccgg

SEQ ID NO: 920311 - RNA, 13 nt, Mycobacterium avium subsp. paratuberculosis
ccgcggucggcgg

SEQ ID NO: 920312 - RNA, 15 nt, Mycobacterium avium subsp. paratuberculosis
ccgcggucggcggcg

SEQ ID NO: 920313 - RNA, 18 nt, Mycobacterium avium subsp. paratuberculosis
ccgcgguuuggucagcgc

SEQ ID NO: 920314 - RNA, 15 nt, Mycobacterium avium subsp. paratuberculosis
ccgcguacaccggcu

SEQ ID NO: 920315 - RNA, 16 nt, Mycobacterium avium subsp. paratuberculosis
ccgcguacaccggcug

SEQ ID NO: 920316 - RNA, 19 nt, Mycobacterium avium subsp. paratuberculosis
ccgcguacaccggcugacc

SEQ ID NO: 920317 - RNA, 20 nt, Mycobacterium avium subsp. paratuberculosis
ccgcguacaccggcugaccg

SEQ ID NO: 920318 - RNA, 22 nt, Mycobacterium avium subsp. paratuberculosis
ccgcguacaccggcugaccggc

SEQ ID NO: 920319 - RNA, 14 nt, Mycobacterium avium subsp. paratuberculosis
ccgcguacagcagc

SEQ ID NO: 920320 - RNA, 14 nt, Mycobacterium avium subsp. paratuberculosis
ccgcguacagcggg

SEQ ID NO: 920321 - RNA, 17 nt, Mycobacterium avium subsp. paratuberculosis
ccgcguacagcgggucg

SEQ ID NO: 920322 - RNA, 18 nt, Mycobacterium avium subsp. paratuberculosis
ccgcguacagggcgucgg

SEQ ID NO: 920323 - RNA, 14 nt, Mycobacterium avium subsp. paratuberculosis
ccgcguaccagcgc

SEQ ID NO: 920324 - RNA, 15 nt, Mycobacterium avium subsp. paratuberculosis
ccgcguaccagcgcc

SEQ ID NO: 920325 - RNA, 18 nt, Mycobacterium avium subsp. paratuberculosis
ccgcguaccagcgccacg

SEQ ID NO: 920326 - RNA, 19 nt, Mycobacterium avium subsp. paratuberculosis
ccgcguccuucuccgccgg

SEQ ID NO: 920327 - RNA, 23 nt, Mycobacterium avium subsp. paratuberculosis
ccgcguccuucuccgccgggcug

SEQ ID NO: 920328 - RNA, 14 nt, Mycobacterium avium subsp. paratuberculosis
ccgcgucgaccacc

SEQ ID NO: 920329 - RNA, 21 nt, Mycobacterium avium subsp. paratuberculosis
ccgcgucgaccaccgccggcc

SEQ ID NO: 920330 - RNA, 12 nt, Mycobacterium avium subsp. paratuberculosis
ccgcgucgacgc

SEQ ID NO: 920331 - RNA, 15 nt, Mycobacterium avium subsp. paratuberculosis
ccgcgucgacgccgc

SEQ ID NO: 920332 - RNA, 18 nt, Mycobacterium avium subsp. paratuberculosis
ccgcgucgacgccgcugc

SEQ ID NO: 920333 - RNA, 19 nt, Mycobacterium avium subsp. paratuberculosis
ccgcgucgacgccgcugcc

SEQ ID NO: 920334 - RNA, 15 nt, Mycobacterium avium subsp. paratuberculosis
ccgcguccgaggcgg

SEQ ID NO: 920335 - RNA, 18 nt, Mycobacterium avium subsp. paratuberculosis
ccgcguccgaggcgguuc

SEQ ID NO: 920336 - RNA, 17 nt, Mycobacterium avium subsp. paratuberculosis
ccgcguaaccggcggcg

SEQ ID NO: 920337 - RNA, 16 nt, Mycobacterium avium subsp. paratuberculosis
ccgcguccgcgguuuc

SEQ ID NO: 920338 - RNA, 15 nt, Mycobacterium avium subsp. paratuberculosis
ccgcguccucgccgu

SEQ ID NO: 920339 - RNA, 17 nt, Mycobacterium avium subsp. paratuberculosis
ccgcguccucgucgaug

SEQ ID NO: 920340 - RNA, 19 nt, Mycobacterium avium subsp. paratuberculosis
ccgcguccucgucgaugcc

SEQ ID NO: 920341 - RNA, 16 nt, Mycobacterium avium subsp. paratuberculosis
ccgcguccugcagcgc

SEQ ID NO: 920342 - RNA, 18 nt, Mycobacterium avium subsp. paratuberculosis
ccgcguccugcagcgccg

SEQ ID NO: 920343 - RNA, 16 nt, Mycobacterium avium subsp. paratuberculosis
ccgcguccugcaggca

SEQ ID NO: 920344 - RNA, 21 nt, Mycobacterium avium subsp. paratuberculosis
ccgcguccugcaggcaggccg

SEQ ID NO: 920345 - RNA, 19 nt, Mycobacterium avium subsp. paratuberculosis
ccgcggggcugggcgccau

SEQ ID NO: 920346 - RNA, 21 nt, Mycobacterium avium subsp. paratuberculosis
ccgcggggcugggcgccaugg

SEQ ID NO: 920347 - RNA, 22 nt, Mycobacterium avium subsp. paratuberculosis
ccgcgggcguggcggucggugc

SEQ ID NO: 920348 - RNA, 19 nt, Mycobacterium avium subsp. paratuberculosis
ccgcgggcguucaucaccu

SEQ ID NO: 920349 - RNA, 12 nt, Mycobacterium avium subsp. paratuberculosis
ccgcgggcucga

SEQ ID NO: 920350 - RNA, 15 nt, Mycobacterium avium subsp. paratuberculosis
ccgcgggcucgaaca

SEQ ID NO: 920351 - RNA, 17 nt, Mycobacterium avium subsp. paratuberculosis
ccgcggguacggucggc

SEQ ID NO: 920352 - RNA, 21 nt, Mycobacterium avium subsp. paratuberculosis
ccgcggguagcccgucgacgg

SEQ ID NO: 920353 - RNA, 21 nt, Mycobacterium avium subsp. paratuberculosis
ccgcgggucgcggcccaccgc

SEQ ID NO: 920354 - RNA, 15 nt, Mycobacterium avium subsp. paratuberculosis
ccgcgggucggcgac

SEQ ID NO: 920355 - RNA, 20 nt, Mycobacterium avium subsp. paratuberculosis
ccgcgggucggcgacggcgc

SEQ ID NO: 920356 - RNA, 14 nt, Mycobacterium avium subsp. paratuberculosis
ccgcgggucgucga

SEQ ID NO: 920357 - RNA, 20 nt, Mycobacterium avium subsp. paratuberculosis
ccgcgggucgucgacgucgg

SEQ ID NO: 920358 - RNA, 14 nt, Mycobacterium avium subsp. paratuberculosis
ccgcgggucgucgg

SEQ ID NO: 920359 - RNA, 20 nt, Mycobacterium avium subsp. paratuberculosis
ccgcgggcgggccgaaccgg

SEQ ID NO: 920360 - RNA, 13 nt, Mycobacterium avium subsp. paratuberculosis
ccgcgggcggggc

SEQ ID NO: 920361 - RNA, 19 nt, Mycobacterium avium subsp. paratuberculosis
ccgcgggcggucgcgcagc

SEQ ID NO: 920362 - RNA, 21 nt, Mycobacterium avium subsp. paratuberculosis
ccgcgggcggucgcgcagccg

SEQ ID NO: 920363 - RNA, 23 nt, Mycobacterium avium subsp. paratuberculosis
ccgcgggcggucgcgcagccgcc

SEQ ID NO: 920364 - RNA, 22 nt, Mycobacterium avium subsp. paratuberculosis
ccgcgggcgccguaggccgcgc

SEQ ID NO: 920365 - RNA, 13 nt, Mycobacterium avium subsp. paratuberculosis
ccgcgggcgcgcc

SEQ ID NO: 920366 - RNA, 15 nt, Mycobacterium avium subsp. paratuberculosis
ccgcgggcgcgccgu

SEQ ID NO: 920367 - RNA, 14 nt, Mycobacterium avium subsp. paratuberculosis
ccgcgggccggcac

SEQ ID NO: 920368 - RNA, 21 nt, Mycobacterium avium subsp. paratuberculosis
ccgcgggccggcacuucgauc

SEQ ID NO: 920369 - RNA, 15 nt, Mycobacterium avium subsp. paratuberculosis
ccgcgggcacggcga

SEQ ID NO: 920370 - RNA, 23 nt, Mycobacterium avium subsp. paratuberculosis
ccgcgggcgauucccggaugcug

SEQ ID NO: 920371 - RNA, 19 nt, Mycobacterium avium subsp. paratuberculosis
ccgcgggccagacugcgca

SEQ ID NO: 920372 - RNA, 16 nt, Mycobacterium avium subsp. paratuberculosis
ccgcgggccagcagcc

SEQ ID NO: 920373 - RNA, 17 nt, Mycobacterium avium subsp. paratuberculosis
ccgcgggcccaccgcca

SEQ ID NO: 920374 - RNA, 18 nt, Mycobacterium avium subsp. paratuberculosis
ccgcgggcagcagcuugg

SEQ ID NO: 920375 - RNA, 17 nt, Mycobacterium avium subsp. paratuberculosis
ccgcgggcagcgagcac

SEQ ID NO: 920376 - RNA, 13 nt, Mycobacterium avium subsp. paratuberculosis
ccgcggcggcacc

SEQ ID NO: 920377 - RNA, 21 nt, Mycobacterium avium subsp. paratuberculosis
ccgcgggaugcuuggucgcgg

SEQ ID NO: 920378 - RNA, 19 nt, Mycobacterium avium subsp. paratuberculosis
ccgcggcgcuugaccucgc

SEQ ID NO: 920379 - RNA, 23 nt, Mycobacterium avium subsp. paratuberculosis
ccgcggcgcuugaccucgccgag

SEQ ID NO: 920380 - RNA, 21 nt, Mycobacterium avium subsp. paratuberculosis
ccgcggcggauccagcaccgc

SEQ ID NO: 920381 - RNA, 14 nt, Mycobacterium avium subsp. paratuberculosis
ccgcggcgcggccc

SEQ ID NO: 920382 - RNA, 15 nt, Mycobacterium avium subsp. paratuberculosis
ccgcggcgcggcccg

SEQ ID NO: 920383 - RNA, 16 nt, Mycobacterium avium subsp. paratuberculosis
ccgcggcgcggcccgg

SEQ ID NO: 920384 - RNA, 17 nt, Mycobacterium avium subsp. paratuberculosis
ccgcggcgcgguugacg

SEQ ID NO: 920385 - RNA, 15 nt, Mycobacterium avium subsp. paratuberculosis
ccgcggcgcgcggcc

SEQ ID NO: 920386 - RNA, 16 nt, Mycobacterium avium subsp. paratuberculosis
ccgcggcgcgcggccg

SEQ ID NO: 920387 - RNA, 19 nt, Mycobacterium avium subsp. paratuberculosis
ccgcggcgcgcggccgcga

SEQ ID NO: 920388 - RNA, 18 nt, Mycobacterium avium subsp. paratuberculosis
ccgcggcgcgcaucgccg

SEQ ID NO: 920389 - RNA, 19 nt, Mycobacterium avium subsp. paratuberculosis
ccgcggcgcccucgccggc

SEQ ID NO: 920390 - RNA, 20 nt, Mycobacterium avium subsp. paratuberculosis
ccgcggcgcccucgccggcg

SEQ ID NO: 920391 - RNA, 18 nt, Mycobacterium avium subsp. paratuberculosis
ccgcggcgccgauggcga

SEQ ID NO: 920392 - RNA, 17 nt, Mycobacterium avium subsp. paratuberculosis
ccgcggcgccgccacgg

SEQ ID NO: 920393 - RNA, 15 nt, Mycobacterium avium subsp. paratuberculosis
ccgcggcgccgcggc

SEQ ID NO: 920394 - RNA, 13 nt, Mycobacterium avium subsp. paratuberculosis
ccgcggcgccggg

SEQ ID NO: 920395 - RNA, 15 nt, Mycobacterium avium subsp. paratuberculosis
ccgcggcgccgggcg

SEQ ID NO: 920396 - RNA, 13 nt, Mycobacterium avium subsp. paratuberculosis
ccgcggcgccguu

SEQ ID NO: 920397 - RNA, 20 nt, Mycobacterium avium subsp. paratuberculosis
ccgcggcgccguugaccggc

SEQ ID NO: 920398 - RNA, 14 nt, Mycobacterium avium subsp. paratuberculosis
ccgcggcgcgauga

SEQ ID NO: 920399 - RNA, 22 nt, Mycobacterium avium subsp. paratuberculosis
ccgcggcgcgaugaucgccggc

SEQ ID NO: 920400 - RNA, 14 nt, Mycobacterium avium subsp. paratuberculosis
ccgcggcgcccgga

SEQ ID NO: 920401 - RNA, 17 nt, Mycobacterium avium subsp. paratuberculosis
ccgcggcgaucucgauc

SEQ ID NO: 920402 - RNA, 16 nt, Mycobacterium avium subsp. paratuberculosis
ccgcggcgaugaccgg

SEQ ID NO: 920403 - RNA, 14 nt, Mycobacterium avium subsp. paratuberculosis
ccgcggcgaugauc

SEQ ID NO: 920404 - RNA, 12 nt, Mycobacterium avium subsp. paratuberculosis
ccgcggcgaugg

SEQ ID NO: 920405 - RNA, 17 nt, Mycobacterium avium subsp. paratuberculosis
ccgcggcgauggcccgc

SEQ ID NO: 920406 - RNA, 14 nt, Mycobacterium avium subsp. paratuberculosis
ccgcggcgagccgg

SEQ ID NO: 920407 - RNA, 17 nt, Mycobacterium avium subsp. paratuberculosis
ccgcggcgacgucgugc

SEQ ID NO: 920408 - RNA, 18 nt, Mycobacterium avium subsp. paratuberculosis
ccgcggcgacgucgugca

SEQ ID NO: 920409 - RNA, 13 nt, Mycobacterium avium subsp. paratuberculosis
ccgcggcgacacc

SEQ ID NO: 920410 - RNA, 18 nt, Mycobacterium avium subsp. paratuberculosis
ccgcggcgacacccagcg

SEQ ID NO: 920411 - RNA, 21 nt, Mycobacterium avium subsp. paratuberculosis
ccgcggcgaccggggcgguga

SEQ ID NO: 920412 - RNA, 16 nt, Mycobacterium avium subsp. paratuberculosis
ccgcgcuugguggcga

SEQ ID NO: 920413 - RNA, 19 nt, Mycobacterium avium subsp. paratuberculosis
ccgcgcuugacggccgggc

SEQ ID NO: 920414 - RNA, 21 nt, Mycobacterium avium subsp. paratuberculosis
ccgcgcuugacggccgggccc

SEQ ID NO: 920415 - RNA, 23 nt, Mycobacterium avium subsp. paratuberculosis
ccgcggaaccguagaccaccucg

SEQ ID NO: 920416 - RNA, 15 nt, Mycobacterium avium subsp. paratuberculosis
ccgcggaaggccagc

SEQ ID NO: 920417 - RNA, 20 nt, Mycobacterium avium subsp. paratuberculosis
ccgcggacauucugcacgac

SEQ ID NO: 920418 - RNA, 22 nt, Mycobacterium avium subsp. paratuberculosis
ccgcggacauucugcacgacga

SEQ ID NO: 920419 - RNA, 14 nt, Mycobacterium avium subsp. paratuberculosis
ccgcggaccccagc

SEQ ID NO: 920420 - RNA, 17 nt, Mycobacterium avium subsp. paratuberculosis
ccgcggaccccagcgug

SEQ ID NO: 920421 - RNA, 18 nt, Mycobacterium avium subsp. paratuberculosis
ccgcggaccccagcguga

SEQ ID NO: 920422 - RNA, 20 nt, Mycobacterium avium subsp. paratuberculosis
ccgcggaccccagcgugacg

SEQ ID NO: 920423 - RNA, 21 nt, Mycobacterium avium subsp. paratuberculosis
ccgcggacccgacggucgggc

SEQ ID NO: 920424 - RNA, 15 nt, Mycobacterium avium subsp. paratuberculosis
ccgcggacggcgaac

SEQ ID NO: 920425 - RNA, 13 nt, Mycobacterium avium subsp. paratuberculosis
ccgcgcuguccac

SEQ ID NO: 920426 - RNA, 15 nt, Mycobacterium avium subsp. paratuberculosis
ccgcgcuguccacgu

SEQ ID NO: 920427 - RNA, 15 nt, Mycobacterium avium subsp. paratuberculosis
ccgcgcuugccgcga

SEQ ID NO: 920428 - RNA, 17 nt, Mycobacterium avium subsp. paratuberculosis
ccgcgcuugccgcgacc

SEQ ID NO: 920429 - RNA, 14 nt, Mycobacterium avium subsp. paratuberculosis
ccgcgcuugcgacc

SEQ ID NO: 920430 - RNA, 20 nt, Mycobacterium avium subsp. paratuberculosis
ccgcgcuugcgaccgccgcu

SEQ ID NO: 920431 - RNA, 16 nt, Mycobacterium avium subsp. paratuberculosis
ccgcgcuugcgaucgc

SEQ ID NO: 920432 - RNA, 15 nt, Mycobacterium avium subsp. paratuberculosis
ccgcgcuggcgcagg

SEQ ID NO: 920433 - RNA, 20 nt, Mycobacterium avium subsp. paratuberculosis
ccgcgcuggcgcaggcgcug

SEQ ID NO: 920434 - RNA, 20 nt, Mycobacterium avium subsp. paratuberculosis
ccgcgcuggucaacucgacc

SEQ ID NO: 920435 - RNA, 18 nt, Mycobacterium avium subsp. paratuberculosis
ccgcgcugggcuggccgu

SEQ ID NO: 920436 - RNA, 15 nt, Mycobacterium avium subsp. paratuberculosis
ccgcgcugcgccggg

SEQ ID NO: 920437 - RNA, 18 nt, Mycobacterium avium subsp. paratuberculosis
ccgcgcugcgccgggugg

SEQ ID NO: 920438 - RNA, 18 nt, Mycobacterium avium subsp. paratuberculosis
ccgcggccggugccacgg

SEQ ID NO: 920439 - RNA, 16 nt, Mycobacterium avium subsp. paratuberculosis
ccgcggccgucgcggc

SEQ ID NO: 920440 - RNA, 18 nt, Mycobacterium avium subsp. paratuberculosis
ccgcggccgucgcggcga

SEQ ID NO: 920441 - RNA, 13 nt, Mycobacterium avium subsp. paratuberculosis
ccgcggccgucgu

SEQ ID NO: 920442 - RNA, 14 nt, Mycobacterium avium subsp. paratuberculosis
ccgcggccgucguc

SEQ ID NO: 920443 - RNA, 16 nt, Mycobacterium avium subsp. paratuberculosis
ccgcggccgucgucgu

SEQ ID NO: 920444 - RNA, 15 nt, Mycobacterium avium subsp. paratuberculosis
ccgcggccucggcgu

SEQ ID NO: 920445 - RNA, 17 nt, Mycobacterium avium subsp. paratuberculosis
ccgcggccucggcgucg

SEQ ID NO: 920446 - RNA, 15 nt, Mycobacterium avium subsp. paratuberculosis
ccgcggccucgucga

SEQ ID NO: 920447 - RNA, 18 nt, Mycobacterium avium subsp. paratuberculosis
ccgcggccucgucgaggu

SEQ ID NO: 920448 - RNA, 17 nt, Mycobacterium avium subsp. paratuberculosis
ccgcggccggcccagcg

SEQ ID NO: 920449 - RNA, 19 nt, Mycobacterium avium subsp. paratuberculosis
ccgcggccggcccagcgcg

SEQ ID NO: 920450 - RNA, 20 nt, Mycobacterium avium subsp. paratuberculosis
ccgcggccggcccagcgcgc

SEQ ID NO: 920451 - RNA, 12 nt, Mycobacterium avium subsp. paratuberculosis
ccgcggccggcc

SEQ ID NO: 920452 - RNA, 14 nt, Mycobacterium avium subsp. paratuberculosis
ccgcggccggcggc

SEQ ID NO: 920453 - RNA, 18 nt, Mycobacterium avium subsp. paratuberculosis
ccgcggccggcggcaguc

SEQ ID NO: 920454 - RNA, 20 nt, Mycobacterium avium subsp. paratuberculosis
ccgcggccggcacuaccgcc

SEQ ID NO: 920455 - RNA, 17 nt, Mycobacterium avium subsp. paratuberculosis
ccgcggccaccccggag

SEQ ID NO: 920456 - RNA, 12 nt, Mycobacterium avium subsp. paratuberculosis
ccgcggccgcgu

SEQ ID NO: 920457 - RNA, 16 nt, Mycobacterium avium subsp. paratuberculosis
ccgcggccgcugcgcc

SEQ ID NO: 920458 - RNA, 21 nt, Mycobacterium avium subsp. paratuberculosis
ccgcggccgcugcgcccagcg

SEQ ID NO: 920459 - RNA, 13 nt, Mycobacterium avium subsp. paratuberculosis
ccgcggccggcac

SEQ ID NO: 920460 - RNA, 12 nt, Mycobacterium avium subsp. paratuberculosis
ccgcggccagcg

SEQ ID NO: 920461 - RNA, 16 nt, Mycobacterium avium subsp. paratuberculosis
ccgcggccgcggcggg

SEQ ID NO: 920462 - RNA, 17 nt, Mycobacterium avium subsp. paratuberculosis
ccgcggccgcggcgggc

SEQ ID NO: 920463 - RNA, 13 nt, Mycobacterium avium subsp. paratuberculosis
ccgcggccaccgg

SEQ ID NO: 920464 - RNA, 15 nt, Mycobacterium avium subsp. paratuberculosis
ccgcggccaccgggu

SEQ ID NO: 920465 - RNA, 18 nt, Mycobacterium avium subsp. paratuberculosis
ccgcggccaccgggucgu

SEQ ID NO: 920466 - RNA, 13 nt, Mycobacterium avium subsp. paratuberculosis
ccgcggccacgcu

SEQ ID NO: 920467 - RNA, 14 nt, Mycobacterium avium subsp. paratuberculosis
ccgcggccacgcuc

SEQ ID NO: 920468 - RNA, 17 nt, Mycobacterium avium subsp. paratuberculosis
ccgcggcacgcugcgcc

SEQ ID NO: 920469 - RNA, 18 nt, Mycobacterium avium subsp. paratuberculosis
ccgcggcagccagccugg

SEQ ID NO: 920470 - RNA, 15 nt, Mycobacterium avium subsp. paratuberculosis
ccgcggcagccgggc

SEQ ID NO: 920471 - RNA, 18 nt, Mycobacterium avium subsp. paratuberculosis
ccgcggcagccgggcgau

SEQ ID NO: 920472 - RNA, 20 nt, Mycobacterium avium subsp. paratuberculosis
ccgcggacuggccaccgcga

SEQ ID NO: 920473 - RNA, 13 nt, Mycobacterium avium subsp. paratuberculosis
ccgcggcaccuuc

SEQ ID NO: 920474 - RNA, 23 nt, Mycobacterium avium subsp. paratuberculosis
ccgcggcaccuucaccgaccagc

SEQ ID NO: 920475 - RNA, 13 nt, Mycobacterium avium subsp. paratuberculosis
ccgcggccaaccc

SEQ ID NO: 920476 - RNA, 22 nt, Mycobacterium avium subsp. paratuberculosis
ccgcggccaacccgggcgccau

SEQ ID NO: 920477 - RNA, 20 nt, Mycobacterium avium subsp. paratuberculosis
ccgcggccaagugcggucgg

SEQ ID NO: 920478 - RNA, 22 nt, Mycobacterium avium subsp. paratuberculosis
ccgcggccaagugcggucgguu

SEQ ID NO: 920479 - RNA, 20 nt, Mycobacterium avium subsp. paratuberculosis
ccgcggccacacuggcguga

SEQ ID NO: 920480 - RNA, 22 nt, Mycobacterium avium subsp. paratuberculosis
ccgcggccacacuggcgugacg

SEQ ID NO: 920481 - RNA, 15 nt, Mycobacterium avium subsp. paratuberculosis
ccgcggccaccaccg

SEQ ID NO: 920482 - RNA, 17 nt, Mycobacterium avium subsp. paratuberculosis
ccgcggccaccaccgcc

SEQ ID NO: 920483 - RNA, 14 nt, Mycobacterium avium subsp. paratuberculosis
ccgcgcggugcccg

SEQ ID NO: 920484 - RNA, 23 nt, Mycobacterium avium subsp. paratuberculosis
ccgcgcggugcccggaacggcgg

SEQ ID NO: 920485 - RNA, 20 nt, Mycobacterium avium subsp. paratuberculosis
ccgcgcgggggccgccgcga

SEQ ID NO: 920486 - RNA, 20 nt, Mycobacterium avium subsp. paratuberculosis
ccgcgcggguacggcggccg

SEQ ID NO: 920487 - RNA, 21 nt, Mycobacterium avium subsp. paratuberculosis
ccgcgcggguacggcggccgc

SEQ ID NO: 920488 - RNA, 23 nt, Mycobacterium avium subsp. paratuberculosis
ccgcgcggguacggcggccgcgg

SEQ ID NO: 920489 - RNA, 16 nt, Mycobacterium avium subsp. paratuberculosis
ccgcgcgucgcgcagc

SEQ ID NO: 920490 - RNA, 18 nt, Mycobacterium avium subsp. paratuberculosis
ccgcgcgucgggcucgcg

SEQ ID NO: 920491 - RNA, 21 nt, Mycobacterium avium subsp. paratuberculosis
ccgcgcgucgggcucgcgguc

SEQ ID NO: 920492 - RNA, 22 nt, Mycobacterium avium subsp. paratuberculosis
ccgcgcgucgggcucgcggucg

SEQ ID NO: 920493 - RNA, 23 nt, Mycobacterium avium subsp. paratuberculosis
ccgcgcgucgggcucgcggucgg

SEQ ID NO: 920494 - RNA, 20 nt, Mycobacterium avium subsp. paratuberculosis
ccgcgcgugcagccgggcgg

SEQ ID NO: 920495 - RNA, 12 nt, Mycobacterium avium subsp. paratuberculosis
ccgcgcgugggc

SEQ ID NO: 920496 - RNA, 18 nt, Mycobacterium avium subsp. paratuberculosis
ccgcgcgugggccaacgc

SEQ ID NO: 920497 - RNA, 21 nt, Mycobacterium avium subsp. paratuberculosis
ccgcgcguggucccacaccac

SEQ ID NO: 920498 - RNA, 22 nt, Mycobacterium avium subsp. paratuberculosis
ccgcgcguggucccacaccacc

SEQ ID NO: 920499 - RNA, 21 nt, Mycobacterium avium subsp. paratuberculosis
ccgcgcguucgaguucgucga

SEQ ID NO: 920500 - RNA, 22 nt, Mycobacterium avium subsp. paratuberculosis
ccgcgcguucgaguucgucgac

SEQ ID NO: 920501 - RNA, 14 nt, Mycobacterium avium subsp. paratuberculosis
ccgcgcuggccagc

SEQ ID NO: 920502 - RNA, 19 nt, Mycobacterium avium subsp. paratuberculosis
ccgcgcuggccagcgucag

SEQ ID NO: 920503 - RNA, 18 nt, Mycobacterium avium subsp. paratuberculosis
ccgcgcuggccgaucccg

SEQ ID NO: 920504 - RNA, 13 nt, Mycobacterium avium subsp. paratuberculosis
ccgcgcuggccgg

SEQ ID NO: 920505 - RNA, 14 nt, Mycobacterium avium subsp. paratuberculosis
ccgcgcuggccggg

SEQ ID NO: 920506 - RNA, 15 nt, Mycobacterium avium subsp. paratuberculosis
ccgcgcuggccgggu

SEQ ID NO: 920507 - RNA, 14 nt, Mycobacterium avium subsp. paratuberculosis
ccgcgcugcccagc

SEQ ID NO: 920508 - RNA, 16 nt, Mycobacterium avium subsp. paratuberculosis
ccgcgcugcccagcgc

SEQ ID NO: 920509 - RNA, 17 nt, Mycobacterium avium subsp. paratuberculosis
ccgcgcugcccagcgcg

SEQ ID NO: 920510 - RNA, 18 nt, Mycobacterium avium subsp. paratuberculosis
ccgcgcugcccagcgcgg

SEQ ID NO: 920511 - RNA, 13 nt, Mycobacterium avium subsp. paratuberculosis
ccgcgcguagugc

SEQ ID NO: 920512 - RNA, 20 nt, Mycobacterium avium subsp. paratuberculosis
ccgcgcguagugcucgcgca

SEQ ID NO: 920513 - RNA, 14 nt, Mycobacterium avium subsp. paratuberculosis
ccgcgcucaacccg

SEQ ID NO: 920514 - RNA, 20 nt, Mycobacterium avium subsp. paratuberculosis
ccgcgcucaacccgggccgg

SEQ ID NO: 920515 - RNA, 21 nt, Mycobacterium avium subsp. paratuberculosis
ccgcgcucaacccgggccgga

SEQ ID NO: 920516 - RNA, 17 nt, Mycobacterium avium subsp. paratuberculosis
ccgcgcugaccagcgug

SEQ ID NO: 920517 - RNA, 18 nt, Mycobacterium avium subsp. paratuberculosis
ccgcgcugaccagcguga

SEQ ID NO: 920518 - RNA, 20 nt, Mycobacterium avium subsp. paratuberculosis
ccgcgccgaacgcaccaccg

SEQ ID NO: 920519 - RNA, 21 nt, Mycobacterium avium subsp. paratuberculosis
ccgcgcccuggugcaacaccg

SEQ ID NO: 920520 - RNA, 17 nt, Mycobacterium avium subsp. paratuberculosis
ccgcgcccgucgagcgu

SEQ ID NO: 920521 - RNA, 21 nt, Mycobacterium avium subsp. paratuberculosis
ccgcgcccgucgagcgucacg

SEQ ID NO: 920522 - RNA, 15 nt, Mycobacterium avium subsp. paratuberculosis
ccgcgcccgccgcgu

SEQ ID NO: 920523 - RNA, 15 nt, Mycobacterium avium subsp. paratuberculosis
ccgcgcccgccggcc

SEQ ID NO: 920524 - RNA, 19 nt, Mycobacterium avium subsp. paratuberculosis
ccgcgcccgccggcccagc

SEQ ID NO: 920525 - RNA, 20 nt, Mycobacterium avium subsp. paratuberculosis
ccgcgcccgccggcccagcu

SEQ ID NO: 920526 - RNA, 14 nt, Mycobacterium avium subsp. paratuberculosis
ccgcgcccgcucga

SEQ ID NO: 920527 - RNA, 20 nt, Mycobacterium avium subsp. paratuberculosis
ccgcgcccgcauguucucga

SEQ ID NO: 920528 - RNA, 14 nt, Mycobacterium avium subsp. paratuberculosis
ccgcgccccggcgc

SEQ ID NO: 920529 - RNA, 16 nt, Mycobacterium avium subsp. paratuberculosis
ccgcgccccggcgcag

SEQ ID NO: 920530 - RNA, 16 nt, Mycobacterium avium subsp. paratuberculosis
ccgcgccccggcgcgc

SEQ ID NO: 920531 - RNA, 18 nt, Mycobacterium avium subsp. paratuberculosis
ccgcgccccggcgcgccu

SEQ ID NO: 920532 - RNA, 18 nt, Mycobacterium avium subsp. paratuberculosis
ccgcgccccggcggccac

SEQ ID NO: 920533 - RNA, 16 nt, Mycobacterium avium subsp. paratuberculosis
ccgcgccccgagcagc

SEQ ID NO: 920534 - RNA, 19 nt, Mycobacterium avium subsp. paratuberculosis
ccgcgccccgagcagcggg

SEQ ID NO: 920535 - RNA, 18 nt, Mycobacterium avium subsp. paratuberculosis
ccgcgcccaucgcggccg

SEQ ID NO: 920536 - RNA, 17 nt, Mycobacterium avium subsp. paratuberculosis
ccgcgcccaugaacgcg

SEQ ID NO: 920537 - RNA, 15 nt, Mycobacterium avium subsp. paratuberculosis
ccgcgcccagugugg

SEQ ID NO: 920538 - RNA, 13 nt, Mycobacterium avium subsp. paratuberculosis
ccgcgcccacccg

SEQ ID NO: 920539 - RNA, 12 nt, Mycobacterium avium subsp. paratuberculosis
ccgcgcccaccu

SEQ ID NO: 920540 - RNA, 14 nt, Mycobacterium avium subsp. paratuberculosis
ccgcgcccaccugg

SEQ ID NO: 920541 - RNA, 22 nt, Mycobacterium avium subsp. paratuberculosis
ccgcgcccaccuggaggccaac

SEQ ID NO: 920542 - RNA, 14 nt, Mycobacterium avium subsp. paratuberculosis
ccgcgcccagcacg

SEQ ID NO: 920543 - RNA, 12 nt, Mycobacterium avium subsp. paratuberculosis
ccgcgcccagcc

SEQ ID NO: 920544 - RNA, 14 nt, Mycobacterium avium subsp. paratuberculosis
ccgcgcccagcccc

SEQ ID NO: 920545 - RNA, 16 nt, Mycobacterium avium subsp. paratuberculosis
ccggcaguugcggccg

SEQ ID NO: 920546 - RNA, 15 nt, Mycobacterium avium subsp. paratuberculosis
ccggcaggucgaggc

SEQ ID NO: 920547 - RNA, 22 nt, Mycobacterium avium subsp. paratuberculosis
ccggcaucggcucguagcgggc

SEQ ID NO: 920548 - RNA, 11 nt, Mycobacterium avium subsp. paratuberculosis
ccggcaucggu

SEQ ID NO: 920549 - RNA, 22 nt, Mycobacterium avium subsp. paratuberculosis
ccggcaucgguggcaccccgcg

SEQ ID NO: 920550 - RNA, 13 nt, Mycobacterium avium subsp. paratuberculosis
ccggcaugggcgg

SEQ ID NO: 920551 - RNA, 21 nt, Mycobacterium avium subsp. paratuberculosis
ccggcaugggcggcaagccga

SEQ ID NO: 920552 - RNA, 15 nt, Mycobacterium avium subsp. paratuberculosis
ccggccaccagcggc

SEQ ID NO: 920553 - RNA, 17 nt, Mycobacterium avium subsp. paratuberculosis
ccggccaccagcggccg

SEQ ID NO: 920554 - RNA, 14 nt, Mycobacterium avium subsp. paratuberculosis
ccggccaccaacag

SEQ ID NO: 920555 - RNA, 22 nt, Mycobacterium avium subsp. paratuberculosis
ccggccaccaacaggucggcgu

SEQ ID NO: 920556 - RNA, 19 nt, Mycobacterium avium subsp. paratuberculosis
ccggccagcacggccagcc

SEQ ID NO: 920557 - RNA, 12 nt, Mycobacterium avium subsp. paratuberculosis
ccggccagcacg

SEQ ID NO: 920558 - RNA, 21 nt, Mycobacterium avium subsp. paratuberculosis
ccggccagcacgaacaccacg

SEQ ID NO: 920559 - RNA, 19 nt, Mycobacterium avium subsp. paratuberculosis
ccggccagcacccgcucgc

SEQ ID NO: 920560 - RNA, 22 nt, Mycobacterium avium subsp. paratuberculosis
ccggccagcacccgcugaucca

SEQ ID NO: 920561 - RNA, 12 nt, Mycobacterium avium subsp. paratuberculosis
ccggccagcaca

SEQ ID NO: 920562 - RNA, 22 nt, Mycobacterium avium subsp. paratuberculosis
ccggccagcacacccucgaccc

SEQ ID NO: 920563 - RNA, 13 nt, Mycobacterium avium subsp. paratuberculosis
ccggccagcacca

SEQ ID NO: 920564 - RNA, 14 nt, Mycobacterium avium subsp. paratuberculosis
ccggccagcaccac

SEQ ID NO: 920565 - RNA, 14 nt, Mycobacterium avium subsp. paratuberculosis
ccggccagcacccg

SEQ ID NO: 920566 - RNA, 16 nt, Mycobacterium avium subsp. paratuberculosis
ccggccacucgccgcg

SEQ ID NO: 920567 - RNA, 17 nt, Mycobacterium avium subsp. paratuberculosis
ccggccacucgccgcga

SEQ ID NO: 920568 - RNA, 20 nt, Mycobacterium avium subsp. paratuberculosis
ccggccacucgccgcgaacg

SEQ ID NO: 920569 - RNA, 12 nt, Mycobacterium avium subsp. paratuberculosis
ccggccagaccg

SEQ ID NO: 920570 - RNA, 14 nt, Mycobacterium avium subsp. paratuberculosis
ccggccagcagcag

SEQ ID NO: 920571 - RNA, 15 nt, Mycobacterium avium subsp. paratuberculosis
ccggccagcagcagc

SEQ ID NO: 920572 - RNA, 23 nt, Mycobacterium avium subsp. paratuberculosis
ccggccagcagcagcccgccgau

SEQ ID NO: 920573 - RNA, 13 nt, Mycobacterium avium subsp. paratuberculosis
ccggccagcagcc

SEQ ID NO: 920574 - RNA, 18 nt, Mycobacterium avium subsp. paratuberculosis
ccggccagcagccgguac

SEQ ID NO: 920575 - RNA, 21 nt, Mycobacterium avium subsp. paratuberculosis
ccggccagcagccgguacagc

SEQ ID NO: 920576 - RNA, 14 nt, Mycobacterium avium subsp. paratuberculosis
ccggccagcaggua

SEQ ID NO: 920577 - RNA, 19 nt, Mycobacterium avium subsp. paratuberculosis
ccggccacguaguccgacg

SEQ ID NO: 920578 - RNA, 20 nt, Mycobacterium avium subsp. paratuberculosis
ccggccacguaguccgacga

SEQ ID NO: 920579 - RNA, 15 nt, Mycobacterium avium subsp. paratuberculosis
ccggccacgucgaug

SEQ ID NO: 920580 - RNA, 16 nt, Mycobacterium avium subsp. paratuberculosis
ccggccacgucgaugc

SEQ ID NO: 920581 - RNA, 16 nt, Mycobacterium avium subsp. paratuberculosis
ccggccaccucguccc

SEQ ID NO: 920582 - RNA, 17 nt, Mycobacterium avium subsp. paratuberculosis
ccggccaccucgucggc

SEQ ID NO: 920583 - RNA, 23 nt, Mycobacterium avium subsp. paratuberculosis
ccggccaccucgucggcggucaa

SEQ ID NO: 920584 - RNA, 16 nt, Mycobacterium avium subsp. paratuberculosis
ccggccacgaccucgg

SEQ ID NO: 920585 - RNA, 15 nt, Mycobacterium avium subsp. paratuberculosis
ccggccacgccgggu

SEQ ID NO: 920586 - RNA, 14 nt, Mycobacterium avium subsp. paratuberculosis
ccggccacgcucgg

SEQ ID NO: 920587 - RNA, 12 nt, Mycobacterium avium subsp. paratuberculosis
ccggccaccugg

SEQ ID NO: 920588 - RNA, 17 nt, Mycobacterium avium subsp. paratuberculosis
ccggccaccuggccggu

SEQ ID NO: 920589 - RNA, 20 nt, Mycobacterium avium subsp. paratuberculosis
ccggccaccagggcgaccgc

SEQ ID NO: 920590 - RNA, 19 nt, Mycobacterium avium subsp. paratuberculosis
ccggccaccagggucucgc

SEQ ID NO: 920591 - RNA, 16 nt, Mycobacterium avium subsp. paratuberculosis
ccggccaccaggucgc

SEQ ID NO: 920592 - RNA, 19 nt, Mycobacterium avium subsp. paratuberculosis
ccggccaccgccccagccg

SEQ ID NO: 920593 - RNA, 20 nt, Mycobacterium avium subsp. paratuberculosis
ccggccaccgccccagccga

SEQ ID NO: 920594 - RNA, 13 nt, Mycobacterium avium subsp. paratuberculosis
ccggccaccgccg

SEQ ID NO: 920595 - RNA, 14 nt, Mycobacterium avium subsp. paratuberculosis
ccggccaccgccgc

SEQ ID NO: 920596 - RNA, 16 nt, Mycobacterium avium subsp. paratuberculosis
ccggccaccgccgcca

SEQ ID NO: 920597 - RNA, 20 nt, Mycobacterium avium subsp. paratuberculosis
ccggccaccgccgccagcag

SEQ ID NO: 920598 - RNA, 21 nt, Mycobacterium avium subsp. paratuberculosis
ccggccaccgccgccagcagc

SEQ ID NO: 920599 - RNA, 12 nt, Mycobacterium avium subsp. paratuberculosis
ccggccaccggc

SEQ ID NO: 920600 - RNA, 17 nt, Mycobacterium avium subsp. paratuberculosis
ccggccaccggcgcgac

SEQ ID NO: 920601 - RNA, 12 nt, Mycobacterium avium subsp. paratuberculosis
ccggccaccucg

SEQ ID NO: 920602 - RNA, 14 nt, Mycobacterium avium subsp. paratuberculosis
ccggcagcggggcg

SEQ ID NO: 920603 - RNA, 20 nt, Mycobacterium avium subsp. paratuberculosis
ccggcagcgucuuggacgcc

SEQ ID NO: 920604 - RNA, 23 nt, Mycobacterium avium subsp. paratuberculosis
ccggcagcgucuuggacgcccgg

SEQ ID NO: 920605 - RNA, 16 nt, Mycobacterium avium subsp. paratuberculosis
ccggcaggccgcggcc

SEQ ID NO: 920606 - RNA, 18 nt, Mycobacterium avium subsp. paratuberculosis
ccggcaggccgcggccgu

SEQ ID NO: 920607 - RNA, 19 nt, Mycobacterium avium subsp. paratuberculosis
ccggcaguuccucgccgga

SEQ ID NO: 920608 - RNA, 21 nt, Mycobacterium avium subsp. paratuberculosis
ccggcagguuguugacgacgu

SEQ ID NO: 920609 - RNA, 16 nt, Mycobacterium avium subsp. paratuberculosis
ccggcaguacgcgccg

SEQ ID NO: 920610 - RNA, 19 nt, Mycobacterium avium subsp. paratuberculosis
ccggcaguacgcgccggcc

SEQ ID NO: 920611 - RNA, 20 nt, Mycobacterium avium subsp. paratuberculosis
ccggcaguacgcgccggccu

SEQ ID NO: 920612 - RNA, 16 nt, Mycobacterium avium subsp. paratuberculosis
ccggcaguccggacac

SEQ ID NO: 920613 - RNA, 19 nt, Mycobacterium avium subsp. paratuberculosis
ccggcaguccggacacggc

SEQ ID NO: 920614 - RNA, 16 nt, Mycobacterium avium subsp. paratuberculosis
ccggcagugaucggcg

SEQ ID NO: 920615 - RNA, 14 nt, Mycobacterium avium subsp. paratuberculosis
ccggcaggccgccc

SEQ ID NO: 920616 - RNA, 15 nt, Mycobacterium avium subsp. paratuberculosis
ccggcaggcucagca

SEQ ID NO: 920617 - RNA, 21 nt, Mycobacterium avium subsp. paratuberculosis
ccggcaggcucagcagcaccg

SEQ ID NO: 920618 - RNA, 22 nt, Mycobacterium avium subsp. paratuberculosis
ccggcaggcucagcagcaccgc

SEQ ID NO: 920619 - RNA, 20 nt, Mycobacterium avium subsp. paratuberculosis
ccggcagcgccucccggacc

SEQ ID NO: 920620 - RNA, 13 nt, Mycobacterium avium subsp. paratuberculosis
ccggcagcggcug

SEQ ID NO: 920621 - RNA, 17 nt, Mycobacterium avium subsp. paratuberculosis
ccggcagcggucauuga

SEQ ID NO: 920622 - RNA, 13 nt, Mycobacterium avium subsp. paratuberculosis
ccggcagcggugc

SEQ ID NO: 920623 - RNA, 16 nt, Mycobacterium avium subsp. paratuberculosis
ccggcagcggugccgc

SEQ ID NO: 920624 - RNA, 23 nt, Mycobacterium avium subsp. paratuberculosis
ccggcagcggugccgcccggagg

SEQ ID NO: 920625 - RNA, 16 nt, Mycobacterium avium subsp. paratuberculosis
ccggcagcgcucgucg

SEQ ID NO: 920626 - RNA, 20 nt, Mycobacterium avium subsp. paratuberculosis
ccggcagcgcucgucgucgg

SEQ ID NO: 920627 - RNA, 12 nt, Mycobacterium avium subsp. paratuberculosis
ccggcagcggcc

SEQ ID NO: 920628 - RNA, 13 nt, Mycobacterium avium subsp. paratuberculosis
ccggcagccgggg

SEQ ID NO: 920629 - RNA, 14 nt, Mycobacterium avium subsp. paratuberculosis
ccggcagccggcca

SEQ ID NO: 920630 - RNA, 15 nt, Mycobacterium avium subsp. paratuberculosis
ccggcagccggccac

SEQ ID NO: 920631 - RNA, 16 nt, Mycobacterium avium subsp. paratuberculosis
ccggcagccggccacc

SEQ ID NO: 920632 - RNA, 14 nt, Mycobacterium avium subsp. paratuberculosis
ccggcagcccggag

SEQ ID NO: 920633 - RNA, 13 nt, Mycobacterium avium subsp. paratuberculosis
ccggcagccgcag

SEQ ID NO: 920634 - RNA, 13 nt, Mycobacterium avium subsp. paratuberculosis
ccggcagccgcgc

SEQ ID NO: 920635 - RNA, 12 nt, Mycobacterium avium subsp. paratuberculosis
ccggcagccgcu

SEQ ID NO: 920636 - RNA, 19 nt, Mycobacterium avium subsp. paratuberculosis
ccggcagcaggugcaccac

SEQ ID NO: 920637 - RNA, 13 nt, Mycobacterium avium subsp. paratuberculosis
ccggcagcaucgg

SEQ ID NO: 920638 - RNA, 17 nt, Mycobacterium avium subsp. paratuberculosis
ccggcagcaucgggacg

SEQ ID NO: 920639 - RNA, 22 nt, Mycobacterium avium subsp. paratuberculosis
ccggcagcaucgggacgccugc

SEQ ID NO: 920640 - RNA, 16 nt, Mycobacterium avium subsp. paratuberculosis
ccggcagcauucgccg

SEQ ID NO: 920641 - RNA, 19 nt, Mycobacterium avium subsp. paratuberculosis
ccggcagcauucgccgggg

SEQ ID NO: 920642 - RNA, 20 nt, Mycobacterium avium subsp. paratuberculosis
ccggauuucgccagugccgc

SEQ ID NO: 920643 - RNA, 21 nt, Mycobacterium avium subsp. paratuberculosis
ccggcaacaccggcggcgacg

SEQ ID NO: 920644 - RNA, 22 nt, Mycobacterium avium subsp. paratuberculosis
ccggcaacacguagucgccgau

SEQ ID NO: 920645 - RNA, 18 nt, Mycobacterium avium subsp. paratuberculosis
ccggcaacgacccgucgg

SEQ ID NO: 920646 - RNA, 22 nt, Mycobacterium avium subsp. paratuberculosis
ccggcaacgacccgucggggug

SEQ ID NO: 920647 - RNA, 13 nt, Mycobacterium avium subsp. paratuberculosis
ccggcaaccgcca

SEQ ID NO: 920648 - RNA, 16 nt, Mycobacterium avium subsp. paratuberculosis
ccggcaaccgccacga

SEQ ID NO: 920649 - RNA, 22 nt, Mycobacterium avium subsp. paratuberculosis
ccggcaaccgccacgacgcggc

SEQ ID NO: 920650 - RNA, 16 nt, Mycobacterium avium subsp. paratuberculosis
ccggcaacuggccgcc

SEQ ID NO: 920651 - RNA, 18 nt, Mycobacterium avium subsp. paratuberculosis
ccggcaacucccgaucgc

SEQ ID NO: 920652 - RNA, 15 nt, Mycobacterium avium subsp. paratuberculosis
ccggcaaucgggacg

SEQ ID NO: 920653 - RNA, 16 nt, Mycobacterium avium subsp. paratuberculosis
ccggcaaggugccguc

SEQ ID NO: 920654 - RNA, 18 nt, Mycobacterium avium subsp. paratuberculosis
ccggcaaggugccguccg

SEQ ID NO: 920655 - RNA, 12 nt, Mycobacterium avium subsp. paratuberculosis
ccggcaccagca

SEQ ID NO: 920656 - RNA, 13 nt, Mycobacterium avium subsp. paratuberculosis
ccggcaccagcag

SEQ ID NO: 920657 - RNA, 16 nt, Mycobacterium avium subsp. paratuberculosis
ccggcaccagcagccg

SEQ ID NO: 920658 - RNA, 14 nt, Mycobacterium avium subsp. paratuberculosis
ccggcacaccgagc

SEQ ID NO: 920659 - RNA, 22 nt, Mycobacterium avium subsp. paratuberculosis
ccggcacccccaauugccgggc

SEQ ID NO: 920660 - RNA, 16 nt, Mycobacterium avium subsp. paratuberculosis
ccggcacccgccagcc

SEQ ID NO: 920661 - RNA, 15 nt, Mycobacterium avium subsp. paratuberculosis
ccggcacgucgagcu

SEQ ID NO: 920662 - RNA, 19 nt, Mycobacterium avium subsp. paratuberculosis
ccggcacgucgagcuccuc

SEQ ID NO: 920663 - RNA, 22 nt, Mycobacterium avium subsp. paratuberculosis
ccggcacgucgagcuccucggc

SEQ ID NO: 920664 - RNA, 13 nt, Mycobacterium avium subsp. paratuberculosis
ccggcacgucggc

SEQ ID NO: 920665 - RNA, 18 nt, Mycobacterium avium subsp. paratuberculosis
ccggcacgucggccacgc

SEQ ID NO: 920666 - RNA, 13 nt, Mycobacterium avium subsp. paratuberculosis
ccggcacguugac

SEQ ID NO: 920667 - RNA, 16 nt, Mycobacterium avium subsp. paratuberculosis
ccggcacggccggccg

SEQ ID NO: 920668 - RNA, 17 nt, Mycobacterium avium subsp. paratuberculosis
ccggcacggugcacacg

SEQ ID NO: 920669 - RNA, 21 nt, Mycobacterium avium subsp. paratuberculosis
ccggcacggugcacacgccga

SEQ ID NO: 920670 - RNA, 22 nt, Mycobacterium avium subsp. paratuberculosis
ccggcacggugcacacgccgag

SEQ ID NO: 920671 - RNA, 14 nt, Mycobacterium avium subsp. paratuberculosis
ccggcacgaacgcg

SEQ ID NO: 920672 - RNA, 22 nt, Mycobacterium avium subsp. paratuberculosis
ccggcacgaacgcgacgaucag

SEQ ID NO: 920673 - RNA, 15 nt, Mycobacterium avium subsp. paratuberculosis
ccggcacggcaccgc

SEQ ID NO: 920674 - RNA, 16 nt, Mycobacterium avium subsp. paratuberculosis
ccggcacggcaccgcg

SEQ ID NO: 920675 - RNA, 19 nt, Mycobacterium avium subsp. paratuberculosis
ccggcacugcugcccgcga

SEQ ID NO: 920676 - RNA, 23 nt, Mycobacterium avium subsp. paratuberculosis
ccggcacugcugcccgcgacggc

SEQ ID NO: 920677 - RNA, 20 nt, Mycobacterium avium subsp. paratuberculosis
ccggcacucgucguggcggu

SEQ ID NO: 920678 - RNA, 22 nt, Mycobacterium avium subsp. paratuberculosis
ccggcacucgucguggcggugc

SEQ ID NO: 920679 - RNA, 21 nt, Mycobacterium avium subsp. paratuberculosis
ccggcacugaaggcgcgggca

SEQ ID NO: 920680 - RNA, 16 nt, Mycobacterium avium subsp. paratuberculosis
ccggcacuucgaucau

SEQ ID NO: 920681 - RNA, 15 nt, Mycobacterium avium subsp. paratuberculosis
ccggcagaacgacgc

SEQ ID NO: 920682 - RNA, 16 nt, Mycobacterium avium subsp. paratuberculosis
ccggcagaacgacgcc

SEQ ID NO: 920683 - RNA, 20 nt, Mycobacterium avium subsp. paratuberculosis
ccggcagcagcgcgucgugc

SEQ ID NO: 920684 - RNA, 13 nt, Mycobacterium avium subsp. paratuberculosis
ccggcagcaccgc

SEQ ID NO: 920685 - RNA, 19 nt, Mycobacterium avium subsp. paratuberculosis
ccggcagcaccgccgagcc

SEQ ID NO: 920686 - RNA, 22 nt, Mycobacterium avium subsp. paratuberculosis
ccggcagcaccgccgagccguc

SEQ ID NO: 920687 - RNA, 14 nt, Mycobacterium avium subsp. paratuberculosis
ccggcagcaccggc

SEQ ID NO: 920688 - RNA, 16 nt, Mycobacterium avium subsp. paratuberculosis
ccggcagcaccggccg

SEQ ID NO: 920689 - RNA, 17 nt, Mycobacterium avium subsp. paratuberculosis
ccggcagcaccggccgg

SEQ ID NO: 920690 - RNA, 15 nt, Mycobacterium avium subsp. paratuberculosis
ccggcagcaaccgcg

SEQ ID NO: 920691 - RNA, 16 nt, Mycobacterium avium subsp. paratuberculosis
ccggcagcaaccggcg

SEQ ID NO: 920692 - RNA, 17 nt, Mycobacterium avium subsp. paratuberculosis
ccggcagcaaccggcgg

SEQ ID NO: 920693 - RNA, 20 nt, Mycobacterium avium subsp. paratuberculosis
ccggcagcaaccggcggcug

SEQ ID NO: 920694 - RNA, 12 nt, Mycobacterium avium subsp. paratuberculosis
ccggcaccgcgg

SEQ ID NO: 920695 - RNA, 18 nt, Mycobacterium avium subsp. paratuberculosis
ccggcaccgcggcgauga

SEQ ID NO: 920696 - RNA, 20 nt, Mycobacterium avium subsp. paratuberculosis
ccggcaccgcggcgaugauc

SEQ ID NO: 920697 - RNA, 17 nt, Mycobacterium avium subsp. paratuberculosis
ccggcaccgcggcggug

SEQ ID NO: 920698 - RNA, 13 nt, Mycobacterium avium subsp. paratuberculosis
ccggcaccgcggu

SEQ ID NO: 920699 - RNA, 16 nt, Mycobacterium avium subsp. paratuberculosis
ccggcaccgcggucug

SEQ ID NO: 920700 - RNA, 18 nt, Mycobacterium avium subsp. paratuberculosis
ccggcaccgaccgggcgc

SEQ ID NO: 920701 - RNA, 14 nt, Mycobacterium avium subsp. paratuberculosis
ccggcaccgccagc

SEQ ID NO: 920702 - RNA, 15 nt, Mycobacterium avium subsp. paratuberculosis
ccggcaccgccagcc

SEQ ID NO: 920703 - RNA, 12 nt, Mycobacterium avium subsp. paratuberculosis
ccggcaccgccc

SEQ ID NO: 920704 - RNA, 15 nt, Mycobacterium avium subsp. paratuberculosis
ccggcaccgcccccg

SEQ ID NO: 920705 - RNA, 20 nt, Mycobacterium avium subsp. paratuberculosis
ccggcacgaucgucgccgcc

SEQ ID NO: 920706 - RNA, 21 nt, Mycobacterium avium subsp. paratuberculosis
ccggcacgaucgucgccgcca

SEQ ID NO: 920707 - RNA, 13 nt, Mycobacterium avium subsp. paratuberculosis
ccggcacgauggc

SEQ ID NO: 920708 - RNA, 16 nt, Mycobacterium avium subsp. paratuberculosis
ccggcacgcaccuugg

SEQ ID NO: 920709 - RNA, 12 nt, Mycobacterium avium subsp. paratuberculosis
ccggcaccgcca

SEQ ID NO: 920710 - RNA, 16 nt, Mycobacterium avium subsp. paratuberculosis
ccggcaccggugcggc

SEQ ID NO: 920711 - RNA, 14 nt, Mycobacterium avium subsp. paratuberculosis
ccggaacggcgggc

SEQ ID NO: 920712 - RNA, 18 nt, Mycobacterium avium subsp. paratuberculosis
ccggaacggcgggcccgu

SEQ ID NO: 920713 - RNA, 23 nt, Mycobacterium avium subsp. paratuberculosis
ccggaacggcgggcccgucgccg

SEQ ID NO: 920714 - RNA, 20 nt, Mycobacterium avium subsp. paratuberculosis
ccggaacggcuugcgcucgg

SEQ ID NO: 920715 - RNA, 23 nt, Mycobacterium avium subsp. paratuberculosis
ccggaacggcuugcgcucggccg

SEQ ID NO: 920716 - RNA, 15 nt, Mycobacterium avium subsp. paratuberculosis
ccggacaacggaucg

SEQ ID NO: 920717 - RNA, 17 nt, Mycobacterium avium subsp. paratuberculosis
ccggacaacggaucgag

SEQ ID NO: 920718 - RNA, 14 nt, Mycobacterium avium subsp. paratuberculosis
ccggaaucgucggc

SEQ ID NO: 920719 - RNA, 22 nt, Mycobacterium avium subsp. paratuberculosis
ccggaauugaagaagcgggcca

SEQ ID NO: 920720 - RNA, 14 nt, Mycobacterium avium subsp. paratuberculosis
ccggacacggccag

SEQ ID NO: 920721 - RNA, 15 nt, Mycobacterium avium subsp. paratuberculosis
ccggacaccaccgcg

SEQ ID NO: 920722 - RNA, 19 nt, Mycobacterium avium subsp. paratuberculosis
ccggacaccccguaggugc

SEQ ID NO: 920723 - RNA, 15 nt, Mycobacterium avium subsp. paratuberculosis
ccggacaccggcacg

SEQ ID NO: 920724 - RNA, 22 nt, Mycobacterium avium subsp. paratuberculosis
ccggacagccacuccauccgga

SEQ ID NO: 920725 - RNA, 13 nt, Mycobacterium avium subsp. paratuberculosis
ccggacagcgcga

SEQ ID NO: 920726 - RNA, 22 nt, Mycobacterium avium subsp. paratuberculosis
ccggacagcgcgacgcacgccg

SEQ ID NO: 920727 - RNA, 17 nt, Mycobacterium avium subsp. paratuberculosis
ccggacagcgggccgac

SEQ ID NO: 920728 - RNA, 13 nt, Mycobacterium avium subsp. paratuberculosis
ccggacaggucga

SEQ ID NO: 920729 - RNA, 22 nt, Mycobacterium avium subsp. paratuberculosis
ccggacaggucgagggugaccc

SEQ ID NO: 920730 - RNA, 13 nt, Mycobacterium avium subsp. paratuberculosis
ccggacaggucgg

SEQ ID NO: 920731 - RNA, 20 nt, Mycobacterium avium subsp. paratuberculosis
ccggacauaggcgucgcggu

SEQ ID NO: 920732 - RNA, 21 nt, Mycobacterium avium subsp. paratuberculosis
ccggacauaggcgucgcgguc

SEQ ID NO: 920733 - RNA, 16 nt, Mycobacterium avium subsp. paratuberculosis
ccggaccacguccccg

SEQ ID NO: 920734 - RNA, 17 nt, Mycobacterium avium subsp. paratuberculosis
ccggaccaggguggccc

SEQ ID NO: 920735 - RNA, 21 nt, Mycobacterium avium subsp. paratuberculosis
ccggaccaggguggccccagc

SEQ ID NO: 920736 - RNA, 15 nt, Mycobacterium avium subsp. paratuberculosis
ccggacgcgcacacg

SEQ ID NO: 920737 - RNA, 22 nt, Mycobacterium avium subsp. paratuberculosis
ccggacgcgcacacggccucgc

SEQ ID NO: 920738 - RNA, 19 nt, Mycobacterium avium subsp. paratuberculosis
ccggacgcagcgaucggcg

SEQ ID NO: 920739 - RNA, 20 nt, Mycobacterium avium subsp. paratuberculosis
ccggacgcagcgaucggcgg

SEQ ID NO: 920740 - RNA, 16 nt, Mycobacterium avium subsp. paratuberculosis
ccggaccugccggcga

SEQ ID NO: 920741 - RNA, 18 nt, Mycobacterium avium subsp. paratuberculosis
ccggaccugccggcgauc

SEQ ID NO: 920742 - RNA, 23 nt, Mycobacterium avium subsp. paratuberculosis
ccggacgaacaucgagcccaccg

SEQ ID NO: 920743 - RNA, 12 nt, Mycobacterium avium subsp. paratuberculosis
ccggacgaccug

SEQ ID NO: 920744 - RNA, 14 nt, Mycobacterium avium subsp. paratuberculosis
ccggacgaccuggg

SEQ ID NO: 920745 - RNA, 17 nt, Mycobacterium avium subsp. paratuberculosis
ccggacgaugacccagc

SEQ ID NO: 920746 - RNA, 14 nt, Mycobacterium avium subsp. paratuberculosis
ccggacgaugccgc

SEQ ID NO: 920747 - RNA, 21 nt, Mycobacterium avium subsp. paratuberculosis
ccggacgaugccgcggcgucc

SEQ ID NO: 920748 - RNA, 21 nt, Mycobacterium avium subsp. paratuberculosis
ccggacgaugcgcacccccgg

SEQ ID NO: 920749 - RNA, 17 nt, Mycobacterium avium subsp. paratuberculosis
ccggacccgcucgccga

SEQ ID NO: 920750 - RNA, 18 nt, Mycobacterium avium subsp. paratuberculosis
ccggacccauucgucggc

SEQ ID NO: 920751 - RNA, 16 nt, Mycobacterium avium subsp. paratuberculosis
ccggaccccacagcgc

SEQ ID NO: 920752 - RNA, 22 nt, Mycobacterium avium subsp. paratuberculosis
ccggacccccucggggcucacc

SEQ ID NO: 920753 - RNA, 15 nt, Mycobacterium avium subsp. paratuberculosis
ccggaccgauccggc

SEQ ID NO: 920754 - RNA, 18 nt, Mycobacterium avium subsp. paratuberculosis
ccggaccgauccggcgcc

SEQ ID NO: 920755 - RNA, 15 nt, Mycobacterium avium subsp. paratuberculosis
ccggaccgccgcggc

SEQ ID NO: 920756 - RNA, 16 nt, Mycobacterium avium subsp. paratuberculosis
ccggaccgccgcggcg

SEQ ID NO: 920757 - RNA, 22 nt, Mycobacterium avium subsp. paratuberculosis
ccggaccgccgcggcgcccggc

SEQ ID NO: 920758 - RNA, 21 nt, Mycobacterium avium subsp. paratuberculosis
ccggaccgccgcggcggccug

SEQ ID NO: 920759 - RNA, 16 nt, Mycobacterium avium subsp. paratuberculosis
ccggaccgcgcgggcc

SEQ ID NO: 920760 - RNA, 17 nt, Mycobacterium avium subsp. paratuberculosis
ccggaccgcgcgggcca

SEQ ID NO: 920761 - RNA, 14 nt, Mycobacterium avium subsp. paratuberculosis
ccggaccgcggucg

SEQ ID NO: 920762 - RNA, 22 nt, Mycobacterium avium subsp. paratuberculosis
ccggaccgcuugacgccgccga

SEQ ID NO: 920763 - RNA, 14 nt, Mycobacterium avium subsp. paratuberculosis
ccggaccggagacg

SEQ ID NO: 920764 - RNA, 16 nt, Mycobacterium avium subsp. paratuberculosis
ccggaccggccagcag

SEQ ID NO: 920765 - RNA, 13 nt, Mycobacterium avium subsp. paratuberculosis
ccggaccggccgu

SEQ ID NO: 920766 - RNA, 14 nt, Mycobacterium avium subsp. paratuberculosis
ccggaccggccgug

SEQ ID NO: 920767 - RNA, 14 nt, Mycobacterium avium subsp. paratuberculosis
ccggaccggcucgu

SEQ ID NO: 920768 - RNA, 12 nt, Mycobacterium avium subsp. paratuberculosis
ccggaccgccga

SEQ ID NO: 920769 - RNA, 17 nt, Mycobacterium avium subsp. paratuberculosis
ccggaccgggugaccgg

SEQ ID NO: 920770 - RNA, 13 nt, Mycobacterium avium subsp. paratuberculosis
ccggaccucgacc

SEQ ID NO: 920771 - RNA, 13 nt, Mycobacterium avium subsp. paratuberculosis
ccggacggugacg

SEQ ID NO: 920772 - RNA, 17 nt, Mycobacterium avium subsp. paratuberculosis
ccggacggugacgccgg

SEQ ID NO: 920773 - RNA, 18 nt, Mycobacterium avium subsp. paratuberculosis
ccggacggugacgccgga

SEQ ID NO: 920774 - RNA, 13 nt, Mycobacterium avium subsp. paratuberculosis
ccggacggccacc

SEQ ID NO: 920775 - RNA, 14 nt, Mycobacterium avium subsp. paratuberculosis
ccggacggcccgca

SEQ ID NO: 920776 - RNA, 20 nt, Mycobacterium avium subsp. paratuberculosis
ccggacggccgaaacgcccg

SEQ ID NO: 920777 - RNA, 13 nt, Mycobacterium avium subsp. paratuberculosis
ccggacggagccg

SEQ ID NO: 920778 - RNA, 22 nt, Mycobacterium avium subsp. paratuberculosis
ccggacuugaugcugcccggcg

SEQ ID NO: 920779 - RNA, 23 nt, Mycobacterium avium subsp. paratuberculosis
ccggacuugaugcugcccggcgc

SEQ ID NO: 920780 - RNA, 13 nt, Mycobacterium avium subsp. paratuberculosis
ccggacuccucgg

SEQ ID NO: 920781 - RNA, 22 nt, Mycobacterium avium subsp. paratuberculosis
ccggacuccucgguggccucgc

SEQ ID NO: 920782 - RNA, 17 nt, Mycobacterium avium subsp. paratuberculosis
ccggacuccuucaucga

SEQ ID NO: 920783 - RNA, 16 nt, Mycobacterium avium subsp. paratuberculosis
ccggacucgaucgcca

SEQ ID NO: 920784 - RNA, 17 nt, Mycobacterium avium subsp. paratuberculosis
ccggacucgaucgccac

SEQ ID NO: 920785 - RNA, 19 nt, Mycobacterium avium subsp. paratuberculosis
ccggacucgaucgccaccg

SEQ ID NO: 920786 - RNA, 20 nt, Mycobacterium avium subsp. paratuberculosis
ccggacuauacacgccugga

SEQ ID NO: 920787 - RNA, 13 nt, Mycobacterium avium subsp. paratuberculosis
ccggagcugucgg

SEQ ID NO: 920788 - RNA, 16 nt, Mycobacterium avium subsp. paratuberculosis
ccggaggccagcucga

SEQ ID NO: 920789 - RNA, 20 nt, Mycobacterium avium subsp. paratuberculosis
ccggaggccagcucgaccgc

SEQ ID NO: 920790 - RNA, 23 nt, Mycobacterium avium subsp. paratuberculosis
ccggaggccagcucgaccgcggc

SEQ ID NO: 920791 - RNA, 13 nt, Mycobacterium avium subsp. paratuberculosis
ccggaggccgcgg

SEQ ID NO: 920792 - RNA, 18 nt, Mycobacterium avium subsp. paratuberculosis
ccggaggcgaucaggugg

SEQ ID NO: 920793 - RNA, 14 nt, Mycobacterium avium subsp. paratuberculosis
ccggagccgucggc

SEQ ID NO: 920794 - RNA, 21 nt, Mycobacterium avium subsp. paratuberculosis
ccggagccgucucggagcggu

SEQ ID NO: 920795 - RNA, 18 nt, Mycobacterium avium subsp. paratuberculosis
ccggagccuucuucgccg

SEQ ID NO: 920796 - RNA, 21 nt, Mycobacterium avium subsp. paratuberculosis
ccggagccuucuucgccgcag

SEQ ID NO: 920797 - RNA, 22 nt, Mycobacterium avium subsp. paratuberculosis
ccggagccuucuugaccgcagc

SEQ ID NO: 920798 - RNA, 13 nt, Mycobacterium avium subsp. paratuberculosis
ccggagccuuggu

SEQ ID NO: 920799 - RNA, 14 nt, Mycobacterium avium subsp. paratuberculosis
ccggagccuugguc

SEQ ID NO: 920800 - RNA, 16 nt, Mycobacterium avium subsp. paratuberculosis
ccggagccuuggucgc

SEQ ID NO: 920801 - RNA, 16 nt, Mycobacterium avium subsp. paratuberculosis
ccggagccggccucgc

SEQ ID NO: 920802 - RNA, 13 nt, Mycobacterium avium subsp. paratuberculosis
ccggagcgcgguc

SEQ ID NO: 920803 - RNA, 21 nt, Mycobacterium avium subsp. paratuberculosis
ccggagcgcgguccacggugg

SEQ ID NO: 920804 - RNA, 23 nt, Mycobacterium avium subsp. paratuberculosis
ccggagcgcgguccacgguggcg

SEQ ID NO: 920805 - RNA, 20 nt, Mycobacterium avium subsp. paratuberculosis
ccggagcggauggcgccguc

SEQ ID NO: 920806 - RNA, 14 nt, Mycobacterium avium subsp. paratuberculosis
ccggagcggcggua

SEQ ID NO: 920807 - RNA, 20 nt, Mycobacterium avium subsp. paratuberculosis
ccggagaugaauucggcgau

SEQ ID NO: 920808 - RNA, 22 nt, Mycobacterium avium subsp. paratuberculosis
ccggagaugaauucggcgaucu

SEQ ID NO: 920809 - RNA, 12 nt, Mycobacterium avium subsp. paratuberculosis
ccggagcccagc

SEQ ID NO: 920810 - RNA, 16 nt, Mycobacterium avium subsp. paratuberculosis
ccggagccgaccucgg

SEQ ID NO: 920811 - RNA, 21 nt, Mycobacterium avium subsp. paratuberculosis
ccggagccgaccucggcgacg

SEQ ID NO: 920812 - RNA, 16 nt, Mycobacterium avium subsp. paratuberculosis
ccggagccgaucgccu

SEQ ID NO: 920813 - RNA, 18 nt, Mycobacterium avium subsp. paratuberculosis
ccggagccgaucgccucc

SEQ ID NO: 920814 - RNA, 19 nt, Mycobacterium avium subsp. paratuberculosis
ccggagccgaucgccuccg

SEQ ID NO: 920815 - RNA, 13 nt, Mycobacterium avium subsp. paratuberculosis
ccggagaccagca

SEQ ID NO: 920816 - RNA, 13 nt, Mycobacterium avium subsp. paratuberculosis
ccggagaccgccg

SEQ ID NO: 920817 - RNA, 16 nt, Mycobacterium avium subsp. paratuberculosis
ccggagaaaccgucgg

SEQ ID NO: 920818 - RNA, 19 nt, Mycobacterium avium subsp. paratuberculosis
ccggagagcccgucgucgg

SEQ ID NO: 920819 - RNA, 15 nt, Mycobacterium avium subsp. paratuberculosis
ccggagauccggccg

SEQ ID NO: 920820 - RNA, 19 nt, Mycobacterium avium subsp. paratuberculosis
ccggaucugcgucuguggu

SEQ ID NO: 920821 - RNA, 18 nt, Mycobacterium avium subsp. paratuberculosis
ccggaucgugucccggcg

SEQ ID NO: 920822 - RNA, 20 nt, Mycobacterium avium subsp. paratuberculosis
ccggaucgugucccggcgcc

SEQ ID NO: 920823 - RNA, 21 nt, Mycobacterium avium subsp. paratuberculosis
ccggaucuugccgucggccgc

SEQ ID NO: 920824 - RNA, 22 nt, Mycobacterium avium subsp. paratuberculosis
ccggaucuugccgucggccgcc

SEQ ID NO: 920825 - RNA, 23 nt, Mycobacterium avium subsp. paratuberculosis
ccggaucuugccgucggccgccg

SEQ ID NO: 920826 - RNA, 19 nt, Mycobacterium avium subsp. paratuberculosis
ccggaucgggaccgggaag

SEQ ID NO: 920827 - RNA, 22 nt, Mycobacterium avium subsp. paratuberculosis
ccggaucgggcgguccaccgac

SEQ ID NO: 920828 - RNA, 18 nt, Mycobacterium avium subsp. paratuberculosis
ccggaucgggguggacgc

SEQ ID NO: 920829 - RNA, 19 nt, Mycobacterium avium subsp. paratuberculosis
ccggaucgggguggacgcg

SEQ ID NO: 920830 - RNA, 21 nt, Mycobacterium avium subsp. paratuberculosis
ccggaucgggguggacgcgac

SEQ ID NO: 920831 - RNA, 19 nt, Mycobacterium avium subsp. paratuberculosis
ccggaucggcugcgggcca

SEQ ID NO: 920832 - RNA, 23 nt, Mycobacterium avium subsp. paratuberculosis
ccggaucggcugcgggccagcgc

SEQ ID NO: 920833 - RNA, 17 nt, Mycobacterium avium subsp. paratuberculosis
ccggaucgggaccggga

SEQ ID NO: 920834 - RNA, 18 nt, Mycobacterium avium subsp. paratuberculosis
ccggaucgggaccgggaa

SEQ ID NO: 920835 - RNA, 21 nt, Mycobacterium avium subsp. paratuberculosis
ccggaugcacgugcaccgcgg

SEQ ID NO: 920836 - RNA, 14 nt, Mycobacterium avium subsp. paratuberculosis
ccggaugccgcgcg

SEQ ID NO: 920837 - RNA, 14 nt, Mycobacterium avium subsp. paratuberculosis
ccggaugccggcgc

SEQ ID NO: 920838 - RNA, 17 nt, Mycobacterium avium subsp. paratuberculosis
ccggaugccggcgccca

SEQ ID NO: 920839 - RNA, 13 nt, Mycobacterium avium subsp. paratuberculosis
ccggaugccggcu

SEQ ID NO: 920840 - RNA, 21 nt, Mycobacterium avium subsp. paratuberculosis
ccggaugaucaacacgucguc

SEQ ID NO: 920841 - RNA, 13 nt, Mycobacterium avium subsp. paratuberculosis
ccggaugaugccg

SEQ ID NO: 920842 - RNA, 22 nt, Mycobacterium avium subsp. paratuberculosis
ccggaugauguucuccggcccg

SEQ ID NO: 920843 - RNA, 12 nt, Mycobacterium avium subsp. paratuberculosis
ccggaugccagc

SEQ ID NO: 920844 - RNA, 22 nt, Mycobacterium avium subsp. paratuberculosis
ccggaugccagcagguccgccg

SEQ ID NO: 920845 - RNA, 16 nt, Mycobacterium avium subsp. paratuberculosis
ccggauggccgggcag

SEQ ID NO: 920846 - RNA, 21 nt, Mycobacterium avium subsp. paratuberculosis
ccggauggccgggcaggccgg

SEQ ID NO: 920847 - RNA, 15 nt, Mycobacterium avium subsp. paratuberculosis
ccggaugcucaccgg

SEQ ID NO: 920848 - RNA, 16 nt, Mycobacterium avium subsp. paratuberculosis
ccggaugcucaccggu

SEQ ID NO: 920849 - RNA, 22 nt, Mycobacterium avium subsp. paratuberculosis
ccggaugcugcgcaacaccucg

SEQ ID NO: 920850 - RNA, 13 nt, Mycobacterium avium subsp. paratuberculosis
ccggaugcggccg

SEQ ID NO: 920851 - RNA, 14 nt, Mycobacterium avium subsp. paratuberculosis
ccggaugcggcgcc

SEQ ID NO: 920852 - RNA, 13 nt, Mycobacterium avium subsp. paratuberculosis
ccggauggucugc

SEQ ID NO: 920853 - RNA, 17 nt, Mycobacterium avium subsp. paratuberculosis
ccggauggucugcagcg

SEQ ID NO: 920854 - RNA, 20 nt, Mycobacterium avium subsp. paratuberculosis
ccggauggucugcagcgacg

SEQ ID NO: 920855 - RNA, 16 nt, Mycobacterium avium subsp. paratuberculosis
ccggauggcgcccggc

SEQ ID NO: 920856 - RNA, 19 nt, Mycobacterium avium subsp. paratuberculosis
ccggauggcgcccggcagc

SEQ ID NO: 920857 - RNA, 17 nt, Mycobacterium avium subsp. paratuberculosis
ccggauuacucgccggc

SEQ ID NO: 920858 - RNA, 20 nt, Mycobacterium avium subsp. paratuberculosis
ccggauuacucgccggcggc

SEQ ID NO: 920859 - RNA, 23 nt, Mycobacterium avium subsp. paratuberculosis
ccggauuacucgccggcggcgcc

SEQ ID NO: 920860 - RNA, 22 nt, Mycobacterium avium subsp. paratuberculosis
ccggaucucgucgggcaccgcc

SEQ ID NO: 920861 - RNA, 19 nt, Mycobacterium avium subsp. paratuberculosis
ccggauggcggucgcgcca

SEQ ID NO: 920862 - RNA, 20 nt, Mycobacterium avium subsp. paratuberculosis
ccggauuggcgucgguggcg

SEQ ID NO: 920863 - RNA, 17 nt, Mycobacterium avium subsp. paratuberculosis
ccggauugccgggcagc

SEQ ID NO: 920864 - RNA, 20 nt, Mycobacterium avium subsp. paratuberculosis
ccggauugccgggcagcggc

SEQ ID NO: 920865 - RNA, 19 nt, Mycobacterium avium subsp. paratuberculosis
ccggauucgcggcggcgcc

SEQ ID NO: 920866 - RNA, 12 nt, Mycobacterium avium subsp. paratuberculosis
ccggauucggcg

SEQ ID NO: 920867 - RNA, 17 nt, Mycobacterium avium subsp. paratuberculosis
ccggauucggcgcggcu

SEQ ID NO: 920868 - RNA, 21 nt, Mycobacterium avium subsp. paratuberculosis
ccggauacacgguggugaccc

SEQ ID NO: 920869 - RNA, 14 nt, Mycobacterium avium subsp. paratuberculosis
ccggaggcggcggg

SEQ ID NO: 920870 - RNA, 15 nt, Mycobacterium avium subsp. paratuberculosis
ccggaggcggcgggg

SEQ ID NO: 920871 - RNA, 23 nt, Mycobacterium avium subsp. paratuberculosis
ccggaggcggcgggggcgggccc

SEQ ID NO: 920872 - RNA, 13 nt, Mycobacterium avium subsp. paratuberculosis
ccggaggcggcgu

SEQ ID NO: 920873 - RNA, 14 nt, Mycobacterium avium subsp. paratuberculosis
ccggaggugccggc

SEQ ID NO: 920874 - RNA, 17 nt, Mycobacterium avium subsp. paratuberculosis
ccggaggugccggccgg

SEQ ID NO: 920875 - RNA, 18 nt, Mycobacterium avium subsp. paratuberculosis
ccggaggugccggccggu

SEQ ID NO: 920876 - RNA, 19 nt, Mycobacterium avium subsp. paratuberculosis
ccggaggugccggccgguc

SEQ ID NO: 920877 - RNA, 12 nt, Mycobacterium avium subsp. paratuberculosis
ccggagguucgc

SEQ ID NO: 920878 - RNA, 16 nt, Mycobacterium avium subsp. paratuberculosis
ccggagguucgccgga

SEQ ID NO: 920879 - RNA, 13 nt, Mycobacterium avium subsp. paratuberculosis
ccggaguccggcu

SEQ ID NO: 920880 - RNA, 14 nt, Mycobacterium avium subsp. paratuberculosis
ccggaguccggcuc

SEQ ID NO: 920881 - RNA, 16 nt, Mycobacterium avium subsp. paratuberculosis
ccggaguccggcucgg

SEQ ID NO: 920882 - RNA, 22 nt, Mycobacterium avium subsp. paratuberculosis
ccggaguccggcucggugccgc

SEQ ID NO: 920883 - RNA, 18 nt, Mycobacterium avium subsp. paratuberculosis
ccggaggguauucgugug

SEQ ID NO: 920884 - RNA, 13 nt, Mycobacterium avium subsp. paratuberculosis
ccggagucgucga

SEQ ID NO: 920885 - RNA, 23 nt, Mycobacterium avium subsp. paratuberculosis
ccggaguucagccugaugccggu

SEQ ID NO: 920886 - RNA, 22 nt, Mycobacterium avium subsp. paratuberculosis
ccggauaacgcaaaacggugcg

SEQ ID NO: 920887 - RNA, 17 nt, Mycobacterium avium subsp. paratuberculosis
ccggauagccgucggcg

SEQ ID NO: 920888 - RNA, 19 nt, Mycobacterium avium subsp. paratuberculosis
ccggauagccgucggcgga

SEQ ID NO: 920889 - RNA, 22 nt, Mycobacterium avium subsp. paratuberculosis
ccggaucaugucguugaugccg

SEQ ID NO: 920890 - RNA, 23 nt, Mycobacterium avium subsp. paratuberculosis
ccggauccaccaauucgcgcugc

SEQ ID NO: 920891 - RNA, 23 nt, Mycobacterium avium subsp. paratuberculosis
ccggaucagcguuccggcggccg

SEQ ID NO: 920892 - RNA, 19 nt, Mycobacterium avium subsp. paratuberculosis
ccggaucagcugaccggcg

SEQ ID NO: 920893 - RNA, 19 nt, Mycobacterium avium subsp. paratuberculosis
ccggaucaaccacaccagc

SEQ ID NO: 920894 - RNA, 20 nt, Mycobacterium avium subsp. paratuberculosis
ccggaucaaccacaccagca

SEQ ID NO: 920895 - RNA, 21 nt, Mycobacterium avium subsp. paratuberculosis
ccggaucaaccacaccagcau

SEQ ID NO: 920896 - RNA, 13 nt, Mycobacterium avium subsp. paratuberculosis
ccggaucgccgaa

SEQ ID NO: 920897 - RNA, 12 nt, Mycobacterium avium subsp. paratuberculosis
ccggaucggcag

SEQ ID NO: 920898 - RNA, 15 nt, Mycobacterium avium subsp. paratuberculosis
ccggaucggccagca

SEQ ID NO: 920899 - RNA, 20 nt, Mycobacterium avium subsp. paratuberculosis
ccggaucggcccccgggccc

SEQ ID NO: 920900 - RNA, 15 nt, Mycobacterium avium subsp. paratuberculosis
ccggaucagcagugc

SEQ ID NO: 920901 - RNA, 21 nt, Mycobacterium avium subsp. paratuberculosis
ccggauccgguaccagaucga

SEQ ID NO: 920902 - RNA, 17 nt, Mycobacterium avium subsp. paratuberculosis
ccggauccgucgccccg

SEQ ID NO: 920903 - RNA, 18 nt, Mycobacterium avium subsp. paratuberculosis
ccggauccgucgccccgc

SEQ ID NO: 920904 - RNA, 19 nt, Mycobacterium avium subsp. paratuberculosis
ccggaucgaauccggcggc

SEQ ID NO: 920905 - RNA, 17 nt, Mycobacterium avium subsp. paratuberculosis
ccggaucgagcacccgg

SEQ ID NO: 920906 - RNA, 20 nt, Mycobacterium avium subsp. paratuberculosis
ccggaucgagcacccggcgg

SEQ ID NO: 920907 - RNA, 20 nt, Mycobacterium avium subsp. paratuberculosis
cgaucgaauacaccugccgc

SEQ ID NO: 920908 - RNA, 22 nt, Mycobacterium avium subsp. paratuberculosis
cgaucgaauacaccugccgcac

SEQ ID NO: 920909 - RNA, 12 nt, Mycobacterium avium subsp. paratuberculosis
cgaucgccagca

SEQ ID NO: 920910 - RNA, 18 nt, Mycobacterium avium subsp. paratuberculosis
cgaucgccagcacggugu

SEQ ID NO: 920911 - RNA, 13 nt, Mycobacterium avium subsp. paratuberculosis
cgaucgccagcgc

SEQ ID NO: 920912 - RNA, 17 nt, Mycobacterium avium subsp. paratuberculosis
cgaucgccagcgcccga

SEQ ID NO: 920913 - RNA, 14 nt, Mycobacterium avium subsp. paratuberculosis
cgaucgccagcgcg

SEQ ID NO: 920914 - RNA, 15 nt, Mycobacterium avium subsp. paratuberculosis
cgaucgccagcgcgc

SEQ ID NO: 920915 - RNA, 18 nt, Mycobacterium avium subsp. paratuberculosis
cgaucgccagcgcgcaga

SEQ ID NO: 920916 - RNA, 21 nt, Mycobacterium avium subsp. paratuberculosis
cgaucgcccgguaggccgccg

SEQ ID NO: 920917 - RNA, 23 nt, Mycobacterium avium subsp. paratuberculosis
cgaucgcccgguaggccgccgcg

SEQ ID NO: 920918 - RNA, 13 nt, Mycobacterium avium subsp. paratuberculosis
cgaucgcccgcuc

SEQ ID NO: 920919 - RNA, 19 nt, Mycobacterium avium subsp. paratuberculosis
cgaucgcccgcuccgcggg

SEQ ID NO: 920920 - RNA, 20 nt, Mycobacterium avium subsp. paratuberculosis
cgaucgcccgcuccgcgggc

SEQ ID NO: 920921 - RNA, 21 nt, Mycobacterium avium subsp. paratuberculosis
cgaucgcccgcuccgcgggca

SEQ ID NO: 920922 - RNA, 15 nt, Mycobacterium avium subsp. paratuberculosis
cgaucgccgacgcca

SEQ ID NO: 920923 - RNA, 19 nt, Mycobacterium avium subsp. paratuberculosis
cgaucgccgacgccagcac

SEQ ID NO: 920924 - RNA, 18 nt, Mycobacterium avium subsp. paratuberculosis
cgaucgccgauccggcgc

SEQ ID NO: 920925 - RNA, 21 nt, Mycobacterium avium subsp. paratuberculosis
cgaucgccgauccggcgccgc

SEQ ID NO: 920926 - RNA, 15 nt, Mycobacterium avium subsp. paratuberculosis
cgaucgccgcgcauu

SEQ ID NO: 920927 - RNA, 14 nt, Mycobacterium avium subsp. paratuberculosis
cgaucgccgcgccc

SEQ ID NO: 920928 - RNA, 16 nt, Mycobacterium avium subsp. paratuberculosis
cgaucgccgcgcccag

SEQ ID NO: 920929 - RNA, 14 nt, Mycobacterium avium subsp. paratuberculosis
cgaucgccgcggcg

SEQ ID NO: 920930 - RNA, 15 nt, Mycobacterium avium subsp. paratuberculosis
cgaucgccgcggcga

SEQ ID NO: 920931 - RNA, 22 nt, Mycobacterium avium subsp. paratuberculosis
cgaucgcgaccaccggccgacc

SEQ ID NO: 920932 - RNA, 18 nt, Mycobacterium avium subsp. paratuberculosis
cgaucgccggugcggccg

SEQ ID NO: 920933 - RNA, 23 nt, Mycobacterium avium subsp. paratuberculosis
cgaucgccgugagauccagcagc

SEQ ID NO: 920934 - RNA, 15 nt, Mycobacterium avium subsp. paratuberculosis
cgaucgccgugguca

SEQ ID NO: 920935 - RNA, 16 nt, Mycobacterium avium subsp. paratuberculosis
cgaucgcgacggccgg

SEQ ID NO: 920936 - RNA, 16 nt, Mycobacterium avium subsp. paratuberculosis
cgaucgcgccggccgc

SEQ ID NO: 920937 - RNA, 20 nt, Mycobacterium avium subsp. paratuberculosis
cgaucgcgccggccgccgcg

SEQ ID NO: 920938 - RNA, 14 nt, Mycobacterium avium subsp. paratuberculosis
cgaucgcgaucacc

SEQ ID NO: 920939 - RNA, 17 nt, Mycobacterium avium subsp. paratuberculosis
cgaucgcgaucaccgcg

SEQ ID NO: 920940 - RNA, 21 nt, Mycobacterium avium subsp. paratuberculosis
cgaucgcgaucaccgcggcca

SEQ ID NO: 920941 - RNA, 13 nt, Mycobacterium avium subsp. paratuberculosis
cgaucgcgaucgc

SEQ ID NO: 920942 - RNA, 18 nt, Mycobacterium avium subsp. paratuberculosis
cgaucgcgaucgccgauc

SEQ ID NO: 920943 - RNA, 16 nt, Mycobacterium avium subsp. paratuberculosis
cgaucgcggugacgcg

SEQ ID NO: 920944 - RNA, 22 nt, Mycobacterium avium subsp. paratuberculosis
cgaucgcggugcggggccgcgg

SEQ ID NO: 920945 - RNA, 22 nt, Mycobacterium avium subsp. paratuberculosis
cgaucgcggcgagcucaacagc

SEQ ID NO: 920946 - RNA, 15 nt, Mycobacterium avium subsp. paratuberculosis
cgaucgcggcgauca

SEQ ID NO: 920947 - RNA, 17 nt, Mycobacterium avium subsp. paratuberculosis
cgaucgcggcgaucagc

SEQ ID NO: 920948 - RNA, 20 nt, Mycobacterium avium subsp. paratuberculosis
cgaucgcggcgaucagcccg

SEQ ID NO: 920949 - RNA, 13 nt, Mycobacterium avium subsp. paratuberculosis
cgaucgcggccag

SEQ ID NO: 920950 - RNA, 23 nt, Mycobacterium avium subsp. paratuberculosis
cgaucgcggccagcgugaacacc

SEQ ID NO: 920951 - RNA, 13 nt, Mycobacterium avium subsp. paratuberculosis
cgaucgcggcccc

SEQ ID NO: 920952 - RNA, 20 nt, Mycobacterium avium subsp. paratuberculosis
cgaucggauggugcccaccg

SEQ ID NO: 920953 - RNA, 13 nt, Mycobacterium avium subsp. paratuberculosis
cgaucggcacccg

SEQ ID NO: 920954 - RNA, 20 nt, Mycobacterium avium subsp. paratuberculosis
cgaucggcacccgcaacacc

SEQ ID NO: 920955 - RNA, 22 nt, Mycobacterium avium subsp. paratuberculosis
cgaucggcacccgcaacaccac

SEQ ID NO: 920956 - RNA, 15 nt, Mycobacterium avium subsp. paratuberculosis
cgaucggcacgucga

SEQ ID NO: 920957 - RNA, 17 nt, Mycobacterium avium subsp. paratuberculosis
cgaucggcacgucgagc

SEQ ID NO: 920958 - RNA, 19 nt, Mycobacterium avium subsp. paratuberculosis
cgaucggcaggucgucgac

SEQ ID NO: 920959 - RNA, 21 nt, Mycobacterium avium subsp. paratuberculosis
cgaucggcaggucgucgacgu

SEQ ID NO: 920960 - RNA, 15 nt, Mycobacterium avium subsp. paratuberculosis
cgaucggcgagccgg

SEQ ID NO: 920961 - RNA, 12 nt, Mycobacterium avium subsp. paratuberculosis
cgaucggcgcca

SEQ ID NO: 920962 - RNA, 15 nt, Mycobacterium avium subsp. paratuberculosis
cgaucggcgcgccga

SEQ ID NO: 920963 - RNA, 16 nt, Mycobacterium avium subsp. paratuberculosis
cgaucggcgcgccgaa

SEQ ID NO: 920964 - RNA, 17 nt, Mycobacterium avium subsp. paratuberculosis
cgaucggcgcgccgaag

SEQ ID NO: 920965 - RNA, 21 nt, Mycobacterium avium subsp. paratuberculosis
cgaucggcggcucgccggcgu

SEQ ID NO: 920966 - RNA, 14 nt, Mycobacterium avium subsp. paratuberculosis
cgaucggcgguccg

SEQ ID NO: 920967 - RNA, 17 nt, Mycobacterium avium subsp. paratuberculosis
cgaucggcgguccgccg

SEQ ID NO: 920968 - RNA, 19 nt, Mycobacterium avium subsp. paratuberculosis
cgaucggcgguccgccgca

SEQ ID NO: 920969 - RNA, 22 nt, Mycobacterium avium subsp. paratuberculosis
cgaucggcgguccgccgcagcg

SEQ ID NO: 920970 - RNA, 16 nt, Mycobacterium avium subsp. paratuberculosis
cgaucggcuccagcgc

SEQ ID NO: 920971 - RNA, 23 nt, Mycobacterium avium subsp. paratuberculosis
cgaucggcuccagcgcccgccgc

SEQ ID NO: 920972 - RNA, 14 nt, Mycobacterium avium subsp. paratuberculosis
cgaucggcucggcg

SEQ ID NO: 920973 - RNA, 13 nt, Mycobacterium avium subsp. paratuberculosis
cgaucggcgcgcc

SEQ ID NO: 920974 - RNA, 12 nt, Mycobacterium avium subsp. paratuberculosis
cgaucggccgcu

SEQ ID NO: 920975 - RNA, 13 nt, Mycobacterium avium subsp. paratuberculosis
cgaucggccgcug

SEQ ID NO: 920976 - RNA, 17 nt, Mycobacterium avium subsp. paratuberculosis
cgaucggccgcugcccg

SEQ ID NO: 920977 - RNA, 20 nt, Mycobacterium avium subsp. paratuberculosis
cgaucggccgcugcgggcgg

SEQ ID NO: 920978 - RNA, 16 nt, Mycobacterium avium subsp. paratuberculosis
cgaucggcccggccaa

SEQ ID NO: 920979 - RNA, 15 nt, Mycobacterium avium subsp. paratuberculosis
cgaucggcagcgcca

SEQ ID NO: 920980 - RNA, 22 nt, Mycobacterium avium subsp. paratuberculosis
cgaucucggucaccgagcggcc

SEQ ID NO: 920981 - RNA, 23 nt, Mycobacterium avium subsp. paratuberculosis
cgaucucggucaccgagcggccg

SEQ ID NO: 920982 - RNA, 15 nt, Mycobacterium avium subsp. paratuberculosis
cgaucucggucgcca

SEQ ID NO: 920983 - RNA, 20 nt, Mycobacterium avium subsp. paratuberculosis
cgaucucggucgccagcacc

SEQ ID NO: 920984 - RNA, 16 nt, Mycobacterium avium subsp. paratuberculosis
cgaucucggugagccg

SEQ ID NO: 920985 - RNA, 22 nt, Mycobacterium avium subsp. paratuberculosis
cgaucucgguuuccacgucgcg

SEQ ID NO: 920986 - RNA, 21 nt, Mycobacterium avium subsp. paratuberculosis
cgaucucguagcccaccucga

SEQ ID NO: 920987 - RNA, 21 nt, Mycobacterium avium subsp. paratuberculosis
cgaucucggccaaccgggcag

SEQ ID NO: 920988 - RNA, 22 nt, Mycobacterium avium subsp. paratuberculosis
cgaucucggccaaccgggcagg

SEQ ID NO: 920989 - RNA, 13 nt, Mycobacterium avium subsp. paratuberculosis
cgaucucggccag

SEQ ID NO: 920990 - RNA, 18 nt, Mycobacterium avium subsp. paratuberculosis
cgaucucggccagcgggc

SEQ ID NO: 920991 - RNA, 20 nt, Mycobacterium avium subsp. paratuberculosis
cgaucucggccagcgggcgg

SEQ ID NO: 920992 - RNA, 13 nt, Mycobacterium avium subsp. paratuberculosis
cgaucucgcgguc

SEQ ID NO: 920993 - RNA, 17 nt, Mycobacterium avium subsp. paratuberculosis
cgaucgguguccagccg

SEQ ID NO: 920994 - RNA, 21 nt, Mycobacterium avium subsp. paratuberculosis
cgaucgguguccagccgcacg

SEQ ID NO: 920995 - RNA, 20 nt, Mycobacterium avium subsp. paratuberculosis
cgaucgggaacagcccgccc

SEQ ID NO: 920996 - RNA, 24 nt, Mycobacterium avium subsp. paratuberculosis
cgaucgggaacagcccgcccuggc

SEQ ID NO: 920997 - RNA, 23 nt, Mycobacterium avium subsp. paratuberculosis
cgaucggggaauccuggccgaug

SEQ ID NO: 920998 - RNA, 17 nt, Mycobacterium avium subsp. paratuberculosis
cgaucggggcgcagccc

SEQ ID NO: 920999 - RNA, 20 nt, Mycobacterium avium subsp. paratuberculosis
cgaucggggcgcagcccggc

SEQ ID NO: 921000 - RNA, 15 nt, Mycobacterium avium subsp. paratuberculosis
cgaucggguagacgu

SEQ ID NO: 921001 - RNA, 16 nt, Mycobacterium avium subsp. paratuberculosis
cgaucgggucaccggc

SEQ ID NO: 921002 - RNA, 21 nt, Mycobacterium avium subsp. paratuberculosis
cgaucgggucaccggccgagc

SEQ ID NO: 921003 - RNA, 22 nt, Mycobacterium avium subsp. paratuberculosis
cgaucggugaacccgccggcga

SEQ ID NO: 921004 - RNA, 15 nt, Mycobacterium avium subsp. paratuberculosis
cgaugaagacccgcc

SEQ ID NO: 921005 - RNA, 19 nt, Mycobacterium avium subsp. paratuberculosis
cgaugaagccccggaccgg

SEQ ID NO: 921006 - RNA, 18 nt, Mycobacterium avium subsp. paratuberculosis
cgaugaagccggcgaacu

SEQ ID NO: 921007 - RNA, 19 nt, Mycobacterium avium subsp. paratuberculosis
cgaugaacucgcgggcgag

SEQ ID NO: 921008 - RNA, 23 nt, Mycobacterium avium subsp. paratuberculosis
cgaugaacucgcgggcgagcagc

SEQ ID NO: 921009 - RNA, 22 nt, Mycobacterium avium subsp. paratuberculosis
cgaugaccacccucagggagcu

SEQ ID NO: 921010 - RNA, 19 nt, Mycobacterium avium subsp. paratuberculosis
cgaugaccaccgcugugga

SEQ ID NO: 921011 - RNA, 19 nt, Mycobacterium avium subsp. paratuberculosis
cgaugacgaauuccgcacc

SEQ ID NO: 921012 - RNA, 18 nt, Mycobacterium avium subsp. paratuberculosis
cgaugacgagcagcgugc

SEQ ID NO: 921013 - RNA, 20 nt, Mycobacterium avium subsp. paratuberculosis
cgaugacgagcagcgugcug

SEQ ID NO: 921014 - RNA, 15 nt, Mycobacterium avium subsp. paratuberculosis
cgaucuugacgugga

SEQ ID NO: 921015 - RNA, 15 nt, Mycobacterium avium subsp. paratuberculosis
cgaucucgucgcaca

SEQ ID NO: 921016 - RNA, 17 nt, Mycobacterium avium subsp. paratuberculosis
cgaucucgucgcacaac

SEQ ID NO: 921017 - RNA, 13 nt, Mycobacterium avium subsp. paratuberculosis
cgaucucgucgcg

SEQ ID NO: 921018 - RNA, 20 nt, Mycobacterium avium subsp. paratuberculosis
cgaucucgucgcgcagcugg

SEQ ID NO: 921019 - RNA, 13 nt, Mycobacterium avium subsp. paratuberculosis
cgaucucggcgga

SEQ ID NO: 921020 - RNA, 21 nt, Mycobacterium avium subsp. paratuberculosis
cgaucucggcggacucggcga

SEQ ID NO: 921021 - RNA, 15 nt, Mycobacterium avium subsp. paratuberculosis
cgaucucggcggccg

SEQ ID NO: 921022 - RNA, 20 nt, Mycobacterium avium subsp. paratuberculosis
cgaucucggcggccgcgucc

SEQ ID NO: 921023 - RNA, 15 nt, Mycobacterium avium subsp. paratuberculosis
cgaucucggcggucu

SEQ ID NO: 921024 - RNA, 20 nt, Mycobacterium avium subsp. paratuberculosis
cgaucucguagguggccagc

SEQ ID NO: 921025 - RNA, 22 nt, Mycobacterium avium subsp. paratuberculosis
cgaucucguagguggccagcac

SEQ ID NO: 921026 - RNA, 19 nt, Mycobacterium avium subsp. paratuberculosis
cgaucucgucccacggcgg

SEQ ID NO: 921027 - RNA, 18 nt, Mycobacterium avium subsp. paratuberculosis
cgaugaaaccccagccgg

SEQ ID NO: 921028 - RNA, 21 nt, Mycobacterium avium subsp. paratuberculosis
cgaugaaaccccagccggccg

SEQ ID NO: 921029 - RNA, 22 nt, Mycobacterium avium subsp. paratuberculosis
cgaugaaaccccagccggccga

SEQ ID NO: 921030 - RNA, 16 nt, Mycobacterium avium subsp. paratuberculosis
cgaugaacaugcccug

SEQ ID NO: 921031 - RNA, 18 nt, Mycobacterium avium subsp. paratuberculosis
cgaugaacagucggccgg

SEQ ID NO: 921032 - RNA, 21 nt, Mycobacterium avium subsp. paratuberculosis
cgaugaacagucggccggcgu

SEQ ID NO: 921033 - RNA, 16 nt, Mycobacterium avium subsp. paratuberculosis
cgaucuugugcucgag

SEQ ID NO: 921034 - RNA, 15 nt, Mycobacterium avium subsp. paratuberculosis
cgaugaaauccggga

SEQ ID NO: 921035 - RNA, 19 nt, Mycobacterium avium subsp. paratuberculosis
cgaugaaauccgggaccgg

SEQ ID NO: 921036 - RNA, 20 nt, Mycobacterium avium subsp. paratuberculosis
cgaugaaauccgggaccggc

SEQ ID NO: 921037 - RNA, 19 nt, Mycobacterium avium subsp. paratuberculosis
cgaugcaacaccgaacgcc

SEQ ID NO: 921038 - RNA, 20 nt, Mycobacterium avium subsp. paratuberculosis
cgaugcaacaccgaacgccg

SEQ ID NO: 921039 - RNA, 14 nt, Mycobacterium avium subsp. paratuberculosis
cgaugcccagcagc

SEQ ID NO: 921040 - RNA, 13 nt, Mycobacterium avium subsp. paratuberculosis
cgaugaugguggc

SEQ ID NO: 921041 - RNA, 15 nt, Mycobacterium avium subsp. paratuberculosis
cgaugaugguggcgg

SEQ ID NO: 921042 - RNA, 21 nt, Mycobacterium avium subsp. paratuberculosis
cgaugaugguggcggccacca

SEQ ID NO: 921043 - RNA, 20 nt, Mycobacterium avium subsp. paratuberculosis
cgaugaugucgcccggcggc

SEQ ID NO: 921044 - RNA, 15 nt, Mycobacterium avium subsp. paratuberculosis
cgaugaugucggccg

SEQ ID NO: 921045 - RNA, 16 nt, Mycobacterium avium subsp. paratuberculosis
cgaugaugucggccgg

SEQ ID NO: 921046 - RNA, 17 nt, Mycobacterium avium subsp. paratuberculosis
cgaugaugucggccggc

SEQ ID NO: 921047 - RNA, 19 nt, Mycobacterium avium subsp. paratuberculosis
cgaugaugucggccggcag

SEQ ID NO: 921048 - RNA, 15 nt, Mycobacterium avium subsp. paratuberculosis
cgaugauggcgucga

SEQ ID NO: 921049 - RNA, 16 nt, Mycobacterium avium subsp. paratuberculosis
cgaugauggcgucgac

SEQ ID NO: 921050 - RNA, 20 nt, Mycobacterium avium subsp. paratuberculosis
cgaugauggcgucgacgugc

SEQ ID NO: 921051 - RNA, 19 nt, Mycobacterium avium subsp. paratuberculosis
cgaugaucgccggcgccgg

SEQ ID NO: 921052 - RNA, 14 nt, Mycobacterium avium subsp. paratuberculosis
cgaugauccgcggc

SEQ ID NO: 921053 - RNA, 16 nt, Mycobacterium avium subsp. paratuberculosis
cgaugauccgcggcgc

SEQ ID NO: 921054 - RNA, 17 nt, Mycobacterium avium subsp. paratuberculosis
cgaugauccgcggcgcc

SEQ ID NO: 921055 - RNA, 18 nt, Mycobacterium avium subsp. paratuberculosis
cgaugauccgcggcgccg

SEQ ID NO: 921056 - RNA, 19 nt, Mycobacterium avium subsp. paratuberculosis
cgaugauccgcggcgccgg

SEQ ID NO: 921057 - RNA, 23 nt, Mycobacterium avium subsp. paratuberculosis
cgaugaucagcucgcgcaucagc

SEQ ID NO: 921058 - RNA, 12 nt, Mycobacterium avium subsp. paratuberculosis
cgaugaucgccg

SEQ ID NO: 921059 - RNA, 19 nt, Mycobacterium avium subsp. paratuberculosis
cgaugaugaaaccggccag

SEQ ID NO: 921060 - RNA, 22 nt, Mycobacterium avium subsp. paratuberculosis
cgaugagcuggugcagcgacuc

SEQ ID NO: 921061 - RNA, 22 nt, Mycobacterium avium subsp. paratuberculosis
cgaugaggcucaggccgguggc

SEQ ID NO: 921062 - RNA, 16 nt, Mycobacterium avium subsp. paratuberculosis
cgaugagggccagcag

SEQ ID NO: 921063 - RNA, 19 nt, Mycobacterium avium subsp. paratuberculosis
cgaugacgucgcgcugccg

SEQ ID NO: 921064 - RNA, 21 nt, Mycobacterium avium subsp. paratuberculosis
cgaugacgucgcgcugccggc

SEQ ID NO: 921065 - RNA, 15 nt, Mycobacterium avium subsp. paratuberculosis
cgaugacgucgucgc

SEQ ID NO: 921066 - RNA, 16 nt, Mycobacterium avium subsp. paratuberculosis
cgaugacgucgucgcg

SEQ ID NO: 921067 - RNA, 21 nt, Mycobacterium avium subsp. paratuberculosis
cgaugacgucgucgcggcgcu

SEQ ID NO: 921068 - RNA, 23 nt, Mycobacterium avium subsp. paratuberculosis
cgaugacgucgucgcggcgcugc

SEQ ID NO: 921069 - RNA, 23 nt, Mycobacterium avium subsp. paratuberculosis
cgaugacgugguugcguucgccg

SEQ ID NO: 921070 - RNA, 14 nt, Mycobacterium avium subsp. paratuberculosis
cgaugacguugcgc

SEQ ID NO: 921071 - RNA, 17 nt, Mycobacterium avium subsp. paratuberculosis
cgaugacgcugccgcgc

SEQ ID NO: 921072 - RNA, 22 nt, Mycobacterium avium subsp. paratuberculosis
cgaugacgcugccgcgccgcca

SEQ ID NO: 921073 - RNA, 14 nt, Mycobacterium avium subsp. paratuberculosis
cgaugacggcgcga

SEQ ID NO: 921074 - RNA, 14 nt, Mycobacterium avium subsp. paratuberculosis
cgaugacggcggcg

SEQ ID NO: 921075 - RNA, 15 nt, Mycobacterium avium subsp. paratuberculosis
cgaugacggcggcgc

SEQ ID NO: 921076 - RNA, 13 nt, Mycobacterium avium subsp. paratuberculosis
cgaugacgccgcg

SEQ ID NO: 921077 - RNA, 16 nt, Mycobacterium avium subsp. paratuberculosis
cgaugacgccgcgccg

SEQ ID NO: 921078 - RNA, 17 nt, Mycobacterium avium subsp. paratuberculosis
cgaugacgccgcgccgc

SEQ ID NO: 921079 - RNA, 20 nt, Mycobacterium avium subsp. paratuberculosis
cgauaacgcgcgcgccgucu

SEQ ID NO: 921080 - RNA, 17 nt, Mycobacterium avium subsp. paratuberculosis
cgauaaccucggcggcg

SEQ ID NO: 921081 - RNA, 22 nt, Mycobacterium avium subsp. paratuberculosis
cgaggcguccuccucguccgcg

SEQ ID NO: 921082 - RNA, 23 nt, Mycobacterium avium subsp. paratuberculosis
cgaggcguccuccucguccgcgg

SEQ ID NO: 921083 - RNA, 20 nt, Mycobacterium avium subsp. paratuberculosis
cgaggcgguuccgguggcgc

SEQ ID NO: 921084 - RNA, 22 nt, Mycobacterium avium subsp. paratuberculosis
cgaggcgguuccgguggcgcga

SEQ ID NO: 921085 - RNA, 20 nt, Mycobacterium avium subsp. paratuberculosis
cgaggcguagcugcaggcga

SEQ ID NO: 921086 - RNA, 23 nt, Mycobacterium avium subsp. paratuberculosis
cgaggcguagcugcaggcgacga

SEQ ID NO: 921087 - RNA, 13 nt, Mycobacterium avium subsp. paratuberculosis
cgaggcguccagc

SEQ ID NO: 921088 - RNA, 14 nt, Mycobacterium avium subsp. paratuberculosis
cgaggcguccagcg

SEQ ID NO: 921089 - RNA, 17 nt, Mycobacterium avium subsp. paratuberculosis
cgaggcguccagcgcgu

SEQ ID NO: 921090 - RNA, 13 nt, Mycobacterium avium subsp. paratuberculosis
cgaggcgugcagc

SEQ ID NO: 921091 - RNA, 15 nt, Mycobacterium avium subsp. paratuberculosis
cgaggcgugcagccc

SEQ ID NO: 921092 - RNA, 20 nt, Mycobacterium avium subsp. paratuberculosis
cgaggcggguaggcgucgcg

SEQ ID NO: 921093 - RNA, 23 nt, Mycobacterium avium subsp. paratuberculosis
cgaggcgggugaggacgcccggc

SEQ ID NO: 921094 - RNA, 22 nt, Mycobacterium avium subsp. paratuberculosis
cgaggcggguguauucgcccac

SEQ ID NO: 921095 - RNA, 23 nt, Mycobacterium avium subsp. paratuberculosis
cgaggcggguguauucgcccacc

SEQ ID NO: 921096 - RNA, 14 nt, Mycobacterium avium subsp. paratuberculosis
cgaggcgggcgauc

SEQ ID NO: 921097 - RNA, 16 nt, Mycobacterium avium subsp. paratuberculosis
cgaggcggccagcggc

SEQ ID NO: 921098 - RNA, 19 nt, Mycobacterium avium subsp. paratuberculosis
cgaggcggccagcggcagc

SEQ ID NO: 921099 - RNA, 22 nt, Mycobacterium avium subsp. paratuberculosis
cgaggcggccagcggcagcguc

SEQ ID NO: 921100 - RNA, 15 nt, Mycobacterium avium subsp. paratuberculosis
cgaggcgcgaaagcg

SEQ ID NO: 921101 - RNA, 18 nt, Mycobacterium avium subsp. paratuberculosis
cgaggcgcgaaagcgcga

SEQ ID NO: 921102 - RNA, 15 nt, Mycobacterium avium subsp. paratuberculosis
cgaggcgcggggcgc

SEQ ID NO: 921103 - RNA, 17 nt, Mycobacterium avium subsp. paratuberculosis
cgaggcgcggggcgcga

SEQ ID NO: 921104 - RNA, 20 nt, Mycobacterium avium subsp. paratuberculosis
cgaggcgcuccugaaucggu

SEQ ID NO: 921105 - RNA, 17 nt, Mycobacterium avium subsp. paratuberculosis
cgaggcgcucgcacaac

SEQ ID NO: 921106 - RNA, 14 nt, Mycobacterium avium subsp. paratuberculosis
cgaggcgcucggcc

SEQ ID NO: 921107 - RNA, 22 nt, Mycobacterium avium subsp. paratuberculosis
cgauagccaucagaacgcccgc

SEQ ID NO: 921108 - RNA, 22 nt, Mycobacterium avium subsp. paratuberculosis
cgauagccggugaucgcggcgc

SEQ ID NO: 921109 - RNA, 14 nt, Mycobacterium avium subsp. paratuberculosis
cgauaauggcggcc

SEQ ID NO: 921110 - RNA, 18 nt, Mycobacterium avium subsp. paratuberculosis
cgauaauggcggccgccg

SEQ ID NO: 921111 - RNA, 15 nt, Mycobacterium avium subsp. paratuberculosis
cgauagucgcgggug

SEQ ID NO: 921112 - RNA, 18 nt, Mycobacterium avium subsp. paratuberculosis
cgauagugaacgccucgg

SEQ ID NO: 921113 - RNA, 22 nt, Mycobacterium avium subsp. paratuberculosis
cgauagugaacgccucgggccg

SEQ ID NO: 921114 - RNA, 16 nt, Mycobacterium avium subsp. paratuberculosis
cgaucaacggcagcga

SEQ ID NO: 921115 - RNA, 17 nt, Mycobacterium avium subsp. paratuberculosis
cgaucaacgggucgagc

SEQ ID NO: 921116 - RNA, 15 nt, Mycobacterium avium subsp. paratuberculosis
cgauaucggccgcgg

SEQ ID NO: 921117 - RNA, 20 nt, Mycobacterium avium subsp. paratuberculosis
cgaucaacgccgggucgacg

SEQ ID NO: 921118 - RNA, 21 nt, Mycobacterium avium subsp. paratuberculosis
cgaucaacgccgggucgacgc

SEQ ID NO: 921119 - RNA, 23 nt, Mycobacterium avium subsp. paratuberculosis
cgaucaacgccgggucgacgccg

SEQ ID NO: 921120 - RNA, 23 nt, Mycobacterium avium subsp. paratuberculosis
cgauccggcgucucagucggcca

SEQ ID NO: 921121 - RNA, 18 nt, Mycobacterium avium subsp. paratuberculosis
cgauccugugcaccgugc

SEQ ID NO: 921122 - RNA, 12 nt, Mycobacterium avium subsp. paratuberculosis
cgauccucgccu

SEQ ID NO: 921123 - RNA, 16 nt, Mycobacterium avium subsp. paratuberculosis
cgauccucgccugucg

SEQ ID NO: 921124 - RNA, 13 nt, Mycobacterium avium subsp. paratuberculosis
cgauccccgcagc

SEQ ID NO: 921125 - RNA, 19 nt, Mycobacterium avium subsp. paratuberculosis
cgauccgguagaagaccac

SEQ ID NO: 921126 - RNA, 21 nt, Mycobacterium avium subsp. paratuberculosis
cgauccgguagaagaccaccu

SEQ ID NO: 921127 - RNA, 14 nt, Mycobacterium avium subsp. paratuberculosis
cgauccgguccagc

SEQ ID NO: 921128 - RNA, 12 nt, Mycobacterium avium subsp. paratuberculosis
cgaucccagacc

SEQ ID NO: 921129 - RNA, 22 nt, Mycobacterium avium subsp. paratuberculosis
cgaucccagacccagcaucgcc

SEQ ID NO: 921130 - RNA, 17 nt, Mycobacterium avium subsp. paratuberculosis
cgauccgggcaugguca

SEQ ID NO: 921131 - RNA, 14 nt, Mycobacterium avium subsp. paratuberculosis
cgauccgggcgccc

SEQ ID NO: 921132 - RNA, 18 nt, Mycobacterium avium subsp. paratuberculosis
cgauccgggcgccggccg

SEQ ID NO: 921133 - RNA, 19 nt, Mycobacterium avium subsp. paratuberculosis
cgauccgggcgccggccgg

SEQ ID NO: 921134 - RNA, 18 nt, Mycobacterium avium subsp. paratuberculosis
cgauccggggggcggggu

SEQ ID NO: 921135 - RNA, 19 nt, Mycobacterium avium subsp. paratuberculosis
cgauccggggggcgggguc

SEQ ID NO: 921136 - RNA, 17 nt, Mycobacterium avium subsp. paratuberculosis
cgauccccacgucgccg

SEQ ID NO: 921137 - RNA, 18 nt, Mycobacterium avium subsp. paratuberculosis
cgauccagcgcuggccgg

SEQ ID NO: 921138 - RNA, 16 nt, Mycobacterium avium subsp. paratuberculosis
cgauccagggcccgcu

SEQ ID NO: 921139 - RNA, 20 nt, Mycobacterium avium subsp. paratuberculosis
cgaucaucgccucggucgcg

SEQ ID NO: 921140 - RNA, 17 nt, Mycobacterium avium subsp. paratuberculosis
cgaucaucgcgucggug

SEQ ID NO: 921141 - RNA, 13 nt, Mycobacterium avium subsp. paratuberculosis
cgaucaucgucgu

SEQ ID NO: 921142 - RNA, 14 nt, Mycobacterium avium subsp. paratuberculosis
cgaucaucgucguc

SEQ ID NO: 921143 - RNA, 21 nt, Mycobacterium avium subsp. paratuberculosis
cgaucaucuccacccggcauc

SEQ ID NO: 921144 - RNA, 21 nt, Mycobacterium avium subsp. paratuberculosis
cgauccagacggucuuggcgu

SEQ ID NO: 921145 - RNA, 14 nt, Mycobacterium avium subsp. paratuberculosis
cgaucaucaccacc

SEQ ID NO: 921146 - RNA, 23 nt, Mycobacterium avium subsp. paratuberculosis
cgaucaucaccaccgccgccgac

SEQ ID NO: 921147 - RNA, 23 nt, Mycobacterium avium subsp. paratuberculosis
cgaucagccggguagcgccgccg

SEQ ID NO: 921148 - RNA, 23 nt, Mycobacterium avium subsp. paratuberculosis
cgaucagcgacggcccgccggag

SEQ ID NO: 921149 - RNA, 19 nt, Mycobacterium avium subsp. paratuberculosis
cgaucagcgacucgacccc

SEQ ID NO: 921150 - RNA, 20 nt, Mycobacterium avium subsp. paratuberculosis
cgaucagcgacucgaccccg

SEQ ID NO: 921151 - RNA, 13 nt, Mycobacterium avium subsp. paratuberculosis
cgaucagcccggc

SEQ ID NO: 921152 - RNA, 22 nt, Mycobacterium avium subsp. paratuberculosis
cgaucagccccagggugcgccg

SEQ ID NO: 921153 - RNA, 23 nt, Mycobacterium avium subsp. paratuberculosis
cgaucagccccagggugcgccgc

SEQ ID NO: 921154 - RNA, 12 nt, Mycobacterium avium subsp. paratuberculosis
cgaucagcccgc

SEQ ID NO: 921155 - RNA, 16 nt, Mycobacterium avium subsp. paratuberculosis
cgaucagcccgcccac

SEQ ID NO: 921156 - RNA, 17 nt, Mycobacterium avium subsp. paratuberculosis
cgaucagcaugacgaac

SEQ ID NO: 921157 - RNA, 15 nt, Mycobacterium avium subsp. paratuberculosis
cgaucagccacaccg

SEQ ID NO: 921158 - RNA, 17 nt, Mycobacterium avium subsp. paratuberculosis
cgaucagcagccgggcc

SEQ ID NO: 921159 - RNA, 18 nt, Mycobacterium avium subsp. paratuberculosis
cgaucacggugaucgccg

SEQ ID NO: 921160 - RNA, 16 nt, Mycobacterium avium subsp. paratuberculosis
cgaucagcagcacccg

SEQ ID NO: 921161 - RNA, 15 nt, Mycobacterium avium subsp. paratuberculosis
cgaucagcagcaccu

SEQ ID NO: 921162 - RNA, 16 nt, Mycobacterium avium subsp. paratuberculosis
cgaucagcagcaccug

SEQ ID NO: 921163 - RNA, 13 nt, Mycobacterium avium subsp. paratuberculosis
cgaucacaccacc

SEQ ID NO: 921164 - RNA, 19 nt, Mycobacterium avium subsp. paratuberculosis
cgaucacaccaccacgcga

SEQ ID NO: 921165 - RNA, 21 nt, Mycobacterium avium subsp. paratuberculosis
cgaucacaccaccacgcgauc

SEQ ID NO: 921166 - RNA, 14 nt, Mycobacterium avium subsp. paratuberculosis
cgaucaccaccacc

SEQ ID NO: 921167 - RNA, 18 nt, Mycobacterium avium subsp. paratuberculosis
cgaucaccaccaccgccg

SEQ ID NO: 921168 - RNA, 19 nt, Mycobacterium avium subsp. paratuberculosis
cgaucaccaccaccgccgu

SEQ ID NO: 921169 - RNA, 21 nt, Mycobacterium avium subsp. paratuberculosis
cgaucaccaccaccgccguca

SEQ ID NO: 921170 - RNA, 13 nt, Mycobacterium avium subsp. paratuberculosis
cgaucaccggcac

SEQ ID NO: 921171 - RNA, 14 nt, Mycobacterium avium subsp. paratuberculosis
cgaucaccggcagc

SEQ ID NO: 921172 - RNA, 15 nt, Mycobacterium avium subsp. paratuberculosis
cgaucaccggcgcgu

SEQ ID NO: 921173 - RNA, 14 nt, Mycobacterium avium subsp. paratuberculosis
cgaucaccgggcgg

SEQ ID NO: 921174 - RNA, 15 nt, Mycobacterium avium subsp. paratuberculosis
cgaucaccgggcggc

SEQ ID NO: 921175 - RNA, 17 nt, Mycobacterium avium subsp. paratuberculosis
cgaucaccgggcggccg

SEQ ID NO: 921176 - RNA, 19 nt, Mycobacterium avium subsp. paratuberculosis
cgaucaccgggcggccgug

SEQ ID NO: 921177 - RNA, 23 nt, Mycobacterium avium subsp. paratuberculosis
cgaucaccgugaguucgcugacc

SEQ ID NO: 921178 - RNA, 16 nt, Mycobacterium avium subsp. paratuberculosis
cgaucaccucgccggc

SEQ ID NO: 921179 - RNA, 18 nt, Mycobacterium avium subsp. paratuberculosis
cgaucaccucgccggccg

SEQ ID NO: 921180 - RNA, 14 nt, Mycobacterium avium subsp. paratuberculosis
cgaucaccucgucg

SEQ ID NO: 921181 - RNA, 16 nt, Mycobacterium avium subsp. paratuberculosis
cgaucaccucgucgag

SEQ ID NO: 921182 - RNA, 19 nt, Mycobacterium avium subsp. paratuberculosis
cgaucaccaccccggugcc

SEQ ID NO: 921183 - RNA, 17 nt, Mycobacterium avium subsp. paratuberculosis
cgaucaccuugcggccg

SEQ ID NO: 921184 - RNA, 19 nt, Mycobacterium avium subsp. paratuberculosis
cgaucaccuugcggccggc

SEQ ID NO: 921185 - RNA, 22 nt, Mycobacterium avium subsp. paratuberculosis
cgaucaccuugcggccggcggc

SEQ ID NO: 921186 - RNA, 19 nt, Mycobacterium avium subsp. paratuberculosis
cgaucacgaacagguccgc

SEQ ID NO: 921187 - RNA, 13 nt, Mycobacterium avium subsp. paratuberculosis
cgaucacgccgcc

SEQ ID NO: 921188 - RNA, 15 nt, Mycobacterium avium subsp. paratuberculosis
cgaucacgccgccgg

SEQ ID NO: 921189 - RNA, 19 nt, Mycobacterium avium subsp. paratuberculosis
cgaucacgccgccggggcg

SEQ ID NO: 921190 - RNA, 15 nt, Mycobacterium avium subsp. paratuberculosis
cgcaacgugcgccgg

SEQ ID NO: 921191 - RNA, 19 nt, Mycobacterium avium subsp. paratuberculosis
cgcaacguguacucggcgu

SEQ ID NO: 921192 - RNA, 21 nt, Mycobacterium avium subsp. paratuberculosis
cgcaacguguacucggcgucg

SEQ ID NO: 921193 - RNA, 19 nt, Mycobacterium avium subsp. paratuberculosis
cgcaaccucuucgggggug

SEQ ID NO: 921194 - RNA, 16 nt, Mycobacterium avium subsp. paratuberculosis
cgcaaccgucaguucg

SEQ ID NO: 921195 - RNA, 19 nt, Mycobacterium avium subsp. paratuberculosis
cgcaaccguucaacggcca

SEQ ID NO: 921196 - RNA, 14 nt, Mycobacterium avium subsp. paratuberculosis
cgcaacgggccgca

SEQ ID NO: 921197 - RNA, 15 nt, Mycobacterium avium subsp. paratuberculosis
cgcaacgggccgcag

SEQ ID NO: 921198 - RNA, 16 nt, Mycobacterium avium subsp. paratuberculosis
cgcaacgggccgcagc

SEQ ID NO: 921199 - RNA, 19 nt, Mycobacterium avium subsp. paratuberculosis
cgcaacgggccgcagccgc

SEQ ID NO: 921200 - RNA, 22 nt, Mycobacterium avium subsp. paratuberculosis
cgcaacgggccgcagccgcgcg

SEQ ID NO: 921201 - RNA, 21 nt, Mycobacterium avium subsp. paratuberculosis
cgcaaccaaaaagcuagcggg

SEQ ID NO: 921202 - RNA, 18 nt, Mycobacterium avium subsp. paratuberculosis
cgcaaccaacucgcgaug

SEQ ID NO: 921203 - RNA, 20 nt, Mycobacterium avium subsp. paratuberculosis
cgcaaccagugcacgcucgg

SEQ ID NO: 921204 - RNA, 15 nt, Mycobacterium avium subsp. paratuberculosis
cgcaaccgggccgca

SEQ ID NO: 921205 - RNA, 17 nt, Mycobacterium avium subsp. paratuberculosis
cgcaaccgggccgcacc

SEQ ID NO: 921206 - RNA, 17 nt, Mycobacterium avium subsp. paratuberculosis
cgcaaccgccggcagcg

SEQ ID NO: 921207 - RNA, 16 nt, Mycobacterium avium subsp. paratuberculosis
cgcaaccgcggcggcg

SEQ ID NO: 921208 - RNA, 17 nt, Mycobacterium avium subsp. paratuberculosis
cgcaaccgcggcggcgg

SEQ ID NO: 921209 - RNA, 23 nt, Mycobacterium avium subsp. paratuberculosis
cgauuggugcgcaauggcgaaca

SEQ ID NO: 921210 - RNA, 17 nt, Mycobacterium avium subsp. paratuberculosis
cgauugucggggccgca

SEQ ID NO: 921211 - RNA, 18 nt, Mycobacterium avium subsp. paratuberculosis
cgauugucggggccgcac

SEQ ID NO: 921212 - RNA, 18 nt, Mycobacterium avium subsp. paratuberculosis
cgauucgcggccaccacc

SEQ ID NO: 921213 - RNA, 12 nt, Mycobacterium avium subsp. paratuberculosis
cgauugccgcgg

SEQ ID NO: 921214 - RNA, 14 nt, Mycobacterium avium subsp. paratuberculosis
cgauugccgcggcc

SEQ ID NO: 921215 - RNA, 14 nt, Mycobacterium avium subsp. paratuberculosis
cgauugcggccgcc

SEQ ID NO: 921216 - RNA, 15 nt, Mycobacterium avium subsp. paratuberculosis
cgauugcggccgccg

SEQ ID NO: 921217 - RNA, 17 nt, Mycobacterium avium subsp. paratuberculosis
cgauugcggccgccggc

SEQ ID NO: 921218 - RNA, 21 nt, Mycobacterium avium subsp. paratuberculosis
cgauugcggccgccggccagc

SEQ ID NO: 921219 - RNA, 14 nt, Mycobacterium avium subsp. paratuberculosis
cgauuccucggacc

SEQ ID NO: 921220 - RNA, 12 nt, Mycobacterium avium subsp. paratuberculosis
cgauucgcgauc

SEQ ID NO: 921221 - RNA, 15 nt, Mycobacterium avium subsp. paratuberculosis
cgauucgcgaucaac

SEQ ID NO: 921222 - RNA, 19 nt, Mycobacterium avium subsp. paratuberculosis
cgauucggcgccgcgaccc

SEQ ID NO: 921223 - RNA, 12 nt, Mycobacterium avium subsp. paratuberculosis
cgauugcccgac

SEQ ID NO: 921224 - RNA, 19 nt, Mycobacterium avium subsp. paratuberculosis
cgauugcccgacuccucac

SEQ ID NO: 921225 - RNA, 21 nt, Mycobacterium avium subsp. paratuberculosis
cgaugucugaucgcguagcgc

SEQ ID NO: 921226 - RNA, 22 nt, Mycobacterium avium subsp. paratuberculosis
cgaugucugaucgcguagcgcc

SEQ ID NO: 921227 - RNA, 14 nt, Mycobacterium avium subsp. paratuberculosis
cgauuccggccggc

SEQ ID NO: 921228 - RNA, 17 nt, Mycobacterium avium subsp. paratuberculosis
cgauuccggccggccgc

SEQ ID NO: 921229 - RNA, 17 nt, Mycobacterium avium subsp. paratuberculosis
cgauuccccggcguguc

SEQ ID NO: 921230 - RNA, 16 nt, Mycobacterium avium subsp. paratuberculosis
cgauucccgccggaug

SEQ ID NO: 921231 - RNA, 23 nt, Mycobacterium avium subsp. paratuberculosis
cgaugucggacuucugguugacg

SEQ ID NO: 921232 - RNA, 12 nt, Mycobacterium avium subsp. paratuberculosis
cgaugucggcca

SEQ ID NO: 921233 - RNA, 17 nt, Mycobacterium avium subsp. paratuberculosis
cgaugucggccagcgcg

SEQ ID NO: 921234 - RNA, 13 nt, Mycobacterium avium subsp. paratuberculosis
cgaugucggccgg

SEQ ID NO: 921235 - RNA, 14 nt, Mycobacterium avium subsp. paratuberculosis
cgaugucggccggu

SEQ ID NO: 921236 - RNA, 16 nt, Mycobacterium avium subsp. paratuberculosis
cgaugucggccggucc

SEQ ID NO: 921237 - RNA, 15 nt, Mycobacterium avium subsp. paratuberculosis
cgaugucggcgaacc

SEQ ID NO: 921238 - RNA, 12 nt, Mycobacterium avium subsp. paratuberculosis
cgaugucgucga

SEQ ID NO: 921239 - RNA, 14 nt, Mycobacterium avium subsp. paratuberculosis
cgaugucgucgaac

SEQ ID NO: 921240 - RNA, 13 nt, Mycobacterium avium subsp. paratuberculosis
cgaugucgucgac

SEQ ID NO: 921241 - RNA, 14 nt, Mycobacterium avium subsp. paratuberculosis
cgaugucgucgacg

SEQ ID NO: 921242 - RNA, 15 nt, Mycobacterium avium subsp. paratuberculosis
cgaugucgucgacgc

SEQ ID NO: 921243 - RNA, 16 nt, Mycobacterium avium subsp. paratuberculosis
cgaugucgucgacgcu

SEQ ID NO: 921244 - RNA, 16 nt, Mycobacterium avium subsp. paratuberculosis
cgaugucgucgccggu

SEQ ID NO: 921245 - RNA, 19 nt, Mycobacterium avium subsp. paratuberculosis
cgaugucgucgccgguggc

SEQ ID NO: 921246 - RNA, 17 nt, Mycobacterium avium subsp. paratuberculosis
cgaugucgucgucgacg

SEQ ID NO: 921247 - RNA, 19 nt, Mycobacterium avium subsp. paratuberculosis
cgaugucgucgucgacgcu

SEQ ID NO: 921248 - RNA, 20 nt, Mycobacterium avium subsp. paratuberculosis
cgaugucgucgucgacgcug

SEQ ID NO: 921249 - RNA, 18 nt, Mycobacterium avium subsp. paratuberculosis
cgaugucgcccggcgcgg

SEQ ID NO: 921250 - RNA, 14 nt, Mycobacterium avium subsp. paratuberculosis
cgaugucgccggcg

SEQ ID NO: 921251 - RNA, 16 nt, Mycobacterium avium subsp. paratuberculosis
cgaugucgccggcgac

SEQ ID NO: 921252 - RNA, 19 nt, Mycobacterium avium subsp. paratuberculosis
cgaugucgccggcgaccgc

SEQ ID NO: 921253 - RNA, 17 nt, Mycobacterium avium subsp. paratuberculosis
cgauggucgccuuguug

SEQ ID NO: 921254 - RNA, 20 nt, Mycobacterium avium subsp. paratuberculosis
cgaugucggcuucguacggc

SEQ ID NO: 921255 - RNA, 17 nt, Mycobacterium avium subsp. paratuberculosis
cgaugucgggcaccugc

SEQ ID NO: 921256 - RNA, 15 nt, Mycobacterium avium subsp. paratuberculosis
cgaugucggugcggc

SEQ ID NO: 921257 - RNA, 16 nt, Mycobacterium avium subsp. paratuberculosis
cgaugucggugcggcc

SEQ ID NO: 921258 - RNA, 17 nt, Mycobacterium avium subsp. paratuberculosis
cgaugucggugcggccg

SEQ ID NO: 921259 - RNA, 12 nt, Mycobacterium avium subsp. paratuberculosis
cgaugucggugg

SEQ ID NO: 921260 - RNA, 15 nt, Mycobacterium avium subsp. paratuberculosis
cgaugucggugggcc

SEQ ID NO: 921261 - RNA, 20 nt, Mycobacterium avium subsp. paratuberculosis
cgaugucggugggccgcacc

SEQ ID NO: 921262 - RNA, 13 nt, Mycobacterium avium subsp. paratuberculosis
cgaugucgguggu

SEQ ID NO: 921263 - RNA, 17 nt, Mycobacterium avium subsp. paratuberculosis
cgauggcggcgcgcucg

SEQ ID NO: 921264 - RNA, 20 nt, Mycobacterium avium subsp. paratuberculosis
cgauggcggcgcgcucgucg

SEQ ID NO: 921265 - RNA, 17 nt, Mycobacterium avium subsp. paratuberculosis
cgauggcggcggcccgc

SEQ ID NO: 921266 - RNA, 14 nt, Mycobacterium avium subsp. paratuberculosis
cgauggcggcggcu

SEQ ID NO: 921267 - RNA, 16 nt, Mycobacterium avium subsp. paratuberculosis
cgauggcggcggcugc

SEQ ID NO: 921268 - RNA, 12 nt, Mycobacterium avium subsp. paratuberculosis
cgauggcggcgu

SEQ ID NO: 921269 - RNA, 14 nt, Mycobacterium avium subsp. paratuberculosis
cgauggcggcgucg

SEQ ID NO: 921270 - RNA, 20 nt, Mycobacterium avium subsp. paratuberculosis
cgauggcgggcgcgccggcg

SEQ ID NO: 921271 - RNA, 15 nt, Mycobacterium avium subsp. paratuberculosis
cgauggcggugugga

SEQ ID NO: 921272 - RNA, 18 nt, Mycobacterium avium subsp. paratuberculosis
cgauggcgguccaccacc

SEQ ID NO: 921273 - RNA, 23 nt, Mycobacterium avium subsp. paratuberculosis
cgauggcguccaccgacaucgaa

SEQ ID NO: 921274 - RNA, 19 nt, Mycobacterium avium subsp. paratuberculosis
cgauggcgucggccagcgg

SEQ ID NO: 921275 - RNA, 21 nt, Mycobacterium avium subsp. paratuberculosis
cgaugguauccgaucgcggcc

SEQ ID NO: 921276 - RNA, 16 nt, Mycobacterium avium subsp. paratuberculosis
cgauggcgucggccag

SEQ ID NO: 921277 - RNA, 12 nt, Mycobacterium avium subsp. paratuberculosis
cgauggcgugcc

SEQ ID NO: 921278 - RNA, 13 nt, Mycobacterium avium subsp. paratuberculosis
cgauggcgugccg

SEQ ID NO: 921279 - RNA, 20 nt, Mycobacterium avium subsp. paratuberculosis
cgauggcgugccggcgcugc

SEQ ID NO: 921280 - RNA, 13 nt, Mycobacterium avium subsp. paratuberculosis
cgauggucgucgg

SEQ ID NO: 921281 - RNA, 15 nt, Mycobacterium avium subsp. paratuberculosis
cgauggucgucgggu

SEQ ID NO: 921282 - RNA, 21 nt, Mycobacterium avium subsp. paratuberculosis
cgauggucgucggguuggcca

SEQ ID NO: 921283 - RNA, 17 nt, Mycobacterium avium subsp. paratuberculosis
cgauggucagcugccgc

SEQ ID NO: 921284 - RNA, 17 nt, Mycobacterium avium subsp. paratuberculosis
cgaugucgacccgcggc

SEQ ID NO: 921285 - RNA, 19 nt, Mycobacterium avium subsp. paratuberculosis
cgaugucgacccgcggcgc

SEQ ID NO: 921286 - RNA, 14 nt, Mycobacterium avium subsp. paratuberculosis
cgaugucgacgccg

SEQ ID NO: 921287 - RNA, 21 nt, Mycobacterium avium subsp. paratuberculosis
cgaugucgacgccgugcugcc

SEQ ID NO: 921288 - RNA, 13 nt, Mycobacterium avium subsp. paratuberculosis
cgaugucgacggu

SEQ ID NO: 921289 - RNA, 23 nt, Mycobacterium avium subsp. paratuberculosis
cgaugucgacgguuugcccggcg

SEQ ID NO: 921290 - RNA, 12 nt, Mycobacterium avium subsp. paratuberculosis
cgaugucgacgu

SEQ ID NO: 921291 - RNA, 16 nt, Mycobacterium avium subsp. paratuberculosis
cgaugucgacgugggc

SEQ ID NO: 921292 - RNA, 23 nt, Mycobacterium avium subsp. paratuberculosis
cgaugucccauugcacaucccga

SEQ ID NO: 921293 - RNA, 18 nt, Mycobacterium avium subsp. paratuberculosis
cgauguccgacagcccgc

SEQ ID NO: 921294 - RNA, 20 nt, Mycobacterium avium subsp. paratuberculosis
cgauguccgacagcccgccc

SEQ ID NO: 921295 - RNA, 14 nt, Mycobacterium avium subsp. paratuberculosis
cgauguccgccggc

SEQ ID NO: 921296 - RNA, 13 nt, Mycobacterium avium subsp. paratuberculosis
cgauggugcugcc

SEQ ID NO: 921297 - RNA, 23 nt, Mycobacterium avium subsp. paratuberculosis
cgauguccagguaggcguugauc

SEQ ID NO: 921298 - RNA, 15 nt, Mycobacterium avium subsp. paratuberculosis
cgauggugccgucgg

SEQ ID NO: 921299 - RNA, 20 nt, Mycobacterium avium subsp. paratuberculosis
cgauggugccgucggcggga

SEQ ID NO: 921300 - RNA, 13 nt, Mycobacterium avium subsp. paratuberculosis
cgauggugccgcc

SEQ ID NO: 921301 - RNA, 14 nt, Mycobacterium avium subsp. paratuberculosis
cgauggugccgccg

SEQ ID NO: 921302 - RNA, 18 nt, Mycobacterium avium subsp. paratuberculosis
cgauggugccgccgguga

SEQ ID NO: 921303 - RNA, 15 nt, Mycobacterium avium subsp. paratuberculosis
cgauggugccggcca

SEQ ID NO: 921304 - RNA, 15 nt, Mycobacterium avium subsp. paratuberculosis
cgauggugaccucgg

SEQ ID NO: 921305 - RNA, 17 nt, Mycobacterium avium subsp. paratuberculosis
cgauggugacggugccg

SEQ ID NO: 921306 - RNA, 23 nt, Mycobacterium avium subsp. paratuberculosis
cgauggucugcccgccgccgaug

SEQ ID NO: 921307 - RNA, 23 nt, Mycobacterium avium subsp. paratuberculosis
cgauggugaagccgugcacgccg

SEQ ID NO: 921308 - RNA, 21 nt, Mycobacterium avium subsp. paratuberculosis
cgauggugaugugcggcgcgg

SEQ ID NO: 921309 - RNA, 23 nt, Mycobacterium avium subsp. paratuberculosis
cgauggugaugugcggcgcggcg

SEQ ID NO: 921310 - RNA, 20 nt, Mycobacterium avium subsp. paratuberculosis
cgauggugccgaagcgccgc

SEQ ID NO: 921311 - RNA, 22 nt, Mycobacterium avium subsp. paratuberculosis
cgaugcugagcgggucggccgg

SEQ ID NO: 921312 - RNA, 23 nt, Mycobacterium avium subsp. paratuberculosis
cgaugcugagcgggucggccggc

SEQ ID NO: 921313 - RNA, 22 nt, Mycobacterium avium subsp. paratuberculosis
cgaugcugauacccgcgcggcg

SEQ ID NO: 921314 - RNA, 23 nt, Mycobacterium avium subsp. paratuberculosis
cgaugcugauacccgcgcggcgc

SEQ ID NO: 921315 - RNA, 23 nt, Mycobacterium avium subsp. paratuberculosis
cgauggccacgcucucgccgguc

SEQ ID NO: 921316 - RNA, 16 nt, Mycobacterium avium subsp. paratuberculosis
cgauggccagcgcguc

SEQ ID NO: 921317 - RNA, 22 nt, Mycobacterium avium subsp. paratuberculosis
cgauggccaggcccagcccggc

SEQ ID NO: 921318 - RNA, 14 nt, Mycobacterium avium subsp. paratuberculosis
cgauggcccgcgcg

SEQ ID NO: 921319 - RNA, 13 nt, Mycobacterium avium subsp. paratuberculosis
cgauggcccgcug

SEQ ID NO: 921320 - RNA, 14 nt, Mycobacterium avium subsp. paratuberculosis
cgauggcccgcugc

SEQ ID NO: 921321 - RNA, 17 nt, Mycobacterium avium subsp. paratuberculosis
cgauggcccgcugcgcc

SEQ ID NO: 921322 - RNA, 19 nt, Mycobacterium avium subsp. paratuberculosis
cgauggcccgcugcgccga

SEQ ID NO: 921323 - RNA, 16 nt, Mycobacterium avium subsp. paratuberculosis
cgauggcccggaccgc

SEQ ID NO: 921324 - RNA, 17 nt, Mycobacterium avium subsp. paratuberculosis
cgauggcccggaccgcc

SEQ ID NO: 921325 - RNA, 18 nt, Mycobacterium avium subsp. paratuberculosis
cgauggcccggaccgccg

SEQ ID NO: 921326 - RNA, 17 nt, Mycobacterium avium subsp. paratuberculosis
cgauggccaucgucgaa

SEQ ID NO: 921327 - RNA, 20 nt, Mycobacterium avium subsp. paratuberculosis
cgauggccauggccaggaac

SEQ ID NO: 921328 - RNA, 19 nt, Mycobacterium avium subsp. paratuberculosis
cgauggcccaggccgcggu

SEQ ID NO: 921329 - RNA, 21 nt, Mycobacterium avium subsp. paratuberculosis
cgauggcccaggccgcggucg

SEQ ID NO: 921330 - RNA, 16 nt, Mycobacterium avium subsp. paratuberculosis
cgauggccaccgggcg

SEQ ID NO: 921331 - RNA, 15 nt, Mycobacterium avium subsp. paratuberculosis
cgaugcuauucgggc

SEQ ID NO: 921332 - RNA, 16 nt, Mycobacterium avium subsp. paratuberculosis
cgaugcuauucgggcc

SEQ ID NO: 921333 - RNA, 19 nt, Mycobacterium avium subsp. paratuberculosis
cgaugcccggggugcuggc

SEQ ID NO: 921334 - RNA, 17 nt, Mycobacterium avium subsp. paratuberculosis
cgaugcccgcgccgacc

SEQ ID NO: 921335 - RNA, 23 nt, Mycobacterium avium subsp. paratuberculosis
cgaugcccgcgccgaccagcgcg

SEQ ID NO: 921336 - RNA, 16 nt, Mycobacterium avium subsp. paratuberculosis
cgaugcccgcguccug

SEQ ID NO: 921337 - RNA, 17 nt, Mycobacterium avium subsp. paratuberculosis
cgaugcccgacaccgcc

SEQ ID NO: 921338 - RNA, 21 nt, Mycobacterium avium subsp. paratuberculosis
cgaugcccgacaccgccccgc

SEQ ID NO: 921339 - RNA, 12 nt, Mycobacterium avium subsp. paratuberculosis
cgaugcccgccc

SEQ ID NO: 921340 - RNA, 16 nt, Mycobacterium avium subsp. paratuberculosis
cgaugcccgccccgga

SEQ ID NO: 921341 - RNA, 14 nt, Mycobacterium avium subsp. paratuberculosis
cgaugcccgucacg

SEQ ID NO: 921342 - RNA, 23 nt, Mycobacterium avium subsp. paratuberculosis
cgaugcccgucacggccguccag

SEQ ID NO: 921343 - RNA, 14 nt, Mycobacterium avium subsp. paratuberculosis
cgaugcccgugauc

SEQ ID NO: 921344 - RNA, 15 nt, Mycobacterium avium subsp. paratuberculosis
cgaugcccgugaucg

SEQ ID NO: 921345 - RNA, 20 nt, Mycobacterium avium subsp. paratuberculosis
cgaugcccgugaucgccacg

SEQ ID NO: 921346 - RNA, 19 nt, Mycobacterium avium subsp. paratuberculosis
cgaugcccuccagcaccgu

SEQ ID NO: 921347 - RNA, 21 nt, Mycobacterium avium subsp. paratuberculosis
cgaugaucugguuccacagcu

SEQ ID NO: 921348 - RNA, 14 nt, Mycobacterium avium subsp. paratuberculosis
cgaugcccagcccc

SEQ ID NO: 921349 - RNA, 14 nt, Mycobacterium avium subsp. paratuberculosis
cgaugcccagcgcg

SEQ ID NO: 921350 - RNA, 15 nt, Mycobacterium avium subsp. paratuberculosis
cgaugcccagcgcgc

SEQ ID NO: 921351 - RNA, 16 nt, Mycobacterium avium subsp. paratuberculosis
cgaugcccagcgcgcg

SEQ ID NO: 921352 - RNA, 20 nt, Mycobacterium avium subsp. paratuberculosis
cgaugcccagcgcgcggugc

SEQ ID NO: 921353 - RNA, 17 nt, Mycobacterium avium subsp. paratuberculosis
cgcaauacccgaccagc

SEQ ID NO: 921354 - RNA, 14 nt, Mycobacterium avium subsp. paratuberculosis
cgcaauccugcccg

SEQ ID NO: 921355 - RNA, 16 nt, Mycobacterium avium subsp. paratuberculosis
cgcaauccugcccggu

SEQ ID NO: 921356 - RNA, 22 nt, Mycobacterium avium subsp. paratuberculosis
cgcaauccuguuccccggcggg

SEQ ID NO: 921357 - RNA, 17 nt, Mycobacterium avium subsp. paratuberculosis
cgcaaucggggccgacc

SEQ ID NO: 921358 - RNA, 20 nt, Mycobacterium avium subsp. paratuberculosis
cgcaacuguucgcggcuggc

SEQ ID NO: 921359 - RNA, 21 nt, Mycobacterium avium subsp. paratuberculosis
cgcaacuguucgcggcuggcc

SEQ ID NO: 921360 - RNA, 18 nt, Mycobacterium avium subsp. paratuberculosis
cgcaacuggguggucaca

SEQ ID NO: 921361 - RNA, 21 nt, Mycobacterium avium subsp. paratuberculosis
cgcaacuggguggucacaccg

SEQ ID NO: 921362 - RNA, 22 nt, Mycobacterium avium subsp. paratuberculosis
cgcaacucguccaccagcucga

SEQ ID NO: 921363 - RNA, 16 nt, Mycobacterium avium subsp. paratuberculosis
cgcaacucguccagcg

SEQ ID NO: 921364 - RNA, 15 nt, Mycobacterium avium subsp. paratuberculosis
cgcaagaagucggug

SEQ ID NO: 921365 - RNA, 20 nt, Mycobacterium avium subsp. paratuberculosis
cgcaagggccgacaucgucg

SEQ ID NO: 921366 - RNA, 19 nt, Mycobacterium avium subsp. paratuberculosis
cgcaaggugauucgcgcgg

SEQ ID NO: 921367 - RNA, 21 nt, Mycobacterium avium subsp. paratuberculosis
cgcaaggugauucgcgcggcg

SEQ ID NO: 921368 - RNA, 22 nt, Mycobacterium avium subsp. paratuberculosis
cgcaaggugauucgcgcggcgc

SEQ ID NO: 921369 - RNA, 14 nt, Mycobacterium avium subsp. paratuberculosis
cgcacaacgaggcc

SEQ ID NO: 921370 - RNA, 18 nt, Mycobacterium avium subsp. paratuberculosis
cgcacaacgaggcccgga

SEQ ID NO: 921371 - RNA, 20 nt, Mycobacterium avium subsp. paratuberculosis
cgcacaacgaggcccggacg

SEQ ID NO: 921372 - RNA, 15 nt, Mycobacterium avium subsp. paratuberculosis
cgcacaacagccaug

SEQ ID NO: 921373 - RNA, 15 nt, Mycobacterium avium subsp. paratuberculosis
cgcacaacccgcccg

SEQ ID NO: 921374 - RNA, 17 nt, Mycobacterium avium subsp. paratuberculosis
cgcacaacccggacagc

SEQ ID NO: 921375 - RNA, 19 nt, Mycobacterium avium subsp. paratuberculosis
cgcacaacccggacagcgc

SEQ ID NO: 921376 - RNA, 15 nt, Mycobacterium avium subsp. paratuberculosis
cgcacaaccgggcca

SEQ ID NO: 921377 - RNA, 19 nt, Mycobacterium avium subsp. paratuberculosis
cgcacaaccgggccaacgg

SEQ ID NO: 921378 - RNA, 13 nt, Mycobacterium avium subsp. paratuberculosis
cgcacaccaccac

SEQ ID NO: 921379 - RNA, 14 nt, Mycobacterium avium subsp. paratuberculosis
cgcacaccagcacg

SEQ ID NO: 921380 - RNA, 20 nt, Mycobacterium avium subsp. paratuberculosis
cgcacaccagcacggcggcg

SEQ ID NO: 921381 - RNA, 17 nt, Mycobacterium avium subsp. paratuberculosis
cgcacaauccggucagc

SEQ ID NO: 921382 - RNA, 14 nt, Mycobacterium avium subsp. paratuberculosis
cgcacaccgcggcg

SEQ ID NO: 921383 - RNA, 15 nt, Mycobacterium avium subsp. paratuberculosis
cgcacaccgcggcgg

SEQ ID NO: 921384 - RNA, 16 nt, Mycobacterium avium subsp. paratuberculosis
cgcacaccgcggcggc

SEQ ID NO: 921385 - RNA, 21 nt, Mycobacterium avium subsp. paratuberculosis
cgcacaccgcggcggcgucgg

SEQ ID NO: 921386 - RNA, 13 nt, Mycobacterium avium subsp. paratuberculosis
cgcacagccggcg

SEQ ID NO: 921387 - RNA, 15 nt, Mycobacterium avium subsp. paratuberculosis
cgcacagccggcgcg

SEQ ID NO: 921388 - RNA, 19 nt, Mycobacterium avium subsp. paratuberculosis
cgcacagccggcgcgcggu

SEQ ID NO: 921389 - RNA, 14 nt, Mycobacterium avium subsp. paratuberculosis
cgcacagccggcgg

SEQ ID NO: 921390 - RNA, 15 nt, Mycobacterium avium subsp. paratuberculosis
cgcacagccggcggc

SEQ ID NO: 921391 - RNA, 18 nt, Mycobacterium avium subsp. paratuberculosis
cgcacagccggcggcggc

SEQ ID NO: 921392 - RNA, 21 nt, Mycobacterium avium subsp. paratuberculosis
cgcacagccggcggcggcggu

SEQ ID NO: 921393 - RNA, 14 nt, Mycobacterium avium subsp. paratuberculosis
cgcacagcgccaca

SEQ ID NO: 921394 - RNA, 17 nt, Mycobacterium avium subsp. paratuberculosis
cgcacagcgccacaccg

SEQ ID NO: 921395 - RNA, 16 nt, Mycobacterium avium subsp. paratuberculosis
cgcacagcgccgcguu

SEQ ID NO: 921396 - RNA, 17 nt, Mycobacterium avium subsp. paratuberculosis
cgcacagcgccgcguug

SEQ ID NO: 921397 - RNA, 23 nt, Mycobacterium avium subsp. paratuberculosis
cgcacagcgccgcguugucggcg

SEQ ID NO: 921398 - RNA, 15 nt, Mycobacterium avium subsp. paratuberculosis
cgcacaccugcauca

SEQ ID NO: 921399 - RNA, 23 nt, Mycobacterium avium subsp. paratuberculosis
cgcacacuuccgggaagucgucg

SEQ ID NO: 921400 - RNA, 18 nt, Mycobacterium avium subsp. paratuberculosis
cgcacagauacgcgacga

SEQ ID NO: 921401 - RNA, 21 nt, Mycobacterium avium subsp. paratuberculosis
cgcacagaucgucucggccag

SEQ ID NO: 921402 - RNA, 22 nt, Mycobacterium avium subsp. paratuberculosis
cgcacagaucgucucggccagc

SEQ ID NO: 921403 - RNA, 12 nt, Mycobacterium avium subsp. paratuberculosis
cgcacagcacca

SEQ ID NO: 921404 - RNA, 13 nt, Mycobacterium avium subsp. paratuberculosis
cgcacagcaccag

SEQ ID NO: 921405 - RNA, 19 nt, Mycobacterium avium subsp. paratuberculosis
cgcaaugcgucgcggcggc

SEQ ID NO: 921406 - RNA, 17 nt, Mycobacterium avium subsp. paratuberculosis
cgcaaugccaucgucac

SEQ ID NO: 921407 - RNA, 19 nt, Mycobacterium avium subsp. paratuberculosis
cgcaaugccgccgcgacga

SEQ ID NO: 921408 - RNA, 18 nt, Mycobacterium avium subsp. paratuberculosis
cgcaauugcgccagcagc

SEQ ID NO: 921409 - RNA, 16 nt, Mycobacterium avium subsp. paratuberculosis
cgcacccgacacgccg

SEQ ID NO: 921410 - RNA, 18 nt, Mycobacterium avium subsp. paratuberculosis
cgcacccgauccacggcg

SEQ ID NO: 921411 - RNA, 19 nt, Mycobacterium avium subsp. paratuberculosis
cgcacccgauccacggcga

SEQ ID NO: 921412 - RNA, 12 nt, Mycobacterium avium subsp. paratuberculosis
cgcacccgcggg

SEQ ID NO: 921413 - RNA, 19 nt, Mycobacterium avium subsp. paratuberculosis
cgcacccgcgggucgucgg

SEQ ID NO: 921414 - RNA, 13 nt, Mycobacterium avium subsp. paratuberculosis
cgcacccguucgg

SEQ ID NO: 921415 - RNA, 19 nt, Mycobacterium avium subsp. paratuberculosis
cgcacccguucggcgucga

SEQ ID NO: 921416 - RNA, 13 nt, Mycobacterium avium subsp. paratuberculosis
cgcacccgggccc

SEQ ID NO: 921417 - RNA, 20 nt, Mycobacterium avium subsp. paratuberculosis
cgcacccgguccggcugguc

SEQ ID NO: 921418 - RNA, 19 nt, Mycobacterium avium subsp. paratuberculosis
cgcaccgacgaaaucgucg

SEQ ID NO: 921419 - RNA, 14 nt, Mycobacterium avium subsp. paratuberculosis
cgcacccguaacac

SEQ ID NO: 921420 - RNA, 20 nt, Mycobacterium avium subsp. paratuberculosis
cgcacccguaacacgaucac

SEQ ID NO: 921421 - RNA, 18 nt, Mycobacterium avium subsp. paratuberculosis
cgcacccuugacuaccgc

SEQ ID NO: 921422 - RNA, 20 nt, Mycobacterium avium subsp. paratuberculosis
cgcacccuugacuaccgcgc

SEQ ID NO: 921423 - RNA, 17 nt, Mycobacterium avium subsp. paratuberculosis
cgcaccgauggguuggc

SEQ ID NO: 921424 - RNA, 22 nt, Mycobacterium avium subsp. paratuberculosis
cgcaccgauggguuggccgucg

SEQ ID NO: 921425 - RNA, 20 nt, Mycobacterium avium subsp. paratuberculosis
cgcaccgcaaagcaccgcga

SEQ ID NO: 921426 - RNA, 13 nt, Mycobacterium avium subsp. paratuberculosis
cgcaccgaccagc

SEQ ID NO: 921427 - RNA, 18 nt, Mycobacterium avium subsp. paratuberculosis
cgcaccgagaccaugccg

SEQ ID NO: 921428 - RNA, 19 nt, Mycobacterium avium subsp. paratuberculosis
cgcaccgagaccaugccgc

SEQ ID NO: 921429 - RNA, 13 nt, Mycobacterium avium subsp. paratuberculosis
cgcaccgagucgg

SEQ ID NO: 921430 - RNA, 17 nt, Mycobacterium avium subsp. paratuberculosis
cgcaccgagucggugac

SEQ ID NO: 921431 - RNA, 14 nt, Mycobacterium avium subsp. paratuberculosis
cgcaccccgucgcg

SEQ ID NO: 921432 - RNA, 18 nt, Mycobacterium avium subsp. paratuberculosis
cgcaccccgucgcggacc

SEQ ID NO: 921433 - RNA, 22 nt, Mycobacterium avium subsp. paratuberculosis
cgcaccccgugguagacgccgg

SEQ ID NO: 921434 - RNA, 18 nt, Mycobacterium avium subsp. paratuberculosis
cgcaccccguugccgccg

SEQ ID NO: 921435 - RNA, 21 nt, Mycobacterium avium subsp. paratuberculosis
cgcaccccguugccgccggcg

SEQ ID NO: 921436 - RNA, 22 nt, Mycobacterium avium subsp. paratuberculosis
cgcaccccguugccgccggcgc

SEQ ID NO: 921437 - RNA, 16 nt, Mycobacterium avium subsp. paratuberculosis
cgcacccccuccacac

SEQ ID NO: 921438 - RNA, 14 nt, Mycobacterium avium subsp. paratuberculosis
cgcaccccgaacca

SEQ ID NO: 921439 - RNA, 15 nt, Mycobacterium avium subsp. paratuberculosis
cgcaccccgaaccag

SEQ ID NO: 921440 - RNA, 14 nt, Mycobacterium avium subsp. paratuberculosis
cgcaccccggcaua

SEQ ID NO: 921441 - RNA, 15 nt, Mycobacterium avium subsp. paratuberculosis
cgcaccccggcauag

SEQ ID NO: 921442 - RNA, 14 nt, Mycobacterium avium subsp. paratuberculosis
cgcacccagcgggc

SEQ ID NO: 921443 - RNA, 16 nt, Mycobacterium avium subsp. paratuberculosis
cgcacccagcgggcga

SEQ ID NO: 921444 - RNA, 18 nt, Mycobacterium avium subsp. paratuberculosis
cgcacccagcgggcgacg

SEQ ID NO: 921445 - RNA, 22 nt, Mycobacterium avium subsp. paratuberculosis
cgcacccagcgggcgacgucgg

SEQ ID NO: 921446 - RNA, 17 nt, Mycobacterium avium subsp. paratuberculosis
cgcaccccacccgcgcg

SEQ ID NO: 921447 - RNA, 19 nt, Mycobacterium avium subsp. paratuberculosis
cgcaccccacccgcgcgac

SEQ ID NO: 921448 - RNA, 15 nt, Mycobacterium avium subsp. paratuberculosis
cgcaccccaccgaca

SEQ ID NO: 921449 - RNA, 16 nt, Mycobacterium avium subsp. paratuberculosis
cgcacccccagcucga

SEQ ID NO: 921450 - RNA, 19 nt, Mycobacterium avium subsp. paratuberculosis
cgcacccccagcucgacga

SEQ ID NO: 921451 - RNA, 20 nt, Mycobacterium avium subsp. paratuberculosis
cgcacccagaaacgacauca

SEQ ID NO: 921452 - RNA, 17 nt, Mycobacterium avium subsp. paratuberculosis
cgcaccaucgcgaugga

SEQ ID NO: 921453 - RNA, 16 nt, Mycobacterium avium subsp. paratuberculosis
cgcaccauccgcgacg

SEQ ID NO: 921454 - RNA, 13 nt, Mycobacterium avium subsp. paratuberculosis
cgcaccaucaccu

SEQ ID NO: 921455 - RNA, 15 nt, Mycobacterium avium subsp. paratuberculosis
cgcaccagggugucg

SEQ ID NO: 921456 - RNA, 22 nt, Mycobacterium avium subsp. paratuberculosis
cgcaccagguagguggccgucg

SEQ ID NO: 921457 - RNA, 13 nt, Mycobacterium avium subsp. paratuberculosis
cgcaccaccagcu

SEQ ID NO: 921458 - RNA, 15 nt, Mycobacterium avium subsp. paratuberculosis
cgcaccacccagccc

SEQ ID NO: 921459 - RNA, 21 nt, Mycobacterium avium subsp. paratuberculosis
cgcaccaccgcccggaccggc

SEQ ID NO: 921460 - RNA, 22 nt, Mycobacterium avium subsp. paratuberculosis
cgcaccacgaccuccgugccga

SEQ ID NO: 921461 - RNA, 23 nt, Mycobacterium avium subsp. paratuberculosis
cgcaccacgguggcgccgcgcag

SEQ ID NO: 921462 - RNA, 24 nt, Mycobacterium avium subsp. paratuberculosis
cgcaccacgguggcgccgcgcagc

SEQ ID NO: 921463 - RNA, 18 nt, Mycobacterium avium subsp. paratuberculosis
cgcaccagaucgucgggc

SEQ ID NO: 921464 - RNA, 20 nt, Mycobacterium avium subsp. paratuberculosis
cgcaccagaucgucgggcac

SEQ ID NO: 921465 - RNA, 21 nt, Mycobacterium avium subsp. paratuberculosis
cgcaccagauucaccagcgcc

SEQ ID NO: 921466 - RNA, 13 nt, Mycobacterium avium subsp. paratuberculosis
cgcaccagcaccc

SEQ ID NO: 921467 - RNA, 15 nt, Mycobacterium avium subsp. paratuberculosis
cgcaccaccgcggug

SEQ ID NO: 921468 - RNA, 19 nt, Mycobacterium avium subsp. paratuberculosis
cgcaccaccucggcgaucu

SEQ ID NO: 921469 - RNA, 14 nt, Mycobacterium avium subsp. paratuberculosis
cgcaccagggccgc

SEQ ID NO: 921470 - RNA, 16 nt, Mycobacterium avium subsp. paratuberculosis
cgcaccagggccgcga

SEQ ID NO: 921471 - RNA, 18 nt, Mycobacterium avium subsp. paratuberculosis
cgcaccagggccugcagc

SEQ ID NO: 921472 - RNA, 14 nt, Mycobacterium avium subsp. paratuberculosis
cgcaccaggcgcca

SEQ ID NO: 921473 - RNA, 15 nt, Mycobacterium avium subsp. paratuberculosis
cgcaccaggcgccac

SEQ ID NO: 921474 - RNA, 18 nt, Mycobacterium avium subsp. paratuberculosis
cgcaccaggcgccacagc

SEQ ID NO: 921475 - RNA, 16 nt, Mycobacterium avium subsp. paratuberculosis
cgcaccaggccgacgc

SEQ ID NO: 921476 - RNA, 21 nt, Mycobacterium avium subsp. paratuberculosis
cgcaccagcucggcgcugucg

SEQ ID NO: 921477 - RNA, 21 nt, Mycobacterium avium subsp. paratuberculosis
cgcaccagcugauucgcggug

SEQ ID NO: 921478 - RNA, 19 nt, Mycobacterium avium subsp. paratuberculosis
cgcaccaaagugccguuga

SEQ ID NO: 921479 - RNA, 20 nt, Mycobacterium avium subsp. paratuberculosis
cgcacaugccgaggcacagc

SEQ ID NO: 921480 - RNA, 17 nt, Mycobacterium avium subsp. paratuberculosis
cgcacaucguggcgacg

SEQ ID NO: 921481 - RNA, 18 nt, Mycobacterium avium subsp. paratuberculosis
cgcacaucguggcgacga

SEQ ID NO: 921482 - RNA, 19 nt, Mycobacterium avium subsp. paratuberculosis
cgcacaucguggcgacgac

SEQ ID NO: 921483 - RNA, 23 nt, Mycobacterium avium subsp. paratuberculosis
cgcacagcuaggucguggcgccg

SEQ ID NO: 921484 - RNA, 20 nt, Mycobacterium avium subsp. paratuberculosis
cgcacaggaugcccaacagc

SEQ ID NO: 921485 - RNA, 16 nt, Mycobacterium avium subsp. paratuberculosis
cgcacagcuuucgggc

SEQ ID NO: 921486 - RNA, 17 nt, Mycobacterium avium subsp. paratuberculosis
cgcacagcuuucgggcg

SEQ ID NO: 921487 - RNA, 20 nt, Mycobacterium avium subsp. paratuberculosis
cgcacagcuuucgggcggcc

SEQ ID NO: 921488 - RNA, 22 nt, Mycobacterium avium subsp. paratuberculosis
cgcacagcuuucgggcggccug

SEQ ID NO: 921489 - RNA, 13 nt, Mycobacterium avium subsp. paratuberculosis
cgcacaggaacgc

SEQ ID NO: 921490 - RNA, 22 nt, Mycobacterium avium subsp. paratuberculosis
cgcacaggaacgcgucgaccgc

SEQ ID NO: 921491 - RNA, 14 nt, Mycobacterium avium subsp. paratuberculosis
cgcacagccgcagc

SEQ ID NO: 921492 - RNA, 18 nt, Mycobacterium avium subsp. paratuberculosis
cgcacagccgcagcagcc

SEQ ID NO: 921493 - RNA, 15 nt, Mycobacterium avium subsp. paratuberculosis
cgccaaaacggggug

SEQ ID NO: 921494 - RNA, 15 nt, Mycobacterium avium subsp. paratuberculosis
cgccaaacugcgcaa

SEQ ID NO: 921495 - RNA, 18 nt, Mycobacterium avium subsp. paratuberculosis
cgcauucaaugucgcccu

SEQ ID NO: 921496 - RNA, 14 nt, Mycobacterium avium subsp. paratuberculosis
cgcauguuggugau

SEQ ID NO: 921497 - RNA, 17 nt, Mycobacterium avium subsp. paratuberculosis
cgcauguugugcccgac

SEQ ID NO: 921498 - RNA, 18 nt, Mycobacterium avium subsp. paratuberculosis
cgcauguugugcccgacg

SEQ ID NO: 921499 - RNA, 12 nt, Mycobacterium avium subsp. paratuberculosis
cgcauucggccg

SEQ ID NO: 921500 - RNA, 13 nt, Mycobacterium avium subsp. paratuberculosis
cgcauucggccgc

SEQ ID NO: 921501 - RNA, 15 nt, Mycobacterium avium subsp. paratuberculosis
cgcauucggccgcca

SEQ ID NO: 921502 - RNA, 18 nt, Mycobacterium avium subsp. paratuberculosis
cgcauucggccgccaccg

SEQ ID NO: 921503 - RNA, 17 nt, Mycobacterium avium subsp. paratuberculosis
cgcauuccucggccagc

SEQ ID NO: 921504 - RNA, 23 nt, Mycobacterium avium subsp. paratuberculosis
cgcauuccucggccagcucaccg

SEQ ID NO: 921505 - RNA, 14 nt, Mycobacterium avium subsp. paratuberculosis
cgccaaccaggucg

SEQ ID NO: 921506 - RNA, 19 nt, Mycobacterium avium subsp. paratuberculosis
cgccaaccaggucgcggcg

SEQ ID NO: 921507 - RNA, 22 nt, Mycobacterium avium subsp. paratuberculosis
cgccaaccaggucgcggcgcug

SEQ ID NO: 921508 - RNA, 23 nt, Mycobacterium avium subsp. paratuberculosis
cgccaacaacucgacgcucggcg

SEQ ID NO: 921509 - RNA, 19 nt, Mycobacterium avium subsp. paratuberculosis
cgccaacgcuuuugcgggu

SEQ ID NO: 921510 - RNA, 20 nt, Mycobacterium avium subsp. paratuberculosis
cgccaacgcuuuugcggguc

SEQ ID NO: 921511 - RNA, 23 nt, Mycobacterium avium subsp. paratuberculosis
cgccaacggauucagcgucgcca

SEQ ID NO: 921512 - RNA, 21 nt, Mycobacterium avium subsp. paratuberculosis
cgccaacagguuuccgaguug

SEQ ID NO: 921513 - RNA, 22 nt, Mycobacterium avium subsp. paratuberculosis
cgccaacgaggcacggcccgcu

SEQ ID NO: 921514 - RNA, 24 nt, Mycobacterium avium subsp. paratuberculosis
cgccaacgaggcacggcccgcucg

SEQ ID NO: 921515 - RNA, 17 nt, Mycobacterium avium subsp. paratuberculosis
cgcaucacccggcgcgc

SEQ ID NO: 921516 - RNA, 21 nt, Mycobacterium avium subsp. paratuberculosis
cgcaucaccuucugcgcgccg

SEQ ID NO: 921517 - RNA, 23 nt, Mycobacterium avium subsp. paratuberculosis
cgcaucaccuucugcgcgccguc

SEQ ID NO: 921518 - RNA, 20 nt, Mycobacterium avium subsp. paratuberculosis
cgcaucaccuucugcgucgg

SEQ ID NO: 921519 - RNA, 22 nt, Mycobacterium avium subsp. paratuberculosis
cgcaucaccuucugcgucggcu

SEQ ID NO: 921520 - RNA, 22 nt, Mycobacterium avium subsp. paratuberculosis
cgcaucagcaccuccggcagcg

SEQ ID NO: 921521 - RNA, 13 nt, Mycobacterium avium subsp. paratuberculosis
cgcaucagcgcca

SEQ ID NO: 921522 - RNA, 21 nt, Mycobacterium avium subsp. paratuberculosis
cgcaucagcgccaccagcacc

SEQ ID NO: 921523 - RNA, 15 nt, Mycobacterium avium subsp. paratuberculosis
cgcaucagcucggca

SEQ ID NO: 921524 - RNA, 19 nt, Mycobacterium avium subsp. paratuberculosis
cgcaucagcucggcagccc

SEQ ID NO: 921525 - RNA, 17 nt, Mycobacterium avium subsp. paratuberculosis
cgcaucagggccagccg

SEQ ID NO: 921526 - RNA, 20 nt, Mycobacterium avium subsp. paratuberculosis
cgcaucagggccagccgaug

SEQ ID NO: 921527 - RNA, 14 nt, Mycobacterium avium subsp. paratuberculosis
cgcaucaucgccca

SEQ ID NO: 921528 - RNA, 15 nt, Mycobacterium avium subsp. paratuberculosis
cgcaucaucucggcg

SEQ ID NO: 921529 - RNA, 18 nt, Mycobacterium avium subsp. paratuberculosis
cgcauccaccagggcggu

SEQ ID NO: 921530 - RNA, 20 nt, Mycobacterium avium subsp. paratuberculosis
cgcauccaccagggcgguga

SEQ ID NO: 921531 - RNA, 22 nt, Mycobacterium avium subsp. paratuberculosis
cgcaucaugcguuugccgucga

SEQ ID NO: 921532 - RNA, 19 nt, Mycobacterium avium subsp. paratuberculosis
cgcaucccgucgaccagga

SEQ ID NO: 921533 - RNA, 15 nt, Mycobacterium avium subsp. paratuberculosis
cgcaucccgaucgac

SEQ ID NO: 921534 - RNA, 16 nt, Mycobacterium avium subsp. paratuberculosis
cgcaucccccucggcg

SEQ ID NO: 921535 - RNA, 11 nt, Mycobacterium avium subsp. paratuberculosis
cgcauccgcac

SEQ ID NO: 921536 - RNA, 16 nt, Mycobacterium avium subsp. paratuberculosis
cgcauccgccgggcgg

SEQ ID NO: 921537 - RNA, 19 nt, Mycobacterium avium subsp. paratuberculosis
cgcauccgccgggcggcgu

SEQ ID NO: 921538 - RNA, 21 nt, Mycobacterium avium subsp. paratuberculosis
cgcauccgccgggcggcgucc

SEQ ID NO: 921539 - RNA, 15 nt, Mycobacterium avium subsp. paratuberculosis
cgcaugaugcggcca

SEQ ID NO: 921540 - RNA, 20 nt, Mycobacterium avium subsp. paratuberculosis
cgcaugaugcccaggcccac

SEQ ID NO: 921541 - RNA, 19 nt, Mycobacterium avium subsp. paratuberculosis
cgcaugccacuugcgcacg

SEQ ID NO: 921542 - RNA, 16 nt, Mycobacterium avium subsp. paratuberculosis
cgcaugccagaccaca

SEQ ID NO: 921543 - RNA, 18 nt, Mycobacterium avium subsp. paratuberculosis
cgcaugcaccggugcacc

SEQ ID NO: 921544 - RNA, 19 nt, Mycobacterium avium subsp. paratuberculosis
cgcaugcaccggugcaccg

SEQ ID NO: 921545 - RNA, 13 nt, Mycobacterium avium subsp. paratuberculosis
cgcauguccgccg

SEQ ID NO: 921546 - RNA, 14 nt, Mycobacterium avium subsp. paratuberculosis
cgcauguccgccgu

SEQ ID NO: 921547 - RNA, 15 nt, Mycobacterium avium subsp. paratuberculosis
cgcauguccgccguc

SEQ ID NO: 921548 - RNA, 15 nt, Mycobacterium avium subsp. paratuberculosis
cgcauguccggggug

SEQ ID NO: 921549 - RNA, 20 nt, Mycobacterium avium subsp. paratuberculosis
cgcaugucgaccucggccac

SEQ ID NO: 921550 - RNA, 19 nt, Mycobacterium avium subsp. paratuberculosis
cgcaugcccuugucgcugg

SEQ ID NO: 921551 - RNA, 21 nt, Mycobacterium avium subsp. paratuberculosis
cgcaugcccuugucgcuggcg

SEQ ID NO: 921552 - RNA, 17 nt, Mycobacterium avium subsp. paratuberculosis
cgcaucaacugcaccag

SEQ ID NO: 921553 - RNA, 21 nt, Mycobacterium avium subsp. paratuberculosis
cgcauaucccauguagagcgg

SEQ ID NO: 921554 - RNA, 15 nt, Mycobacterium avium subsp. paratuberculosis
cgcauaggaccggau

SEQ ID NO: 921555 - RNA, 17 nt, Mycobacterium avium subsp. paratuberculosis
cgcauagcgggagccgg

SEQ ID NO: 921556 - RNA, 18 nt, Mycobacterium avium subsp. paratuberculosis
cgcauagcgggagccggc

SEQ ID NO: 921557 - RNA, 14 nt, Mycobacterium avium subsp. paratuberculosis
cgcauagcggucca

SEQ ID NO: 921558 - RNA, 13 nt, Mycobacterium avium subsp. paratuberculosis
cgcauaggccgcg

SEQ ID NO: 921559 - RNA, 16 nt, Mycobacterium avium subsp. paratuberculosis
cgcaguugcgcggcgg

SEQ ID NO: 921560 - RNA, 18 nt, Mycobacterium avium subsp. paratuberculosis
cgcaguucgaccggcacc

SEQ ID NO: 921561 - RNA, 14 nt, Mycobacterium avium subsp. paratuberculosis
cgcaguucggccgc

SEQ ID NO: 921562 - RNA, 17 nt, Mycobacterium avium subsp. paratuberculosis
cgcaguucggccgccgu

SEQ ID NO: 921563 - RNA, 15 nt, Mycobacterium avium subsp. paratuberculosis
cgcaguucgggaucg

SEQ ID NO: 921564 - RNA, 22 nt, Mycobacterium avium subsp. paratuberculosis
cgcaguucgggaucgucgccgg

SEQ ID NO: 921565 - RNA, 15 nt, Mycobacterium avium subsp. paratuberculosis
cgcaguucaccgaag

SEQ ID NO: 921566 - RNA, 22 nt, Mycobacterium avium subsp. paratuberculosis
cgcauacaccuugucggcgagc

SEQ ID NO: 921567 - RNA, 14 nt, Mycobacterium avium subsp. paratuberculosis
cgcagucgucgaug

SEQ ID NO: 921568 - RNA, 14 nt, Mycobacterium avium subsp. paratuberculosis
cgcagucguucggc

SEQ ID NO: 921569 - RNA, 17 nt, Mycobacterium avium subsp. paratuberculosis
cgcagucguucggccag

SEQ ID NO: 921570 - RNA, 14 nt, Mycobacterium avium subsp. paratuberculosis
cgcagucgaucacc

SEQ ID NO: 921571 - RNA, 16 nt, Mycobacterium avium subsp. paratuberculosis
cgcagucgaucaccga

SEQ ID NO: 921572 - RNA, 12 nt, Mycobacterium avium subsp. paratuberculosis
cgcagucgcugg

SEQ ID NO: 921573 - RNA, 14 nt, Mycobacterium avium subsp. paratuberculosis
cgcagucggccgga

SEQ ID NO: 921574 - RNA, 14 nt, Mycobacterium avium subsp. paratuberculosis
cgcagucggcgucg

SEQ ID NO: 921575 - RNA, 15 nt, Mycobacterium avium subsp. paratuberculosis
cgcagucggcgucgc

SEQ ID NO: 921576 - RNA, 21 nt, Mycobacterium avium subsp. paratuberculosis
cgcaguccaaaaacugcgcgu

SEQ ID NO: 921577 - RNA, 22 nt, Mycobacterium avium subsp. paratuberculosis
cgcaguccaaaaacugcgcguc

SEQ ID NO: 921578 - RNA, 13 nt, Mycobacterium avium subsp. paratuberculosis
cgcagucuuguug

SEQ ID NO: 921579 - RNA, 17 nt, Mycobacterium avium subsp. paratuberculosis
cgcagugcccgcccagc

SEQ ID NO: 921580 - RNA, 18 nt, Mycobacterium avium subsp. paratuberculosis
cgcagugcccgcccagcu

SEQ ID NO: 921581 - RNA, 14 nt, Mycobacterium avium subsp. paratuberculosis
cgcagugccgcacc

SEQ ID NO: 921582 - RNA, 18 nt, Mycobacterium avium subsp. paratuberculosis
cgcagugccgcaccagca

SEQ ID NO: 921583 - RNA, 18 nt, Mycobacterium avium subsp. paratuberculosis
cgcagugccggcgcaccg

SEQ ID NO: 921584 - RNA, 22 nt, Mycobacterium avium subsp. paratuberculosis
cgcagugccggugcagcaccuc

SEQ ID NO: 921585 - RNA, 18 nt, Mycobacterium avium subsp. paratuberculosis
cgcaggguggccagcacc

SEQ ID NO: 921586 - RNA, 20 nt, Mycobacterium avium subsp. paratuberculosis
cgcaggguggccagcaccgc

SEQ ID NO: 921587 - RNA, 18 nt, Mycobacterium avium subsp. paratuberculosis
cgcagguacgcggcguug

SEQ ID NO: 921588 - RNA, 17 nt, Mycobacterium avium subsp. paratuberculosis
cgcagguagccgccgua

SEQ ID NO: 921589 - RNA, 21 nt, Mycobacterium avium subsp. paratuberculosis
cgcagguagccgccguagccg

SEQ ID NO: 921590 - RNA, 14 nt, Mycobacterium avium subsp. paratuberculosis
cgcaguagccgacg

SEQ ID NO: 921591 - RNA, 15 nt, Mycobacterium avium subsp. paratuberculosis
cgcaguagccgacgu

SEQ ID NO: 921592 - RNA, 22 nt, Mycobacterium avium subsp. paratuberculosis
cgcaguagccgacgugcccgau

SEQ ID NO: 921593 - RNA, 15 nt, Mycobacterium avium subsp. paratuberculosis
cgcagggcggccggc

SEQ ID NO: 921594 - RNA, 23 nt, Mycobacterium avium subsp. paratuberculosis
cgcagggucagcgcuuccagcgc

SEQ ID NO: 921595 - RNA, 22 nt, Mycobacterium avium subsp. paratuberculosis
cgcagggcguucgacguccacc

SEQ ID NO: 921596 - RNA, 13 nt, Mycobacterium avium subsp. paratuberculosis
cgcagggcggccg

SEQ ID NO: 921597 - RNA, 13 nt, Mycobacterium avium subsp. paratuberculosis
cgcagggcgccgg

SEQ ID NO: 921598 - RNA, 16 nt, Mycobacterium avium subsp. paratuberculosis
cgcagggcgccgguga

SEQ ID NO: 921599 - RNA, 19 nt, Mycobacterium avium subsp. paratuberculosis
cgcaggcggccagcaccag

SEQ ID NO: 921600 - RNA, 14 nt, Mycobacterium avium subsp. paratuberculosis
cgcaggcggcgacg

SEQ ID NO: 921601 - RNA, 15 nt, Mycobacterium avium subsp. paratuberculosis
cgcaggcggcgacgg

SEQ ID NO: 921602 - RNA, 18 nt, Mycobacterium avium subsp. paratuberculosis
cgcaggcggcgacggccg

SEQ ID NO: 921603 - RNA, 20 nt, Mycobacterium avium subsp. paratuberculosis
cgcaggcggcgacggccguc

SEQ ID NO: 921604 - RNA, 13 nt, Mycobacterium avium subsp. paratuberculosis
cgcaggcggcgcg

SEQ ID NO: 921605 - RNA, 14 nt, Mycobacterium avium subsp. paratuberculosis
cgcaggcggcgcgc

SEQ ID NO: 921606 - RNA, 19 nt, Mycobacterium avium subsp. paratuberculosis
cgcaggcggcgcgcagccg

SEQ ID NO: 921607 - RNA, 12 nt, Mycobacterium avium subsp. paratuberculosis
cgcagcgugggc

SEQ ID NO: 921608 - RNA, 17 nt, Mycobacterium avium subsp. paratuberculosis
cgcagcgugggcaccgg

SEQ ID NO: 921609 - RNA, 20 nt, Mycobacterium avium subsp. paratuberculosis
cgcagcgugggcaccggcac

SEQ ID NO: 921610 - RNA, 22 nt, Mycobacterium avium subsp. paratuberculosis
cgcagcgugggcaccggcaccg

SEQ ID NO: 921611 - RNA, 18 nt, Mycobacterium avium subsp. paratuberculosis
cgcagcgugucggggucg

SEQ ID NO: 921612 - RNA, 14 nt, Mycobacterium avium subsp. paratuberculosis
cgcagcuccagguc

SEQ ID NO: 921613 - RNA, 23 nt, Mycobacterium avium subsp. paratuberculosis
cgcagcucgacgaccucgccgac

SEQ ID NO: 921614 - RNA, 15 nt, Mycobacterium avium subsp. paratuberculosis
cgcagcucgaucacc

SEQ ID NO: 921615 - RNA, 17 nt, Mycobacterium avium subsp. paratuberculosis
cgcagcucgcccagcac

SEQ ID NO: 921616 - RNA, 13 nt, Mycobacterium avium subsp. paratuberculosis
cgcagcucgccgg

SEQ ID NO: 921617 - RNA, 15 nt, Mycobacterium avium subsp. paratuberculosis
cgcagcucgccggug

SEQ ID NO: 921618 - RNA, 18 nt, Mycobacterium avium subsp. paratuberculosis
cgcagcucgccgguggcg

SEQ ID NO: 921619 - RNA, 17 nt, Mycobacterium avium subsp. paratuberculosis
cgcagcucgcgcagccg

SEQ ID NO: 921620 - RNA, 15 nt, Mycobacterium avium subsp. paratuberculosis
cgcagcucggggucg

SEQ ID NO: 921621 - RNA, 21 nt, Mycobacterium avium subsp. paratuberculosis
cgcagcucggggucggcgucg

SEQ ID NO: 921622 - RNA, 17 nt, Mycobacterium avium subsp. paratuberculosis
cgcagcuguucgggcag

SEQ ID NO: 921623 - RNA, 18 nt, Mycobacterium avium subsp. paratuberculosis
cgcagcuucugcagcucg

SEQ ID NO: 921624 - RNA, 13 nt, Mycobacterium avium subsp. paratuberculosis
cgcagcugcgccg

SEQ ID NO: 921625 - RNA, 14 nt, Mycobacterium avium subsp. paratuberculosis
cgcagcugcgccgc

SEQ ID NO: 921626 - RNA, 19 nt, Mycobacterium avium subsp. paratuberculosis
cgcagcugcgccgcgucga

SEQ ID NO: 921627 - RNA, 22 nt, Mycobacterium avium subsp. paratuberculosis
cgcagcugaucggggcccaccc

SEQ ID NO: 921628 - RNA, 14 nt, Mycobacterium avium subsp. paratuberculosis
cgcagcugcagcuc

SEQ ID NO: 921629 - RNA, 20 nt, Mycobacterium avium subsp. paratuberculosis
cgcagcugcagcuccucggc

SEQ ID NO: 921630 - RNA, 22 nt, Mycobacterium avium subsp. paratuberculosis
cgcagcugcagcuccucggcgg

SEQ ID NO: 921631 - RNA, 18 nt, Mycobacterium avium subsp. paratuberculosis
cgcagcugcugcggccgg

SEQ ID NO: 921632 - RNA, 20 nt, Mycobacterium avium subsp. paratuberculosis
cgcagcugcugcggccggac

SEQ ID NO: 921633 - RNA, 15 nt, Mycobacterium avium subsp. paratuberculosis
cgcagcuggccaagu

SEQ ID NO: 921634 - RNA, 18 nt, Mycobacterium avium subsp. paratuberculosis
cgcagcuggccgugcacc

SEQ ID NO: 921635 - RNA, 22 nt, Mycobacterium avium subsp. paratuberculosis
cgcagcuggccgugcaccgucg

SEQ ID NO: 921636 - RNA, 19 nt, Mycobacterium avium subsp. paratuberculosis
cgcaggaacuccagcagcu

SEQ ID NO: 921637 - RNA, 21 nt, Mycobacterium avium subsp. paratuberculosis
cgcaggccguccagcagcagc

SEQ ID NO: 921638 - RNA, 16 nt, Mycobacterium avium subsp. paratuberculosis
cgcaggccgucgccgg

SEQ ID NO: 921639 - RNA, 17 nt, Mycobacterium avium subsp. paratuberculosis
cgcaggccgucgccggu

SEQ ID NO: 921640 - RNA, 15 nt, Mycobacterium avium subsp. paratuberculosis
cgcaggcgagccgac

SEQ ID NO: 921641 - RNA, 20 nt, Mycobacterium avium subsp. paratuberculosis
cgcaggccucuacucagccg

SEQ ID NO: 921642 - RNA, 14 nt, Mycobacterium avium subsp. paratuberculosis
cgcaggcgcaccac

SEQ ID NO: 921643 - RNA, 17 nt, Mycobacterium avium subsp. paratuberculosis
cgcaggcgcgcaccauc

SEQ ID NO: 921644 - RNA, 12 nt, Mycobacterium avium subsp. paratuberculosis
cgcaggcgcgcg

SEQ ID NO: 921645 - RNA, 17 nt, Mycobacterium avium subsp. paratuberculosis
cgcaggcgcgcggccag

SEQ ID NO: 921646 - RNA, 20 nt, Mycobacterium avium subsp. paratuberculosis
cgcaggcgcgcggccagccc

SEQ ID NO: 921647 - RNA, 21 nt, Mycobacterium avium subsp. paratuberculosis
cgcaggcgcgcggccagcccc

SEQ ID NO: 921648 - RNA, 13 nt, Mycobacterium avium subsp. paratuberculosis
cgcaggcgcugag

SEQ ID NO: 921649 - RNA, 12 nt, Mycobacterium avium subsp. paratuberculosis
cgcaggcggcca

SEQ ID NO: 921650 - RNA, 21 nt, Mycobacterium avium subsp. paratuberculosis
cgcagcgucuugcccagcggg

SEQ ID NO: 921651 - RNA, 22 nt, Mycobacterium avium subsp. paratuberculosis
cgcagcgucuugcccagcgggg

SEQ ID NO: 921652 - RNA, 12 nt, Mycobacterium avium subsp. paratuberculosis
cgcagcgucggc

SEQ ID NO: 921653 - RNA, 13 nt, Mycobacterium avium subsp. paratuberculosis
cgcagcgucggcg

SEQ ID NO: 921654 - RNA, 17 nt, Mycobacterium avium subsp. paratuberculosis
cgcagcgucucccgggu

SEQ ID NO: 921655 - RNA, 23 nt, Mycobacterium avium subsp. paratuberculosis
cgcagcgucucgaucgacgacgc

SEQ ID NO: 921656 - RNA, 19 nt, Mycobacterium avium subsp. paratuberculosis
cgcagcgucaucgcguagu

SEQ ID NO: 921657 - RNA, 13 nt, Mycobacterium avium subsp. paratuberculosis
cgcagcggggagg

SEQ ID NO: 921658 - RNA, 22 nt, Mycobacterium avium subsp. paratuberculosis
cgcagcggggaggcccagcccg

SEQ ID NO: 921659 - RNA, 16 nt, Mycobacterium avium subsp. paratuberculosis
cgcagcggggcgcgca

SEQ ID NO: 921660 - RNA, 17 nt, Mycobacterium avium subsp. paratuberculosis
cgcagcggggcgcgcag

SEQ ID NO: 921661 - RNA, 17 nt, Mycobacterium avium subsp. paratuberculosis
cgcagcggugcagcccc

SEQ ID NO: 921662 - RNA, 18 nt, Mycobacterium avium subsp. paratuberculosis
cgcagcggugcagccccg

SEQ ID NO: 921663 - RNA, 19 nt, Mycobacterium avium subsp. paratuberculosis
cgcagcggugcagccccgc

SEQ ID NO: 921664 - RNA, 18 nt, Mycobacterium avium subsp. paratuberculosis
cgcagcggcuugaccggc

SEQ ID NO: 921665 - RNA, 21 nt, Mycobacterium avium subsp. paratuberculosis
cgcagcggcuugaccggcucg

SEQ ID NO: 921666 - RNA, 13 nt, Mycobacterium avium subsp. paratuberculosis
cgcagcggcccga

SEQ ID NO: 921667 - RNA, 14 nt, Mycobacterium avium subsp. paratuberculosis
cgcagcggcgccgc

SEQ ID NO: 921668 - RNA, 15 nt, Mycobacterium avium subsp. paratuberculosis
cgcagcggcgccggg

SEQ ID NO: 921669 - RNA, 19 nt, Mycobacterium avium subsp. paratuberculosis
cgcagcggcgccgggaucg

SEQ ID NO: 921670 - RNA, 12 nt, Mycobacterium avium subsp. paratuberculosis
cgcagcggcggc

SEQ ID NO: 921671 - RNA, 15 nt, Mycobacterium avium subsp. paratuberculosis
cgcagcggcggcacg

SEQ ID NO: 921672 - RNA, 18 nt, Mycobacterium avium subsp. paratuberculosis
cgcagcggcggcacgguu

SEQ ID NO: 921673 - RNA, 17 nt, Mycobacterium avium subsp. paratuberculosis
cgcagcggcggcucguc

SEQ ID NO: 921674 - RNA, 21 nt, Mycobacterium avium subsp. paratuberculosis
cgcagcggcggcucguccagc

SEQ ID NO: 921675 - RNA, 17 nt, Mycobacterium avium subsp. paratuberculosis
cgcagcggcaggucguc

SEQ ID NO: 921676 - RNA, 15 nt, Mycobacterium avium subsp. paratuberculosis
cgcagcggcacgucg

SEQ ID NO: 921677 - RNA, 15 nt, Mycobacterium avium subsp. paratuberculosis
cgcagcgcgucgggc

SEQ ID NO: 921678 - RNA, 16 nt, Mycobacterium avium subsp. paratuberculosis
cgcagcgcgucgggcu

SEQ ID NO: 921679 - RNA, 14 nt, Mycobacterium avium subsp. paratuberculosis
cgcagcgcgucguc

SEQ ID NO: 921680 - RNA, 18 nt, Mycobacterium avium subsp. paratuberculosis
cgcagcgcgucgcgcccg

SEQ ID NO: 921681 - RNA, 13 nt, Mycobacterium avium subsp. paratuberculosis
cgcagcgcgucgg

SEQ ID NO: 921682 - RNA, 13 nt, Mycobacterium avium subsp. paratuberculosis
cgcagcgcggcga

SEQ ID NO: 921683 - RNA, 14 nt, Mycobacterium avium subsp. paratuberculosis
cgcagcgcggcgac

SEQ ID NO: 921684 - RNA, 13 nt, Mycobacterium avium subsp. paratuberculosis
cgcagcgcggcgg

SEQ ID NO: 921685 - RNA, 15 nt, Mycobacterium avium subsp. paratuberculosis
cgcagcgcggcggag

SEQ ID NO: 921686 - RNA, 21 nt, Mycobacterium avium subsp. paratuberculosis
cgcagcgcggcggaggucagc

SEQ ID NO: 921687 - RNA, 14 nt, Mycobacterium avium subsp. paratuberculosis
cgcagccggccgac

SEQ ID NO: 921688 - RNA, 15 nt, Mycobacterium avium subsp. paratuberculosis
cgcagccggccgacc

SEQ ID NO: 921689 - RNA, 16 nt, Mycobacterium avium subsp. paratuberculosis
cgcagccggccgaccg

SEQ ID NO: 921690 - RNA, 18 nt, Mycobacterium avium subsp. paratuberculosis
cgcagccggccgaccgcc

SEQ ID NO: 921691 - RNA, 17 nt, Mycobacterium avium subsp. paratuberculosis
cgcagcgcgcgcucggu

SEQ ID NO: 921692 - RNA, 12 nt, Mycobacterium avium subsp. paratuberculosis
cgcagcgcgcgg

SEQ ID NO: 921693 - RNA, 14 nt, Mycobacterium avium subsp. paratuberculosis
cgcagcgcgcggcg

SEQ ID NO: 921694 - RNA, 18 nt, Mycobacterium avium subsp. paratuberculosis
cgcagcgcgcggcgcaga

SEQ ID NO: 921695 - RNA, 15 nt, Mycobacterium avium subsp. paratuberculosis
cgcagcgcgcgggug

SEQ ID NO: 921696 - RNA, 14 nt, Mycobacterium avium subsp. paratuberculosis
cgcagccgcgcccg

SEQ ID NO: 921697 - RNA, 16 nt, Mycobacterium avium subsp. paratuberculosis
cgcagccgcgcccgau

SEQ ID NO: 921698 - RNA, 17 nt, Mycobacterium avium subsp. paratuberculosis
cgcagccgcgcccgaug

SEQ ID NO: 921699 - RNA, 15 nt, Mycobacterium avium subsp. paratuberculosis
cgcagccgcugcagc

SEQ ID NO: 921700 - RNA, 18 nt, Mycobacterium avium subsp. paratuberculosis
cgcagccgcugcagcgcc

SEQ ID NO: 921701 - RNA, 19 nt, Mycobacterium avium subsp. paratuberculosis
cgcagccgcugcagcgccg

SEQ ID NO: 921702 - RNA, 23 nt, Mycobacterium avium subsp. paratuberculosis
cgcagccgcugcagcgccgcccg

SEQ ID NO: 921703 - RNA, 18 nt, Mycobacterium avium subsp. paratuberculosis
cgcagccgcuggccgcgc

SEQ ID NO: 921704 - RNA, 19 nt, Mycobacterium avium subsp. paratuberculosis
cgcagccgcuggccgcgcc

SEQ ID NO: 921705 - RNA, 13 nt, Mycobacterium avium subsp. paratuberculosis
cgcagccggcagc

SEQ ID NO: 921706 - RNA, 17 nt, Mycobacterium avium subsp. paratuberculosis
cgcagccggccaccgcc

SEQ ID NO: 921707 - RNA, 20 nt, Mycobacterium avium subsp. paratuberculosis
cgcagccggccaccgcccca

SEQ ID NO: 921708 - RNA, 14 nt, Mycobacterium avium subsp. paratuberculosis
cgcagccgcgcggc

SEQ ID NO: 921709 - RNA, 17 nt, Mycobacterium avium subsp. paratuberculosis
cgcagccgcgcggccgg

SEQ ID NO: 921710 - RNA, 18 nt, Mycobacterium avium subsp. paratuberculosis
cgcagccgcgcggccggc

SEQ ID NO: 921711 - RNA, 12 nt, Mycobacterium avium subsp. paratuberculosis
cgcagccgccgg

SEQ ID NO: 921712 - RNA, 14 nt, Mycobacterium avium subsp. paratuberculosis
cgcagccgccgggc

SEQ ID NO: 921713 - RNA, 17 nt, Mycobacterium avium subsp. paratuberculosis
cgcagccgcgacggcgg

SEQ ID NO: 921714 - RNA, 16 nt, Mycobacterium avium subsp. paratuberculosis
cgcagccgcgagucga

SEQ ID NO: 921715 - RNA, 18 nt, Mycobacterium avium subsp. paratuberculosis
cgcagccgcgagucgagg

SEQ ID NO: 921716 - RNA, 14 nt, Mycobacterium avium subsp. paratuberculosis
cgcagcaacgguac

SEQ ID NO: 921717 - RNA, 21 nt, Mycobacterium avium subsp. paratuberculosis
cgcagcaacgguacgugcgcc

SEQ ID NO: 921718 - RNA, 13 nt, Mycobacterium avium subsp. paratuberculosis
cgcagauggucgg

SEQ ID NO: 921719 - RNA, 15 nt, Mycobacterium avium subsp. paratuberculosis
cgcagauggucggga

SEQ ID NO: 921720 - RNA, 22 nt, Mycobacterium avium subsp. paratuberculosis
cgcagauggucgggacgucggc

SEQ ID NO: 921721 - RNA, 23 nt, Mycobacterium avium subsp. paratuberculosis
cgcagauggucgggacgucggcg

SEQ ID NO: 921722 - RNA, 15 nt, Mycobacterium avium subsp. paratuberculosis
cgcagaugaccggcc

SEQ ID NO: 921723 - RNA, 17 nt, Mycobacterium avium subsp. paratuberculosis
cgcagaugaccggccug

SEQ ID NO: 921724 - RNA, 16 nt, Mycobacterium avium subsp. paratuberculosis
cgcagcaucacgucgg

SEQ ID NO: 921725 - RNA, 18 nt, Mycobacterium avium subsp. paratuberculosis
cgcagcaucacgucggcg

SEQ ID NO: 921726 - RNA, 17 nt, Mycobacterium avium subsp. paratuberculosis
cgcagcaggugcaucgc

SEQ ID NO: 921727 - RNA, 18 nt, Mycobacterium avium subsp. paratuberculosis
cgcagcaggugcaucgcc

SEQ ID NO: 921728 - RNA, 13 nt, Mycobacterium avium subsp. paratuberculosis
cgcagcaggugcg

SEQ ID NO: 921729 - RNA, 15 nt, Mycobacterium avium subsp. paratuberculosis
cgcagcaggugcgcc

SEQ ID NO: 921730 - RNA, 21 nt, Mycobacterium avium subsp. paratuberculosis
cgcagcaggugcgccagaucg

SEQ ID NO: 921731 - RNA, 19 nt, Mycobacterium avium subsp. paratuberculosis
cgcagcagguaaaccagca

SEQ ID NO: 921732 - RNA, 21 nt, Mycobacterium avium subsp. paratuberculosis
cgcagcagguaaaccagcagc

SEQ ID NO: 921733 - RNA, 22 nt, Mycobacterium avium subsp. paratuberculosis
cgcagcagguaaaccagcagcg

SEQ ID NO: 921734 - RNA, 15 nt, Mycobacterium avium subsp. paratuberculosis
cgcagcaggcggacg

SEQ ID NO: 921735 - RNA, 16 nt, Mycobacterium avium subsp. paratuberculosis
cgcagcaggcggacgg

SEQ ID NO: 921736 - RNA, 17 nt, Mycobacterium avium subsp. paratuberculosis
cgcagcaauugacgccg

SEQ ID NO: 921737 - RNA, 19 nt, Mycobacterium avium subsp. paratuberculosis
cgcagcaggcgccggucgu

SEQ ID NO: 921738 - RNA, 21 nt, Mycobacterium avium subsp. paratuberculosis
cgcagcaucuccgagucggcg

SEQ ID NO: 921739 - RNA, 16 nt, Mycobacterium avium subsp. paratuberculosis
cgcagcauccgcacca

SEQ ID NO: 921740 - RNA, 18 nt, Mycobacterium avium subsp. paratuberculosis
cgcagcauccgcaccagg

SEQ ID NO: 921741 - RNA, 17 nt, Mycobacterium avium subsp. paratuberculosis
cgcagcccccggaccac

SEQ ID NO: 921742 - RNA, 18 nt, Mycobacterium avium subsp. paratuberculosis
cgcagcccaggcccagca

SEQ ID NO: 921743 - RNA, 16 nt, Mycobacterium avium subsp. paratuberculosis
cgcagccgaucgacga

SEQ ID NO: 921744 - RNA, 21 nt, Mycobacterium avium subsp. paratuberculosis
cgcagccgaucucguagccca

SEQ ID NO: 921745 - RNA, 21 nt, Mycobacterium avium subsp. paratuberculosis
cgcagcccguacuugcuggcg

SEQ ID NO: 921746 - RNA, 13 nt, Mycobacterium avium subsp. paratuberculosis
cgcagcccgucga

SEQ ID NO: 921747 - RNA, 16 nt, Mycobacterium avium subsp. paratuberculosis
cgcagcccgucgaucc

SEQ ID NO: 921748 - RNA, 17 nt, Mycobacterium avium subsp. paratuberculosis
cgcagcccgagcggcau

SEQ ID NO: 921749 - RNA, 18 nt, Mycobacterium avium subsp. paratuberculosis
cgcagcccgagcggcauc

SEQ ID NO: 921750 - RNA, 19 nt, Mycobacterium avium subsp. paratuberculosis
cgcagcccgagcggcauca

SEQ ID NO: 921751 - RNA, 20 nt, Mycobacterium avium subsp. paratuberculosis
cgcagcccgagcggcaucag

SEQ ID NO: 921752 - RNA, 15 nt, Mycobacterium avium subsp. paratuberculosis
cgcagcccgaucgcc

SEQ ID NO: 921753 - RNA, 21 nt, Mycobacterium avium subsp. paratuberculosis
cgcagcccgaucgccagcgcc

SEQ ID NO: 921754 - RNA, 22 nt, Mycobacterium avium subsp. paratuberculosis
cgcagcccgaucgccagcgccc

SEQ ID NO: 921755 - RNA, 14 nt, Mycobacterium avium subsp. paratuberculosis
cgcagcccgccagg

SEQ ID NO: 921756 - RNA, 12 nt, Mycobacterium avium subsp. paratuberculosis
cgcagcccgccg

SEQ ID NO: 921757 - RNA, 13 nt, Mycobacterium avium subsp. paratuberculosis
cgcagcccgccgg

SEQ ID NO: 921758 - RNA, 15 nt, Mycobacterium avium subsp. paratuberculosis
cgcagcccgccggga

SEQ ID NO: 921759 - RNA, 21 nt, Mycobacterium avium subsp. paratuberculosis
cgcagauacaucucgguggug

SEQ ID NO: 921760 - RNA, 16 nt, Mycobacterium avium subsp. paratuberculosis
cgcagauagaucgacg

SEQ ID NO: 921761 - RNA, 22 nt, Mycobacterium avium subsp. paratuberculosis
cgcagauagaucgacgcgaccu

SEQ ID NO: 921762 - RNA, 15 nt, Mycobacterium avium subsp. paratuberculosis
cgcagaucccgccgg

SEQ ID NO: 921763 - RNA, 19 nt, Mycobacterium avium subsp. paratuberculosis
cgcagaucccgccggcggc

SEQ ID NO: 921764 - RNA, 22 nt, Mycobacterium avium subsp. paratuberculosis
cgcagaucgagaucagggcgcg

SEQ ID NO: 921765 - RNA, 24 nt, Mycobacterium avium subsp. paratuberculosis
cgcagaucgagaucagggcgcgca

SEQ ID NO: 921766 - RNA, 17 nt, Mycobacterium avium subsp. paratuberculosis
cgcagaucgauggggau

SEQ ID NO: 921767 - RNA, 16 nt, Mycobacterium avium subsp. paratuberculosis
cgcagaucgccagcac

SEQ ID NO: 921768 - RNA, 15 nt, Mycobacterium avium subsp. paratuberculosis
cgcagaucgcgcauc

SEQ ID NO: 921769 - RNA, 22 nt, Mycobacterium avium subsp. paratuberculosis
cgcagaucgcgcaucacccggc

SEQ ID NO: 921770 - RNA, 13 nt, Mycobacterium avium subsp. paratuberculosis
cgcagaucgucga

SEQ ID NO: 921771 - RNA, 15 nt, Mycobacterium avium subsp. paratuberculosis
cgcagaucgucgaac

SEQ ID NO: 921772 - RNA, 14 nt, Mycobacterium avium subsp. paratuberculosis
cgcagaucgucgac

SEQ ID NO: 921773 - RNA, 15 nt, Mycobacterium avium subsp. paratuberculosis
cgcagaucgucgacc

SEQ ID NO: 921774 - RNA, 17 nt, Mycobacterium avium subsp. paratuberculosis
cgcagacguagcaccag

SEQ ID NO: 921775 - RNA, 18 nt, Mycobacterium avium subsp. paratuberculosis
cgcagacguagcaccagu

SEQ ID NO: 921776 - RNA, 16 nt, Mycobacterium avium subsp. paratuberculosis
cgcagacccucguucg

SEQ ID NO: 921777 - RNA, 19 nt, Mycobacterium avium subsp. paratuberculosis
cgcagaagcuaacgccagc

SEQ ID NO: 921778 - RNA, 19 nt, Mycobacterium avium subsp. paratuberculosis
cgcaccgccgggcauccgg

SEQ ID NO: 921779 - RNA, 13 nt, Mycobacterium avium subsp. paratuberculosis
cgcaccgccgucg

SEQ ID NO: 921780 - RNA, 14 nt, Mycobacterium avium subsp. paratuberculosis
cgcaccgccgucgg

SEQ ID NO: 921781 - RNA, 22 nt, Mycobacterium avium subsp. paratuberculosis
cgcaccgccgucggggcgucgg

SEQ ID NO: 921782 - RNA, 23 nt, Mycobacterium avium subsp. paratuberculosis
cgcaccgccgucggggcgucggc

SEQ ID NO: 921783 - RNA, 21 nt, Mycobacterium avium subsp. paratuberculosis
cgcaccgccuccucgaugucg

SEQ ID NO: 921784 - RNA, 22 nt, Mycobacterium avium subsp. paratuberculosis
cgcaccgccuccucgaugucgg

SEQ ID NO: 921785 - RNA, 13 nt, Mycobacterium avium subsp. paratuberculosis
cgcaccgccgcgg

SEQ ID NO: 921786 - RNA, 15 nt, Mycobacterium avium subsp. paratuberculosis
cgcaccgccagcacc

SEQ ID NO: 921787 - RNA, 17 nt, Mycobacterium avium subsp. paratuberculosis
cgcaccgccagcaccga

SEQ ID NO: 921788 - RNA, 13 nt, Mycobacterium avium subsp. paratuberculosis
cgcaccgccagca

SEQ ID NO: 921789 - RNA, 16 nt, Mycobacterium avium subsp. paratuberculosis
cgccaguuugccgucg

SEQ ID NO: 921790 - RNA, 18 nt, Mycobacterium avium subsp. paratuberculosis
cgccaguuugccgucggg

SEQ ID NO: 921791 - RNA, 16 nt, Mycobacterium avium subsp. paratuberculosis
cgccaguucgucggcc

SEQ ID NO: 921792 - RNA, 19 nt, Mycobacterium avium subsp. paratuberculosis
cgccaguucgucggccguc

SEQ ID NO: 921793 - RNA, 18 nt, Mycobacterium avium subsp. paratuberculosis
cgccaguugcucggguga

SEQ ID NO: 921794 - RNA, 16 nt, Mycobacterium avium subsp. paratuberculosis
cgccaguuguuggccg

SEQ ID NO: 921795 - RNA, 16 nt, Mycobacterium avium subsp. paratuberculosis
cgccaucaccagcgcg

SEQ ID NO: 921796 - RNA, 17 nt, Mycobacterium avium subsp. paratuberculosis
cgccaucaccagcgcgu

SEQ ID NO: 921797 - RNA, 15 nt, Mycobacterium avium subsp. paratuberculosis
cgccaucaccgcgcu

SEQ ID NO: 921798 - RNA, 14 nt, Mycobacterium avium subsp. paratuberculosis
cgccaucagcagcg

SEQ ID NO: 921799 - RNA, 21 nt, Mycobacterium avium subsp. paratuberculosis
cgccauccccgcuucggcucg

SEQ ID NO: 921800 - RNA, 13 nt, Mycobacterium avium subsp. paratuberculosis
cgccauccgcagc

SEQ ID NO: 921801 - RNA, 18 nt, Mycobacterium avium subsp. paratuberculosis
cgccauccgcagcccguc

SEQ ID NO: 921802 - RNA, 19 nt, Mycobacterium avium subsp. paratuberculosis
cgccauccgcagcccgucg

SEQ ID NO: 921803 - RNA, 14 nt, Mycobacterium avium subsp. paratuberculosis
cgccauccgccacc

SEQ ID NO: 921804 - RNA, 15 nt, Mycobacterium avium subsp. paratuberculosis
cgccauccguucggc

SEQ ID NO: 921805 - RNA, 20 nt, Mycobacterium avium subsp. paratuberculosis
cgccaucgcaccgcgagcag

SEQ ID NO: 921806 - RNA, 16 nt, Mycobacterium avium subsp. paratuberculosis
cgccaucgcccggugc

SEQ ID NO: 921807 - RNA, 17 nt, Mycobacterium avium subsp. paratuberculosis
cgccaucgcccggugcg

SEQ ID NO: 921808 - RNA, 14 nt, Mycobacterium avium subsp. paratuberculosis
cgccaucgccgccg

SEQ ID NO: 921809 - RNA, 16 nt, Mycobacterium avium subsp. paratuberculosis
cgccaucgccgccgcc

SEQ ID NO: 921810 - RNA, 13 nt, Mycobacterium avium subsp. paratuberculosis
cgccaucgccucg

SEQ ID NO: 921811 - RNA, 19 nt, Mycobacterium avium subsp. paratuberculosis
cgccaucgaucgggcgucg

SEQ ID NO: 921812 - RNA, 20 nt, Mycobacterium avium subsp. paratuberculosis
cgccauccugucauccgucg

SEQ ID NO: 921813 - RNA, 15 nt, Mycobacterium avium subsp. paratuberculosis
cgccaugaacggcgg

SEQ ID NO: 921814 - RNA, 16 nt, Mycobacterium avium subsp. paratuberculosis
cgccaugaacggcggg

SEQ ID NO: 921815 - RNA, 17 nt, Mycobacterium avium subsp. paratuberculosis
cgccaugaacucgucca

SEQ ID NO: 921816 - RNA, 14 nt, Mycobacterium avium subsp. paratuberculosis
cgccaucguggccg

SEQ ID NO: 921817 - RNA, 16 nt, Mycobacterium avium subsp. paratuberculosis
cgccaucguggccgcg

SEQ ID NO: 921818 - RNA, 14 nt, Mycobacterium avium subsp. paratuberculosis
cgccaucggcaucg

SEQ ID NO: 921819 - RNA, 23 nt, Mycobacterium avium subsp. paratuberculosis
cgccaucggcaucgcgcgcggcg

SEQ ID NO: 921820 - RNA, 17 nt, Mycobacterium avium subsp. paratuberculosis
cgccaucgccucggcca

SEQ ID NO: 921821 - RNA, 18 nt, Mycobacterium avium subsp. paratuberculosis
cgccaucgccucggccac

SEQ ID NO: 921822 - RNA, 14 nt, Mycobacterium avium subsp. paratuberculosis
cgccaucgccucgu

SEQ ID NO: 921823 - RNA, 16 nt, Mycobacterium avium subsp. paratuberculosis
cgccaucgcggcguug

SEQ ID NO: 921824 - RNA, 13 nt, Mycobacterium avium subsp. paratuberculosis
cgccaggcggcga

SEQ ID NO: 921825 - RNA, 16 nt, Mycobacterium avium subsp. paratuberculosis
cgccaggccggcgacg

SEQ ID NO: 921826 - RNA, 19 nt, Mycobacterium avium subsp. paratuberculosis
cgccaggccggcgacgccg

SEQ ID NO: 921827 - RNA, 22 nt, Mycobacterium avium subsp. paratuberculosis
cgccaggccggcgacgccggcg

SEQ ID NO: 921828 - RNA, 13 nt, Mycobacterium avium subsp. paratuberculosis
cgccaggcuggcc

SEQ ID NO: 921829 - RNA, 14 nt, Mycobacterium avium subsp. paratuberculosis
cgccaggcuggcca

SEQ ID NO: 921830 - RNA, 15 nt, Mycobacterium avium subsp. paratuberculosis
cgccaggcuggccag

SEQ ID NO: 921831 - RNA, 18 nt, Mycobacterium avium subsp. paratuberculosis
cgccaggcuggccaggcu

SEQ ID NO: 921832 - RNA, 15 nt, Mycobacterium avium subsp. paratuberculosis
cgccagggcgcggcg

SEQ ID NO: 921833 - RNA, 17 nt, Mycobacterium avium subsp. paratuberculosis
cgccagggcgcggcgca

SEQ ID NO: 921834 - RNA, 22 nt, Mycobacterium avium subsp. paratuberculosis
cgccagggcgcggcgcaccgag

SEQ ID NO: 921835 - RNA, 16 nt, Mycobacterium avium subsp. paratuberculosis
cgccagggcgacgccg

SEQ ID NO: 921836 - RNA, 18 nt, Mycobacterium avium subsp. paratuberculosis
cgccagggcgacgccgcg

SEQ ID NO: 921837 - RNA, 19 nt, Mycobacterium avium subsp. paratuberculosis
cgccagggcgacgccgcgg

SEQ ID NO: 921838 - RNA, 20 nt, Mycobacterium avium subsp. paratuberculosis
cgccagggcgacgccgcgga

SEQ ID NO: 921839 - RNA, 22 nt, Mycobacterium avium subsp. paratuberculosis
cgccagggccagguucaggccc

SEQ ID NO: 921840 - RNA, 18 nt, Mycobacterium avium subsp. paratuberculosis
cgccagggucuggcccgg

SEQ ID NO: 921841 - RNA, 19 nt, Mycobacterium avium subsp. paratuberculosis
cgccagggucuggcccggu

SEQ ID NO: 921842 - RNA, 16 nt, Mycobacterium avium subsp. paratuberculosis
cgccagggugccgcug

SEQ ID NO: 921843 - RNA, 23 nt, Mycobacterium avium subsp. paratuberculosis
cgccagggugccgcugcccgccg

SEQ ID NO: 921844 - RNA, 14 nt, Mycobacterium avium subsp. paratuberculosis
cgccagguuggcgg

SEQ ID NO: 921845 - RNA, 16 nt, Mycobacterium avium subsp. paratuberculosis
cgccagguuggcggcg

SEQ ID NO: 921846 - RNA, 17 nt, Mycobacterium avium subsp. paratuberculosis
cgccagguuggcggcgg

SEQ ID NO: 921847 - RNA, 22 nt, Mycobacterium avium subsp. paratuberculosis
cgccagguuggcggcggcccgc

SEQ ID NO: 921848 - RNA, 23 nt, Mycobacterium avium subsp. paratuberculosis
cgccagguuggcggcggcccgcg

SEQ ID NO: 921849 - RNA, 19 nt, Mycobacterium avium subsp. paratuberculosis
cgccaguaguggaucagcc

SEQ ID NO: 921850 - RNA, 21 nt, Mycobacterium avium subsp. paratuberculosis
cgccaggugggugaacgccug

SEQ ID NO: 921851 - RNA, 19 nt, Mycobacterium avium subsp. paratuberculosis
cgccagggucucgggcagc

SEQ ID NO: 921852 - RNA, 19 nt, Mycobacterium avium subsp. paratuberculosis
cgccagggccccguuggug

SEQ ID NO: 921853 - RNA, 19 nt, Mycobacterium avium subsp. paratuberculosis
cgccaggucgggguccagg

SEQ ID NO: 921854 - RNA, 16 nt, Mycobacterium avium subsp. paratuberculosis
cgccaguguggccgcg

SEQ ID NO: 921855 - RNA, 17 nt, Mycobacterium avium subsp. paratuberculosis
cgccaguguggccgcgg

SEQ ID NO: 921856 - RNA, 19 nt, Mycobacterium avium subsp. paratuberculosis
cgccaguguggccgcggcg

SEQ ID NO: 921857 - RNA, 14 nt, Mycobacterium avium subsp. paratuberculosis
cgccagugccgcgc

SEQ ID NO: 921858 - RNA, 16 nt, Mycobacterium avium subsp. paratuberculosis
cgccagugccgcgcgg

SEQ ID NO: 921859 - RNA, 19 nt, Mycobacterium avium subsp. paratuberculosis
cgccagugccgcgcggacg

SEQ ID NO: 921860 - RNA, 17 nt, Mycobacterium avium subsp. paratuberculosis
cgccagucgcggcgaac

SEQ ID NO: 921861 - RNA, 23 nt, Mycobacterium avium subsp. paratuberculosis
cgccagucgcggcgaaccagcau

SEQ ID NO: 921862 - RNA, 16 nt, Mycobacterium avium subsp. paratuberculosis
cgccaguccggcgccg

SEQ ID NO: 921863 - RNA, 18 nt, Mycobacterium avium subsp. paratuberculosis
cgccaguccggcgccgac

SEQ ID NO: 921864 - RNA, 14 nt, Mycobacterium avium subsp. paratuberculosis
cgccaguucccggc

SEQ ID NO: 921865 - RNA, 20 nt, Mycobacterium avium subsp. paratuberculosis
cgccagcaguguccagucgg

SEQ ID NO: 921866 - RNA, 23 nt, Mycobacterium avium subsp. paratuberculosis
cgccagcaguguccagucggccg

SEQ ID NO: 921867 - RNA, 22 nt, Mycobacterium avium subsp. paratuberculosis
cgccagcagaugccgcccaggu

SEQ ID NO: 921868 - RNA, 11 nt, Mycobacterium avium subsp. paratuberculosis
cgccagcagca

SEQ ID NO: 921869 - RNA, 14 nt, Mycobacterium avium subsp. paratuberculosis
cgccagcagcaacg

SEQ ID NO: 921870 - RNA, 19 nt, Mycobacterium avium subsp. paratuberculosis
cgccagcagcaacgcggug

SEQ ID NO: 921871 - RNA, 15 nt, Mycobacterium avium subsp. paratuberculosis
cgccagcagcaccug

SEQ ID NO: 921872 - RNA, 13 nt, Mycobacterium avium subsp. paratuberculosis
cgccagcaccggc

SEQ ID NO: 921873 - RNA, 19 nt, Mycobacterium avium subsp. paratuberculosis
cgccagcaccuucgggccg

SEQ ID NO: 921874 - RNA, 14 nt, Mycobacterium avium subsp. paratuberculosis
cgccagcacggugu

SEQ ID NO: 921875 - RNA, 14 nt, Mycobacterium avium subsp. paratuberculosis
cgccagcacgugau

SEQ ID NO: 921876 - RNA, 18 nt, Mycobacterium avium subsp. paratuberculosis
cgccagcacguggccggg

SEQ ID NO: 921877 - RNA, 21 nt, Mycobacterium avium subsp. paratuberculosis
cgccagcacguggccgggcuc

SEQ ID NO: 921878 - RNA, 23 nt, Mycobacterium avium subsp. paratuberculosis
cgccagcacguggccgggcucga

SEQ ID NO: 921879 - RNA, 15 nt, Mycobacterium avium subsp. paratuberculosis
cgccagcacggccac

SEQ ID NO: 921880 - RNA, 16 nt, Mycobacterium avium subsp. paratuberculosis
cgccagcacggccacc

SEQ ID NO: 921881 - RNA, 20 nt, Mycobacterium avium subsp. paratuberculosis
cgccagcacggccaccagca

SEQ ID NO: 921882 - RNA, 24 nt, Mycobacterium avium subsp. paratuberculosis
cgccagcacggccaccagcagcga

SEQ ID NO: 921883 - RNA, 15 nt, Mycobacterium avium subsp. paratuberculosis
cgccagcaccggcgc

SEQ ID NO: 921884 - RNA, 17 nt, Mycobacterium avium subsp. paratuberculosis
cgccagcaccggcgcgc

SEQ ID NO: 921885 - RNA, 19 nt, Mycobacterium avium subsp. paratuberculosis
cgccagcaccggcgcgccg

SEQ ID NO: 921886 - RNA, 17 nt, Mycobacterium avium subsp. paratuberculosis
cgccagcaccgggccca

SEQ ID NO: 921887 - RNA, 19 nt, Mycobacterium avium subsp. paratuberculosis
cgccagcaccucgaacgcc

SEQ ID NO: 921888 - RNA, 22 nt, Mycobacterium avium subsp. paratuberculosis
cgccagcaccucgaacgccggu

SEQ ID NO: 921889 - RNA, 16 nt, Mycobacterium avium subsp. paratuberculosis
cgccagcaccucggcg

SEQ ID NO: 921890 - RNA, 19 nt, Mycobacterium avium subsp. paratuberculosis
cgccagcaccucggcgacc

SEQ ID NO: 921891 - RNA, 22 nt, Mycobacterium avium subsp. paratuberculosis
cgccagcaccucggcgaccacg

SEQ ID NO: 921892 - RNA, 21 nt, Mycobacterium avium subsp. paratuberculosis
cgccagcaccaccgucaccgc

SEQ ID NO: 921893 - RNA, 14 nt, Mycobacterium avium subsp. paratuberculosis
cgccagcaccaccu

SEQ ID NO: 921894 - RNA, 21 nt, Mycobacterium avium subsp. paratuberculosis
cgccagcaccaccucgcgcgg

SEQ ID NO: 921895 - RNA, 22 nt, Mycobacterium avium subsp. paratuberculosis
cgccagcaccaccucgcgcggg

SEQ ID NO: 921896 - RNA, 18 nt, Mycobacterium avium subsp. paratuberculosis
cgccagcaccgacagcuu

SEQ ID NO: 921897 - RNA, 19 nt, Mycobacterium avium subsp. paratuberculosis
cgccagcaccgacgcgccg

SEQ ID NO: 921898 - RNA, 12 nt, Mycobacterium avium subsp. paratuberculosis
cgccagcaccgc

SEQ ID NO: 921899 - RNA, 15 nt, Mycobacterium avium subsp. paratuberculosis
cgccagcaccgccac

SEQ ID NO: 921900 - RNA, 19 nt, Mycobacterium avium subsp. paratuberculosis
cgccagcaccgccaccggc

SEQ ID NO: 921901 - RNA, 24 nt, Mycobacterium avium subsp. paratuberculosis
cgccagcaccgccaccggcccggc

SEQ ID NO: 921902 - RNA, 17 nt, Mycobacterium avium subsp. paratuberculosis
cgccagcaccgcggggg

SEQ ID NO: 921903 - RNA, 19 nt, Mycobacterium avium subsp. paratuberculosis
cgccagcaccgcgggggcg

SEQ ID NO: 921904 - RNA, 13 nt, Mycobacterium avium subsp. paratuberculosis
cgccagccagccg

SEQ ID NO: 921905 - RNA, 20 nt, Mycobacterium avium subsp. paratuberculosis
cgccagcauccgcuggugcg

SEQ ID NO: 921906 - RNA, 20 nt, Mycobacterium avium subsp. paratuberculosis
cgccagcaucgagaugcugu

SEQ ID NO: 921907 - RNA, 16 nt, Mycobacterium avium subsp. paratuberculosis
cgccagccaggcgaug

SEQ ID NO: 921908 - RNA, 16 nt, Mycobacterium avium subsp. paratuberculosis
cgccagccagccggug

SEQ ID NO: 921909 - RNA, 18 nt, Mycobacterium avium subsp. paratuberculosis
cgccagccagccggugcg

SEQ ID NO: 921910 - RNA, 12 nt, Mycobacterium avium subsp. paratuberculosis
cgccagccgccg

SEQ ID NO: 921911 - RNA, 13 nt, Mycobacterium avium subsp. paratuberculosis
cgccagccgccgc

SEQ ID NO: 921912 - RNA, 14 nt, Mycobacterium avium subsp. paratuberculosis
cgccagccgccgcc

SEQ ID NO: 921913 - RNA, 17 nt, Mycobacterium avium subsp. paratuberculosis
cgccagccgccgccgac

SEQ ID NO: 921914 - RNA, 19 nt, Mycobacterium avium subsp. paratuberculosis
cgccagccgccgccgacca

SEQ ID NO: 921915 - RNA, 14 nt, Mycobacterium avium subsp. paratuberculosis
cgccagccgccggc

SEQ ID NO: 921916 - RNA, 15 nt, Mycobacterium avium subsp. paratuberculosis
cgccagccgccggcu

SEQ ID NO: 921917 - RNA, 20 nt, Mycobacterium avium subsp. paratuberculosis
cgccagccgccggcucagcg

SEQ ID NO: 921918 - RNA, 23 nt, Mycobacterium avium subsp. paratuberculosis
cgccagccgccggcucagcggca

SEQ ID NO: 921919 - RNA, 19 nt, Mycobacterium avium subsp. paratuberculosis
cgccagcgcggcggcgccg

SEQ ID NO: 921920 - RNA, 23 nt, Mycobacterium avium subsp. paratuberculosis
cgccagcgcggcggcgccgucgc

SEQ ID NO: 921921 - RNA, 15 nt, Mycobacterium avium subsp. paratuberculosis
cgccagcuccagcag

SEQ ID NO: 921922 - RNA, 16 nt, Mycobacterium avium subsp. paratuberculosis
cgccagcuccagcagc

SEQ ID NO: 921923 - RNA, 19 nt, Mycobacterium avium subsp. paratuberculosis
cgccagcuccagcagcccg

SEQ ID NO: 921924 - RNA, 23 nt, Mycobacterium avium subsp. paratuberculosis
cgccagcguggcgaacgcgaccu

SEQ ID NO: 921925 - RNA, 20 nt, Mycobacterium avium subsp. paratuberculosis
cgccagcgugaacagcgccc

SEQ ID NO: 921926 - RNA, 13 nt, Mycobacterium avium subsp. paratuberculosis
cgccagcgugacg

SEQ ID NO: 921927 - RNA, 17 nt, Mycobacterium avium subsp. paratuberculosis
cgccagcgugacgcccg

SEQ ID NO: 921928 - RNA, 19 nt, Mycobacterium avium subsp. paratuberculosis
cgccagcgugacgcccggc

SEQ ID NO: 921929 - RNA, 21 nt, Mycobacterium avium subsp. paratuberculosis
cgccagcgugacgcccggcgc

SEQ ID NO: 921930 - RNA, 22 nt, Mycobacterium avium subsp. paratuberculosis
cgccagcgugacgcccggcgcc

SEQ ID NO: 921931 - RNA, 17 nt, Mycobacterium avium subsp. paratuberculosis
cgccagcgugacgccgg

SEQ ID NO: 921932 - RNA, 20 nt, Mycobacterium avium subsp. paratuberculosis
cgccagcgugacgccgggcc

SEQ ID NO: 921933 - RNA, 13 nt, Mycobacterium avium subsp. paratuberculosis
cgccagcgugagc

SEQ ID NO: 921934 - RNA, 12 nt, Mycobacterium avium subsp. paratuberculosis
cgccagcucggc

SEQ ID NO: 921935 - RNA, 13 nt, Mycobacterium avium subsp. paratuberculosis
cgccagcgcgacc

SEQ ID NO: 921936 - RNA, 16 nt, Mycobacterium avium subsp. paratuberculosis
cgccagcgcgacccgc

SEQ ID NO: 921937 - RNA, 17 nt, Mycobacterium avium subsp. paratuberculosis
cgccagcgcgacccgcu

SEQ ID NO: 921938 - RNA, 18 nt, Mycobacterium avium subsp. paratuberculosis
cgccagcgcgacccgcuc

SEQ ID NO: 921939 - RNA, 19 nt, Mycobacterium avium subsp. paratuberculosis
cgccagcgcgacccgcucg

SEQ ID NO: 921940 - RNA, 14 nt, Mycobacterium avium subsp. paratuberculosis
cgccagcgccgggu

SEQ ID NO: 921941 - RNA, 13 nt, Mycobacterium avium subsp. paratuberculosis
cgccagcgccggg

SEQ ID NO: 921942 - RNA, 22 nt, Mycobacterium avium subsp. paratuberculosis
cgccagcgcgcagaacaccacc

SEQ ID NO: 921943 - RNA, 12 nt, Mycobacterium avium subsp. paratuberculosis
cgccagcgcggc

SEQ ID NO: 921944 - RNA, 17 nt, Mycobacterium avium subsp. paratuberculosis
cgccagcgcggggucgg

SEQ ID NO: 921945 - RNA, 21 nt, Mycobacterium avium subsp. paratuberculosis
cgccagcgcggggucggccag

SEQ ID NO: 921946 - RNA, 12 nt, Mycobacterium avium subsp. paratuberculosis
cgccagcgcggu

SEQ ID NO: 921947 - RNA, 13 nt, Mycobacterium avium subsp. paratuberculosis
cgccagcgcggug

SEQ ID NO: 921948 - RNA, 15 nt, Mycobacterium avium subsp. paratuberculosis
cgccagcgcgguguc

SEQ ID NO: 921949 - RNA, 22 nt, Mycobacterium avium subsp. paratuberculosis
cgccagcgcggugucgacgucg

SEQ ID NO: 921950 - RNA, 14 nt, Mycobacterium avium subsp. paratuberculosis
cgccagcgcgcccg

SEQ ID NO: 921951 - RNA, 14 nt, Mycobacterium avium subsp. paratuberculosis
cgccagcgcggcgg

SEQ ID NO: 921952 - RNA, 15 nt, Mycobacterium avium subsp. paratuberculosis
cgccagcgcggcggc

SEQ ID NO: 921953 - RNA, 13 nt, Mycobacterium avium subsp. paratuberculosis
cgccagcgcggcg

SEQ ID NO: 921954 - RNA, 15 nt, Mycobacterium avium subsp. paratuberculosis
cgccagccguccugg

SEQ ID NO: 921955 - RNA, 21 nt, Mycobacterium avium subsp. paratuberculosis
cgccagccgucgccgcgcccg

SEQ ID NO: 921956 - RNA, 22 nt, Mycobacterium avium subsp. paratuberculosis
cgccagccgucgccgcgcccgc

SEQ ID NO: 921957 - RNA, 19 nt, Mycobacterium avium subsp. paratuberculosis
cgccagccgguacggaucg

SEQ ID NO: 921958 - RNA, 22 nt, Mycobacterium avium subsp. paratuberculosis
cgccagccgguacggaucgccg

SEQ ID NO: 921959 - RNA, 13 nt, Mycobacterium avium subsp. paratuberculosis
cgccagccgguca

SEQ ID NO: 921960 - RNA, 18 nt, Mycobacterium avium subsp. paratuberculosis
cgccagccggucaucgcg

SEQ ID NO: 921961 - RNA, 22 nt, Mycobacterium avium subsp. paratuberculosis
cgccagacugaugcccucgccg

SEQ ID NO: 921962 - RNA, 15 nt, Mycobacterium avium subsp. paratuberculosis
cgccagacguccagc

SEQ ID NO: 921963 - RNA, 21 nt, Mycobacterium avium subsp. paratuberculosis
cgccagacguccagcgccgcc

SEQ ID NO: 921964 - RNA, 22 nt, Mycobacterium avium subsp. paratuberculosis
cgccagacguccagcgccgcca

SEQ ID NO: 921965 - RNA, 18 nt, Mycobacterium avium subsp. paratuberculosis
cgccagacucacggcggc

SEQ ID NO: 921966 - RNA, 22 nt, Mycobacterium avium subsp. paratuberculosis
cgccagaccgguugcggcgaac

SEQ ID NO: 921967 - RNA, 13 nt, Mycobacterium avium subsp. paratuberculosis
cgccagcaccacc

SEQ ID NO: 921968 - RNA, 17 nt, Mycobacterium avium subsp. paratuberculosis
cgccagcaaccccgcgg

SEQ ID NO: 921969 - RNA, 22 nt, Mycobacterium avium subsp. paratuberculosis
cgccagcaaccccgcggugcac

SEQ ID NO: 921970 - RNA, 15 nt, Mycobacterium avium subsp. paratuberculosis
cgccagcaacgaccc

SEQ ID NO: 921971 - RNA, 20 nt, Mycobacterium avium subsp. paratuberculosis
cgccagcaacgacccggcca

SEQ ID NO: 921972 - RNA, 21 nt, Mycobacterium avium subsp. paratuberculosis
cgccagcaacgacccggccac

SEQ ID NO: 921973 - RNA, 23 nt, Mycobacterium avium subsp. paratuberculosis
cgccagcaacgacccggccaccg

SEQ ID NO: 921974 - RNA, 12 nt, Mycobacterium avium subsp. paratuberculosis
cgccagaaccgg

SEQ ID NO: 921975 - RNA, 13 nt, Mycobacterium avium subsp. paratuberculosis
cgccagaaccggc

SEQ ID NO: 921976 - RNA, 14 nt, Mycobacterium avium subsp. paratuberculosis
cgccacugccgccg

SEQ ID NO: 921977 - RNA, 15 nt, Mycobacterium avium subsp. paratuberculosis
cgccacugccgccgc

SEQ ID NO: 921978 - RNA, 23 nt, Mycobacterium avium subsp. paratuberculosis
cgccacugccgccgcccaggccg

SEQ ID NO: 921979 - RNA, 15 nt, Mycobacterium avium subsp. paratuberculosis
cgccacucgggcggc

SEQ ID NO: 921980 - RNA, 17 nt, Mycobacterium avium subsp. paratuberculosis
cgccacucgggcggccg

SEQ ID NO: 921981 - RNA, 18 nt, Mycobacterium avium subsp. paratuberculosis
cgccacucgggcggccgc

SEQ ID NO: 921982 - RNA, 20 nt, Mycobacterium avium subsp. paratuberculosis
cgccacucgggcggccgcgg

SEQ ID NO: 921983 - RNA, 14 nt, Mycobacterium avium subsp. paratuberculosis
cgccacucgucgac

SEQ ID NO: 921984 - RNA, 18 nt, Mycobacterium avium subsp. paratuberculosis
cgccacucgucgacguuc

SEQ ID NO: 921985 - RNA, 23 nt, Mycobacterium avium subsp. paratuberculosis
cgccacguaucgcgccugcaccg

SEQ ID NO: 921986 - RNA, 21 nt, Mycobacterium avium subsp. paratuberculosis
cgccacgucguucaugaucgg

SEQ ID NO: 921987 - RNA, 19 nt, Mycobacterium avium subsp. paratuberculosis
cgccacguccggaugcggc

SEQ ID NO: 921988 - RNA, 20 nt, Mycobacterium avium subsp. paratuberculosis
cgccacguccggaugcggcg

SEQ ID NO: 921989 - RNA, 19 nt, Mycobacterium avium subsp. paratuberculosis
cgccacgucgaacccgacc

SEQ ID NO: 921990 - RNA, 12 nt, Mycobacterium avium subsp. paratuberculosis
cgccacggccac

SEQ ID NO: 921991 - RNA, 13 nt, Mycobacterium avium subsp. paratuberculosis
cgccacggccagc

SEQ ID NO: 921992 - RNA, 14 nt, Mycobacterium avium subsp. paratuberculosis
cgccacggccagca

SEQ ID NO: 921993 - RNA, 15 nt, Mycobacterium avium subsp. paratuberculosis
cgccacggccagcac

SEQ ID NO: 921994 - RNA, 16 nt, Mycobacterium avium subsp. paratuberculosis
cgccacggccagcacc

SEQ ID NO: 921995 - RNA, 21 nt, Mycobacterium avium subsp. paratuberculosis
cgccacggccagcaccgccag

SEQ ID NO: 921996 - RNA, 20 nt, Mycobacterium avium subsp. paratuberculosis
cgccaccgucgucgagcgcu

SEQ ID NO: 921997 - RNA, 14 nt, Mycobacterium avium subsp. paratuberculosis
cgccaauccggcgg

SEQ ID NO: 921998 - RNA, 16 nt, Mycobacterium avium subsp. paratuberculosis
cgccaauccggcgggc

SEQ ID NO: 921999 - RNA, 23 nt, Mycobacterium avium subsp. paratuberculosis
cgccaauccggcgggccucgccg

SEQ ID NO: 922000 - RNA, 14 nt, Mycobacterium avium subsp. paratuberculosis
cgccaaucaccgcg

SEQ ID NO: 922001 - RNA, 17 nt, Mycobacterium avium subsp. paratuberculosis
cgccaaucaccgcggug

SEQ ID NO: 922002 - RNA, 19 nt, Mycobacterium avium subsp. paratuberculosis
cgccaagugcgguguggcc

SEQ ID NO: 922003 - RNA, 23 nt, Mycobacterium avium subsp. paratuberculosis
cgccaagugcgguguggccgcgg

SEQ ID NO: 922004 - RNA, 17 nt, Mycobacterium avium subsp. paratuberculosis
cgccaaggucgucaacg

SEQ ID NO: 922005 - RNA, 20 nt, Mycobacterium avium subsp. paratuberculosis
cgccaaggggaacaacgcgc

SEQ ID NO: 922006 - RNA, 14 nt, Mycobacterium avium subsp. paratuberculosis
cgccacgcuggcgu

SEQ ID NO: 922007 - RNA, 12 nt, Mycobacterium avium subsp. paratuberculosis
cgccacgcuggu

SEQ ID NO: 922008 - RNA, 22 nt, Mycobacterium avium subsp. paratuberculosis
cgccacgcuggugugacgcucg

SEQ ID NO: 922009 - RNA, 16 nt, Mycobacterium avium subsp. paratuberculosis
cgccacgcucaugccc

SEQ ID NO: 922010 - RNA, 21 nt, Mycobacterium avium subsp. paratuberculosis
cgccacgcucaugcccgccac

SEQ ID NO: 922011 - RNA, 12 nt, Mycobacterium avium subsp. paratuberculosis
cgccacgcuggc

SEQ ID NO: 922012 - RNA, 12 nt, Mycobacterium avium subsp. paratuberculosis
cgccacgcggcg

SEQ ID NO: 922013 - RNA, 14 nt, Mycobacterium avium subsp. paratuberculosis
cgccacgcggcgcg

SEQ ID NO: 922014 - RNA, 15 nt, Mycobacterium avium subsp. paratuberculosis
cgccacgcggcgcgc

SEQ ID NO: 922015 - RNA, 16 nt, Mycobacterium avium subsp. paratuberculosis
cgccacgcggcgcgca

SEQ ID NO: 922016 - RNA, 16 nt, Mycobacterium avium subsp. paratuberculosis
cgccacgcgucaggcg

SEQ ID NO: 922017 - RNA, 14 nt, Mycobacterium avium subsp. paratuberculosis
cgccacgaccagcg

SEQ ID NO: 922018 - RNA, 16 nt, Mycobacterium avium subsp. paratuberculosis
cgccacgaccagcggc

SEQ ID NO: 922019 - RNA, 17 nt, Mycobacterium avium subsp. paratuberculosis
cgccacgaccagcggca

SEQ ID NO: 922020 - RNA, 15 nt, Mycobacterium avium subsp. paratuberculosis
cgccacgacgcggcg

SEQ ID NO: 922021 - RNA, 23 nt, Mycobacterium avium subsp. paratuberculosis
cgccacgacguacccccgcacgc

SEQ ID NO: 922022 - RNA, 13 nt, Mycobacterium avium subsp. paratuberculosis
cgccacgccgugg

SEQ ID NO: 922023 - RNA, 19 nt, Mycobacterium avium subsp. paratuberculosis
cgccacgccguggcccgcc

SEQ ID NO: 922024 - RNA, 23 nt, Mycobacterium avium subsp. paratuberculosis
cgccacgccguggcccgcccagc

SEQ ID NO: 922025 - RNA, 13 nt, Mycobacterium avium subsp. paratuberculosis
cgccacgccguug

SEQ ID NO: 922026 - RNA, 15 nt, Mycobacterium avium subsp. paratuberculosis
cgccaccucggagau

SEQ ID NO: 922027 - RNA, 22 nt, Mycobacterium avium subsp. paratuberculosis
cgccaccucggagaugauggcc

SEQ ID NO: 922028 - RNA, 19 nt, Mycobacterium avium subsp. paratuberculosis
cgccaccuucaccgcgccg

SEQ ID NO: 922029 - RNA, 20 nt, Mycobacterium avium subsp. paratuberculosis
cgccaccuucaccgcgccgg

SEQ ID NO: 922030 - RNA, 13 nt, Mycobacterium avium subsp. paratuberculosis
cgagagcgcgucg

SEQ ID NO: 922031 - RNA, 13 nt, Mycobacterium avium subsp. paratuberculosis
cgagagccgcauc

SEQ ID NO: 922032 - RNA, 21 nt, Mycobacterium avium subsp. paratuberculosis
cgagaucuucuccccgccucg

SEQ ID NO: 922033 - RNA, 17 nt, Mycobacterium avium subsp. paratuberculosis
cgagaugaucagccgcc

SEQ ID NO: 922034 - RNA, 17 nt, Mycobacterium avium subsp. paratuberculosis
cgagaucggcagaccgg

SEQ ID NO: 922035 - RNA, 17 nt, Mycobacterium avium subsp. paratuberculosis
cgagaucgacgcugacc

SEQ ID NO: 922036 - RNA, 13 nt, Mycobacterium avium subsp. paratuberculosis
cgagaucgcgggc

SEQ ID NO: 922037 - RNA, 14 nt, Mycobacterium avium subsp. paratuberculosis
cgagaucgcggugg

SEQ ID NO: 922038 - RNA, 23 nt, Mycobacterium avium subsp. paratuberculosis
cgagaucccgguucccggcacca

SEQ ID NO: 922039 - RNA, 19 nt, Mycobacterium avium subsp. paratuberculosis
cgagaucaugccggcgaac

SEQ ID NO: 922040 - RNA, 15 nt, Mycobacterium avium subsp. paratuberculosis
cgagauccaccgcgc

SEQ ID NO: 922041 - RNA, 19 nt, Mycobacterium avium subsp. paratuberculosis
cgagauccaccgcgcggcc

SEQ ID NO: 922042 - RNA, 20 nt, Mycobacterium avium subsp. paratuberculosis
cgagauccaccgcgcggcca

SEQ ID NO: 922043 - RNA, 21 nt, Mycobacterium avium subsp. paratuberculosis
cgacugcacccgaacggaccg

SEQ ID NO: 922044 - RNA, 16 nt, Mycobacterium avium subsp. paratuberculosis
cgacucuuccaggaca

SEQ ID NO: 922045 - RNA, 17 nt, Mycobacterium avium subsp. paratuberculosis
cgacucggugucgcuca

SEQ ID NO: 922046 - RNA, 16 nt, Mycobacterium avium subsp. paratuberculosis
cgacucguucgacgcc

SEQ ID NO: 922047 - RNA, 16 nt, Mycobacterium avium subsp. paratuberculosis
cgacucguuggccggc

SEQ ID NO: 922048 - RNA, 18 nt, Mycobacterium avium subsp. paratuberculosis
cgacucguuggccggcuc

SEQ ID NO: 922049 - RNA, 13 nt, Mycobacterium avium subsp. paratuberculosis
cgagacggcgugg

SEQ ID NO: 922050 - RNA, 14 nt, Mycobacterium avium subsp. paratuberculosis
cgagacggcguggc

SEQ ID NO: 922051 - RNA, 13 nt, Mycobacterium avium subsp. paratuberculosis
cgagacgucggcg

SEQ ID NO: 922052 - RNA, 17 nt, Mycobacterium avium subsp. paratuberculosis
cgacugcaggugacgga

SEQ ID NO: 922053 - RNA, 22 nt, Mycobacterium avium subsp. paratuberculosis
cgacugaucgacgagccgggcc

SEQ ID NO: 922054 - RNA, 15 nt, Mycobacterium avium subsp. paratuberculosis
cgacugcgcggccgg

SEQ ID NO: 922055 - RNA, 16 nt, Mycobacterium avium subsp. paratuberculosis
cgacugcgcggccggc

SEQ ID NO: 922056 - RNA, 17 nt, Mycobacterium avium subsp. paratuberculosis
cgacugcgcggccggcg

SEQ ID NO: 922057 - RNA, 22 nt, Mycobacterium avium subsp. paratuberculosis
cgagauuggccucggcgcgggc

SEQ ID NO: 922058 - RNA, 20 nt, Mycobacterium avium subsp. paratuberculosis
cgagauguaguccuccgucg

SEQ ID NO: 922059 - RNA, 12 nt, Mycobacterium avium subsp. paratuberculosis
cgagaucgucgu

SEQ ID NO: 922060 - RNA, 15 nt, Mycobacterium avium subsp. paratuberculosis
cgagaucgucgugga

SEQ ID NO: 922061 - RNA, 15 nt, Mycobacterium avium subsp. paratuberculosis
cgagaugcguucggc

SEQ ID NO: 922062 - RNA, 20 nt, Mycobacterium avium subsp. paratuberculosis
cgagaugcguucggccgcag

SEQ ID NO: 922063 - RNA, 17 nt, Mycobacterium avium subsp. paratuberculosis
cgagaugccccaggcga

SEQ ID NO: 922064 - RNA, 14 nt, Mycobacterium avium subsp. paratuberculosis
cgagauggacagca

SEQ ID NO: 922065 - RNA, 14 nt, Mycobacterium avium subsp. paratuberculosis
cgagauggccacca

SEQ ID NO: 922066 - RNA, 15 nt, Mycobacterium avium subsp. paratuberculosis
cgagcaaggcgagca

SEQ ID NO: 922067 - RNA, 16 nt, Mycobacterium avium subsp. paratuberculosis
cgagcaaggcgagcac

SEQ ID NO: 922068 - RNA, 20 nt, Mycobacterium avium subsp. paratuberculosis
cgagcaaggcgagcacggca

SEQ ID NO: 922069 - RNA, 17 nt, Mycobacterium avium subsp. paratuberculosis
cgagcaccucgucgccg

SEQ ID NO: 922070 - RNA, 20 nt, Mycobacterium avium subsp. paratuberculosis
cgagcaccucgucgccgucg

SEQ ID NO: 922071 - RNA, 21 nt, Mycobacterium avium subsp. paratuberculosis
cgagcaccucgucgccgucgg

SEQ ID NO: 922072 - RNA, 18 nt, Mycobacterium avium subsp. paratuberculosis
cgagcaccugaacggccg

SEQ ID NO: 922073 - RNA, 21 nt, Mycobacterium avium subsp. paratuberculosis
cgagcaccugaacggccgcgc

SEQ ID NO: 922074 - RNA, 23 nt, Mycobacterium avium subsp. paratuberculosis
cgagcaccugaacggccgcgcag

SEQ ID NO: 922075 - RNA, 21 nt, Mycobacterium avium subsp. paratuberculosis
cgagcaaccgcaccuugcgcc

SEQ ID NO: 922076 - RNA, 15 nt, Mycobacterium avium subsp. paratuberculosis
cgagcaacuggguga

SEQ ID NO: 922077 - RNA, 14 nt, Mycobacterium avium subsp. paratuberculosis
cgagcaacggccgc

SEQ ID NO: 922078 - RNA, 15 nt, Mycobacterium avium subsp. paratuberculosis
cgagcaacggccgca

SEQ ID NO: 922079 - RNA, 16 nt, Mycobacterium avium subsp. paratuberculosis
cgagcaacggccgcag

SEQ ID NO: 922080 - RNA, 14 nt, Mycobacterium avium subsp. paratuberculosis
cgagcaacaccacc

SEQ ID NO: 922081 - RNA, 18 nt, Mycobacterium avium subsp. paratuberculosis
cgagcaacaccaccuugg

SEQ ID NO: 922082 - RNA, 20 nt, Mycobacterium avium subsp. paratuberculosis
cgagcagacacaaaagcacc

SEQ ID NO: 922083 - RNA, 23 nt, Mycobacterium avium subsp. paratuberculosis
cgagcagacacaaaagcacccaa

SEQ ID NO: 922084 - RNA, 20 nt, Mycobacterium avium subsp. paratuberculosis
cgagcagacacaaaagcgcc

SEQ ID NO: 922085 - RNA, 17 nt, Mycobacterium avium subsp. paratuberculosis
cgagcagacccgccgcg

SEQ ID NO: 922086 - RNA, 20 nt, Mycobacterium avium subsp. paratuberculosis
cgagcagacccgccgcggca

SEQ ID NO: 922087 - RNA, 21 nt, Mycobacterium avium subsp. paratuberculosis
cgagcagacccgccgcggcaa

SEQ ID NO: 922088 - RNA, 20 nt, Mycobacterium avium subsp. paratuberculosis
cgagcagacgcaaaaacccc

SEQ ID NO: 922089 - RNA, 21 nt, Mycobacterium avium subsp. paratuberculosis
cgagcaccuggccguucaggu

SEQ ID NO: 922090 - RNA, 22 nt, Mycobacterium avium subsp. paratuberculosis
cgagcacgugggucaaccggua

SEQ ID NO: 922091 - RNA, 19 nt, Mycobacterium avium subsp. paratuberculosis
cgagcagacgcaaaagccc

SEQ ID NO: 922092 - RNA, 16 nt, Mycobacterium avium subsp. paratuberculosis
cgagcacggcucgucc

SEQ ID NO: 922093 - RNA, 21 nt, Mycobacterium avium subsp. paratuberculosis
cgagcacgggaugaucggcgc

SEQ ID NO: 922094 - RNA, 16 nt, Mycobacterium avium subsp. paratuberculosis
cgagcacgaacgcggc

SEQ ID NO: 922095 - RNA, 14 nt, Mycobacterium avium subsp. paratuberculosis
cgagcacgucgacg

SEQ ID NO: 922096 - RNA, 20 nt, Mycobacterium avium subsp. paratuberculosis
cgagcacgucgacgccgguc

SEQ ID NO: 922097 - RNA, 14 nt, Mycobacterium avium subsp. paratuberculosis
cgagcacgucgagc

SEQ ID NO: 922098 - RNA, 18 nt, Mycobacterium avium subsp. paratuberculosis
cgagcacgucgagcaccg

SEQ ID NO: 922099 - RNA, 19 nt, Mycobacterium avium subsp. paratuberculosis
cgagcacgucgagcaccgc

SEQ ID NO: 922100 - RNA, 21 nt, Mycobacterium avium subsp. paratuberculosis
cgagcacgucgagcaccgcgu

SEQ ID NO: 922101 - RNA, 23 nt, Mycobacterium avium subsp. paratuberculosis
cgagcacgucgagcaccgcgucc

SEQ ID NO: 922102 - RNA, 14 nt, Mycobacterium avium subsp. paratuberculosis
cgagcacgacgucg

SEQ ID NO: 922103 - RNA, 15 nt, Mycobacterium avium subsp. paratuberculosis
cgagcacgacgucga

SEQ ID NO: 922104 - RNA, 14 nt, Mycobacterium avium subsp. paratuberculosis
cgagcacgcccugc

SEQ ID NO: 922105 - RNA, 17 nt, Mycobacterium avium subsp. paratuberculosis
cgagcacgcccugcggc

SEQ ID NO: 922106 - RNA, 23 nt, Mycobacterium avium subsp. paratuberculosis
cgagcacgcccugcggcuggguc

SEQ ID NO: 922107 - RNA, 14 nt, Mycobacterium avium subsp. paratuberculosis
cgagcacgccgccg

SEQ ID NO: 922108 - RNA, 14 nt, Mycobacterium avium subsp. paratuberculosis
cgagcacgcggccg

SEQ ID NO: 922109 - RNA, 16 nt, Mycobacterium avium subsp. paratuberculosis
cgagcacgcggccgcg

SEQ ID NO: 922110 - RNA, 17 nt, Mycobacterium avium subsp. paratuberculosis
cgagcacgcggccgcgc

SEQ ID NO: 922111 - RNA, 19 nt, Mycobacterium avium subsp. paratuberculosis
cgagcacgcggccgcgccg

SEQ ID NO: 922112 - RNA, 20 nt, Mycobacterium avium subsp. paratuberculosis
cgagcagcucgacaucggcc

SEQ ID NO: 922113 - RNA, 12 nt, Mycobacterium avium subsp. paratuberculosis
cgagcagcgugc

SEQ ID NO: 922114 - RNA, 21 nt, Mycobacterium avium subsp. paratuberculosis
cgagcagcgugcugacgucgu

SEQ ID NO: 922115 - RNA, 20 nt, Mycobacterium avium subsp. paratuberculosis
cgagcagacgcgaaagcacc

SEQ ID NO: 922116 - RNA, 21 nt, Mycobacterium avium subsp. paratuberculosis
cgagcaggcugaucucggcgg

SEQ ID NO: 922117 - RNA, 23 nt, Mycobacterium avium subsp. paratuberculosis
cgagcaggcugaucucggcgguc

SEQ ID NO: 922118 - RNA, 18 nt, Mycobacterium avium subsp. paratuberculosis
cgagcagcucagccgccu

SEQ ID NO: 922119 - RNA, 15 nt, Mycobacterium avium subsp. paratuberculosis
cgagcagcucggcgg

SEQ ID NO: 922120 - RNA, 16 nt, Mycobacterium avium subsp. paratuberculosis
cgagcagcucggcggc

SEQ ID NO: 922121 - RNA, 21 nt, Mycobacterium avium subsp. paratuberculosis
cgagcagcugggacagcguca

SEQ ID NO: 922122 - RNA, 23 nt, Mycobacterium avium subsp. paratuberculosis
cgagcagcugggacagcgucacc

SEQ ID NO: 922123 - RNA, 21 nt, Mycobacterium avium subsp. paratuberculosis
cgagcaggaacagacacagca

SEQ ID NO: 922124 - RNA, 14 nt, Mycobacterium avium subsp. paratuberculosis
cgagcauuucgcgc

SEQ ID NO: 922125 - RNA, 18 nt, Mycobacterium avium subsp. paratuberculosis
cgagcauuucgcgcacgu

SEQ ID NO: 922126 - RNA, 22 nt, Mycobacterium avium subsp. paratuberculosis
cgagcauuucgcgcacgucgag

SEQ ID NO: 922127 - RNA, 13 nt, Mycobacterium avium subsp. paratuberculosis
cgagcccggccag

SEQ ID NO: 922128 - RNA, 14 nt, Mycobacterium avium subsp. paratuberculosis
cgagcccggccagu

SEQ ID NO: 922129 - RNA, 18 nt, Mycobacterium avium subsp. paratuberculosis
cgagcccggccaguccgg

SEQ ID NO: 922130 - RNA, 23 nt, Mycobacterium avium subsp. paratuberculosis
cgagcccggccaguccggcagca

SEQ ID NO: 922131 - RNA, 14 nt, Mycobacterium avium subsp. paratuberculosis
cgagcccgcgccca

SEQ ID NO: 922132 - RNA, 16 nt, Mycobacterium avium subsp. paratuberculosis
cgagcccgcgcccaug

SEQ ID NO: 922133 - RNA, 20 nt, Mycobacterium avium subsp. paratuberculosis
cgagcccgcaaaucagccga

SEQ ID NO: 922134 - RNA, 13 nt, Mycobacterium avium subsp. paratuberculosis
cgagcccgccggc

SEQ ID NO: 922135 - RNA, 18 nt, Mycobacterium avium subsp. paratuberculosis
cgagcccgccggcggcga

SEQ ID NO: 922136 - RNA, 16 nt, Mycobacterium avium subsp. paratuberculosis
cgagcccgccggcggg

SEQ ID NO: 922137 - RNA, 24 nt, Mycobacterium avium subsp. paratuberculosis
cgagcaucucggugccgucgaucg

SEQ ID NO: 922138 - RNA, 20 nt, Mycobacterium avium subsp. paratuberculosis
cgagcaucggguugccggcg

SEQ ID NO: 922139 - RNA, 23 nt, Mycobacterium avium subsp. paratuberculosis
cgagcaucggguugccggcggcc

SEQ ID NO: 922140 - RNA, 16 nt, Mycobacterium avium subsp. paratuberculosis
cgagcaucuccagccg

SEQ ID NO: 922141 - RNA, 19 nt, Mycobacterium avium subsp. paratuberculosis
cgagcauccggcgcacggc

SEQ ID NO: 922142 - RNA, 20 nt, Mycobacterium avium subsp. paratuberculosis
cgagcauccggcgcacggcg

SEQ ID NO: 922143 - RNA, 15 nt, Mycobacterium avium subsp. paratuberculosis
cgagcauccggugcc

SEQ ID NO: 922144 - RNA, 22 nt, Mycobacterium avium subsp. paratuberculosis
cgagcauccggugccgagcgcg

SEQ ID NO: 922145 - RNA, 15 nt, Mycobacterium avium subsp. paratuberculosis
cgagcaucgccgagc

SEQ ID NO: 922146 - RNA, 22 nt, Mycobacterium avium subsp. paratuberculosis
cgagcgacgccacggggcugcg

SEQ ID NO: 922147 - RNA, 12 nt, Mycobacterium avium subsp. paratuberculosis
cgagcgagccga

SEQ ID NO: 922148 - RNA, 12 nt, Mycobacterium avium subsp. paratuberculosis
cgagccgucgcg

SEQ ID NO: 922149 - RNA, 13 nt, Mycobacterium avium subsp. paratuberculosis
cgagccgucgucg

SEQ ID NO: 922150 - RNA, 17 nt, Mycobacterium avium subsp. paratuberculosis
cgagcgaacacgugcag

SEQ ID NO: 922151 - RNA, 16 nt, Mycobacterium avium subsp. paratuberculosis
cgagcgcaagggccga

SEQ ID NO: 922152 - RNA, 18 nt, Mycobacterium avium subsp. paratuberculosis
cgagcgcaagggccgaca

SEQ ID NO: 922153 - RNA, 19 nt, Mycobacterium avium subsp. paratuberculosis
cgagcgcaagggccgacau

SEQ ID NO: 922154 - RNA, 12 nt, Mycobacterium avium subsp. paratuberculosis
cgagccgccgcc

SEQ ID NO: 922155 - RNA, 13 nt, Mycobacterium avium subsp. paratuberculosis
cgagccgccgccg

SEQ ID NO: 922156 - RNA, 17 nt, Mycobacterium avium subsp. paratuberculosis
cgagccgccgccggcgu

SEQ ID NO: 922157 - RNA, 19 nt, Mycobacterium avium subsp. paratuberculosis
cgagccgccgccggcgucg

SEQ ID NO: 922158 - RNA, 24 nt, Mycobacterium avium subsp. paratuberculosis
cgagccggugguuuugcggcccug

SEQ ID NO: 922159 - RNA, 16 nt, Mycobacterium avium subsp. paratuberculosis
cgagccguaggccagg

SEQ ID NO: 922160 - RNA, 17 nt, Mycobacterium avium subsp. paratuberculosis
cgagccguaggccaggu

SEQ ID NO: 922161 - RNA, 13 nt, Mycobacterium avium subsp. paratuberculosis
cgagccgucgaag

SEQ ID NO: 922162 - RNA, 20 nt, Mycobacterium avium subsp. paratuberculosis
cgagccgucgaccggguccg

SEQ ID NO: 922163 - RNA, 14 nt, Mycobacterium avium subsp. paratuberculosis
cgagccgucgucgc

SEQ ID NO: 922164 - RNA, 16 nt, Mycobacterium avium subsp. paratuberculosis
cgagccgucgucgcug

SEQ ID NO: 922165 - RNA, 19 nt, Mycobacterium avium subsp. paratuberculosis
cgagccgucgucgcugcag

SEQ ID NO: 922166 - RNA, 16 nt, Mycobacterium avium subsp. paratuberculosis
cgagccguuugaugcc

SEQ ID NO: 922167 - RNA, 17 nt, Mycobacterium avium subsp. paratuberculosis
cgagccguuugaugccg

SEQ ID NO: 922168 - RNA, 19 nt, Mycobacterium avium subsp. paratuberculosis
cgagccguuugaugccguc

SEQ ID NO: 922169 - RNA, 14 nt, Mycobacterium avium subsp. paratuberculosis
cgagccuggcgcgc

SEQ ID NO: 922170 - RNA, 20 nt, Mycobacterium avium subsp. paratuberculosis
cgagccugggauugccgggc

SEQ ID NO: 922171 - RNA, 13 nt, Mycobacterium avium subsp. paratuberculosis
cgagccgcagucg

SEQ ID NO: 922172 - RNA, 20 nt, Mycobacterium avium subsp. paratuberculosis
cgagccgcagucgaucaccg

SEQ ID NO: 922173 - RNA, 23 nt, Mycobacterium avium subsp. paratuberculosis
cgagccgcagucgaucaccgaga

SEQ ID NO: 922174 - RNA, 13 nt, Mycobacterium avium subsp. paratuberculosis
cgagccgcaccgc

SEQ ID NO: 922175 - RNA, 21 nt, Mycobacterium avium subsp. paratuberculosis
cgagccgcaccgccucaugcc

SEQ ID NO: 922176 - RNA, 16 nt, Mycobacterium avium subsp. paratuberculosis
cgagccgaggccgaug

SEQ ID NO: 922177 - RNA, 17 nt, Mycobacterium avium subsp. paratuberculosis
cgagccgaugcccagca

SEQ ID NO: 922178 - RNA, 20 nt, Mycobacterium avium subsp. paratuberculosis
cgagccgaugcccagcagcg

SEQ ID NO: 922179 - RNA, 21 nt, Mycobacterium avium subsp. paratuberculosis
cgagccgaugcccagcagcgg

SEQ ID NO: 922180 - RNA, 22 nt, Mycobacterium avium subsp. paratuberculosis
cgagccgauggaacgcaagaag

SEQ ID NO: 922181 - RNA, 15 nt, Mycobacterium avium subsp. paratuberculosis
cgagccgagcaccgg

SEQ ID NO: 922182 - RNA, 19 nt, Mycobacterium avium subsp. paratuberculosis
cgagccgagcaccggcagc

SEQ ID NO: 922183 - RNA, 20 nt, Mycobacterium avium subsp. paratuberculosis
cgagccgagcaccggcagca

SEQ ID NO: 922184 - RNA, 15 nt, Mycobacterium avium subsp. paratuberculosis
cgagccgagcacgca

SEQ ID NO: 922185 - RNA, 16 nt, Mycobacterium avium subsp. paratuberculosis
cgagccgagcacgcag

SEQ ID NO: 922186 - RNA, 15 nt, Mycobacterium avium subsp. paratuberculosis
cgagccgacccgggc

SEQ ID NO: 922187 - RNA, 13 nt, Mycobacterium avium subsp. paratuberculosis
cgagccgagccga

SEQ ID NO: 922188 - RNA, 15 nt, Mycobacterium avium subsp. paratuberculosis
cgagccgagccgacc

SEQ ID NO: 922189 - RNA, 14 nt, Mycobacterium avium subsp. paratuberculosis
cgagccgagccggu

SEQ ID NO: 922190 - RNA, 17 nt, Mycobacterium avium subsp. paratuberculosis
cgagccgagccgguccg

SEQ ID NO: 922191 - RNA, 21 nt, Mycobacterium avium subsp. paratuberculosis
cgagccgacagucgcgggcgg

SEQ ID NO: 922192 - RNA, 17 nt, Mycobacterium avium subsp. paratuberculosis
cgagcccugcgccagca

SEQ ID NO: 922193 - RNA, 19 nt, Mycobacterium avium subsp. paratuberculosis
cgagcccugcgccagcagc

SEQ ID NO: 922194 - RNA, 21 nt, Mycobacterium avium subsp. paratuberculosis
cgagcccugcgccagcagcag

SEQ ID NO: 922195 - RNA, 16 nt, Mycobacterium avium subsp. paratuberculosis
cgagcccuucgcggug

SEQ ID NO: 922196 - RNA, 17 nt, Mycobacterium avium subsp. paratuberculosis
cgagcccuuugcgcugc

SEQ ID NO: 922197 - RNA, 22 nt, Mycobacterium avium subsp. paratuberculosis
cgagcccuuugcgcugcccgau

SEQ ID NO: 922198 - RNA, 13 nt, Mycobacterium avium subsp. paratuberculosis
cgagcccggcgac

SEQ ID NO: 922199 - RNA, 17 nt, Mycobacterium avium subsp. paratuberculosis
cgagcccggcgacgucg

SEQ ID NO: 922200 - RNA, 16 nt, Mycobacterium avium subsp. paratuberculosis
cgagcccgggaacguc

SEQ ID NO: 922201 - RNA, 18 nt, Mycobacterium avium subsp. paratuberculosis
cgagcccguucagugacc

SEQ ID NO: 922202 - RNA, 17 nt, Mycobacterium avium subsp. paratuberculosis
cgagcuugggccggugc

SEQ ID NO: 922203 - RNA, 15 nt, Mycobacterium avium subsp. paratuberculosis
cgagcuugccgucgu

SEQ ID NO: 922204 - RNA, 16 nt, Mycobacterium avium subsp. paratuberculosis
cgagcuugccgucguu

SEQ ID NO: 922205 - RNA, 18 nt, Mycobacterium avium subsp. paratuberculosis
cgagcuugccgucguuga

SEQ ID NO: 922206 - RNA, 14 nt, Mycobacterium avium subsp. paratuberculosis
cgagcuugccgucg

SEQ ID NO: 922207 - RNA, 15 nt, Mycobacterium avium subsp. paratuberculosis
cgagcuggccgccca

SEQ ID NO: 922208 - RNA, 16 nt, Mycobacterium avium subsp. paratuberculosis
cgagcuggccgcccac

SEQ ID NO: 922209 - RNA, 21 nt, Mycobacterium avium subsp. paratuberculosis
cgagcuggccgcccaccacga

SEQ ID NO: 922210 - RNA, 14 nt, Mycobacterium avium subsp. paratuberculosis
cgagcugggcccgc

SEQ ID NO: 922211 - RNA, 15 nt, Mycobacterium avium subsp. paratuberculosis
cgagcugggcccgcg

SEQ ID NO: 922212 - RNA, 12 nt, Mycobacterium avium subsp. paratuberculosis
cgagcugggccg

SEQ ID NO: 922213 - RNA, 15 nt, Mycobacterium avium subsp. paratuberculosis
cgagcugggccggcg

SEQ ID NO: 922214 - RNA, 17 nt, Mycobacterium avium subsp. paratuberculosis
cgagcugggccggcgcc

SEQ ID NO: 922215 - RNA, 18 nt, Mycobacterium avium subsp. paratuberculosis
cgagcugggccggcgccg

SEQ ID NO: 922216 - RNA, 19 nt, Mycobacterium avium subsp. paratuberculosis
cgagcugggccggcgccga

SEQ ID NO: 922217 - RNA, 16 nt, Mycobacterium avium subsp. paratuberculosis
cgagcugcuucgucgc

SEQ ID NO: 922218 - RNA, 21 nt, Mycobacterium avium subsp. paratuberculosis
cgagcugcuucgucgccgggc

SEQ ID NO: 922219 - RNA, 23 nt, Mycobacterium avium subsp. paratuberculosis
cgagcugcuucgucgccgggcuc

SEQ ID NO: 922220 - RNA, 15 nt, Mycobacterium avium subsp. paratuberculosis
cgagcugccggcggc

SEQ ID NO: 922221 - RNA, 17 nt, Mycobacterium avium subsp. paratuberculosis
cgagcugccggcggccg

SEQ ID NO: 922222 - RNA, 19 nt, Mycobacterium avium subsp. paratuberculosis
cgagcugccggcggccgcc

SEQ ID NO: 922223 - RNA, 21 nt, Mycobacterium avium subsp. paratuberculosis
cgagcugaucgcggccggcga

SEQ ID NO: 922224 - RNA, 16 nt, Mycobacterium avium subsp. paratuberculosis
cgagcugaccggccac

SEQ ID NO: 922225 - RNA, 17 nt, Mycobacterium avium subsp. paratuberculosis
cgagcugcaacgcgucg

SEQ ID NO: 922226 - RNA, 18 nt, Mycobacterium avium subsp. paratuberculosis
cgagcugcaacgcgucgg

SEQ ID NO: 922227 - RNA, 20 nt, Mycobacterium avium subsp. paratuberculosis
cgagcugcaacgcgucggcg

SEQ ID NO: 922228 - RNA, 23 nt, Mycobacterium avium subsp. paratuberculosis
cgagcugcaacgcgucggcgccg

SEQ ID NO: 922229 - RNA, 14 nt, Mycobacterium avium subsp. paratuberculosis
cgagcugcacgggc

SEQ ID NO: 922230 - RNA, 23 nt, Mycobacterium avium subsp. paratuberculosis
cgagcugacgaacgcgccgccca

SEQ ID NO: 922231 - RNA, 14 nt, Mycobacterium avium subsp. paratuberculosis
cgagcucgugaugg

SEQ ID NO: 922232 - RNA, 18 nt, Mycobacterium avium subsp. paratuberculosis
cgagcucguucucggcga

SEQ ID NO: 922233 - RNA, 24 nt, Mycobacterium avium subsp. paratuberculosis
cgagcucguucucggcgaacagcg

SEQ ID NO: 922234 - RNA, 15 nt, Mycobacterium avium subsp. paratuberculosis
cgagcucggccuuga

SEQ ID NO: 922235 - RNA, 18 nt, Mycobacterium avium subsp. paratuberculosis
cgagcucggcgaggucgu

SEQ ID NO: 922236 - RNA, 15 nt, Mycobacterium avium subsp. paratuberculosis
cgagcucgggcgcga

SEQ ID NO: 922237 - RNA, 21 nt, Mycobacterium avium subsp. paratuberculosis
cgagcucgggcgcgaacagcg

SEQ ID NO: 922238 - RNA, 23 nt, Mycobacterium avium subsp. paratuberculosis
cgagcucgggcgcgaacagcgcc

SEQ ID NO: 922239 - RNA, 15 nt, Mycobacterium avium subsp. paratuberculosis
cgagcuccucggcca

SEQ ID NO: 922240 - RNA, 17 nt, Mycobacterium avium subsp. paratuberculosis
cgagcuccucggccagc

SEQ ID NO: 922241 - RNA, 19 nt, Mycobacterium avium subsp. paratuberculosis
cgagcuccucggccagcgg

SEQ ID NO: 922242 - RNA, 13 nt, Mycobacterium avium subsp. paratuberculosis
cgagcucgaagcc

SEQ ID NO: 922243 - RNA, 14 nt, Mycobacterium avium subsp. paratuberculosis
cgagcucgcagucg

SEQ ID NO: 922244 - RNA, 15 nt, Mycobacterium avium subsp. paratuberculosis
cgagcucgcagucga

SEQ ID NO: 922245 - RNA, 19 nt, Mycobacterium avium subsp. paratuberculosis
cgagcucgcagucgaucag

SEQ ID NO: 922246 - RNA, 12 nt, Mycobacterium avium subsp. paratuberculosis
cgagcucgccgc

SEQ ID NO: 922247 - RNA, 15 nt, Mycobacterium avium subsp. paratuberculosis
cgagcucaggccggc

SEQ ID NO: 922248 - RNA, 21 nt, Mycobacterium avium subsp. paratuberculosis
cgagcucgccgcugucgucga

SEQ ID NO: 922249 - RNA, 23 nt, Mycobacterium avium subsp. paratuberculosis
cgagcucgccgcugucgucgaag

SEQ ID NO: 922250 - RNA, 15 nt, Mycobacterium avium subsp. paratuberculosis
cgagcucgcggccgu

SEQ ID NO: 922251 - RNA, 17 nt, Mycobacterium avium subsp. paratuberculosis
cgagcgcagcgccaggc

SEQ ID NO: 922252 - RNA, 19 nt, Mycobacterium avium subsp. paratuberculosis
cgagcgcagcgccaggcag

SEQ ID NO: 922253 - RNA, 23 nt, Mycobacterium avium subsp. paratuberculosis
cgagcgcagcgccaggcagaagc

SEQ ID NO: 922254 - RNA, 13 nt, Mycobacterium avium subsp. paratuberculosis
cgagcgcagcggg

SEQ ID NO: 922255 - RNA, 22 nt, Mycobacterium avium subsp. paratuberculosis
cgagcgcaucgacugcgacacc

SEQ ID NO: 922256 - RNA, 15 nt, Mycobacterium avium subsp. paratuberculosis
cgagcgcgccgaggu

SEQ ID NO: 922257 - RNA, 13 nt, Mycobacterium avium subsp. paratuberculosis
cgagcgcgccgcc

SEQ ID NO: 922258 - RNA, 15 nt, Mycobacterium avium subsp. paratuberculosis
cgagcgcgccgccgc

SEQ ID NO: 922259 - RNA, 21 nt, Mycobacterium avium subsp. paratuberculosis
cgagcgcgccgccgccgccca

SEQ ID NO: 922260 - RNA, 13 nt, Mycobacterium avium subsp. paratuberculosis
cgagcgcaccgcc

SEQ ID NO: 922261 - RNA, 16 nt, Mycobacterium avium subsp. paratuberculosis
cgagcgcaccgcggag

SEQ ID NO: 922262 - RNA, 20 nt, Mycobacterium avium subsp. paratuberculosis
cgagcgcguucuccaccgcg

SEQ ID NO: 922263 - RNA, 21 nt, Mycobacterium avium subsp. paratuberculosis
cgagcgcguucuccaccgcgc

SEQ ID NO: 922264 - RNA, 14 nt, Mycobacterium avium subsp. paratuberculosis
cgagcgcuaccgcg

SEQ ID NO: 922265 - RNA, 14 nt, Mycobacterium avium subsp. paratuberculosis
cgagcgcgucgacc

SEQ ID NO: 922266 - RNA, 20 nt, Mycobacterium avium subsp. paratuberculosis
cgagcgcgucgaccagccgc

SEQ ID NO: 922267 - RNA, 18 nt, Mycobacterium avium subsp. paratuberculosis
cgagcgcggcccgccgaa

SEQ ID NO: 922268 - RNA, 19 nt, Mycobacterium avium subsp. paratuberculosis
cgagcgcggcccgccgaac

SEQ ID NO: 922269 - RNA, 12 nt, Mycobacterium avium subsp. paratuberculosis
cgagcgcgcuga

SEQ ID NO: 922270 - RNA, 18 nt, Mycobacterium avium subsp. paratuberculosis
cgagcgcgcugaucgccg

SEQ ID NO: 922271 - RNA, 19 nt, Mycobacterium avium subsp. paratuberculosis
cgagcgcgcugaucgccgc

SEQ ID NO: 922272 - RNA, 18 nt, Mycobacterium avium subsp. paratuberculosis
cgagcgugggggccaugu

SEQ ID NO: 922273 - RNA, 17 nt, Mycobacterium avium subsp. paratuberculosis
cgagcguucggcgcgga

SEQ ID NO: 922274 - RNA, 23 nt, Mycobacterium avium subsp. paratuberculosis
cgagcgugaaacuaguuucacgu

SEQ ID NO: 922275 - RNA, 15 nt, Mycobacterium avium subsp. paratuberculosis
cgagcgugcccgcgc

SEQ ID NO: 922276 - RNA, 20 nt, Mycobacterium avium subsp. paratuberculosis
cgagcgugcccgcgcccacc

SEQ ID NO: 922277 - RNA, 21 nt, Mycobacterium avium subsp. paratuberculosis
cgagcgugcccgcgcccaccu

SEQ ID NO: 922278 - RNA, 14 nt, Mycobacterium avium subsp. paratuberculosis
cgagcucaacagca

SEQ ID NO: 922279 - RNA, 14 nt, Mycobacterium avium subsp. paratuberculosis
cgagcucaccgccg

SEQ ID NO: 922280 - RNA, 15 nt, Mycobacterium avium subsp. paratuberculosis
cgagcucaccgccga

SEQ ID NO: 922281 - RNA, 22 nt, Mycobacterium avium subsp. paratuberculosis
cgagcgcugcccgugccgcacc

SEQ ID NO: 922282 - RNA, 13 nt, Mycobacterium avium subsp. paratuberculosis
cgagcgucacgcc

SEQ ID NO: 922283 - RNA, 19 nt, Mycobacterium avium subsp. paratuberculosis
cgagcgucacgccagcgug

SEQ ID NO: 922284 - RNA, 20 nt, Mycobacterium avium subsp. paratuberculosis
cgagcgucacgccagugugg

SEQ ID NO: 922285 - RNA, 15 nt, Mycobacterium avium subsp. paratuberculosis
cgagcgucacgccgc

SEQ ID NO: 922286 - RNA, 18 nt, Mycobacterium avium subsp. paratuberculosis
cgagcgucacgccgcgcc

SEQ ID NO: 922287 - RNA, 18 nt, Mycobacterium avium subsp. paratuberculosis
cgagcgucacgcuagcgu

SEQ ID NO: 922288 - RNA, 15 nt, Mycobacterium avium subsp. paratuberculosis
cgagcgucacgcugg

SEQ ID NO: 922289 - RNA, 19 nt, Mycobacterium avium subsp. paratuberculosis
cgagcgucacgcuggcgug

SEQ ID NO: 922290 - RNA, 20 nt, Mycobacterium avium subsp. paratuberculosis
cgagcgucacgcuggcgugg

SEQ ID NO: 922291 - RNA, 21 nt, Mycobacterium avium subsp. paratuberculosis
cgagcgucacgcuggcguggc

SEQ ID NO: 922292 - RNA, 20 nt, Mycobacterium avium subsp. paratuberculosis
cgagcgucauuccgccgcgc

SEQ ID NO: 922293 - RNA, 21 nt, Mycobacterium avium subsp. paratuberculosis
cgagcgucauuccgccgcgcc

SEQ ID NO: 922294 - RNA, 14 nt, Mycobacterium avium subsp. paratuberculosis
cgagcgucgccgcg

SEQ ID NO: 922295 - RNA, 17 nt, Mycobacterium avium subsp. paratuberculosis
cgagcgucgccgcgugg

SEQ ID NO: 922296 - RNA, 17 nt, Mycobacterium avium subsp. paratuberculosis
cgaggaacuugcgccgg

SEQ ID NO: 922297 - RNA, 19 nt, Mycobacterium avium subsp. paratuberculosis
cgaggaacuugcgccgggu

SEQ ID NO: 922298 - RNA, 18 nt, Mycobacterium avium subsp. paratuberculosis
cgaggaacccgaccgcga

SEQ ID NO: 922299 - RNA, 19 nt, Mycobacterium avium subsp. paratuberculosis
cgaggaacccgaccgcgau

SEQ ID NO: 922300 - RNA, 16 nt, Mycobacterium avium subsp. paratuberculosis
cgaggaacucagcgcc

SEQ ID NO: 922301 - RNA, 12 nt, Mycobacterium avium subsp. paratuberculosis
cgaggacaccgc

SEQ ID NO: 922302 - RNA, 18 nt, Mycobacterium avium subsp. paratuberculosis
cgaggaaguuguagacgu

SEQ ID NO: 922303 - RNA, 15 nt, Mycobacterium avium subsp. paratuberculosis
cgaggaaucgcggca

SEQ ID NO: 922304 - RNA, 17 nt, Mycobacterium avium subsp. paratuberculosis
cgaggaaguccggcgcg

SEQ ID NO: 922305 - RNA, 18 nt, Mycobacterium avium subsp. paratuberculosis
cgaggaaguccggcgcgc

SEQ ID NO: 922306 - RNA, 20 nt, Mycobacterium avium subsp. paratuberculosis
cgaggaaguccggcgcgccc

SEQ ID NO: 922307 - RNA, 22 nt, Mycobacterium avium subsp. paratuberculosis
cgaggaaguccggcgcgcccgg

SEQ ID NO: 922308 - RNA, 13 nt, Mycobacterium avium subsp. paratuberculosis
cgaggaccagcau

SEQ ID NO: 922309 - RNA, 14 nt, Mycobacterium avium subsp. paratuberculosis
cgaggaccggcgcc

SEQ ID NO: 922310 - RNA, 17 nt, Mycobacterium avium subsp. paratuberculosis
cgaggaccggcgccggc

SEQ ID NO: 922311 - RNA, 18 nt, Mycobacterium avium subsp. paratuberculosis
cgaggaccggcgccggcc

SEQ ID NO: 922312 - RNA, 22 nt, Mycobacterium avium subsp. paratuberculosis
cgaggaccggcgccggccgccg

SEQ ID NO: 922313 - RNA, 14 nt, Mycobacterium avium subsp. paratuberculosis
cgaggaggggucgg

SEQ ID NO: 922314 - RNA, 19 nt, Mycobacterium avium subsp. paratuberculosis
cgaggaggggucggugcgg

SEQ ID NO: 922315 - RNA, 21 nt, Mycobacterium avium subsp. paratuberculosis
cgaggagggugucggcggggc

SEQ ID NO: 922316 - RNA, 14 nt, Mycobacterium avium subsp. paratuberculosis
cgaggagacgucgg

SEQ ID NO: 922317 - RNA, 18 nt, Mycobacterium avium subsp. paratuberculosis
cgaggagacgucggccgg

SEQ ID NO: 922318 - RNA, 19 nt, Mycobacterium avium subsp. paratuberculosis
cgaggacggcuugggugug

SEQ ID NO: 922319 - RNA, 17 nt, Mycobacterium avium subsp. paratuberculosis
cgaggacgucgagcggc

SEQ ID NO: 922320 - RNA, 18 nt, Mycobacterium avium subsp. paratuberculosis
cgaggacgucgagcggcg

SEQ ID NO: 922321 - RNA, 21 nt, Mycobacterium avium subsp. paratuberculosis
cgaggacgucgagcggcgccu

SEQ ID NO: 922322 - RNA, 15 nt, Mycobacterium avium subsp. paratuberculosis
cgaggacgucgucga

SEQ ID NO: 922323 - RNA, 18 nt, Mycobacterium avium subsp. paratuberculosis
cgaggaucugggcggcgg

SEQ ID NO: 922324 - RNA, 20 nt, Mycobacterium avium subsp. paratuberculosis
cgaggaucgcgaugucgacg

SEQ ID NO: 922325 - RNA, 15 nt, Mycobacterium avium subsp. paratuberculosis
cgaggaucgcggcca

SEQ ID NO: 922326 - RNA, 16 nt, Mycobacterium avium subsp. paratuberculosis
cgaggaugaccgcggc

SEQ ID NO: 922327 - RNA, 14 nt, Mycobacterium avium subsp. paratuberculosis
cgaggaugccgccc

SEQ ID NO: 922328 - RNA, 17 nt, Mycobacterium avium subsp. paratuberculosis
cgaggaugccgcccacc

SEQ ID NO: 922329 - RNA, 18 nt, Mycobacterium avium subsp. paratuberculosis
cgaggaugccgcccacca

SEQ ID NO: 922330 - RNA, 23 nt, Mycobacterium avium subsp. paratuberculosis
cgaggaugccgcccaccaccggc

SEQ ID NO: 922331 - RNA, 18 nt, Mycobacterium avium subsp. paratuberculosis
cgaggaucuugaucgcga

SEQ ID NO: 922332 - RNA, 18 nt, Mycobacterium avium subsp. paratuberculosis
cgaggauggggucgcggg

SEQ ID NO: 922333 - RNA, 18 nt, Mycobacterium avium subsp. paratuberculosis
cgaggccaacucgcgaag

SEQ ID NO: 922334 - RNA, 18 nt, Mycobacterium avium subsp. paratuberculosis
cgaggcaguuccaugucg

SEQ ID NO: 922335 - RNA, 23 nt, Mycobacterium avium subsp. paratuberculosis
cgaggcaguuccaugucgacgac

SEQ ID NO: 922336 - RNA, 19 nt, Mycobacterium avium subsp. paratuberculosis
cgaggcaaucgagcgggcg

SEQ ID NO: 922337 - RNA, 12 nt, Mycobacterium avium subsp. paratuberculosis
cgaggcacagca

SEQ ID NO: 922338 - RNA, 18 nt, Mycobacterium avium subsp. paratuberculosis
cgaggauuucgcgaucga

SEQ ID NO: 922339 - RNA, 15 nt, Mycobacterium avium subsp. paratuberculosis
cgaggcacggcccgc

SEQ ID NO: 922340 - RNA, 15 nt, Mycobacterium avium subsp. paratuberculosis
cgaggcccucgacac

SEQ ID NO: 922341 - RNA, 14 nt, Mycobacterium avium subsp. paratuberculosis
cgaggccgacgugc

SEQ ID NO: 922342 - RNA, 22 nt, Mycobacterium avium subsp. paratuberculosis
cgaggccgacgugcuuggccag

SEQ ID NO: 922343 - RNA, 14 nt, Mycobacterium avium subsp. paratuberculosis
cgaggccgacgugg

SEQ ID NO: 922344 - RNA, 16 nt, Mycobacterium avium subsp. paratuberculosis
cgaggccccgccagau

SEQ ID NO: 922345 - RNA, 15 nt, Mycobacterium avium subsp. paratuberculosis
cgaggccccgcguga

SEQ ID NO: 922346 - RNA, 17 nt, Mycobacterium avium subsp. paratuberculosis
cgaggccccgcgugacg

SEQ ID NO: 922347 - RNA, 22 nt, Mycobacterium avium subsp. paratuberculosis
cgaggccccgcgugacggccgc

SEQ ID NO: 922348 - RNA, 17 nt, Mycobacterium avium subsp. paratuberculosis
cgaggcccggacggcca

SEQ ID NO: 922349 - RNA, 16 nt, Mycobacterium avium subsp. paratuberculosis
cgaggccaucaucccg

SEQ ID NO: 922350 - RNA, 20 nt, Mycobacterium avium subsp. paratuberculosis
cgaggccagcacgccgguca

SEQ ID NO: 922351 - RNA, 18 nt, Mycobacterium avium subsp. paratuberculosis
cgaggcccacgaaccggu

SEQ ID NO: 922352 - RNA, 13 nt, Mycobacterium avium subsp. paratuberculosis
cgaggccagcgcg

SEQ ID NO: 922353 - RNA, 14 nt, Mycobacterium avium subsp. paratuberculosis
cgaggccagcgcga

SEQ ID NO: 922354 - RNA, 17 nt, Mycobacterium avium subsp. paratuberculosis
cgaggcgcgcagguagc

SEQ ID NO: 922355 - RNA, 18 nt, Mycobacterium avium subsp. paratuberculosis
cgaggcgcgcagguagcc

SEQ ID NO: 922356 - RNA, 22 nt, Mycobacterium avium subsp. paratuberculosis
cgaggcgcgcagguagccgccg

SEQ ID NO: 922357 - RNA, 16 nt, Mycobacterium avium subsp. paratuberculosis
cgaggcgaucgcggcc

SEQ ID NO: 922358 - RNA, 17 nt, Mycobacterium avium subsp. paratuberculosis
cgaggcgcaacaccgga

SEQ ID NO: 922359 - RNA, 20 nt, Mycobacterium avium subsp. paratuberculosis
cgaggcgcaguagccgacgu

SEQ ID NO: 922360 - RNA, 22 nt, Mycobacterium avium subsp. paratuberculosis
cgaggcgcaguagccgacgugc

SEQ ID NO: 922361 - RNA, 16 nt, Mycobacterium avium subsp. paratuberculosis
cgaggcgaucaucgcc

SEQ ID NO: 922362 - RNA, 21 nt, Mycobacterium avium subsp. paratuberculosis
cgaggcgaucaucgccccgga

SEQ ID NO: 922363 - RNA, 18 nt, Mycobacterium avium subsp. paratuberculosis
cgaggcgaguaaggccga

SEQ ID NO: 922364 - RNA, 21 nt, Mycobacterium avium subsp. paratuberculosis
cgaggcgaguaaggccgaggc

SEQ ID NO: 922365 - RNA, 13 nt, Mycobacterium avium subsp. paratuberculosis
cgaggccgggcug

SEQ ID NO: 922366 - RNA, 16 nt, Mycobacterium avium subsp. paratuberculosis
cgaggccgggcuggcg

SEQ ID NO: 922367 - RNA, 17 nt, Mycobacterium avium subsp. paratuberculosis
cgaggccgggcuggcgc

SEQ ID NO: 922368 - RNA, 14 nt, Mycobacterium avium subsp. paratuberculosis
cgaggccgcgccgu

SEQ ID NO: 922369 - RNA, 23 nt, Mycobacterium avium subsp. paratuberculosis
cgaggccuccagguagacgaugc

SEQ ID NO: 922370 - RNA, 13 nt, Mycobacterium avium subsp. paratuberculosis
cgaggccucgccg

SEQ ID NO: 922371 - RNA, 14 nt, Mycobacterium avium subsp. paratuberculosis
cgaggccucgccgc

SEQ ID NO: 922372 - RNA, 16 nt, Mycobacterium avium subsp. paratuberculosis
cgaggccggccagcgg

SEQ ID NO: 922373 - RNA, 21 nt, Mycobacterium avium subsp. paratuberculosis
cgaggccgaggucggucgcgg

SEQ ID NO: 922374 - RNA, 19 nt, Mycobacterium avium subsp. paratuberculosis
cgaggccgauggcgcccag

SEQ ID NO: 922375 - RNA, 20 nt, Mycobacterium avium subsp. paratuberculosis
cgaggccgauggcgcccagc

SEQ ID NO: 922376 - RNA, 21 nt, Mycobacterium avium subsp. paratuberculosis
cgacguucgauugcaccaccg

SEQ ID NO: 922377 - RNA, 14 nt, Mycobacterium avium subsp. paratuberculosis
cgacguucgccgcc

SEQ ID NO: 922378 - RNA, 15 nt, Mycobacterium avium subsp. paratuberculosis
cgacguucgccgcca

SEQ ID NO: 922379 - RNA, 19 nt, Mycobacterium avium subsp. paratuberculosis
cgacguucgccgccagcac

SEQ ID NO: 922380 - RNA, 20 nt, Mycobacterium avium subsp. paratuberculosis
cgacguucgccgccagcacg

SEQ ID NO: 922381 - RNA, 11 nt, Mycobacterium avium subsp. paratuberculosis
cgacguucggc

SEQ ID NO: 922382 - RNA, 13 nt, Mycobacterium avium subsp. paratuberculosis
cgacguucggcgg

SEQ ID NO: 922383 - RNA, 14 nt, Mycobacterium avium subsp. paratuberculosis
cgacguucggcggg

SEQ ID NO: 922384 - RNA, 15 nt, Mycobacterium avium subsp. paratuberculosis
cgacguucggcgggc

SEQ ID NO: 922385 - RNA, 18 nt, Mycobacterium avium subsp. paratuberculosis
cgacguucggcgggcagg

SEQ ID NO: 922386 - RNA, 16 nt, Mycobacterium avium subsp. paratuberculosis
cgacuccccgcccggc

SEQ ID NO: 922387 - RNA, 23 nt, Mycobacterium avium subsp. paratuberculosis
cgacuccccgcccggcaacacgu

SEQ ID NO: 922388 - RNA, 12 nt, Mycobacterium avium subsp. paratuberculosis
cgacuccggcgc

SEQ ID NO: 922389 - RNA, 15 nt, Mycobacterium avium subsp. paratuberculosis
cgacuccggcgccgg

SEQ ID NO: 922390 - RNA, 18 nt, Mycobacterium avium subsp. paratuberculosis
cgacuccggcgccgguca

SEQ ID NO: 922391 - RNA, 20 nt, Mycobacterium avium subsp. paratuberculosis
cgacuccggcgccggucagc

SEQ ID NO: 922392 - RNA, 14 nt, Mycobacterium avium subsp. paratuberculosis
cgacuccucacacc

SEQ ID NO: 922393 - RNA, 18 nt, Mycobacterium avium subsp. paratuberculosis
cgacuccucacaccucgc

SEQ ID NO: 922394 - RNA, 19 nt, Mycobacterium avium subsp. paratuberculosis
cgacuccucacaccucgcu

SEQ ID NO: 922395 - RNA, 13 nt, Mycobacterium avium subsp. paratuberculosis
cgacuccuccggc

SEQ ID NO: 922396 - RNA, 22 nt, Mycobacterium avium subsp. paratuberculosis
cgacuccugcaggcccucgacg

SEQ ID NO: 922397 - RNA, 17 nt, Mycobacterium avium subsp. paratuberculosis
cgacucgcaggugccgg

SEQ ID NO: 922398 - RNA, 17 nt, Mycobacterium avium subsp. paratuberculosis
cgacucgaugcgcguga

SEQ ID NO: 922399 - RNA, 20 nt, Mycobacterium avium subsp. paratuberculosis
cgacucgaugcgcgugacgc

SEQ ID NO: 922400 - RNA, 16 nt, Mycobacterium avium subsp. paratuberculosis
cgacucgaccccgccc

SEQ ID NO: 922401 - RNA, 19 nt, Mycobacterium avium subsp. paratuberculosis
cgacucgaccccgcccagc

SEQ ID NO: 922402 - RNA, 14 nt, Mycobacterium avium subsp. paratuberculosis
cgacuccuggccga

SEQ ID NO: 922403 - RNA, 21 nt, Mycobacterium avium subsp. paratuberculosis
cgacuccuggguaagccaggu

SEQ ID NO: 922404 - RNA, 17 nt, Mycobacterium avium subsp. paratuberculosis
cgacuccuugggcaugg

SEQ ID NO: 922405 - RNA, 13 nt, Mycobacterium avium subsp. paratuberculosis
cgacucggcggug

SEQ ID NO: 922406 - RNA, 14 nt, Mycobacterium avium subsp. paratuberculosis
cgacucggcggugc

SEQ ID NO: 922407 - RNA, 21 nt, Mycobacterium avium subsp. paratuberculosis
cgacucggccuccgcgcgcgg

SEQ ID NO: 922408 - RNA, 22 nt, Mycobacterium avium subsp. paratuberculosis
cgacgugucgucgucgccgccg

SEQ ID NO: 922409 - RNA, 24 nt, Mycobacterium avium subsp. paratuberculosis
cgacgugucgucgucgccgccggu

SEQ ID NO: 922410 - RNA, 19 nt, Mycobacterium avium subsp. paratuberculosis
cgacguguucaacgcgccg

SEQ ID NO: 922411 - RNA, 20 nt, Mycobacterium avium subsp. paratuberculosis
cgacguguucaacgcgccga

SEQ ID NO: 922412 - RNA, 15 nt, Mycobacterium avium subsp. paratuberculosis
cgacgugggcggcca

SEQ ID NO: 922413 - RNA, 16 nt, Mycobacterium avium subsp. paratuberculosis
cgacgugggcggccac

SEQ ID NO: 922414 - RNA, 17 nt, Mycobacterium avium subsp. paratuberculosis
cgacgugggcggccacc

SEQ ID NO: 922415 - RNA, 17 nt, Mycobacterium avium subsp. paratuberculosis
cgacguggugcaccgcc

SEQ ID NO: 922416 - RNA, 18 nt, Mycobacterium avium subsp. paratuberculosis
cgacguggugcaccgcca

SEQ ID NO: 922417 - RNA, 20 nt, Mycobacterium avium subsp. paratuberculosis
cgacgugguggaugaugccg

SEQ ID NO: 922418 - RNA, 21 nt, Mycobacterium avium subsp. paratuberculosis
cgacgugguggaugaugccgg

SEQ ID NO: 922419 - RNA, 12 nt, Mycobacterium avium subsp. paratuberculosis
cgacgucgucga

SEQ ID NO: 922420 - RNA, 13 nt, Mycobacterium avium subsp. paratuberculosis
cgacgucgucgac

SEQ ID NO: 922421 - RNA, 15 nt, Mycobacterium avium subsp. paratuberculosis
cgacgucgucgaugc

SEQ ID NO: 922422 - RNA, 20 nt, Mycobacterium avium subsp. paratuberculosis
cgacgucgucgaugccgauc

SEQ ID NO: 922423 - RNA, 15 nt, Mycobacterium avium subsp. paratuberculosis
cgacgucgucgccca

SEQ ID NO: 922424 - RNA, 17 nt, Mycobacterium avium subsp. paratuberculosis
cgacgucgucgcccacc

SEQ ID NO: 922425 - RNA, 18 nt, Mycobacterium avium subsp. paratuberculosis
cgacgucgucgcccaccc

SEQ ID NO: 922426 - RNA, 21 nt, Mycobacterium avium subsp. paratuberculosis
cgacgucgucgcccacccgcc

SEQ ID NO: 922427 - RNA, 24 nt, Mycobacterium avium subsp. paratuberculosis
cgacgucgucgcccacccgccagc

SEQ ID NO: 922428 - RNA, 16 nt, Mycobacterium avium subsp. paratuberculosis
cgacgucgugcacgcc

SEQ ID NO: 922429 - RNA, 17 nt, Mycobacterium avium subsp. paratuberculosis
cgacgucgugcacgccg

SEQ ID NO: 922430 - RNA, 20 nt, Mycobacterium avium subsp. paratuberculosis
cgacgucgugcacgccgugg

SEQ ID NO: 922431 - RNA, 12 nt, Mycobacterium avium subsp. paratuberculosis
cgacgucguggc

SEQ ID NO: 922432 - RNA, 19 nt, Mycobacterium avium subsp. paratuberculosis
cgacgucgugggcgauccg

SEQ ID NO: 922433 - RNA, 22 nt, Mycobacterium avium subsp. paratuberculosis
cgacgugcuuggccagcucggc

SEQ ID NO: 922434 - RNA, 20 nt, Mycobacterium avium subsp. paratuberculosis
cgacguggagucgaagcggu

SEQ ID NO: 922435 - RNA, 24 nt, Mycobacterium avium subsp. paratuberculosis
cgacgucgguguagucggcgaucg

SEQ ID NO: 922436 - RNA, 14 nt, Mycobacterium avium subsp. paratuberculosis
cgacgucguagagc

SEQ ID NO: 922437 - RNA, 21 nt, Mycobacterium avium subsp. paratuberculosis
cgacgucguagagcaggaccg

SEQ ID NO: 922438 - RNA, 14 nt, Mycobacterium avium subsp. paratuberculosis
cgacgucggcguca

SEQ ID NO: 922439 - RNA, 15 nt, Mycobacterium avium subsp. paratuberculosis
cgacgucggcgucau

SEQ ID NO: 922440 - RNA, 21 nt, Mycobacterium avium subsp. paratuberculosis
cgacgucggggucgucgcggu

SEQ ID NO: 922441 - RNA, 13 nt, Mycobacterium avium subsp. paratuberculosis
cgacgucggucgg

SEQ ID NO: 922442 - RNA, 13 nt, Mycobacterium avium subsp. paratuberculosis
cgacguccgggcc

SEQ ID NO: 922443 - RNA, 15 nt, Mycobacterium avium subsp. paratuberculosis
cgacguccgggccgc

SEQ ID NO: 922444 - RNA, 16 nt, Mycobacterium avium subsp. paratuberculosis
cgacguccgggccgcc

SEQ ID NO: 922445 - RNA, 18 nt, Mycobacterium avium subsp. paratuberculosis
cgacguccgggccgccuc

SEQ ID NO: 922446 - RNA, 14 nt, Mycobacterium avium subsp. paratuberculosis
cgacgucggacgcg

SEQ ID NO: 922447 - RNA, 16 nt, Mycobacterium avium subsp. paratuberculosis
cgacgucggacgcggc

SEQ ID NO: 922448 - RNA, 18 nt, Mycobacterium avium subsp. paratuberculosis
cgacgucggacgcggccg

SEQ ID NO: 922449 - RNA, 20 nt, Mycobacterium avium subsp. paratuberculosis
cgacgucggacgcggccgag

SEQ ID NO: 922450 - RNA, 21 nt, Mycobacterium avium subsp. paratuberculosis
cgacgucggacgcggccgagc

SEQ ID NO: 922451 - RNA, 13 nt, Mycobacterium avium subsp. paratuberculosis
cgacggcgucggc

SEQ ID NO: 922452 - RNA, 20 nt, Mycobacterium avium subsp. paratuberculosis
cgacggcgucggcggccugc

SEQ ID NO: 922453 - RNA, 17 nt, Mycobacterium avium subsp. paratuberculosis
cgacggucaguccgggu

SEQ ID NO: 922454 - RNA, 22 nt, Mycobacterium avium subsp. paratuberculosis
cgacggucuucccgccgccguc

SEQ ID NO: 922455 - RNA, 17 nt, Mycobacterium avium subsp. paratuberculosis
cgacggugaccggcucg

SEQ ID NO: 922456 - RNA, 20 nt, Mycobacterium avium subsp. paratuberculosis
cgacggugaccggcucgagc

SEQ ID NO: 922457 - RNA, 14 nt, Mycobacterium avium subsp. paratuberculosis
cgacggugaccucg

SEQ ID NO: 922458 - RNA, 17 nt, Mycobacterium avium subsp. paratuberculosis
cgacggugaccucgucg

SEQ ID NO: 922459 - RNA, 20 nt, Mycobacterium avium subsp. paratuberculosis
cgacggugaccucgucgggc

SEQ ID NO: 922460 - RNA, 21 nt, Mycobacterium avium subsp. paratuberculosis
cgacggugaccucgucgggcg

SEQ ID NO: 922461 - RNA, 16 nt, Mycobacterium avium subsp. paratuberculosis
cgacggugagcaccgc

SEQ ID NO: 922462 - RNA, 18 nt, Mycobacterium avium subsp. paratuberculosis
cgacggugagcaccgccg

SEQ ID NO: 922463 - RNA, 20 nt, Mycobacterium avium subsp. paratuberculosis
cgacggcguggaacacgccc

SEQ ID NO: 922464 - RNA, 22 nt, Mycobacterium avium subsp. paratuberculosis
cgacggcguggaacacgcccag

SEQ ID NO: 922465 - RNA, 17 nt, Mycobacterium avium subsp. paratuberculosis
cgacggcguggucggcg

SEQ ID NO: 922466 - RNA, 18 nt, Mycobacterium avium subsp. paratuberculosis
cgacggcguggucggcga

SEQ ID NO: 922467 - RNA, 17 nt, Mycobacterium avium subsp. paratuberculosis
cgacggcguugcuggcg

SEQ ID NO: 922468 - RNA, 19 nt, Mycobacterium avium subsp. paratuberculosis
cgacggcguugcuggcgcg

SEQ ID NO: 922469 - RNA, 21 nt, Mycobacterium avium subsp. paratuberculosis
cgacggcuaccugaccagcgg

SEQ ID NO: 922470 - RNA, 12 nt, Mycobacterium avium subsp. paratuberculosis
cgacggcgucca

SEQ ID NO: 922471 - RNA, 17 nt, Mycobacterium avium subsp. paratuberculosis
cgacggcguccagcugc

SEQ ID NO: 922472 - RNA, 23 nt, Mycobacterium avium subsp. paratuberculosis
cgacggcguccagcugcgcgccg

SEQ ID NO: 922473 - RNA, 13 nt, Mycobacterium avium subsp. paratuberculosis
cgacggcguccgg

SEQ ID NO: 922474 - RNA, 16 nt, Mycobacterium avium subsp. paratuberculosis
cgacggcguccgggcg

SEQ ID NO: 922475 - RNA, 16 nt, Mycobacterium avium subsp. paratuberculosis
cgacggcgcgcccgac

SEQ ID NO: 922476 - RNA, 20 nt, Mycobacterium avium subsp. paratuberculosis
cgacggcgcgcccgacgaug

SEQ ID NO: 922477 - RNA, 22 nt, Mycobacterium avium subsp. paratuberculosis
cgacggcgcgcccgacgaugcg

SEQ ID NO: 922478 - RNA, 13 nt, Mycobacterium avium subsp. paratuberculosis
cgacggcgcguga

SEQ ID NO: 922479 - RNA, 14 nt, Mycobacterium avium subsp. paratuberculosis
cgacggcgcuggcc

SEQ ID NO: 922480 - RNA, 15 nt, Mycobacterium avium subsp. paratuberculosis
cgacggcgcuggccg

SEQ ID NO: 922481 - RNA, 16 nt, Mycobacterium avium subsp. paratuberculosis
cgacggcgcuggccgc

SEQ ID NO: 922482 - RNA, 18 nt, Mycobacterium avium subsp. paratuberculosis
cgacggcgcuggccgcgg

SEQ ID NO: 922483 - RNA, 18 nt, Mycobacterium avium subsp. paratuberculosis
cgacggcgcuguaccgcg

SEQ ID NO: 922484 - RNA, 18 nt, Mycobacterium avium subsp. paratuberculosis
cgacggcgccgacgaugc

SEQ ID NO: 922485 - RNA, 12 nt, Mycobacterium avium subsp. paratuberculosis
cgacggcggccg

SEQ ID NO: 922486 - RNA, 21 nt, Mycobacterium avium subsp. paratuberculosis
cgacggcggcgaagacgucgg

SEQ ID NO: 922487 - RNA, 22 nt, Mycobacterium avium subsp. paratuberculosis
cgacggcggcgaagacgucggc

SEQ ID NO: 922488 - RNA, 14 nt, Mycobacterium avium subsp. paratuberculosis
cgacggcggcgacg

SEQ ID NO: 922489 - RNA, 17 nt, Mycobacterium avium subsp. paratuberculosis
cgacggcggcgacguga

SEQ ID NO: 922490 - RNA, 14 nt, Mycobacterium avium subsp. paratuberculosis
cgacggcggggaug

SEQ ID NO: 922491 - RNA, 13 nt, Mycobacterium avium subsp. paratuberculosis
cgacggcggggug

SEQ ID NO: 922492 - RNA, 14 nt, Mycobacterium avium subsp. paratuberculosis
cgacggcggggugc

SEQ ID NO: 922493 - RNA, 15 nt, Mycobacterium avium subsp. paratuberculosis
cgacggcggggugcg

SEQ ID NO: 922494 - RNA, 16 nt, Mycobacterium avium subsp. paratuberculosis
cgacggcggggugcgc

SEQ ID NO: 922495 - RNA, 20 nt, Mycobacterium avium subsp. paratuberculosis
cgacggcggggugcgcggcg

SEQ ID NO: 922496 - RNA, 14 nt, Mycobacterium avium subsp. paratuberculosis
cgacggcggugacg

SEQ ID NO: 922497 - RNA, 14 nt, Mycobacterium avium subsp. paratuberculosis
cgacguccaggccg

SEQ ID NO: 922498 - RNA, 18 nt, Mycobacterium avium subsp. paratuberculosis
cgacguccaggccggcgc

SEQ ID NO: 922499 - RNA, 20 nt, Mycobacterium avium subsp. paratuberculosis
cgacguccaggccggcgccg

SEQ ID NO: 922500 - RNA, 14 nt, Mycobacterium avium subsp. paratuberculosis
cgacguccaccgga

SEQ ID NO: 922501 - RNA, 22 nt, Mycobacterium avium subsp. paratuberculosis
cgacguccaccggauggcgccc

SEQ ID NO: 922502 - RNA, 23 nt, Mycobacterium avium subsp. paratuberculosis
cgacguccaucgggaccgcgggc

SEQ ID NO: 922503 - RNA, 12 nt, Mycobacterium avium subsp. paratuberculosis
cgacguccacgu

SEQ ID NO: 922504 - RNA, 20 nt, Mycobacterium avium subsp. paratuberculosis
cgacguccacguugaugccg

SEQ ID NO: 922505 - RNA, 14 nt, Mycobacterium avium subsp. paratuberculosis
cgacgucaccaccg

SEQ ID NO: 922506 - RNA, 21 nt, Mycobacterium avium subsp. paratuberculosis
cgacgucaccaccgggucguc

SEQ ID NO: 922507 - RNA, 14 nt, Mycobacterium avium subsp. paratuberculosis
cgacgucacgacgg

SEQ ID NO: 922508 - RNA, 15 nt, Mycobacterium avium subsp. paratuberculosis
cgacggugucguaga

SEQ ID NO: 922509 - RNA, 19 nt, Mycobacterium avium subsp. paratuberculosis
cgacgucaggggugccgga

SEQ ID NO: 922510 - RNA, 21 nt, Mycobacterium avium subsp. paratuberculosis
cgacgucaggguggccucguc

SEQ ID NO: 922511 - RNA, 23 nt, Mycobacterium avium subsp. paratuberculosis
cgacgucaggguggccucgucgg

SEQ ID NO: 922512 - RNA, 22 nt, Mycobacterium avium subsp. paratuberculosis
cgacgucaggucgaccggcucg

SEQ ID NO: 922513 - RNA, 17 nt, Mycobacterium avium subsp. paratuberculosis
cgacgucauccggcugc

SEQ ID NO: 922514 - RNA, 16 nt, Mycobacterium avium subsp. paratuberculosis
cgacgucaacaccgug

SEQ ID NO: 922515 - RNA, 20 nt, Mycobacterium avium subsp. paratuberculosis
cgacgucaacaccguggugg

SEQ ID NO: 922516 - RNA, 20 nt, Mycobacterium avium subsp. paratuberculosis
cgacgguguaggacgccgug

SEQ ID NO: 922517 - RNA, 22 nt, Mycobacterium avium subsp. paratuberculosis
cgacgguguaggacgccgugca

SEQ ID NO: 922518 - RNA, 23 nt, Mycobacterium avium subsp. paratuberculosis
cgacgguguaggacgccgugcag

SEQ ID NO: 922519 - RNA, 21 nt, Mycobacterium avium subsp. paratuberculosis
cgacgguggcccccaccacga

SEQ ID NO: 922520 - RNA, 19 nt, Mycobacterium avium subsp. paratuberculosis
cgacgguggcgcccagcga

SEQ ID NO: 922521 - RNA, 17 nt, Mycobacterium avium subsp. paratuberculosis
cgacgguggcggcgaug

SEQ ID NO: 922522 - RNA, 18 nt, Mycobacterium avium subsp. paratuberculosis
cgacgguggcggcgaugu

SEQ ID NO: 922523 - RNA, 12 nt, Mycobacterium avium subsp. paratuberculosis
cgacggugcgcc

SEQ ID NO: 922524 - RNA, 14 nt, Mycobacterium avium subsp. paratuberculosis
cgacggugcgcccg

SEQ ID NO: 922525 - RNA, 15 nt, Mycobacterium avium subsp. paratuberculosis
cgacggugcgcccgu

SEQ ID NO: 922526 - RNA, 17 nt, Mycobacterium avium subsp. paratuberculosis
cgacggugcgcccgucg

SEQ ID NO: 922527 - RNA, 22 nt, Mycobacterium avium subsp. paratuberculosis
cgacggugcgcccgucgucgcc

SEQ ID NO: 922528 - RNA, 20 nt, Mycobacterium avium subsp. paratuberculosis
cgacggucgugcugggccgg

SEQ ID NO: 922529 - RNA, 18 nt, Mycobacterium avium subsp. paratuberculosis
cgacggugaugucgccgg

SEQ ID NO: 922530 - RNA, 23 nt, Mycobacterium avium subsp. paratuberculosis
cgacggugaugucgccggcggcg

SEQ ID NO: 922531 - RNA, 12 nt, Mycobacterium avium subsp. paratuberculosis
cgacgcgccgca

SEQ ID NO: 922532 - RNA, 13 nt, Mycobacterium avium subsp. paratuberculosis
cgacgcgccgcac

SEQ ID NO: 922533 - RNA, 14 nt, Mycobacterium avium subsp. paratuberculosis
cgacgcgccgcacu

SEQ ID NO: 922534 - RNA, 21 nt, Mycobacterium avium subsp. paratuberculosis
cgacgccggcgaggcggucgg

SEQ ID NO: 922535 - RNA, 14 nt, Mycobacterium avium subsp. paratuberculosis
cgacgccgucgggg

SEQ ID NO: 922536 - RNA, 23 nt, Mycobacterium avium subsp. paratuberculosis
cgacgccuccacauacgcggcgg

SEQ ID NO: 922537 - RNA, 18 nt, Mycobacterium avium subsp. paratuberculosis
cgacgcgccacgccccgg

SEQ ID NO: 922538 - RNA, 19 nt, Mycobacterium avium subsp. paratuberculosis
cgacgcgccacgccccggc

SEQ ID NO: 922539 - RNA, 21 nt, Mycobacterium avium subsp. paratuberculosis
cgacgcgccacgccccggcgc

SEQ ID NO: 922540 - RNA, 17 nt, Mycobacterium avium subsp. paratuberculosis
cgacgcgcugcgcgccg

SEQ ID NO: 922541 - RNA, 14 nt, Mycobacterium avium subsp. paratuberculosis
cgacgcgcucggcg

SEQ ID NO: 922542 - RNA, 19 nt, Mycobacterium avium subsp. paratuberculosis
cgacgcgcucggcgaccgc

SEQ ID NO: 922543 - RNA, 14 nt, Mycobacterium avium subsp. paratuberculosis
cgacgcgccgucgg

SEQ ID NO: 922544 - RNA, 15 nt, Mycobacterium avium subsp. paratuberculosis
cgacgcgccgucggc

SEQ ID NO: 922545 - RNA, 18 nt, Mycobacterium avium subsp. paratuberculosis
cgacgcgccgucggccca

SEQ ID NO: 922546 - RNA, 12 nt, Mycobacterium avium subsp. paratuberculosis
cgacgcggcacg

SEQ ID NO: 922547 - RNA, 15 nt, Mycobacterium avium subsp. paratuberculosis
cgacgcggcacgccg

SEQ ID NO: 922548 - RNA, 16 nt, Mycobacterium avium subsp. paratuberculosis
cgacgcggcacgccgc

SEQ ID NO: 922549 - RNA, 18 nt, Mycobacterium avium subsp. paratuberculosis
cgacgcggcacgccgcuc

SEQ ID NO: 922550 - RNA, 13 nt, Mycobacterium avium subsp. paratuberculosis
cgacgcggcgcga

SEQ ID NO: 922551 - RNA, 22 nt, Mycobacterium avium subsp. paratuberculosis
cgacgcggcgcgacaccgcggc

SEQ ID NO: 922552 - RNA, 15 nt, Mycobacterium avium subsp. paratuberculosis
cgacgcugcaggugg

SEQ ID NO: 922553 - RNA, 16 nt, Mycobacterium avium subsp. paratuberculosis
cgacgcugccggggcg

SEQ ID NO: 922554 - RNA, 20 nt, Mycobacterium avium subsp. paratuberculosis
cgacgcugccgguggucccg

SEQ ID NO: 922555 - RNA, 21 nt, Mycobacterium avium subsp. paratuberculosis
cgacgcugccgguggucccgg

SEQ ID NO: 922556 - RNA, 15 nt, Mycobacterium avium subsp. paratuberculosis
cgacgcuggccgaga

SEQ ID NO: 922557 - RNA, 19 nt, Mycobacterium avium subsp. paratuberculosis
cgacgcuggccgagagccg

SEQ ID NO: 922558 - RNA, 21 nt, Mycobacterium avium subsp. paratuberculosis
cgacgcuggccgagagccggu

SEQ ID NO: 922559 - RNA, 12 nt, Mycobacterium avium subsp. paratuberculosis
cgacggacgggu

SEQ ID NO: 922560 - RNA, 17 nt, Mycobacterium avium subsp. paratuberculosis
cgacggaccagugcagg

SEQ ID NO: 922561 - RNA, 18 nt, Mycobacterium avium subsp. paratuberculosis
cgacggaccagugcaggu

SEQ ID NO: 922562 - RNA, 16 nt, Mycobacterium avium subsp. paratuberculosis
cgacgcuucguggacg

SEQ ID NO: 922563 - RNA, 13 nt, Mycobacterium avium subsp. paratuberculosis
cgacggagccgag

SEQ ID NO: 922564 - RNA, 15 nt, Mycobacterium avium subsp. paratuberculosis
cgacggagccgagca

SEQ ID NO: 922565 - RNA, 17 nt, Mycobacterium avium subsp. paratuberculosis
cgacggagccgagcacc

SEQ ID NO: 922566 - RNA, 15 nt, Mycobacterium avium subsp. paratuberculosis
cgacggagucgucgg

SEQ ID NO: 922567 - RNA, 16 nt, Mycobacterium avium subsp. paratuberculosis
cgacggagucgucggc

SEQ ID NO: 922568 - RNA, 14 nt, Mycobacterium avium subsp. paratuberculosis
cgacggagacgacg

SEQ ID NO: 922569 - RNA, 17 nt, Mycobacterium avium subsp. paratuberculosis
cgacggcaauccggccc

SEQ ID NO: 922570 - RNA, 13 nt, Mycobacterium avium subsp. paratuberculosis
cgacggaucgccc

SEQ ID NO: 922571 - RNA, 16 nt, Mycobacterium avium subsp. paratuberculosis
cgacggaucgcccugg

SEQ ID NO: 922572 - RNA, 18 nt, Mycobacterium avium subsp. paratuberculosis
cgacggaucggccgcguc

SEQ ID NO: 922573 - RNA, 13 nt, Mycobacterium avium subsp. paratuberculosis
cgacggaucugcu

SEQ ID NO: 922574 - RNA, 15 nt, Mycobacterium avium subsp. paratuberculosis
cgacggaucugcucg

SEQ ID NO: 922575 - RNA, 21 nt, Mycobacterium avium subsp. paratuberculosis
cgacggaagccgagcggucca

SEQ ID NO: 922576 - RNA, 18 nt, Mycobacterium avium subsp. paratuberculosis
cgacgcugugcgccuugc

SEQ ID NO: 922577 - RNA, 19 nt, Mycobacterium avium subsp. paratuberculosis
cgacgcugugcgccuugcc

SEQ ID NO: 922578 - RNA, 20 nt, Mycobacterium avium subsp. paratuberculosis
cgacgcugugcgccuugccg

SEQ ID NO: 922579 - RNA, 17 nt, Mycobacterium avium subsp. paratuberculosis
cgacgcggcgaccacca

SEQ ID NO: 922580 - RNA, 20 nt, Mycobacterium avium subsp. paratuberculosis
cgacgcggcgaccaccaccg

SEQ ID NO: 922581 - RNA, 19 nt, Mycobacterium avium subsp. paratuberculosis
cgacggcgccugauccgcg

SEQ ID NO: 922582 - RNA, 23 nt, Mycobacterium avium subsp. paratuberculosis
cgacggcgccugauccgcgguca

SEQ ID NO: 922583 - RNA, 12 nt, Mycobacterium avium subsp. paratuberculosis
cgacggcgccga

SEQ ID NO: 922584 - RNA, 13 nt, Mycobacterium avium subsp. paratuberculosis
cgacggcgccgcc

SEQ ID NO: 922585 - RNA, 15 nt, Mycobacterium avium subsp. paratuberculosis
cgacggcgccgcccg

SEQ ID NO: 922586 - RNA, 14 nt, Mycobacterium avium subsp. paratuberculosis
cgacggcgccgcgg

SEQ ID NO: 922587 - RNA, 16 nt, Mycobacterium avium subsp. paratuberculosis
cgacggcgccgcggcc

SEQ ID NO: 922588 - RNA, 17 nt, Mycobacterium avium subsp. paratuberculosis
cgacggcgccgcggccg

SEQ ID NO: 922589 - RNA, 15 nt, Mycobacterium avium subsp. paratuberculosis
cgacggcgccgcguc

SEQ ID NO: 922590 - RNA, 12 nt, Mycobacterium avium subsp. paratuberculosis
cgacggcgccgg

SEQ ID NO: 922591 - RNA, 13 nt, Mycobacterium avium subsp. paratuberculosis
cgacggcgccgga

SEQ ID NO: 922592 - RNA, 13 nt, Mycobacterium avium subsp. paratuberculosis
cgacggcgccggu

SEQ ID NO: 922593 - RNA, 14 nt, Mycobacterium avium subsp. paratuberculosis
cgacggcgccggug

SEQ ID NO: 922594 - RNA, 23 nt, Mycobacterium avium subsp. paratuberculosis
cgacggcgccggugcccacgccg

SEQ ID NO: 922595 - RNA, 15 nt, Mycobacterium avium subsp. paratuberculosis
cgacggcgacggcgu

SEQ ID NO: 922596 - RNA, 18 nt, Mycobacterium avium subsp. paratuberculosis
cgacggcgacggcguccg

SEQ ID NO: 922597 - RNA, 13 nt, Mycobacterium avium subsp. paratuberculosis
cgacggcgagccg

SEQ ID NO: 922598 - RNA, 16 nt, Mycobacterium avium subsp. paratuberculosis
cgacggcgagccgggc

SEQ ID NO: 922599 - RNA, 17 nt, Mycobacterium avium subsp. paratuberculosis
cgacggcgagccgggcc

SEQ ID NO: 922600 - RNA, 20 nt, Mycobacterium avium subsp. paratuberculosis
cgacggcgaguucgaugacg

SEQ ID NO: 922601 - RNA, 14 nt, Mycobacterium avium subsp. paratuberculosis
cgacggccugcacg

SEQ ID NO: 922602 - RNA, 21 nt, Mycobacterium avium subsp. paratuberculosis
cgacggccgcaccccacccgc

SEQ ID NO: 922603 - RNA, 18 nt, Mycobacterium avium subsp. paratuberculosis
cgacggccucgccgucgc

SEQ ID NO: 922604 - RNA, 19 nt, Mycobacterium avium subsp. paratuberculosis
cgacggccucgccgucgcg

SEQ ID NO: 922605 - RNA, 14 nt, Mycobacterium avium subsp. paratuberculosis
cgacggccggguca

SEQ ID NO: 922606 - RNA, 13 nt, Mycobacterium avium subsp. paratuberculosis
cgacggccgguga

SEQ ID NO: 922607 - RNA, 18 nt, Mycobacterium avium subsp. paratuberculosis
cgacggccguccggucgc

SEQ ID NO: 922608 - RNA, 21 nt, Mycobacterium avium subsp. paratuberculosis
cgacggccguccggucgcugg

SEQ ID NO: 922609 - RNA, 16 nt, Mycobacterium avium subsp. paratuberculosis
cgacggccggcccugc

SEQ ID NO: 922610 - RNA, 13 nt, Mycobacterium avium subsp. paratuberculosis
cgacggccggcgu

SEQ ID NO: 922611 - RNA, 15 nt, Mycobacterium avium subsp. paratuberculosis
cgacggccggcguca

SEQ ID NO: 922612 - RNA, 15 nt, Mycobacterium avium subsp. paratuberculosis
cgacggccggggcca

SEQ ID NO: 922613 - RNA, 20 nt, Mycobacterium avium subsp. paratuberculosis
cgacggccggggccagcacc

SEQ ID NO: 922614 - RNA, 20 nt, Mycobacterium avium subsp. paratuberculosis
cgacggccucguggaaaucg

SEQ ID NO: 922615 - RNA, 19 nt, Mycobacterium avium subsp. paratuberculosis
cgacggcgaacgucgaugu

SEQ ID NO: 922616 - RNA, 17 nt, Mycobacterium avium subsp. paratuberculosis
cgacggcgaagccggcg

SEQ ID NO: 922617 - RNA, 20 nt, Mycobacterium avium subsp. paratuberculosis
cgacggcgaagccggcguca

SEQ ID NO: 922618 - RNA, 16 nt, Mycobacterium avium subsp. paratuberculosis
cgacggcgaccacacc

SEQ ID NO: 922619 - RNA, 14 nt, Mycobacterium avium subsp. paratuberculosis
cgacggcgaccauc

SEQ ID NO: 922620 - RNA, 22 nt, Mycobacterium avium subsp. paratuberculosis
cgacggcgaccauccacucggg

SEQ ID NO: 922621 - RNA, 11 nt, Mycobacterium avium subsp. paratuberculosis
cgacggcgacg

SEQ ID NO: 922622 - RNA, 14 nt, Mycobacterium avium subsp. paratuberculosis
cgacggcgacgacc

SEQ ID NO: 922623 - RNA, 15 nt, Mycobacterium avium subsp. paratuberculosis
cgacggcgacgaccg

SEQ ID NO: 922624 - RNA, 15 nt, Mycobacterium avium subsp. paratuberculosis
cgacggcgacggcca

SEQ ID NO: 922625 - RNA, 18 nt, Mycobacterium avium subsp. paratuberculosis
cgacggccccccgggcac

SEQ ID NO: 922626 - RNA, 16 nt, Mycobacterium avium subsp. paratuberculosis
cgacggccagcgcggc

SEQ ID NO: 922627 - RNA, 17 nt, Mycobacterium avium subsp. paratuberculosis
cgacggccagcgcggcg

SEQ ID NO: 922628 - RNA, 22 nt, Mycobacterium avium subsp. paratuberculosis
cgacggccagcgcggcggucgc

SEQ ID NO: 922629 - RNA, 22 nt, Mycobacterium avium subsp. paratuberculosis
cgacggccagcugauagccgcc

SEQ ID NO: 922630 - RNA, 14 nt, Mycobacterium avium subsp. paratuberculosis
cgacggccagcgcg

SEQ ID NO: 922631 - RNA, 14 nt, Mycobacterium avium subsp. paratuberculosis
cgacggccagcagg

SEQ ID NO: 922632 - RNA, 13 nt, Mycobacterium avium subsp. paratuberculosis
cgacggcccgccg

SEQ ID NO: 922633 - RNA, 22 nt, Mycobacterium avium subsp. paratuberculosis
cgacggcccgccggagccgauc

SEQ ID NO: 922634 - RNA, 15 nt, Mycobacterium avium subsp. paratuberculosis
cgacggcccggucca

SEQ ID NO: 922635 - RNA, 12 nt, Mycobacterium avium subsp. paratuberculosis
cgacggccgccg

SEQ ID NO: 922636 - RNA, 22 nt, Mycobacterium avium subsp. paratuberculosis
cgacggccgccgauuccggccg

SEQ ID NO: 922637 - RNA, 23 nt, Mycobacterium avium subsp. paratuberculosis
cgacggccgccgauuccggccgg

SEQ ID NO: 922638 - RNA, 12 nt, Mycobacterium avium subsp. paratuberculosis
cgacggccgcgc

SEQ ID NO: 922639 - RNA, 18 nt, Mycobacterium avium subsp. paratuberculosis
cgacggccgcgccgaaca

SEQ ID NO: 922640 - RNA, 17 nt, Mycobacterium avium subsp. paratuberculosis
cgacggccgcgccguug

SEQ ID NO: 922641 - RNA, 15 nt, Mycobacterium avium subsp. paratuberculosis
cgacggccaccgcga

SEQ ID NO: 922642 - RNA, 17 nt, Mycobacterium avium subsp. paratuberculosis
cgacggccaccgcgacg

SEQ ID NO: 922643 - RNA, 18 nt, Mycobacterium avium subsp. paratuberculosis
cgacggccaccgcgacgc

SEQ ID NO: 922644 - RNA, 22 nt, Mycobacterium avium subsp. paratuberculosis
cgacggccaccgcgacgcugcc

SEQ ID NO: 922645 - RNA, 14 nt, Mycobacterium avium subsp. paratuberculosis
cgacggcagcgcga

SEQ ID NO: 922646 - RNA, 13 nt, Mycobacterium avium subsp. paratuberculosis
cgacggcagcggc

SEQ ID NO: 922647 - RNA, 19 nt, Mycobacterium avium subsp. paratuberculosis
cgacggcagcggcaccaac

SEQ ID NO: 922648 - RNA, 21 nt, Mycobacterium avium subsp. paratuberculosis
cgacggcaggucggugcgcgg

SEQ ID NO: 922649 - RNA, 15 nt, Mycobacterium avium subsp. paratuberculosis
cgacggcaccgccgg

SEQ ID NO: 922650 - RNA, 17 nt, Mycobacterium avium subsp. paratuberculosis
cgacggcaccgccggcg

SEQ ID NO: 922651 - RNA, 19 nt, Mycobacterium avium subsp. paratuberculosis
cgacggcaccgccggcggc

SEQ ID NO: 922652 - RNA, 15 nt, Mycobacterium avium subsp. paratuberculosis
cgacggcaccucucg

SEQ ID NO: 922653 - RNA, 19 nt, Mycobacterium avium subsp. paratuberculosis
cgacggcaccucucgggaa

SEQ ID NO: 922654 - RNA, 14 nt, Mycobacterium avium subsp. paratuberculosis
cgacggcagcaccg

SEQ ID NO: 922655 - RNA, 15 nt, Mycobacterium avium subsp. paratuberculosis
cgacggcagcaccgc

SEQ ID NO: 922656 - RNA, 18 nt, Mycobacterium avium subsp. paratuberculosis
cgacggcagcaccgccga

SEQ ID NO: 922657 - RNA, 19 nt, Mycobacterium avium subsp. paratuberculosis
cgacggcagcaccgccgac

SEQ ID NO: 922658 - RNA, 20 nt, Mycobacterium avium subsp. paratuberculosis
cgacggcagcaccgccgaca

SEQ ID NO: 922659 - RNA, 22 nt, Mycobacterium avium subsp. paratuberculosis
cgacggcagcaccgccgacauc

SEQ ID NO: 922660 - RNA, 23 nt, Mycobacterium avium subsp. paratuberculosis
cgacggcagcaccgccgacaucg

SEQ ID NO: 922661 - RNA, 15 nt, Mycobacterium avium subsp. paratuberculosis
cgacgcauguccgcc

SEQ ID NO: 922662 - RNA, 19 nt, Mycobacterium avium subsp. paratuberculosis
cgacgcauguccgccguca

SEQ ID NO: 922663 - RNA, 20 nt, Mycobacterium avium subsp. paratuberculosis
cgacgcauguccgccgucau

SEQ ID NO: 922664 - RNA, 20 nt, Mycobacterium avium subsp. paratuberculosis
cgacgcauucgcugugaugg

SEQ ID NO: 922665 - RNA, 13 nt, Mycobacterium avium subsp. paratuberculosis
cgacgccaccgcg

SEQ ID NO: 922666 - RNA, 14 nt, Mycobacterium avium subsp. paratuberculosis
cgacgccaccgcga

SEQ ID NO: 922667 - RNA, 13 nt, Mycobacterium avium subsp. paratuberculosis
cgacgccccgcgc

SEQ ID NO: 922668 - RNA, 17 nt, Mycobacterium avium subsp. paratuberculosis
cgacgccccgcgccucg

SEQ ID NO: 922669 - RNA, 19 nt, Mycobacterium avium subsp. paratuberculosis
cgacgcccaggugcacccg

SEQ ID NO: 922670 - RNA, 20 nt, Mycobacterium avium subsp. paratuberculosis
cgacgcccaggugcacccga

SEQ ID NO: 922671 - RNA, 19 nt, Mycobacterium avium subsp. paratuberculosis
cgacgccagaaccggcaac

SEQ ID NO: 922672 - RNA, 15 nt, Mycobacterium avium subsp. paratuberculosis
cgacgccagcaccuu

SEQ ID NO: 922673 - RNA, 22 nt, Mycobacterium avium subsp. paratuberculosis
cgacgccagcaccuucgggccg

SEQ ID NO: 922674 - RNA, 13 nt, Mycobacterium avium subsp. paratuberculosis
cgacgccagcacg

SEQ ID NO: 922675 - RNA, 14 nt, Mycobacterium avium subsp. paratuberculosis
cgacgccagcacgu

SEQ ID NO: 922676 - RNA, 20 nt, Mycobacterium avium subsp. paratuberculosis
cgacgccagcacguggccgg

SEQ ID NO: 922677 - RNA, 14 nt, Mycobacterium avium subsp. paratuberculosis
cgacgccgucacgg

SEQ ID NO: 922678 - RNA, 13 nt, Mycobacterium avium subsp. paratuberculosis
cgacgccgucgag

SEQ ID NO: 922679 - RNA, 15 nt, Mycobacterium avium subsp. paratuberculosis
cgacgccgucgagcc

SEQ ID NO: 922680 - RNA, 16 nt, Mycobacterium avium subsp. paratuberculosis
cgacgccgucgaugac

SEQ ID NO: 922681 - RNA, 20 nt, Mycobacterium avium subsp. paratuberculosis
cgacgccgucgaugacgcgc

SEQ ID NO: 922682 - RNA, 12 nt, Mycobacterium avium subsp. paratuberculosis
cgacgccgucgg

SEQ ID NO: 922683 - RNA, 14 nt, Mycobacterium avium subsp. paratuberculosis
cgacgccgggcagc

SEQ ID NO: 922684 - RNA, 16 nt, Mycobacterium avium subsp. paratuberculosis
cgacgccgggcagcgc

SEQ ID NO: 922685 - RNA, 12 nt, Mycobacterium avium subsp. paratuberculosis
cgacgccgggcg

SEQ ID NO: 922686 - RNA, 13 nt, Mycobacterium avium subsp. paratuberculosis
cgacgccgggcgc

SEQ ID NO: 922687 - RNA, 14 nt, Mycobacterium avium subsp. paratuberculosis
cgacgccgggcgcc

SEQ ID NO: 922688 - RNA, 18 nt, Mycobacterium avium subsp. paratuberculosis
cgacgccgggcgcccgcg

SEQ ID NO: 922689 - RNA, 19 nt, Mycobacterium avium subsp. paratuberculosis
cgacgcccugccacagcga

SEQ ID NO: 922690 - RNA, 20 nt, Mycobacterium avium subsp. paratuberculosis
cgacgcccugccacagcgac

SEQ ID NO: 922691 - RNA, 24 nt, Mycobacterium avium subsp. paratuberculosis
cgacgccggaccccacagcgcgcc

SEQ ID NO: 922692 - RNA, 12 nt, Mycobacterium avium subsp. paratuberculosis
cgacgccggcca

SEQ ID NO: 922693 - RNA, 15 nt, Mycobacterium avium subsp. paratuberculosis
cgacgccggccacca

SEQ ID NO: 922694 - RNA, 18 nt, Mycobacterium avium subsp. paratuberculosis
cgacgcccuuggcgccca

SEQ ID NO: 922695 - RNA, 19 nt, Mycobacterium avium subsp. paratuberculosis
cgacgcccuuggcgcccag

SEQ ID NO: 922696 - RNA, 22 nt, Mycobacterium avium subsp. paratuberculosis
cgacgcccuuggcgcccagcgu

SEQ ID NO: 922697 - RNA, 23 nt, Mycobacterium avium subsp. paratuberculosis
cgacgcccuuggcgcccagcgug

SEQ ID NO: 922698 - RNA, 14 nt, Mycobacterium avium subsp. paratuberculosis
cgacgccgaacugc

SEQ ID NO: 922699 - RNA, 19 nt, Mycobacterium avium subsp. paratuberculosis
cgacgccgaacugccggac

SEQ ID NO: 922700 - RNA, 22 nt, Mycobacterium avium subsp. paratuberculosis
cgacgccgaacugccggaccag

SEQ ID NO: 922701 - RNA, 12 nt, Mycobacterium avium subsp. paratuberculosis
cgacgccgcgga

SEQ ID NO: 922702 - RNA, 13 nt, Mycobacterium avium subsp. paratuberculosis
cgacgccgcggaa

SEQ ID NO: 922703 - RNA, 20 nt, Mycobacterium avium subsp. paratuberculosis
cgacgcacgaaaccgcgugg

SEQ ID NO: 922704 - RNA, 14 nt, Mycobacterium avium subsp. paratuberculosis
cgacgcacgccggc

SEQ ID NO: 922705 - RNA, 16 nt, Mycobacterium avium subsp. paratuberculosis
cgacgauugucggggc

SEQ ID NO: 922706 - RNA, 17 nt, Mycobacterium avium subsp. paratuberculosis
cgacgauugucggggcc

SEQ ID NO: 922707 - RNA, 22 nt, Mycobacterium avium subsp. paratuberculosis
cgacgauugucggggccgcacu

SEQ ID NO: 922708 - RNA, 13 nt, Mycobacterium avium subsp. paratuberculosis
cgacgcaccacga

SEQ ID NO: 922709 - RNA, 14 nt, Mycobacterium avium subsp. paratuberculosis
cgacgcaccacgag

SEQ ID NO: 922710 - RNA, 18 nt, Mycobacterium avium subsp. paratuberculosis
cgacgcaccacgagcagc

SEQ ID NO: 922711 - RNA, 23 nt, Mycobacterium avium subsp. paratuberculosis
cgacgcaccacgagcagccgauc

SEQ ID NO: 922712 - RNA, 14 nt, Mycobacterium avium subsp. paratuberculosis
cgacgcaccucggc

SEQ ID NO: 922713 - RNA, 15 nt, Mycobacterium avium subsp. paratuberculosis
cgacgcaccucggcc

SEQ ID NO: 922714 - RNA, 12 nt, Mycobacterium avium subsp. paratuberculosis
cgacgaugucgg

SEQ ID NO: 922715 - RNA, 20 nt, Mycobacterium avium subsp. paratuberculosis
cgacgauacgugcucccgcc

SEQ ID NO: 922716 - RNA, 14 nt, Mycobacterium avium subsp. paratuberculosis
cgacgaugucgacg

SEQ ID NO: 922717 - RNA, 15 nt, Mycobacterium avium subsp. paratuberculosis
cgacgaugucgacgc

SEQ ID NO: 922718 - RNA, 15 nt, Mycobacterium avium subsp. paratuberculosis
cgacgauguuggcga

SEQ ID NO: 922719 - RNA, 18 nt, Mycobacterium avium subsp. paratuberculosis
cgacgauguuggcgacga

SEQ ID NO: 922720 - RNA, 19 nt, Mycobacterium avium subsp. paratuberculosis
cgacgauguuggcgacgac

SEQ ID NO: 922721 - RNA, 21 nt, Mycobacterium avium subsp. paratuberculosis
cgacgauguuggcgacgacgg

SEQ ID NO: 922722 - RNA, 20 nt, Mycobacterium avium subsp. paratuberculosis
cgacgagguugucccgggcg

SEQ ID NO: 922723 - RNA, 16 nt, Mycobacterium avium subsp. paratuberculosis
cgacgaggugaugccg

SEQ ID NO: 922724 - RNA, 20 nt, Mycobacterium avium subsp. paratuberculosis
cgacgaggugaugccgucca

SEQ ID NO: 922725 - RNA, 14 nt, Mycobacterium avium subsp. paratuberculosis
cgacgaggcgggcg

SEQ ID NO: 922726 - RNA, 19 nt, Mycobacterium avium subsp. paratuberculosis
cgacgaggcgggcgaucuc

SEQ ID NO: 922727 - RNA, 21 nt, Mycobacterium avium subsp. paratuberculosis
cgacgaggcgggcgaucucga

SEQ ID NO: 922728 - RNA, 14 nt, Mycobacterium avium subsp. paratuberculosis
cgacgagcgggccg

SEQ ID NO: 922729 - RNA, 18 nt, Mycobacterium avium subsp. paratuberculosis
cgacgagcgggccgauca

SEQ ID NO: 922730 - RNA, 14 nt, Mycobacterium avium subsp. paratuberculosis
cgacgagcucgccg

SEQ ID NO: 922731 - RNA, 16 nt, Mycobacterium avium subsp. paratuberculosis
cgacgagcucgccgcu

SEQ ID NO: 922732 - RNA, 22 nt, Mycobacterium avium subsp. paratuberculosis
cgacgaggagaccuccugcugg

SEQ ID NO: 922733 - RNA, 13 nt, Mycobacterium avium subsp. paratuberculosis
cgacgacgucgac

SEQ ID NO: 922734 - RNA, 14 nt, Mycobacterium avium subsp. paratuberculosis
cgacgacgucgacg

SEQ ID NO: 922735 - RNA, 15 nt, Mycobacterium avium subsp. paratuberculosis
cgacgacgucgacga

SEQ ID NO: 922736 - RNA, 21 nt, Mycobacterium avium subsp. paratuberculosis
cgacgacgucgacgacccgua

SEQ ID NO: 922737 - RNA, 14 nt, Mycobacterium avium subsp. paratuberculosis
cgacgacgucgcgc

SEQ ID NO: 922738 - RNA, 16 nt, Mycobacterium avium subsp. paratuberculosis
cgacgacgucgcgcag

SEQ ID NO: 922739 - RNA, 14 nt, Mycobacterium avium subsp. paratuberculosis
cgacgaccucgccc

SEQ ID NO: 922740 - RNA, 17 nt, Mycobacterium avium subsp. paratuberculosis
cgacgaccucgcccgcc

SEQ ID NO: 922741 - RNA, 19 nt, Mycobacterium avium subsp. paratuberculosis
cgacgaccucgcccgccgc

SEQ ID NO: 922742 - RNA, 22 nt, Mycobacterium avium subsp. paratuberculosis
cgacgaccucgcccgccgcgac

SEQ ID NO: 922743 - RNA, 23 nt, Mycobacterium avium subsp. paratuberculosis
cgacgaccucgcccgccgcgacg

SEQ ID NO: 922744 - RNA, 16 nt, Mycobacterium avium subsp. paratuberculosis
cgacgaccucgccgac

SEQ ID NO: 922745 - RNA, 17 nt, Mycobacterium avium subsp. paratuberculosis
cgacgaccucgccgacg

SEQ ID NO: 922746 - RNA, 14 nt, Mycobacterium avium subsp. paratuberculosis
cgacgaccucggug

SEQ ID NO: 922747 - RNA, 17 nt, Mycobacterium avium subsp. paratuberculosis
cgacgaccucgucgucg

SEQ ID NO: 922748 - RNA, 19 nt, Mycobacterium avium subsp. paratuberculosis
cgacgacgaagacguacgg

SEQ ID NO: 922749 - RNA, 19 nt, Mycobacterium avium subsp. paratuberculosis
cgacgacgaaucccgccuc

SEQ ID NO: 922750 - RNA, 15 nt, Mycobacterium avium subsp. paratuberculosis
cgacgacgccagcug

SEQ ID NO: 922751 - RNA, 12 nt, Mycobacterium avium subsp. paratuberculosis
cgacgacgccga

SEQ ID NO: 922752 - RNA, 13 nt, Mycobacterium avium subsp. paratuberculosis
cgacgacgccgau

SEQ ID NO: 922753 - RNA, 14 nt, Mycobacterium avium subsp. paratuberculosis
cgacgacgccgauc

SEQ ID NO: 922754 - RNA, 17 nt, Mycobacterium avium subsp. paratuberculosis
cgacgacgccgauccgc

SEQ ID NO: 922755 - RNA, 12 nt, Mycobacterium avium subsp. paratuberculosis
cgacgacgccgu

SEQ ID NO: 922756 - RNA, 16 nt, Mycobacterium avium subsp. paratuberculosis
cgacgacgccgucacg

SEQ ID NO: 922757 - RNA, 18 nt, Mycobacterium avium subsp. paratuberculosis
cgacgacgccgucacgga

SEQ ID NO: 922758 - RNA, 15 nt, Mycobacterium avium subsp. paratuberculosis
cgacgacgcggucgu

SEQ ID NO: 922759 - RNA, 20 nt, Mycobacterium avium subsp. paratuberculosis
cgacgacgcggucgucgucg

SEQ ID NO: 922760 - RNA, 18 nt, Mycobacterium avium subsp. paratuberculosis
cgacgacggcgaacgucg

SEQ ID NO: 922761 - RNA, 12 nt, Mycobacterium avium subsp. paratuberculosis
cgacgacggcgc

SEQ ID NO: 922762 - RNA, 13 nt, Mycobacterium avium subsp. paratuberculosis
cgacgacggcgcc

SEQ ID NO: 922763 - RNA, 14 nt, Mycobacterium avium subsp. paratuberculosis
cgacgacggcgccg

SEQ ID NO: 922764 - RNA, 15 nt, Mycobacterium avium subsp. paratuberculosis
cgacgacggcgccgc

SEQ ID NO: 922765 - RNA, 16 nt, Mycobacterium avium subsp. paratuberculosis
cgacgacggcgccgcg

SEQ ID NO: 922766 - RNA, 23 nt, Mycobacterium avium subsp. paratuberculosis
cgacgacggcgccgcgucggacc

SEQ ID NO: 922767 - RNA, 16 nt, Mycobacterium avium subsp. paratuberculosis
cgacgacggcggaguc

SEQ ID NO: 922768 - RNA, 22 nt, Mycobacterium avium subsp. paratuberculosis
cgacgacggucuucccgccgcc

SEQ ID NO: 922769 - RNA, 23 nt, Mycobacterium avium subsp. paratuberculosis
cgacgacggucuucccgccgccg

SEQ ID NO: 922770 - RNA, 15 nt, Mycobacterium avium subsp. paratuberculosis
cgacgaccaucagcg

SEQ ID NO: 922771 - RNA, 17 nt, Mycobacterium avium subsp. paratuberculosis
cgacgaccaucagcgcc

SEQ ID NO: 922772 - RNA, 18 nt, Mycobacterium avium subsp. paratuberculosis
cgacgaccaucagcgccc

SEQ ID NO: 922773 - RNA, 19 nt, Mycobacterium avium subsp. paratuberculosis
cgacgaccaucagcgcccg

SEQ ID NO: 922774 - RNA, 20 nt, Mycobacterium avium subsp. paratuberculosis
cgacgaccaucagcgcccgg

SEQ ID NO: 922775 - RNA, 19 nt, Mycobacterium avium subsp. paratuberculosis
cgacgaccaccaggagcac

SEQ ID NO: 922776 - RNA, 23 nt, Mycobacterium avium subsp. paratuberculosis
cgacgaccaccaggagcaccugc

SEQ ID NO: 922777 - RNA, 16 nt, Mycobacterium avium subsp. paratuberculosis
cgacgaccgcaccgac

SEQ ID NO: 922778 - RNA, 14 nt, Mycobacterium avium subsp. paratuberculosis
cgacgaccgcgacg

SEQ ID NO: 922779 - RNA, 16 nt, Mycobacterium avium subsp. paratuberculosis
cgacgaccgcgacggc

SEQ ID NO: 922780 - RNA, 15 nt, Mycobacterium avium subsp. paratuberculosis
cgacgaccgcguccg

SEQ ID NO: 922781 - RNA, 15 nt, Mycobacterium avium subsp. paratuberculosis
cgacgaccgucauca

SEQ ID NO: 922782 - RNA, 18 nt, Mycobacterium avium subsp. paratuberculosis
cgacgaccucccccgacg

SEQ ID NO: 922783 - RNA, 14 nt, Mycobacterium avium subsp. paratuberculosis
cgacgacccguagg

SEQ ID NO: 922784 - RNA, 16 nt, Mycobacterium avium subsp. paratuberculosis
cgacgacaggucgagc

SEQ ID NO: 922785 - RNA, 21 nt, Mycobacterium avium subsp. paratuberculosis
cgacgaagaaggacgccucgc

SEQ ID NO: 922786 - RNA, 14 nt, Mycobacterium avium subsp. paratuberculosis
cgacgaacgcggcg

SEQ ID NO: 922787 - RNA, 13 nt, Mycobacterium avium subsp. paratuberculosis
cgacgaacgcggu

SEQ ID NO: 922788 - RNA, 14 nt, Mycobacterium avium subsp. paratuberculosis
cgacgaacgcggug

SEQ ID NO: 922789 - RNA, 15 nt, Mycobacterium avium subsp. paratuberculosis
cgacgaacgcgguga

SEQ ID NO: 922790 - RNA, 24 nt, Mycobacterium avium subsp. paratuberculosis
cgacgaaccgugcacgaucgcggu

SEQ ID NO: 922791 - RNA, 14 nt, Mycobacterium avium subsp. paratuberculosis
cgacgaacugccgu

SEQ ID NO: 922792 - RNA, 16 nt, Mycobacterium avium subsp. paratuberculosis
cgacgaacugccguug

SEQ ID NO: 922793 - RNA, 17 nt, Mycobacterium avium subsp. paratuberculosis
cgaccugcuuggcggcc

SEQ ID NO: 922794 - RNA, 20 nt, Mycobacterium avium subsp. paratuberculosis
cgaccugcuuggcggccugc

SEQ ID NO: 922795 - RNA, 22 nt, Mycobacterium avium subsp. paratuberculosis
cgaccugcuuggcggccugcgc

SEQ ID NO: 922796 - RNA, 20 nt, Mycobacterium avium subsp. paratuberculosis
cgaccuggacgccgcacgcg

SEQ ID NO: 922797 - RNA, 18 nt, Mycobacterium avium subsp. paratuberculosis
cgacgaacagcaccgcca

SEQ ID NO: 922798 - RNA, 22 nt, Mycobacterium avium subsp. paratuberculosis
cgacgaacagcaccgccacggc

SEQ ID NO: 922799 - RNA, 13 nt, Mycobacterium avium subsp. paratuberculosis
cgacgaacgccgg

SEQ ID NO: 922800 - RNA, 16 nt, Mycobacterium avium subsp. paratuberculosis
cgacgaacgccggcau

SEQ ID NO: 922801 - RNA, 22 nt, Mycobacterium avium subsp. paratuberculosis
cgacgaacuccgagccggugga

SEQ ID NO: 922802 - RNA, 16 nt, Mycobacterium avium subsp. paratuberculosis
cgacgaacuccgcgcg

SEQ ID NO: 922803 - RNA, 17 nt, Mycobacterium avium subsp. paratuberculosis
cgacgaacuccgcgcgc

SEQ ID NO: 922804 - RNA, 18 nt, Mycobacterium avium subsp. paratuberculosis
cgacgaacuccgcgcgcg

SEQ ID NO: 922805 - RNA, 19 nt, Mycobacterium avium subsp. paratuberculosis
cgacgaacuccgcgcgcgg

SEQ ID NO: 922806 - RNA, 20 nt, Mycobacterium avium subsp. paratuberculosis
cgacgaacuccgcgcgcggc

SEQ ID NO: 922807 - RNA, 18 nt, Mycobacterium avium subsp. paratuberculosis
cgaccugcggcucgucgg

SEQ ID NO: 922808 - RNA, 20 nt, Mycobacterium avium subsp. paratuberculosis
cgaccugcggcucgucggcg

SEQ ID NO: 922809 - RNA, 21 nt, Mycobacterium avium subsp. paratuberculosis
cgaccugcggcucgucggcga

SEQ ID NO: 922810 - RNA, 11 nt, Mycobacterium avium subsp. paratuberculosis
cgaccugcggg

SEQ ID NO: 922811 - RNA, 12 nt, Mycobacterium avium subsp. paratuberculosis
cgaccugcgggc

SEQ ID NO: 922812 - RNA, 17 nt, Mycobacterium avium subsp. paratuberculosis
cgaccugcucgucggug

SEQ ID NO: 922813 - RNA, 18 nt, Mycobacterium avium subsp. paratuberculosis
cgaccugcucgucgguga

SEQ ID NO: 922814 - RNA, 19 nt, Mycobacterium avium subsp. paratuberculosis
cgaccugcucgucggugac

SEQ ID NO: 922815 - RNA, 15 nt, Mycobacterium avium subsp. paratuberculosis
cgaccugcgcgacgg

SEQ ID NO: 922816 - RNA, 13 nt, Mycobacterium avium subsp. paratuberculosis
cgaccugcccggg

SEQ ID NO: 922817 - RNA, 14 nt, Mycobacterium avium subsp. paratuberculosis
cgaccugcccgggc

SEQ ID NO: 922818 - RNA, 24 nt, Mycobacterium avium subsp. paratuberculosis
cgaccugauuucaucgcggcgacc

SEQ ID NO: 922819 - RNA, 17 nt, Mycobacterium avium subsp. paratuberculosis
cgaccugaacgcgcagu

SEQ ID NO: 922820 - RNA, 14 nt, Mycobacterium avium subsp. paratuberculosis
cgaccucggugaug

SEQ ID NO: 922821 - RNA, 14 nt, Mycobacterium avium subsp. paratuberculosis
cgaccucgguggug

SEQ ID NO: 922822 - RNA, 15 nt, Mycobacterium avium subsp. paratuberculosis
cgaccucgucgacgg

SEQ ID NO: 922823 - RNA, 18 nt, Mycobacterium avium subsp. paratuberculosis
cgaccucgucgacggcgg

SEQ ID NO: 922824 - RNA, 16 nt, Mycobacterium avium subsp. paratuberculosis
cgaccucuucgcugga

SEQ ID NO: 922825 - RNA, 21 nt, Mycobacterium avium subsp. paratuberculosis
cgaccucuucggcgccggcau

SEQ ID NO: 922826 - RNA, 13 nt, Mycobacterium avium subsp. paratuberculosis
cgaccucggcggc

SEQ ID NO: 922827 - RNA, 15 nt, Mycobacterium avium subsp. paratuberculosis
cgaccucggcggcca

SEQ ID NO: 922828 - RNA, 21 nt, Mycobacterium avium subsp. paratuberculosis
cgaccucggcggccagcgcga

SEQ ID NO: 922829 - RNA, 14 nt, Mycobacterium avium subsp. paratuberculosis
cgaccucggggaug

SEQ ID NO: 922830 - RNA, 18 nt, Mycobacterium avium subsp. paratuberculosis
cgaccucggggucggccg

SEQ ID NO: 922831 - RNA, 20 nt, Mycobacterium avium subsp. paratuberculosis
cgaccucggggucggccgga

SEQ ID NO: 922832 - RNA, 17 nt, Mycobacterium avium subsp. paratuberculosis
cgaccucggguguaggc

SEQ ID NO: 922833 - RNA, 23 nt, Mycobacterium avium subsp. paratuberculosis
cgaccucggguguaggcccgauc

SEQ ID NO: 922834 - RNA, 14 nt, Mycobacterium avium subsp. paratuberculosis
cgaccucgucggcg

SEQ ID NO: 922835 - RNA, 17 nt, Mycobacterium avium subsp. paratuberculosis
cgaccucgucggcggcg

SEQ ID NO: 922836 - RNA, 17 nt, Mycobacterium avium subsp. paratuberculosis
cgaccucgucggcggug

SEQ ID NO: 922837 - RNA, 18 nt, Mycobacterium avium subsp. paratuberculosis
cgaccucgucggcggugc

SEQ ID NO: 922838 - RNA, 19 nt, Mycobacterium avium subsp. paratuberculosis
cgaccucgucggcggugcc

SEQ ID NO: 922839 - RNA, 14 nt, Mycobacterium avium subsp. paratuberculosis
cgaccucgucgucg

SEQ ID NO: 922840 - RNA, 23 nt, Mycobacterium avium subsp. paratuberculosis
cgaccuccacccgcuccucgcag

SEQ ID NO: 922841 - RNA, 20 nt, Mycobacterium avium subsp. paratuberculosis
cgaccuccacgagccggucg

SEQ ID NO: 922842 - RNA, 21 nt, Mycobacterium avium subsp. paratuberculosis
cgaccucccccgacgccgaca

SEQ ID NO: 922843 - RNA, 22 nt, Mycobacterium avium subsp. paratuberculosis
cgaccucccccgacgccgacac

SEQ ID NO: 922844 - RNA, 17 nt, Mycobacterium avium subsp. paratuberculosis
cgaccuccgugccgaug

SEQ ID NO: 922845 - RNA, 18 nt, Mycobacterium avium subsp. paratuberculosis
cgaccuccgugccgaugg

SEQ ID NO: 922846 - RNA, 16 nt, Mycobacterium avium subsp. paratuberculosis
cgaccuccucgacccc

SEQ ID NO: 922847 - RNA, 23 nt, Mycobacterium avium subsp. paratuberculosis
cgaccuccucgaccccgaaggcg

SEQ ID NO: 922848 - RNA, 24 nt, Mycobacterium avium subsp. paratuberculosis
cgaccucgaacacaucguggcgca

SEQ ID NO: 922849 - RNA, 23 nt, Mycobacterium avium subsp. paratuberculosis
cgaccucgagcgucacgcuggcg

SEQ ID NO: 922850 - RNA, 12 nt, Mycobacterium avium subsp. paratuberculosis
cgaccucgaggc

SEQ ID NO: 922851 - RNA, 13 nt, Mycobacterium avium subsp. paratuberculosis
cgaccucgaggcc

SEQ ID NO: 922852 - RNA, 14 nt, Mycobacterium avium subsp. paratuberculosis
cgaccucgaugcgc

SEQ ID NO: 922853 - RNA, 21 nt, Mycobacterium avium subsp. paratuberculosis
cgaccucgaugcgcagggcgg

SEQ ID NO: 922854 - RNA, 16 nt, Mycobacterium avium subsp. paratuberculosis
cgaccucgcccgccgc

SEQ ID NO: 922855 - RNA, 20 nt, Mycobacterium avium subsp. paratuberculosis
cgaccucgcccgccgcgacg

SEQ ID NO: 922856 - RNA, 12 nt, Mycobacterium avium subsp. paratuberculosis
cgaccucgccga

SEQ ID NO: 922857 - RNA, 15 nt, Mycobacterium avium subsp. paratuberculosis
cgaccucgccgacgu

SEQ ID NO: 922858 - RNA, 13 nt, Mycobacterium avium subsp. paratuberculosis
cgaccucgcgcgu

SEQ ID NO: 922859 - RNA, 16 nt, Mycobacterium avium subsp. paratuberculosis
cgaccucggccaccac

SEQ ID NO: 922860 - RNA, 16 nt, Mycobacterium avium subsp. paratuberculosis
cgaccucggccagcgu

SEQ ID NO: 922861 - RNA, 12 nt, Mycobacterium avium subsp. paratuberculosis
cgaccucggcga

SEQ ID NO: 922862 - RNA, 14 nt, Mycobacterium avium subsp. paratuberculosis
cgaccucggcgacc

SEQ ID NO: 922863 - RNA, 15 nt, Mycobacterium avium subsp. paratuberculosis
cgaccucggcgacga

SEQ ID NO: 922864 - RNA, 13 nt, Mycobacterium avium subsp. paratuberculosis
cgaccccgccguc

SEQ ID NO: 922865 - RNA, 14 nt, Mycobacterium avium subsp. paratuberculosis
cgaccccgccgucg

SEQ ID NO: 922866 - RNA, 13 nt, Mycobacterium avium subsp. paratuberculosis
cgacccaccgucg

SEQ ID NO: 922867 - RNA, 13 nt, Mycobacterium avium subsp. paratuberculosis
cgacccccgccgc

SEQ ID NO: 922868 - RNA, 18 nt, Mycobacterium avium subsp. paratuberculosis
cgacccccgccgcgucgg

SEQ ID NO: 922869 - RNA, 19 nt, Mycobacterium avium subsp. paratuberculosis
cgaccccgaaggcguugga

SEQ ID NO: 922870 - RNA, 16 nt, Mycobacterium avium subsp. paratuberculosis
cgaccccgaugcgcuc

SEQ ID NO: 922871 - RNA, 20 nt, Mycobacterium avium subsp. paratuberculosis
cgaccccgaugcgcucgccg

SEQ ID NO: 922872 - RNA, 13 nt, Mycobacterium avium subsp. paratuberculosis
cgaccccgccagc

SEQ ID NO: 922873 - RNA, 14 nt, Mycobacterium avium subsp. paratuberculosis
cgaccccgccagca

SEQ ID NO: 922874 - RNA, 16 nt, Mycobacterium avium subsp. paratuberculosis
cgaccccgccagcacc

SEQ ID NO: 922875 - RNA, 13 nt, Mycobacterium avium subsp. paratuberculosis
cgaccccgcccac

SEQ ID NO: 922876 - RNA, 14 nt, Mycobacterium avium subsp. paratuberculosis
cgacccccaccgcg

SEQ ID NO: 922877 - RNA, 15 nt, Mycobacterium avium subsp. paratuberculosis
cgacccccaccgcga

SEQ ID NO: 922878 - RNA, 19 nt, Mycobacterium avium subsp. paratuberculosis
cgacccccaccgcgacacg

SEQ ID NO: 922879 - RNA, 22 nt, Mycobacterium avium subsp. paratuberculosis
cgacccccaccgcgacacgucg

SEQ ID NO: 922880 - RNA, 22 nt, Mycobacterium avium subsp. paratuberculosis
cgaaacuuguggaaggcgccgg

SEQ ID NO: 922881 - RNA, 17 nt, Mycobacterium avium subsp. paratuberculosis
cgaaagcacccgacacg

SEQ ID NO: 922882 - RNA, 18 nt, Mycobacterium avium subsp. paratuberculosis
cgaaagcagcaacggcgg

SEQ ID NO: 922883 - RNA, 20 nt, Mycobacterium avium subsp. paratuberculosis
cgaaagcagcaacggcggcg

SEQ ID NO: 922884 - RNA, 21 nt, Mycobacterium avium subsp. paratuberculosis
cgaaagcagcaacggcggcgg

SEQ ID NO: 922885 - RNA, 15 nt, Mycobacterium avium subsp. paratuberculosis
cgaaagccacccgcg

SEQ ID NO: 922886 - RNA, 15 nt, Mycobacterium avium subsp. paratuberculosis
cgaaagcccccagcu

SEQ ID NO: 922887 - RNA, 23 nt, Mycobacterium avium subsp. paratuberculosis
cgaaagccguaccgcaacaccga

SEQ ID NO: 922888 - RNA, 23 nt, Mycobacterium avium subsp. paratuberculosis
cgaaagccguagcgcaacaccga

SEQ ID NO: 922889 - RNA, 14 nt, Mycobacterium avium subsp. paratuberculosis
cgaacacggcgcug

SEQ ID NO: 922890 - RNA, 16 nt, Mycobacterium avium subsp. paratuberculosis
cgaacacggcgcugag

SEQ ID NO: 922891 - RNA, 15 nt, Mycobacterium avium subsp. paratuberculosis
cgaacacgggcggca

SEQ ID NO: 922892 - RNA, 17 nt, Mycobacterium avium subsp. paratuberculosis
cgaacacgggcggcagg

SEQ ID NO: 922893 - RNA, 21 nt, Mycobacterium avium subsp. paratuberculosis
cgaacacguacagcggcggcc

SEQ ID NO: 922894 - RNA, 15 nt, Mycobacterium avium subsp. paratuberculosis
cgaacaccgucgagg

SEQ ID NO: 922895 - RNA, 17 nt, Mycobacterium avium subsp. paratuberculosis
cgaacaccgugccguca

SEQ ID NO: 922896 - RNA, 19 nt, Mycobacterium avium subsp. paratuberculosis
cgaacaccgugccgucacg

SEQ ID NO: 922897 - RNA, 15 nt, Mycobacterium avium subsp. paratuberculosis
cgaacaccugcggcg

SEQ ID NO: 922898 - RNA, 16 nt, Mycobacterium avium subsp. paratuberculosis
cgaacaccugcggcgg

SEQ ID NO: 922899 - RNA, 20 nt, Mycobacterium avium subsp. paratuberculosis
cgaacacgucggccagcgcg

SEQ ID NO: 922900 - RNA, 18 nt, Mycobacterium avium subsp. paratuberculosis
cgaacacgugcagcucgg

SEQ ID NO: 922901 - RNA, 22 nt, Mycobacterium avium subsp. paratuberculosis
cgaacacguugcgcaucagcgc

SEQ ID NO: 922902 - RNA, 12 nt, Mycobacterium avium subsp. paratuberculosis
cgaacagcgggg

SEQ ID NO: 922903 - RNA, 15 nt, Mycobacterium avium subsp. paratuberculosis
cgaacagcggggugc

SEQ ID NO: 922904 - RNA, 15 nt, Mycobacterium avium subsp. paratuberculosis
cgaacagcgccgacu

SEQ ID NO: 922905 - RNA, 12 nt, Mycobacterium avium subsp. paratuberculosis
cgaacagcgcgc

SEQ ID NO: 922906 - RNA, 14 nt, Mycobacterium avium subsp. paratuberculosis
cgaacagcgcgccc

SEQ ID NO: 922907 - RNA, 17 nt, Mycobacterium avium subsp. paratuberculosis
cgaacagcgcgcccgac

SEQ ID NO: 922908 - RNA, 18 nt, Mycobacterium avium subsp. paratuberculosis
cgaacagcgcggccacca

SEQ ID NO: 922909 - RNA, 20 nt, Mycobacterium avium subsp. paratuberculosis
cgaacaggcccugcugcagc

SEQ ID NO: 922910 - RNA, 15 nt, Mycobacterium avium subsp. paratuberculosis
cgaacaggaugcagc

SEQ ID NO: 922911 - RNA, 17 nt, Mycobacterium avium subsp. paratuberculosis
cgaacaggaugcagccg

SEQ ID NO: 922912 - RNA, 23 nt, Mycobacterium avium subsp. paratuberculosis
cgaacaggaugcgggugaugccg

SEQ ID NO: 922913 - RNA, 20 nt, Mycobacterium avium subsp. paratuberculosis
cgaacagggcgacggcggcg

SEQ ID NO: 922914 - RNA, 15 nt, Mycobacterium avium subsp. paratuberculosis
cgaacagggcggcgg

SEQ ID NO: 922915 - RNA, 13 nt, Mycobacterium avium subsp. paratuberculosis
cgaacagccgggc

SEQ ID NO: 922916 - RNA, 21 nt, Mycobacterium avium subsp. paratuberculosis
cgaacagccgggccgcccgcg

SEQ ID NO: 922917 - RNA, 14 nt, Mycobacterium avium subsp. paratuberculosis
cgaacagccgggcg

SEQ ID NO: 922918 - RNA, 18 nt, Mycobacterium avium subsp. paratuberculosis
cgaacagccgggcggccg

SEQ ID NO: 922919 - RNA, 14 nt, Mycobacterium avium subsp. paratuberculosis
cgaacagccggucc

SEQ ID NO: 922920 - RNA, 13 nt, Mycobacterium avium subsp. paratuberculosis
cgaacagccgacc

SEQ ID NO: 922921 - RNA, 17 nt, Mycobacterium avium subsp. paratuberculosis
cgaacagcgacgucugc

SEQ ID NO: 922922 - RNA, 18 nt, Mycobacterium avium subsp. paratuberculosis
cgaacagcgacgucugcg

SEQ ID NO: 922923 - RNA, 13 nt, Mycobacterium avium subsp. paratuberculosis
cgaacagcaccgc

SEQ ID NO: 922924 - RNA, 20 nt, Mycobacterium avium subsp. paratuberculosis
cgaacagcaccgccacggcg

SEQ ID NO: 922925 - RNA, 17 nt, Mycobacterium avium subsp. paratuberculosis
cgaacagcacgccggcc

SEQ ID NO: 922926 - RNA, 13 nt, Mycobacterium avium subsp. paratuberculosis
cgaacagcagcac

SEQ ID NO: 922927 - RNA, 15 nt, Mycobacterium avium subsp. paratuberculosis
cgaacagcagcaccc

SEQ ID NO: 922928 - RNA, 16 nt, Mycobacterium avium subsp. paratuberculosis
cgaacagcagcacccg

SEQ ID NO: 922929 - RNA, 22 nt, Mycobacterium avium subsp. paratuberculosis
cgaacagcagcgcgccgaccac

SEQ ID NO: 922930 - RNA, 12 nt, Mycobacterium avium subsp. paratuberculosis
cgaacagcaggc

SEQ ID NO: 922931 - RNA, 17 nt, Mycobacterium avium subsp. paratuberculosis
cgaaccccacguaggcg

SEQ ID NO: 922932 - RNA, 14 nt, Mycobacterium avium subsp. paratuberculosis
cgaacccaccagcg

SEQ ID NO: 922933 - RNA, 20 nt, Mycobacterium avium subsp. paratuberculosis
cgaacccgccgcggccgaac

SEQ ID NO: 922934 - RNA, 17 nt, Mycobacterium avium subsp. paratuberculosis
cgaacccgcccucgccc

SEQ ID NO: 922935 - RNA, 13 nt, Mycobacterium avium subsp. paratuberculosis
cgaacccggccag

SEQ ID NO: 922936 - RNA, 16 nt, Mycobacterium avium subsp. paratuberculosis
cgaacccggccagcgu

SEQ ID NO: 922937 - RNA, 14 nt, Mycobacterium avium subsp. paratuberculosis
cgaacccggcggcc

SEQ ID NO: 922938 - RNA, 17 nt, Mycobacterium avium subsp. paratuberculosis
cgaacccggcggccccg

SEQ ID NO: 922939 - RNA, 21 nt, Mycobacterium avium subsp. paratuberculosis
cgaacccggcggccccgguag

SEQ ID NO: 922940 - RNA, 20 nt, Mycobacterium avium subsp. paratuberculosis
cgaacccgaaaagcaccagg

SEQ ID NO: 922941 - RNA, 17 nt, Mycobacterium avium subsp. paratuberculosis
cgaacccgaccccggcg

SEQ ID NO: 922942 - RNA, 12 nt, Mycobacterium avium subsp. paratuberculosis
cgaaccagcgcc

SEQ ID NO: 922943 - RNA, 15 nt, Mycobacterium avium subsp. paratuberculosis
cgaaccaggcgccgg

SEQ ID NO: 922944 - RNA, 18 nt, Mycobacterium avium subsp. paratuberculosis
cgaaccaggcgccggcca

SEQ ID NO: 922945 - RNA, 21 nt, Mycobacterium avium subsp. paratuberculosis
cgaaccaggcgccggccagca

SEQ ID NO: 922946 - RNA, 23 nt, Mycobacterium avium subsp. paratuberculosis
cgaaccaggcgccggccagcacg

SEQ ID NO: 922947 - RNA, 16 nt, Mycobacterium avium subsp. paratuberculosis
cgaaccagggcagcca

SEQ ID NO: 922948 - RNA, 17 nt, Mycobacterium avium subsp. paratuberculosis
cgaaccaguucgccacc

SEQ ID NO: 922949 - RNA, 18 nt, Mycobacterium avium subsp. paratuberculosis
cgaaccaguucgccacca

SEQ ID NO: 922950 - RNA, 18 nt, Mycobacterium avium subsp. paratuberculosis
cgaaccacgcggcggcgg

SEQ ID NO: 922951 - RNA, 13 nt, Mycobacterium avium subsp. paratuberculosis
cgaaccacggguc

SEQ ID NO: 922952 - RNA, 17 nt, Mycobacterium avium subsp. paratuberculosis
cgaaccacgggucgcug

SEQ ID NO: 922953 - RNA, 11 nt, Mycobacterium avium subsp. paratuberculosis
cgaacaggucc

SEQ ID NO: 922954 - RNA, 15 nt, Mycobacterium avium subsp. paratuberculosis
cgaacagguccgcga

SEQ ID NO: 922955 - RNA, 19 nt, Mycobacterium avium subsp. paratuberculosis
cgaacagugcacugccgac

SEQ ID NO: 922956 - RNA, 20 nt, Mycobacterium avium subsp. paratuberculosis
cgaacagugcacugccgacc

SEQ ID NO: 922957 - RNA, 16 nt, Mycobacterium avium subsp. paratuberculosis
cgaacaucacccggcg

SEQ ID NO: 922958 - RNA, 14 nt, Mycobacterium avium subsp. paratuberculosis
cgaacaucagccga

SEQ ID NO: 922959 - RNA, 14 nt, Mycobacterium avium subsp. paratuberculosis
cgaacaucgacgac

SEQ ID NO: 922960 - RNA, 18 nt, Mycobacterium avium subsp. paratuberculosis
cgaacaucgacgacgggu

SEQ ID NO: 922961 - RNA, 22 nt, Mycobacterium avium subsp. paratuberculosis
cgaacaucgagcccaccgcgcc

SEQ ID NO: 922962 - RNA, 19 nt, Mycobacterium avium subsp. paratuberculosis
cgaacauggcggccagccg

SEQ ID NO: 922963 - RNA, 22 nt, Mycobacterium avium subsp. paratuberculosis
cgaacaucuccagauugcggau

SEQ ID NO: 922964 - RNA, 16 nt, Mycobacterium avium subsp. paratuberculosis
cgaacaugcugccgcc

SEQ ID NO: 922965 - RNA, 18 nt, Mycobacterium avium subsp. paratuberculosis
cgaacaugcugccgccgg

SEQ ID NO: 922966 - RNA, 20 nt, Mycobacterium avium subsp. paratuberculosis
cgaacaugcugccgccggcg

SEQ ID NO: 922967 - RNA, 22 nt, Mycobacterium avium subsp. paratuberculosis
cgaacaugcugccgccggcgaa

SEQ ID NO: 922968 - RNA, 15 nt, Mycobacterium avium subsp. paratuberculosis
cgaacaucgccagca

SEQ ID NO: 922969 - RNA, 14 nt, Mycobacterium avium subsp. paratuberculosis
cgaacaucgccucg

SEQ ID NO: 922970 - RNA, 18 nt, Mycobacterium avium subsp. paratuberculosis
cgaacaucuuggucagcc

SEQ ID NO: 922971 - RNA, 17 nt, Mycobacterium avium subsp. paratuberculosis
cgaagagcggcacgauc

SEQ ID NO: 922972 - RNA, 18 nt, Mycobacterium avium subsp. paratuberculosis
cgaacuugcuggccgagu

SEQ ID NO: 922973 - RNA, 13 nt, Mycobacterium avium subsp. paratuberculosis
cgaagaucaccgc

SEQ ID NO: 922974 - RNA, 17 nt, Mycobacterium avium subsp. paratuberculosis
cgaagaucaccgcgacg

SEQ ID NO: 922975 - RNA, 19 nt, Mycobacterium avium subsp. paratuberculosis
cgaagaggugcucgacggc

SEQ ID NO: 922976 - RNA, 13 nt, Mycobacterium avium subsp. paratuberculosis
cgaacuucagcgc

SEQ ID NO: 922977 - RNA, 17 nt, Mycobacterium avium subsp. paratuberculosis
cgaacuucagcgcgucg

SEQ ID NO: 922978 - RNA, 23 nt, Mycobacterium avium subsp. paratuberculosis
cgaacugccggcauaggccagca

SEQ ID NO: 922979 - RNA, 13 nt, Mycobacterium avium subsp. paratuberculosis
cgaagacgcccca

SEQ ID NO: 922980 - RNA, 16 nt, Mycobacterium avium subsp. paratuberculosis
cgaagacgucggcgcg

SEQ ID NO: 922981 - RNA, 20 nt, Mycobacterium avium subsp. paratuberculosis
cgaacugggugccccgccgu

SEQ ID NO: 922982 - RNA, 15 nt, Mycobacterium avium subsp. paratuberculosis
cgaacgggcuggcca

SEQ ID NO: 922983 - RNA, 17 nt, Mycobacterium avium subsp. paratuberculosis
cgaacggguccuugccg

SEQ ID NO: 922984 - RNA, 16 nt, Mycobacterium avium subsp. paratuberculosis
cgaacgggucggcgac

SEQ ID NO: 922985 - RNA, 18 nt, Mycobacterium avium subsp. paratuberculosis
cgaacgggucggcgacca

SEQ ID NO: 922986 - RNA, 14 nt, Mycobacterium avium subsp. paratuberculosis
cgaacgggucgggg

SEQ ID NO: 922987 - RNA, 17 nt, Mycobacterium avium subsp. paratuberculosis
cgaacgggugaccggcg

SEQ ID NO: 922988 - RNA, 18 nt, Mycobacterium avium subsp. paratuberculosis
cgaacugcaccagcacga

SEQ ID NO: 922989 - RNA, 23 nt, Mycobacterium avium subsp. paratuberculosis
cgaacggguaggugcccgggucg

SEQ ID NO: 922990 - RNA, 14 nt, Mycobacterium avium subsp. paratuberculosis
cgaacgggccgggc

SEQ ID NO: 922991 - RNA, 16 nt, Mycobacterium avium subsp. paratuberculosis
cgaacgggccgggcac

SEQ ID NO: 922992 - RNA, 21 nt, Mycobacterium avium subsp. paratuberculosis
cgaacgggccgggcaccgcgc

SEQ ID NO: 922993 - RNA, 17 nt, Mycobacterium avium subsp. paratuberculosis
cgaacggcgucuggccg

SEQ ID NO: 922994 - RNA, 22 nt, Mycobacterium avium subsp. paratuberculosis
cgaacggcgucuggccggagcg

SEQ ID NO: 922995 - RNA, 16 nt, Mycobacterium avium subsp. paratuberculosis
cgaacgcgccggugac

SEQ ID NO: 922996 - RNA, 13 nt, Mycobacterium avium subsp. paratuberculosis
cgaacggccgcga

SEQ ID NO: 922997 - RNA, 24 nt, Mycobacterium avium subsp. paratuberculosis
cgaacggccaguccaggccgccgu

SEQ ID NO: 922998 - RNA, 18 nt, Mycobacterium avium subsp. paratuberculosis
cgaacggcccgccgccgg

SEQ ID NO: 922999 - RNA, 13 nt, Mycobacterium avium subsp. paratuberculosis
cgaacggcccgga

SEQ ID NO: 923000 - RNA, 22 nt, Mycobacterium avium subsp. paratuberculosis
cgaacggcccggucuugccggc

SEQ ID NO: 923001 - RNA, 21 nt, Mycobacterium avium subsp. paratuberculosis
cgaacgcgaugugccacuucg

SEQ ID NO: 923002 - RNA, 16 nt, Mycobacterium avium subsp. paratuberculosis
cgaacggcgcgaaccg

SEQ ID NO: 923003 - RNA, 17 nt, Mycobacterium avium subsp. paratuberculosis
cgaacggcgcgaaccgg

SEQ ID NO: 923004 - RNA, 22 nt, Mycobacterium avium subsp. paratuberculosis
cgaacggcgcgaaccgggccag

SEQ ID NO: 923005 - RNA, 16 nt, Mycobacterium avium subsp. paratuberculosis
cgaacggcggaaccgg

SEQ ID NO: 923006 - RNA, 17 nt, Mycobacterium avium subsp. paratuberculosis
cgaacgccaccacggcg

SEQ ID NO: 923007 - RNA, 20 nt, Mycobacterium avium subsp. paratuberculosis
cgaacgccaccacggcgucg

SEQ ID NO: 923008 - RNA, 21 nt, Mycobacterium avium subsp. paratuberculosis
cgaacgccaccacggcgucgc

SEQ ID NO: 923009 - RNA, 14 nt, Mycobacterium avium subsp. paratuberculosis
cgaacgccagcgcc

SEQ ID NO: 923010 - RNA, 19 nt, Mycobacterium avium subsp. paratuberculosis
cgaacgccagcgccgcaac

SEQ ID NO: 923011 - RNA, 14 nt, Mycobacterium avium subsp. paratuberculosis
cgaacgcccggucg

SEQ ID NO: 923012 - RNA, 19 nt, Mycobacterium avium subsp. paratuberculosis
cgaacgccucgguggucga

SEQ ID NO: 923013 - RNA, 21 nt, Mycobacterium avium subsp. paratuberculosis
cgaacgccucguuggccagcu

SEQ ID NO: 923014 - RNA, 17 nt, Mycobacterium avium subsp. paratuberculosis
cgaacgccuccgccgcc

SEQ ID NO: 923015 - RNA, 14 nt, Mycobacterium avium subsp. paratuberculosis
cgaacgccucgauc

SEQ ID NO: 923016 - RNA, 14 nt, Mycobacterium avium subsp. paratuberculosis
cgaacgccggcauc

SEQ ID NO: 923017 - RNA, 15 nt, Mycobacterium avium subsp. paratuberculosis
cgaacgccggcauca

SEQ ID NO: 923018 - RNA, 15 nt, Mycobacterium avium subsp. paratuberculosis
cgaacgcccgcacca

SEQ ID NO: 923019 - RNA, 18 nt, Mycobacterium avium subsp. paratuberculosis
cgaacgcccgcaccacga

SEQ ID NO: 923020 - RNA, 14 nt, Mycobacterium avium subsp. paratuberculosis
cgaacgcggccagc

SEQ ID NO: 923021 - RNA, 16 nt, Mycobacterium avium subsp. paratuberculosis
cgaacgcggccgccag

SEQ ID NO: 923022 - RNA, 17 nt, Mycobacterium avium subsp. paratuberculosis
cgaacgcggccgccagc

SEQ ID NO: 923023 - RNA, 14 nt, Mycobacterium avium subsp. paratuberculosis
cgaacggcaugucg

SEQ ID NO: 923024 - RNA, 17 nt, Mycobacterium avium subsp. paratuberculosis
cgaacgcgcggucgucg

SEQ ID NO: 923025 - RNA, 18 nt, Mycobacterium avium subsp. paratuberculosis
cgaacgcgcggucgucgc

SEQ ID NO: 923026 - RNA, 15 nt, Mycobacterium avium subsp. paratuberculosis
cgaacgcgcgucggu

SEQ ID NO: 923027 - RNA, 12 nt, Mycobacterium avium subsp. paratuberculosis
cgaacgcgccgg

SEQ ID NO: 923028 - RNA, 13 nt, Mycobacterium avium subsp. paratuberculosis
cgaacgcgccggu

SEQ ID NO: 923029 - RNA, 21 nt, Mycobacterium avium subsp. paratuberculosis
cgaacgcgccccgccgggauc

SEQ ID NO: 923030 - RNA, 21 nt, Mycobacterium avium subsp. paratuberculosis
cgaacgcgccgaucgagacga

SEQ ID NO: 923031 - RNA, 16 nt, Mycobacterium avium subsp. paratuberculosis
cgaacgcgccgcccac

SEQ ID NO: 923032 - RNA, 14 nt, Mycobacterium avium subsp. paratuberculosis
cgaacgcgccgccg

SEQ ID NO: 923033 - RNA, 17 nt, Mycobacterium avium subsp. paratuberculosis
cgaacgccucggcgagc

SEQ ID NO: 923034 - RNA, 19 nt, Mycobacterium avium subsp. paratuberculosis
cgaacgccucggcgagccg

SEQ ID NO: 923035 - RNA, 20 nt, Mycobacterium avium subsp. paratuberculosis
cgaacgccucggcgagccgc

SEQ ID NO: 923036 - RNA, 14 nt, Mycobacterium avium subsp. paratuberculosis
cgaacgcgaccugc

SEQ ID NO: 923037 - RNA, 12 nt, Mycobacterium avium subsp. paratuberculosis
cgaacgcgacga

SEQ ID NO: 923038 - RNA, 21 nt, Mycobacterium avium subsp. paratuberculosis
cgaacgcgacgaagcggucgc

SEQ ID NO: 923039 - RNA, 14 nt, Mycobacterium avium subsp. paratuberculosis
cgaacgcgacgauc

SEQ ID NO: 923040 - RNA, 21 nt, Mycobacterium avium subsp. paratuberculosis
cgaacgcgacgaucagcagcc

SEQ ID NO: 923041 - RNA, 14 nt, Mycobacterium avium subsp. paratuberculosis
cgaacgacgaccuc

SEQ ID NO: 923042 - RNA, 17 nt, Mycobacterium avium subsp. paratuberculosis
cgaacgacgagccgucg

SEQ ID NO: 923043 - RNA, 13 nt, Mycobacterium avium subsp. paratuberculosis
cgaacgacgcggc

SEQ ID NO: 923044 - RNA, 23 nt, Mycobacterium avium subsp. paratuberculosis
cgaacgacgcggcacgccgcucg

SEQ ID NO: 923045 - RNA, 15 nt, Mycobacterium avium subsp. paratuberculosis
cgaaccgcguccacg

SEQ ID NO: 923046 - RNA, 21 nt, Mycobacterium avium subsp. paratuberculosis
cgaaccgcuccccgagcacgu

SEQ ID NO: 923047 - RNA, 22 nt, Mycobacterium avium subsp. paratuberculosis
cgaaccgcuccccgagcacguc

SEQ ID NO: 923048 - RNA, 14 nt, Mycobacterium avium subsp. paratuberculosis
cgaaccgcucgucg

SEQ ID NO: 923049 - RNA, 18 nt, Mycobacterium avium subsp. paratuberculosis
cgaaccgcugcaaccggu

SEQ ID NO: 923050 - RNA, 19 nt, Mycobacterium avium subsp. paratuberculosis
cgaacgcaccaccgcggug

SEQ ID NO: 923051 - RNA, 14 nt, Mycobacterium avium subsp. paratuberculosis
cgaacgaguugccc

SEQ ID NO: 923052 - RNA, 20 nt, Mycobacterium avium subsp. paratuberculosis
cgaacgagaaggcggcgucg

SEQ ID NO: 923053 - RNA, 19 nt, Mycobacterium avium subsp. paratuberculosis
cgaacgaggccgacgugga

SEQ ID NO: 923054 - RNA, 17 nt, Mycobacterium avium subsp. paratuberculosis
cgaacccguggauggac

SEQ ID NO: 923055 - RNA, 14 nt, Mycobacterium avium subsp. paratuberculosis
cgaaccgcccgccc

SEQ ID NO: 923056 - RNA, 17 nt, Mycobacterium avium subsp. paratuberculosis
cgaaccgcccgcccggc

SEQ ID NO: 923057 - RNA, 23 nt, Mycobacterium avium subsp. paratuberculosis
cgaaccgcccgcccggcacgaac

SEQ ID NO: 923058 - RNA, 17 nt, Mycobacterium avium subsp. paratuberculosis
cgaaccgcagccggauc

SEQ ID NO: 923059 - RNA, 15 nt, Mycobacterium avium subsp. paratuberculosis
cgaaccgccacacgu

SEQ ID NO: 923060 - RNA, 13 nt, Mycobacterium avium subsp. paratuberculosis
cgaaccgccgcac

SEQ ID NO: 923061 - RNA, 12 nt, Mycobacterium avium subsp. paratuberculosis
cgaaccgccgcg

SEQ ID NO: 923062 - RNA, 13 nt, Mycobacterium avium subsp. paratuberculosis
cgaaccgccgcgc

SEQ ID NO: 923063 - RNA, 19 nt, Mycobacterium avium subsp. paratuberculosis
cgaaccgcgagcgcgcggu

SEQ ID NO: 923064 - RNA, 16 nt, Mycobacterium avium subsp. paratuberculosis
ccuucuuggccggagc

SEQ ID NO: 923065 - RNA, 18 nt, Mycobacterium avium subsp. paratuberculosis
ccuucuuggccggagccu

SEQ ID NO: 923066 - RNA, 16 nt, Mycobacterium avium subsp. paratuberculosis
ccuucuugggcucgcg

SEQ ID NO: 923067 - RNA, 14 nt, Mycobacterium avium subsp. paratuberculosis
ccuucuugaccgca

SEQ ID NO: 923068 - RNA, 18 nt, Mycobacterium avium subsp. paratuberculosis
ccuucuugaccgcagccu

SEQ ID NO: 923069 - RNA, 22 nt, Mycobacterium avium subsp. paratuberculosis
ccuucuugcugcccgcggccgc

SEQ ID NO: 923070 - RNA, 16 nt, Mycobacterium avium subsp. paratuberculosis
ccuucuucgccgcagc

SEQ ID NO: 923071 - RNA, 18 nt, Mycobacterium avium subsp. paratuberculosis
ccuucuucgccggggccu

SEQ ID NO: 923072 - RNA, 13 nt, Mycobacterium avium subsp. paratuberculosis
ccuucugaucggg

SEQ ID NO: 923073 - RNA, 17 nt, Mycobacterium avium subsp. paratuberculosis
ccuucuccacgcucgga

SEQ ID NO: 923074 - RNA, 22 nt, Mycobacterium avium subsp. paratuberculosis
ccuucucgaaccggggcaccac

SEQ ID NO: 923075 - RNA, 16 nt, Mycobacterium avium subsp. paratuberculosis
ccuucucgaccaggcu

SEQ ID NO: 923076 - RNA, 12 nt, Mycobacterium avium subsp. paratuberculosis
ccuugccggcgg

SEQ ID NO: 923077 - RNA, 13 nt, Mycobacterium avium subsp. paratuberculosis
ccuugccggcggc

SEQ ID NO: 923078 - RNA, 15 nt, Mycobacterium avium subsp. paratuberculosis
ccuugccgucgagca

SEQ ID NO: 923079 - RNA, 22 nt, Mycobacterium avium subsp. paratuberculosis
ccuugaacgcguccgacggcug

SEQ ID NO: 923080 - RNA, 13 nt, Mycobacterium avium subsp. paratuberculosis
ccuugccgccgaa

SEQ ID NO: 923081 - RNA, 16 nt, Mycobacterium avium subsp. paratuberculosis
ccuugcggccggcggc

SEQ ID NO: 923082 - RNA, 22 nt, Mycobacterium avium subsp. paratuberculosis
ccuuggccagcagugccaccac

SEQ ID NO: 923083 - RNA, 14 nt, Mycobacterium avium subsp. paratuberculosis
ccuugcggccgccg

SEQ ID NO: 923084 - RNA, 13 nt, Mycobacterium avium subsp. paratuberculosis
ccuuggccagcag

SEQ ID NO: 923085 - RNA, 13 nt, Mycobacterium avium subsp. paratuberculosis
ccuugcgcgccgc

SEQ ID NO: 923086 - RNA, 21 nt, Mycobacterium avium subsp. paratuberculosis
ccuugcgcagcagcaggucgg

SEQ ID NO: 923087 - RNA, 13 nt, Mycobacterium avium subsp. paratuberculosis
ccuugcgccgcuu

SEQ ID NO: 923088 - RNA, 15 nt, Mycobacterium avium subsp. paratuberculosis
ccuuggcggcggcca

SEQ ID NO: 923089 - RNA, 14 nt, Mycobacterium avium subsp. paratuberculosis
ccuuggcggcgugg

SEQ ID NO: 923090 - RNA, 16 nt, Mycobacterium avium subsp. paratuberculosis
ccuuggcggccacgac

SEQ ID NO: 923091 - RNA, 18 nt, Mycobacterium avium subsp. paratuberculosis
ccuuggcccgcgcggccg

SEQ ID NO: 923092 - RNA, 16 nt, Mycobacterium avium subsp. paratuberculosis
ccuuggcccgggcguc

SEQ ID NO: 923093 - RNA, 15 nt, Mycobacterium avium subsp. paratuberculosis
ccuuggccgcaggcg

SEQ ID NO: 923094 - RNA, 18 nt, Mycobacterium avium subsp. paratuberculosis
ccuuggccgcaggcggcc

SEQ ID NO: 923095 - RNA, 19 nt, Mycobacterium avium subsp. paratuberculosis
ccuuggccgcaggcggcca

SEQ ID NO: 923096 - RNA, 23 nt, Mycobacterium avium subsp. paratuberculosis
ccuuggccggugcgccgaccgcg

SEQ ID NO: 923097 - RNA, 17 nt, Mycobacterium avium subsp. paratuberculosis
ccuuugcuguucgucga

SEQ ID NO: 923098 - RNA, 15 nt, Mycobacterium avium subsp. paratuberculosis
cgaaaaaacggcggc

SEQ ID NO: 923099 - RNA, 15 nt, Mycobacterium avium subsp. paratuberculosis
cgaaacucaccgcgu

SEQ ID NO: 923100 - RNA, 20 nt, Mycobacterium avium subsp. paratuberculosis
ccuugucguccucgaucacc

SEQ ID NO: 923101 - RNA, 23 nt, Mycobacterium avium subsp. paratuberculosis
ccuugucguccucgaucaccgac

SEQ ID NO: 923102 - RNA, 19 nt, Mycobacterium avium subsp. paratuberculosis
ccuugucgcgcaccgcggc

SEQ ID NO: 923103 - RNA, 20 nt, Mycobacterium avium subsp. paratuberculosis
ccuugucgcugaccaccgag

SEQ ID NO: 923104 - RNA, 13 nt, Mycobacterium avium subsp. paratuberculosis
ccuugucggcgag

SEQ ID NO: 923105 - RNA, 15 nt, Mycobacterium avium subsp. paratuberculosis
ccuugucggcgagcu

SEQ ID NO: 923106 - RNA, 15 nt, Mycobacterium avium subsp. paratuberculosis
ccuuggugucggcga

SEQ ID NO: 923107 - RNA, 20 nt, Mycobacterium avium subsp. paratuberculosis
ccuuggugccguugaccacg

SEQ ID NO: 923108 - RNA, 13 nt, Mycobacterium avium subsp. paratuberculosis
ccuugguggccgc

SEQ ID NO: 923109 - RNA, 18 nt, Mycobacterium avium subsp. paratuberculosis
ccuugguggccgcggccg

SEQ ID NO: 923110 - RNA, 20 nt, Mycobacterium avium subsp. paratuberculosis
ccuuggguucggcggcgcgg

SEQ ID NO: 923111 - RNA, 20 nt, Mycobacterium avium subsp. paratuberculosis
ccuugggcauccgcucgccg

SEQ ID NO: 923112 - RNA, 22 nt, Mycobacterium avium subsp. paratuberculosis
ccuugggcauccgcucgccgcg

SEQ ID NO: 923113 - RNA, 23 nt, Mycobacterium avium subsp. paratuberculosis
ccuugggcauccgcucgccgcgg

SEQ ID NO: 923114 - RNA, 22 nt, Mycobacterium avium subsp. paratuberculosis
ccuugggcuccucgaccacgca

SEQ ID NO: 923115 - RNA, 17 nt, Mycobacterium avium subsp. paratuberculosis
ccuuggucgcggccuuc

SEQ ID NO: 923116 - RNA, 14 nt, Mycobacterium avium subsp. paratuberculosis
ccuuggugauccgg

SEQ ID NO: 923117 - RNA, 21 nt, Mycobacterium avium subsp. paratuberculosis
ccuuggugaugggcagcgccc

SEQ ID NO: 923118 - RNA, 18 nt, Mycobacterium avium subsp. paratuberculosis
ccuucaacuugcgcgacg

SEQ ID NO: 923119 - RNA, 13 nt, Mycobacterium avium subsp. paratuberculosis
ccuuccccggcgg

SEQ ID NO: 923120 - RNA, 14 nt, Mycobacterium avium subsp. paratuberculosis
ccuuccccggcggc

SEQ ID NO: 923121 - RNA, 15 nt, Mycobacterium avium subsp. paratuberculosis
ccuuccccggcggcc

SEQ ID NO: 923122 - RNA, 19 nt, Mycobacterium avium subsp. paratuberculosis
ccuuccacgaccuggcggg

SEQ ID NO: 923123 - RNA, 18 nt, Mycobacterium avium subsp. paratuberculosis
ccuucgacccgguggccc

SEQ ID NO: 923124 - RNA, 15 nt, Mycobacterium avium subsp. paratuberculosis
ccuucgacggccggc

SEQ ID NO: 923125 - RNA, 16 nt, Mycobacterium avium subsp. paratuberculosis
ccuucgagccgccgcc

SEQ ID NO: 923126 - RNA, 17 nt, Mycobacterium avium subsp. paratuberculosis
ccuucgagccgccgccg

SEQ ID NO: 923127 - RNA, 18 nt, Mycobacterium avium subsp. paratuberculosis
ccuucgagccgccgccgg

SEQ ID NO: 923128 - RNA, 19 nt, Mycobacterium avium subsp. paratuberculosis
ccuguuuggcugucgcgcu

SEQ ID NO: 923129 - RNA, 13 nt, Mycobacterium avium subsp. paratuberculosis
ccuuacgccgacg

SEQ ID NO: 923130 - RNA, 15 nt, Mycobacterium avium subsp. paratuberculosis
ccuuacgccgacguc

SEQ ID NO: 923131 - RNA, 15 nt, Mycobacterium avium subsp. paratuberculosis
ccuggaugucacggu

SEQ ID NO: 923132 - RNA, 15 nt, Mycobacterium avium subsp. paratuberculosis
ccuggcacgacgccg

SEQ ID NO: 923133 - RNA, 18 nt, Mycobacterium avium subsp. paratuberculosis
ccuggcacgacgccgccg

SEQ ID NO: 923134 - RNA, 20 nt, Mycobacterium avium subsp. paratuberculosis
ccuggcacgacgccgccgag

SEQ ID NO: 923135 - RNA, 15 nt, Mycobacterium avium subsp. paratuberculosis
ccuguccgaucaccg

SEQ ID NO: 923136 - RNA, 13 nt, Mycobacterium avium subsp. paratuberculosis
ccuguccgggucg

SEQ ID NO: 923137 - RNA, 19 nt, Mycobacterium avium subsp. paratuberculosis
ccuggcccagacaggccgg

SEQ ID NO: 923138 - RNA, 15 nt, Mycobacterium avium subsp. paratuberculosis
ccuggccacgugguc

SEQ ID NO: 923139 - RNA, 17 nt, Mycobacterium avium subsp. paratuberculosis
ccuggccacguggucgc

SEQ ID NO: 923140 - RNA, 13 nt, Mycobacterium avium subsp. paratuberculosis
ccuggccagcacc

SEQ ID NO: 923141 - RNA, 14 nt, Mycobacterium avium subsp. paratuberculosis
ccuggccagcaccg

SEQ ID NO: 923142 - RNA, 17 nt, Mycobacterium avium subsp. paratuberculosis
ccuggccagcaccgcgg

SEQ ID NO: 923143 - RNA, 11 nt, Mycobacterium avium subsp. paratuberculosis
ccuggccacca

SEQ ID NO: 923144 - RNA, 14 nt, Mycobacterium avium subsp. paratuberculosis
ccuggccaccucga

SEQ ID NO: 923145 - RNA, 17 nt, Mycobacterium avium subsp. paratuberculosis
ccuggccaccucgacgg

SEQ ID NO: 923146 - RNA, 18 nt, Mycobacterium avium subsp. paratuberculosis
ccuggccaccucgacggc

SEQ ID NO: 923147 - RNA, 22 nt, Mycobacterium avium subsp. paratuberculosis
ccuggccaccucgacggcgugg

SEQ ID NO: 923148 - RNA, 19 nt, Mycobacterium avium subsp. paratuberculosis
ccuggcaggugagccgggu

SEQ ID NO: 923149 - RNA, 14 nt, Mycobacterium avium subsp. paratuberculosis
ccugugggucgaca

SEQ ID NO: 923150 - RNA, 23 nt, Mycobacterium avium subsp. paratuberculosis
ccuguuccccggcgggcucgccg

SEQ ID NO: 923151 - RNA, 19 nt, Mycobacterium avium subsp. paratuberculosis
ccugugcaccgugcugugc

SEQ ID NO: 923152 - RNA, 19 nt, Mycobacterium avium subsp. paratuberculosis
ccugugcgacggcgucggc

SEQ ID NO: 923153 - RNA, 20 nt, Mycobacterium avium subsp. paratuberculosis
ccugugcgacggcgucggcg

SEQ ID NO: 923154 - RNA, 19 nt, Mycobacterium avium subsp. paratuberculosis
ccuggccaacucgaccugc

SEQ ID NO: 923155 - RNA, 20 nt, Mycobacterium avium subsp. paratuberculosis
ccugugaggcaccgaacgcc

SEQ ID NO: 923156 - RNA, 13 nt, Mycobacterium avium subsp. paratuberculosis
cgaccaccagccg

SEQ ID NO: 923157 - RNA, 18 nt, Mycobacterium avium subsp. paratuberculosis
cgaccaccacgaccagug

SEQ ID NO: 923158 - RNA, 13 nt, Mycobacterium avium subsp. paratuberculosis
cgaccaccacggc

SEQ ID NO: 923159 - RNA, 16 nt, Mycobacterium avium subsp. paratuberculosis
cgaccaccacggccgc

SEQ ID NO: 923160 - RNA, 18 nt, Mycobacterium avium subsp. paratuberculosis
cgaccaccacggccgcag

SEQ ID NO: 923161 - RNA, 20 nt, Mycobacterium avium subsp. paratuberculosis
cgaccaccacggccgcagcg

SEQ ID NO: 923162 - RNA, 21 nt, Mycobacterium avium subsp. paratuberculosis
cgaccaccacggccgcagcgg

SEQ ID NO: 923163 - RNA, 14 nt, Mycobacterium avium subsp. paratuberculosis
cgaccacccccagc

SEQ ID NO: 923164 - RNA, 14 nt, Mycobacterium avium subsp. paratuberculosis
cgaccacccgcagc

SEQ ID NO: 923165 - RNA, 15 nt, Mycobacterium avium subsp. paratuberculosis
cgaccacccgcagcu

SEQ ID NO: 923166 - RNA, 20 nt, Mycobacterium avium subsp. paratuberculosis
cgaccacccggacgaugacc

SEQ ID NO: 923167 - RNA, 16 nt, Mycobacterium avium subsp. paratuberculosis
cgaccacccggcgggc

SEQ ID NO: 923168 - RNA, 23 nt, Mycobacterium avium subsp. paratuberculosis
cgaccaccaggagcaccugcgcg

SEQ ID NO: 923169 - RNA, 20 nt, Mycobacterium avium subsp. paratuberculosis
cgaccaauugcgagcaggcc

SEQ ID NO: 923170 - RNA, 21 nt, Mycobacterium avium subsp. paratuberculosis
cgaccaauugcgagcaggccg

SEQ ID NO: 923171 - RNA, 12 nt, Mycobacterium avium subsp. paratuberculosis
cgaccaccaccg

SEQ ID NO: 923172 - RNA, 16 nt, Mycobacterium avium subsp. paratuberculosis
cgaccacacccgcacg

SEQ ID NO: 923173 - RNA, 18 nt, Mycobacterium avium subsp. paratuberculosis
cgaccacacccgcacgcu

SEQ ID NO: 923174 - RNA, 17 nt, Mycobacterium avium subsp. paratuberculosis
cgaccacaccgccggcc

SEQ ID NO: 923175 - RNA, 21 nt, Mycobacterium avium subsp. paratuberculosis
cgaccacaccgccggccacgu

SEQ ID NO: 923176 - RNA, 16 nt, Mycobacterium avium subsp. paratuberculosis
cgaccacaccggcgcu

SEQ ID NO: 923177 - RNA, 14 nt, Mycobacterium avium subsp. paratuberculosis
cgaccacaccgucg

SEQ ID NO: 923178 - RNA, 13 nt, Mycobacterium avium subsp. paratuberculosis
cgaccacagcgcc

SEQ ID NO: 923179 - RNA, 13 nt, Mycobacterium avium subsp. paratuberculosis
cgaccacgcgcca

SEQ ID NO: 923180 - RNA, 23 nt, Mycobacterium avium subsp. paratuberculosis
cgaccacggccccagccgccgcg

SEQ ID NO: 923181 - RNA, 15 nt, Mycobacterium avium subsp. paratuberculosis
cgaccacggccgguc

SEQ ID NO: 923182 - RNA, 13 nt, Mycobacterium avium subsp. paratuberculosis
cgaccacgccgcg

SEQ ID NO: 923183 - RNA, 20 nt, Mycobacterium avium subsp. paratuberculosis
cgaccacgccgcgcuugacg

SEQ ID NO: 923184 - RNA, 14 nt, Mycobacterium avium subsp. paratuberculosis
cgaccacgccgcgg

SEQ ID NO: 923185 - RNA, 17 nt, Mycobacterium avium subsp. paratuberculosis
cgaccacgccgcggucg

SEQ ID NO: 923186 - RNA, 15 nt, Mycobacterium avium subsp. paratuberculosis
cgaccacgcacacca

SEQ ID NO: 923187 - RNA, 16 nt, Mycobacterium avium subsp. paratuberculosis
cgaccacgcacaccac

SEQ ID NO: 923188 - RNA, 23 nt, Mycobacterium avium subsp. paratuberculosis
cgaccacgcacaccaccgacgcg

SEQ ID NO: 923189 - RNA, 17 nt, Mycobacterium avium subsp. paratuberculosis
cgaccaccuccccgcgg

SEQ ID NO: 923190 - RNA, 17 nt, Mycobacterium avium subsp. paratuberculosis
cgaccaccucggcgacg

SEQ ID NO: 923191 - RNA, 14 nt, Mycobacterium avium subsp. paratuberculosis
cgaccacgaccggg

SEQ ID NO: 923192 - RNA, 17 nt, Mycobacterium avium subsp. paratuberculosis
cgaccacgaccgggucu

SEQ ID NO: 923193 - RNA, 19 nt, Mycobacterium avium subsp. paratuberculosis
cgaccacgaccgggucugc

SEQ ID NO: 923194 - RNA, 13 nt, Mycobacterium avium subsp. paratuberculosis
cgaccaccgccgg

SEQ ID NO: 923195 - RNA, 17 nt, Mycobacterium avium subsp. paratuberculosis
cgaccaccgccggcccg

SEQ ID NO: 923196 - RNA, 20 nt, Mycobacterium avium subsp. paratuberculosis
cgaccaccgccggcccggcg

SEQ ID NO: 923197 - RNA, 22 nt, Mycobacterium avium subsp. paratuberculosis
cgaccaccgccggcccggcguu

SEQ ID NO: 923198 - RNA, 14 nt, Mycobacterium avium subsp. paratuberculosis
cgaccaccggccga

SEQ ID NO: 923199 - RNA, 15 nt, Mycobacterium avium subsp. paratuberculosis
cgaccaccggccgac

SEQ ID NO: 923200 - RNA, 12 nt, Mycobacterium avium subsp. paratuberculosis
cgaccaccgggu

SEQ ID NO: 923201 - RNA, 20 nt, Mycobacterium avium subsp. paratuberculosis
cgaccaccggguagcccgcg

SEQ ID NO: 923202 - RNA, 21 nt, Mycobacterium avium subsp. paratuberculosis
cgaccaccggguagcccgcgu

SEQ ID NO: 923203 - RNA, 17 nt, Mycobacterium avium subsp. paratuberculosis
cgaccacgaacaccggc

SEQ ID NO: 923204 - RNA, 18 nt, Mycobacterium avium subsp. paratuberculosis
cgaccacgaacaccggcg

SEQ ID NO: 923205 - RNA, 19 nt, Mycobacterium avium subsp. paratuberculosis
cgaccacgaacaccggcgc

SEQ ID NO: 923206 - RNA, 21 nt, Mycobacterium avium subsp. paratuberculosis
cgaccacgaacaccggcgcga

SEQ ID NO: 923207 - RNA, 17 nt, Mycobacterium avium subsp. paratuberculosis
cgaccacgaagggcgcc

SEQ ID NO: 923208 - RNA, 20 nt, Mycobacterium avium subsp. paratuberculosis
cgaccacgaagggcgccagc

SEQ ID NO: 923209 - RNA, 22 nt, Mycobacterium avium subsp. paratuberculosis
cgaccacgaagggcgccagcac

SEQ ID NO: 923210 - RNA, 15 nt, Mycobacterium avium subsp. paratuberculosis
cgacaguucggcgcg

SEQ ID NO: 923211 - RNA, 16 nt, Mycobacterium avium subsp. paratuberculosis
cgacaguucggcgcgc

SEQ ID NO: 923212 - RNA, 17 nt, Mycobacterium avium subsp. paratuberculosis
cgacaugcccgcggugc

SEQ ID NO: 923213 - RNA, 17 nt, Mycobacterium avium subsp. paratuberculosis
cgacaugcccggcgacg

SEQ ID NO: 923214 - RNA, 20 nt, Mycobacterium avium subsp. paratuberculosis
cgacaugcccggcgacggcg

SEQ ID NO: 923215 - RNA, 16 nt, Mycobacterium avium subsp. paratuberculosis
cgacaguccgaccgcg

SEQ ID NO: 923216 - RNA, 17 nt, Mycobacterium avium subsp. paratuberculosis
cgacaguccgaccgcgu

SEQ ID NO: 923217 - RNA, 13 nt, Mycobacterium avium subsp. paratuberculosis
cgacagucgcggg

SEQ ID NO: 923218 - RNA, 14 nt, Mycobacterium avium subsp. paratuberculosis
cgacagucgcgggc

SEQ ID NO: 923219 - RNA, 17 nt, Mycobacterium avium subsp. paratuberculosis
cgacagucgcgggcagc

SEQ ID NO: 923220 - RNA, 19 nt, Mycobacterium avium subsp. paratuberculosis
cgacagucgcgggcagccg

SEQ ID NO: 923221 - RNA, 21 nt, Mycobacterium avium subsp. paratuberculosis
cgacagucgcgggcagccggc

SEQ ID NO: 923222 - RNA, 16 nt, Mycobacterium avium subsp. paratuberculosis
cgacagucgcgggcgg

SEQ ID NO: 923223 - RNA, 20 nt, Mycobacterium avium subsp. paratuberculosis
cgacagucgcgggcggggcg

SEQ ID NO: 923224 - RNA, 12 nt, Mycobacterium avium subsp. paratuberculosis
cgacauuggccg

SEQ ID NO: 923225 - RNA, 14 nt, Mycobacterium avium subsp. paratuberculosis
cgacauuggccgcg

SEQ ID NO: 923226 - RNA, 16 nt, Mycobacterium avium subsp. paratuberculosis
cgacauuggccgcgcg

SEQ ID NO: 923227 - RNA, 19 nt, Mycobacterium avium subsp. paratuberculosis
cgacauuggccgcgcgcag

SEQ ID NO: 923228 - RNA, 23 nt, Mycobacterium avium subsp. paratuberculosis
cgacauguccgggauggacgacg

SEQ ID NO: 923229 - RNA, 22 nt, Mycobacterium avium subsp. paratuberculosis
cgaccaagaaccaacugagcgc

SEQ ID NO: 923230 - RNA, 21 nt, Mycobacterium avium subsp. paratuberculosis
cgaccaagacggugggcccgc

SEQ ID NO: 923231 - RNA, 22 nt, Mycobacterium avium subsp. paratuberculosis
cgaccaagacggugggcccgcc

SEQ ID NO: 923232 - RNA, 18 nt, Mycobacterium avium subsp. paratuberculosis
cgaccaacgccaugggca

SEQ ID NO: 923233 - RNA, 21 nt, Mycobacterium avium subsp. paratuberculosis
cgaccaacgccaugggcaucg

SEQ ID NO: 923234 - RNA, 15 nt, Mycobacterium avium subsp. paratuberculosis
cgaccaacgggcggc

SEQ ID NO: 923235 - RNA, 17 nt, Mycobacterium avium subsp. paratuberculosis
cgaccaacgggcggcgg

SEQ ID NO: 923236 - RNA, 23 nt, Mycobacterium avium subsp. paratuberculosis
cgacaugcugggcuaccagcccc

SEQ ID NO: 923237 - RNA, 20 nt, Mycobacterium avium subsp. paratuberculosis
cgacaugcuguuccagacgu

SEQ ID NO: 923238 - RNA, 19 nt, Mycobacterium avium subsp. paratuberculosis
cgacauggacgcggccuca

SEQ ID NO: 923239 - RNA, 15 nt, Mycobacterium avium subsp. paratuberculosis
cgacauggccagcac

SEQ ID NO: 923240 - RNA, 18 nt, Mycobacterium avium subsp. paratuberculosis
cgacaugucgccgggcgg

SEQ ID NO: 923241 - RNA, 16 nt, Mycobacterium avium subsp. paratuberculosis
cgacauggucgggcgc

SEQ ID NO: 923242 - RNA, 16 nt, Mycobacterium avium subsp. paratuberculosis
cgaccaugcccagcag

SEQ ID NO: 923243 - RNA, 16 nt, Mycobacterium avium subsp. paratuberculosis
cgaccaugcccggcgc

SEQ ID NO: 923244 - RNA, 15 nt, Mycobacterium avium subsp. paratuberculosis
cgaccaugccgcggg

SEQ ID NO: 923245 - RNA, 18 nt, Mycobacterium avium subsp. paratuberculosis
cgaccaugccgcgggcca

SEQ ID NO: 923246 - RNA, 22 nt, Mycobacterium avium subsp. paratuberculosis
cgaccaugccgcgggccagcag

SEQ ID NO: 923247 - RNA, 14 nt, Mycobacterium avium subsp. paratuberculosis
cgaccaugccguag

SEQ ID NO: 923248 - RNA, 15 nt, Mycobacterium avium subsp. paratuberculosis
cgaccaugucggcga

SEQ ID NO: 923249 - RNA, 16 nt, Mycobacterium avium subsp. paratuberculosis
cgaccaugucggcgac

SEQ ID NO: 923250 - RNA, 20 nt, Mycobacterium avium subsp. paratuberculosis
cgaccaugucggcgacccgc

SEQ ID NO: 923251 - RNA, 22 nt, Mycobacterium avium subsp. paratuberculosis
cgaccaugucggcgacccgcac

SEQ ID NO: 923252 - RNA, 17 nt, Mycobacterium avium subsp. paratuberculosis
cgaccauccacucgggc

SEQ ID NO: 923253 - RNA, 19 nt, Mycobacterium avium subsp. paratuberculosis
cgaccauccacucgggcca

SEQ ID NO: 923254 - RNA, 16 nt, Mycobacterium avium subsp. paratuberculosis
cgaccaucagcccggu

SEQ ID NO: 923255 - RNA, 15 nt, Mycobacterium avium subsp. paratuberculosis
cgaccaucagcgccc

SEQ ID NO: 923256 - RNA, 13 nt, Mycobacterium avium subsp. paratuberculosis
cgaccaucugccg

SEQ ID NO: 923257 - RNA, 20 nt, Mycobacterium avium subsp. paratuberculosis
cgaccaguagaaguggccga

SEQ ID NO: 923258 - RNA, 21 nt, Mycobacterium avium subsp. paratuberculosis
cgaccaguucuucgaugacgg

SEQ ID NO: 923259 - RNA, 19 nt, Mycobacterium avium subsp. paratuberculosis
cgaccagugcaccucgacg

SEQ ID NO: 923260 - RNA, 16 nt, Mycobacterium avium subsp. paratuberculosis
cgaccagugcccggcc

SEQ ID NO: 923261 - RNA, 17 nt, Mycobacterium avium subsp. paratuberculosis
cgaccaguuccacaccg

SEQ ID NO: 923262 - RNA, 22 nt, Mycobacterium avium subsp. paratuberculosis
cgaccaguucgcccuggccgcg

SEQ ID NO: 923263 - RNA, 16 nt, Mycobacterium avium subsp. paratuberculosis
cgaccaguaccgggcc

SEQ ID NO: 923264 - RNA, 18 nt, Mycobacterium avium subsp. paratuberculosis
cgaccaguaccgggccug

SEQ ID NO: 923265 - RNA, 17 nt, Mycobacterium avium subsp. paratuberculosis
cgaccaguucggccacc

SEQ ID NO: 923266 - RNA, 17 nt, Mycobacterium avium subsp. paratuberculosis
cgaccagguccaccccg

SEQ ID NO: 923267 - RNA, 12 nt, Mycobacterium avium subsp. paratuberculosis
cgaccaggcuca

SEQ ID NO: 923268 - RNA, 18 nt, Mycobacterium avium subsp. paratuberculosis
cgaccaggcucacgcugc

SEQ ID NO: 923269 - RNA, 18 nt, Mycobacterium avium subsp. paratuberculosis
cgaccagguagcgcugca

SEQ ID NO: 923270 - RNA, 19 nt, Mycobacterium avium subsp. paratuberculosis
cgaccagguaggcgcccug

SEQ ID NO: 923271 - RNA, 20 nt, Mycobacterium avium subsp. paratuberculosis
cgaccagguaggcgcccugc

SEQ ID NO: 923272 - RNA, 14 nt, Mycobacterium avium subsp. paratuberculosis
cgaccagggcgauc

SEQ ID NO: 923273 - RNA, 23 nt, Mycobacterium avium subsp. paratuberculosis
cgaccagggcgaucaccgcggcc

SEQ ID NO: 923274 - RNA, 19 nt, Mycobacterium avium subsp. paratuberculosis
cgaccaggguuugggcgug

SEQ ID NO: 923275 - RNA, 18 nt, Mycobacterium avium subsp. paratuberculosis
cgaccaggcuuggcccgc

SEQ ID NO: 923276 - RNA, 20 nt, Mycobacterium avium subsp. paratuberculosis
cgaccaggcuuggcccgccg

SEQ ID NO: 923277 - RNA, 21 nt, Mycobacterium avium subsp. paratuberculosis
cgaccaggcuuggcccgccgc

SEQ ID NO: 923278 - RNA, 22 nt, Mycobacterium avium subsp. paratuberculosis
cgaccaggcuuggcccgccgcc

SEQ ID NO: 923279 - RNA, 23 nt, Mycobacterium avium subsp. paratuberculosis
cgaccaggcuuggcccgccgccg

SEQ ID NO: 923280 - RNA, 24 nt, Mycobacterium avium subsp. paratuberculosis
cgaccaggcuuggcccgccgccgg

SEQ ID NO: 923281 - RNA, 17 nt, Mycobacterium avium subsp. paratuberculosis
cgaccaggcccagcgga

SEQ ID NO: 923282 - RNA, 20 nt, Mycobacterium avium subsp. paratuberculosis
cgaccaggcccagcggaucg

SEQ ID NO: 923283 - RNA, 18 nt, Mycobacterium avium subsp. paratuberculosis
cgaccagauaggccagcg

SEQ ID NO: 923284 - RNA, 23 nt, Mycobacterium avium subsp. paratuberculosis
cgaccagauugcggcaccagucg

SEQ ID NO: 923285 - RNA, 18 nt, Mycobacterium avium subsp. paratuberculosis
cgaccagcccggccgccg

SEQ ID NO: 923286 - RNA, 21 nt, Mycobacterium avium subsp. paratuberculosis
cgaccagcccggccgccgagg

SEQ ID NO: 923287 - RNA, 23 nt, Mycobacterium avium subsp. paratuberculosis
cgaccagccgaaguuggcgucgg

SEQ ID NO: 923288 - RNA, 14 nt, Mycobacterium avium subsp. paratuberculosis
cgaccagccgcauc

SEQ ID NO: 923289 - RNA, 17 nt, Mycobacterium avium subsp. paratuberculosis
cgaccagccgguaggcc

SEQ ID NO: 923290 - RNA, 14 nt, Mycobacterium avium subsp. paratuberculosis
cgaccagccggucu

SEQ ID NO: 923291 - RNA, 15 nt, Mycobacterium avium subsp. paratuberculosis
cgaccagcccggccg

SEQ ID NO: 923292 - RNA, 16 nt, Mycobacterium avium subsp. paratuberculosis
cgaccagcccggccgc

SEQ ID NO: 923293 - RNA, 18 nt, Mycobacterium avium subsp. paratuberculosis
cgaccagccccucgacca

SEQ ID NO: 923294 - RNA, 19 nt, Mycobacterium avium subsp. paratuberculosis
cgaccagccccucgaccac

SEQ ID NO: 923295 - RNA, 21 nt, Mycobacterium avium subsp. paratuberculosis
cgaccagccccucgaccaccu

SEQ ID NO: 923296 - RNA, 13 nt, Mycobacterium avium subsp. paratuberculosis
cgaccagcccccg

SEQ ID NO: 923297 - RNA, 16 nt, Mycobacterium avium subsp. paratuberculosis
cgaccagcccccgcgg

SEQ ID NO: 923298 - RNA, 20 nt, Mycobacterium avium subsp. paratuberculosis
cgaccagcaggacgcgcccg

SEQ ID NO: 923299 - RNA, 22 nt, Mycobacterium avium subsp. paratuberculosis
cgaccagcaggacgcgcccggc

SEQ ID NO: 923300 - RNA, 23 nt, Mycobacterium avium subsp. paratuberculosis
cgaccagcaggacgcgcccggcg

SEQ ID NO: 923301 - RNA, 13 nt, Mycobacterium avium subsp. paratuberculosis
cgaccagcaccgc

SEQ ID NO: 923302 - RNA, 15 nt, Mycobacterium avium subsp. paratuberculosis
cgaccagcaccgcau

SEQ ID NO: 923303 - RNA, 16 nt, Mycobacterium avium subsp. paratuberculosis
cgaccagcaccgcauc

SEQ ID NO: 923304 - RNA, 14 nt, Mycobacterium avium subsp. paratuberculosis
cgaccagcaccgcg

SEQ ID NO: 923305 - RNA, 16 nt, Mycobacterium avium subsp. paratuberculosis
cgaccagcaccgcggc

SEQ ID NO: 923306 - RNA, 19 nt, Mycobacterium avium subsp. paratuberculosis
cgaccagcaccgcggcgua

SEQ ID NO: 923307 - RNA, 16 nt, Mycobacterium avium subsp. paratuberculosis
cgaccagcggcagcag

SEQ ID NO: 923308 - RNA, 19 nt, Mycobacterium avium subsp. paratuberculosis
cgaccagcggcagcagcac

SEQ ID NO: 923309 - RNA, 14 nt, Mycobacterium avium subsp. paratuberculosis
cgaccagcgccgag

SEQ ID NO: 923310 - RNA, 14 nt, Mycobacterium avium subsp. paratuberculosis
cgaccagcgagccc

SEQ ID NO: 923311 - RNA, 22 nt, Mycobacterium avium subsp. paratuberculosis
cgaccagcgagcccagcugcgc

SEQ ID NO: 923312 - RNA, 13 nt, Mycobacterium avium subsp. paratuberculosis
cgaccagcgccga

SEQ ID NO: 923313 - RNA, 12 nt, Mycobacterium avium subsp. paratuberculosis
cgaccagcgcga

SEQ ID NO: 923314 - RNA, 13 nt, Mycobacterium avium subsp. paratuberculosis
cgaccagcgcgcc

SEQ ID NO: 923315 - RNA, 16 nt, Mycobacterium avium subsp. paratuberculosis
cgaccagcgcgccgcc

SEQ ID NO: 923316 - RNA, 19 nt, Mycobacterium avium subsp. paratuberculosis
cgaccagcgcgccgcccag

SEQ ID NO: 923317 - RNA, 20 nt, Mycobacterium avium subsp. paratuberculosis
cgaccagcgcgccgcccagc

SEQ ID NO: 923318 - RNA, 22 nt, Mycobacterium avium subsp. paratuberculosis
cgaccagcgcgccgcccagcgg

SEQ ID NO: 923319 - RNA, 15 nt, Mycobacterium avium subsp. paratuberculosis
cgaccagcgcgccgg

SEQ ID NO: 923320 - RNA, 20 nt, Mycobacterium avium subsp. paratuberculosis
cgaccagcgcgccggccagc

SEQ ID NO: 923321 - RNA, 19 nt, Mycobacterium avium subsp. paratuberculosis
cgaccaggacgucggccgg

SEQ ID NO: 923322 - RNA, 13 nt, Mycobacterium avium subsp. paratuberculosis
cgaccaggaugcc

SEQ ID NO: 923323 - RNA, 21 nt, Mycobacterium avium subsp. paratuberculosis
cgaccaggaaguacaccaccg

SEQ ID NO: 923324 - RNA, 14 nt, Mycobacterium avium subsp. paratuberculosis
cgaccagcgggaug

SEQ ID NO: 923325 - RNA, 17 nt, Mycobacterium avium subsp. paratuberculosis
cgaccagcgggcugucg

SEQ ID NO: 923326 - RNA, 11 nt, Mycobacterium avium subsp. paratuberculosis
cgaccagcggu

SEQ ID NO: 923327 - RNA, 22 nt, Mycobacterium avium subsp. paratuberculosis
cgaccagcggucgggugcgcuc

SEQ ID NO: 923328 - RNA, 20 nt, Mycobacterium avium subsp. paratuberculosis
cgaccagcugauuguugacg

SEQ ID NO: 923329 - RNA, 17 nt, Mycobacterium avium subsp. paratuberculosis
cgaauccgauugcggcg

SEQ ID NO: 923330 - RNA, 13 nt, Mycobacterium avium subsp. paratuberculosis
cgaauccgcgggc

SEQ ID NO: 923331 - RNA, 22 nt, Mycobacterium avium subsp. paratuberculosis
cgaaguucggcaucucggccgg

SEQ ID NO: 923332 - RNA, 15 nt, Mycobacterium avium subsp. paratuberculosis
cgaagugcccgccuu

SEQ ID NO: 923333 - RNA, 21 nt, Mycobacterium avium subsp. paratuberculosis
cgaaguggacaugcagccgcc

SEQ ID NO: 923334 - RNA, 15 nt, Mycobacterium avium subsp. paratuberculosis
cgaaguggcagcgcu

SEQ ID NO: 923335 - RNA, 23 nt, Mycobacterium avium subsp. paratuberculosis
cgaagucgccgcccgggccgcgc

SEQ ID NO: 923336 - RNA, 17 nt, Mycobacterium avium subsp. paratuberculosis
cgaaguccugcgccgcg

SEQ ID NO: 923337 - RNA, 20 nt, Mycobacterium avium subsp. paratuberculosis
cgaaguccugcgccgcggug

SEQ ID NO: 923338 - RNA, 21 nt, Mycobacterium avium subsp. paratuberculosis
cgaaguccugcgccgcggugc

SEQ ID NO: 923339 - RNA, 17 nt, Mycobacterium avium subsp. paratuberculosis
cgaagucgacggcggug

SEQ ID NO: 923340 - RNA, 15 nt, Mycobacterium avium subsp. paratuberculosis
cgaagucgaucccgg

SEQ ID NO: 923341 - RNA, 19 nt, Mycobacterium avium subsp. paratuberculosis
cgaagucgaucccgggugc

SEQ ID NO: 923342 - RNA, 14 nt, Mycobacterium avium subsp. paratuberculosis
cgaagucgccggcc

SEQ ID NO: 923343 - RNA, 15 nt, Mycobacterium avium subsp. paratuberculosis
cgaagucgccggcca

SEQ ID NO: 923344 - RNA, 17 nt, Mycobacterium avium subsp. paratuberculosis
cgaaucgccgagcucga

SEQ ID NO: 923345 - RNA, 21 nt, Mycobacterium avium subsp. paratuberculosis
cgaaucgagccgccugcgcgc

SEQ ID NO: 923346 - RNA, 23 nt, Mycobacterium avium subsp. paratuberculosis
cgaaucgagccgccugcgcgccg

SEQ ID NO: 923347 - RNA, 23 nt, Mycobacterium avium subsp. paratuberculosis
cgaaucgccuuggcucgggccau

SEQ ID NO: 923348 - RNA, 13 nt, Mycobacterium avium subsp. paratuberculosis
cgaauccggcggc

SEQ ID NO: 923349 - RNA, 13 nt, Mycobacterium avium subsp. paratuberculosis
cgaauccggcggg

SEQ ID NO: 923350 - RNA, 19 nt, Mycobacterium avium subsp. paratuberculosis
cgaaucguugagcaccacg

SEQ ID NO: 923351 - RNA, 23 nt, Mycobacterium avium subsp. paratuberculosis
cgaaucguugagcaccacgaggc

SEQ ID NO: 923352 - RNA, 15 nt, Mycobacterium avium subsp. paratuberculosis
cgaaucgucgccguc

SEQ ID NO: 923353 - RNA, 17 nt, Mycobacterium avium subsp. paratuberculosis
cgaaucgucgccgucca

SEQ ID NO: 923354 - RNA, 14 nt, Mycobacterium avium subsp. paratuberculosis
cgaaucgucggcga

SEQ ID NO: 923355 - RNA, 15 nt, Mycobacterium avium subsp. paratuberculosis
cgaaugacgcgcauc

SEQ ID NO: 923356 - RNA, 18 nt, Mycobacterium avium subsp. paratuberculosis
cgaagggaaaggcagcag

SEQ ID NO: 923357 - RNA, 14 nt, Mycobacterium avium subsp. paratuberculosis
cgaagcacgaccac

SEQ ID NO: 923358 - RNA, 13 nt, Mycobacterium avium subsp. paratuberculosis
cgaagcagcucgc

SEQ ID NO: 923359 - RNA, 14 nt, Mycobacterium avium subsp. paratuberculosis
cgaagaugucggug

SEQ ID NO: 923360 - RNA, 18 nt, Mycobacterium avium subsp. paratuberculosis
cgaagaugucggugccga

SEQ ID NO: 923361 - RNA, 17 nt, Mycobacterium avium subsp. paratuberculosis
cgaagauggccagcgcg

SEQ ID NO: 923362 - RNA, 18 nt, Mycobacterium avium subsp. paratuberculosis
cgaagauggccagcgcgg

SEQ ID NO: 923363 - RNA, 20 nt, Mycobacterium avium subsp. paratuberculosis
cgaagauggccagcgcggcg

SEQ ID NO: 923364 - RNA, 21 nt, Mycobacterium avium subsp. paratuberculosis
cgaagauggccagcgcggcgu

SEQ ID NO: 923365 - RNA, 18 nt, Mycobacterium avium subsp. paratuberculosis
cgaagauggucgcgccgc

SEQ ID NO: 923366 - RNA, 23 nt, Mycobacterium avium subsp. paratuberculosis
cgaagaucuccgggaacgcggcg

SEQ ID NO: 923367 - RNA, 15 nt, Mycobacterium avium subsp. paratuberculosis
cgaagaucggagccg

SEQ ID NO: 923368 - RNA, 14 nt, Mycobacterium avium subsp. paratuberculosis
cgaaguccgacgag

SEQ ID NO: 923369 - RNA, 20 nt, Mycobacterium avium subsp. paratuberculosis
cgaagucaucgagaugccgg

SEQ ID NO: 923370 - RNA, 17 nt, Mycobacterium avium subsp. paratuberculosis
cgaagucaucaccgggg

SEQ ID NO: 923371 - RNA, 21 nt, Mycobacterium avium subsp. paratuberculosis
cgaaguauccggucagcgcca

SEQ ID NO: 923372 - RNA, 22 nt, Mycobacterium avium subsp. paratuberculosis
cgaaguauccggucagcgccag

SEQ ID NO: 923373 - RNA, 23 nt, Mycobacterium avium subsp. paratuberculosis
cgaaguaguagcuguuggccagc

SEQ ID NO: 923374 - RNA, 17 nt, Mycobacterium avium subsp. paratuberculosis
cgaaguagucggcgucc

SEQ ID NO: 923375 - RNA, 20 nt, Mycobacterium avium subsp. paratuberculosis
cgaaguagaagaucagcgcc

SEQ ID NO: 923376 - RNA, 21 nt, Mycobacterium avium subsp. paratuberculosis
cgaaguagaagaucagcgcca

SEQ ID NO: 923377 - RNA, 15 nt, Mycobacterium avium subsp. paratuberculosis
cgaaguacgccgucu

SEQ ID NO: 923378 - RNA, 20 nt, Mycobacterium avium subsp. paratuberculosis
cgaagguguccucgagcugc

SEQ ID NO: 923379 - RNA, 19 nt, Mycobacterium avium subsp. paratuberculosis
cgaaggugccgcgaugccc

SEQ ID NO: 923380 - RNA, 18 nt, Mycobacterium avium subsp. paratuberculosis
cgaaggugcgcacgaacg

SEQ ID NO: 923381 - RNA, 21 nt, Mycobacterium avium subsp. paratuberculosis
cgaaggucugaaaugccgggc

SEQ ID NO: 923382 - RNA, 17 nt, Mycobacterium avium subsp. paratuberculosis
cgaaggucugcagcagc

SEQ ID NO: 923383 - RNA, 14 nt, Mycobacterium avium subsp. paratuberculosis
cgaagggucggucg

SEQ ID NO: 923384 - RNA, 23 nt, Mycobacterium avium subsp. paratuberculosis
cgaagggcaucgggucguagagc

SEQ ID NO: 923385 - RNA, 17 nt, Mycobacterium avium subsp. paratuberculosis
cgaagggcgccagcacc

SEQ ID NO: 923386 - RNA, 16 nt, Mycobacterium avium subsp. paratuberculosis
cgaagggcgccagccg

SEQ ID NO: 923387 - RNA, 15 nt, Mycobacterium avium subsp. paratuberculosis
cgacagcuccaacag

SEQ ID NO: 923388 - RNA, 18 nt, Mycobacterium avium subsp. paratuberculosis
cgacagcuccaacagccg

SEQ ID NO: 923389 - RNA, 16 nt, Mycobacterium avium subsp. paratuberculosis
cgacagcucgcgcuga

SEQ ID NO: 923390 - RNA, 13 nt, Mycobacterium avium subsp. paratuberculosis
cgacagcgucguc

SEQ ID NO: 923391 - RNA, 15 nt, Mycobacterium avium subsp. paratuberculosis
cgacagcgucgucca

SEQ ID NO: 923392 - RNA, 22 nt, Mycobacterium avium subsp. paratuberculosis
cgacagcgucguccaugcccgc

SEQ ID NO: 923393 - RNA, 22 nt, Mycobacterium avium subsp. paratuberculosis
cgacagcuugauguugccgugc

SEQ ID NO: 923394 - RNA, 17 nt, Mycobacterium avium subsp. paratuberculosis
cgacagcugagcagccc

SEQ ID NO: 923395 - RNA, 18 nt, Mycobacterium avium subsp. paratuberculosis
cgacagcugagcagcccg

SEQ ID NO: 923396 - RNA, 19 nt, Mycobacterium avium subsp. paratuberculosis
cgacagcugagcagcccga

SEQ ID NO: 923397 - RNA, 21 nt, Mycobacterium avium subsp. paratuberculosis
cgacaggcccacccacucgga

SEQ ID NO: 923398 - RNA, 19 nt, Mycobacterium avium subsp. paratuberculosis
cgacaggaugcuggggucg

SEQ ID NO: 923399 - RNA, 22 nt, Mycobacterium avium subsp. paratuberculosis
cgacaggaugcuggggucggcc

SEQ ID NO: 923400 - RNA, 14 nt, Mycobacterium avium subsp. paratuberculosis
cgacaggcagcccg

SEQ ID NO: 923401 - RNA, 19 nt, Mycobacterium avium subsp. paratuberculosis
cgacaggcagcccggcugc

SEQ ID NO: 923402 - RNA, 20 nt, Mycobacterium avium subsp. paratuberculosis
cgacaggcagcccggcugcg

SEQ ID NO: 923403 - RNA, 13 nt, Mycobacterium avium subsp. paratuberculosis
cgacagcgcgucg

SEQ ID NO: 923404 - RNA, 15 nt, Mycobacterium avium subsp. paratuberculosis
cgacagcgcgucggc

SEQ ID NO: 923405 - RNA, 16 nt, Mycobacterium avium subsp. paratuberculosis
cgacagcgcgucggcc

SEQ ID NO: 923406 - RNA, 18 nt, Mycobacterium avium subsp. paratuberculosis
cgacagcgcgucggccag

SEQ ID NO: 923407 - RNA, 17 nt, Mycobacterium avium subsp. paratuberculosis
cgacagcgcgucggcga

SEQ ID NO: 923408 - RNA, 14 nt, Mycobacterium avium subsp. paratuberculosis
cgacagcgccugcc

SEQ ID NO: 923409 - RNA, 18 nt, Mycobacterium avium subsp. paratuberculosis
cgacagcgacaaucucgg

SEQ ID NO: 923410 - RNA, 17 nt, Mycobacterium avium subsp. paratuberculosis
cgacagcgacgggccgg

SEQ ID NO: 923411 - RNA, 16 nt, Mycobacterium avium subsp. paratuberculosis
cgacacgggccgcgcc

SEQ ID NO: 923412 - RNA, 14 nt, Mycobacterium avium subsp. paratuberculosis
cgacagccggacgg

SEQ ID NO: 923413 - RNA, 23 nt, Mycobacterium avium subsp. paratuberculosis
cgacagccgggaaucgagggcgc

SEQ ID NO: 923414 - RNA, 19 nt, Mycobacterium avium subsp. paratuberculosis
cgacagccggucgcgcauc

SEQ ID NO: 923415 - RNA, 20 nt, Mycobacterium avium subsp. paratuberculosis
cgacagccggucgcgcaucg

SEQ ID NO: 923416 - RNA, 15 nt, Mycobacterium avium subsp. paratuberculosis
cgacagccgcaccgg

SEQ ID NO: 923417 - RNA, 17 nt, Mycobacterium avium subsp. paratuberculosis
cgacagccgcaccggcg

SEQ ID NO: 923418 - RNA, 19 nt, Mycobacterium avium subsp. paratuberculosis
cgacagccgcaccggcgcc

SEQ ID NO: 923419 - RNA, 20 nt, Mycobacterium avium subsp. paratuberculosis
cgacagccgcaccggcgccg

SEQ ID NO: 923420 - RNA, 15 nt, Mycobacterium avium subsp. paratuberculosis
cgacagccgcccggc

SEQ ID NO: 923421 - RNA, 16 nt, Mycobacterium avium subsp. paratuberculosis
cgacagccgcccggcg

SEQ ID NO: 923422 - RNA, 21 nt, Mycobacterium avium subsp. paratuberculosis
cgacagccgcccggcgccccg

SEQ ID NO: 923423 - RNA, 21 nt, Mycobacterium avium subsp. paratuberculosis
cgacacggaaaccgcugcggc

SEQ ID NO: 923424 - RNA, 22 nt, Mycobacterium avium subsp. paratuberculosis
cgacacggaaaccgcugcggca

SEQ ID NO: 923425 - RNA, 14 nt, Mycobacterium avium subsp. paratuberculosis
cgacacgccggccg

SEQ ID NO: 923426 - RNA, 13 nt, Mycobacterium avium subsp. paratuberculosis
cgacacgccgacg

SEQ ID NO: 923427 - RNA, 14 nt, Mycobacterium avium subsp. paratuberculosis
cgacacgccgacga

SEQ ID NO: 923428 - RNA, 15 nt, Mycobacterium avium subsp. paratuberculosis
cgacacgaucggcau

SEQ ID NO: 923429 - RNA, 20 nt, Mycobacterium avium subsp. paratuberculosis
cgacacgaucggcaugacgc

SEQ ID NO: 923430 - RNA, 23 nt, Mycobacterium avium subsp. paratuberculosis
cgacacgauguugaugucgcgcg

SEQ ID NO: 923431 - RNA, 16 nt, Mycobacterium avium subsp. paratuberculosis
cgacaccucgccgucc

SEQ ID NO: 923432 - RNA, 16 nt, Mycobacterium avium subsp. paratuberculosis
cgacaccgcguccuuc

SEQ ID NO: 923433 - RNA, 13 nt, Mycobacterium avium subsp. paratuberculosis
cgacaccggacug

SEQ ID NO: 923434 - RNA, 18 nt, Mycobacterium avium subsp. paratuberculosis
cgacaccggccgggacgg

SEQ ID NO: 923435 - RNA, 14 nt, Mycobacterium avium subsp. paratuberculosis
cgacaccggcgguc

SEQ ID NO: 923436 - RNA, 15 nt, Mycobacterium avium subsp. paratuberculosis
cgacaccggcgguca

SEQ ID NO: 923437 - RNA, 23 nt, Mycobacterium avium subsp. paratuberculosis
cgacaccggcgugaugacggcgg

SEQ ID NO: 923438 - RNA, 18 nt, Mycobacterium avium subsp. paratuberculosis
cgacaccgggucccccgc

SEQ ID NO: 923439 - RNA, 22 nt, Mycobacterium avium subsp. paratuberculosis
cgacaccgggucccccgccgac

SEQ ID NO: 923440 - RNA, 23 nt, Mycobacterium avium subsp. paratuberculosis
cgacaccgggucccccgccgacc

SEQ ID NO: 923441 - RNA, 23 nt, Mycobacterium avium subsp. paratuberculosis
cgacaccgguggcguugcgggcg

SEQ ID NO: 923442 - RNA, 15 nt, Mycobacterium avium subsp. paratuberculosis
cgacaccgugguggc

SEQ ID NO: 923443 - RNA, 17 nt, Mycobacterium avium subsp. paratuberculosis
cgacaccgugguggcgg

SEQ ID NO: 923444 - RNA, 20 nt, Mycobacterium avium subsp. paratuberculosis
cgacaccgugguggcggcga

SEQ ID NO: 923445 - RNA, 14 nt, Mycobacterium avium subsp. paratuberculosis
cgacaccgucgccg

SEQ ID NO: 923446 - RNA, 17 nt, Mycobacterium avium subsp. paratuberculosis
cgacaccucacacugaa

SEQ ID NO: 923447 - RNA, 15 nt, Mycobacterium avium subsp. paratuberculosis
cgacaccgcacggcc

SEQ ID NO: 923448 - RNA, 15 nt, Mycobacterium avium subsp. paratuberculosis
cgacaccgcauggcc

SEQ ID NO: 923449 - RNA, 19 nt, Mycobacterium avium subsp. paratuberculosis
cgacaccgcauggccggcg

SEQ ID NO: 923450 - RNA, 20 nt, Mycobacterium avium subsp. paratuberculosis
cgacaccgaacccaccagcg

SEQ ID NO: 923451 - RNA, 15 nt, Mycobacterium avium subsp. paratuberculosis
cgacaccgacgacca

SEQ ID NO: 923452 - RNA, 22 nt, Mycobacterium avium subsp. paratuberculosis
cgacacccuucaucagcaccgc

SEQ ID NO: 923453 - RNA, 16 nt, Mycobacterium avium subsp. paratuberculosis
cgacaccgcggcgacg

SEQ ID NO: 923454 - RNA, 19 nt, Mycobacterium avium subsp. paratuberculosis
cgacaccgcggcgacgucg

SEQ ID NO: 923455 - RNA, 22 nt, Mycobacterium avium subsp. paratuberculosis
cgacaccgcggcgacgucgugc

SEQ ID NO: 923456 - RNA, 12 nt, Mycobacterium avium subsp. paratuberculosis
cgacaccgccag

SEQ ID NO: 923457 - RNA, 20 nt, Mycobacterium avium subsp. paratuberculosis
cgacaccgccuucgacggcc

SEQ ID NO: 923458 - RNA, 18 nt, Mycobacterium avium subsp. paratuberculosis
cgacaccgccagcagcgc

SEQ ID NO: 923459 - RNA, 19 nt, Mycobacterium avium subsp. paratuberculosis
cgacaccgccagcagcgcc

SEQ ID NO: 923460 - RNA, 20 nt, Mycobacterium avium subsp. paratuberculosis
cgacaccgccagcagcgccg

SEQ ID NO: 923461 - RNA, 20 nt, Mycobacterium avium subsp. paratuberculosis
cgacaccgccccgccgcgcc

SEQ ID NO: 923462 - RNA, 21 nt, Mycobacterium avium subsp. paratuberculosis
cgacaccgccccgccgcgccg

SEQ ID NO: 923463 - RNA, 22 nt, Mycobacterium avium subsp. paratuberculosis
cgacaccgccccgccgcgccgg

SEQ ID NO: 923464 - RNA, 18 nt, Mycobacterium avium subsp. paratuberculosis
cgacaccacggucgccgc

SEQ ID NO: 923465 - RNA, 22 nt, Mycobacterium avium subsp. paratuberculosis
cgacaccacggucgccgcgccg

SEQ ID NO: 923466 - RNA, 16 nt, Mycobacterium avium subsp. paratuberculosis
cgacaccacggugaac

SEQ ID NO: 923467 - RNA, 17 nt, Mycobacterium avium subsp. paratuberculosis
cgacaccagcgcgcacg

SEQ ID NO: 923468 - RNA, 14 nt, Mycobacterium avium subsp. paratuberculosis
cgacaccagcgucg

SEQ ID NO: 923469 - RNA, 17 nt, Mycobacterium avium subsp. paratuberculosis
cgacacccagcggcgcg

SEQ ID NO: 923470 - RNA, 18 nt, Mycobacterium avium subsp. paratuberculosis
cgacacccagcggcgcgg

SEQ ID NO: 923471 - RNA, 21 nt, Mycobacterium avium subsp. paratuberculosis
cgacacccagcggcgcggccg

SEQ ID NO: 923472 - RNA, 15 nt, Mycobacterium avium subsp. paratuberculosis
cgacaccccacaccg

SEQ ID NO: 923473 - RNA, 17 nt, Mycobacterium avium subsp. paratuberculosis
cgacaccccacaccguc

SEQ ID NO: 923474 - RNA, 16 nt, Mycobacterium avium subsp. paratuberculosis
cgacaccaggucgagg

SEQ ID NO: 923475 - RNA, 14 nt, Mycobacterium avium subsp. paratuberculosis
cgacacccgcgacg

SEQ ID NO: 923476 - RNA, 22 nt, Mycobacterium avium subsp. paratuberculosis
cgacaccccgcgagucaccggc

SEQ ID NO: 923477 - RNA, 15 nt, Mycobacterium avium subsp. paratuberculosis
cgacaccccgcucgg

SEQ ID NO: 923478 - RNA, 18 nt, Mycobacterium avium subsp. paratuberculosis
cgacaccccgcucggcca

SEQ ID NO: 923479 - RNA, 23 nt, Mycobacterium avium subsp. paratuberculosis
cgacaccccgcucggccagcgcg

SEQ ID NO: 923480 - RNA, 20 nt, Mycobacterium avium subsp. paratuberculosis
cgaauggcaauacgccucgc

SEQ ID NO: 923481 - RNA, 19 nt, Mycobacterium avium subsp. paratuberculosis
cgaaugccugacgggaguc

SEQ ID NO: 923482 - RNA, 11 nt, Mycobacterium avium subsp. paratuberculosis
cgaaugcggcc

SEQ ID NO: 923483 - RNA, 12 nt, Mycobacterium avium subsp. paratuberculosis
cgaaugcggcca

SEQ ID NO: 923484 - RNA, 14 nt, Mycobacterium avium subsp. paratuberculosis
aacaacccggccgc

SEQ ID NO: 923485 - RNA, 21 nt, Mycobacterium avium subsp. paratuberculosis
aacaccaccuugguggccgcg

SEQ ID NO: 923486 - RNA, 23 nt, Mycobacterium avium subsp. paratuberculosis
aacaccaccuugguggccgcggc

SEQ ID NO: 923487 - RNA, 16 nt, Mycobacterium avium subsp. paratuberculosis
aacaccacgccgagca

SEQ ID NO: 923488 - RNA, 23 nt, Mycobacterium avium subsp. paratuberculosis
aacaccacgguccccgcgcccgc

SEQ ID NO: 923489 - RNA, 14 nt, Mycobacterium avium subsp. paratuberculosis
aacacccagccgcu

SEQ ID NO: 923490 - RNA, 21 nt, Mycobacterium avium subsp. paratuberculosis
aacaccagggugcgcagcgcg

SEQ ID NO: 923491 - RNA, 13 nt, Mycobacterium avium subsp. paratuberculosis
aacaccgccagca

SEQ ID NO: 923492 - RNA, 18 nt, Mycobacterium avium subsp. paratuberculosis
aacaccgccagcaccgcc

SEQ ID NO: 923493 - RNA, 16 nt, Mycobacterium avium subsp. paratuberculosis
aacacccugcgccaca

SEQ ID NO: 923494 - RNA, 17 nt, Mycobacterium avium subsp. paratuberculosis
aacaccgaaagccguac

SEQ ID NO: 923495 - RNA, 17 nt, Mycobacterium avium subsp. paratuberculosis
aacaccgaacgccgagg

SEQ ID NO: 923496 - RNA, 17 nt, Mycobacterium avium subsp. paratuberculosis
aacaccgagccggcggc

SEQ ID NO: 923497 - RNA, 21 nt, Mycobacterium avium subsp. paratuberculosis
aacaccgagccggcggcguug

SEQ ID NO: 923498 - RNA, 13 nt, Mycobacterium avium subsp. paratuberculosis
aacaccgcaccgg

SEQ ID NO: 923499 - RNA, 22 nt, Mycobacterium avium subsp. paratuberculosis
aaaucggacccagcccggcgac

SEQ ID NO: 923500 - RNA, 23 nt, Mycobacterium avium subsp. paratuberculosis
aaaucggacccagcccggcgacg

SEQ ID NO: 923501 - RNA, 13 nt, Mycobacterium avium subsp. paratuberculosis
aaauccgggcgcg

SEQ ID NO: 923502 - RNA, 13 nt, Mycobacterium avium subsp. paratuberculosis
aaaucccgcagcu

SEQ ID NO: 923503 - RNA, 14 nt, Mycobacterium avium subsp. paratuberculosis
aaaaccugcggugc

SEQ ID NO: 923504 - RNA, 13 nt, Mycobacterium avium subsp. paratuberculosis
aaauaaccgcgcg

SEQ ID NO: 923505 - RNA, 18 nt, Mycobacterium avium subsp. paratuberculosis
aaaccguuggccugcgcg

SEQ ID NO: 923506 - RNA, 13 nt, Mycobacterium avium subsp. paratuberculosis
aaaccgucggccc

SEQ ID NO: 923507 - RNA, 14 nt, Mycobacterium avium subsp. paratuberculosis
aaaccgucggcccg

SEQ ID NO: 923508 - RNA, 16 nt, Mycobacterium avium subsp. paratuberculosis
aaaccggaccgccgcg

SEQ ID NO: 923509 - RNA, 15 nt, Mycobacterium avium subsp. paratuberculosis
aaaccggccggcgcg

SEQ ID NO: 923510 - RNA, 12 nt, Mycobacterium avium subsp. paratuberculosis
aaaccccacccc

SEQ ID NO: 923511 - RNA, 15 nt, Mycobacterium avium subsp. paratuberculosis
aaaccgaccgccgcg

SEQ ID NO: 923512 - RNA, 12 nt, Mycobacterium avium subsp. paratuberculosis
aaacccggcgga

SEQ ID NO: 923513 - RNA, 22 nt, Mycobacterium avium subsp. paratuberculosis
aaacacgagcagacccgccgcg

SEQ ID NO: 923514 - RNA, 23 nt, Mycobacterium avium subsp. paratuberculosis
aaacaucgucaaagccguucgcg

SEQ ID NO: 923515 - RNA, 22 nt, Mycobacterium avium subsp. paratuberculosis
aaagcgaccagcgcgccggcca

SEQ ID NO: 923516 - RNA, 23 nt, Mycobacterium avium subsp. paratuberculosis
aaagacauucggggccaccaggc

SEQ ID NO: 923517 - RNA, 13 nt, Mycobacterium avium subsp. paratuberculosis
aaagccacccgcg

SEQ ID NO: 923518 - RNA, 14 nt, Mycobacterium avium subsp. paratuberculosis
aaacgcccggcuca

SEQ ID NO: 923519 - RNA, 12 nt, Mycobacterium avium subsp. paratuberculosis
aaacgccugcgc

SEQ ID NO: 923520 - RNA, 14 nt, Mycobacterium avium subsp. paratuberculosis
aaacgcgcgaucgg

SEQ ID NO: 923521 - RNA, 16 nt, Mycobacterium avium subsp. paratuberculosis
aaacgcugggcgccgg

SEQ ID NO: 923522 - RNA, 20 nt, Mycobacterium avium subsp. paratuberculosis
aaacuuguggaaggcgccgg

SEQ ID NO: 923523 - RNA, 20 nt, Mycobacterium avium subsp. paratuberculosis
aaaauguccuccugcgccgg

SEQ ID NO: 923524 - RNA, 20 nt, Mycobacterium avium subsp. paratuberculosis
aaaaccccaccccgagcagg

SEQ ID NO: 923525 - RNA, 16 nt, Mycobacterium avium subsp. paratuberculosis
aaugggcugcgcgucg

SEQ ID NO: 923526 - RNA, 17 nt, Mycobacterium avium subsp. paratuberculosis
aauggcggccgccgcga

SEQ ID NO: 923527 - RNA, 12 nt, Mycobacterium avium subsp. paratuberculosis
aauuccggcgcg

SEQ ID NO: 923528 - RNA, 13 nt, Mycobacterium avium subsp. paratuberculosis
aauucgcgcugcc

SEQ ID NO: 923529 - RNA, 17 nt, Mycobacterium avium subsp. paratuberculosis
aauucggucagcgcgua

SEQ ID NO: 923530 - RNA, 14 nt, Mycobacterium avium subsp. paratuberculosis
aauucgggccgccg

SEQ ID NO: 923531 - RNA, 19 nt, Mycobacterium avium subsp. paratuberculosis
aauugagguagucggccca

SEQ ID NO: 923532 - RNA, 17 nt, Mycobacterium avium subsp. paratuberculosis
aaucaccaagcgcgaca

SEQ ID NO: 923533 - RNA, 18 nt, Mycobacterium avium subsp. paratuberculosis
aaugcugcacccaccggc

SEQ ID NO: 923534 - RNA, 23 nt, Mycobacterium avium subsp. paratuberculosis
aaugcggccauguccccgccggu

SEQ ID NO: 923535 - RNA, 13 nt, Mycobacterium avium subsp. paratuberculosis
aaugcgucgccag

SEQ ID NO: 923536 - RNA, 14 nt, Mycobacterium avium subsp. paratuberculosis
aaugcgucgcggcg

SEQ ID NO: 923537 - RNA, 17 nt, Mycobacterium avium subsp. paratuberculosis
acaaucgcugcgagccc

SEQ ID NO: 923538 - RNA, 16 nt, Mycobacterium avium subsp. paratuberculosis
acaaucucgggcaccc

SEQ ID NO: 923539 - RNA, 23 nt, Mycobacterium avium subsp. paratuberculosis
acaaucucgggcaccccugccgc

SEQ ID NO: 923540 - RNA, 16 nt, Mycobacterium avium subsp. paratuberculosis
acacaaaagcgcccga

SEQ ID NO: 923541 - RNA, 12 nt, Mycobacterium avium subsp. paratuberculosis
acacacaggucg

SEQ ID NO: 923542 - RNA, 22 nt, Mycobacterium avium subsp. paratuberculosis
acacagcagcacgcccagcccg

SEQ ID NO: 923543 - RNA, 23 nt, Mycobacterium avium subsp. paratuberculosis
acacagccaaagccuacggcgcc

SEQ ID NO: 923544 - RNA, 20 nt, Mycobacterium avium subsp. paratuberculosis
acacagcccccacgcucggc

SEQ ID NO: 923545 - RNA, 15 nt, Mycobacterium avium subsp. paratuberculosis
acacagccgcuuggc

SEQ ID NO: 923546 - RNA, 16 nt, Mycobacterium avium subsp. paratuberculosis
acacagccgcuuggcg

SEQ ID NO: 923547 - RNA, 17 nt, Mycobacterium avium subsp. paratuberculosis
acacagcaccggcgucg

SEQ ID NO: 923548 - RNA, 16 nt, Mycobacterium avium subsp. paratuberculosis
acaaggugauggcccg

SEQ ID NO: 923549 - RNA, 21 nt, Mycobacterium avium subsp. paratuberculosis
acaagggcggguaggcgccga

SEQ ID NO: 923550 - RNA, 15 nt, Mycobacterium avium subsp. paratuberculosis
acaagccggcgucga

SEQ ID NO: 923551 - RNA, 14 nt, Mycobacterium avium subsp. paratuberculosis
acaacuggccggga

SEQ ID NO: 923552 - RNA, 23 nt, Mycobacterium avium subsp. paratuberculosis
acaacuggucgugcucgucggcg

SEQ ID NO: 923553 - RNA, 13 nt, Mycobacterium avium subsp. paratuberculosis
acaacuucggggu

SEQ ID NO: 923554 - RNA, 17 nt, Mycobacterium avium subsp. paratuberculosis
acaacucgaagcugcgc

SEQ ID NO: 923555 - RNA, 20 nt, Mycobacterium avium subsp. paratuberculosis
acaacucgacgcucggcgau

SEQ ID NO: 923556 - RNA, 21 nt, Mycobacterium avium subsp. paratuberculosis
acaacucgacgcucggcgaug

SEQ ID NO: 923557 - RNA, 20 nt, Mycobacterium avium subsp. paratuberculosis
acaacucgacguucggcggg

SEQ ID NO: 923558 - RNA, 21 nt, Mycobacterium avium subsp. paratuberculosis
acaacgucucugucgucgacc

SEQ ID NO: 923559 - RNA, 14 nt, Mycobacterium avium subsp. paratuberculosis
acaacggugguggc

SEQ ID NO: 923560 - RNA, 16 nt, Mycobacterium avium subsp. paratuberculosis
acaacggaucgagcgc

SEQ ID NO: 923561 - RNA, 20 nt, Mycobacterium avium subsp. paratuberculosis
acaacgccacaaacagcgcg

SEQ ID NO: 923562 - RNA, 12 nt, Mycobacterium avium subsp. paratuberculosis
acaacgcgcagc

SEQ ID NO: 923563 - RNA, 15 nt, Mycobacterium avium subsp. paratuberculosis
acaacauccgcgacg

SEQ ID NO: 923564 - RNA, 15 nt, Mycobacterium avium subsp. paratuberculosis
acaacagggccgcgc

SEQ ID NO: 923565 - RNA, 22 nt, Mycobacterium avium subsp. paratuberculosis
acaacagggccgcgcgggcgac

SEQ ID NO: 923566 - RNA, 20 nt, Mycobacterium avium subsp. paratuberculosis
acaacccggacagcgcgacg

SEQ ID NO: 923567 - RNA, 21 nt, Mycobacterium avium subsp. paratuberculosis
acaaccgauguggacgaugcg

SEQ ID NO: 923568 - RNA, 16 nt, Mycobacterium avium subsp. paratuberculosis
acaaagccggucacgc

SEQ ID NO: 923569 - RNA, 23 nt, Mycobacterium avium subsp. paratuberculosis
acaaagccggucacgcugaucga

SEQ ID NO: 923570 - RNA, 20 nt, Mycobacterium avium subsp. paratuberculosis
acacgaugcccuuggccagc

SEQ ID NO: 923571 - RNA, 13 nt, Mycobacterium avium subsp. paratuberculosis
acacgaucggcau

SEQ ID NO: 923572 - RNA, 14 nt, Mycobacterium avium subsp. paratuberculosis
acacgaucggcaug

SEQ ID NO: 923573 - RNA, 16 nt, Mycobacterium avium subsp. paratuberculosis
acacgaucucggucgc

SEQ ID NO: 923574 - RNA, 19 nt, Mycobacterium avium subsp. paratuberculosis
acacgaucucguagguggc

SEQ ID NO: 923575 - RNA, 22 nt, Mycobacterium avium subsp. paratuberculosis
acacgagcagacccgccgcggc

SEQ ID NO: 923576 - RNA, 22 nt, Mycobacterium avium subsp. paratuberculosis
acacgaauacccuucggccggc

SEQ ID NO: 923577 - RNA, 16 nt, Mycobacterium avium subsp. paratuberculosis
acacgaacccggcggc

SEQ ID NO: 923578 - RNA, 17 nt, Mycobacterium avium subsp. paratuberculosis
acacgaacccggcggcc

SEQ ID NO: 923579 - RNA, 16 nt, Mycobacterium avium subsp. paratuberculosis
acacgaacgacgcggc

SEQ ID NO: 923580 - RNA, 14 nt, Mycobacterium avium subsp. paratuberculosis
acacgaacggcgcc

SEQ ID NO: 923581 - RNA, 13 nt, Mycobacterium avium subsp. paratuberculosis
acaccucggucgg

SEQ ID NO: 923582 - RNA, 16 nt, Mycobacterium avium subsp. paratuberculosis
acaccuuucggccgcg

SEQ ID NO: 923583 - RNA, 18 nt, Mycobacterium avium subsp. paratuberculosis
acaccucggccagcgccg

SEQ ID NO: 923584 - RNA, 19 nt, Mycobacterium avium subsp. paratuberculosis
acaccucggccagcgccgc

SEQ ID NO: 923585 - RNA, 22 nt, Mycobacterium avium subsp. paratuberculosis
acaccucggccagcgccgcgcg

SEQ ID NO: 923586 - RNA, 14 nt, Mycobacterium avium subsp. paratuberculosis
acaccucggcgacg

SEQ ID NO: 923587 - RNA, 16 nt, Mycobacterium avium subsp. paratuberculosis
acaccuuccaccaccg

SEQ ID NO: 923588 - RNA, 20 nt, Mycobacterium avium subsp. paratuberculosis
acaccuuccaccaccgcggc

SEQ ID NO: 923589 - RNA, 22 nt, Mycobacterium avium subsp. paratuberculosis
acaccuuccaccaccgcggcgc

SEQ ID NO: 923590 - RNA, 20 nt, Mycobacterium avium subsp. paratuberculosis
acaccuucgcggucggcaac

SEQ ID NO: 923591 - RNA, 15 nt, Mycobacterium avium subsp. paratuberculosis
acaccgguccggccg

SEQ ID NO: 923592 - RNA, 23 nt, Mycobacterium avium subsp. paratuberculosis
acaccgguggcguugcgggcgaa

SEQ ID NO: 923593 - RNA, 13 nt, Mycobacterium avium subsp. paratuberculosis
acaccgucgcccg

SEQ ID NO: 923594 - RNA, 16 nt, Mycobacterium avium subsp. paratuberculosis
acaccgucgcccgccc

SEQ ID NO: 923595 - RNA, 19 nt, Mycobacterium avium subsp. paratuberculosis
acaccguccagcucagcgc

SEQ ID NO: 923596 - RNA, 21 nt, Mycobacterium avium subsp. paratuberculosis
acaccguccagcucagcgcgc

SEQ ID NO: 923597 - RNA, 22 nt, Mycobacterium avium subsp. paratuberculosis
acaccguccagcucagcgcgca

SEQ ID NO: 923598 - RNA, 21 nt, Mycobacterium avium subsp. paratuberculosis
acaccuccuuggguucggcgg

SEQ ID NO: 923599 - RNA, 22 nt, Mycobacterium avium subsp. paratuberculosis
acaccucgaagccgaucgcggc

SEQ ID NO: 923600 - RNA, 23 nt, Mycobacterium avium subsp. paratuberculosis
acaccgugugacgaugcugagca

SEQ ID NO: 923601 - RNA, 15 nt, Mycobacterium avium subsp. paratuberculosis
acaccguucccaccg

SEQ ID NO: 923602 - RNA, 13 nt, Mycobacterium avium subsp. paratuberculosis
acaccgugguggc

SEQ ID NO: 923603 - RNA, 16 nt, Mycobacterium avium subsp. paratuberculosis
acaccgugcccgagcc

SEQ ID NO: 923604 - RNA, 19 nt, Mycobacterium avium subsp. paratuberculosis
acaccgugcccgagccgau

SEQ ID NO: 923605 - RNA, 14 nt, Mycobacterium avium subsp. paratuberculosis
acaccgugccguca

SEQ ID NO: 923606 - RNA, 18 nt, Mycobacterium avium subsp. paratuberculosis
acaccgugccgucacgcc

SEQ ID NO: 923607 - RNA, 13 nt, Mycobacterium avium subsp. paratuberculosis
acacgcccagcgc

SEQ ID NO: 923608 - RNA, 14 nt, Mycobacterium avium subsp. paratuberculosis
acacgcccagcgcc

SEQ ID NO: 923609 - RNA, 15 nt, Mycobacterium avium subsp. paratuberculosis
acacgcccagcgccg

SEQ ID NO: 923610 - RNA, 17 nt, Mycobacterium avium subsp. paratuberculosis
acacgcccagcgccgcg

SEQ ID NO: 923611 - RNA, 18 nt, Mycobacterium avium subsp. paratuberculosis
acacgcccagcgccgcgu

SEQ ID NO: 923612 - RNA, 13 nt, Mycobacterium avium subsp. paratuberculosis
acacgcugccgag

SEQ ID NO: 923613 - RNA, 20 nt, Mycobacterium avium subsp. paratuberculosis
acacgcggacagggcggcga

SEQ ID NO: 923614 - RNA, 15 nt, Mycobacterium avium subsp. paratuberculosis
acacgcccugcaggu

SEQ ID NO: 923615 - RNA, 16 nt, Mycobacterium avium subsp. paratuberculosis
acacgcccugcagguu

SEQ ID NO: 923616 - RNA, 22 nt, Mycobacterium avium subsp. paratuberculosis
acacgcccugguaggccuggaa

SEQ ID NO: 923617 - RNA, 11 nt, Mycobacterium avium subsp. paratuberculosis
acacgccgacg

SEQ ID NO: 923618 - RNA, 16 nt, Mycobacterium avium subsp. paratuberculosis
acacgccgaucgggau

SEQ ID NO: 923619 - RNA, 15 nt, Mycobacterium avium subsp. paratuberculosis
acacgccgcgcauca

SEQ ID NO: 923620 - RNA, 21 nt, Mycobacterium avium subsp. paratuberculosis
acacgcgaugaucagcucgcg

SEQ ID NO: 923621 - RNA, 14 nt, Mycobacterium avium subsp. paratuberculosis
acacgcgccggcgc

SEQ ID NO: 923622 - RNA, 19 nt, Mycobacterium avium subsp. paratuberculosis
acacggcgccgugcgccuc

SEQ ID NO: 923623 - RNA, 13 nt, Mycobacterium avium subsp. paratuberculosis
acacgggcccguc

SEQ ID NO: 923624 - RNA, 13 nt, Mycobacterium avium subsp. paratuberculosis
acacgggccgcgc

SEQ ID NO: 923625 - RNA, 17 nt, Mycobacterium avium subsp. paratuberculosis
acacgggccgcgccgag

SEQ ID NO: 923626 - RNA, 21 nt, Mycobacterium avium subsp. paratuberculosis
acacgggcggcagggccagca

SEQ ID NO: 923627 - RNA, 17 nt, Mycobacterium avium subsp. paratuberculosis
acacggcgcugagcgac

SEQ ID NO: 923628 - RNA, 12 nt, Mycobacterium avium subsp. paratuberculosis
acacggcggcgc

SEQ ID NO: 923629 - RNA, 13 nt, Mycobacterium avium subsp. paratuberculosis
acacggcggcgcg

SEQ ID NO: 923630 - RNA, 19 nt, Mycobacterium avium subsp. paratuberculosis
acacggcggcgcgggcggc

SEQ ID NO: 923631 - RNA, 22 nt, Mycobacterium avium subsp. paratuberculosis
acacggcggcgcgggcggcguc

SEQ ID NO: 923632 - RNA, 16 nt, Mycobacterium avium subsp. paratuberculosis
acacggccagcgccgu

SEQ ID NO: 923633 - RNA, 18 nt, Mycobacterium avium subsp. paratuberculosis
acacggccagcgccguca

SEQ ID NO: 923634 - RNA, 22 nt, Mycobacterium avium subsp. paratuberculosis
acacggcccgcggcacgcugcg

SEQ ID NO: 923635 - RNA, 15 nt, Mycobacterium avium subsp. paratuberculosis
acacggccgccucca

SEQ ID NO: 923636 - RNA, 16 nt, Mycobacterium avium subsp. paratuberculosis
acacggccucgcccag

SEQ ID NO: 923637 - RNA, 13 nt, Mycobacterium avium subsp. paratuberculosis
acacccgucgacu

SEQ ID NO: 923638 - RNA, 11 nt, Mycobacterium avium subsp. paratuberculosis
acacccucacc

SEQ ID NO: 923639 - RNA, 16 nt, Mycobacterium avium subsp. paratuberculosis
acacccucaccccgcc

SEQ ID NO: 923640 - RNA, 19 nt, Mycobacterium avium subsp. paratuberculosis
acaccgaaagccgacaccu

SEQ ID NO: 923641 - RNA, 19 nt, Mycobacterium avium subsp. paratuberculosis
acaccgaaccgccccgcgc

SEQ ID NO: 923642 - RNA, 20 nt, Mycobacterium avium subsp. paratuberculosis
acaccgaaccgccccgcgcg

SEQ ID NO: 923643 - RNA, 22 nt, Mycobacterium avium subsp. paratuberculosis
acaccgaaccgccccgcgcgau

SEQ ID NO: 923644 - RNA, 15 nt, Mycobacterium avium subsp. paratuberculosis
acaccgaacgccgag

SEQ ID NO: 923645 - RNA, 16 nt, Mycobacterium avium subsp. paratuberculosis
acaccgaacgccgagg

SEQ ID NO: 923646 - RNA, 18 nt, Mycobacterium avium subsp. paratuberculosis
acaccgaagaaccccgag

SEQ ID NO: 923647 - RNA, 20 nt, Mycobacterium avium subsp. paratuberculosis
acacccggcuucgcugcgcc

SEQ ID NO: 923648 - RNA, 23 nt, Mycobacterium avium subsp. paratuberculosis
acacccgcggccgcugcgcccag

SEQ ID NO: 923649 - RNA, 12 nt, Mycobacterium avium subsp. paratuberculosis
acacccccgcgc

SEQ ID NO: 923650 - RNA, 20 nt, Mycobacterium avium subsp. paratuberculosis
acaccgaucagcaugccggu

SEQ ID NO: 923651 - RNA, 15 nt, Mycobacterium avium subsp. paratuberculosis
acaccgacaccggcc

SEQ ID NO: 923652 - RNA, 16 nt, Mycobacterium avium subsp. paratuberculosis
acaccgacaccggccg

SEQ ID NO: 923653 - RNA, 18 nt, Mycobacterium avium subsp. paratuberculosis
acaccgacaccggccggg

SEQ ID NO: 923654 - RNA, 14 nt, Mycobacterium avium subsp. paratuberculosis
acaccgccgcggcg

SEQ ID NO: 923655 - RNA, 14 nt, Mycobacterium avium subsp. paratuberculosis
acaccgccggcgcg

SEQ ID NO: 923656 - RNA, 19 nt, Mycobacterium avium subsp. paratuberculosis
acaccgccggcgcggacgg

SEQ ID NO: 923657 - RNA, 16 nt, Mycobacterium avium subsp. paratuberculosis
acaccgcauggccggc

SEQ ID NO: 923658 - RNA, 17 nt, Mycobacterium avium subsp. paratuberculosis
acaccgcauuugccgac

SEQ ID NO: 923659 - RNA, 15 nt, Mycobacterium avium subsp. paratuberculosis
acaccgccagcaccg

SEQ ID NO: 923660 - RNA, 19 nt, Mycobacterium avium subsp. paratuberculosis
acaccgccagcaccgccac

SEQ ID NO: 923661 - RNA, 20 nt, Mycobacterium avium subsp. paratuberculosis
acaccgccagcagcgccgcu

SEQ ID NO: 923662 - RNA, 13 nt, Mycobacterium avium subsp. paratuberculosis
acaccgccccgcc

SEQ ID NO: 923663 - RNA, 22 nt, Mycobacterium avium subsp. paratuberculosis
acaccgccccgccgcgccgggc

SEQ ID NO: 923664 - RNA, 21 nt, Mycobacterium avium subsp. paratuberculosis
acaccgcggaccaccgcgugc

SEQ ID NO: 923665 - RNA, 20 nt, Mycobacterium avium subsp. paratuberculosis
acaccgcgcagaaccgcacc

SEQ ID NO: 923666 - RNA, 18 nt, Mycobacterium avium subsp. paratuberculosis
acaccgcgaguucgcgca

SEQ ID NO: 923667 - RNA, 20 nt, Mycobacterium avium subsp. paratuberculosis
acaccgccuucgacggccgg

SEQ ID NO: 923668 - RNA, 16 nt, Mycobacterium avium subsp. paratuberculosis
acaccgcggcgacguc

SEQ ID NO: 923669 - RNA, 16 nt, Mycobacterium avium subsp. paratuberculosis
acaccgcggcggcguc

SEQ ID NO: 923670 - RNA, 19 nt, Mycobacterium avium subsp. paratuberculosis
acaccgcggcggcgucggc

SEQ ID NO: 923671 - RNA, 13 nt, Mycobacterium avium subsp. paratuberculosis
acaccgcugucgg

SEQ ID NO: 923672 - RNA, 23 nt, Mycobacterium avium subsp. paratuberculosis
acaccgcuuugugaggcgcgccg

SEQ ID NO: 923673 - RNA, 23 nt, Mycobacterium avium subsp. paratuberculosis
acaccggacugcuugggcgccuc

SEQ ID NO: 923674 - RNA, 20 nt, Mycobacterium avium subsp. paratuberculosis
acaccggaucggcugcgggc

SEQ ID NO: 923675 - RNA, 14 nt, Mycobacterium avium subsp. paratuberculosis
acaccgcggccagc

SEQ ID NO: 923676 - RNA, 17 nt, Mycobacterium avium subsp. paratuberculosis
acaccgcggccagcgcg

SEQ ID NO: 923677 - RNA, 22 nt, Mycobacterium avium subsp. paratuberculosis
acaccggcacgaucgucgccgc

SEQ ID NO: 923678 - RNA, 16 nt, Mycobacterium avium subsp. paratuberculosis
acaccggcacgucggc

SEQ ID NO: 923679 - RNA, 20 nt, Mycobacterium avium subsp. paratuberculosis
acaccggcacgucggccacg

SEQ ID NO: 923680 - RNA, 17 nt, Mycobacterium avium subsp. paratuberculosis
acaccggcgcugcccgc

SEQ ID NO: 923681 - RNA, 13 nt, Mycobacterium avium subsp. paratuberculosis
acaccggcggcga

SEQ ID NO: 923682 - RNA, 14 nt, Mycobacterium avium subsp. paratuberculosis
acaccggcggcgac

SEQ ID NO: 923683 - RNA, 15 nt, Mycobacterium avium subsp. paratuberculosis
acaccggcucgcuga

SEQ ID NO: 923684 - RNA, 13 nt, Mycobacterium avium subsp. paratuberculosis
acaccggcgcgac

SEQ ID NO: 923685 - RNA, 16 nt, Mycobacterium avium subsp. paratuberculosis
acaccggcgcgaccac

SEQ ID NO: 923686 - RNA, 18 nt, Mycobacterium avium subsp. paratuberculosis
acaccggcugaccggcgg

SEQ ID NO: 923687 - RNA, 17 nt, Mycobacterium avium subsp. paratuberculosis
acaccgggauccggcgc

SEQ ID NO: 923688 - RNA, 18 nt, Mycobacterium avium subsp. paratuberculosis
acaccgggauccggcgcg

SEQ ID NO: 923689 - RNA, 21 nt, Mycobacterium avium subsp. paratuberculosis
acaccgggauccggcgcgccg

SEQ ID NO: 923690 - RNA, 22 nt, Mycobacterium avium subsp. paratuberculosis
acaccgggauccggcgcgccgc

SEQ ID NO: 923691 - RNA, 17 nt, Mycobacterium avium subsp. paratuberculosis
acaccgggaucggcggc

SEQ ID NO: 923692 - RNA, 16 nt, Mycobacterium avium subsp. paratuberculosis
acaccgggaucggggu

SEQ ID NO: 923693 - RNA, 17 nt, Mycobacterium avium subsp. paratuberculosis
acaccgggcaccgacau

SEQ ID NO: 923694 - RNA, 19 nt, Mycobacterium avium subsp. paratuberculosis
acaccagaugccgcucggc

SEQ ID NO: 923695 - RNA, 22 nt, Mycobacterium avium subsp. paratuberculosis
acaccagaugccgcucggcgcu

SEQ ID NO: 923696 - RNA, 17 nt, Mycobacterium avium subsp. paratuberculosis
acaccagcacggcggcg

SEQ ID NO: 923697 - RNA, 17 nt, Mycobacterium avium subsp. paratuberculosis
acaccagcgcgcacgcg

SEQ ID NO: 923698 - RNA, 15 nt, Mycobacterium avium subsp. paratuberculosis
acaccagcggucggc

SEQ ID NO: 923699 - RNA, 22 nt, Mycobacterium avium subsp. paratuberculosis
acaccagcuggauggcgcccag

SEQ ID NO: 923700 - RNA, 15 nt, Mycobacterium avium subsp. paratuberculosis
acaccagguaggcgg

SEQ ID NO: 923701 - RNA, 19 nt, Mycobacterium avium subsp. paratuberculosis
acaccagguaggcgguggc

SEQ ID NO: 923702 - RNA, 20 nt, Mycobacterium avium subsp. paratuberculosis
acaccagguaggcgguggcg

SEQ ID NO: 923703 - RNA, 22 nt, Mycobacterium avium subsp. paratuberculosis
acaccaggucgagguccucggc

SEQ ID NO: 923704 - RNA, 21 nt, Mycobacterium avium subsp. paratuberculosis
acaccagggugcgcagcgcgu

SEQ ID NO: 923705 - RNA, 13 nt, Mycobacterium avium subsp. paratuberculosis
acacccagcgcca

SEQ ID NO: 923706 - RNA, 23 nt, Mycobacterium avium subsp. paratuberculosis
acacccaggucuuccggaugccg

SEQ ID NO: 923707 - RNA, 14 nt, Mycobacterium avium subsp. paratuberculosis
acacccaugacccg

SEQ ID NO: 923708 - RNA, 17 nt, Mycobacterium avium subsp. paratuberculosis
acacccauucacgcagc

SEQ ID NO: 923709 - RNA, 12 nt, Mycobacterium avium subsp. paratuberculosis
acaccccgcgag

SEQ ID NO: 923710 - RNA, 21 nt, Mycobacterium avium subsp. paratuberculosis
acaccccgcgagucaccggcu

SEQ ID NO: 923711 - RNA, 22 nt, Mycobacterium avium subsp. paratuberculosis
acaccccgcgggaguccacgcc

SEQ ID NO: 923712 - RNA, 14 nt, Mycobacterium avium subsp. paratuberculosis
acaccccgcucggc

SEQ ID NO: 923713 - RNA, 15 nt, Mycobacterium avium subsp. paratuberculosis
acaccccgcucggcc

SEQ ID NO: 923714 - RNA, 21 nt, Mycobacterium avium subsp. paratuberculosis
acaccccgcucggccagcgcg

SEQ ID NO: 923715 - RNA, 13 nt, Mycobacterium avium subsp. paratuberculosis
acaccccggccag

SEQ ID NO: 923716 - RNA, 13 nt, Mycobacterium avium subsp. paratuberculosis
acacaucguggcg

SEQ ID NO: 923717 - RNA, 12 nt, Mycobacterium avium subsp. paratuberculosis
acaccaccaccg

SEQ ID NO: 923718 - RNA, 14 nt, Mycobacterium avium subsp. paratuberculosis
acaccaccaccgag

SEQ ID NO: 923719 - RNA, 23 nt, Mycobacterium avium subsp. paratuberculosis
acaccaccaccgagccggcgucg

SEQ ID NO: 923720 - RNA, 14 nt, Mycobacterium avium subsp. paratuberculosis
acaccaccgacgcg

SEQ ID NO: 923721 - RNA, 22 nt, Mycobacterium avium subsp. paratuberculosis
acaccaccgacgcgucgcggcg

SEQ ID NO: 923722 - RNA, 15 nt, Mycobacterium avium subsp. paratuberculosis
acaccacgguggcgu

SEQ ID NO: 923723 - RNA, 16 nt, Mycobacterium avium subsp. paratuberculosis
acaccacguagccgac

SEQ ID NO: 923724 - RNA, 22 nt, Mycobacterium avium subsp. paratuberculosis
acaccacgucggugccgcguuc

SEQ ID NO: 923725 - RNA, 13 nt, Mycobacterium avium subsp. paratuberculosis
acaccacgucguc

SEQ ID NO: 923726 - RNA, 16 nt, Mycobacterium avium subsp. paratuberculosis
acaccacgucgucggc

SEQ ID NO: 923727 - RNA, 12 nt, Mycobacterium avium subsp. paratuberculosis
acaccaccgcgc

SEQ ID NO: 923728 - RNA, 13 nt, Mycobacterium avium subsp. paratuberculosis
acaccaccggccg

SEQ ID NO: 923729 - RNA, 19 nt, Mycobacterium avium subsp. paratuberculosis
acaccaccggccgcccggc

SEQ ID NO: 923730 - RNA, 14 nt, Mycobacterium avium subsp. paratuberculosis
acaccaccgugcug

SEQ ID NO: 923731 - RNA, 16 nt, Mycobacterium avium subsp. paratuberculosis
acaccaccuugguggc

SEQ ID NO: 923732 - RNA, 20 nt, Mycobacterium avium subsp. paratuberculosis
acaccaccuugguggccgcg

SEQ ID NO: 923733 - RNA, 16 nt, Mycobacterium avium subsp. paratuberculosis
acaccacgaucagcgc

SEQ ID NO: 923734 - RNA, 13 nt, Mycobacterium avium subsp. paratuberculosis
acaccacggccgg

SEQ ID NO: 923735 - RNA, 16 nt, Mycobacterium avium subsp. paratuberculosis
acaccacggucgccgc

SEQ ID NO: 923736 - RNA, 18 nt, Mycobacterium avium subsp. paratuberculosis
acaccacggucgccgcgc

SEQ ID NO: 923737 - RNA, 21 nt, Mycobacterium avium subsp. paratuberculosis
acaccacggugaacgggccgc

SEQ ID NO: 923738 - RNA, 20 nt, Mycobacterium avium subsp. paratuberculosis
acacguugagcccggaccgg

SEQ ID NO: 923739 - RNA, 21 nt, Mycobacterium avium subsp. paratuberculosis
acacugaaagccgaggcgcaa

SEQ ID NO: 923740 - RNA, 15 nt, Mycobacterium avium subsp. paratuberculosis
acacgugcaucugcg

SEQ ID NO: 923741 - RNA, 20 nt, Mycobacterium avium subsp. paratuberculosis
acacgucgcgggugaccggc

SEQ ID NO: 923742 - RNA, 13 nt, Mycobacterium avium subsp. paratuberculosis
acacgucggccag

SEQ ID NO: 923743 - RNA, 23 nt, Mycobacterium avium subsp. paratuberculosis
acacgugcggauggccccggcga

SEQ ID NO: 923744 - RNA, 22 nt, Mycobacterium avium subsp. paratuberculosis
acacguggaccgagcgcgcgau

SEQ ID NO: 923745 - RNA, 13 nt, Mycobacterium avium subsp. paratuberculosis
acacguggccgau

SEQ ID NO: 923746 - RNA, 24 nt, Mycobacterium avium subsp. paratuberculosis
acacguggccgaucagcugcucgg

SEQ ID NO: 923747 - RNA, 20 nt, Mycobacterium avium subsp. paratuberculosis
acacuggcgugacgcucggc

SEQ ID NO: 923748 - RNA, 23 nt, Mycobacterium avium subsp. paratuberculosis
acacuggcgugacgcucggccuc

SEQ ID NO: 923749 - RNA, 21 nt, Mycobacterium avium subsp. paratuberculosis
acacugcaacuacgcacccga

SEQ ID NO: 923750 - RNA, 21 nt, Mycobacterium avium subsp. paratuberculosis
acacuucggguguggugccgg

SEQ ID NO: 923751 - RNA, 19 nt, Mycobacterium avium subsp. paratuberculosis
acacuuuuaaggagcaauc

SEQ ID NO: 923752 - RNA, 12 nt, Mycobacterium avium subsp. paratuberculosis
acagcaacgcca

SEQ ID NO: 923753 - RNA, 15 nt, Mycobacterium avium subsp. paratuberculosis
acagcaacgccaggg

SEQ ID NO: 923754 - RNA, 16 nt, Mycobacterium avium subsp. paratuberculosis
acagcaccagcaccac

SEQ ID NO: 923755 - RNA, 19 nt, Mycobacterium avium subsp. paratuberculosis
acagcacccccucggcgcc

SEQ ID NO: 923756 - RNA, 21 nt, Mycobacterium avium subsp. paratuberculosis
acagcacccccucggcgccgg

SEQ ID NO: 923757 - RNA, 21 nt, Mycobacterium avium subsp. paratuberculosis
acagcacgcccuggaaggcga

SEQ ID NO: 923758 - RNA, 22 nt, Mycobacterium avium subsp. paratuberculosis
acagcacgcccuggaaggcgau

SEQ ID NO: 923759 - RNA, 16 nt, Mycobacterium avium subsp. paratuberculosis
acagcacgccggccgg

SEQ ID NO: 923760 - RNA, 13 nt, Mycobacterium avium subsp. paratuberculosis
acagcacgccggg

SEQ ID NO: 923761 - RNA, 22 nt, Mycobacterium avium subsp. paratuberculosis
acagcagcaccggcaccgcggc

SEQ ID NO: 923762 - RNA, 17 nt, Mycobacterium avium subsp. paratuberculosis
acagcagcagcagcggc

SEQ ID NO: 923763 - RNA, 15 nt, Mycobacterium avium subsp. paratuberculosis
acagcaccgccgcgg

SEQ ID NO: 923764 - RNA, 14 nt, Mycobacterium avium subsp. paratuberculosis
acagcaccggcguc

SEQ ID NO: 923765 - RNA, 15 nt, Mycobacterium avium subsp. paratuberculosis
acagcaccggcgucg

SEQ ID NO: 923766 - RNA, 18 nt, Mycobacterium avium subsp. paratuberculosis
acagcaccggcgucgaca

SEQ ID NO: 923767 - RNA, 13 nt, Mycobacterium avium subsp. paratuberculosis
acagcaccucgcc

SEQ ID NO: 923768 - RNA, 20 nt, Mycobacterium avium subsp. paratuberculosis
acagcaccucgucgcccggc

SEQ ID NO: 923769 - RNA, 13 nt, Mycobacterium avium subsp. paratuberculosis
acagcacccgcug

SEQ ID NO: 923770 - RNA, 11 nt, Mycobacterium avium subsp. paratuberculosis
acagcaccgcc

SEQ ID NO: 923771 - RNA, 19 nt, Mycobacterium avium subsp. paratuberculosis
acagcaccgccacggcgac

SEQ ID NO: 923772 - RNA, 13 nt, Mycobacterium avium subsp. paratuberculosis
acagcaccgccau

SEQ ID NO: 923773 - RNA, 16 nt, Mycobacterium avium subsp. paratuberculosis
acagaugcggcaccag

SEQ ID NO: 923774 - RNA, 16 nt, Mycobacterium avium subsp. paratuberculosis
acagaucgucucggcc

SEQ ID NO: 923775 - RNA, 23 nt, Mycobacterium avium subsp. paratuberculosis
acagagucgaauugucuugcgug

SEQ ID NO: 923776 - RNA, 14 nt, Mycobacterium avium subsp. paratuberculosis
acagauacgcgacg

SEQ ID NO: 923777 - RNA, 13 nt, Mycobacterium avium subsp. paratuberculosis
acagacucagccc

SEQ ID NO: 923778 - RNA, 14 nt, Mycobacterium avium subsp. paratuberculosis
acagacucagcccg

SEQ ID NO: 923779 - RNA, 21 nt, Mycobacterium avium subsp. paratuberculosis
acagacucagcccggcccagc

SEQ ID NO: 923780 - RNA, 22 nt, Mycobacterium avium subsp. paratuberculosis
acagacugaugaagccgccgac

SEQ ID NO: 923781 - RNA, 15 nt, Mycobacterium avium subsp. paratuberculosis
acagacaucgcugac

SEQ ID NO: 923782 - RNA, 15 nt, Mycobacterium avium subsp. paratuberculosis
acagcuuucgggcgg

SEQ ID NO: 923783 - RNA, 15 nt, Mycobacterium avium subsp. paratuberculosis
acagcuuggcgcagc

SEQ ID NO: 923784 - RNA, 14 nt, Mycobacterium avium subsp. paratuberculosis
acagcugccggccg

SEQ ID NO: 923785 - RNA, 15 nt, Mycobacterium avium subsp. paratuberculosis
acagcugccggccgu

SEQ ID NO: 923786 - RNA, 21 nt, Mycobacterium avium subsp. paratuberculosis
acagcugccggccguugcggg

SEQ ID NO: 923787 - RNA, 15 nt, Mycobacterium avium subsp. paratuberculosis
acagcuggcggucgc

SEQ ID NO: 923788 - RNA, 17 nt, Mycobacterium avium subsp. paratuberculosis
acagcuggucccacagc

SEQ ID NO: 923789 - RNA, 18 nt, Mycobacterium avium subsp. paratuberculosis
acagcugguccggccggc

SEQ ID NO: 923790 - RNA, 19 nt, Mycobacterium avium subsp. paratuberculosis
acagcugguccggccggcc

SEQ ID NO: 923791 - RNA, 20 nt, Mycobacterium avium subsp. paratuberculosis
acagcugguccggccggccg

SEQ ID NO: 923792 - RNA, 15 nt, Mycobacterium avium subsp. paratuberculosis
acagcuucggcgccg

SEQ ID NO: 923793 - RNA, 17 nt, Mycobacterium avium subsp. paratuberculosis
acagcuucggcgccgag

SEQ ID NO: 923794 - RNA, 21 nt, Mycobacterium avium subsp. paratuberculosis
acaggacguugaggcggcggc

SEQ ID NO: 923795 - RNA, 20 nt, Mycobacterium avium subsp. paratuberculosis
acaggcgaguuaugccguca

SEQ ID NO: 923796 - RNA, 22 nt, Mycobacterium avium subsp. paratuberculosis
acaggccguagcgagcgcuggc

SEQ ID NO: 923797 - RNA, 21 nt, Mycobacterium avium subsp. paratuberculosis
acaggcccugcugcagcgcga

SEQ ID NO: 923798 - RNA, 15 nt, Mycobacterium avium subsp. paratuberculosis
acaggccgagcgcgc

SEQ ID NO: 923799 - RNA, 18 nt, Mycobacterium avium subsp. paratuberculosis
acagguaggcggcgccgu

SEQ ID NO: 923800 - RNA, 16 nt, Mycobacterium avium subsp. paratuberculosis
acagguaguagcgcgc

SEQ ID NO: 923801 - RNA, 15 nt, Mycobacterium avium subsp. paratuberculosis
acaggugccggcggc

SEQ ID NO: 923802 - RNA, 21 nt, Mycobacterium avium subsp. paratuberculosis
acaggugccggcggcgcggca

SEQ ID NO: 923803 - RNA, 20 nt, Mycobacterium avium subsp. paratuberculosis
acaggugcuuggucagcgcg

SEQ ID NO: 923804 - RNA, 22 nt, Mycobacterium avium subsp. paratuberculosis
acaggugcuuggucagcgcggc

SEQ ID NO: 923805 - RNA, 13 nt, Mycobacterium avium subsp. paratuberculosis
acagguggccgau

SEQ ID NO: 923806 - RNA, 15 nt, Mycobacterium avium subsp. paratuberculosis
acagguggccgauca

SEQ ID NO: 923807 - RNA, 17 nt, Mycobacterium avium subsp. paratuberculosis
acagguuucgcucgucg

SEQ ID NO: 923808 - RNA, 16 nt, Mycobacterium avium subsp. paratuberculosis
acaggucggcggucgc

SEQ ID NO: 923809 - RNA, 11 nt, Mycobacterium avium subsp. paratuberculosis
acaggugacga

SEQ ID NO: 923810 - RNA, 21 nt, Mycobacterium avium subsp. paratuberculosis
acaggugcagcagcagccacg

SEQ ID NO: 923811 - RNA, 20 nt, Mycobacterium avium subsp. paratuberculosis
acaggugcauccagucggcg

SEQ ID NO: 923812 - RNA, 15 nt, Mycobacterium avium subsp. paratuberculosis
acaggucgcgguagc

SEQ ID NO: 923813 - RNA, 22 nt, Mycobacterium avium subsp. paratuberculosis
acaggucgagggugacccgggc

SEQ ID NO: 923814 - RNA, 19 nt, Mycobacterium avium subsp. paratuberculosis
acagcgauuugagcauguu

SEQ ID NO: 923815 - RNA, 15 nt, Mycobacterium avium subsp. paratuberculosis
acagcgagaagucgc

SEQ ID NO: 923816 - RNA, 18 nt, Mycobacterium avium subsp. paratuberculosis
acagcgagaagucgccga

SEQ ID NO: 923817 - RNA, 14 nt, Mycobacterium avium subsp. paratuberculosis
acagcggcgcgguu

SEQ ID NO: 923818 - RNA, 22 nt, Mycobacterium avium subsp. paratuberculosis
acagcgggaacaccacgucguc

SEQ ID NO: 923819 - RNA, 19 nt, Mycobacterium avium subsp. paratuberculosis
acagcgggauguagccggu

SEQ ID NO: 923820 - RNA, 16 nt, Mycobacterium avium subsp. paratuberculosis
acagcgguucggcgac

SEQ ID NO: 923821 - RNA, 17 nt, Mycobacterium avium subsp. paratuberculosis
acagcgguucggcgacg

SEQ ID NO: 923822 - RNA, 18 nt, Mycobacterium avium subsp. paratuberculosis
acagcgguucggcgacgc

SEQ ID NO: 923823 - RNA, 17 nt, Mycobacterium avium subsp. paratuberculosis
acagcgggucguuggcg

SEQ ID NO: 923824 - RNA, 21 nt, Mycobacterium avium subsp. paratuberculosis
acagcgggucguuggcggcgg

SEQ ID NO: 923825 - RNA, 22 nt, Mycobacterium avium subsp. paratuberculosis
acagcgguaucccguugggguc

SEQ ID NO: 923826 - RNA, 16 nt, Mycobacterium avium subsp. paratuberculosis
acagcugacgggccgg

SEQ ID NO: 923827 - RNA, 17 nt, Mycobacterium avium subsp. paratuberculosis
acagcugacgggccggc

SEQ ID NO: 923828 - RNA, 19 nt, Mycobacterium avium subsp. paratuberculosis
acagcugacgggccggcgg

SEQ ID NO: 923829 - RNA, 22 nt, Mycobacterium avium subsp. paratuberculosis
acagcgucaccaaugcgccggc

SEQ ID NO: 923830 - RNA, 23 nt, Mycobacterium avium subsp. paratuberculosis
acagcgucaccaaugcgccggcg

SEQ ID NO: 923831 - RNA, 17 nt, Mycobacterium avium subsp. paratuberculosis
acagcgucagcaucgcc

SEQ ID NO: 923832 - RNA, 21 nt, Mycobacterium avium subsp. paratuberculosis
acagcgucagcaucgccgucg

SEQ ID NO: 923833 - RNA, 18 nt, Mycobacterium avium subsp. paratuberculosis
acagcgacaaucucgggc

SEQ ID NO: 923834 - RNA, 21 nt, Mycobacterium avium subsp. paratuberculosis
acagcgacaaucucgggcacc

SEQ ID NO: 923835 - RNA, 17 nt, Mycobacterium avium subsp. paratuberculosis
acagcgaccagucggcg

SEQ ID NO: 923836 - RNA, 15 nt, Mycobacterium avium subsp. paratuberculosis
acagcgacgggccgg

SEQ ID NO: 923837 - RNA, 17 nt, Mycobacterium avium subsp. paratuberculosis
acagcgacgggccgggc

SEQ ID NO: 923838 - RNA, 14 nt, Mycobacterium avium subsp. paratuberculosis
acagcgacgucugc

SEQ ID NO: 923839 - RNA, 19 nt, Mycobacterium avium subsp. paratuberculosis
acagcgacuccagcgcgau

SEQ ID NO: 923840 - RNA, 21 nt, Mycobacterium avium subsp. paratuberculosis
acagcgacuccagcgcgauca

SEQ ID NO: 923841 - RNA, 14 nt, Mycobacterium avium subsp. paratuberculosis
acagcgagccgucg

SEQ ID NO: 923842 - RNA, 15 nt, Mycobacterium avium subsp. paratuberculosis
acagcgagccgucga

SEQ ID NO: 923843 - RNA, 16 nt, Mycobacterium avium subsp. paratuberculosis
acagcgagccgucgac

SEQ ID NO: 923844 - RNA, 13 nt, Mycobacterium avium subsp. paratuberculosis
acagcgaggcgac

SEQ ID NO: 923845 - RNA, 15 nt, Mycobacterium avium subsp. paratuberculosis
acagcgaggcgacgu

SEQ ID NO: 923846 - RNA, 16 nt, Mycobacterium avium subsp. paratuberculosis
acagcgaggcgacguc

SEQ ID NO: 923847 - RNA, 18 nt, Mycobacterium avium subsp. paratuberculosis
acagcgaggcgacgucga

SEQ ID NO: 923848 - RNA, 19 nt, Mycobacterium avium subsp. paratuberculosis
acagcaggaucuccggccg

SEQ ID NO: 923849 - RNA, 12 nt, Mycobacterium avium subsp. paratuberculosis
acagcagcgcgc

SEQ ID NO: 923850 - RNA, 14 nt, Mycobacterium avium subsp. paratuberculosis
acagcagcgcgccg

SEQ ID NO: 923851 - RNA, 16 nt, Mycobacterium avium subsp. paratuberculosis
acagcagcgcgccgac

SEQ ID NO: 923852 - RNA, 20 nt, Mycobacterium avium subsp. paratuberculosis
acagcagcucauacagcggc

SEQ ID NO: 923853 - RNA, 23 nt, Mycobacterium avium subsp. paratuberculosis
acagcagcucauacagcggcgcg

SEQ ID NO: 923854 - RNA, 14 nt, Mycobacterium avium subsp. paratuberculosis
acagcagcagcucc

SEQ ID NO: 923855 - RNA, 17 nt, Mycobacterium avium subsp. paratuberculosis
acagcagcagcucccac

SEQ ID NO: 923856 - RNA, 22 nt, Mycobacterium avium subsp. paratuberculosis
acagcagccgcaccucggggcg

SEQ ID NO: 923857 - RNA, 21 nt, Mycobacterium avium subsp. paratuberculosis
acagcagcgaacccgccaggg

SEQ ID NO: 923858 - RNA, 13 nt, Mycobacterium avium subsp. paratuberculosis
acagcagcgaggc

SEQ ID NO: 923859 - RNA, 16 nt, Mycobacterium avium subsp. paratuberculosis
acagcagcgaggcguc

SEQ ID NO: 923860 - RNA, 12 nt, Mycobacterium avium subsp. paratuberculosis
acagcagcgccg

SEQ ID NO: 923861 - RNA, 20 nt, Mycobacterium avium subsp. paratuberculosis
aagucguuggggaugucgaa

SEQ ID NO: 923862 - RNA, 13 nt, Mycobacterium avium subsp. paratuberculosis
aagucuucggcca

SEQ ID NO: 923863 - RNA, 18 nt, Mycobacterium avium subsp. paratuberculosis
aagugacgccgcucggcc

SEQ ID NO: 923864 - RNA, 23 nt, Mycobacterium avium subsp. paratuberculosis
aagugacuggcguugaugcgggc

SEQ ID NO: 923865 - RNA, 16 nt, Mycobacterium avium subsp. paratuberculosis
aagguggacgagcagc

SEQ ID NO: 923866 - RNA, 13 nt, Mycobacterium avium subsp. paratuberculosis
aaggugacgucgc

SEQ ID NO: 923867 - RNA, 16 nt, Mycobacterium avium subsp. paratuberculosis
aagucggugagcaccg

SEQ ID NO: 923868 - RNA, 16 nt, Mycobacterium avium subsp. paratuberculosis
aagucgccgacgccga

SEQ ID NO: 923869 - RNA, 13 nt, Mycobacterium avium subsp. paratuberculosis
aagucgccggcca

SEQ ID NO: 923870 - RNA, 17 nt, Mycobacterium avium subsp. paratuberculosis
aagucgccguccggggc

SEQ ID NO: 923871 - RNA, 20 nt, Mycobacterium avium subsp. paratuberculosis
aaguggaccgcgugugcccg

SEQ ID NO: 923872 - RNA, 16 nt, Mycobacterium avium subsp. paratuberculosis
aaguucucgcacccgg

SEQ ID NO: 923873 - RNA, 16 nt, Mycobacterium avium subsp. paratuberculosis
aaguuggucaccacca

SEQ ID NO: 923874 - RNA, 11 nt, Mycobacterium avium subsp. paratuberculosis
aaucaacgcgc

SEQ ID NO: 923875 - RNA, 14 nt, Mycobacterium avium subsp. paratuberculosis
aagaccguugacga

SEQ ID NO: 923876 - RNA, 17 nt, Mycobacterium avium subsp. paratuberculosis
aagaccggaagccuguu

SEQ ID NO: 923877 - RNA, 17 nt, Mycobacterium avium subsp. paratuberculosis
aagacguugaccgcgaa

SEQ ID NO: 923878 - RNA, 17 nt, Mycobacterium avium subsp. paratuberculosis
aagacguaggcggccag

SEQ ID NO: 923879 - RNA, 18 nt, Mycobacterium avium subsp. paratuberculosis
aagacguccgcgucggcg

SEQ ID NO: 923880 - RNA, 21 nt, Mycobacterium avium subsp. paratuberculosis
aagacguccgcgucggcgccg

SEQ ID NO: 923881 - RNA, 17 nt, Mycobacterium avium subsp. paratuberculosis
aagacggugggcccgcc

SEQ ID NO: 923882 - RNA, 23 nt, Mycobacterium avium subsp. paratuberculosis
aagacggugggcccgccgucgac

SEQ ID NO: 923883 - RNA, 15 nt, Mycobacterium avium subsp. paratuberculosis
aagccguugccgccg

SEQ ID NO: 923884 - RNA, 19 nt, Mycobacterium avium subsp. paratuberculosis
aagccgugggugccgacga

SEQ ID NO: 923885 - RNA, 22 nt, Mycobacterium avium subsp. paratuberculosis
aagccgugggugccgacgagcu

SEQ ID NO: 923886 - RNA, 16 nt, Mycobacterium avium subsp. paratuberculosis
aagccguucgcgccga

SEQ ID NO: 923887 - RNA, 20 nt, Mycobacterium avium subsp. paratuberculosis
aagccgucgaccccgccggc

SEQ ID NO: 923888 - RNA, 15 nt, Mycobacterium avium subsp. paratuberculosis
aagccgugacccgcc

SEQ ID NO: 923889 - RNA, 12 nt, Mycobacterium avium subsp. paratuberculosis
aagccggcgacg

SEQ ID NO: 923890 - RNA, 19 nt, Mycobacterium avium subsp. paratuberculosis
aagcgcagaucgcgcauca

SEQ ID NO: 923891 - RNA, 19 nt, Mycobacterium avium subsp. paratuberculosis
aagcgcagcaccuccgaca

SEQ ID NO: 923892 - RNA, 19 nt, Mycobacterium avium subsp. paratuberculosis
aagcccuugcagcacaccg

SEQ ID NO: 923893 - RNA, 13 nt, Mycobacterium avium subsp. paratuberculosis
aagcccucgucga

SEQ ID NO: 923894 - RNA, 13 nt, Mycobacterium avium subsp. paratuberculosis
aagccaugccggg

SEQ ID NO: 923895 - RNA, 18 nt, Mycobacterium avium subsp. paratuberculosis
aagccgaucaccggcgcg

SEQ ID NO: 923896 - RNA, 14 nt, Mycobacterium avium subsp. paratuberculosis
aagccgacgucgac

SEQ ID NO: 923897 - RNA, 16 nt, Mycobacterium avium subsp. paratuberculosis
aagccgaggucgccga

SEQ ID NO: 923898 - RNA, 19 nt, Mycobacterium avium subsp. paratuberculosis
aagccgaggucgccgacgc

SEQ ID NO: 923899 - RNA, 10 nt, Mycobacterium avium subsp. paratuberculosis
aagccgcgga

SEQ ID NO: 923900 - RNA, 17 nt, Mycobacterium avium subsp. paratuberculosis
aagccgcggacggcgaa

SEQ ID NO: 923901 - RNA, 22 nt, Mycobacterium avium subsp. paratuberculosis
aagccgcagcaggugcgccaga

SEQ ID NO: 923902 - RNA, 21 nt, Mycobacterium avium subsp. paratuberculosis
aagccgcgaacgccucggcga

SEQ ID NO: 923903 - RNA, 23 nt, Mycobacterium avium subsp. paratuberculosis
aaggcacccaggaaaaccagcga

SEQ ID NO: 923904 - RNA, 12 nt, Mycobacterium avium subsp. paratuberculosis
aaggcaggcacu

SEQ ID NO: 923905 - RNA, 13 nt, Mycobacterium avium subsp. paratuberculosis
aaggcccccggcu

SEQ ID NO: 923906 - RNA, 17 nt, Mycobacterium avium subsp. paratuberculosis
aagcgguuccagaccgg

SEQ ID NO: 923907 - RNA, 15 nt, Mycobacterium avium subsp. paratuberculosis
aagcgcaucgccggc

SEQ ID NO: 923908 - RNA, 22 nt, Mycobacterium avium subsp. paratuberculosis
aaggucgaccgcgcaccggcgc

SEQ ID NO: 923909 - RNA, 18 nt, Mycobacterium avium subsp. paratuberculosis
aaggucugcagcagccgc

SEQ ID NO: 923910 - RNA, 18 nt, Mycobacterium avium subsp. paratuberculosis
aaggccgcugcccggcgc

SEQ ID NO: 923911 - RNA, 22 nt, Mycobacterium avium subsp. paratuberculosis
aaggccuuggugugagggcgug

SEQ ID NO: 923912 - RNA, 20 nt, Mycobacterium avium subsp. paratuberculosis
aaggccgggguguagcggau

SEQ ID NO: 923913 - RNA, 10 nt, Mycobacterium avium subsp. paratuberculosis
aaggccgccu

SEQ ID NO: 923914 - RNA, 22 nt, Mycobacterium avium subsp. paratuberculosis
aaggccgacagguagcaggcgc

SEQ ID NO: 923915 - RNA, 18 nt, Mycobacterium avium subsp. paratuberculosis
aaggcguuggacuccacc

SEQ ID NO: 923916 - RNA, 22 nt, Mycobacterium avium subsp. paratuberculosis
aaggcguuggacuccaccgcca

SEQ ID NO: 923917 - RNA, 15 nt, Mycobacterium avium subsp. paratuberculosis
aaggcgaacaccagc

SEQ ID NO: 923918 - RNA, 22 nt, Mycobacterium avium subsp. paratuberculosis
aaggcguuguugaggaacgcga

SEQ ID NO: 923919 - RNA, 18 nt, Mycobacterium avium subsp. paratuberculosis
aacgccacaaacagcgcg

SEQ ID NO: 923920 - RNA, 20 nt, Mycobacterium avium subsp. paratuberculosis
aacgccacaaacagcgcggc

SEQ ID NO: 923921 - RNA, 22 nt, Mycobacterium avium subsp. paratuberculosis
aacgccacaaacagcgcggccg

SEQ ID NO: 923922 - RNA, 18 nt, Mycobacterium avium subsp. paratuberculosis
aacgccaccuucaccgcg

SEQ ID NO: 923923 - RNA, 19 nt, Mycobacterium avium subsp. paratuberculosis
aacgccaccuucaccgcgc

SEQ ID NO: 923924 - RNA, 20 nt, Mycobacterium avium subsp. paratuberculosis
aacgccaccuucaccgcgcc

SEQ ID NO: 923925 - RNA, 14 nt, Mycobacterium avium subsp. paratuberculosis
aacgagcgcgccga

SEQ ID NO: 923926 - RNA, 16 nt, Mycobacterium avium subsp. paratuberculosis
aacgagcgcgccgagg

SEQ ID NO: 923927 - RNA, 18 nt, Mycobacterium avium subsp. paratuberculosis
aacgacgccaguucgucg

SEQ ID NO: 923928 - RNA, 18 nt, Mycobacterium avium subsp. paratuberculosis
aacgacgcggcacgccgc

SEQ ID NO: 923929 - RNA, 14 nt, Mycobacterium avium subsp. paratuberculosis
aacgacggugcgcc

SEQ ID NO: 923930 - RNA, 22 nt, Mycobacterium avium subsp. paratuberculosis
aacgacguguucaacgcgccga

SEQ ID NO: 923931 - RNA, 15 nt, Mycobacterium avium subsp. paratuberculosis
aacgacuggcggcgg

SEQ ID NO: 923932 - RNA, 16 nt, Mycobacterium avium subsp. paratuberculosis
aacgacuggcggcggc

SEQ ID NO: 923933 - RNA, 19 nt, Mycobacterium avium subsp. paratuberculosis
aacgacgacaggucgagca

SEQ ID NO: 923934 - RNA, 13 nt, Mycobacterium avium subsp. paratuberculosis
aacgacccggcca

SEQ ID NO: 923935 - RNA, 15 nt, Mycobacterium avium subsp. paratuberculosis
aacgccagcagccgc

SEQ ID NO: 923936 - RNA, 16 nt, Mycobacterium avium subsp. paratuberculosis
aacgccagcagccgca

SEQ ID NO: 923937 - RNA, 11 nt, Mycobacterium avium subsp. paratuberculosis
aacgccagcca

SEQ ID NO: 923938 - RNA, 22 nt, Mycobacterium avium subsp. paratuberculosis
aacgccucgggccggcagccgg

SEQ ID NO: 923939 - RNA, 18 nt, Mycobacterium avium subsp. paratuberculosis
aacgccucgguggucgac

SEQ ID NO: 923940 - RNA, 13 nt, Mycobacterium avium subsp. paratuberculosis
aacgccucgucga

SEQ ID NO: 923941 - RNA, 14 nt, Mycobacterium avium subsp. paratuberculosis
aacgccucgucgac

SEQ ID NO: 923942 - RNA, 23 nt, Mycobacterium avium subsp. paratuberculosis
aacgccucgucgaccgcggccug

SEQ ID NO: 923943 - RNA, 17 nt, Mycobacterium avium subsp. paratuberculosis
aacgcguucgucggcgc

SEQ ID NO: 923944 - RNA, 24 nt, Mycobacterium avium subsp. paratuberculosis
aacgcguucgucggcgcgucguac

SEQ ID NO: 923945 - RNA, 21 nt, Mycobacterium avium subsp. paratuberculosis
aacgcuuccagcaccacccgg

SEQ ID NO: 923946 - RNA, 18 nt, Mycobacterium avium subsp. paratuberculosis
aacggcaccucgaucacc

SEQ ID NO: 923947 - RNA, 19 nt, Mycobacterium avium subsp. paratuberculosis
aacggcaccucgaucaccg

SEQ ID NO: 923948 - RNA, 19 nt, Mycobacterium avium subsp. paratuberculosis
aacgcuggucgaacgccac

SEQ ID NO: 923949 - RNA, 17 nt, Mycobacterium avium subsp. paratuberculosis
aacgcggcaugaccggc

SEQ ID NO: 923950 - RNA, 22 nt, Mycobacterium avium subsp. paratuberculosis
aacgcgcggaugcccaggccgg

SEQ ID NO: 923951 - RNA, 13 nt, Mycobacterium avium subsp. paratuberculosis
aacgccugccggc

SEQ ID NO: 923952 - RNA, 13 nt, Mycobacterium avium subsp. paratuberculosis
aacgccugcgccg

SEQ ID NO: 923953 - RNA, 15 nt, Mycobacterium avium subsp. paratuberculosis
aacgccugcgccgcc

SEQ ID NO: 923954 - RNA, 17 nt, Mycobacterium avium subsp. paratuberculosis
aacgcggugaccgcggc

SEQ ID NO: 923955 - RNA, 22 nt, Mycobacterium avium subsp. paratuberculosis
aacgcggcggugacgaacccgc

SEQ ID NO: 923956 - RNA, 17 nt, Mycobacterium avium subsp. paratuberculosis
aacgcggcgaagcaggc

SEQ ID NO: 923957 - RNA, 18 nt, Mycobacterium avium subsp. paratuberculosis
aacgcggcgaagcaggcc

SEQ ID NO: 923958 - RNA, 23 nt, Mycobacterium avium subsp. paratuberculosis
aacgcguacacggcccgcggcac

SEQ ID NO: 923959 - RNA, 23 nt, Mycobacterium avium subsp. paratuberculosis
aacgcguacuucgugguggugcg

SEQ ID NO: 923960 - RNA, 18 nt, Mycobacterium avium subsp. paratuberculosis
aacgcgucgaacagccgg

SEQ ID NO: 923961 - RNA, 18 nt, Mycobacterium avium subsp. paratuberculosis
aacgcgucgaccgccgcg

SEQ ID NO: 923962 - RNA, 14 nt, Mycobacterium avium subsp. paratuberculosis
aacgcgucgacggc

SEQ ID NO: 923963 - RNA, 20 nt, Mycobacterium avium subsp. paratuberculosis
aacgcgucgcccacgccggu

SEQ ID NO: 923964 - RNA, 17 nt, Mycobacterium avium subsp. paratuberculosis
aacgcgucggcgccgga

SEQ ID NO: 923965 - RNA, 19 nt, Mycobacterium avium subsp. paratuberculosis
aaccguuggccugcgcgac

SEQ ID NO: 923966 - RNA, 20 nt, Mycobacterium avium subsp. paratuberculosis
aaccguuggccugcgcgacc

SEQ ID NO: 923967 - RNA, 12 nt, Mycobacterium avium subsp. paratuberculosis
aaccucgcggcg

SEQ ID NO: 923968 - RNA, 15 nt, Mycobacterium avium subsp. paratuberculosis
aaccucggcggcggc

SEQ ID NO: 923969 - RNA, 17 nt, Mycobacterium avium subsp. paratuberculosis
aaccucuugcggcgcaa

SEQ ID NO: 923970 - RNA, 16 nt, Mycobacterium avium subsp. paratuberculosis
aaccgucccacacggg

SEQ ID NO: 923971 - RNA, 19 nt, Mycobacterium avium subsp. paratuberculosis
aaccguggaagucgccguc

SEQ ID NO: 923972 - RNA, 21 nt, Mycobacterium avium subsp. paratuberculosis
aaccguggaagucgccguccg

SEQ ID NO: 923973 - RNA, 16 nt, Mycobacterium avium subsp. paratuberculosis
aaccgggccugcgcgc

SEQ ID NO: 923974 - RNA, 19 nt, Mycobacterium avium subsp. paratuberculosis
aaccgggccugcgcgccga

SEQ ID NO: 923975 - RNA, 23 nt, Mycobacterium avium subsp. paratuberculosis
aaccgggcgcgcagaucgucgac

SEQ ID NO: 923976 - RNA, 14 nt, Mycobacterium avium subsp. paratuberculosis
aaccggggccgcac

SEQ ID NO: 923977 - RNA, 22 nt, Mycobacterium avium subsp. paratuberculosis
aaccgggacagccgcgccgaca

SEQ ID NO: 923978 - RNA, 17 nt, Mycobacterium avium subsp. paratuberculosis
aaccgggauaccgcgac

SEQ ID NO: 923979 - RNA, 19 nt, Mycobacterium avium subsp. paratuberculosis
aaccgggccaacgguucgg

SEQ ID NO: 923980 - RNA, 17 nt, Mycobacterium avium subsp. paratuberculosis
aaccgggcccucguccg

SEQ ID NO: 923981 - RNA, 19 nt, Mycobacterium avium subsp. paratuberculosis
aaccgggcccucguccgac

SEQ ID NO: 923982 - RNA, 19 nt, Mycobacterium avium subsp. paratuberculosis
aaccgggucagcaccacca

SEQ ID NO: 923983 - RNA, 20 nt, Mycobacterium avium subsp. paratuberculosis
aaccgggucucgcgccacca

SEQ ID NO: 923984 - RNA, 18 nt, Mycobacterium avium subsp. paratuberculosis
aaccggucaacggcucgg

SEQ ID NO: 923985 - RNA, 15 nt, Mycobacterium avium subsp. paratuberculosis
aaccgguccgccguc

SEQ ID NO: 923986 - RNA, 23 nt, Mycobacterium avium subsp. paratuberculosis
aaccgcugcugcugcccgcccga

SEQ ID NO: 923987 - RNA, 16 nt, Mycobacterium avium subsp. paratuberculosis
aaccggaccgccgcgg

SEQ ID NO: 923988 - RNA, 17 nt, Mycobacterium avium subsp. paratuberculosis
aaccggaccgccgcggc

SEQ ID NO: 923989 - RNA, 22 nt, Mycobacterium avium subsp. paratuberculosis
aaccggaccgccgcggcgcccg

SEQ ID NO: 923990 - RNA, 19 nt, Mycobacterium avium subsp. paratuberculosis
aaccggaugaugcccuugg

SEQ ID NO: 923991 - RNA, 19 nt, Mycobacterium avium subsp. paratuberculosis
aaccggccccgagcgucac

SEQ ID NO: 923992 - RNA, 13 nt, Mycobacterium avium subsp. paratuberculosis
aaccggaggccgc

SEQ ID NO: 923993 - RNA, 14 nt, Mycobacterium avium subsp. paratuberculosis
aaccggcagccggc

SEQ ID NO: 923994 - RNA, 22 nt, Mycobacterium avium subsp. paratuberculosis
aaccggcaggacgggggccggu

SEQ ID NO: 923995 - RNA, 14 nt, Mycobacterium avium subsp. paratuberculosis
aaccggcaggccgu

SEQ ID NO: 923996 - RNA, 12 nt, Mycobacterium avium subsp. paratuberculosis
aaccggccacca

SEQ ID NO: 923997 - RNA, 23 nt, Mycobacterium avium subsp. paratuberculosis
aaccggccagcagcagcccgccg

SEQ ID NO: 923998 - RNA, 12 nt, Mycobacterium avium subsp. paratuberculosis
aaccggcggcgg

SEQ ID NO: 923999 - RNA, 13 nt, Mycobacterium avium subsp. paratuberculosis
aaccggcggcggu

SEQ ID NO: 924000 - RNA, 13 nt, Mycobacterium avium subsp. paratuberculosis
aaccggcgccgaa

SEQ ID NO: 924001 - RNA, 19 nt, Mycobacterium avium subsp. paratuberculosis
aaccggccggcgcgcacgg

SEQ ID NO: 924002 - RNA, 18 nt, Mycobacterium avium subsp. paratuberculosis
aacaccucgccuccagca

SEQ ID NO: 924003 - RNA, 17 nt, Mycobacterium avium subsp. paratuberculosis
aacaccgguccggccgu

SEQ ID NO: 924004 - RNA, 12 nt, Mycobacterium avium subsp. paratuberculosis
aacaccggcgag

SEQ ID NO: 924005 - RNA, 23 nt, Mycobacterium avium subsp. paratuberculosis
aacaccggcgaggugaaccgcga

SEQ ID NO: 924006 - RNA, 16 nt, Mycobacterium avium subsp. paratuberculosis
aacaccggcgcgacca

SEQ ID NO: 924007 - RNA, 15 nt, Mycobacterium avium subsp. paratuberculosis
aacaccggcggcgac

SEQ ID NO: 924008 - RNA, 16 nt, Mycobacterium avium subsp. paratuberculosis
aacaccuuucggccgc

SEQ ID NO: 924009 - RNA, 17 nt, Mycobacterium avium subsp. paratuberculosis
aacaccuuucggccgcg

SEQ ID NO: 924010 - RNA, 14 nt, Mycobacterium avium subsp. paratuberculosis
aacacgccggcggc

SEQ ID NO: 924011 - RNA, 13 nt, Mycobacterium avium subsp. paratuberculosis
aacacgccccggc

SEQ ID NO: 924012 - RNA, 16 nt, Mycobacterium avium subsp. paratuberculosis
aacacgccccggcggg

SEQ ID NO: 924013 - RNA, 22 nt, Mycobacterium avium subsp. paratuberculosis
aacacgaucucggucgccagca

SEQ ID NO: 924014 - RNA, 18 nt, Mycobacterium avium subsp. paratuberculosis
aacacguacagcggcggc

SEQ ID NO: 924015 - RNA, 20 nt, Mycobacterium avium subsp. paratuberculosis
aacacguagcgaucggugaa

SEQ ID NO: 924016 - RNA, 14 nt, Mycobacterium avium subsp. paratuberculosis
aacacguccuggcg

SEQ ID NO: 924017 - RNA, 13 nt, Mycobacterium avium subsp. paratuberculosis
aacacgucggcca

SEQ ID NO: 924018 - RNA, 21 nt, Mycobacterium avium subsp. paratuberculosis
aacuucagcugcuccgggggc

SEQ ID NO: 924019 - RNA, 14 nt, Mycobacterium avium subsp. paratuberculosis
aacuugcuggccga

SEQ ID NO: 924020 - RNA, 18 nt, Mycobacterium avium subsp. paratuberculosis
aacuuguggaaggcgccg

SEQ ID NO: 924021 - RNA, 13 nt, Mycobacterium avium subsp. paratuberculosis
aacugcucgacca

SEQ ID NO: 924022 - RNA, 18 nt, Mycobacterium avium subsp. paratuberculosis
aacugcucgaccagcgcc

SEQ ID NO: 924023 - RNA, 23 nt, Mycobacterium avium subsp. paratuberculosis
aacugcucgaccagcgccgaggu

SEQ ID NO: 924024 - RNA, 22 nt, Mycobacterium avium subsp. paratuberculosis
aacugggccgccgucgccacca

SEQ ID NO: 924025 - RNA, 18 nt, Mycobacterium avium subsp. paratuberculosis
aacugggugccccgccgu

SEQ ID NO: 924026 - RNA, 21 nt, Mycobacterium avium subsp. paratuberculosis
aacuguuaagacuucggcgaa

SEQ ID NO: 924027 - RNA, 20 nt, Mycobacterium avium subsp. paratuberculosis
aacuggucgugcucgucggc

SEQ ID NO: 924028 - RNA, 15 nt, Mycobacterium avium subsp. paratuberculosis
aagaacucagccgaa

SEQ ID NO: 924029 - RNA, 16 nt, Mycobacterium avium subsp. paratuberculosis
aagaacgcgucccaca

SEQ ID NO: 924030 - RNA, 21 nt, Mycobacterium avium subsp. paratuberculosis
aagaaccaacugagcgcggcg

SEQ ID NO: 924031 - RNA, 19 nt, Mycobacterium avium subsp. paratuberculosis
aacugaauuccuggccggu

SEQ ID NO: 924032 - RNA, 18 nt, Mycobacterium avium subsp. paratuberculosis
aacucguugccagccggu

SEQ ID NO: 924033 - RNA, 17 nt, Mycobacterium avium subsp. paratuberculosis
aacucgucgaugcacgc

SEQ ID NO: 924034 - RNA, 21 nt, Mycobacterium avium subsp. paratuberculosis
aacucgaucugcagccggcgc

SEQ ID NO: 924035 - RNA, 22 nt, Mycobacterium avium subsp. paratuberculosis
aacucgaucugcagccggcgcg

SEQ ID NO: 924036 - RNA, 20 nt, Mycobacterium avium subsp. paratuberculosis
aacucgcgaagaucggagcc

SEQ ID NO: 924037 - RNA, 16 nt, Mycobacterium avium subsp. paratuberculosis
aacucgggcucgucgu

SEQ ID NO: 924038 - RNA, 15 nt, Mycobacterium avium subsp. paratuberculosis
aacucggcggcgguu

SEQ ID NO: 924039 - RNA, 20 nt, Mycobacterium avium subsp. paratuberculosis
aacugcauuucggacggcga

SEQ ID NO: 924040 - RNA, 13 nt, Mycobacterium avium subsp. paratuberculosis
aacugcaccagca

SEQ ID NO: 924041 - RNA, 15 nt, Mycobacterium avium subsp. paratuberculosis
aacugcaccagcggc

SEQ ID NO: 924042 - RNA, 16 nt, Mycobacterium avium subsp. paratuberculosis
aacugcaccagcggcg

SEQ ID NO: 924043 - RNA, 14 nt, Mycobacterium avium subsp. paratuberculosis
aacugagcgcccgg

SEQ ID NO: 924044 - RNA, 13 nt, Mycobacterium avium subsp. paratuberculosis
aacugccgcgcac

SEQ ID NO: 924045 - RNA, 12 nt, Mycobacterium avium subsp. paratuberculosis
aacugccgcggc

SEQ ID NO: 924046 - RNA, 14 nt, Mycobacterium avium subsp. paratuberculosis
aacggcgcucccga

SEQ ID NO: 924047 - RNA, 22 nt, Mycobacterium avium subsp. paratuberculosis
aacggcgcggcaguccgccgga

SEQ ID NO: 924048 - RNA, 13 nt, Mycobacterium avium subsp. paratuberculosis
aacggccaaccgc

SEQ ID NO: 924049 - RNA, 18 nt, Mycobacterium avium subsp. paratuberculosis
aacggccaaccgcccggc

SEQ ID NO: 924050 - RNA, 17 nt, Mycobacterium avium subsp. paratuberculosis
aacucccgcgccgcggc

SEQ ID NO: 924051 - RNA, 12 nt, Mycobacterium avium subsp. paratuberculosis
aacuccggcggc

SEQ ID NO: 924052 - RNA, 19 nt, Mycobacterium avium subsp. paratuberculosis
aacuccgccgaaccgauca

SEQ ID NO: 924053 - RNA, 15 nt, Mycobacterium avium subsp. paratuberculosis
aacuccgcgcgcggc

SEQ ID NO: 924054 - RNA, 17 nt, Mycobacterium avium subsp. paratuberculosis
aacuccgcgcgcggcac

SEQ ID NO: 924055 - RNA, 15 nt, Mycobacterium avium subsp. paratuberculosis
aacuccgcucgggcc

SEQ ID NO: 924056 - RNA, 13 nt, Mycobacterium avium subsp. paratuberculosis
aacuccugcagga

SEQ ID NO: 924057 - RNA, 19 nt, Mycobacterium avium subsp. paratuberculosis
aacucgaagcugcgccaca

SEQ ID NO: 924058 - RNA, 18 nt, Mycobacterium avium subsp. paratuberculosis
aacucgacccgcaccucg

SEQ ID NO: 924059 - RNA, 20 nt, Mycobacterium avium subsp. paratuberculosis
aacucgacguucggcgggca

SEQ ID NO: 924060 - RNA, 22 nt, Mycobacterium avium subsp. paratuberculosis
aacucaccgcgucagcagcgcg

SEQ ID NO: 924061 - RNA, 19 nt, Mycobacterium avium subsp. paratuberculosis
aacucaguccucgccgaga

SEQ ID NO: 924062 - RNA, 16 nt, Mycobacterium avium subsp. paratuberculosis
agaucccgccggcggc

SEQ ID NO: 924063 - RNA, 14 nt, Mycobacterium avium subsp. paratuberculosis
agaucccgcuggcc

SEQ ID NO: 924064 - RNA, 17 nt, Mycobacterium avium subsp. paratuberculosis
agaucauuugaccgcac

SEQ ID NO: 924065 - RNA, 19 nt, Mycobacterium avium subsp. paratuberculosis
agaucagcaccguccacag

SEQ ID NO: 924066 - RNA, 21 nt, Mycobacterium avium subsp. paratuberculosis
agaucagggugcucagccgca

SEQ ID NO: 924067 - RNA, 22 nt, Mycobacterium avium subsp. paratuberculosis
agaucagggugcucagccgcac

SEQ ID NO: 924068 - RNA, 15 nt, Mycobacterium avium subsp. paratuberculosis
agaucaacaccgcgc

SEQ ID NO: 924069 - RNA, 12 nt, Mycobacterium avium subsp. paratuberculosis
agaucacggcgu

SEQ ID NO: 924070 - RNA, 17 nt, Mycobacterium avium subsp. paratuberculosis
agaucaccggcaccccc

SEQ ID NO: 924071 - RNA, 13 nt, Mycobacterium avium subsp. paratuberculosis
agaucagcaccag

SEQ ID NO: 924072 - RNA, 21 nt, Mycobacterium avium subsp. paratuberculosis
agaucagcaccagguggcccg

SEQ ID NO: 924073 - RNA, 16 nt, Mycobacterium avium subsp. paratuberculosis
agauaccggccggcgc

SEQ ID NO: 924074 - RNA, 15 nt, Mycobacterium avium subsp. paratuberculosis
agauaggagacagcc

SEQ ID NO: 924075 - RNA, 15 nt, Mycobacterium avium subsp. paratuberculosis
agagcuugccgcgga

SEQ ID NO: 924076 - RNA, 15 nt, Mycobacterium avium subsp. paratuberculosis
agaggugcucgacgg

SEQ ID NO: 924077 - RNA, 13 nt, Mycobacterium avium subsp. paratuberculosis
agaggcuguccag

SEQ ID NO: 924078 - RNA, 18 nt, Mycobacterium avium subsp. paratuberculosis
agaggcuguccagcagcg

SEQ ID NO: 924079 - RNA, 13 nt, Mycobacterium avium subsp. paratuberculosis
agagucgcuggcg

SEQ ID NO: 924080 - RNA, 21 nt, Mycobacterium avium subsp. paratuberculosis
agaguaucgccacgccgacca

SEQ ID NO: 924081 - RNA, 13 nt, Mycobacterium avium subsp. paratuberculosis
agaguccgccgcc

SEQ ID NO: 924082 - RNA, 20 nt, Mycobacterium avium subsp. paratuberculosis
agagugcaacuagcgacggc

SEQ ID NO: 924083 - RNA, 16 nt, Mycobacterium avium subsp. paratuberculosis
agaugaagacccggcc

SEQ ID NO: 924084 - RNA, 15 nt, Mycobacterium avium subsp. paratuberculosis
agaugauggccgcgc

SEQ ID NO: 924085 - RNA, 20 nt, Mycobacterium avium subsp. paratuberculosis
agaugauugcgugcccggcc

SEQ ID NO: 924086 - RNA, 22 nt, Mycobacterium avium subsp. paratuberculosis
agaugauugcgugcccggccag

SEQ ID NO: 924087 - RNA, 15 nt, Mycobacterium avium subsp. paratuberculosis
agaugaucagccgcc

SEQ ID NO: 924088 - RNA, 13 nt, Mycobacterium avium subsp. paratuberculosis
agaugaucagcgc

SEQ ID NO: 924089 - RNA, 15 nt, Mycobacterium avium subsp. paratuberculosis
agaugaucucgccga

SEQ ID NO: 924090 - RNA, 17 nt, Mycobacterium avium subsp. paratuberculosis
agaugaucucgccgagc

SEQ ID NO: 924091 - RNA, 12 nt, Mycobacterium avium subsp. paratuberculosis
agaugcggccca

SEQ ID NO: 924092 - RNA, 16 nt, Mycobacterium avium subsp. paratuberculosis
agaugcggcccagccc

SEQ ID NO: 924093 - RNA, 13 nt, Mycobacterium avium subsp. paratuberculosis
agaugccgccgcc

SEQ ID NO: 924094 - RNA, 18 nt, Mycobacterium avium subsp. paratuberculosis
agaugccgccgccagcgc

SEQ ID NO: 924095 - RNA, 14 nt, Mycobacterium avium subsp. paratuberculosis
agaugccgcucggc

SEQ ID NO: 924096 - RNA, 19 nt, Mycobacterium avium subsp. paratuberculosis
agaugcccacccgcucggc

SEQ ID NO: 924097 - RNA, 15 nt, Mycobacterium avium subsp. paratuberculosis
agaugcccagcagga

SEQ ID NO: 924098 - RNA, 15 nt, Mycobacterium avium subsp. paratuberculosis
agaugcccagcggca

SEQ ID NO: 924099 - RNA, 16 nt, Mycobacterium avium subsp. paratuberculosis
agaugcccgccccgcc

SEQ ID NO: 924100 - RNA, 23 nt, Mycobacterium avium subsp. paratuberculosis
agauggccaccaucaggccggcc

SEQ ID NO: 924101 - RNA, 15 nt, Mycobacterium avium subsp. paratuberculosis
agaugcguucggccg

SEQ ID NO: 924102 - RNA, 15 nt, Mycobacterium avium subsp. paratuberculosis
agaugcgcgacggcc

SEQ ID NO: 924103 - RNA, 16 nt, Mycobacterium avium subsp. paratuberculosis
agaugcgggccaccgu

SEQ ID NO: 924104 - RNA, 17 nt, Mycobacterium avium subsp. paratuberculosis
agaugcuucagcccucg

SEQ ID NO: 924105 - RNA, 17 nt, Mycobacterium avium subsp. paratuberculosis
agauguugcggccggcc

SEQ ID NO: 924106 - RNA, 13 nt, Mycobacterium avium subsp. paratuberculosis
agauguugcggcg

SEQ ID NO: 924107 - RNA, 13 nt, Mycobacterium avium subsp. paratuberculosis
agaugucggugcc

SEQ ID NO: 924108 - RNA, 15 nt, Mycobacterium avium subsp. paratuberculosis
agaugucggugccga

SEQ ID NO: 924109 - RNA, 21 nt, Mycobacterium avium subsp. paratuberculosis
agauguugaugaucgagccgc

SEQ ID NO: 924110 - RNA, 21 nt, Mycobacterium avium subsp. paratuberculosis
agauggucgccgacgguggcg

SEQ ID NO: 924111 - RNA, 19 nt, Mycobacterium avium subsp. paratuberculosis
agaugguggccgucggccu

SEQ ID NO: 924112 - RNA, 22 nt, Mycobacterium avium subsp. paratuberculosis
agauggccagcgcggcgucacc

SEQ ID NO: 924113 - RNA, 12 nt, Mycobacterium avium subsp. paratuberculosis
agauggccagga

SEQ ID NO: 924114 - RNA, 13 nt, Mycobacterium avium subsp. paratuberculosis
agaugggcgccga

SEQ ID NO: 924115 - RNA, 17 nt, Mycobacterium avium subsp. paratuberculosis
agauccuuugcggcccc

SEQ ID NO: 924116 - RNA, 21 nt, Mycobacterium avium subsp. paratuberculosis
agaucgccagcgcccccagcg

SEQ ID NO: 924117 - RNA, 14 nt, Mycobacterium avium subsp. paratuberculosis
agaucgacagggcg

SEQ ID NO: 924118 - RNA, 21 nt, Mycobacterium avium subsp. paratuberculosis
agaucgagcugggcccgcgca

SEQ ID NO: 924119 - RNA, 16 nt, Mycobacterium avium subsp. paratuberculosis
agaucgaggccagcgc

SEQ ID NO: 924120 - RNA, 19 nt, Mycobacterium avium subsp. paratuberculosis
agaucgcgcaucacccggc

SEQ ID NO: 924121 - RNA, 23 nt, Mycobacterium avium subsp. paratuberculosis
agaucgcgcaucacccggcgcgc

SEQ ID NO: 924122 - RNA, 17 nt, Mycobacterium avium subsp. paratuberculosis
agaucgcgguccaccag

SEQ ID NO: 924123 - RNA, 13 nt, Mycobacterium avium subsp. paratuberculosis
agaucgcggcccg

SEQ ID NO: 924124 - RNA, 16 nt, Mycobacterium avium subsp. paratuberculosis
agaucgcggcccgccg

SEQ ID NO: 924125 - RNA, 19 nt, Mycobacterium avium subsp. paratuberculosis
agaucgcggcccgccgcuc

SEQ ID NO: 924126 - RNA, 13 nt, Mycobacterium avium subsp. paratuberculosis
agaucgccagcac

SEQ ID NO: 924127 - RNA, 16 nt, Mycobacterium avium subsp. paratuberculosis
agaucggccagccacg

SEQ ID NO: 924128 - RNA, 17 nt, Mycobacterium avium subsp. paratuberculosis
agaucggcucaccgaac

SEQ ID NO: 924129 - RNA, 20 nt, Mycobacterium avium subsp. paratuberculosis
agaucguagggcucggcguc

SEQ ID NO: 924130 - RNA, 13 nt, Mycobacterium avium subsp. paratuberculosis
agaucgucgggca

SEQ ID NO: 924131 - RNA, 16 nt, Mycobacterium avium subsp. paratuberculosis
agaucucgcgccgcgc

SEQ ID NO: 924132 - RNA, 20 nt, Mycobacterium avium subsp. paratuberculosis
agaucuccgggaacgcggcg

SEQ ID NO: 924133 - RNA, 12 nt, Mycobacterium avium subsp. paratuberculosis
agaucugcaggg

SEQ ID NO: 924134 - RNA, 21 nt, Mycobacterium avium subsp. paratuberculosis
agacugaugcccucgccgguc

SEQ ID NO: 924135 - RNA, 14 nt, Mycobacterium avium subsp. paratuberculosis
agacugaugguggc

SEQ ID NO: 924136 - RNA, 18 nt, Mycobacterium avium subsp. paratuberculosis
agagccguuuggcgccgc

SEQ ID NO: 924137 - RNA, 20 nt, Mycobacterium avium subsp. paratuberculosis
agagcaggaccgagccgcgc

SEQ ID NO: 924138 - RNA, 19 nt, Mycobacterium avium subsp. paratuberculosis
agagcgccggacucgaaga

SEQ ID NO: 924139 - RNA, 17 nt, Mycobacterium avium subsp. paratuberculosis
agagcgcgggcaccguc

SEQ ID NO: 924140 - RNA, 16 nt, Mycobacterium avium subsp. paratuberculosis
agacgcgcaccagggc

SEQ ID NO: 924141 - RNA, 22 nt, Mycobacterium avium subsp. paratuberculosis
agacgcgcaccagggccgcgag

SEQ ID NO: 924142 - RNA, 20 nt, Mycobacterium avium subsp. paratuberculosis
agacggacacccgcgcggug

SEQ ID NO: 924143 - RNA, 22 nt, Mycobacterium avium subsp. paratuberculosis
agacggcaugccgggccagccg

SEQ ID NO: 924144 - RNA, 20 nt, Mycobacterium avium subsp. paratuberculosis
agacggccagcagcaccgcg

SEQ ID NO: 924145 - RNA, 23 nt, Mycobacterium avium subsp. paratuberculosis
agacggugggcccgccgucgacc

SEQ ID NO: 924146 - RNA, 14 nt, Mycobacterium avium subsp. paratuberculosis
agacguagcaccag

SEQ ID NO: 924147 - RNA, 16 nt, Mycobacterium avium subsp. paratuberculosis
agacguaggcggccag

SEQ ID NO: 924148 - RNA, 19 nt, Mycobacterium avium subsp. paratuberculosis
agacguagugcagccgccc

SEQ ID NO: 924149 - RNA, 21 nt, Mycobacterium avium subsp. paratuberculosis
agacguaagccauggcggccc

SEQ ID NO: 924150 - RNA, 22 nt, Mycobacterium avium subsp. paratuberculosis
agacguaagccauggcggcccg

SEQ ID NO: 924151 - RNA, 18 nt, Mycobacterium avium subsp. paratuberculosis
agacguccgcgucggcgc

SEQ ID NO: 924152 - RNA, 20 nt, Mycobacterium avium subsp. paratuberculosis
agacguccgcgucggcgccg

SEQ ID NO: 924153 - RNA, 22 nt, Mycobacterium avium subsp. paratuberculosis
agacguccgcgucggcgccggc

SEQ ID NO: 924154 - RNA, 24 nt, Mycobacterium avium subsp. paratuberculosis
agacguccgcgucggcgccggcca

SEQ ID NO: 924155 - RNA, 20 nt, Mycobacterium avium subsp. paratuberculosis
agacgucgaccuugcagccc

SEQ ID NO: 924156 - RNA, 12 nt, Mycobacterium avium subsp. paratuberculosis
agacgucggcgc

SEQ ID NO: 924157 - RNA, 16 nt, Mycobacterium avium subsp. paratuberculosis
agacgucggcgcgguc

SEQ ID NO: 924158 - RNA, 22 nt, Mycobacterium avium subsp. paratuberculosis
agacgucggcgcggucgcaggc

SEQ ID NO: 924159 - RNA, 12 nt, Mycobacterium avium subsp. paratuberculosis
agacgucggcgu

SEQ ID NO: 924160 - RNA, 18 nt, Mycobacterium avium subsp. paratuberculosis
agacgugacgugccccuc

SEQ ID NO: 924161 - RNA, 22 nt, Mycobacterium avium subsp. paratuberculosis
agacguggucgggcaugccggc

SEQ ID NO: 924162 - RNA, 12 nt, Mycobacterium avium subsp. paratuberculosis
agacgucggccg

SEQ ID NO: 924163 - RNA, 22 nt, Mycobacterium avium subsp. paratuberculosis
agacguugccgcacaccgcgca

SEQ ID NO: 924164 - RNA, 14 nt, Mycobacterium avium subsp. paratuberculosis
agacacgcgccggc

SEQ ID NO: 924165 - RNA, 21 nt, Mycobacterium avium subsp. paratuberculosis
agacauucggggccaccaggc

SEQ ID NO: 924166 - RNA, 19 nt, Mycobacterium avium subsp. paratuberculosis
agacagcguggucgcgcag

SEQ ID NO: 924167 - RNA, 13 nt, Mycobacterium avium subsp. paratuberculosis
agacaggccggcc

SEQ ID NO: 924168 - RNA, 16 nt, Mycobacterium avium subsp. paratuberculosis
agaccaugccgccgaa

SEQ ID NO: 924169 - RNA, 16 nt, Mycobacterium avium subsp. paratuberculosis
agaccaugucggccag

SEQ ID NO: 924170 - RNA, 16 nt, Mycobacterium avium subsp. paratuberculosis
agacccacagcugccg

SEQ ID NO: 924171 - RNA, 21 nt, Mycobacterium avium subsp. paratuberculosis
agacccacagcugccggccgu

SEQ ID NO: 924172 - RNA, 14 nt, Mycobacterium avium subsp. paratuberculosis
agaccagcgacgcc

SEQ ID NO: 924173 - RNA, 22 nt, Mycobacterium avium subsp. paratuberculosis
agaccagcgugucgccggggcg

SEQ ID NO: 924174 - RNA, 13 nt, Mycobacterium avium subsp. paratuberculosis
agacccagcagcg

SEQ ID NO: 924175 - RNA, 14 nt, Mycobacterium avium subsp. paratuberculosis
agaccagcaucagc

SEQ ID NO: 924176 - RNA, 20 nt, Mycobacterium avium subsp. paratuberculosis
agaccucacggucggcgucc

SEQ ID NO: 924177 - RNA, 13 nt, Mycobacterium avium subsp. paratuberculosis
agaccggcggcga

SEQ ID NO: 924178 - RNA, 14 nt, Mycobacterium avium subsp. paratuberculosis
agaccggcggcgau

SEQ ID NO: 924179 - RNA, 20 nt, Mycobacterium avium subsp. paratuberculosis
agaccggcggcgaucggcgc

SEQ ID NO: 924180 - RNA, 11 nt, Mycobacterium avium subsp. paratuberculosis
agaccgcggcg

SEQ ID NO: 924181 - RNA, 14 nt, Mycobacterium avium subsp. paratuberculosis
agaccgcggcgguc

SEQ ID NO: 924182 - RNA, 17 nt, Mycobacterium avium subsp. paratuberculosis
agaccgcggucaccggu

SEQ ID NO: 924183 - RNA, 16 nt, Mycobacterium avium subsp. paratuberculosis
agaccgcuugcggcuc

SEQ ID NO: 924184 - RNA, 20 nt, Mycobacterium avium subsp. paratuberculosis
agaccggacagcugggcgua

SEQ ID NO: 924185 - RNA, 14 nt, Mycobacterium avium subsp. paratuberculosis
agacccuguggguc

SEQ ID NO: 924186 - RNA, 21 nt, Mycobacterium avium subsp. paratuberculosis
agaccgcacaauccggucagc

SEQ ID NO: 924187 - RNA, 17 nt, Mycobacterium avium subsp. paratuberculosis
agaccgaacgucacggc

SEQ ID NO: 924188 - RNA, 14 nt, Mycobacterium avium subsp. paratuberculosis
agacgccccaguug

SEQ ID NO: 924189 - RNA, 16 nt, Mycobacterium avium subsp. paratuberculosis
agaccuugaccaccga

SEQ ID NO: 924190 - RNA, 14 nt, Mycobacterium avium subsp. paratuberculosis
agaccugguugccg

SEQ ID NO: 924191 - RNA, 13 nt, Mycobacterium avium subsp. paratuberculosis
agacgaccagguc

SEQ ID NO: 924192 - RNA, 18 nt, Mycobacterium avium subsp. paratuberculosis
agacgacgucgaccgcgc

SEQ ID NO: 924193 - RNA, 15 nt, Mycobacterium avium subsp. paratuberculosis
agacgagccgccgcg

SEQ ID NO: 924194 - RNA, 18 nt, Mycobacterium avium subsp. paratuberculosis
agacgagcucaccgccga

SEQ ID NO: 924195 - RNA, 19 nt, Mycobacterium avium subsp. paratuberculosis
agacgagcucaccgccgau

SEQ ID NO: 924196 - RNA, 14 nt, Mycobacterium avium subsp. paratuberculosis
agacgaucaccggc

SEQ ID NO: 924197 - RNA, 21 nt, Mycobacterium avium subsp. paratuberculosis
agaagucgauugccgcggccg

SEQ ID NO: 924198 - RNA, 23 nt, Mycobacterium avium subsp. paratuberculosis
agaagucgauugccgcggccgcg

SEQ ID NO: 924199 - RNA, 22 nt, Mycobacterium avium subsp. paratuberculosis
agaagucgcccgcguugcggcg

SEQ ID NO: 924200 - RNA, 23 nt, Mycobacterium avium subsp. paratuberculosis
agaagucgcccgcguugcggcgc

SEQ ID NO: 924201 - RNA, 14 nt, Mycobacterium avium subsp. paratuberculosis
agaagucgccgacg

SEQ ID NO: 924202 - RNA, 14 nt, Mycobacterium avium subsp. paratuberculosis
agaaggacgccucg

SEQ ID NO: 924203 - RNA, 14 nt, Mycobacterium avium subsp. paratuberculosis
agaaggcggcgucg

SEQ ID NO: 924204 - RNA, 14 nt, Mycobacterium avium subsp. paratuberculosis
agaaggcgccgucg

SEQ ID NO: 924205 - RNA, 20 nt, Mycobacterium avium subsp. paratuberculosis
agaagaucugccggugccgc

SEQ ID NO: 924206 - RNA, 16 nt, Mycobacterium avium subsp. paratuberculosis
agaagaugggcgccga

SEQ ID NO: 924207 - RNA, 22 nt, Mycobacterium avium subsp. paratuberculosis
agaagauguugcggcggccggc

SEQ ID NO: 924208 - RNA, 18 nt, Mycobacterium avium subsp. paratuberculosis
agaagccgugggugccga

SEQ ID NO: 924209 - RNA, 19 nt, Mycobacterium avium subsp. paratuberculosis
agaagcggccgacgaacaa

SEQ ID NO: 924210 - RNA, 18 nt, Mycobacterium avium subsp. paratuberculosis
agaagcuccacgccgccg

SEQ ID NO: 924211 - RNA, 21 nt, Mycobacterium avium subsp. paratuberculosis
agaagccccgguuccaaccac

SEQ ID NO: 924212 - RNA, 20 nt, Mycobacterium avium subsp. paratuberculosis
agaagaccugguugccgccc

SEQ ID NO: 924213 - RNA, 23 nt, Mycobacterium avium subsp. paratuberculosis
agaagaccugguugccgcccucg

SEQ ID NO: 924214 - RNA, 17 nt, Mycobacterium avium subsp. paratuberculosis
agaacccgaacgcgucg

SEQ ID NO: 924215 - RNA, 20 nt, Mycobacterium avium subsp. paratuberculosis
agaaccgcucgauggcgccg

SEQ ID NO: 924216 - RNA, 16 nt, Mycobacterium avium subsp. paratuberculosis
agaaccgcucggcggc

SEQ ID NO: 924217 - RNA, 15 nt, Mycobacterium avium subsp. paratuberculosis
agaacaguucgacgu

SEQ ID NO: 924218 - RNA, 21 nt, Mycobacterium avium subsp. paratuberculosis
agaaccaacugagcgcggcga

SEQ ID NO: 924219 - RNA, 16 nt, Mycobacterium avium subsp. paratuberculosis
agaacaccaccgccag

SEQ ID NO: 924220 - RNA, 23 nt, Mycobacterium avium subsp. paratuberculosis
agaacaccacgguguagcggcgg

SEQ ID NO: 924221 - RNA, 19 nt, Mycobacterium avium subsp. paratuberculosis
agaacacguuucggcccuc

SEQ ID NO: 924222 - RNA, 17 nt, Mycobacterium avium subsp. paratuberculosis
acuucgacggcagcggc

SEQ ID NO: 924223 - RNA, 14 nt, Mycobacterium avium subsp. paratuberculosis
acuucgagccgggc

SEQ ID NO: 924224 - RNA, 12 nt, Mycobacterium avium subsp. paratuberculosis
acuagguccggc

SEQ ID NO: 924225 - RNA, 14 nt, Mycobacterium avium subsp. paratuberculosis
acugaagcuucaag

SEQ ID NO: 924226 - RNA, 16 nt, Mycobacterium avium subsp. paratuberculosis
acugagucaagccggc

SEQ ID NO: 924227 - RNA, 18 nt, Mycobacterium avium subsp. paratuberculosis
acugaccgauggccgccc

SEQ ID NO: 924228 - RNA, 19 nt, Mycobacterium avium subsp. paratuberculosis
acugaccuucucccgcggc

SEQ ID NO: 924229 - RNA, 21 nt, Mycobacterium avium subsp. paratuberculosis
acugcccguagucggcggcga

SEQ ID NO: 924230 - RNA, 23 nt, Mycobacterium avium subsp. paratuberculosis
acugccgagcaucagcugccguc

SEQ ID NO: 924231 - RNA, 14 nt, Mycobacterium avium subsp. paratuberculosis
acugccgaugcuga

SEQ ID NO: 924232 - RNA, 15 nt, Mycobacterium avium subsp. paratuberculosis
acugccgccgcccag

SEQ ID NO: 924233 - RNA, 22 nt, Mycobacterium avium subsp. paratuberculosis
acugccccgcuccuccucgcgc

SEQ ID NO: 924234 - RNA, 15 nt, Mycobacterium avium subsp. paratuberculosis
acugcccgaccgcgc

SEQ ID NO: 924235 - RNA, 20 nt, Mycobacterium avium subsp. paratuberculosis
acugcauuucggacggcgac

SEQ ID NO: 924236 - RNA, 24 nt, Mycobacterium avium subsp. paratuberculosis
acugcagauaggacccggcgagcg

SEQ ID NO: 924237 - RNA, 14 nt, Mycobacterium avium subsp. paratuberculosis
acugcaucgccagc

SEQ ID NO: 924238 - RNA, 12 nt, Mycobacterium avium subsp. paratuberculosis
acugcaucucga

SEQ ID NO: 924239 - RNA, 13 nt, Mycobacterium avium subsp. paratuberculosis
acugcaggugacg

SEQ ID NO: 924240 - RNA, 20 nt, Mycobacterium avium subsp. paratuberculosis
acugcagcgacuggcccucg

SEQ ID NO: 924241 - RNA, 16 nt, Mycobacterium avium subsp. paratuberculosis
acugcaccagcacgac

SEQ ID NO: 924242 - RNA, 17 nt, Mycobacterium avium subsp. paratuberculosis
acugcaccagcggcgcc

SEQ ID NO: 924243 - RNA, 11 nt, Mycobacterium avium subsp. paratuberculosis
acugcacccga

SEQ ID NO: 924244 - RNA, 19 nt, Mycobacterium avium subsp. paratuberculosis
acugcacccgaacggaccg

SEQ ID NO: 924245 - RNA, 15 nt, Mycobacterium avium subsp. paratuberculosis
acugcagcccgaucu

SEQ ID NO: 924246 - RNA, 13 nt, Mycobacterium avium subsp. paratuberculosis
acuguucgcggcu

SEQ ID NO: 924247 - RNA, 15 nt, Mycobacterium avium subsp. paratuberculosis
acuguucgcggcugg

SEQ ID NO: 924248 - RNA, 19 nt, Mycobacterium avium subsp. paratuberculosis
acuguucgcggcuggccgc

SEQ ID NO: 924249 - RNA, 23 nt, Mycobacterium avium subsp. paratuberculosis
acuguucgcggcuggccgcggcg

SEQ ID NO: 924250 - RNA, 15 nt, Mycobacterium avium subsp. paratuberculosis
acugggugcgcgggc

SEQ ID NO: 924251 - RNA, 23 nt, Mycobacterium avium subsp. paratuberculosis
acugggugcgcgggcgcccguag

SEQ ID NO: 924252 - RNA, 16 nt, Mycobacterium avium subsp. paratuberculosis
acugguccuccaacgg

SEQ ID NO: 924253 - RNA, 21 nt, Mycobacterium avium subsp. paratuberculosis
acuggucgaacagcgcgcccg

SEQ ID NO: 924254 - RNA, 22 nt, Mycobacterium avium subsp. paratuberculosis
acuggucgugcagcaccgccag

SEQ ID NO: 924255 - RNA, 23 nt, Mycobacterium avium subsp. paratuberculosis
acuggucgugcagcaccgccagc

SEQ ID NO: 924256 - RNA, 12 nt, Mycobacterium avium subsp. paratuberculosis
acuggucgugcu

SEQ ID NO: 924257 - RNA, 17 nt, Mycobacterium avium subsp. paratuberculosis
acuggucgugcucgucg

SEQ ID NO: 924258 - RNA, 19 nt, Mycobacterium avium subsp. paratuberculosis
acuggucgugcucgucggc

SEQ ID NO: 924259 - RNA, 21 nt, Mycobacterium avium subsp. paratuberculosis
acuggucguugcacacccggu

SEQ ID NO: 924260 - RNA, 22 nt, Mycobacterium avium subsp. paratuberculosis
acugccggcauaggccagcacc

SEQ ID NO: 924261 - RNA, 14 nt, Mycobacterium avium subsp. paratuberculosis
acugccggcgacgg

SEQ ID NO: 924262 - RNA, 13 nt, Mycobacterium avium subsp. paratuberculosis
acugccgcggcac

SEQ ID NO: 924263 - RNA, 18 nt, Mycobacterium avium subsp. paratuberculosis
acugcgccggggccgcgg

SEQ ID NO: 924264 - RNA, 19 nt, Mycobacterium avium subsp. paratuberculosis
acugcgccggggccgcggc

SEQ ID NO: 924265 - RNA, 20 nt, Mycobacterium avium subsp. paratuberculosis
acugcgcgaccaaacgcagc

SEQ ID NO: 924266 - RNA, 18 nt, Mycobacterium avium subsp. paratuberculosis
acugcgguaugccaagcc

SEQ ID NO: 924267 - RNA, 20 nt, Mycobacterium avium subsp. paratuberculosis
acugcggcagaccgguggcg

SEQ ID NO: 924268 - RNA, 23 nt, Mycobacterium avium subsp. paratuberculosis
acugggugggugcggugcggccg

SEQ ID NO: 924269 - RNA, 20 nt, Mycobacterium avium subsp. paratuberculosis
acuggguggucacaccgcug

SEQ ID NO: 924270 - RNA, 13 nt, Mycobacterium avium subsp. paratuberculosis
acuggcggccggc

SEQ ID NO: 924271 - RNA, 14 nt, Mycobacterium avium subsp. paratuberculosis
acuggcggccggcc

SEQ ID NO: 924272 - RNA, 15 nt, Mycobacterium avium subsp. paratuberculosis
acuggcggccggccg

SEQ ID NO: 924273 - RNA, 18 nt, Mycobacterium avium subsp. paratuberculosis
acuggcggccggccgcgc

SEQ ID NO: 924274 - RNA, 19 nt, Mycobacterium avium subsp. paratuberculosis
acugcgugcugggcaccgu

SEQ ID NO: 924275 - RNA, 15 nt, Mycobacterium avium subsp. paratuberculosis
acugcguggccgugu

SEQ ID NO: 924276 - RNA, 15 nt, Mycobacterium avium subsp. paratuberculosis
acuggcccacgcagc

SEQ ID NO: 924277 - RNA, 20 nt, Mycobacterium avium subsp. paratuberculosis
acuggcccacgcagccgucg

SEQ ID NO: 924278 - RNA, 21 nt, Mycobacterium avium subsp. paratuberculosis
acuggcccacgcagccgucga

SEQ ID NO: 924279 - RNA, 15 nt, Mycobacterium avium subsp. paratuberculosis
acggaucggccgcgu

SEQ ID NO: 924280 - RNA, 21 nt, Mycobacterium avium subsp. paratuberculosis
acggaucggccgcgucgggca

SEQ ID NO: 924281 - RNA, 14 nt, Mycobacterium avium subsp. paratuberculosis
acggauugcggacg

SEQ ID NO: 924282 - RNA, 16 nt, Mycobacterium avium subsp. paratuberculosis
acggauguggucggcc

SEQ ID NO: 924283 - RNA, 18 nt, Mycobacterium avium subsp. paratuberculosis
acggcaaccugggcggcg

SEQ ID NO: 924284 - RNA, 16 nt, Mycobacterium avium subsp. paratuberculosis
acggcaacggcggcgg

SEQ ID NO: 924285 - RNA, 16 nt, Mycobacterium avium subsp. paratuberculosis
acggaguuggaucgcc

SEQ ID NO: 924286 - RNA, 22 nt, Mycobacterium avium subsp. paratuberculosis
acggaucgcccacccgcacgcc

SEQ ID NO: 924287 - RNA, 12 nt, Mycobacterium avium subsp. paratuberculosis
acggaucgccgg

SEQ ID NO: 924288 - RNA, 16 nt, Mycobacterium avium subsp. paratuberculosis
acggaucgccggacag

SEQ ID NO: 924289 - RNA, 23 nt, Mycobacterium avium subsp. paratuberculosis
acggaucgccggacagcgggccg

SEQ ID NO: 924290 - RNA, 19 nt, Mycobacterium avium subsp. paratuberculosis
acggaucgagcgcaccgcc

SEQ ID NO: 924291 - RNA, 19 nt, Mycobacterium avium subsp. paratuberculosis
acggaucgagucccgcgcg

SEQ ID NO: 924292 - RNA, 18 nt, Mycobacterium avium subsp. paratuberculosis
acggauaucccgcggguc

SEQ ID NO: 924293 - RNA, 16 nt, Mycobacterium avium subsp. paratuberculosis
acggcaauccggcccc

SEQ ID NO: 924294 - RNA, 18 nt, Mycobacterium avium subsp. paratuberculosis
acggcaauccggccccgc

SEQ ID NO: 924295 - RNA, 20 nt, Mycobacterium avium subsp. paratuberculosis
acggcaauccggccccgcug

SEQ ID NO: 924296 - RNA, 16 nt, Mycobacterium avium subsp. paratuberculosis
acggcaaugguugcgg

SEQ ID NO: 924297 - RNA, 19 nt, Mycobacterium avium subsp. paratuberculosis
acggcaaugguugcggcgg

SEQ ID NO: 924298 - RNA, 20 nt, Mycobacterium avium subsp. paratuberculosis
acggcaaugguugcggcggg

SEQ ID NO: 924299 - RNA, 21 nt, Mycobacterium avium subsp. paratuberculosis
acggcaaugguugcggcgggc

SEQ ID NO: 924300 - RNA, 20 nt, Mycobacterium avium subsp. paratuberculosis
acggcaccccgcggucggcg

SEQ ID NO: 924301 - RNA, 22 nt, Mycobacterium avium subsp. paratuberculosis
acggcaccccgcggucggcggc

SEQ ID NO: 924302 - RNA, 16 nt, Mycobacterium avium subsp. paratuberculosis
acggcacccgcagcuc

SEQ ID NO: 924303 - RNA, 13 nt, Mycobacterium avium subsp. paratuberculosis
acggcacccggcc

SEQ ID NO: 924304 - RNA, 18 nt, Mycobacterium avium subsp. paratuberculosis
acggcaccagcggaucgg

SEQ ID NO: 924305 - RNA, 15 nt, Mycobacterium avium subsp. paratuberculosis
acggcaccaccacgg

SEQ ID NO: 924306 - RNA, 20 nt, Mycobacterium avium subsp. paratuberculosis
acggcaccaccacgguggcg

SEQ ID NO: 924307 - RNA, 22 nt, Mycobacterium avium subsp. paratuberculosis
acggcaccaccacgguggcgcc

SEQ ID NO: 924308 - RNA, 13 nt, Mycobacterium avium subsp. paratuberculosis
acggcaccgacgg

SEQ ID NO: 924309 - RNA, 17 nt, Mycobacterium avium subsp. paratuberculosis
acggcaccgacggagcc

SEQ ID NO: 924310 - RNA, 17 nt, Mycobacterium avium subsp. paratuberculosis
acggcaccgccgcgcgg

SEQ ID NO: 924311 - RNA, 14 nt, Mycobacterium avium subsp. paratuberculosis
acggcaccgccggc

SEQ ID NO: 924312 - RNA, 14 nt, Mycobacterium avium subsp. paratuberculosis
acggcaccgcgagc

SEQ ID NO: 924313 - RNA, 21 nt, Mycobacterium avium subsp. paratuberculosis
acggcaggucggugcgcgggg

SEQ ID NO: 924314 - RNA, 22 nt, Mycobacterium avium subsp. paratuberculosis
acggcaggucggugcgcggggu

SEQ ID NO: 924315 - RNA, 15 nt, Mycobacterium avium subsp. paratuberculosis
acggcaggcggcccg

SEQ ID NO: 924316 - RNA, 18 nt, Mycobacterium avium subsp. paratuberculosis
acggcaggcggcccgcuc

SEQ ID NO: 924317 - RNA, 20 nt, Mycobacterium avium subsp. paratuberculosis
acggcaggcggcccgcucga

SEQ ID NO: 924318 - RNA, 17 nt, Mycobacterium avium subsp. paratuberculosis
acggcagcucgucgacg

SEQ ID NO: 924319 - RNA, 23 nt, Mycobacterium avium subsp. paratuberculosis
acggcagcucgucgacguccucg

SEQ ID NO: 924320 - RNA, 14 nt, Mycobacterium avium subsp. paratuberculosis
acggcagcaacuga

SEQ ID NO: 924321 - RNA, 18 nt, Mycobacterium avium subsp. paratuberculosis
acggcagcaacugaccga

SEQ ID NO: 924322 - RNA, 22 nt, Mycobacterium avium subsp. paratuberculosis
acggcagcaccucgcgcagcac

SEQ ID NO: 924323 - RNA, 16 nt, Mycobacterium avium subsp. paratuberculosis
acggcagcaccgccga

SEQ ID NO: 924324 - RNA, 17 nt, Mycobacterium avium subsp. paratuberculosis
acggcagcaccgccgac

SEQ ID NO: 924325 - RNA, 19 nt, Mycobacterium avium subsp. paratuberculosis
acggcagcaccgccgacau

SEQ ID NO: 924326 - RNA, 21 nt, Mycobacterium avium subsp. paratuberculosis
acggcagcgcuaaccgcgggc

SEQ ID NO: 924327 - RNA, 12 nt, Mycobacterium avium subsp. paratuberculosis
acggcagcggca

SEQ ID NO: 924328 - RNA, 13 nt, Mycobacterium avium subsp. paratuberculosis
acggcagcccgac

SEQ ID NO: 924329 - RNA, 15 nt, Mycobacterium avium subsp. paratuberculosis
acggcagcccgacgu

SEQ ID NO: 924330 - RNA, 13 nt, Mycobacterium avium subsp. paratuberculosis
acggccaccagca

SEQ ID NO: 924331 - RNA, 20 nt, Mycobacterium avium subsp. paratuberculosis
acggccaccagcagcgagac

SEQ ID NO: 924332 - RNA, 23 nt, Mycobacterium avium subsp. paratuberculosis
acggccaccagcagcgagaccgg

SEQ ID NO: 924333 - RNA, 14 nt, Mycobacterium avium subsp. paratuberculosis
acggccaccgcgac

SEQ ID NO: 924334 - RNA, 18 nt, Mycobacterium avium subsp. paratuberculosis
acggccaccgcgacgcug

SEQ ID NO: 924335 - RNA, 18 nt, Mycobacterium avium subsp. paratuberculosis
acggccaccuugucggcg

SEQ ID NO: 924336 - RNA, 20 nt, Mycobacterium avium subsp. paratuberculosis
acggccaccuugucggcgcc

SEQ ID NO: 924337 - RNA, 17 nt, Mycobacterium avium subsp. paratuberculosis
acggccacugccccggc

SEQ ID NO: 924338 - RNA, 13 nt, Mycobacterium avium subsp. paratuberculosis
acggccagaccgc

SEQ ID NO: 924339 - RNA, 16 nt, Mycobacterium avium subsp. paratuberculosis
acggccagcaccgcca

SEQ ID NO: 924340 - RNA, 17 nt, Mycobacterium avium subsp. paratuberculosis
acggccagcaccgccag

SEQ ID NO: 924341 - RNA, 24 nt, Mycobacterium avium subsp. paratuberculosis
acggccagcaccgccagcgccggc

SEQ ID NO: 924342 - RNA, 12 nt, Mycobacterium avium subsp. paratuberculosis
acggcaugucgg

SEQ ID NO: 924343 - RNA, 16 nt, Mycobacterium avium subsp. paratuberculosis
acggcaugucggugga

SEQ ID NO: 924344 - RNA, 14 nt, Mycobacterium avium subsp. paratuberculosis
acggcauugcagcg

SEQ ID NO: 924345 - RNA, 17 nt, Mycobacterium avium subsp. paratuberculosis
acggccaaccgcccggc

SEQ ID NO: 924346 - RNA, 19 nt, Mycobacterium avium subsp. paratuberculosis
acggccaaccgcccggcgc

SEQ ID NO: 924347 - RNA, 17 nt, Mycobacterium avium subsp. paratuberculosis
acggccaacugcaucgc

SEQ ID NO: 924348 - RNA, 21 nt, Mycobacterium avium subsp. paratuberculosis
acggccaacugcaucgccagc

SEQ ID NO: 924349 - RNA, 18 nt, Mycobacterium avium subsp. paratuberculosis
acggcaucgauggcgggc

SEQ ID NO: 924350 - RNA, 22 nt, Mycobacterium avium subsp. paratuberculosis
acggcauggcgaacacgucggc

SEQ ID NO: 924351 - RNA, 19 nt, Mycobacterium avium subsp. paratuberculosis
acggcauggugaugauccc

SEQ ID NO: 924352 - RNA, 12 nt, Mycobacterium avium subsp. paratuberculosis
acggcaugccgg

SEQ ID NO: 924353 - RNA, 22 nt, Mycobacterium avium subsp. paratuberculosis
acggcaugccgggccagccggc

SEQ ID NO: 924354 - RNA, 13 nt, Mycobacterium avium subsp. paratuberculosis
acgcuuccgugcu

SEQ ID NO: 924355 - RNA, 22 nt, Mycobacterium avium subsp. paratuberculosis
acgcuuccgugcuugcccgacg

SEQ ID NO: 924356 - RNA, 22 nt, Mycobacterium avium subsp. paratuberculosis
acgcuuccagcaccacccgguc

SEQ ID NO: 924357 - RNA, 23 nt, Mycobacterium avium subsp. paratuberculosis
acgcuuccagcaccacccggucg

SEQ ID NO: 924358 - RNA, 21 nt, Mycobacterium avium subsp. paratuberculosis
acgcuugggguuuggcgacgu

SEQ ID NO: 924359 - RNA, 14 nt, Mycobacterium avium subsp. paratuberculosis
acggaagccgagcg

SEQ ID NO: 924360 - RNA, 11 nt, Mycobacterium avium subsp. paratuberculosis
acggaaaucgc

SEQ ID NO: 924361 - RNA, 21 nt, Mycobacterium avium subsp. paratuberculosis
acggaauucagugaggccagc

SEQ ID NO: 924362 - RNA, 18 nt, Mycobacterium avium subsp. paratuberculosis
acggacacccgcgcggug

SEQ ID NO: 924363 - RNA, 19 nt, Mycobacterium avium subsp. paratuberculosis
acggacagcucaccgggcu

SEQ ID NO: 924364 - RNA, 17 nt, Mycobacterium avium subsp. paratuberculosis
acggacaggugugggcg

SEQ ID NO: 924365 - RNA, 20 nt, Mycobacterium avium subsp. paratuberculosis
acggagcgcccggccagccg

SEQ ID NO: 924366 - RNA, 14 nt, Mycobacterium avium subsp. paratuberculosis
acggagucgucggc

SEQ ID NO: 924367 - RNA, 15 nt, Mycobacterium avium subsp. paratuberculosis
acggagucgucggcg

SEQ ID NO: 924368 - RNA, 16 nt, Mycobacterium avium subsp. paratuberculosis
acggagucgucggcgc

SEQ ID NO: 924369 - RNA, 20 nt, Mycobacterium avium subsp. paratuberculosis
acggagucgucggcgcgguu

SEQ ID NO: 924370 - RNA, 12 nt, Mycobacterium avium subsp. paratuberculosis
acggagccgagc

SEQ ID NO: 924371 - RNA, 21 nt, Mycobacterium avium subsp. paratuberculosis
acggacgcauccacggccggu

SEQ ID NO: 924372 - RNA, 18 nt, Mycobacterium avium subsp. paratuberculosis
acgcugccgcgccgccac

SEQ ID NO: 924373 - RNA, 20 nt, Mycobacterium avium subsp. paratuberculosis
acgcugccgcuggcgucgau

SEQ ID NO: 924374 - RNA, 22 nt, Mycobacterium avium subsp. paratuberculosis
acgcugccgcuggcgucgaucg

SEQ ID NO: 924375 - RNA, 13 nt, Mycobacterium avium subsp. paratuberculosis
acgcugccaggcg

SEQ ID NO: 924376 - RNA, 15 nt, Mycobacterium avium subsp. paratuberculosis
acgcugcagguggcc

SEQ ID NO: 924377 - RNA, 19 nt, Mycobacterium avium subsp. paratuberculosis
acgcugcggaugucggugu

SEQ ID NO: 924378 - RNA, 13 nt, Mycobacterium avium subsp. paratuberculosis
acgcugcggcgcc

SEQ ID NO: 924379 - RNA, 17 nt, Mycobacterium avium subsp. paratuberculosis
acgcugcggcgccgggc

SEQ ID NO: 924380 - RNA, 12 nt, Mycobacterium avium subsp. paratuberculosis
acgcugcgguac

SEQ ID NO: 924381 - RNA, 15 nt, Mycobacterium avium subsp. paratuberculosis
acgcugccggggcgc

SEQ ID NO: 924382 - RNA, 21 nt, Mycobacterium avium subsp. paratuberculosis
acgcugccgguggucccgguc

SEQ ID NO: 924383 - RNA, 15 nt, Mycobacterium avium subsp. paratuberculosis
acgcugcgcacccgg

SEQ ID NO: 924384 - RNA, 15 nt, Mycobacterium avium subsp. paratuberculosis
acgcugcgcgccgau

SEQ ID NO: 924385 - RNA, 19 nt, Mycobacterium avium subsp. paratuberculosis
acgcuguuggaaccggcca

SEQ ID NO: 924386 - RNA, 20 nt, Mycobacterium avium subsp. paratuberculosis
acgcuguuggaaccggccac

SEQ ID NO: 924387 - RNA, 21 nt, Mycobacterium avium subsp. paratuberculosis
acgcugugcgccuugccgucg

SEQ ID NO: 924388 - RNA, 19 nt, Mycobacterium avium subsp. paratuberculosis
acgcuggugugacgcucgc

SEQ ID NO: 924389 - RNA, 13 nt, Mycobacterium avium subsp. paratuberculosis
acgcuggccgaga

SEQ ID NO: 924390 - RNA, 20 nt, Mycobacterium avium subsp. paratuberculosis
acgcgaacaccagaugccgc

SEQ ID NO: 924391 - RNA, 22 nt, Mycobacterium avium subsp. paratuberculosis
acgcgaacaccagaugccgcuc

SEQ ID NO: 924392 - RNA, 14 nt, Mycobacterium avium subsp. paratuberculosis
acgcgaacccacac

SEQ ID NO: 924393 - RNA, 17 nt, Mycobacterium avium subsp. paratuberculosis
acgcgaaugucgaccac

SEQ ID NO: 924394 - RNA, 16 nt, Mycobacterium avium subsp. paratuberculosis
acgcgaacgcgccccg

SEQ ID NO: 924395 - RNA, 15 nt, Mycobacterium avium subsp. paratuberculosis
acgcgaagucgccgc

SEQ ID NO: 924396 - RNA, 21 nt, Mycobacterium avium subsp. paratuberculosis
acgcgaagucgccgcccgggc

SEQ ID NO: 924397 - RNA, 22 nt, Mycobacterium avium subsp. paratuberculosis
acgcgaagucgccgcccgggcc

SEQ ID NO: 924398 - RNA, 13 nt, Mycobacterium avium subsp. paratuberculosis
aaacagguuggcg

SEQ ID NO: 924399 - RNA, 13 nt, Mycobacterium avium subsp. paratuberculosis
aaacagcgcggcc

SEQ ID NO: 924400 - RNA, 17 nt, Mycobacterium avium subsp. paratuberculosis
acgcgaaagcacccgac

SEQ ID NO: 924401 - RNA, 15 nt, Mycobacterium avium subsp. paratuberculosis
acgcgaaagcagcgu

SEQ ID NO: 924402 - RNA, 20 nt, Mycobacterium avium subsp. paratuberculosis
acgccuugcgguuggccgga

SEQ ID NO: 924403 - RNA, 19 nt, Mycobacterium avium subsp. paratuberculosis
acgcagaacucgucgccac

SEQ ID NO: 924404 - RNA, 21 nt, Mycobacterium avium subsp. paratuberculosis
acgcacucgguguggcccaac

SEQ ID NO: 924405 - RNA, 21 nt, Mycobacterium avium subsp. paratuberculosis
acgcagaucuugugccagccg

SEQ ID NO: 924406 - RNA, 20 nt, Mycobacterium avium subsp. paratuberculosis
acgcgcacaucacgguggcc

SEQ ID NO: 924407 - RNA, 22 nt, Mycobacterium avium subsp. paratuberculosis
acgcgcacaucacgguggccgc

SEQ ID NO: 924408 - RNA, 14 nt, Mycobacterium avium subsp. paratuberculosis
acgcgcagccagga

SEQ ID NO: 924409 - RNA, 21 nt, Mycobacterium avium subsp. paratuberculosis
acgcgcagggcgaacggcgga

SEQ ID NO: 924410 - RNA, 14 nt, Mycobacterium avium subsp. paratuberculosis
acgcgcgugacggc

SEQ ID NO: 924411 - RNA, 19 nt, Mycobacterium avium subsp. paratuberculosis
acgcgcgugacggcggggc

SEQ ID NO: 924412 - RNA, 21 nt, Mycobacterium avium subsp. paratuberculosis
acgcgcgugacggcggggcgg

SEQ ID NO: 924413 - RNA, 16 nt, Mycobacterium avium subsp. paratuberculosis
acgcgcggaugcccag

SEQ ID NO: 924414 - RNA, 22 nt, Mycobacterium avium subsp. paratuberculosis
acgcgcggaugcccaggccggc

SEQ ID NO: 924415 - RNA, 24 nt, Mycobacterium avium subsp. paratuberculosis
acgcgcggaugcccaggccggcga

SEQ ID NO: 924416 - RNA, 24 nt, Mycobacterium avium subsp. paratuberculosis
acgcgcaucaugcguuugccgucg

SEQ ID NO: 924417 - RNA, 21 nt, Mycobacterium avium subsp. paratuberculosis
acgcgcgggucgucggccugu

SEQ ID NO: 924418 - RNA, 24 nt, Mycobacterium avium subsp. paratuberculosis
acgcgcgggucgucggccuguccg

SEQ ID NO: 924419 - RNA, 13 nt, Mycobacterium avium subsp. paratuberculosis
acgcgcgggugcg

SEQ ID NO: 924420 - RNA, 14 nt, Mycobacterium avium subsp. paratuberculosis
acgcgcgggugcgg

SEQ ID NO: 924421 - RNA, 17 nt, Mycobacterium avium subsp. paratuberculosis
acgcgcgggugcgggcg

SEQ ID NO: 924422 - RNA, 15 nt, Mycobacterium avium subsp. paratuberculosis
acgcgcggucgucgc

SEQ ID NO: 924423 - RNA, 19 nt, Mycobacterium avium subsp. paratuberculosis
acgcgcggucgucgcccgu

SEQ ID NO: 924424 - RNA, 21 nt, Mycobacterium avium subsp. paratuberculosis
acgcgcggucgucgcccgucu

SEQ ID NO: 924425 - RNA, 17 nt, Mycobacterium avium subsp. paratuberculosis
acgcgcacaacagccau

SEQ ID NO: 924426 - RNA, 23 nt, Mycobacterium avium subsp. paratuberculosis
acgcgcacaacagccaugccggu

SEQ ID NO: 924427 - RNA, 17 nt, Mycobacterium avium subsp. paratuberculosis
acgcgcacacggccucg

SEQ ID NO: 924428 - RNA, 19 nt, Mycobacterium avium subsp. paratuberculosis
acgcgcaccagggccgcga

SEQ ID NO: 924429 - RNA, 18 nt, Mycobacterium avium subsp. paratuberculosis
acgcgcacccgggaccgg

SEQ ID NO: 924430 - RNA, 12 nt, Mycobacterium avium subsp. paratuberculosis
acgcgcaccgcc

SEQ ID NO: 924431 - RNA, 18 nt, Mycobacterium avium subsp. paratuberculosis
acgcgcaccgccaccgcc

SEQ ID NO: 924432 - RNA, 18 nt, Mycobacterium avium subsp. paratuberculosis
acgcgcaauccugcccgg

SEQ ID NO: 924433 - RNA, 20 nt, Mycobacterium avium subsp. paratuberculosis
acgcgcaauccugcccgguc

SEQ ID NO: 924434 - RNA, 14 nt, Mycobacterium avium subsp. paratuberculosis
acgcgacgaucagc

SEQ ID NO: 924435 - RNA, 22 nt, Mycobacterium avium subsp. paratuberculosis
acgcgacgaucagcagccgggc

SEQ ID NO: 924436 - RNA, 20 nt, Mycobacterium avium subsp. paratuberculosis
acgcgauucucgcugcggcg

SEQ ID NO: 924437 - RNA, 21 nt, Mycobacterium avium subsp. paratuberculosis
acgcgauucucgcugcggcgc

SEQ ID NO: 924438 - RNA, 22 nt, Mycobacterium avium subsp. paratuberculosis
acgcgaccgucgggacggccag

SEQ ID NO: 924439 - RNA, 22 nt, Mycobacterium avium subsp. paratuberculosis
acgcgaccugcaucucgacccg

SEQ ID NO: 924440 - RNA, 22 nt, Mycobacterium avium subsp. paratuberculosis
acgcgaccuguuugaacaccuc

SEQ ID NO: 924441 - RNA, 18 nt, Mycobacterium avium subsp. paratuberculosis
acgcgacgaaccgccaca

SEQ ID NO: 924442 - RNA, 18 nt, Mycobacterium avium subsp. paratuberculosis
acgcgacgaagccggugc

SEQ ID NO: 924443 - RNA, 13 nt, Mycobacterium avium subsp. paratuberculosis
acgcgaccaggcc

SEQ ID NO: 924444 - RNA, 14 nt, Mycobacterium avium subsp. paratuberculosis
acgcgaccaggccc

SEQ ID NO: 924445 - RNA, 17 nt, Mycobacterium avium subsp. paratuberculosis
acgcgaccaggcccagc

SEQ ID NO: 924446 - RNA, 19 nt, Mycobacterium avium subsp. paratuberculosis
acgcgaccaggcccagcgg

SEQ ID NO: 924447 - RNA, 14 nt, Mycobacterium avium subsp. paratuberculosis
acgcgaccgagguc

SEQ ID NO: 924448 - RNA, 17 nt, Mycobacterium avium subsp. paratuberculosis
acgcgaccgaggucgac

SEQ ID NO: 924449 - RNA, 17 nt, Mycobacterium avium subsp. paratuberculosis
acgcgaccgcgcggcga

SEQ ID NO: 924450 - RNA, 17 nt, Mycobacterium avium subsp. paratuberculosis
acgcgaccgcgucgacg

SEQ ID NO: 924451 - RNA, 14 nt, Mycobacterium avium subsp. paratuberculosis
acgcgaccggcccg

SEQ ID NO: 924452 - RNA, 15 nt, Mycobacterium avium subsp. paratuberculosis
acgcgaccggcccga

SEQ ID NO: 924453 - RNA, 15 nt, Mycobacterium avium subsp. paratuberculosis
acgcucacccggccc

SEQ ID NO: 924454 - RNA, 20 nt, Mycobacterium avium subsp. paratuberculosis
acgcucaggcguccagccag

SEQ ID NO: 924455 - RNA, 17 nt, Mycobacterium avium subsp. paratuberculosis
acgcggugggcaccagc

SEQ ID NO: 924456 - RNA, 18 nt, Mycobacterium avium subsp. paratuberculosis
acgcggugggcaccagca

SEQ ID NO: 924457 - RNA, 21 nt, Mycobacterium avium subsp. paratuberculosis
acgcgguguuggcggcgucgu

SEQ ID NO: 924458 - RNA, 22 nt, Mycobacterium avium subsp. paratuberculosis
acgcgguguuggcggcgucguc

SEQ ID NO: 924459 - RNA, 16 nt, Mycobacterium avium subsp. paratuberculosis
acgcggugagcgcgcc

SEQ ID NO: 924460 - RNA, 19 nt, Mycobacterium avium subsp. paratuberculosis
acgcggugagcgcgccggc

SEQ ID NO: 924461 - RNA, 16 nt, Mycobacterium avium subsp. paratuberculosis
acgcggugaccgcggc

SEQ ID NO: 924462 - RNA, 19 nt, Mycobacterium avium subsp. paratuberculosis
acgcucccgguagagcggc

SEQ ID NO: 924463 - RNA, 22 nt, Mycobacterium avium subsp. paratuberculosis
acgcucccgguagagcggcacc

SEQ ID NO: 924464 - RNA, 16 nt, Mycobacterium avium subsp. paratuberculosis
acgcucgaggccccgc

SEQ ID NO: 924465 - RNA, 24 nt, Mycobacterium avium subsp. paratuberculosis
acgcucaugcccgccacggccagc

SEQ ID NO: 924466 - RNA, 13 nt, Mycobacterium avium subsp. paratuberculosis
acgcucggcggcc

SEQ ID NO: 924467 - RNA, 18 nt, Mycobacterium avium subsp. paratuberculosis
acgcucggcggcgcgcag

SEQ ID NO: 924468 - RNA, 14 nt, Mycobacterium avium subsp. paratuberculosis
acgcucggcgccga

SEQ ID NO: 924469 - RNA, 15 nt, Mycobacterium avium subsp. paratuberculosis
acgcucggcgccgag

SEQ ID NO: 924470 - RNA, 17 nt, Mycobacterium avium subsp. paratuberculosis
acgcucggcgccgcggg

SEQ ID NO: 924471 - RNA, 23 nt, Mycobacterium avium subsp. paratuberculosis
acgcucggcgccgcggggcgagu

SEQ ID NO: 924472 - RNA, 17 nt, Mycobacterium avium subsp. paratuberculosis
acgcucggcgccggccg

SEQ ID NO: 924473 - RNA, 18 nt, Mycobacterium avium subsp. paratuberculosis
acgcucggcgccggccgu

SEQ ID NO: 924474 - RNA, 19 nt, Mycobacterium avium subsp. paratuberculosis
acgcucggcgccggccguc

SEQ ID NO: 924475 - RNA, 20 nt, Mycobacterium avium subsp. paratuberculosis
acgcucggcgccggccguca

SEQ ID NO: 924476 - RNA, 17 nt, Mycobacterium avium subsp. paratuberculosis
acgcucggcgcgacguu

SEQ ID NO: 924477 - RNA, 22 nt, Mycobacterium avium subsp. paratuberculosis
acgcucggcgcgcggggccggc

SEQ ID NO: 924478 - RNA, 23 nt, Mycobacterium avium subsp. paratuberculosis
acgcucggcgcgcggggccggcg

SEQ ID NO: 924479 - RNA, 20 nt, Mycobacterium avium subsp. paratuberculosis
acgcucggcgcgucguccga

SEQ ID NO: 924480 - RNA, 22 nt, Mycobacterium avium subsp. paratuberculosis
acgcucggcgcgucguccgaca

SEQ ID NO: 924481 - RNA, 17 nt, Mycobacterium avium subsp. paratuberculosis
acgcucgcaggcgagcc

SEQ ID NO: 924482 - RNA, 17 nt, Mycobacterium avium subsp. paratuberculosis
acgcucgccagaccggu

SEQ ID NO: 924483 - RNA, 19 nt, Mycobacterium avium subsp. paratuberculosis
acgcucgcgugcgaacgug

SEQ ID NO: 924484 - RNA, 22 nt, Mycobacterium avium subsp. paratuberculosis
acgcucgcguggccugggcgac

SEQ ID NO: 924485 - RNA, 14 nt, Mycobacterium avium subsp. paratuberculosis
acgcucggcaggcg

SEQ ID NO: 924486 - RNA, 22 nt, Mycobacterium avium subsp. paratuberculosis
acgcucggccagggugacgguc

SEQ ID NO: 924487 - RNA, 21 nt, Mycobacterium avium subsp. paratuberculosis
acgcucggccguggccgucac

SEQ ID NO: 924488 - RNA, 13 nt, Mycobacterium avium subsp. paratuberculosis
acgcucggccuca

SEQ ID NO: 924489 - RNA, 16 nt, Mycobacterium avium subsp. paratuberculosis
acgcucggccucaggc

SEQ ID NO: 924490 - RNA, 18 nt, Mycobacterium avium subsp. paratuberculosis
acgcugagcaaccgccga

SEQ ID NO: 924491 - RNA, 14 nt, Mycobacterium avium subsp. paratuberculosis
acgcugagcacccg

SEQ ID NO: 924492 - RNA, 14 nt, Mycobacterium avium subsp. paratuberculosis
acgcugagccgcuc

SEQ ID NO: 924493 - RNA, 19 nt, Mycobacterium avium subsp. paratuberculosis
acgcugagccgcucgucga

SEQ ID NO: 924494 - RNA, 20 nt, Mycobacterium avium subsp. paratuberculosis
acgcugacgaugcggccggc

SEQ ID NO: 924495 - RNA, 23 nt, Mycobacterium avium subsp. paratuberculosis
acgcugacgaugcggccggcggg

SEQ ID NO: 924496 - RNA, 13 nt, Mycobacterium avium subsp. paratuberculosis
acgcucggcgggu

SEQ ID NO: 924497 - RNA, 15 nt, Mycobacterium avium subsp. paratuberculosis
acgcucgggccggcg

SEQ ID NO: 924498 - RNA, 16 nt, Mycobacterium avium subsp. paratuberculosis
acgcucgggccggcgc

SEQ ID NO: 924499 - RNA, 18 nt, Mycobacterium avium subsp. paratuberculosis
acgcucgggccggcgccg

SEQ ID NO: 924500 - RNA, 20 nt, Mycobacterium avium subsp. paratuberculosis
acgcucgggccggcgccgac

SEQ ID NO: 924501 - RNA, 21 nt, Mycobacterium avium subsp. paratuberculosis
acgcucgggccggcgccgacg

SEQ ID NO: 924502 - RNA, 22 nt, Mycobacterium avium subsp. paratuberculosis
acgcugaucuacgucggcuggc

SEQ ID NO: 924503 - RNA, 23 nt, Mycobacterium avium subsp. paratuberculosis
acgcugaucuacgucggcuggcg

SEQ ID NO: 924504 - RNA, 20 nt, Mycobacterium avium subsp. paratuberculosis
acgcugaucaccacggucag

SEQ ID NO: 924505 - RNA, 12 nt, Mycobacterium avium subsp. paratuberculosis
acgcugagcgcc

SEQ ID NO: 924506 - RNA, 23 nt, Mycobacterium avium subsp. paratuberculosis
acgcugagcgccaggccauggcg

SEQ ID NO: 924507 - RNA, 23 nt, Mycobacterium avium subsp. paratuberculosis
acgcugagucuacuuggccagcu

SEQ ID NO: 924508 - RNA, 13 nt, Mycobacterium avium subsp. paratuberculosis
acgcgcugccgac

SEQ ID NO: 924509 - RNA, 20 nt, Mycobacterium avium subsp. paratuberculosis
acgcgcugcuugacccgcuc

SEQ ID NO: 924510 - RNA, 21 nt, Mycobacterium avium subsp. paratuberculosis
acgcgcugucgcccucgaucg

SEQ ID NO: 924511 - RNA, 16 nt, Mycobacterium avium subsp. paratuberculosis
acgcgcugcgcgccgc

SEQ ID NO: 924512 - RNA, 21 nt, Mycobacterium avium subsp. paratuberculosis
acgcgcugcgcgccgcccucg

SEQ ID NO: 924513 - RNA, 17 nt, Mycobacterium avium subsp. paratuberculosis
acgcgcucagccccagc

SEQ ID NO: 924514 - RNA, 17 nt, Mycobacterium avium subsp. paratuberculosis
acgcgcucagcgcggcc

SEQ ID NO: 924515 - RNA, 13 nt, Mycobacterium avium subsp. paratuberculosis
acgcgcucggcga

SEQ ID NO: 924516 - RNA, 14 nt, Mycobacterium avium subsp. paratuberculosis
acgcgcucggcgac

SEQ ID NO: 924517 - RNA, 15 nt, Mycobacterium avium subsp. paratuberculosis
acgcgcucggcgacc

SEQ ID NO: 924518 - RNA, 20 nt, Mycobacterium avium subsp. paratuberculosis
acgcggcggccgacagcgcg

SEQ ID NO: 924519 - RNA, 13 nt, Mycobacterium avium subsp. paratuberculosis
acgcggcggccug

SEQ ID NO: 924520 - RNA, 14 nt, Mycobacterium avium subsp. paratuberculosis
acgcggcggccugc

SEQ ID NO: 924521 - RNA, 20 nt, Mycobacterium avium subsp. paratuberculosis
acgcggcggccugcgcgucg

SEQ ID NO: 924522 - RNA, 22 nt, Mycobacterium avium subsp. paratuberculosis
acgcggcggccugcgcgucguc

SEQ ID NO: 924523 - RNA, 21 nt, Mycobacterium avium subsp. paratuberculosis
acgcggcggccuggccgucgc

SEQ ID NO: 924524 - RNA, 22 nt, Mycobacterium avium subsp. paratuberculosis
acgcggcgggaacgguugacgc

SEQ ID NO: 924525 - RNA, 22 nt, Mycobacterium avium subsp. paratuberculosis
acgcggcgggcauaccgucugc

SEQ ID NO: 924526 - RNA, 17 nt, Mycobacterium avium subsp. paratuberculosis
acgcggacacggccggg

SEQ ID NO: 924527 - RNA, 17 nt, Mycobacterium avium subsp. paratuberculosis
acgcggacagcucgccg

SEQ ID NO: 924528 - RNA, 18 nt, Mycobacterium avium subsp. paratuberculosis
acgcggacagcucgccgg

SEQ ID NO: 924529 - RNA, 19 nt, Mycobacterium avium subsp. paratuberculosis
acgcggacagcucgccggc

SEQ ID NO: 924530 - RNA, 17 nt, Mycobacterium avium subsp. paratuberculosis
acgcggacagggcggcg

SEQ ID NO: 924531 - RNA, 18 nt, Mycobacterium avium subsp. paratuberculosis
acgcggacagggcggcga

SEQ ID NO: 924532 - RNA, 19 nt, Mycobacterium avium subsp. paratuberculosis
acgcggacagggcggcgac

SEQ ID NO: 924533 - RNA, 22 nt, Mycobacterium avium subsp. paratuberculosis
acgcggaccuuggugucggcga

SEQ ID NO: 924534 - RNA, 24 nt, Mycobacterium avium subsp. paratuberculosis
acgcggaccuuggugucggcgagc

SEQ ID NO: 924535 - RNA, 23 nt, Mycobacterium avium subsp. paratuberculosis
acgcgggaccgggcccggcgcca

SEQ ID NO: 924536 - RNA, 18 nt, Mycobacterium avium subsp. paratuberculosis
acgcgggauugccgagca

SEQ ID NO: 924537 - RNA, 20 nt, Mycobacterium avium subsp. paratuberculosis
acgcgggauugccgagcacc

SEQ ID NO: 924538 - RNA, 13 nt, Mycobacterium avium subsp. paratuberculosis
acgcgggccggca

SEQ ID NO: 924539 - RNA, 14 nt, Mycobacterium avium subsp. paratuberculosis
acgcgggccggcac

SEQ ID NO: 924540 - RNA, 19 nt, Mycobacterium avium subsp. paratuberculosis
acgcggcguugccgccggc

SEQ ID NO: 924541 - RNA, 22 nt, Mycobacterium avium subsp. paratuberculosis
acgcggcguugccgccggcgcg

SEQ ID NO: 924542 - RNA, 23 nt, Mycobacterium avium subsp. paratuberculosis
acgcggcguugccgccggcgcgg

SEQ ID NO: 924543 - RNA, 15 nt, Mycobacterium avium subsp. paratuberculosis
acgcggcucgcgcgg

SEQ ID NO: 924544 - RNA, 13 nt, Mycobacterium avium subsp. paratuberculosis
acgcggcugauca

SEQ ID NO: 924545 - RNA, 21 nt, Mycobacterium avium subsp. paratuberculosis
acgcggcugaucagccggcga

SEQ ID NO: 924546 - RNA, 16 nt, Mycobacterium avium subsp. paratuberculosis
acgcggcuggcccggc

SEQ ID NO: 924547 - RNA, 21 nt, Mycobacterium avium subsp. paratuberculosis
acgcggcuggcccggcgcggc

SEQ ID NO: 924548 - RNA, 22 nt, Mycobacterium avium subsp. paratuberculosis
acgcggcuggcccggcgcggcg

SEQ ID NO: 924549 - RNA, 23 nt, Mycobacterium avium subsp. paratuberculosis
acgcggcuggcgggugguuggcc

SEQ ID NO: 924550 - RNA, 23 nt, Mycobacterium avium subsp. paratuberculosis
acgcggcuucauaugacgccggc

SEQ ID NO: 924551 - RNA, 15 nt, Mycobacterium avium subsp. paratuberculosis
acgcgggcgcccagc

SEQ ID NO: 924552 - RNA, 16 nt, Mycobacterium avium subsp. paratuberculosis
acgcgggcgcccagca

SEQ ID NO: 924553 - RNA, 14 nt, Mycobacterium avium subsp. paratuberculosis
acgcggggcggcgg

SEQ ID NO: 924554 - RNA, 18 nt, Mycobacterium avium subsp. paratuberculosis
acgcggggcggcggcgcc

SEQ ID NO: 924555 - RNA, 18 nt, Mycobacterium avium subsp. paratuberculosis
acgcgguaccgaugacca

SEQ ID NO: 924556 - RNA, 13 nt, Mycobacterium avium subsp. paratuberculosis
acgcggucgccgc

SEQ ID NO: 924557 - RNA, 17 nt, Mycobacterium avium subsp. paratuberculosis
acgcggucugcggugcg

SEQ ID NO: 924558 - RNA, 22 nt, Mycobacterium avium subsp. paratuberculosis
acgcggucugcggugcgcccag

SEQ ID NO: 924559 - RNA, 17 nt, Mycobacterium avium subsp. paratuberculosis
acgcggucaccggcucg

SEQ ID NO: 924560 - RNA, 17 nt, Mycobacterium avium subsp. paratuberculosis
acuagcuucacgcucgg

SEQ ID NO: 924561 - RNA, 18 nt, Mycobacterium avium subsp. paratuberculosis
acuagcuucacgcucggc

SEQ ID NO: 924562 - RNA, 14 nt, Mycobacterium avium subsp. paratuberculosis
acuaccgacggcac

SEQ ID NO: 924563 - RNA, 17 nt, Mycobacterium avium subsp. paratuberculosis
acuacgcacccgacacg

SEQ ID NO: 924564 - RNA, 22 nt, Mycobacterium avium subsp. paratuberculosis
acuacgcacccgacacgccgau

SEQ ID NO: 924565 - RNA, 19 nt, Mycobacterium avium subsp. paratuberculosis
acguucagcgacuugccgc

SEQ ID NO: 924566 - RNA, 23 nt, Mycobacterium avium subsp. paratuberculosis
acguucagcgacuugccgccggc

SEQ ID NO: 924567 - RNA, 19 nt, Mycobacterium avium subsp. paratuberculosis
acguguucgggaucggcgc

SEQ ID NO: 924568 - RNA, 16 nt, Mycobacterium avium subsp. paratuberculosis
acguguucucacggcg

SEQ ID NO: 924569 - RNA, 12 nt, Mycobacterium avium subsp. paratuberculosis
acguuggugauc

SEQ ID NO: 924570 - RNA, 20 nt, Mycobacterium avium subsp. paratuberculosis
acguuggugaucgccgacgu

SEQ ID NO: 924571 - RNA, 16 nt, Mycobacterium avium subsp. paratuberculosis
acguuggcggccagcg

SEQ ID NO: 924572 - RNA, 17 nt, Mycobacterium avium subsp. paratuberculosis
acguuggcggccagcgc

SEQ ID NO: 924573 - RNA, 18 nt, Mycobacterium avium subsp. paratuberculosis
acguuccagccgugcugg

SEQ ID NO: 924574 - RNA, 14 nt, Mycobacterium avium subsp. paratuberculosis
acguucgccgccag

SEQ ID NO: 924575 - RNA, 16 nt, Mycobacterium avium subsp. paratuberculosis
acguugucgcccgggu

SEQ ID NO: 924576 - RNA, 22 nt, Mycobacterium avium subsp. paratuberculosis
acguugucgcccggguagggca

SEQ ID NO: 924577 - RNA, 16 nt, Mycobacterium avium subsp. paratuberculosis
acguugucgcggccca

SEQ ID NO: 924578 - RNA, 13 nt, Mycobacterium avium subsp. paratuberculosis
acgugcacccacg

SEQ ID NO: 924579 - RNA, 17 nt, Mycobacterium avium subsp. paratuberculosis
acgugcacccacgccag

SEQ ID NO: 924580 - RNA, 17 nt, Mycobacterium avium subsp. paratuberculosis
acgugcacgcguucgga

SEQ ID NO: 924581 - RNA, 16 nt, Mycobacterium avium subsp. paratuberculosis
acgugcacggcgccgu

SEQ ID NO: 924582 - RNA, 17 nt, Mycobacterium avium subsp. paratuberculosis
acgugcacggcgccgug

SEQ ID NO: 924583 - RNA, 18 nt, Mycobacterium avium subsp. paratuberculosis
acgugcacucagggcgau

SEQ ID NO: 924584 - RNA, 18 nt, Mycobacterium avium subsp. paratuberculosis
acgugauagcggccgcgg

SEQ ID NO: 924585 - RNA, 18 nt, Mycobacterium avium subsp. paratuberculosis
acgugauaguggucgucg

SEQ ID NO: 924586 - RNA, 16 nt, Mycobacterium avium subsp. paratuberculosis
acgugaucgcgguggc

SEQ ID NO: 924587 - RNA, 18 nt, Mycobacterium avium subsp. paratuberculosis
acgugaucgcgguggccg

SEQ ID NO: 924588 - RNA, 21 nt, Mycobacterium avium subsp. paratuberculosis
acgugaucggcggccugcggc

SEQ ID NO: 924589 - RNA, 18 nt, Mycobacterium avium subsp. paratuberculosis
acgugaucuggucggcca

SEQ ID NO: 924590 - RNA, 22 nt, Mycobacterium avium subsp. paratuberculosis
acgugaugagcgaggacgucga

SEQ ID NO: 924591 - RNA, 16 nt, Mycobacterium avium subsp. paratuberculosis
acgugauggcgaaguu

SEQ ID NO: 924592 - RNA, 21 nt, Mycobacterium avium subsp. paratuberculosis
acgugauggcgaaguucggca

SEQ ID NO: 924593 - RNA, 23 nt, Mycobacterium avium subsp. paratuberculosis
acgucucgcgggaguggccggcg

SEQ ID NO: 924594 - RNA, 17 nt, Mycobacterium avium subsp. paratuberculosis
acgucguucaugaucgg

SEQ ID NO: 924595 - RNA, 15 nt, Mycobacterium avium subsp. paratuberculosis
acgucgucgacgucc

SEQ ID NO: 924596 - RNA, 19 nt, Mycobacterium avium subsp. paratuberculosis
acgucgucgaugccgaucg

SEQ ID NO: 924597 - RNA, 14 nt, Mycobacterium avium subsp. paratuberculosis
acgucgugcacgcc

SEQ ID NO: 924598 - RNA, 14 nt, Mycobacterium avium subsp. paratuberculosis
acgucguccggcgc

SEQ ID NO: 924599 - RNA, 15 nt, Mycobacterium avium subsp. paratuberculosis
acgucguccggcgcg

SEQ ID NO: 924600 - RNA, 19 nt, Mycobacterium avium subsp. paratuberculosis
acgucgucgugcgcgggcg

SEQ ID NO: 924601 - RNA, 16 nt, Mycobacterium avium subsp. paratuberculosis
acgugggcggccacca

SEQ ID NO: 924602 - RNA, 15 nt, Mycobacterium avium subsp. paratuberculosis
acguggcggccgucg

SEQ ID NO: 924603 - RNA, 12 nt, Mycobacterium avium subsp. paratuberculosis
acguggcggcgg

SEQ ID NO: 924604 - RNA, 23 nt, Mycobacterium avium subsp. paratuberculosis
acguggccgaucagcugcucggc

SEQ ID NO: 924605 - RNA, 23 nt, Mycobacterium avium subsp. paratuberculosis
acguggagcugaaguucaccacc

SEQ ID NO: 924606 - RNA, 20 nt, Mycobacterium avium subsp. paratuberculosis
acguggagucgaagcggugc

SEQ ID NO: 924607 - RNA, 15 nt, Mycobacterium avium subsp. paratuberculosis
acguggcaacgugcc

SEQ ID NO: 924608 - RNA, 17 nt, Mycobacterium avium subsp. paratuberculosis
acguggcaacgugccac

SEQ ID NO: 924609 - RNA, 15 nt, Mycobacterium avium subsp. paratuberculosis
acgugcucggcggcc

SEQ ID NO: 924610 - RNA, 19 nt, Mycobacterium avium subsp. paratuberculosis
acgugcucggcggccgcca

SEQ ID NO: 924611 - RNA, 14 nt, Mycobacterium avium subsp. paratuberculosis
acguggaccgagcg

SEQ ID NO: 924612 - RNA, 15 nt, Mycobacterium avium subsp. paratuberculosis
acgugcuuggccagc

SEQ ID NO: 924613 - RNA, 15 nt, Mycobacterium avium subsp. paratuberculosis
acgugcagcgccagc

SEQ ID NO: 924614 - RNA, 17 nt, Mycobacterium avium subsp. paratuberculosis
acgugcagcuuccgaac

SEQ ID NO: 924615 - RNA, 15 nt, Mycobacterium avium subsp. paratuberculosis
acgugcaggugcggc

SEQ ID NO: 924616 - RNA, 16 nt, Mycobacterium avium subsp. paratuberculosis
acguaggggcccgggu

SEQ ID NO: 924617 - RNA, 13 nt, Mycobacterium avium subsp. paratuberculosis
acguaggugagca

SEQ ID NO: 924618 - RNA, 17 nt, Mycobacterium avium subsp. paratuberculosis
acguaggcgaugucgac

SEQ ID NO: 924619 - RNA, 15 nt, Mycobacterium avium subsp. paratuberculosis
acguaggcggccagc

SEQ ID NO: 924620 - RNA, 19 nt, Mycobacterium avium subsp. paratuberculosis
acguaggcgaucagcgcgc

SEQ ID NO: 924621 - RNA, 21 nt, Mycobacterium avium subsp. paratuberculosis
acguaggcgaucagcgcgcac

SEQ ID NO: 924622 - RNA, 13 nt, Mycobacterium avium subsp. paratuberculosis
acguaguccggcc

SEQ ID NO: 924623 - RNA, 15 nt, Mycobacterium avium subsp. paratuberculosis
acguaguccggccag

SEQ ID NO: 924624 - RNA, 15 nt, Mycobacterium avium subsp. paratuberculosis
acguagucguccucg

SEQ ID NO: 924625 - RNA, 15 nt, Mycobacterium avium subsp. paratuberculosis
acguaggccagaucu

SEQ ID NO: 924626 - RNA, 15 nt, Mycobacterium avium subsp. paratuberculosis
acguagugcagccgc

SEQ ID NO: 924627 - RNA, 18 nt, Mycobacterium avium subsp. paratuberculosis
acguagugcagccgcccg

SEQ ID NO: 924628 - RNA, 16 nt, Mycobacterium avium subsp. paratuberculosis
acguagcccgccgaau

SEQ ID NO: 924629 - RNA, 19 nt, Mycobacterium avium subsp. paratuberculosis
acgguuucaccgccguccc

SEQ ID NO: 924630 - RNA, 14 nt, Mycobacterium avium subsp. paratuberculosis
acguagcgaucggu

SEQ ID NO: 924631 - RNA, 18 nt, Mycobacterium avium subsp. paratuberculosis
acguagcgcggccgcccg

SEQ ID NO: 924632 - RNA, 21 nt, Mycobacterium avium subsp. paratuberculosis
acguagcgcggccgcccgucg

SEQ ID NO: 924633 - RNA, 21 nt, Mycobacterium avium subsp. paratuberculosis
acguaggacagcaccacaucg

SEQ ID NO: 924634 - RNA, 13 nt, Mycobacterium avium subsp. paratuberculosis
acgguuggccggc

SEQ ID NO: 924635 - RNA, 15 nt, Mycobacterium avium subsp. paratuberculosis
acgguuggccggccc

SEQ ID NO: 924636 - RNA, 17 nt, Mycobacterium avium subsp. paratuberculosis
acgguuguucagcccgg

SEQ ID NO: 924637 - RNA, 21 nt, Mycobacterium avium subsp. paratuberculosis
acgguuguucagcccggucag

SEQ ID NO: 924638 - RNA, 15 nt, Mycobacterium avium subsp. paratuberculosis
acgucgcccagcgug

SEQ ID NO: 924639 - RNA, 13 nt, Mycobacterium avium subsp. paratuberculosis
acgucgccggcga

SEQ ID NO: 924640 - RNA, 21 nt, Mycobacterium avium subsp. paratuberculosis
acgucgccggcgaccgccacc

SEQ ID NO: 924641 - RNA, 11 nt, Mycobacterium avium subsp. paratuberculosis
acgucgccgau

SEQ ID NO: 924642 - RNA, 16 nt, Mycobacterium avium subsp. paratuberculosis
acgucgccgccgcaau

SEQ ID NO: 924643 - RNA, 21 nt, Mycobacterium avium subsp. paratuberculosis
acgucgcgauagggccggccg

SEQ ID NO: 924644 - RNA, 21 nt, Mycobacterium avium subsp. paratuberculosis
acgucgccggccugcccgccg

SEQ ID NO: 924645 - RNA, 22 nt, Mycobacterium avium subsp. paratuberculosis
acgucgccggccugcccgccgc

SEQ ID NO: 924646 - RNA, 22 nt, Mycobacterium avium subsp. paratuberculosis
acgucgccguucugacccuucu

SEQ ID NO: 924647 - RNA, 14 nt, Mycobacterium avium subsp. paratuberculosis
acgucgcgccgcuc

SEQ ID NO: 924648 - RNA, 20 nt, Mycobacterium avium subsp. paratuberculosis
acgucgcgccgcucggccag

SEQ ID NO: 924649 - RNA, 14 nt, Mycobacterium avium subsp. paratuberculosis
acgucgcgcggggu

SEQ ID NO: 924650 - RNA, 16 nt, Mycobacterium avium subsp. paratuberculosis
acgucgcgcggggucg

SEQ ID NO: 924651 - RNA, 21 nt, Mycobacterium avium subsp. paratuberculosis
acgucgcgcggggucgggccg

SEQ ID NO: 924652 - RNA, 19 nt, Mycobacterium avium subsp. paratuberculosis
acgucgcgcggggugacgc

SEQ ID NO: 924653 - RNA, 17 nt, Mycobacterium avium subsp. paratuberculosis
acgucgcgcugccggcc

SEQ ID NO: 924654 - RNA, 20 nt, Mycobacterium avium subsp. paratuberculosis
acgucgcgcugccggcccga

SEQ ID NO: 924655 - RNA, 13 nt, Mycobacterium avium subsp. paratuberculosis
acgucggccacgc

SEQ ID NO: 924656 - RNA, 15 nt, Mycobacterium avium subsp. paratuberculosis
acgucggccacgccg

SEQ ID NO: 924657 - RNA, 11 nt, Mycobacterium avium subsp. paratuberculosis
acgucggccag

SEQ ID NO: 924658 - RNA, 16 nt, Mycobacterium avium subsp. paratuberculosis
acgucggacgcggccg

SEQ ID NO: 924659 - RNA, 19 nt, Mycobacterium avium subsp. paratuberculosis
acgucggacgcggccgagc

SEQ ID NO: 924660 - RNA, 20 nt, Mycobacterium avium subsp. paratuberculosis
acgucgcgggugaccggcgc

SEQ ID NO: 924661 - RNA, 17 nt, Mycobacterium avium subsp. paratuberculosis
acgucgucgcccacccg

SEQ ID NO: 924662 - RNA, 13 nt, Mycobacterium avium subsp. paratuberculosis
acgucgucgccgg

SEQ ID NO: 924663 - RNA, 15 nt, Mycobacterium avium subsp. paratuberculosis
acgucgucgccgggg

SEQ ID NO: 924664 - RNA, 23 nt, Mycobacterium avium subsp. paratuberculosis
acgucgucgcggcgcugccggug

SEQ ID NO: 924665 - RNA, 16 nt, Mycobacterium avium subsp. paratuberculosis
acgucgucggacagca

SEQ ID NO: 924666 - RNA, 14 nt, Mycobacterium avium subsp. paratuberculosis
acgucgucggccug

SEQ ID NO: 924667 - RNA, 15 nt, Mycobacterium avium subsp. paratuberculosis
acgucgucggccugc

SEQ ID NO: 924668 - RNA, 16 nt, Mycobacterium avium subsp. paratuberculosis
acgucgucggccugca

SEQ ID NO: 924669 - RNA, 16 nt, Mycobacterium avium subsp. paratuberculosis
acgucguagagcagga

SEQ ID NO: 924670 - RNA, 13 nt, Mycobacterium avium subsp. paratuberculosis
acgucggugccgc

SEQ ID NO: 924671 - RNA, 17 nt, Mycobacterium avium subsp. paratuberculosis
acgucggugccgcguuc

SEQ ID NO: 924672 - RNA, 12 nt, Mycobacterium avium subsp. paratuberculosis
acggugguggcg

SEQ ID NO: 924673 - RNA, 23 nt, Mycobacterium avium subsp. paratuberculosis
acgguguugcgcacccgcggguc

SEQ ID NO: 924674 - RNA, 15 nt, Mycobacterium avium subsp. paratuberculosis
acgguguccgcggcg

SEQ ID NO: 924675 - RNA, 15 nt, Mycobacterium avium subsp. paratuberculosis
acgguguccgcgggc

SEQ ID NO: 924676 - RNA, 21 nt, Mycobacterium avium subsp. paratuberculosis
acgguguucuugaacggcgcg

SEQ ID NO: 924677 - RNA, 22 nt, Mycobacterium avium subsp. paratuberculosis
acgguguucuugaacggcgcgu

SEQ ID NO: 924678 - RNA, 21 nt, Mycobacterium avium subsp. paratuberculosis
acggugucgcccucgcgcagg

SEQ ID NO: 924679 - RNA, 20 nt, Mycobacterium avium subsp. paratuberculosis
acggugugcgggucgguggu

SEQ ID NO: 924680 - RNA, 21 nt, Mycobacterium avium subsp. paratuberculosis
acgguggggcuggccgcacgg

SEQ ID NO: 924681 - RNA, 15 nt, Mycobacterium avium subsp. paratuberculosis
acgguggugucgucg

SEQ ID NO: 924682 - RNA, 16 nt, Mycobacterium avium subsp. paratuberculosis
acgguguagcggcggc

SEQ ID NO: 924683 - RNA, 14 nt, Mycobacterium avium subsp. paratuberculosis
acggugggcgccgg

SEQ ID NO: 924684 - RNA, 16 nt, Mycobacterium avium subsp. paratuberculosis
acggugggcccgccgu

SEQ ID NO: 924685 - RNA, 19 nt, Mycobacterium avium subsp. paratuberculosis
acggugggcccgccgucga

SEQ ID NO: 924686 - RNA, 17 nt, Mycobacterium avium subsp. paratuberculosis
acggugggacggcgggu

SEQ ID NO: 924687 - RNA, 14 nt, Mycobacterium avium subsp. paratuberculosis
acggugaacgggcc

SEQ ID NO: 924688 - RNA, 18 nt, Mycobacterium avium subsp. paratuberculosis
acggugaacgggccgcac

SEQ ID NO: 924689 - RNA, 14 nt, Mycobacterium avium subsp. paratuberculosis
acggucggccccgc

SEQ ID NO: 924690 - RNA, 19 nt, Mycobacterium avium subsp. paratuberculosis
acggucggccccgcgcauc

SEQ ID NO: 924691 - RNA, 21 nt, Mycobacterium avium subsp. paratuberculosis
acggucggcguccagcgcggu

SEQ ID NO: 924692 - RNA, 12 nt, Mycobacterium avium subsp. paratuberculosis
acggucggggcg

SEQ ID NO: 924693 - RNA, 13 nt, Mycobacterium avium subsp. paratuberculosis
acggucggggcgg

SEQ ID NO: 924694 - RNA, 15 nt, Mycobacterium avium subsp. paratuberculosis
acggucggggcggcg

SEQ ID NO: 924695 - RNA, 23 nt, Mycobacterium avium subsp. paratuberculosis
acggucggggcggcgggcgaagu

SEQ ID NO: 924696 - RNA, 19 nt, Mycobacterium avium subsp. paratuberculosis
acggucugggaggcggcgg

SEQ ID NO: 924697 - RNA, 22 nt, Mycobacterium avium subsp. paratuberculosis
acggucuucccgccgccgucgg

SEQ ID NO: 924698 - RNA, 15 nt, Mycobacterium avium subsp. paratuberculosis
acggucuugcggccg

SEQ ID NO: 924699 - RNA, 15 nt, Mycobacterium avium subsp. paratuberculosis
acgguggcgccgaau

SEQ ID NO: 924700 - RNA, 13 nt, Mycobacterium avium subsp. paratuberculosis
acgguggcgccgc

SEQ ID NO: 924701 - RNA, 14 nt, Mycobacterium avium subsp. paratuberculosis
acgguggcgccgcg

SEQ ID NO: 924702 - RNA, 14 nt, Mycobacterium avium subsp. paratuberculosis
acgguggcgccggc

SEQ ID NO: 924703 - RNA, 20 nt, Mycobacterium avium subsp. paratuberculosis
acgguggcgccggcaucgac

SEQ ID NO: 924704 - RNA, 22 nt, Mycobacterium avium subsp. paratuberculosis
acgguggcgccggcaucgaccg

SEQ ID NO: 924705 - RNA, 17 nt, Mycobacterium avium subsp. paratuberculosis
acgguggcgggccgccg

SEQ ID NO: 924706 - RNA, 19 nt, Mycobacterium avium subsp. paratuberculosis
acgguggcguccagcgggu

SEQ ID NO: 924707 - RNA, 21 nt, Mycobacterium avium subsp. paratuberculosis
acgguccaucagcaccgagaa

SEQ ID NO: 924708 - RNA, 14 nt, Mycobacterium avium subsp. paratuberculosis
acgguccccgcgcc

SEQ ID NO: 924709 - RNA, 16 nt, Mycobacterium avium subsp. paratuberculosis
acgguccccgcgcccg

SEQ ID NO: 924710 - RNA, 18 nt, Mycobacterium avium subsp. paratuberculosis
acgguccccgcgcccgcc

SEQ ID NO: 924711 - RNA, 22 nt, Mycobacterium avium subsp. paratuberculosis
acgguccccgcgcccgccgcgu

SEQ ID NO: 924712 - RNA, 20 nt, Mycobacterium avium subsp. paratuberculosis
acggucccguccaucgccgc

SEQ ID NO: 924713 - RNA, 19 nt, Mycobacterium avium subsp. paratuberculosis
acggucgcggugucggcgu

SEQ ID NO: 924714 - RNA, 22 nt, Mycobacterium avium subsp. paratuberculosis
acggucgcggugucggcgucga

SEQ ID NO: 924715 - RNA, 15 nt, Mycobacterium avium subsp. paratuberculosis
acggucggagcccag

SEQ ID NO: 924716 - RNA, 22 nt, Mycobacterium avium subsp. paratuberculosis
acggucgccggcuuaccgaccu

SEQ ID NO: 924717 - RNA, 20 nt, Mycobacterium avium subsp. paratuberculosis
acggucgaccucgagcguca

SEQ ID NO: 924718 - RNA, 15 nt, Mycobacterium avium subsp. paratuberculosis
acggucgcaccgcgg

SEQ ID NO: 924719 - RNA, 11 nt, Mycobacterium avium subsp. paratuberculosis
acggucgccga

SEQ ID NO: 924720 - RNA, 14 nt, Mycobacterium avium subsp. paratuberculosis
acggucgccgacgu

SEQ ID NO: 924721 - RNA, 18 nt, Mycobacterium avium subsp. paratuberculosis
acggucgccgcgccgccg

SEQ ID NO: 924722 - RNA, 13 nt, Mycobacterium avium subsp. paratuberculosis
acgguaugcccgc

SEQ ID NO: 924723 - RNA, 14 nt, Mycobacterium avium subsp. paratuberculosis
acgguaggcgcggu

SEQ ID NO: 924724 - RNA, 15 nt, Mycobacterium avium subsp. paratuberculosis
acgguaggcgcgguc

SEQ ID NO: 924725 - RNA, 17 nt, Mycobacterium avium subsp. paratuberculosis
acgguaggcgcggucgg

SEQ ID NO: 924726 - RNA, 22 nt, Mycobacterium avium subsp. paratuberculosis
acgguaggcgcggucgguggcg

SEQ ID NO: 924727 - RNA, 12 nt, Mycobacterium avium subsp. paratuberculosis
acgggugaccgg

SEQ ID NO: 924728 - RNA, 16 nt, Mycobacterium avium subsp. paratuberculosis
acgguacgugcgccgg

SEQ ID NO: 924729 - RNA, 19 nt, Mycobacterium avium subsp. paratuberculosis
acgguacgugcgccggcgg

SEQ ID NO: 924730 - RNA, 20 nt, Mycobacterium avium subsp. paratuberculosis
acgguacuguuacgcccgau

SEQ ID NO: 924731 - RNA, 22 nt, Mycobacterium avium subsp. paratuberculosis
acgguacuguuacgcccgaucc

SEQ ID NO: 924732 - RNA, 13 nt, Mycobacterium avium subsp. paratuberculosis
acggucaggccgg

SEQ ID NO: 924733 - RNA, 14 nt, Mycobacterium avium subsp. paratuberculosis
acggucaggccggg

SEQ ID NO: 924734 - RNA, 14 nt, Mycobacterium avium subsp. paratuberculosis
acggucagcgcgcc

SEQ ID NO: 924735 - RNA, 14 nt, Mycobacterium avium subsp. paratuberculosis
acggucagcgcguc

SEQ ID NO: 924736 - RNA, 16 nt, Mycobacterium avium subsp. paratuberculosis
acggucagcgcgucgg

SEQ ID NO: 924737 - RNA, 15 nt, Mycobacterium avium subsp. paratuberculosis
acggucagcggccag

SEQ ID NO: 924738 - RNA, 16 nt, Mycobacterium avium subsp. paratuberculosis
acggucagcucgcgcc

SEQ ID NO: 924739 - RNA, 18 nt, Mycobacterium avium subsp. paratuberculosis
acggucagcucgcgcccg

SEQ ID NO: 924740 - RNA, 20 nt, Mycobacterium avium subsp. paratuberculosis
acggucagcucgcgcccggc

SEQ ID NO: 924741 - RNA, 23 nt, Mycobacterium avium subsp. paratuberculosis
acggucagcacgcugaucaccac

SEQ ID NO: 924742 - RNA, 13 nt, Mycobacterium avium subsp. paratuberculosis
acggucacgcugg

SEQ ID NO: 924743 - RNA, 21 nt, Mycobacterium avium subsp. paratuberculosis
acggucacgcuggcgugacgc

SEQ ID NO: 924744 - RNA, 13 nt, Mycobacterium avium subsp. paratuberculosis
acgggucgccgau

SEQ ID NO: 924745 - RNA, 19 nt, Mycobacterium avium subsp. paratuberculosis
acgggucucagcgcccgcc

SEQ ID NO: 924746 - RNA, 23 nt, Mycobacterium avium subsp. paratuberculosis
acgggucucagcgcccgcccggc

SEQ ID NO: 924747 - RNA, 15 nt, Mycobacterium avium subsp. paratuberculosis
acgggucggcggcga

SEQ ID NO: 924748 - RNA, 20 nt, Mycobacterium avium subsp. paratuberculosis
acgggucggucggcccgcug

SEQ ID NO: 924749 - RNA, 21 nt, Mycobacterium avium subsp. paratuberculosis
acgggucggucggcccgcugc

SEQ ID NO: 924750 - RNA, 23 nt, Mycobacterium avium subsp. paratuberculosis
acgggucggucggcccgcugcgg

SEQ ID NO: 924751 - RNA, 17 nt, Mycobacterium avium subsp. paratuberculosis
acggguccuugccggcg

SEQ ID NO: 924752 - RNA, 20 nt, Mycobacterium avium subsp. paratuberculosis
acggguccuugccggcggcg

SEQ ID NO: 924753 - RNA, 17 nt, Mycobacterium avium subsp. paratuberculosis
acgggucgaucucggcg

SEQ ID NO: 924754 - RNA, 18 nt, Mycobacterium avium subsp. paratuberculosis
acgggucgaucucggcgc

SEQ ID NO: 924755 - RNA, 12 nt, Mycobacterium avium subsp. paratuberculosis
acgggcucggcg

SEQ ID NO: 924756 - RNA, 22 nt, Mycobacterium avium subsp. paratuberculosis
acgggcucggcguacaggccgu

SEQ ID NO: 924757 - RNA, 20 nt, Mycobacterium avium subsp. paratuberculosis
acgggcugaacucgacgucg

SEQ ID NO: 924758 - RNA, 18 nt, Mycobacterium avium subsp. paratuberculosis
acgggcugcugcacgucg

SEQ ID NO: 924759 - RNA, 20 nt, Mycobacterium avium subsp. paratuberculosis
acgggcugcugcacgucgcc

SEQ ID NO: 924760 - RNA, 23 nt, Mycobacterium avium subsp. paratuberculosis
acgggcugcugcacgucgccggc

SEQ ID NO: 924761 - RNA, 17 nt, Mycobacterium avium subsp. paratuberculosis
acggguugggcgccagc

SEQ ID NO: 924762 - RNA, 19 nt, Mycobacterium avium subsp. paratuberculosis
acggguugggcgccagcag

SEQ ID NO: 924763 - RNA, 22 nt, Mycobacterium avium subsp. paratuberculosis
acggguugggcggggcgucgau

SEQ ID NO: 924764 - RNA, 18 nt, Mycobacterium avium subsp. paratuberculosis
acggguuggucggcgcgg

SEQ ID NO: 924765 - RNA, 23 nt, Mycobacterium avium subsp. paratuberculosis
acggguuggucggcgcggcgacg

SEQ ID NO: 924766 - RNA, 14 nt, Mycobacterium avium subsp. paratuberculosis
acgggugcggcgcu

SEQ ID NO: 924767 - RNA, 20 nt, Mycobacterium avium subsp. paratuberculosis
acgggugcucagguugcgca

SEQ ID NO: 924768 - RNA, 15 nt, Mycobacterium avium subsp. paratuberculosis
acggguucgcgcagc

SEQ ID NO: 924769 - RNA, 21 nt, Mycobacterium avium subsp. paratuberculosis
acggguucggucucggcggcg

SEQ ID NO: 924770 - RNA, 16 nt, Mycobacterium avium subsp. paratuberculosis
acggguugagccagac

SEQ ID NO: 924771 - RNA, 14 nt, Mycobacterium avium subsp. paratuberculosis
acggguugccgucg

SEQ ID NO: 924772 - RNA, 17 nt, Mycobacterium avium subsp. paratuberculosis
acggguugccgucgacg

SEQ ID NO: 924773 - RNA, 16 nt, Mycobacterium avium subsp. paratuberculosis
acggguugcgguccac

SEQ ID NO: 924774 - RNA, 18 nt, Mycobacterium avium subsp. paratuberculosis
acggguugcgguccacgu

SEQ ID NO: 924775 - RNA, 12 nt, Mycobacterium avium subsp. paratuberculosis
acgggcaccagu

SEQ ID NO: 924776 - RNA, 15 nt, Mycobacterium avium subsp. paratuberculosis
acgggcacccgcgcg

SEQ ID NO: 924777 - RNA, 17 nt, Mycobacterium avium subsp. paratuberculosis
acgggcacccgcgcguc

SEQ ID NO: 924778 - RNA, 13 nt, Mycobacterium avium subsp. paratuberculosis
acgggaucggcgc

SEQ ID NO: 924779 - RNA, 18 nt, Mycobacterium avium subsp. paratuberculosis
acgggaucggcgcgucgg

SEQ ID NO: 924780 - RNA, 22 nt, Mycobacterium avium subsp. paratuberculosis
acgggaugaacucgugcggcgc

SEQ ID NO: 924781 - RNA, 23 nt, Mycobacterium avium subsp. paratuberculosis
acgggaugaacucgugcggcgcc

SEQ ID NO: 924782 - RNA, 16 nt, Mycobacterium avium subsp. paratuberculosis
acgggaugcggcacgc

SEQ ID NO: 924783 - RNA, 15 nt, Mycobacterium avium subsp. paratuberculosis
acgggauggcucagc

SEQ ID NO: 924784 - RNA, 16 nt, Mycobacterium avium subsp. paratuberculosis
acgggauggcucagcg

SEQ ID NO: 924785 - RNA, 14 nt, Mycobacterium avium subsp. paratuberculosis
acgggcgaucuugg

SEQ ID NO: 924786 - RNA, 24 nt, Mycobacterium avium subsp. paratuberculosis
acgggcugaagaucaacagccgcc

SEQ ID NO: 924787 - RNA, 16 nt, Mycobacterium avium subsp. paratuberculosis
acgggcugaccgccag

SEQ ID NO: 924788 - RNA, 14 nt, Mycobacterium avium subsp. paratuberculosis
acgggcaccgacga

SEQ ID NO: 924789 - RNA, 18 nt, Mycobacterium avium subsp. paratuberculosis
acgggcucagcaccacau

SEQ ID NO: 924790 - RNA, 20 nt, Mycobacterium avium subsp. paratuberculosis
acgggcggucggacgcgggg

SEQ ID NO: 924791 - RNA, 14 nt, Mycobacterium avium subsp. paratuberculosis
acgggcgucggcgg

SEQ ID NO: 924792 - RNA, 14 nt, Mycobacterium avium subsp. paratuberculosis
acgggcgugccggc

SEQ ID NO: 924793 - RNA, 19 nt, Mycobacterium avium subsp. paratuberculosis
acgggcguguagccugcgg

SEQ ID NO: 924794 - RNA, 17 nt, Mycobacterium avium subsp. paratuberculosis
acgggcggcggaucagc

SEQ ID NO: 924795 - RNA, 23 nt, Mycobacterium avium subsp. paratuberculosis
acgggcggcggaucagcaccgac

SEQ ID NO: 924796 - RNA, 18 nt, Mycobacterium avium subsp. paratuberculosis
acgggcgggcaugguucc

SEQ ID NO: 924797 - RNA, 16 nt, Mycobacterium avium subsp. paratuberculosis
acgggcgcaccgcgcg

SEQ ID NO: 924798 - RNA, 15 nt, Mycobacterium avium subsp. paratuberculosis
acgggcgcagcgccg

SEQ ID NO: 924799 - RNA, 17 nt, Mycobacterium avium subsp. paratuberculosis
acgggcggcagggccag

SEQ ID NO: 924800 - RNA, 18 nt, Mycobacterium avium subsp. paratuberculosis
acgggcggcagggccagc

SEQ ID NO: 924801 - RNA, 21 nt, Mycobacterium avium subsp. paratuberculosis
acgggcggcagggccagcacc

SEQ ID NO: 924802 - RNA, 17 nt, Mycobacterium avium subsp. paratuberculosis
acgggaccacccgcagc

SEQ ID NO: 924803 - RNA, 23 nt, Mycobacterium avium subsp. paratuberculosis
acgggaccacccgcagcgcggcg

SEQ ID NO: 924804 - RNA, 14 nt, Mycobacterium avium subsp. paratuberculosis
acgggagucgggcc

SEQ ID NO: 924805 - RNA, 17 nt, Mycobacterium avium subsp. paratuberculosis
acgggagucgggcccgc

SEQ ID NO: 924806 - RNA, 14 nt, Mycobacterium avium subsp. paratuberculosis
acgggaccgcacgc

SEQ ID NO: 924807 - RNA, 15 nt, Mycobacterium avium subsp. paratuberculosis
acgggaccgcacgcc

SEQ ID NO: 924808 - RNA, 19 nt, Mycobacterium avium subsp. paratuberculosis
acgggaccgcacgccgggu

SEQ ID NO: 924809 - RNA, 23 nt, Mycobacterium avium subsp. paratuberculosis
acggcggggccuccaccagcggc

SEQ ID NO: 924810 - RNA, 23 nt, Mycobacterium avium subsp. paratuberculosis
acggcggggcggaugcgcuggug

SEQ ID NO: 924811 - RNA, 17 nt, Mycobacterium avium subsp. paratuberculosis
acggcggggugcgcggc

SEQ ID NO: 924812 - RNA, 18 nt, Mycobacterium avium subsp. paratuberculosis
acggcgggugcgacggca

SEQ ID NO: 924813 - RNA, 14 nt, Mycobacterium avium subsp. paratuberculosis
acggcggucgugcg

SEQ ID NO: 924814 - RNA, 20 nt, Mycobacterium avium subsp. paratuberculosis
acggcggucgugcggcugcc

SEQ ID NO: 924815 - RNA, 21 nt, Mycobacterium avium subsp. paratuberculosis
acggcggucgugcggcugccc

SEQ ID NO: 924816 - RNA, 17 nt, Mycobacterium avium subsp. paratuberculosis
acggcggugggcucggc

SEQ ID NO: 924817 - RNA, 18 nt, Mycobacterium avium subsp. paratuberculosis
acggcggugggcucggcc

SEQ ID NO: 924818 - RNA, 21 nt, Mycobacterium avium subsp. paratuberculosis
acggcggugggcucggccauc

SEQ ID NO: 924819 - RNA, 17 nt, Mycobacterium avium subsp. paratuberculosis
acggcggugucggcggc

SEQ ID NO: 924820 - RNA, 20 nt, Mycobacterium avium subsp. paratuberculosis
acggccaugcagaccagccc

SEQ ID NO: 924821 - RNA, 16 nt, Mycobacterium avium subsp. paratuberculosis
acggccccagccgccg

SEQ ID NO: 924822 - RNA, 17 nt, Mycobacterium avium subsp. paratuberculosis
acggccccagccgccgc

SEQ ID NO: 924823 - RNA, 20 nt, Mycobacterium avium subsp. paratuberculosis
acggcccaucaccagcggcu

SEQ ID NO: 924824 - RNA, 17 nt, Mycobacterium avium subsp. paratuberculosis
acggcggaccggcggcc

SEQ ID NO: 924825 - RNA, 22 nt, Mycobacterium avium subsp. paratuberculosis
acggcggaccggcggccgccau

SEQ ID NO: 924826 - RNA, 13 nt, Mycobacterium avium subsp. paratuberculosis
acggcggcagcga

SEQ ID NO: 924827 - RNA, 16 nt, Mycobacterium avium subsp. paratuberculosis
acggcggcagcgaggc

SEQ ID NO: 924828 - RNA, 14 nt, Mycobacterium avium subsp. paratuberculosis
acggcggcagcgcg

SEQ ID NO: 924829 - RNA, 16 nt, Mycobacterium avium subsp. paratuberculosis
acggcggcagcgcggc

SEQ ID NO: 924830 - RNA, 18 nt, Mycobacterium avium subsp. paratuberculosis
acggcggcagcgcggcgu

SEQ ID NO: 924831 - RNA, 18 nt, Mycobacterium avium subsp. paratuberculosis
acggccagcgcggcgguc

SEQ ID NO: 924832 - RNA, 17 nt, Mycobacterium avium subsp. paratuberculosis
acggccaguccaggccg

SEQ ID NO: 924833 - RNA, 20 nt, Mycobacterium avium subsp. paratuberculosis
acggccaguccaggccgccg

SEQ ID NO: 924834 - RNA, 19 nt, Mycobacterium avium subsp. paratuberculosis
acggccaggaagccggcga

SEQ ID NO: 924835 - RNA, 20 nt, Mycobacterium avium subsp. paratuberculosis
acggccaggaagccggcgac

SEQ ID NO: 924836 - RNA, 21 nt, Mycobacterium avium subsp. paratuberculosis
acggccaggaagccggcgacg

SEQ ID NO: 924837 - RNA, 23 nt, Mycobacterium avium subsp. paratuberculosis
acggccaggaagccggcgacgac

SEQ ID NO: 924838 - RNA, 15 nt, Mycobacterium avium subsp. paratuberculosis
acggccagcgccguc

SEQ ID NO: 924839 - RNA, 17 nt, Mycobacterium avium subsp. paratuberculosis
acggccagcgccgucau

SEQ ID NO: 924840 - RNA, 12 nt, Mycobacterium avium subsp. paratuberculosis
acggccagcgcg

SEQ ID NO: 924841 - RNA, 14 nt, Mycobacterium avium subsp. paratuberculosis
acggccagcgcggc

SEQ ID NO: 924842 - RNA, 13 nt, Mycobacterium avium subsp. paratuberculosis
acggccagccagc

SEQ ID NO: 924843 - RNA, 17 nt, Mycobacterium avium subsp. paratuberculosis
acggccagccagccgcc

SEQ ID NO: 924844 - RNA, 22 nt, Mycobacterium avium subsp. paratuberculosis
acggccagccagccgcccagca

SEQ ID NO: 924845 - RNA, 15 nt, Mycobacterium avium subsp. paratuberculosis
acggccagcccgucg

SEQ ID NO: 924846 - RNA, 24 nt, Mycobacterium avium subsp. paratuberculosis
acggccagcaggaugaugaccgac

SEQ ID NO: 924847 - RNA, 17 nt, Mycobacterium avium subsp. paratuberculosis
acggccagcagggcgcc

SEQ ID NO: 924848 - RNA, 20 nt, Mycobacterium avium subsp. paratuberculosis
acggccagcagggcgccgac

SEQ ID NO: 924849 - RNA, 17 nt, Mycobacterium avium subsp. paratuberculosis
acggccagcagcaccgc

SEQ ID NO: 924850 - RNA, 21 nt, Mycobacterium avium subsp. paratuberculosis
acggccagcagcaccgcguug

SEQ ID NO: 924851 - RNA, 13 nt, Mycobacterium avium subsp. paratuberculosis
acggcgggccggc

SEQ ID NO: 924852 - RNA, 14 nt, Mycobacterium avium subsp. paratuberculosis
acggcgggccggcg

SEQ ID NO: 924853 - RNA, 16 nt, Mycobacterium avium subsp. paratuberculosis
acggcgggccggcgcc

SEQ ID NO: 924854 - RNA, 17 nt, Mycobacterium avium subsp. paratuberculosis
acggcgggccggcgccg

SEQ ID NO: 924855 - RNA, 18 nt, Mycobacterium avium subsp. paratuberculosis
acggcgggccggcgccgg

SEQ ID NO: 924856 - RNA, 19 nt, Mycobacterium avium subsp. paratuberculosis
acggcgggccggcgccggu

SEQ ID NO: 924857 - RNA, 20 nt, Mycobacterium avium subsp. paratuberculosis
acggcgggccggcgccggug

SEQ ID NO: 924858 - RNA, 21 nt, Mycobacterium avium subsp. paratuberculosis
acggcggcucgggggugucgu

SEQ ID NO: 924859 - RNA, 13 nt, Mycobacterium avium subsp. paratuberculosis
acggcgggcccgu

SEQ ID NO: 924860 - RNA, 19 nt, Mycobacterium avium subsp. paratuberculosis
acggcgggcccgucgccgg

SEQ ID NO: 924861 - RNA, 21 nt, Mycobacterium avium subsp. paratuberculosis
acggcgggcccgucgccggcg

SEQ ID NO: 924862 - RNA, 23 nt, Mycobacterium avium subsp. paratuberculosis
acggcgggcccgucgccggcgcg

SEQ ID NO: 924863 - RNA, 13 nt, Mycobacterium avium subsp. paratuberculosis
acggcggcggugc

SEQ ID NO: 924864 - RNA, 14 nt, Mycobacterium avium subsp. paratuberculosis
acggcggcggugcc

SEQ ID NO: 924865 - RNA, 17 nt, Mycobacterium avium subsp. paratuberculosis
acggcggcgcgggcggc

SEQ ID NO: 924866 - RNA, 21 nt, Mycobacterium avium subsp. paratuberculosis
acggcggcgcgggcggcgucg

SEQ ID NO: 924867 - RNA, 23 nt, Mycobacterium avium subsp. paratuberculosis
acggcggcgcgggcggcgucggc

SEQ ID NO: 924868 - RNA, 22 nt, Mycobacterium avium subsp. paratuberculosis
acggcggcgcugaugccguccu

SEQ ID NO: 924869 - RNA, 14 nt, Mycobacterium avium subsp. paratuberculosis
acggcggcgcgcac

SEQ ID NO: 924870 - RNA, 22 nt, Mycobacterium avium subsp. paratuberculosis
acggcggcgugcaccgcccgcg

SEQ ID NO: 924871 - RNA, 23 nt, Mycobacterium avium subsp. paratuberculosis
acggcggcgugcaccgcccgcgc

SEQ ID NO: 924872 - RNA, 20 nt, Mycobacterium avium subsp. paratuberculosis
acggcggcgaguucggcggc

SEQ ID NO: 924873 - RNA, 22 nt, Mycobacterium avium subsp. paratuberculosis
acggcggcgaguucggcggccc

SEQ ID NO: 924874 - RNA, 18 nt, Mycobacterium avium subsp. paratuberculosis
acggcggccgcggacccg

SEQ ID NO: 924875 - RNA, 19 nt, Mycobacterium avium subsp. paratuberculosis
acggcggcgaacgccgccg

SEQ ID NO: 924876 - RNA, 20 nt, Mycobacterium avium subsp. paratuberculosis
acggcggcgaacgccgccgu

SEQ ID NO: 924877 - RNA, 22 nt, Mycobacterium avium subsp. paratuberculosis
acggcggcgaacgccgccgugu

SEQ ID NO: 924878 - RNA, 16 nt, Mycobacterium avium subsp. paratuberculosis
acggcggcgaagacgu

SEQ ID NO: 924879 - RNA, 20 nt, Mycobacterium avium subsp. paratuberculosis
acggcggcgaagacgucggc

SEQ ID NO: 924880 - RNA, 22 nt, Mycobacterium avium subsp. paratuberculosis
acggcggcgaagacgucggcgc

SEQ ID NO: 924881 - RNA, 15 nt, Mycobacterium avium subsp. paratuberculosis
acggcggauccaggu

SEQ ID NO: 924882 - RNA, 18 nt, Mycobacterium avium subsp. paratuberculosis
acggcggccgaauccggc

SEQ ID NO: 924883 - RNA, 22 nt, Mycobacterium avium subsp. paratuberculosis
acggcggccgaauccggccgga

SEQ ID NO: 924884 - RNA, 15 nt, Mycobacterium avium subsp. paratuberculosis
acccgcccggagaac

SEQ ID NO: 924885 - RNA, 14 nt, Mycobacterium avium subsp. paratuberculosis
acccgccagcccgc

SEQ ID NO: 924886 - RNA, 20 nt, Mycobacterium avium subsp. paratuberculosis
acccgccagggcgacgccgc

SEQ ID NO: 924887 - RNA, 12 nt, Mycobacterium avium subsp. paratuberculosis
acccgccccgcc

SEQ ID NO: 924888 - RNA, 16 nt, Mycobacterium avium subsp. paratuberculosis
acccgccccgccgcgg

SEQ ID NO: 924889 - RNA, 17 nt, Mycobacterium avium subsp. paratuberculosis
acccgccccgccgcggc

SEQ ID NO: 924890 - RNA, 14 nt, Mycobacterium avium subsp. paratuberculosis
acccgcccgccggg

SEQ ID NO: 924891 - RNA, 20 nt, Mycobacterium avium subsp. paratuberculosis
acccgcccgccgggcacccg

SEQ ID NO: 924892 - RNA, 23 nt, Mycobacterium avium subsp. paratuberculosis
acccgcccgccgggcacccgggu

SEQ ID NO: 924893 - RNA, 15 nt, Mycobacterium avium subsp. paratuberculosis
acccgcauccgccgg

SEQ ID NO: 924894 - RNA, 17 nt, Mycobacterium avium subsp. paratuberculosis
acccgcauccgccgggc

SEQ ID NO: 924895 - RNA, 20 nt, Mycobacterium avium subsp. paratuberculosis
acccgcauccgccgggcggc

SEQ ID NO: 924896 - RNA, 21 nt, Mycobacterium avium subsp. paratuberculosis
acccgcauccgccgggcggcg

SEQ ID NO: 924897 - RNA, 14 nt, Mycobacterium avium subsp. paratuberculosis
acccgccauggcgg

SEQ ID NO: 924898 - RNA, 13 nt, Mycobacterium avium subsp. paratuberculosis
acccgaucgagga

SEQ ID NO: 924899 - RNA, 23 nt, Mycobacterium avium subsp. paratuberculosis
acccgaucgaucaucgccucggu

SEQ ID NO: 924900 - RNA, 13 nt, Mycobacterium avium subsp. paratuberculosis
acccgaucgccga

SEQ ID NO: 924901 - RNA, 17 nt, Mycobacterium avium subsp. paratuberculosis
acccgaucgccgagucg

SEQ ID NO: 924902 - RNA, 14 nt, Mycobacterium avium subsp. paratuberculosis
acccgaucggcccg

SEQ ID NO: 924903 - RNA, 16 nt, Mycobacterium avium subsp. paratuberculosis
acccgaucggcccggc

SEQ ID NO: 924904 - RNA, 19 nt, Mycobacterium avium subsp. paratuberculosis
acccgaucggcccggccaa

SEQ ID NO: 924905 - RNA, 16 nt, Mycobacterium avium subsp. paratuberculosis
acccgaugaccggccc

SEQ ID NO: 924906 - RNA, 19 nt, Mycobacterium avium subsp. paratuberculosis
acccgaugaccggcccggc

SEQ ID NO: 924907 - RNA, 21 nt, Mycobacterium avium subsp. paratuberculosis
acccgaugaccggcccggcgg

SEQ ID NO: 924908 - RNA, 22 nt, Mycobacterium avium subsp. paratuberculosis
acccgaugaccggcccggcggc

SEQ ID NO: 924909 - RNA, 17 nt, Mycobacterium avium subsp. paratuberculosis
acccgcaacaccacguc

SEQ ID NO: 924910 - RNA, 15 nt, Mycobacterium avium subsp. paratuberculosis
acccgcaacgcgcgc

SEQ ID NO: 924911 - RNA, 17 nt, Mycobacterium avium subsp. paratuberculosis
acccgcaacgcgcgcga

SEQ ID NO: 924912 - RNA, 18 nt, Mycobacterium avium subsp. paratuberculosis
acccgcaacgcgcgcgac

SEQ ID NO: 924913 - RNA, 23 nt, Mycobacterium avium subsp. paratuberculosis
acccgcaacgcgcgcgacggcgc

SEQ ID NO: 924914 - RNA, 18 nt, Mycobacterium avium subsp. paratuberculosis
acccgcaacgcugaccgc

SEQ ID NO: 924915 - RNA, 22 nt, Mycobacterium avium subsp. paratuberculosis
acccgcaacucgggcucgucgu

SEQ ID NO: 924916 - RNA, 16 nt, Mycobacterium avium subsp. paratuberculosis
acccgcaaggccgcca

SEQ ID NO: 924917 - RNA, 14 nt, Mycobacterium avium subsp. paratuberculosis
acccgcaccaccgc

SEQ ID NO: 924918 - RNA, 18 nt, Mycobacterium avium subsp. paratuberculosis
acccgaggccguucaggu

SEQ ID NO: 924919 - RNA, 15 nt, Mycobacterium avium subsp. paratuberculosis
accccggcggcaccg

SEQ ID NO: 924920 - RNA, 20 nt, Mycobacterium avium subsp. paratuberculosis
accccggcggccgcgucggc

SEQ ID NO: 924921 - RNA, 17 nt, Mycobacterium avium subsp. paratuberculosis
accccggcguccacgcc

SEQ ID NO: 924922 - RNA, 11 nt, Mycobacterium avium subsp. paratuberculosis
accccggccag

SEQ ID NO: 924923 - RNA, 20 nt, Mycobacterium avium subsp. paratuberculosis
accccggccagggugccgac

SEQ ID NO: 924924 - RNA, 15 nt, Mycobacterium avium subsp. paratuberculosis
accccggccaguccg

SEQ ID NO: 924925 - RNA, 21 nt, Mycobacterium avium subsp. paratuberculosis
accccggccaguccgcgugac

SEQ ID NO: 924926 - RNA, 11 nt, Mycobacterium avium subsp. paratuberculosis
accccggcccc

SEQ ID NO: 924927 - RNA, 16 nt, Mycobacterium avium subsp. paratuberculosis
accccggccccggccg

SEQ ID NO: 924928 - RNA, 18 nt, Mycobacterium avium subsp. paratuberculosis
accccggccccggccggc

SEQ ID NO: 924929 - RNA, 19 nt, Mycobacterium avium subsp. paratuberculosis
accccggccccggccggcg

SEQ ID NO: 924930 - RNA, 18 nt, Mycobacterium avium subsp. paratuberculosis
accccggccaccagggcg

SEQ ID NO: 924931 - RNA, 13 nt, Mycobacterium avium subsp. paratuberculosis
accccggcgacgg

SEQ ID NO: 924932 - RNA, 14 nt, Mycobacterium avium subsp. paratuberculosis
accccggcgacggc

SEQ ID NO: 924933 - RNA, 13 nt, Mycobacterium avium subsp. paratuberculosis
accccggcgauga

SEQ ID NO: 924934 - RNA, 15 nt, Mycobacterium avium subsp. paratuberculosis
accccggcgaugacc

SEQ ID NO: 924935 - RNA, 16 nt, Mycobacterium avium subsp. paratuberculosis
accccggcgaugaccg

SEQ ID NO: 924936 - RNA, 15 nt, Mycobacterium avium subsp. paratuberculosis
acccgcgcacgcucg

SEQ ID NO: 924937 - RNA, 13 nt, Mycobacterium avium subsp. paratuberculosis
acccgcgccggca

SEQ ID NO: 924938 - RNA, 23 nt, Mycobacterium avium subsp. paratuberculosis
acccgcgccuccauucgggccag

SEQ ID NO: 924939 - RNA, 20 nt, Mycobacterium avium subsp. paratuberculosis
acccgcgcgucgcgcagcga

SEQ ID NO: 924940 - RNA, 23 nt, Mycobacterium avium subsp. paratuberculosis
acccgcgcccccugggacagcga

SEQ ID NO: 924941 - RNA, 14 nt, Mycobacterium avium subsp. paratuberculosis
acccgcgcccgcau

SEQ ID NO: 924942 - RNA, 15 nt, Mycobacterium avium subsp. paratuberculosis
acccgccgugaccgg

SEQ ID NO: 924943 - RNA, 17 nt, Mycobacterium avium subsp. paratuberculosis
acccgcucaggucggcc

SEQ ID NO: 924944 - RNA, 22 nt, Mycobacterium avium subsp. paratuberculosis
acccgcucaggucggccgcggc

SEQ ID NO: 924945 - RNA, 15 nt, Mycobacterium avium subsp. paratuberculosis
acccgcucgggcgcc

SEQ ID NO: 924946 - RNA, 17 nt, Mycobacterium avium subsp. paratuberculosis
acccgcucgggcgccuc

SEQ ID NO: 924947 - RNA, 15 nt, Mycobacterium avium subsp. paratuberculosis
acccgcucgacgcgc

SEQ ID NO: 924948 - RNA, 17 nt, Mycobacterium avium subsp. paratuberculosis
acccgcucgacgcgcac

SEQ ID NO: 924949 - RNA, 14 nt, Mycobacterium avium subsp. paratuberculosis
acccgcucgccgaa

SEQ ID NO: 924950 - RNA, 14 nt, Mycobacterium avium subsp. paratuberculosis
acccgcucgccgau

SEQ ID NO: 924951 - RNA, 23 nt, Mycobacterium avium subsp. paratuberculosis
acccgcucgccgaugacguugcg

SEQ ID NO: 924952 - RNA, 18 nt, Mycobacterium avium subsp. paratuberculosis
acccgcucgcgggcccgc

SEQ ID NO: 924953 - RNA, 20 nt, Mycobacterium avium subsp. paratuberculosis
acccgcucgcgggcccgcgc

SEQ ID NO: 924954 - RNA, 18 nt, Mycobacterium avium subsp. paratuberculosis
acccgcguggcaggucgg

SEQ ID NO: 924955 - RNA, 16 nt, Mycobacterium avium subsp. paratuberculosis
acccgcuccagcggcc

SEQ ID NO: 924956 - RNA, 18 nt, Mycobacterium avium subsp. paratuberculosis
acccgcuccagcggccac

SEQ ID NO: 924957 - RNA, 18 nt, Mycobacterium avium subsp. paratuberculosis
acccgcuccgacgcggug

SEQ ID NO: 924958 - RNA, 20 nt, Mycobacterium avium subsp. paratuberculosis
acccgcuccgacgcgguggc

SEQ ID NO: 924959 - RNA, 21 nt, Mycobacterium avium subsp. paratuberculosis
acccgcuccgacgcgguggcg

SEQ ID NO: 924960 - RNA, 13 nt, Mycobacterium avium subsp. paratuberculosis
acccgcgcggcgu

SEQ ID NO: 924961 - RNA, 18 nt, Mycobacterium avium subsp. paratuberculosis
acccgcgucaucgggccc

SEQ ID NO: 924962 - RNA, 21 nt, Mycobacterium avium subsp. paratuberculosis
acccgcgucaucgggcccgac

SEQ ID NO: 924963 - RNA, 12 nt, Mycobacterium avium subsp. paratuberculosis
acccgcgucgau

SEQ ID NO: 924964 - RNA, 12 nt, Mycobacterium avium subsp. paratuberculosis
acccgcggccgc

SEQ ID NO: 924965 - RNA, 16 nt, Mycobacterium avium subsp. paratuberculosis
acccgcggccgcugcg

SEQ ID NO: 924966 - RNA, 22 nt, Mycobacterium avium subsp. paratuberculosis
acccgcggccgcugcgcccagc

SEQ ID NO: 924967 - RNA, 17 nt, Mycobacterium avium subsp. paratuberculosis
acccgcggccggcccag

SEQ ID NO: 924968 - RNA, 14 nt, Mycobacterium avium subsp. paratuberculosis
acccgcggcgccgc

SEQ ID NO: 924969 - RNA, 16 nt, Mycobacterium avium subsp. paratuberculosis
acccgcggcgccgcgg

SEQ ID NO: 924970 - RNA, 19 nt, Mycobacterium avium subsp. paratuberculosis
acccgcggcgccgcggcgg

SEQ ID NO: 924971 - RNA, 16 nt, Mycobacterium avium subsp. paratuberculosis
acccgcggcgcgauga

SEQ ID NO: 924972 - RNA, 20 nt, Mycobacterium avium subsp. paratuberculosis
accauugcgggaagggcccg

SEQ ID NO: 924973 - RNA, 19 nt, Mycobacterium avium subsp. paratuberculosis
accauguuccagaaccggc

SEQ ID NO: 924974 - RNA, 21 nt, Mycobacterium avium subsp. paratuberculosis
accauguuccagaaccggcag

SEQ ID NO: 924975 - RNA, 17 nt, Mycobacterium avium subsp. paratuberculosis
accaugucgacgcugag

SEQ ID NO: 924976 - RNA, 17 nt, Mycobacterium avium subsp. paratuberculosis
accauggcgcggcggcc

SEQ ID NO: 924977 - RNA, 18 nt, Mycobacterium avium subsp. paratuberculosis
accauggcgcggcggccg

SEQ ID NO: 924978 - RNA, 14 nt, Mycobacterium avium subsp. paratuberculosis
accauggcuuccgc

SEQ ID NO: 924979 - RNA, 23 nt, Mycobacterium avium subsp. paratuberculosis
accauggcuuccgccgagacggc

SEQ ID NO: 924980 - RNA, 14 nt, Mycobacterium avium subsp. paratuberculosis
accaugucggcgac

SEQ ID NO: 924981 - RNA, 15 nt, Mycobacterium avium subsp. paratuberculosis
accaugucggcgacc

SEQ ID NO: 924982 - RNA, 20 nt, Mycobacterium avium subsp. paratuberculosis
accaugucggcgucgccgag

SEQ ID NO: 924983 - RNA, 15 nt, Mycobacterium avium subsp. paratuberculosis
acccagcggcgcggc

SEQ ID NO: 924984 - RNA, 19 nt, Mycobacterium avium subsp. paratuberculosis
acccagcggcgcggccgau

SEQ ID NO: 924985 - RNA, 24 nt, Mycobacterium avium subsp. paratuberculosis
acccagcgggcgacgucggggucg

SEQ ID NO: 924986 - RNA, 13 nt, Mycobacterium avium subsp. paratuberculosis
acccagcgccucg

SEQ ID NO: 924987 - RNA, 14 nt, Mycobacterium avium subsp. paratuberculosis
acccagcgccucga

SEQ ID NO: 924988 - RNA, 22 nt, Mycobacterium avium subsp. paratuberculosis
acccagccgugccccaggucgg

SEQ ID NO: 924989 - RNA, 21 nt, Mycobacterium avium subsp. paratuberculosis
acccagcgagcucaggccggc

SEQ ID NO: 924990 - RNA, 19 nt, Mycobacterium avium subsp. paratuberculosis
acccagcccagcugcucga

SEQ ID NO: 924991 - RNA, 15 nt, Mycobacterium avium subsp. paratuberculosis
acccagcccggcgac

SEQ ID NO: 924992 - RNA, 11 nt, Mycobacterium avium subsp. paratuberculosis
acccagccgca

SEQ ID NO: 924993 - RNA, 21 nt, Mycobacterium avium subsp. paratuberculosis
acccagccgcauucggugagc

SEQ ID NO: 924994 - RNA, 11 nt, Mycobacterium avium subsp. paratuberculosis
acccagccgcu

SEQ ID NO: 924995 - RNA, 15 nt, Mycobacterium avium subsp. paratuberculosis
acccagcuccucggc

SEQ ID NO: 924996 - RNA, 18 nt, Mycobacterium avium subsp. paratuberculosis
acccagcuccucggccag

SEQ ID NO: 924997 - RNA, 19 nt, Mycobacterium avium subsp. paratuberculosis
acccagcuccucggccagc

SEQ ID NO: 924998 - RNA, 17 nt, Mycobacterium avium subsp. paratuberculosis
acccagcuugaccaccc

SEQ ID NO: 924999 - RNA, 21 nt, Mycobacterium avium subsp. paratuberculosis
acccauccccaggauggccgc

SEQ ID NO: 925000 - RNA, 20 nt, Mycobacterium avium subsp. paratuberculosis
accccgcgggaguccacgcc

SEQ ID NO: 925001 - RNA, 18 nt, Mycobacterium avium subsp. paratuberculosis
accccgcggucggcggcg

SEQ ID NO: 925002 - RNA, 14 nt, Mycobacterium avium subsp. paratuberculosis
accccgcgcgcggg

SEQ ID NO: 925003 - RNA, 15 nt, Mycobacterium avium subsp. paratuberculosis
accccgcgcgcgggc

SEQ ID NO: 925004 - RNA, 12 nt, Mycobacterium avium subsp. paratuberculosis
accccgcucggc

SEQ ID NO: 925005 - RNA, 16 nt, Mycobacterium avium subsp. paratuberculosis
accccgcucggccagc

SEQ ID NO: 925006 - RNA, 22 nt, Mycobacterium avium subsp. paratuberculosis
accccgcucggccagcgcgccg

SEQ ID NO: 925007 - RNA, 23 nt, Mycobacterium avium subsp. paratuberculosis
accccgcucggccagcgcgccgc

SEQ ID NO: 925008 - RNA, 21 nt, Mycobacterium avium subsp. paratuberculosis
accccgcucggcguggcgcuc

SEQ ID NO: 925009 - RNA, 21 nt, Mycobacterium avium subsp. paratuberculosis
accccgcuugcgcagcgucgu

SEQ ID NO: 925010 - RNA, 13 nt, Mycobacterium avium subsp. paratuberculosis
accccgacggcgc

SEQ ID NO: 925011 - RNA, 16 nt, Mycobacterium avium subsp. paratuberculosis
accccgacggcgccgc

SEQ ID NO: 925012 - RNA, 19 nt, Mycobacterium avium subsp. paratuberculosis
accccgacggcgccgcggc

SEQ ID NO: 925013 - RNA, 18 nt, Mycobacterium avium subsp. paratuberculosis
accccgagaucgcgggcu

SEQ ID NO: 925014 - RNA, 16 nt, Mycobacterium avium subsp. paratuberculosis
accccgagcaggcgga

SEQ ID NO: 925015 - RNA, 21 nt, Mycobacterium avium subsp. paratuberculosis
accccgaucaacaccgccagc

SEQ ID NO: 925016 - RNA, 22 nt, Mycobacterium avium subsp. paratuberculosis
accccgaucaacaccgccagca

SEQ ID NO: 925017 - RNA, 12 nt, Mycobacterium avium subsp. paratuberculosis
acccccucgcgc

SEQ ID NO: 925018 - RNA, 13 nt, Mycobacterium avium subsp. paratuberculosis
acccccucggggc

SEQ ID NO: 925019 - RNA, 14 nt, Mycobacterium avium subsp. paratuberculosis
acccccucggggcu

SEQ ID NO: 925020 - RNA, 18 nt, Mycobacterium avium subsp. paratuberculosis
acccccguuuccucgcgc

SEQ ID NO: 925021 - RNA, 20 nt, Mycobacterium avium subsp. paratuberculosis
acccccguuuccucgcgcac

SEQ ID NO: 925022 - RNA, 15 nt, Mycobacterium avium subsp. paratuberculosis
accccgaacccggcc

SEQ ID NO: 925023 - RNA, 17 nt, Mycobacterium avium subsp. paratuberculosis
accccgaacccggccag

SEQ ID NO: 925024 - RNA, 18 nt, Mycobacterium avium subsp. paratuberculosis
accccgaacccggccagc

SEQ ID NO: 925025 - RNA, 19 nt, Mycobacterium avium subsp. paratuberculosis
accccgaacccggccagcg

SEQ ID NO: 925026 - RNA, 21 nt, Mycobacterium avium subsp. paratuberculosis
accccgaaccgcccgcccggc

SEQ ID NO: 925027 - RNA, 18 nt, Mycobacterium avium subsp. paratuberculosis
accccgaaggcguuggag

SEQ ID NO: 925028 - RNA, 13 nt, Mycobacterium avium subsp. paratuberculosis
acccccagcucga

SEQ ID NO: 925029 - RNA, 22 nt, Mycobacterium avium subsp. paratuberculosis
acccccagcucgacgacuucgg

SEQ ID NO: 925030 - RNA, 23 nt, Mycobacterium avium subsp. paratuberculosis
acccccagcucgacgacuucggc

SEQ ID NO: 925031 - RNA, 14 nt, Mycobacterium avium subsp. paratuberculosis
accccccacgcucg

SEQ ID NO: 925032 - RNA, 17 nt, Mycobacterium avium subsp. paratuberculosis
acccccgcacgccagca

SEQ ID NO: 925033 - RNA, 13 nt, Mycobacterium avium subsp. paratuberculosis
acccccgccgggg

SEQ ID NO: 925034 - RNA, 16 nt, Mycobacterium avium subsp. paratuberculosis
acccccgcggugaguu

SEQ ID NO: 925035 - RNA, 14 nt, Mycobacterium avium subsp. paratuberculosis
acccccggcgcgac

SEQ ID NO: 925036 - RNA, 23 nt, Mycobacterium avium subsp. paratuberculosis
acccccgggaugccugcccgcgc

SEQ ID NO: 925037 - RNA, 20 nt, Mycobacterium avium subsp. paratuberculosis
acccccggggccuccagcca

SEQ ID NO: 925038 - RNA, 21 nt, Mycobacterium avium subsp. paratuberculosis
acccccggggccuccagccag

SEQ ID NO: 925039 - RNA, 21 nt, Mycobacterium avium subsp. paratuberculosis
acccccggugucugaccucgc

SEQ ID NO: 925040 - RNA, 18 nt, Mycobacterium avium subsp. paratuberculosis
acccauucgucggcgguc

SEQ ID NO: 925041 - RNA, 15 nt, Mycobacterium avium subsp. paratuberculosis
acccauugucgccgu

SEQ ID NO: 925042 - RNA, 20 nt, Mycobacterium avium subsp. paratuberculosis
acccauugucgccgugcggc

SEQ ID NO: 925043 - RNA, 23 nt, Mycobacterium avium subsp. paratuberculosis
acccaugccccaggugacgccgc

SEQ ID NO: 925044 - RNA, 22 nt, Mycobacterium avium subsp. paratuberculosis
accccacaccuucgcggucggc

SEQ ID NO: 925045 - RNA, 14 nt, Mycobacterium avium subsp. paratuberculosis
accccacagcgcgc

SEQ ID NO: 925046 - RNA, 15 nt, Mycobacterium avium subsp. paratuberculosis
accccacagcgcgcc

SEQ ID NO: 925047 - RNA, 12 nt, Mycobacterium avium subsp. paratuberculosis
acccccagcccg

SEQ ID NO: 925048 - RNA, 18 nt, Mycobacterium avium subsp. paratuberculosis
acccccagcccgccgggc

SEQ ID NO: 925049 - RNA, 15 nt, Mycobacterium avium subsp. paratuberculosis
accaucugccggcgc

SEQ ID NO: 925050 - RNA, 16 nt, Mycobacterium avium subsp. paratuberculosis
accaucugccggcgcu

SEQ ID NO: 925051 - RNA, 13 nt, Mycobacterium avium subsp. paratuberculosis
accaugaagccgu

SEQ ID NO: 925052 - RNA, 18 nt, Mycobacterium avium subsp. paratuberculosis
accaugaucagcgccgug

SEQ ID NO: 925053 - RNA, 18 nt, Mycobacterium avium subsp. paratuberculosis
accaugaucaggccccac

SEQ ID NO: 925054 - RNA, 22 nt, Mycobacterium avium subsp. paratuberculosis
accaugccgccgaagcccgaca

SEQ ID NO: 925055 - RNA, 13 nt, Mycobacterium avium subsp. paratuberculosis
accaugccgcggg

SEQ ID NO: 925056 - RNA, 17 nt, Mycobacterium avium subsp. paratuberculosis
accaugccgcgggccag

SEQ ID NO: 925057 - RNA, 14 nt, Mycobacterium avium subsp. paratuberculosis
accaugccggcguc

SEQ ID NO: 925058 - RNA, 18 nt, Mycobacterium avium subsp. paratuberculosis
accaugccggcguccagu

SEQ ID NO: 925059 - RNA, 19 nt, Mycobacterium avium subsp. paratuberculosis
accaugccguagcggucgc

SEQ ID NO: 925060 - RNA, 13 nt, Mycobacterium avium subsp. paratuberculosis
accaucccgccgc

SEQ ID NO: 925061 - RNA, 23 nt, Mycobacterium avium subsp. paratuberculosis
accauccagugcaguucgaugcc

SEQ ID NO: 925062 - RNA, 19 nt, Mycobacterium avium subsp. paratuberculosis
accaucagcccggugacga

SEQ ID NO: 925063 - RNA, 17 nt, Mycobacterium avium subsp. paratuberculosis
accaucagccugcggug

SEQ ID NO: 925064 - RNA, 21 nt, Mycobacterium avium subsp. paratuberculosis
accaucagccugcggugaugc

SEQ ID NO: 925065 - RNA, 13 nt, Mycobacterium avium subsp. paratuberculosis
accaucagcggcu

SEQ ID NO: 925066 - RNA, 14 nt, Mycobacterium avium subsp. paratuberculosis
accaucagcggcuc

SEQ ID NO: 925067 - RNA, 17 nt, Mycobacterium avium subsp. paratuberculosis
accaucacgucgcgcuu

SEQ ID NO: 925068 - RNA, 22 nt, Mycobacterium avium subsp. paratuberculosis
accaucaacccgagcaccgggc

SEQ ID NO: 925069 - RNA, 21 nt, Mycobacterium avium subsp. paratuberculosis
accagugucagggcagcggug

SEQ ID NO: 925070 - RNA, 20 nt, Mycobacterium avium subsp. paratuberculosis
accaguguccgggcgcccag

SEQ ID NO: 925071 - RNA, 20 nt, Mycobacterium avium subsp. paratuberculosis
accaguucgcguacccgcgc

SEQ ID NO: 925072 - RNA, 23 nt, Mycobacterium avium subsp. paratuberculosis
accaguucgcguacccgcgcggc

SEQ ID NO: 925073 - RNA, 15 nt, Mycobacterium avium subsp. paratuberculosis
accaguucgccacca

SEQ ID NO: 925074 - RNA, 18 nt, Mycobacterium avium subsp. paratuberculosis
accaguucgccaccacgg

SEQ ID NO: 925075 - RNA, 20 nt, Mycobacterium avium subsp. paratuberculosis
accaguucgcccuggccgcg

SEQ ID NO: 925076 - RNA, 15 nt, Mycobacterium avium subsp. paratuberculosis
accagugcacgcucg

SEQ ID NO: 925077 - RNA, 13 nt, Mycobacterium avium subsp. paratuberculosis
accagugcccggc

SEQ ID NO: 925078 - RNA, 14 nt, Mycobacterium avium subsp. paratuberculosis
accagugcccggcc

SEQ ID NO: 925079 - RNA, 16 nt, Mycobacterium avium subsp. paratuberculosis
accagugcccggccau

SEQ ID NO: 925080 - RNA, 20 nt, Mycobacterium avium subsp. paratuberculosis
accaguucggccaccgcguc

SEQ ID NO: 925081 - RNA, 21 nt, Mycobacterium avium subsp. paratuberculosis
accaguucggccaccgcgucc

SEQ ID NO: 925082 - RNA, 17 nt, Mycobacterium avium subsp. paratuberculosis
accaguuucacgucggc

SEQ ID NO: 925083 - RNA, 15 nt, Mycobacterium avium subsp. paratuberculosis
accaguugcaccggc

SEQ ID NO: 925084 - RNA, 13 nt, Mycobacterium avium subsp. paratuberculosis
accaggccgcgcu

SEQ ID NO: 925085 - RNA, 14 nt, Mycobacterium avium subsp. paratuberculosis
accaggccgcgcug

SEQ ID NO: 925086 - RNA, 13 nt, Mycobacterium avium subsp. paratuberculosis
accaggccgacgc

SEQ ID NO: 925087 - RNA, 17 nt, Mycobacterium avium subsp. paratuberculosis
accaggccgacgcuggc

SEQ ID NO: 925088 - RNA, 20 nt, Mycobacterium avium subsp. paratuberculosis
accaggccgacgcuggccga

SEQ ID NO: 925089 - RNA, 13 nt, Mycobacterium avium subsp. paratuberculosis
acaguucggcgcg

SEQ ID NO: 925090 - RNA, 15 nt, Mycobacterium avium subsp. paratuberculosis
acaguucggcgcgca

SEQ ID NO: 925091 - RNA, 22 nt, Mycobacterium avium subsp. paratuberculosis
acaguucggugcacggcgccac

SEQ ID NO: 925092 - RNA, 17 nt, Mycobacterium avium subsp. paratuberculosis
acaguucggugcggguc

SEQ ID NO: 925093 - RNA, 14 nt, Mycobacterium avium subsp. paratuberculosis
accaggcgacguuc

SEQ ID NO: 925094 - RNA, 18 nt, Mycobacterium avium subsp. paratuberculosis
accaggcgccggccagca

SEQ ID NO: 925095 - RNA, 12 nt, Mycobacterium avium subsp. paratuberculosis
accaggcgccgu

SEQ ID NO: 925096 - RNA, 14 nt, Mycobacterium avium subsp. paratuberculosis
accaggcgccgucg

SEQ ID NO: 925097 - RNA, 15 nt, Mycobacterium avium subsp. paratuberculosis
accaggcgccgucga

SEQ ID NO: 925098 - RNA, 14 nt, Mycobacterium avium subsp. paratuberculosis
accaggcgcucguc

SEQ ID NO: 925099 - RNA, 15 nt, Mycobacterium avium subsp. paratuberculosis
accaggcgcucgucg

SEQ ID NO: 925100 - RNA, 17 nt, Mycobacterium avium subsp. paratuberculosis
accaggccuuccgcaac

SEQ ID NO: 925101 - RNA, 20 nt, Mycobacterium avium subsp. paratuberculosis
accaggccuuccgcaacauc

SEQ ID NO: 925102 - RNA, 19 nt, Mycobacterium avium subsp. paratuberculosis
accaggccguccaccagau

SEQ ID NO: 925103 - RNA, 22 nt, Mycobacterium avium subsp. paratuberculosis
accaggcugcucggcgggcucg

SEQ ID NO: 925104 - RNA, 16 nt, Mycobacterium avium subsp. paratuberculosis
accaggcgguccgaca

SEQ ID NO: 925105 - RNA, 18 nt, Mycobacterium avium subsp. paratuberculosis
accaggcucacgcugcca

SEQ ID NO: 925106 - RNA, 19 nt, Mycobacterium avium subsp. paratuberculosis
accaggcucgcucccgcgc

SEQ ID NO: 925107 - RNA, 20 nt, Mycobacterium avium subsp. paratuberculosis
accaggcucgcucccgcgcg

SEQ ID NO: 925108 - RNA, 22 nt, Mycobacterium avium subsp. paratuberculosis
accaggcucgcucccgcgcggg

SEQ ID NO: 925109 - RNA, 23 nt, Mycobacterium avium subsp. paratuberculosis
accaggcucgcucccgcgcgggc

SEQ ID NO: 925110 - RNA, 18 nt, Mycobacterium avium subsp. paratuberculosis
accaggcugaacgucguc

SEQ ID NO: 925111 - RNA, 15 nt, Mycobacterium avium subsp. paratuberculosis
accaggcugaccagc

SEQ ID NO: 925112 - RNA, 18 nt, Mycobacterium avium subsp. paratuberculosis
accaggcugaccagcgcc

SEQ ID NO: 925113 - RNA, 20 nt, Mycobacterium avium subsp. paratuberculosis
accaggcugaccagcgccuc

SEQ ID NO: 925114 - RNA, 22 nt, Mycobacterium avium subsp. paratuberculosis
accaggcugaccagcgccucgc

SEQ ID NO: 925115 - RNA, 19 nt, Mycobacterium avium subsp. paratuberculosis
accaggcuuggcccgccgc

SEQ ID NO: 925116 - RNA, 21 nt, Mycobacterium avium subsp. paratuberculosis
accaggcuuggcccgccgccg

SEQ ID NO: 925117 - RNA, 22 nt, Mycobacterium avium subsp. paratuberculosis
accaggcuuggcccgccgccgg

SEQ ID NO: 925118 - RNA, 14 nt, Mycobacterium avium subsp. paratuberculosis
accagggacaugcc

SEQ ID NO: 925119 - RNA, 16 nt, Mycobacterium avium subsp. paratuberculosis
accagggacaugccga

SEQ ID NO: 925120 - RNA, 13 nt, Mycobacterium avium subsp. paratuberculosis
accagggcagcca

SEQ ID NO: 925121 - RNA, 14 nt, Mycobacterium avium subsp. paratuberculosis
accagggcagccag

SEQ ID NO: 925122 - RNA, 20 nt, Mycobacterium avium subsp. paratuberculosis
accagggcagccagcccgcg

SEQ ID NO: 925123 - RNA, 14 nt, Mycobacterium avium subsp. paratuberculosis
accagggcagcgcc

SEQ ID NO: 925124 - RNA, 17 nt, Mycobacterium avium subsp. paratuberculosis
accagguaccggcgggc

SEQ ID NO: 925125 - RNA, 20 nt, Mycobacterium avium subsp. paratuberculosis
accagguagauggugaucga
